United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 93

SEQ ID NO: 4167041 - RNA, 55 nt, Human
ugaagugcagccauucccuggggcuucacaguccuggcuggauucucugcauuca

SEQ ID NO: 4167042 - RNA, 73 nt, Human
ugaagugcaggcucagagccuuauugauuucccauaacaacugauggaucuuuagggcucuauuuuuauuuca

SEQ ID NO: 4167043 - RNA, 77 nt, Human
ugaaguuaaagggcuuguccaaguucauacaacuaguuagauguauaagcagaacuuggaccugguccuuugguuca

SEQ ID NO: 4167044 - RNA, 86 nt, Human
ugaauaaaugccuaaggcugggccccaacccgggucaaugcaaacaggaucuuugggagaaggggucccagccuccauguuguuua

SEQ ID NO: 4167045 - RNA, 80 nt, Human
ugaauaacuuaaaaugaugguacucauguuuagcauuauuaacuuauaguuagacauguuugcuaaaaugauugaauuca

SEQ ID NO: 4167046 - RNA, 99 nt, Human
ugaauaagacauacagcuugcucuggguggcauggcaaagaaauagcuaggacuacuggcuuucccugcccucagaaggaagggcuguaguugcuauca

SEQ ID NO: 4167047 - RNA, 95 nt, Human
ugaauaauccacagucauucaucuuuuuuauaguuaguuugcucaggguccugaaggacauuaucagaaacgugagacauuuggaacaguauuca

SEQ ID NO: 4167048 - RNA, 82 nt, Human
ugaauaaugcuaucaggacaaccacagccgggugccucggccgcuggcacguccuuggcugggcuugccucggcagaguuca

SEQ ID NO: 4167049 - RNA, 128 nt, Human
ugaauacaacaaagacagcuugcauaggacaugccaguaacaggaaagacuagcacuugaaggauuuguuucucugugugggagaucuuuuuauugcuguuguuuuguuuguugguuauuuguaauca

SEQ ID NO: 4167050 - RNA, 94 nt, Human
ugaauacgauugagugguauuuguugaaugaaucauuaugcuaauuuuaagucaggauagaucacaaugguucacuuucacuauucaguauuca

SEQ ID NO: 4167051 - RNA, 68 nt, Human
ugaauacuuacucacucagauauauuuugcaaaaaagcaugaaugagaaacaggugagauaggauuca

SEQ ID NO: 4167052 - RNA, 57 nt, Human
ugaauaucuccuuacagggaaaauagcuggagaguuuuaacucuguggagguguuua

SEQ ID NO: 4167053 - RNA, 97 nt, Human
ugaauaugccacagaauuaucccuuaaggaaggaggauaggacauuauccucugacuccuguccccauuguuugaggguuagccccagugguauuca

SEQ ID NO: 4167054 - RNA, 79 nt, Human
ugaaucaaacacuguuuuugauuuuuuguaaauuaucucuacagaauggugugcaggcuaucacagacagaguguuuca

SEQ ID NO: 4167055 - RNA, 60 nt, Human
ugaaucagcugaguguuggcagauccaagcugggcuccacugugcagcucugcugauuca

SEQ ID NO: 4167056 - RNA, 122 nt, Human
ugaauccucugggacuugguuaacaugcgaauuccugggucucuuccuuaguucuuuugauucgguaggaauggugugaggcccuggagcaugcacuguuaaaagcacccagguaagguuca

SEQ ID NO: 4167057 - RNA, 94 nt, Human
ugaaucuaacuaagaagccugaaugagauguugaauuauuguuuaauagaaauaaucccaauucuggcucucaguaaaccaggucuuaagguca

SEQ ID NO: 4167058 - RNA, 64 nt, Human
ugaaucucagaggaaucuguacuugaaaugugugucuaauuuucaguuccuccucugaggcuua

SEQ ID NO: 4167059 - RNA, 71 nt, Human
ugaaucuuuuuucuugccaggcacuacucuagcuguuuguuaguucugcagucauaagaagaaagaucuca

SEQ ID NO: 4167060 - RNA, 89 nt, Human
ugaaugaaagcagcaauuggacagacugauucauugcucagggaaacuccugaaagcaacucaucuguguaaaugugucucuccauuca

SEQ ID NO: 4167061 - RNA, 64 nt, Human
ugaaugaaugaucauuauaaagugcucugguaauuccaugagcucaacugguggucuuuauuca

SEQ ID NO: 4167062 - RNA, 66 nt, Human
ugaaugaaugcaugcuuauuuugcaagguugccaggaagauguaaauaaugcauguaaaucauuua

SEQ ID NO: 4167063 - RNA, 68 nt, Human
ugaaugaccugggugucauuucauggcugaaauauuuaacggccaacagaagaccuucuagcucuuua

SEQ ID NO: 4167064 - RNA, 65 nt, Human
ugaaugaguuucuuacucaggagcuggcugaagauggcuacucuggaguugagaugcgaguuaca

SEQ ID NO: 4167065 - RNA, 74 nt, Human
ugaaugauagcuggauucacauggcugaaaagaggucacaauuuacugaaagucuguggguccuccccucuuca

SEQ ID NO: 4167066 - RNA, 72 nt, Human
ugaauggcucugguggcaauugacuggaucccuacuggcucagaccucccuugucccaggaaccccauauca

SEQ ID NO: 4167067 - RNA, 69 nt, Human
ugaaugggcaaccugcaacaacugaaacagguauuaugccugggccagcuugggucaggugccugcuca

SEQ ID NO: 4167068 - RNA, 72 nt, Human
ugaauguaggcaucacucucucuugggcaguuaucacauuggcagacugaagggaugugauuucuacaguca

SEQ ID NO: 4167069 - RNA, 81 nt, Human
ugaauguggcuacuagaacauuuaacauuacaaugugauacauguuauauuuauuggacaguguugcuguagacccauuca

SEQ ID NO: 4167070 - RNA, 84 nt, Human
ugaauuaauacuaccccagauacacagagcaucuucagaggagugcagugccucuucugagucauuuguuuuuguuugucuuca

SEQ ID NO: 4167071 - RNA, 75 nt, Human
ugaauuacuuaagagaaacuuugagauggccuuaaaugucauucccucaaagcguucuuuauauaagucaauuua

SEQ ID NO: 4167072 - RNA, 55 nt, Human
ugaauuagagugaauucugugcaugcguguaugcacagcugaacacucuaaaaca

SEQ ID NO: 4167073 - RNA, 62 nt, Human
ugaauucccugcaggcauccucagucucucuaaguccaaaggucagcucugcagggaaauua

SEQ ID NO: 4167074 - RNA, 64 nt, Human
ugaauuucuccuauaauuuauauaauuaacaaagaagagauuguauggauuugugggugaguca

SEQ ID NO: 4167075 - RNA, 75 nt, Human
ugaauuuucuagguacaaggagggauucuugauacuuaaucuauccuguguuccugugugccaagcugagaauca

SEQ ID NO: 4167076 - RNA, 66 nt, Human
ugaauuuugacagacuauucauuucacgucaucuuugacugugaaagacaagguuuuuucagauca

SEQ ID NO: 4167077 - RNA, 74 nt, Human
ugacaaaaguuaacuguguucaugcaugcucagccuugcuggguucuugcucguggagcauaguucucugcuca

SEQ ID NO: 4167078 - RNA, 65 nt, Human
ugacaaacuguauagggaaaaguagaaugcaugcuugauucucucccuuuccuuaucaguuuuca

SEQ ID NO: 4167079 - RNA, 68 nt, Human
ugacaaaggcuagagagguauucaagucauucugguaccaggcagagacuuucuuuuugacuuuguca

SEQ ID NO: 4167080 - RNA, 61 nt, Human
ugacaacucuaguuaaugaauucugaguaguuucuugggcuuucagagcaggaguguguca

SEQ ID NO: 4167081 - RNA, 68 nt, Human
ugacaagaauuugggacuguuagcaaauauucuagaugacagaaucagguucucccaaguucuugaca

SEQ ID NO: 4167082 - RNA, 56 nt, Human
ugacaagagaccccuccgcaggcgcaguugcuagucuuuaaggggccuuuguguca

SEQ ID NO: 4167083 - RNA, 77 nt, Human
ugacaagcauguacauucuguuuccccaaagagagcaggaacuuuucaguggaaaaagagugauuucugcuuuguca

SEQ ID NO: 4167084 - RNA, 68 nt, Human
ugacaagggauggugccaggaucuaaucccacgguuggauuaguagauccugagcccuaucuacuuca

SEQ ID NO: 4167085 - RNA, 75 nt, Human
ugacaagggccccacuguggaaccuaagucugggagcccccugacuucuggcuggccagaggcugcgguccguca

SEQ ID NO: 4167086 - RNA, 75 nt, Human
ugacaagugacaaaaggguauccaaagcaugaauccaguagaaggacuuuuuagaaacccuguuugcauugguua

SEQ ID NO: 4167087 - RNA, 58 nt, Human
ugacaagugcaaauguaaagugcagugccaucuuccauugcaguguccucacuuguca

SEQ ID NO: 4167088 - RNA, 74 nt, Human
ugacaaucugccgagcuguuguuuuaugcagugagacuuugcagaccgugacaagacagcuugcagacaacuca

SEQ ID NO: 4167089 - RNA, 55 nt, Human
ugacacacugccaggcgcucggaaacuauuuacggguugccugaagcugcuguca

SEQ ID NO: 4167090 - RNA, 127 nt, Human
ugacacagucagauauuaaguugauaugccuaucauugaaugucuggagcaagguaaccucaccucagacuugauuccuaacaaacuucagugaauauucaauuuuuguuuuaucacaaauguauua

SEQ ID NO: 4167091 - RNA, 59 nt, Human
ugacaccuggcugaggucaccaguagcugagagacuccuuagcuagugcucagcuguca

SEQ ID NO: 4167092 - RNA, 57 nt, Human
ugacagaacuggaauuggaacucaggcagccugauuucagaguucacguucuuguca

SEQ ID NO: 4167093 - RNA, 89 nt, Human
ugacagaauggccacccagucaacuacagaaucauagaaaauaacaacucauguuguuuuaagccacugaguauugguaugguuuguua

SEQ ID NO: 4167094 - RNA, 58 nt, Human
ugacagacacaccuuaggaaaguggccccaccgguuuccccagccuggagugcuguua

SEQ ID NO: 4167095 - RNA, 100 nt, Human
ugacagagaauaauuacaaggaaaguucaaaggcagauugguuuaaacauuacuuguaaauugucucuauuuugauucgcuagugauucuuguucuguca

SEQ ID NO: 4167096 - RNA, 56 nt, Human
ugacagcaaccucaugagaaacuucgaaccagagguaccaugcuuggccugcugca

SEQ ID NO: 4167097 - RNA, 55 nt, Human
ugacagcagcauagugagcaaugagcaguagcucaccauucugcacaugcuguca

SEQ ID NO: 4167098 - RNA, 60 nt, Human
ugacagcugauacagugaaaucgugccuucucuuuaagaguacauauuauaucagcugca

SEQ ID NO: 4167099 - RNA, 87 nt, Human
ugacagcuuaacuguuucaugcccagucugcaugagcuacaauagccccugccauacaaugcugugcauguaauggaugcccuguca

SEQ ID NO: 4167100 - RNA, 78 nt, Human
ugacaggauugaauaagacagugaguguagguaaaacucuggaaagcgugacuuuaacuguuauuacucacccuguua

SEQ ID NO: 4167101 - RNA, 56 nt, Human
ugacaggcacugcuguagugcugauugcuuucucauucuauuuccagucucuguca

SEQ ID NO: 4167102 - RNA, 77 nt, Human
ugacaggcagagaggaagagagaaagggaauuacucuuuccauuuacuauucucauaucgcuuucucguauuuguua

SEQ ID NO: 4167103 - RNA, 61 nt, Human
ugacagggcuagaggcaaugcagggaaccgaccaaugcugauucagcuacuggugcuguca

SEQ ID NO: 4167104 - RNA, 58 nt, Human
ugacaguggcugaaaacgugaucaucauccuauuggugcugcaaaaucggccacugca

SEQ ID NO: 4167105 - RNA, 81 nt, Human
ugacaguuuugaggagcacuagucagguauuugguagaauaugccucuauugggauuugucugauguuuuucucaugguua

SEQ ID NO: 4167106 - RNA, 61 nt, Human
ugacaucauuggccauuggggauagacucaaccucaguaccucuccccuuccaggaaguca

SEQ ID NO: 4167107 - RNA, 57 nt, Human
ugacaucuguuuggugaagucuucucugacuccccagagaauccccagacagaguua

SEQ ID NO: 4167108 - RNA, 61 nt, Human
ugacauucaggccacaguggagucagugcuggguucugccuccucuaggacuuguguuuca

SEQ ID NO: 4167109 - RNA, 130 nt, Human
ugacauuccucaguguugugagcggggaagagagaaaugcuuuuugguuggcucagauuaccuuguucugguuaaaugaaaaaguauuaacauacguuucuugucaccacaauuccagcuguccaaguca

SEQ ID NO: 4167110 - RNA, 69 nt, Human
ugacauucucgucugagcugcuuuagugaaauggccuagcaccugaagcaggaacagcgagauugcuca

SEQ ID NO: 4167111 - RNA, 91 nt, Human
ugacauucugugggugguuugugaagaaggcaauacaaagaagagaauaugucucuucuaugucuuugucagcaaacugaacuaagaguca

SEQ ID NO: 4167112 - RNA, 62 nt, Human
ugaccaacagaauuuccuguuuucuguuaaggagcaaccagaaaauguuuccuuguugguua

SEQ ID NO: 4167113 - RNA, 87 nt, Human
ugaccaaggaccauucuccaguccugccccuacuccagaccaaagacccugaaggagcagggcaggacaggggaauguuugggguca

SEQ ID NO: 4167114 - RNA, 130 nt, Human
ugaccaccgggaggguccucaguugcacccggucuguccugggccggcgacuggucauggcucuggagggaggagcaggacuggccagagccuaggaagcccggauggagggccaggugguggaauaaag

SEQ ID NO: 4167115 - RNA, 87 nt, Human
ugaccaggagccugacuguggucuguucuccaggugggucugaucauucuacuugaucauagccacaguuauucucaucugauguca

SEQ ID NO: 4167116 - RNA, 101 nt, Human
ugaccagguauccuggugugccuggaacuguccugauuucaauaccgagucccaugucuugagaaagccuuuagucccaggcaaaccaggaugguugguca

SEQ ID NO: 4167117 - RNA, 62 nt, Human
ugaccauuugaucuacauuccauuauuuuggcagcauggugggaguggauucggaauggaca

SEQ ID NO: 4167118 - RNA, 78 nt, Human
ugacccagagauggaaaauauagacagagaaugggguacgugaucucucucagaguuuuuuuccaggacuucugggca

SEQ ID NO: 4167119 - RNA, 71 nt, Human
ugacccagauugagagccggccacgcagcuuugggacacccugagugcucccaggcaggcucucuggguca

SEQ ID NO: 4167120 - RNA, 58 nt, Human
ugacccagcuaaccagguggggagggcucaggcauccaggguaggguuagcuggguca

SEQ ID NO: 4167121 - RNA, 67 nt, Human
ugacccauaguuguucuugcagugaguauucuucucuaauacuuauagccagaauuaauuauguuca

SEQ ID NO: 4167122 - RNA, 58 nt, Human
ugacccugaaauguagugguuuaaacaauaaccauuuuauugcaucauuuauggguca

SEQ ID NO: 4167123 - RNA, 56 nt, Human
ugaccguuuuggcacccaugcugcgggcgauguccgcuguggggccagggggguca

SEQ ID NO: 4167124 - RNA, 68 nt, Human
ugaccucauuugauccuugcuaugagaggcauauugucauuaugcuuuuacaagagccagagagguca

SEQ ID NO: 4167125 - RNA, 62 nt, Human
ugaccugaaauaugagggugaugcccagagccaguuuuggcagaugacccucaaguugguca

SEQ ID NO: 4167126 - RNA, 105 nt, Human
ugaccuuaggcaagcagccuccuucuggggccccaguguccucgcugguggaaagugcugugaguuucaaaggaggccacagagagagcuagcuugggaagguca

SEQ ID NO: 4167127 - RNA, 77 nt, Human
ugaccuucaaauuaccuaauucugacauuuucucucuuaggaauaugggagugaaggaaacaauugguugaggguug

SEQ ID NO: 4167128 - RNA, 125 nt, Human
ugaccuugauuauuugauugugugguaucugacagaguguuuuuaaguauauuuaugaaugccuaaagcagaauauagaaaaaggaauacucuucaaacagcuacccugaagauuucuuggauua

SEQ ID NO: 4167129 - RNA, 117 nt, Human
ugaccuuugacuuacuuucugacaguuacauguagcacaauaauuuuuuuaagaggacaagaacaaguguccucuacauuauagugucugccuguguaggaacacaaauaaagguua

SEQ ID NO: 4167130 - RNA, 64 nt, Human
ugacgcacagugcuaaguuaaucucucuaaugauauuaaugcuauuuacuuguauugugcuuua

SEQ ID NO: 4167131 - RNA, 73 nt, Human
ugacguccugggacuuucaaggcuaggucauaacaagucuuacagugucugccugaaucucuuagaacacuca

SEQ ID NO: 4167132 - RNA, 67 nt, Human
ugacguccuucagggagucaaacacuuuggaaagaaacgcgaacugaaaaugcuauuggaggacgca

SEQ ID NO: 4167133 - RNA, 72 nt, Human
ugacuacaauauuguacccagaaguuuuuggaaacaguuuauguaaauuauggguaagauaugauaaaguca

SEQ ID NO: 4167134 - RNA, 87 nt, Human
ugacuacuguucuaggggacauaauaugaaaagucuuuuagcugugacauuuuaugguuuuucuauuguaagucuccuauaguggca

SEQ ID NO: 4167135 - RNA, 95 nt, Human
ugacuacuuguuuuuuaaauaaugaacacuuagccuuucuaugcgcauaaugguguaaaaguuagaugguuagguguuugacaaacagaugguug

SEQ ID NO: 4167136 - RNA, 55 nt, Human
ugacuagagcaauuggaaacaauuguuaaaaauuguuuuuaaaauguccugguua

SEQ ID NO: 4167137 - RNA, 101 nt, Human
ugacuauucuccaacauguacuguuuuaacauuuagaaaguguccauuuuuagcaaaaucacagcugugugaauguaacauauugguguggaggaggguua

SEQ ID NO: 4167138 - RNA, 84 nt, Human
ugacuauuucuguaguuuucucugauguuaauaguuuucucaagugacaucaaugugcagagaugaacguuuagaaucuaguua

SEQ ID NO: 4167139 - RNA, 58 nt, Human
ugacucaccagguagccagugcucagaauuuuuugcaucaguugccaaagugauguca

SEQ ID NO: 4167140 - RNA, 64 nt, Human
ugacuccgaagcccuguucuuucucucacccuggaggauggaugagggugggauggggcaguua

SEQ ID NO: 4167141 - RNA, 94 nt, Human
ugacuccuccaggucuuggaguaggucauuggguggauccucuauuuccuuacgugggccacuggauggcuccuccaugucuuggaguagauca

SEQ ID NO: 4167142 - RNA, 56 nt, Human
ugacuccuccucccaaguccuguuucugucuauugcagggcccaggaagagaguua

SEQ ID NO: 4167143 - RNA, 83 nt, Human
ugacucuacuguauugugaaagcagccaugggcauucucuaugugaaugggcaugacuguguuucaaagcaacaguauguaca

SEQ ID NO: 4167144 - RNA, 129 nt, Human
ugacucuccaugaccugcucacagugcgaaagaaacccagccucugaggcugcgaaacagaaaaacaagcuaaaugguugggaguuuucuauaugcauuuacuguaguggguaauucacucugauguca

SEQ ID NO: 4167145 - RNA, 91 nt, Human
ugacugaguuguauaguuauuuuugccuucacuuugaaaguaaaaucucugcagguuuuggaggcagucaaaugacugacaacuucgguua

SEQ ID NO: 4167146 - RNA, 60 nt, Human
ugacugccacaaaauugcuagaccaacugaagucaugguguaauuauuucugugcaguca

SEQ ID NO: 4167147 - RNA, 62 nt, Human
ugacuggaguuaguuuucagagguuuuaucauauuuuagaugaaacagcaacuuccuaguca

SEQ ID NO: 4167148 - RNA, 66 nt, Human
ugacuggucugccuguuuuccugcugcucauaggacuccuuucagcagguuaacagaggcugguca

SEQ ID NO: 4167149 - RNA, 84 nt, Human
ugacuguccccgcuuggaugggggguccagaguauaggcagggcuggccuguccauccagagccccagucuaguggggaagaca

SEQ ID NO: 4167150 - RNA, 55 nt, Human
ugacugugccuguugaaugaauugacaaggagauucaugaaacaugacacgguca

SEQ ID NO: 4167151 - RNA, 78 nt, Human
ugacuguggcagaaauguuguugacauagcagauggucuugauauuucugaaaaccggcaacaucuuugccauggcca

SEQ ID NO: 4167152 - RNA, 73 nt, Human
ucuugaucuccucaccuugugauccucuugccuuggccucccaaagugcugggauuacaggccugagucaaga

SEQ ID NO: 4167153 - RNA, 71 nt, Human
ucuugaugcuuuuucuaaauguggacaaaauacucuuccaucagaaugacuuuagaaagagcgugauaaga

SEQ ID NO: 4167154 - RNA, 84 nt, Human
ucuugauguuugacagcuugagcauaaacucagggacacacagacucuucuguguucccguuugugaguuucugauaugcaaga

SEQ ID NO: 4167155 - RNA, 58 nt, Human
ucuugcagacucacaagguacuugcgcauaucaaaggccuugagaaguccugcaguga

SEQ ID NO: 4167156 - RNA, 68 nt, Human
ucuugccaaaucucauauugacauguaaucuaaauuaaugucaaggugauagauuuguaguuguaaga

SEQ ID NO: 4167157 - RNA, 61 nt, Human
ucuugccugugcuuuaggccucaaacugaucuccuggcagugcucagggcauuaggcuaga

SEQ ID NO: 4167158 - RNA, 101 nt, Human
ucuugcugaaauagccaaaguauguaauauggaaaucgaggagaaaucugcuucucagugcuauccauauuccaggaacauugagcuguuucugauaaaga

SEQ ID NO: 4167159 - RNA, 92 nt, Human
ucuugcugaauuuguugcauuuguuugaguagaaugagacauuguauagcuuucaucuaguucacaaaugaugauaaugcuagcuaaaaaga

SEQ ID NO: 4167160 - RNA, 62 nt, Human
ucuugcugcacuugaguuuaggaacaugauuugccauccuugaagcaacgugcagacagcga

SEQ ID NO: 4167161 - RNA, 58 nt, Human
ucuugcugccuuucaauguugucauauuuagauaugacucuuagcuaaagguaagaga

SEQ ID NO: 4167162 - RNA, 66 nt, Human
ucuugcuugagcuaauagaaugcagcagaagcaauguuguacaaguuuugagcuuaaguuucaaga

SEQ ID NO: 4167163 - RNA, 104 nt, Human
ucuugcuugcuggggaaagagaugauaaauuguugguacuuuagggacugcuguuugaaccacccugaggcagcaauugauuauucaggccuaaggaaacaaga

SEQ ID NO: 4167164 - RNA, 106 nt, Human
ucuuggaaacccagacacacgccuggccucuccgaguaaccugauuauuaacuugcaugcuuuaacuuaccaccagaggcucagugcgaggucugggcaggcaaga

SEQ ID NO: 4167165 - RNA, 61 nt, Human
ucuuggaagcccuggauuaaagaugccagaaucgcaagguggcaaaauccugggucuauga

SEQ ID NO: 4167166 - RNA, 93 nt, Human
ucuuggaaugcagauuuuacagaauggugaccagcuucuacuaguagaggcuuuggggcauucuguguuugucauuaguuaugcaaucuaagg

SEQ ID NO: 4167167 - RNA, 70 nt, Human
ucuuggaccaucagagcagggaggaacuaggcagaucauuugguucaaccccuugaugguacaguuaaga

SEQ ID NO: 4167168 - RNA, 59 nt, Human
ucuuggagauaguccaggugaagggauagcuggcauuguccaucagauuaucuccauga

SEQ ID NO: 4167169 - RNA, 78 nt, Human
ucuuggauacagauaaauuuuaaguagaaagaaauucaaaaucaaguuuucuaaaauaaguuuaucugguaucuagga

SEQ ID NO: 4167170 - RNA, 83 nt, Human
ucuuggauguuguguauuuguuuuaauguuuagaacuuguucuuuuauuucagaacaauaugaacagaacacaauguugaaga

SEQ ID NO: 4167171 - RNA, 63 nt, Human
ucuuggcauucuuaauuucaucuauucccauacuuacaauagguggccaccagaauguuaagg

SEQ ID NO: 4167172 - RNA, 68 nt, Human
ucuuggcuacaucgaggcuccagcagcaaacaguuuaaaagcugcucaucugccaugaugaguuuuga

SEQ ID NO: 4167173 - RNA, 74 nt, Human
ucuuggcuuccaggggcuuuuacagauacccccagucuggaggggaaacuguuucuggcugacuggggcuagga

SEQ ID NO: 4167174 - RNA, 64 nt, Human
ucuuggcuuucuccuagggauguggccugaguccucuaguuucaauccuuggcagaauccagga

SEQ ID NO: 4167175 - RNA, 74 nt, Human
ucuugggaggagcaccugccugugacucccuuccucccugucuuuuucuggcaggugacucgccuuucucaaga

SEQ ID NO: 4167176 - RNA, 85 nt, Human
ucuugggauacaaggcugugggagaaccucuuuuugaagugugaggucaaagaaagagggacccaacaugcuuugcauaauaaga

SEQ ID NO: 4167177 - RNA, 56 nt, Human
ucuugggcauguguuugauuuccuguuuccauggggauaaaauaacugccacaaga

SEQ ID NO: 4167178 - RNA, 65 nt, Human
ucuugggcucuuccuauaguuuauaacuuuuguuuuaguuuuauauuaccuggaauagcuuagga

SEQ ID NO: 4167179 - RNA, 78 nt, Human
ucuugggggaaguuguguaaccucugggcccugcgacgcccuuuccuggagccuggagcuggaacgaagccccuugga

SEQ ID NO: 4167180 - RNA, 129 nt, Human
ucuugggucuauaaaauuggaacugaaaucucauggaaacuggcuuucuccagaaauuuuuggugagccagaaauacugugagagcagccuuucccgugguguuuuggcauuuuuacuuuggccccaga

SEQ ID NO: 4167181 - RNA, 111 nt, Human
ucuuggguuuggaauacuauuuuauggcuaugaacagaaugcuucuucauugccaguugcucaccagcagcuaagaaguaccucuuuuccugaagccuccaaaucaaugga

SEQ ID NO: 4167182 - RNA, 68 nt, Human
ucuugguuugcuuugguuacuuccacauguugaucaaacaucuguaaaaggaaaucaaagcacuaaga

SEQ ID NO: 4167183 - RNA, 74 nt, Human
ucuuguauuucacacuuuucauuuauuaagcaagcaaugacguaauugcucugaagagcuuuggaaguaugagg

SEQ ID NO: 4167184 - RNA, 63 nt, Human
ucuugucccuggugacacgcuaaacauacuaauugauaugaagcugauuuuuaggagacagga

SEQ ID NO: 4167185 - RNA, 59 nt, Human
ucuugugaacauauuaaaagccucagccuaaagugauguuucccaaauuguucacaggg

SEQ ID NO: 4167186 - RNA, 80 nt, Human
ucuugugagaccuuggaagaaauaucaauaguguucaacaauccugagucaagaugagaauucuuuuuaauuucacagga

SEQ ID NO: 4167187 - RNA, 71 nt, Human
ucuugugccuuggggaugaauuaugaggaaccauguaacuauaaacccaaccaaucucccauuggccaagg

SEQ ID NO: 4167188 - RNA, 107 nt, Human
ucuuguggcuuguuuugaagccagcguaacaaaacauuugccucuauuacuuuugcaguacugcugggcaaguguuuugucugccugggcucucucuagccaggaga

SEQ ID NO: 4167189 - RNA, 84 nt, Human
ucuuguguguauguaaguuuguguaguuuagcauccuuguauuauauugcauggguuacugcuucaaaaaauuaugcgccaagg

SEQ ID NO: 4167190 - RNA, 61 nt, Human
ucuuguuguaacuacuuuaucugccuugggauuuugaggcugagguacauuuacaggaaga

SEQ ID NO: 4167191 - RNA, 92 nt, Human
ucuuguuuuaaucauguuuuagcauggaaaaaugacacauaucucaaaguauacauuuugagguuuuugauauguauauggcuaauuuagga

SEQ ID NO: 4167192 - RNA, 74 nt, Human
ucuuuaaaagccuuggucaucugguucccugacccuaaaugauugagaggaaucagagcagaggcuguuagagg

SEQ ID NO: 4167193 - RNA, 70 nt, Human
ucuuuacaggaaaagguggcuguggccauuaccaaguuauuaaaaccacagagaucuugacuuguaugga

SEQ ID NO: 4167194 - RNA, 63 nt, Human
ucuuuaccuucuuugcuugugccagucuuguuucauugaaagguuuggcaguggaggaagaga

SEQ ID NO: 4167195 - RNA, 58 nt, Human
ucuuuacuuguguauuguauauauuccaacuggaauacaagcuuuauguaagcagaga

SEQ ID NO: 4167196 - RNA, 75 nt, Human
ucuuuaguuucuugauuagccacuuuggccugugauguuuggaaauaggaaaacaguggcauuaagacacaaagg

SEQ ID NO: 4167197 - RNA, 99 nt, Human
ucuuuauagcagugccccacuccucaguaucaacuuccuguauuaguucauucucacgcugcuauacagagacacuugagacuggguaauuuauaaaga

SEQ ID NO: 4167198 - RNA, 66 nt, Human
ucuuuaugcuguuuguuuuccuaagcauuuuaugauaaggauguaaacuuagauaagcaguaagga

SEQ ID NO: 4167199 - RNA, 83 nt, Human
ucuuuauggacauggcucugcugggcaaagcaaggacgggcacauccagccuaugcgguccaucaggggcacucacauuuaga

SEQ ID NO: 4167200 - RNA, 130 nt, Human
ucuuuaugggagcaccaucuuuuuuggugaucacaccucuggaaaugauguuauaagaccaggaaauugauuuccugcauugcaaaaucauucccagggucaucaguaucaaagccaagugguucaugga

SEQ ID NO: 4167201 - RNA, 65 nt, Human
ucuuuauucaggcucucuuuggcuagauuucugagugucugcuacauaucugccuguagugcaga

SEQ ID NO: 4167202 - RNA, 82 nt, Human
ucuuuauuugcguggucuccauucuucacauggauaggaucugacucaacacagccccauguugaagaaagaauuauaagga

SEQ ID NO: 4167203 - RNA, 75 nt, Human
ucuuucaaacauagaucugaauaugaaagagaaaagaaacacuuccauauuuguuagagucuauguguggacaga

SEQ ID NO: 4167204 - RNA, 129 nt, Human
ucuuucaacucucccugucguaaguuuugcccuuagaaaaguccuggagaagaggggcuuggacggacagaauccuccaucccucuccuccaagccgucaggggccuauuuaaaaugaggaaggacaga

SEQ ID NO: 4167205 - RNA, 85 nt, Human
ucuuucagucugauaucagaaaaaguaaagcaguaaagugagguucuguuuucucuuuuaagauacaguaagaucugcugagaga

SEQ ID NO: 4167206 - RNA, 60 nt, Human
ucuuucagugaaggcucagauuguuugauuaccccaaagcaagagcauaguacaggaaga

SEQ ID NO: 4167207 - RNA, 88 nt, Human
ucuuucauggcacaguugagagacugagaccuauagaaaugucauguaauuuucucaaguuucuacaguuaaguaguggcaggaaaga

SEQ ID NO: 4167208 - RNA, 59 nt, Human
ucuuuccaugccucuauuuagaauucccuuaauaguuaagugugugaggugugguagga

SEQ ID NO: 4167209 - RNA, 109 nt, Human
ucuuuccccucaagucugagaucagggugccagagcaaucaggcucugggaagggcccucuuccagguugcagauuccugacuuguuguauccucucacgggagaaaga

SEQ ID NO: 4167210 - RNA, 92 nt, Human
ucuuuccuaaaauauuacagauagaugaucauuuaugagaguacagguuacuucacaaagagaucaucuaaugauuggaauaacaggaaaga

SEQ ID NO: 4167211 - RNA, 73 nt, Human
ucuuuccuaggugauaugcaauuaaacugaagucuuccuucuccuuuggacuugugcauauaucuaugaaaga

SEQ ID NO: 4167212 - RNA, 62 nt, Human
ucuuuccuccacccaguguuucuacaggugugaucugcaaguugaugugggggaggacauga

SEQ ID NO: 4167213 - RNA, 70 nt, Human
ucuuucugaggagcugucauuugauucacacuugcaggauaaguaggaauuuuacagguuuagagaggga

SEQ ID NO: 4167214 - RNA, 68 nt, Human
ucuuucuggaccuuauuuauagguaggcagauucuaaauuuaggccucuauaagcagcuccaggcaga

SEQ ID NO: 4167215 - RNA, 73 nt, Human
ucuuucuggugugaauugguucucuuccaucggugucaaacacgugagcccaggagacccaaugccagaaaga

SEQ ID NO: 4167216 - RNA, 96 nt, Human
ucuuucuguguucugcuguaacaacacuucccugaggcaaagaaugccuaaaggucugguuugaacagggaauguuccacaggacauaaaaaaaga

SEQ ID NO: 4167217 - RNA, 71 nt, Human
ucuuugaaacacccuaaccuuucauagcaaacuucuuuuccugcagcagaaagguggagugucaguauaga

SEQ ID NO: 4167218 - RNA, 61 nt, Human
ucuuugaaacauucacucucaauuuuagaaugcuguggacauucugagugugaaacagaga

SEQ ID NO: 4167219 - RNA, 105 nt, Human
ucuuugaacuucuccuccuucucuauaugaaaggugacauuucuuggauccuaaaaucuuuugaagucauccuuuuuaucuuagucaagggagaagcccccaaga

SEQ ID NO: 4167220 - RNA, 73 nt, Human
ucccacuuaguuuuucagaauucuacacagcuuuuccucaugaagaucaagugucauucugugaauuuaggga

SEQ ID NO: 4167221 - RNA, 58 nt, Human
ucccagaagccucugcccccgggagauguaagaggagcuggaggcagagccagaggga

SEQ ID NO: 4167222 - RNA, 82 nt, Human
ucccagacacaagagauaccugcuguugcuauuugugaccaaauaccauauuugucaauaacuaccaacaggggcucuggga

SEQ ID NO: 4167223 - RNA, 71 nt, Human
ucccagacauugugucuguauuaguuuccuagggccgucguaacaaacuaucacaaacagagugucuuaga

SEQ ID NO: 4167224 - RNA, 99 nt, Human
ucccagauaauaagcugucuuccuccagagcuucauccugccccgcugggaguugacuggggccaagaucaggggauuuggcaggcaggcagccuggga

SEQ ID NO: 4167225 - RNA, 69 nt, Human
ucccagcaagaauaaaggcauauauccuuucaauaaaaauaauaaauguaugcuuauuccuuguuguga

SEQ ID NO: 4167226 - RNA, 84 nt, Human
ucccagccacuuugccuucuuacuguguuguguguuuuuccuggugcuucaagagcgugugcagggcaagugccgucacuggga

SEQ ID NO: 4167227 - RNA, 75 nt, Human
ucccagcucccuucccuuucaugcccacagcaaggucuauugcugcaaauugguggugaggcaaguuggcuggga

SEQ ID NO: 4167228 - RNA, 60 nt, Human
ucccaggaauugaagccaguguuuuucaaagaggauuccacacaggcauuauuccugcga

SEQ ID NO: 4167229 - RNA, 65 nt, Human
ucccaggcagcuucuuucaucaaugaggucacugaagccagaaaugaucaggaagcggcuuggga

SEQ ID NO: 4167230 - RNA, 90 nt, Human
ucccaggcccagaccuugaacuuaguuggggacaccauggugggggaacucagcuauggcuccuucucuacuggggggcuggggguggga

SEQ ID NO: 4167231 - RNA, 75 nt, Human
ucccaggccucaaacugcaaugacagguaggagauccuccucuccuccucuaugcggggcagugugaucuggaga

SEQ ID NO: 4167232 - RNA, 56 nt, Human
ucccaggcuaggccucugcguuucuaagcagaacuaggagcaggcguugccuggga

SEQ ID NO: 4167233 - RNA, 56 nt, Human
ucccagggcuuuucucaugcuuuauucuuucuggagccuaagauuagcccuguggg

SEQ ID NO: 4167234 - RNA, 85 nt, Human
ucccagggucugagauuaggcuggaaccacuggccagaaacuuaguuucauggcaggcuucuucagccuuucuggcaucugcgga

SEQ ID NO: 4167235 - RNA, 130 nt, Human
ucccaguagacuucuauccccaggacaugaguggugcccaccugagccugagaccacaguugcuuuucagaugucucucagcaggguuccacaucgucaugcccuggcacaagcacagagguuaagggga

SEQ ID NO: 4167236 - RNA, 74 nt, Human
ucccaguccggugggcuggagcaaugauuucagaggcccggaaucugaggcaagcugggcccauggacuaggga

SEQ ID NO: 4167237 - RNA, 61 nt, Human
ucccagugcuacagacagggcacaaugggcaaggccacacuguacaaaguagcugcuggga

SEQ ID NO: 4167238 - RNA, 58 nt, Human
ucccaguggcuucauaaggcagaguuuauuucuuccuuucaugaaguccacugaagga

SEQ ID NO: 4167239 - RNA, 76 nt, Human
ucccaguggcuucuauuuucucagugagacaggaagugacaucaucagcugagaguagaaauggaggcuccaggga

SEQ ID NO: 4167240 - RNA, 62 nt, Human
ucccaguuuggcagacuccagaguccuugcucuaaaucacuccccagacugccaugcuggga

SEQ ID NO: 4167241 - RNA, 76 nt, Human
ucccauaaccauuuaugaaauuaucuuuucauuagugcuucaacagaaaaggaaauuuauagagaucgagauggga

SEQ ID NO: 4167242 - RNA, 61 nt, Human
ucccaucacuuuugccauauucuauuggauacuagguccagcugacacuuaaggggaggga

SEQ ID NO: 4167243 - RNA, 64 nt, Human
ucccaugccccacucugcuuuucugcuggcuggugcaggagacaauggcuguggggcauguggg

SEQ ID NO: 4167244 - RNA, 56 nt, Human
ucccauuuauuugcugcuauagucucauaaugauacaagcaguuauaugcauggga

SEQ ID NO: 4167245 - RNA, 62 nt, Human
ucccauuuuugacuauggucccggguuuacauggccacggaaacacagguuauaagauagga

SEQ ID NO: 4167246 - RNA, 84 nt, Human
uccccaaaucccaauauucuggauacacacaggccuuugcaacauggaacagaggcuaagaguguccaaaguuuaugggaggga

SEQ ID NO: 4167247 - RNA, 130 nt, Human
uccccacacuacacugcuccaggcugggugccagagugacccugaagcaggcacucagcuugugacaaggcugggggcagcuggggguagcuucuggccugagagagacuaaucagauguacagugggaa

SEQ ID NO: 4167248 - RNA, 73 nt, Human
uccccaccccuucuaccacuaugagccaguguuauuaacaauagugugucuuauccugggagaaaagagggga

SEQ ID NO: 4167249 - RNA, 56 nt, Human
uccccacuucccacacccuguuuucucacuccuggagugagcaugggcagugggga

SEQ ID NO: 4167250 - RNA, 70 nt, Human
uccccagagcauuuugugcacacguggaguuccgcgcagggacaggcgccgggcacagaguggcuuggga

SEQ ID NO: 4167251 - RNA, 70 nt, Human
uccccagggcagcgccccuccacgccacuguuccgagaaccugcgcaggaggugguggcugcuccaggga

SEQ ID NO: 4167252 - RNA, 58 nt, Human
uccccagggcugcagaggguguccuggucuucccccaucaguucugcaccccugagga

SEQ ID NO: 4167253 - RNA, 106 nt, Human
uccccagguucccaguaauggccacguuugaggcaaccucucagguacugauguaugugaccuacagcagacugaagguuguguuagguccugagggcuuguggga

SEQ ID NO: 4167254 - RNA, 81 nt, Human
uccccagguugagcugaccugaaucauucgggguccagagaggacccaggagccgugagagguuauuccaaccagagggga

SEQ ID NO: 4167255 - RNA, 90 nt, Human
uccccauauuuuuccugccaucuuugggaacugggccuggcacacuggugaggcuaggguaacagauguggcagacaagggguauaagga

SEQ ID NO: 4167256 - RNA, 69 nt, Human
uccccauuuccucuucccaggccacugugccauagaaauggagacagaguauuggaaaggcagugggga

SEQ ID NO: 4167257 - RNA, 69 nt, Human
ucccccaauucugcagguggaggauggcaggagacuagacuaccauccuccaccugcagaacuggggga

SEQ ID NO: 4167258 - RNA, 69 nt, Human
ucccccauaagcuagaagccuccucugccagauugcaggaacagggcuucaagcuucaugcuuggggga

SEQ ID NO: 4167259 - RNA, 69 nt, Human
ucccccuaaaugucucagagggagacaaaucagcggacuaccuugcuuccuuugaugacuuggaaagga

SEQ ID NO: 4167260 - RNA, 91 nt, Human
uccccgacugcccuguccagcccgggcuccgccagccucccucuagugcuguucugcgucccaggcugguccgcguggauuucagagggga

SEQ ID NO: 4167261 - RNA, 77 nt, Human
uccccuaaugcacuuaguaugaaugccuuaauaagauccuuuccugggcaauauauacuagugcagcgugagggugg

SEQ ID NO: 4167262 - RNA, 74 nt, Human
uccccucacaccaaauuuccccaagcuguccaaaccgaaguuuguacaaugcugcagggaaauuaggaugggga

SEQ ID NO: 4167263 - RNA, 83 nt, Human
uccccucggcugcuuggcacagagcugcagccugggacucuccguggacccagacuggggauuuugccaggggggcgauggga

SEQ ID NO: 4167264 - RNA, 68 nt, Human
uccccucguuggucaaacugcuuauagggcacuauuuucuuaagcaaauagcuagaucagagaggggg

SEQ ID NO: 4167265 - RNA, 69 nt, Human
uccccuggugacccugaggaugcaccagcagggcuccugcuugcuguggcaucucagggagcuagaaga

SEQ ID NO: 4167266 - RNA, 88 nt, Human
uccccugugcuccuucugggacuugggcugagggccagcagcugucagggcgugcuguucucaggcucgauuaccaggguacaaggga

SEQ ID NO: 4167267 - RNA, 82 nt, Human
uccccuguuccucagcuccucacgagucuugaaaaauaacaggcuaucuuuucaguacuggagggagcagagcacauuugga

SEQ ID NO: 4167268 - RNA, 61 nt, Human
uccccuuaaggaagacacagaugaagugaccucuuuuucauuucuucaacuuccuggggga

SEQ ID NO: 4167269 - RNA, 55 nt, Human
uccccuucuccagucaaagagagagaauauagcccucuggacugucagacaggga

SEQ ID NO: 4167270 - RNA, 117 nt, Human
ucccgaaauaacugauaauuggccauuuuauguaacuguuuaguaaauugaaauggagauauguugagauccaugauggcugcugguaaaauagguuuuggaagcuuguuucuagga

SEQ ID NO: 4167271 - RNA, 58 nt, Human
ucccggagccauggccuaguacucuuaugugaagucuagcaagcucgugcucaaggga

SEQ ID NO: 4167272 - RNA, 123 nt, Human
ucccggcacacggugcugugucucuccacucuugggcucugcagugacuugaggggucaagucuaggaccccaggggaggcugggcucaugaggggaccagagaccucagugcugugcaggga

SEQ ID NO: 4167273 - RNA, 88 nt, Human
ucccggcgccaucucagaguccuuccagcaggcauuuauugaacaccuaaugugccuugcucucuggggcugaagggaagguauggga

SEQ ID NO: 4167274 - RNA, 100 nt, Human
ucccuaaaaacagaaugugucaacuauguuaauaaguuucauuauuuaugguaacaaugacccugauuggcaaguugcaccucggacuguggacuagggg

SEQ ID NO: 4167275 - RNA, 69 nt, Human
ucccuaaacuguuuuuuacuagaggacuucuaaagaaugaaguugaacugggaaaaaaaugggcuggga

SEQ ID NO: 4167276 - RNA, 65 nt, Human
ucccuaaauacagucauguucugagguacugggaguuaggacuuuaacauauuaacuguuagggg

SEQ ID NO: 4167277 - RNA, 75 nt, Human
ucccuaauuuguaguaaagcuuuauggauugagaauucuucuuggagucaaagagcucuaucuucaaaacuggga

SEQ ID NO: 4167278 - RNA, 72 nt, Human
ucccuacucaguauucuuuucacuaguguacccucggagugaggacuaugaaaguauaauauugaauagaga

SEQ ID NO: 4167279 - RNA, 130 nt, Human
ucccuagagcuuuuaaguuauuaauuuuuaaauaacaauuuaaguuauugcuaaugugucuaaagguaaaagcuacagcgaaaauuuagcuugauugcaguugaauaaauggcuugauuacuuuuaggga

SEQ ID NO: 4167280 - RNA, 62 nt, Human
ucccuaggcugaaaucagcucucccagggucagauccugagauggcaacaccagcuuuggga

SEQ ID NO: 4167281 - RNA, 68 nt, Human
ucccuagucuaugguauucuguuguagcagcccaaacaggcuaaaacaucaugauagccaacuuggga

SEQ ID NO: 4167282 - RNA, 63 nt, Human
ucccuaucuguaagcuuguccaccucuucuccuuucuggggacaagaauuuacauguagugga

SEQ ID NO: 4167283 - RNA, 79 nt, Human
ucccuaugauauuuuaugagcuuucauaaaugggucauuuguccagauaagaaauuuaguuauagaaugaacauagaga

SEQ ID NO: 4167284 - RNA, 69 nt, Human
ucccuauguuauugguagaggcaagcggaaggugagugcuuugccaagaucagccagcuaacaugggga

SEQ ID NO: 4167285 - RNA, 55 nt, Human
ucccucagcaggaacuggccugacaauuuuguuccugcucugugaugcugagggg

SEQ ID NO: 4167286 - RNA, 111 nt, Human
ucccucagccugcugcuugaacaguugcgaaugaaugaagaucaccgcagccuuccccccugcuguugcucauuugcccauuagcaucugcuuaagcagcaggcuggggga

SEQ ID NO: 4167287 - RNA, 81 nt, Human
ucccucccccaucagcccuggcccaggugccuuagcaaagcuucuucccugacaccuggaagcugcgguuuggccaaggga

SEQ ID NO: 4167288 - RNA, 97 nt, Human
ucuuuuaggcccagcucuugucuuccaagaucuacagcaguuuaggguuugugcuuugaggccugcuggaagguguucccaggaggugggaggaaga

SEQ ID NO: 4167289 - RNA, 60 nt, Human
ucuuuuauauuaacaaaugugagagcuccaaaagaacuaaacauuuguggaucugagaga

SEQ ID NO: 4167290 - RNA, 73 nt, Human
ucuuuuauauucuucucuauccuucccucauaguaaaaagaaaggggaaaaagaguagcaguaauauggaaga

SEQ ID NO: 4167291 - RNA, 90 nt, Human
ucuuuuaucugaugagaugacuagaggagggauggccaaauaagguuuaucuggggucccaacucugauugauuggaauuggcugaagga

SEQ ID NO: 4167292 - RNA, 73 nt, Human
ucuuuucaagccuuauuucuacuugaugaaguggcuuucaagaguauauucagaagaguaauagggugagaga

SEQ ID NO: 4167293 - RNA, 73 nt, Human
ucuuuuccaguggaaccuucuugucuugugucucauuaccucaagucccaagauuuccaacccuggguaaaga

SEQ ID NO: 4167294 - RNA, 56 nt, Human
ucuuuucugccacagccugagccagaguggaagcugggcugugcagcagagcagga

SEQ ID NO: 4167295 - RNA, 58 nt, Human
ucuuuucugccucuaaacaauugacaaagggcaagaguuucuaaggaggaagaaaaga

SEQ ID NO: 4167296 - RNA, 72 nt, Human
ucuuuugaaucuuuuuggaaauaaagagggcucaucauuugucuucuguuucaauuggaagguuccaauaga

SEQ ID NO: 4167297 - RNA, 61 nt, Human
ucuuuugugauucuucacuugcuucaggccaacuggacauaaaggugcaggucacagggga

SEQ ID NO: 4167298 - RNA, 61 nt, Human
ucuuuugugauucuuuaguuacuucaggccaucugggcguauacgugcaagucacagggga

SEQ ID NO: 4167299 - RNA, 78 nt, Human
ucuuuuuagagcugaggugauguggucguucucaauuuaaagaugaacguuuaaagccaucucaugugcauagcugga

SEQ ID NO: 4167300 - RNA, 74 nt, Human
ucuuuuucuucccagucuuggguaguauuuaucagcagcauguaaguggacuaauacaaggacuaagaaaagga

SEQ ID NO: 4167301 - RNA, 58 nt, Human
ucuuuuugggccugaaauucccauuuuacuuaaaccuuuaaguucaggcuuucaagga

SEQ ID NO: 4167302 - RNA, 130 nt, Human
ucuuuuuucacgccucuucucuauugugcugcaagcaucaugucugcaggaauguguugugaccagaauacacaauacagaucccacagcaugugacugacagcguuauuuagucagugguccaaaaaga

SEQ ID NO: 4167303 - RNA, 130 nt, Human
ucuuuuuuuuuuuuuuugagacagaauuuugcucuugucgcccaggcuggagagcaguggcaugaucuugccucacugcaaccucugccuccgggguucaagcaauucuugugccucagucucuagaaga

SEQ ID NO: 4167304 - RNA, 80 nt, Human
ugaaaaacaauugagggagauguugacuucaguucuuauugggggagcaagagguuaugacauuugucuuuaaauauucg

SEQ ID NO: 4167305 - RNA, 129 nt, Human
ugaaaaacacaucagcuauaaaguucugucaagguacuauugaccuaggugcuaauaauguguuaauuuccaucagggaaacagcaaauuauggcaauugggcagcagauaggauuuagcuauuuuuca

SEQ ID NO: 4167306 - RNA, 76 nt, Human
ugaaaaauguuucauggcugacauggcauuucuacucuguuuuaaaagauuuuggcaacagccaugagccaguuca

SEQ ID NO: 4167307 - RNA, 70 nt, Human
ugaaaaauuguaccaacuuuucucuuuaaauuugcuuuaaaagcaaauucagaaaauugguagaggguca

SEQ ID NO: 4167308 - RNA, 56 nt, Human
ugaaaacauccagagauagaccuuaccuucagguaaggcuggauccagguguuuca

SEQ ID NO: 4167309 - RNA, 71 nt, Human
ugaaaagaugugcuucuguaaugaauguuacuuacuauuaauggcagguagucagaggcgacauuuuugca

SEQ ID NO: 4167310 - RNA, 59 nt, Human
ugaaaagauucaccugaaauguuuuggcuaucugaguucaucacaggaugauuuuuuca

SEQ ID NO: 4167311 - RNA, 72 nt, Human
ugaaaagcauaugcuugcuuggugcuaaugacguuuuacagucuuauagaugaagcaacauguguaauuuca

SEQ ID NO: 4167312 - RNA, 129 nt, Human
ugaaaaggguuucuuuugugcucauccugcugagugagccgaauugcuucauuaacauuuaggccauguuacacauucaagugcuugugagguauuuggauuucagaugaguuuuuuuuuuuuuuuuua

SEQ ID NO: 4167313 - RNA, 81 nt, Human
ugaaaauaaagugugccaccagucaaggugaauaaugucuauagauuuuucaccuguguuuuguggcugaauuuauuuaca

SEQ ID NO: 4167314 - RNA, 64 nt, Human
ugaaaaucugcacaauucaguuucagcucuggauaacuucaguugaccuuugugaagguuuuua

SEQ ID NO: 4167315 - RNA, 77 nt, Human
ugaaaauguguagcaggacaauaugggaucaggaaaccaaguguucugacucugcauugucugccccuccguguuca

SEQ ID NO: 4167316 - RNA, 58 nt, Human
ugaaacagggucucacucuguagcccaggcuggaaugcaguggugagaucuuggcuca

SEQ ID NO: 4167317 - RNA, 63 nt, Human
ugaaaccauccugagaaaauaaaggagauaccacuucugucuugucucuucucccugguuuua

SEQ ID NO: 4167318 - RNA, 74 nt, Human
ugaaacuacaguagagguugucagggauuguggcaaagauuguguaggugacaaaccucacuguaggcgacuca

SEQ ID NO: 4167319 - RNA, 78 nt, Human
ugaaacucacugcagccuuuuccucuguaugcgugagauuuauuaucagcucauuuugauggaaaugcagugacuuca

SEQ ID NO: 4167320 - RNA, 90 nt, Human
ugaaagaaaaauacugaacuguaguuaauacuacacaugcaguguguauguguguauaauaaugucugcaguuuacuuuucaaucuuuca

SEQ ID NO: 4167321 - RNA, 60 nt, Human
ugaaagaagccucccuuuggaguugcuaaugcggcgauggaaggguuuggcucugaauca

SEQ ID NO: 4167322 - RNA, 64 nt, Human
ugaaagagaggucagauuucuccuggugaugaaagagucaccgcuggggacuaaccuccuuuca

SEQ ID NO: 4167323 - RNA, 55 nt, Human
ugaaagcagaacugagagagcugggguuuaccuccacugguuuuauucucuuuca

SEQ ID NO: 4167324 - RNA, 69 nt, Human
ugaaagcaggcgggcuacuuuagcaucugaugccagggauaugagagaguagcccaguguguucauuca

SEQ ID NO: 4167325 - RNA, 62 nt, Human
ugaaagccaggcugaaguucuccuccucuaccacacugagaagaaaaaccagcauguuuuca

SEQ ID NO: 4167326 - RNA, 99 nt, Human
ugaaauaaaugaagaucucuacaaguauucuacaaagaaauugaauugguaguuuaaucuucaguuuccuagguuuuguuuggauguuuguuuuuuuca

SEQ ID NO: 4167327 - RNA, 73 nt, Human
ugaaauaagauuuucuguaaaauuguuagcacagcauuccaguuuugauaacacuucagaugauuuuguugca

SEQ ID NO: 4167328 - RNA, 69 nt, Human
ugaaauaguccucuguuccuugauuaugagcugauagcaaucauaugaaguucaacagagaugaaguca

SEQ ID NO: 4167329 - RNA, 90 nt, Human
ugaaauauggaagguauauuugguuucaggauucucagggacauuuuggccuguagaaucuguagacccauuguuuuugcacauauuuua

SEQ ID NO: 4167330 - RNA, 58 nt, Human
ugaaaucugaguuuaugcucccccaacaaauuggaggacacauuuauuucagaauuca

SEQ ID NO: 4167331 - RNA, 61 nt, Human
ugaaaucuuauacuuugguagucuucucaagguucagaggauagagcuccaugagauuuca

SEQ ID NO: 4167332 - RNA, 60 nt, Human
ugaaaugcauucuaacacuuguguuaaaaaaagugaacacuugguggaacguguauuuua

SEQ ID NO: 4167333 - RNA, 80 nt, Human
ugaaaugcugaggcugcugagagcaaggacaaagcauuagaccucaugcuugugggguugcuucaggguuuaguauuuca

SEQ ID NO: 4167334 - RNA, 64 nt, Human
ugaaaugcuugugcuucugggaguuugccccauucuucguggcacucccugcauaagugauuua

SEQ ID NO: 4167335 - RNA, 90 nt, Human
ugaaaugugagggcaugagauuugggaggggucaggggaggaaugauauggguuggcucuguccccacccaaaucucaucuuuaauuuua

SEQ ID NO: 4167336 - RNA, 68 nt, Human
ugaaauguuaaucacacaaaggcucccaaagcaauuucgcucuggacuccucaugguuaugcauuaca

SEQ ID NO: 4167337 - RNA, 60 nt, Human
ugaaauuauucuuaccaaggugauauccaggaucucugcccuuguucaggaauaguuuca

SEQ ID NO: 4167338 - RNA, 63 nt, Human
ugaaauuccacagcuaguugaauaugaaugucauuaauucaagagcuggcuuugaaaugcuca

SEQ ID NO: 4167339 - RNA, 68 nt, Human
ugaaauuuggaaaaucugguuauagagacaaaacaauucagguuuuuuuggucagauuccagguuuua

SEQ ID NO: 4167340 - RNA, 80 nt, Human
ugaacaauuggggagaugggagacugcugaaauaagaaacucaaagcuuuuucucuacauaaccucaauacucagguuca

SEQ ID NO: 4167341 - RNA, 128 nt, Human
ugaacacauuucauauccuauuuuuguuaggcccuaugcucuuuuggaaaugccauagaccacucucuauuaaugauucaauaguguccauauggggccuggcaaugggucaggugcuguguaguaca

SEQ ID NO: 4167342 - RNA, 79 nt, Human
ugaacaccaccacacacugacaccuuaucuuguugccuaguagcagcuacaagaaugaauucaauguguggugugucca

SEQ ID NO: 4167343 - RNA, 126 nt, Human
ugaacacuuucuauaaaugaauaauucagugaaaaccucagaaauguauagacuagugucauggaaagucugcuuuccuaacaagucuaucuuugaucagugauucauuuacauagauucugucua

SEQ ID NO: 4167344 - RNA, 81 nt, Human
ugaacagcuaaaugcauuucaagacuggaucucuauuucuuacugaaacaguccccuggaaguggguuuagccuauguuca

SEQ ID NO: 4167345 - RNA, 90 nt, Human
ugaacagggcaccuugccauuugcaguauauggaaaauugaagaaauacagucuacuuccgcaaaaggcacauacaaagggcucuguuua

SEQ ID NO: 4167346 - RNA, 67 nt, Human
ugaacaggugccuucagggaguguaaagaauuagggaacugcccugucccucagaagcucuugguca

SEQ ID NO: 4167347 - RNA, 72 nt, Human
ugaacaugauaauuguuaacaaaguacuuugacauuauauguaauugugcauuggugauaauuacguauuca

SEQ ID NO: 4167348 - RNA, 68 nt, Human
ugaaccaagugaaauugccauucuuauaagucaaaaaugguugucuaauggcaauuucaugugguuca

SEQ ID NO: 4167349 - RNA, 58 nt, Human
ugaaccagagucuccagugguuucagcugcuuugaccacacuguggcacauugguuua

SEQ ID NO: 4167350 - RNA, 58 nt, Human
ugaaccagcagccagcugcauuuauuguccuggaugucagugccaacuuugcugguca

SEQ ID NO: 4167351 - RNA, 130 nt, Human
ugaaccaucuggcaaaggggcaaauggggugccauuucuaggagagauggaaauugaugaggcacagugaguuguuugguccuuuaagucuuucucuggucucuagucugccccuccuguuucaguguca

SEQ ID NO: 4167352 - RNA, 64 nt, Human
ugaacccaggagguggagauugcagugaaccaagauggcgccacugcacuccagccuggggaca

SEQ ID NO: 4167353 - RNA, 71 nt, Human
ugaacccuggucugugcgucucccaggacagcugcagcagcugccuguccuaggccaucaguccugguuca

SEQ ID NO: 4167354 - RNA, 101 nt, Human
ugaacguuuuuuaaaaccagaaaaggaauaacaggugucuucacuguucauuucaguuggaggcauuugauguucauaaucaacauuuugaaauauguuca

SEQ ID NO: 4167355 - RNA, 82 nt, Human
ugaacuacggcaaggcccaggaauccucugagauuguacauccacuuucccauggagagauuccagggcuuugauucucuca

SEQ ID NO: 4167356 - RNA, 71 nt, Human
ucuuugacccuuuggagguagucaccacucuuuauccagugacuggcugccucuaaggaguauaacagagg

SEQ ID NO: 4167357 - RNA, 57 nt, Human
ucuuugauacagauguaagcuguaucuuauauagauguagcuuaccuauaucaaaga

SEQ ID NO: 4167358 - RNA, 56 nt, Human
ucuuugaucagccuuucacugaauacacaaucuccaugugagaggcagguagagga

SEQ ID NO: 4167359 - RNA, 61 nt, Human
ucuuugauccauuaaaauccaagagugagcccuuccucgucucuagaguguggagcaaaga

SEQ ID NO: 4167360 - RNA, 71 nt, Human
ucuuugcugccuuccgaauccucuccuuugugauccuguaauuugugagagagccuggaggguagcaugga

SEQ ID NO: 4167361 - RNA, 58 nt, Human
ucuuugcuuucacauguuugaaugcuauuuaauagggcaucuuaauugaaagcagaga

SEQ ID NO: 4167362 - RNA, 100 nt, Human
ucuuuggacagagagucucagaugugcauuucucauacacuaaaugugagucaugagcaagcaaguggaagagaaguuaucuuagauccugugcaacaga

SEQ ID NO: 4167363 - RNA, 56 nt, Human
ucuuugggcuaggaguuuggauuggguucagcuuggugauucuucuggucuauggg

SEQ ID NO: 4167364 - RNA, 91 nt, Human
ucuuugggguauugauaauguauucuucaaccuugcuaaacucacuaguucuagcagcauuuuuguagaguauauugaauuuucucaagga

SEQ ID NO: 4167365 - RNA, 55 nt, Human
ucuuugugaaaguucauuugcaauucaauuggaacugcagcugguuucacaggga

SEQ ID NO: 4167366 - RNA, 64 nt, Human
ucuuugugguacuuucucugucugaccagaaaggaauggccagcagguggagagaucaaggaga

SEQ ID NO: 4167367 - RNA, 69 nt, Human
ucuuuguggugggggcagaacugugcauuguacgauguuuagcagccuuccugaccucuacccauuuga

SEQ ID NO: 4167368 - RNA, 110 nt, Human
ucuuuguucugcugacauaaauuuucauaaacaaauuaaggccugguccaaaaaauucaaauuucauuuuuucaggcugauuuguguuaguaugauuggcauucaaaaga

SEQ ID NO: 4167369 - RNA, 76 nt, Human
ucuuuuaauaaaaucagucuguguuagaaaagaguugggagaaaccuuuucagagacagaugaguauccuaauaga

SEQ ID NO: 4167370 - RNA, 64 nt, Human
ucuuuuauaagcauaguaccguagcagcugcuuaagugcagcguucagggaauguuuaacaaga

SEQ ID NO: 4167371 - RNA, 67 nt, Human
ucuuuuauaagggcacugauuccauucaugaagguugugcccucaugaccuaaucacuguccaaaga

SEQ ID NO: 4167372 - RNA, 78 nt, Human
ucuuuuauucucuggcuuccaugcaguuauugagaaaguagucacaauuacccagggaccaagagaaacccugagaga

SEQ ID NO: 4167373 - RNA, 64 nt, Human
ucuuuucacaccagcauggucucagugugauggggacgcaccuccugagaggcugugugaugga

SEQ ID NO: 4167374 - RNA, 78 nt, Human
ucuuuucagugucucagccccaacuagagaaagacagacaucuguucccucugcaugggugcucagaccuagggagga

SEQ ID NO: 4167375 - RNA, 67 nt, Human
ucuuuuccucuugcuuauuuccaaauggaaggaauucuuaugagguaauagggcaguggggaggaga

SEQ ID NO: 4167376 - RNA, 62 nt, Human
ucuuuucgugucucaggggcauugaaauaaaaauuauuucauuauuucuugagcaaaaagga

SEQ ID NO: 4167377 - RNA, 71 nt, Human
ucuuuucuccagaccugggaucuggccucuggaauucucucuccccacucuguccuagauuugagaaagga

SEQ ID NO: 4167378 - RNA, 59 nt, Human
ucuuuucuugcauuauugcacugguuacaaucucuauguucaaugaugccuagaaauga

SEQ ID NO: 4167379 - RNA, 75 nt, Human
ucuuuucuuugcccuguggauuaaugagcaggcauggagaugucuauuauuugggcuacagugcagaagaaauga

SEQ ID NO: 4167380 - RNA, 80 nt, Human
ucuuuugauaaguuucacagaggguuagacgcaguuuccacccagcuguuguccaguguucucugaaaucaaucaaaaga

SEQ ID NO: 4167381 - RNA, 69 nt, Human
ucuuuugguuuuaucagccacauuuuauggguuauuaaaauagcaccugugaugggaugagcaaaaaga

SEQ ID NO: 4167382 - RNA, 130 nt, Human
ucuuuuguacuguuuuuguuuuguaauaguaucagaguaauaguggccucauaaaauguacugggaagcauuuccucuauauucugaaacaguuaguguagagauggaauacgguagaauucagcaguga

SEQ ID NO: 4167383 - RNA, 69 nt, Human
ucuuuuuauguaugcuuuuaaggaauuccauuccugggauucaacauagcugaggcauauauggacaga

SEQ ID NO: 4167384 - RNA, 66 nt, Human
ucuuuuuauuccaaacuuaccccagaggaauggaguucaucaucaucuuuaguuuggaaugagaga

SEQ ID NO: 4167385 - RNA, 59 nt, Human
ucuuuuucucuacaaaauaaccagccagaauucuugggaugggcgaugagagaggcaga

SEQ ID NO: 4167386 - RNA, 92 nt, Human
ucuuuuugcccuuuauucaauuaguccuaauguuucaguucucuaauuaccaauuaguuaaauuauggaaauuggggaaagugguaaaauga

SEQ ID NO: 4167387 - RNA, 55 nt, Human
ucuuuuuucaaacugagguagugucagcacugacacagacaguccagagaaaaga

SEQ ID NO: 4167388 - RNA, 56 nt, Human
ucuuuuuucauaauaccuggcauggugcuaccugcacaggaggcuguggagaagga

SEQ ID NO: 4167389 - RNA, 58 nt, Human
ucuuuuuuucucacuuuauuuccugauggugugcaggaaaguguguggggaagaagga

SEQ ID NO: 4167390 - RNA, 99 nt, Human
ugaaaacauuuaugauguacaauaacaugggcacuuaccuuuccuuucacuauauuuugagagaaaacaaguucuccauuuuaucugggucaguuuuua

SEQ ID NO: 4167391 - RNA, 79 nt, Human
ugaaaaccaguuaauacaaccaugaucuucucaacauaauggucugaggugauuuauuuguguugacaguguuuacuca

SEQ ID NO: 4167392 - RNA, 59 nt, Human
ugaaaaccuaagugcuguugaacguuugaaaaagcaugucauuaggacuuaggucauca

SEQ ID NO: 4167393 - RNA, 116 nt, Human
ugaaaagaaacaaugugaaggaaggaaagaagggagggaggaccaaugugugguuaugaacauagagcaaagggauuuuucuaccuuuuagaucuauccaacauacuuucuuuuua

SEQ ID NO: 4167394 - RNA, 79 nt, Human
ugaaaagaagguugaaggggcaugcuuuugccaggaccuguuuucguggcacccaugaccucuuaggccuuugguguca

SEQ ID NO: 4167395 - RNA, 82 nt, Human
ugaaaagugcagggugcucugguaugucuaagaaugaacaaagucuacaauucuguaagaugcuggccuccugcaguuuuua

SEQ ID NO: 4167396 - RNA, 71 nt, Human
ugaaaaguuggugcuaugaucccaaguuacagaagagaacugaagccuggagaggcgccauacacuguuca

SEQ ID NO: 4167397 - RNA, 66 nt, Human
ugaaaaugccaacaaacacauugugcaaguuuugugacuguacaauguguuuguuggcuuuuuuca

SEQ ID NO: 4167398 - RNA, 57 nt, Human
ugaaacacaagccugguuagugguauaguuaguauauacuucaggccugauguuuua

SEQ ID NO: 4167399 - RNA, 123 nt, Human
ugaaacaccaacuacaacuacuuucuauuauacuucguuuuuguuauggucugcaucuauguuccuccguguacauaaagcccugguacaguauaguggcuaaacaauguagugggaguuuca

SEQ ID NO: 4167400 - RNA, 68 nt, Human
ugaaacagugacugguacauaauacgccuccaguagauguuagguauuagaauuacguuacuguugca

SEQ ID NO: 4167401 - RNA, 60 nt, Human
ugaaacauguauauauuguaggauggcuaaaucuagcuaauucacauauacauugcuuca

SEQ ID NO: 4167402 - RNA, 80 nt, Human
ugaaaccauaguagagucagcuugauaugcugucauauaauuuaucuuuuagcauucaaugauuggacuugccuguuuua

SEQ ID NO: 4167403 - RNA, 85 nt, Human
ugaaacgcguuucuuuucccauguacauuuucagacgguaaaaguguuucgauuuguuugggggagaagucaggcgcugguuuua

SEQ ID NO: 4167404 - RNA, 85 nt, Human
ugaaacuauaaagccaaauaauguagguacauaaaauauucauuugauauuaauguauuugcuuguuauggauuugaaaguauca

SEQ ID NO: 4167405 - RNA, 78 nt, Human
ugaaacucuugaauucugauuuauuuauacauuggggcaaaauaacaccucaguugagguuagaauguaagaguuuca

SEQ ID NO: 4167406 - RNA, 67 nt, Human
ugaaacuucagugaaugacuuauguuuauuuuaaaaucuuaguggcaugaagucacuggagcuuuca

SEQ ID NO: 4167407 - RNA, 79 nt, Human
ugaaagaggaaaucucuacuuugucauuugcucacuagaaaauguugguaaaugugagaaaagagguuucuaucaguca

SEQ ID NO: 4167408 - RNA, 72 nt, Human
ugaaagcaaaugugggugcagaauuucugaggugccacaggaaacuuuccacagccacaugcugugcuuuca

SEQ ID NO: 4167409 - RNA, 100 nt, Human
ugaaagccugagaaucuuguuacauuugaguuaaguuauauaagcaugucuuauacaaguuaaugagaaugacaugaaaggaaaauaaaucucuuuuuca

SEQ ID NO: 4167410 - RNA, 68 nt, Human
ugaaagcuggcucugcagagugccuuaaaaaugacuuuaauuaggaaauucugaguugucagucuuca

SEQ ID NO: 4167411 - RNA, 85 nt, Human
ugaaagcuucagucauacagagaaggauaauaaagccaauacuccucuugccgagguuuuaugaguuucugugcugaagacagca

SEQ ID NO: 4167412 - RNA, 72 nt, Human
ugaaaggcugaggcucaugccaucuuggcaugcuuuaggauuauggcaaggagguaaaaguccauuuuuuca

SEQ ID NO: 4167413 - RNA, 85 nt, Human
ugaaaggcuugcuuuuggcuggcacacugggaccguuguuuucagccaacagaugaaacccagcuaguuggaagaggcccauuca

SEQ ID NO: 4167414 - RNA, 66 nt, Human
ugaaagguaaaggaguaaaucaguccucucacuuuuaagcugccuccuauuaaaauuuaccuuuca

SEQ ID NO: 4167415 - RNA, 76 nt, Human
ugaaaguaaauuuccuuuucgugauuugaugauauugaugguuauugucaaacuugguaagagaaauacagcuuca

SEQ ID NO: 4167416 - RNA, 67 nt, Human
ugaaaguagucguucucuagauaccuaggaauacacauuuuaacauucugagagcaacugcccuuua

SEQ ID NO: 4167417 - RNA, 91 nt, Human
ugaaaguaucuauaggacucuauuuccucaucuauguaaugggguuaguaagacucaguugcuaugagaaauaaaugaggugaugccuuca

SEQ ID NO: 4167418 - RNA, 83 nt, Human
ugaaaguggcucccuugagaagagauuuauauuugcuucccccaggcauuugaaaauacucuuuuccagccagggccacguca

SEQ ID NO: 4167419 - RNA, 60 nt, Human
ugaaaguguuuuugagcuguaguuucacauuuguaacugcuuccuuggcaggcauguuca

SEQ ID NO: 4167420 - RNA, 88 nt, Human
ugaaauauauuugacaucuggaacaggaccuuuucuguuucgcuaaacaggaaauuuugugaucuguucuucuuuacuuaugauuuca

SEQ ID NO: 4167421 - RNA, 71 nt, Human
ugaaauauucgcauguuuuacugagaaaacaaggaaccucugauuuucuugggaaacaaugagagucguca

SEQ ID NO: 4167422 - RNA, 62 nt, Human
ugaaauauugcuuacuaaucaucuucagaggaacuuugugagcuaugaguaagcaaguuuca

SEQ ID NO: 4167423 - RNA, 122 nt, Human
ugaaauccagcgauggugccaugggagugaauaggaugaugugugugaagagccuggcucagugucugcugugcauauuuaucuaggagguguuuaauacauggcagaauuuggggauuaca

SEQ ID NO: 4167424 - RNA, 68 nt, Human
ugaaaugcaaauacuuuccuauauaaggugcuuggcauagcaucuggcccauaguaaguaagcuuuua

SEQ ID NO: 4167425 - RNA, 106 nt, Human
ugaacuaggccagucuucucauugccugaguuguuaacacagaugacaggcauucacggauguaaugcuaauuguuuuaaugagguaggagugggaaaguaguuca

SEQ ID NO: 4167426 - RNA, 73 nt, Human
ugaacucggucugagauauuuguucagcuggcagguccaggccagaaaguuaaauggauaucucugaaguuca

SEQ ID NO: 4167427 - RNA, 65 nt, Human
ugaacugaauugcugggggcucaguguggaaaacugagaguuaaaaacuccagggaacucaguca

SEQ ID NO: 4167428 - RNA, 79 nt, Human
ugaacuguaucuuaaaggcuucggaucagaagguaaaacauuuuacuuuaauauaugugaaguucugagacucaacuca

SEQ ID NO: 4167429 - RNA, 55 nt, Human
ugaacuugaauuuuggaaauacugagggcucaguauugcugcuauugucaguuca

SEQ ID NO: 4167430 - RNA, 60 nt, Human
ugaacuuggguuuuaacuucucucucaccuaugggggaguauagucuggccucauuauca

SEQ ID NO: 4167431 - RNA, 82 nt, Human
ugaagaauaguuuugggaaguuuaaugacagacuuuggcaaggcuaaaauggcugaugcaaacuucccaauagcucucuaca

SEQ ID NO: 4167432 - RNA, 66 nt, Human
ugaagacauguuaucucuggcuucaaaagagcauauaguuuugaauaggaagaaagcauguauuca

SEQ ID NO: 4167433 - RNA, 76 nt, Human
ugaagagaaugagaagagcaaggaacugguucacacagugcgagccccauuggugugcuuuacguggucugcuuca

SEQ ID NO: 4167434 - RNA, 64 nt, Human
ugaagagagagggggaagggagggaacugugaucacauccauucuuuuuaccucucagagguca

SEQ ID NO: 4167435 - RNA, 69 nt, Human
ugaagagaggaaggacguggucaagcugcacaauagaaguaaagguuggcugcucuuuuccuaauuuca

SEQ ID NO: 4167436 - RNA, 70 nt, Human
ugaagagucuuguucucuuucuccacucagcccagaucugucagugggagaaugaauaagggccucuuca

SEQ ID NO: 4167437 - RNA, 58 nt, Human
ugaagagugccacugacaggucccugcugcagcccaggcuccacaugggcacuuugca

SEQ ID NO: 4167438 - RNA, 62 nt, Human
ugaagauauuuuaaaauacugacaguucuugugaagaaaaucagugagguugagauauguca

SEQ ID NO: 4167439 - RNA, 57 nt, Human
ugaagauccuaucugcaaauauagucacauucugaggcauuugggguuaggguuuca

SEQ ID NO: 4167440 - RNA, 70 nt, Human
ugaagauuagauaccuuuguguuguagaauguuuuaagcaaucugaacuauagaaaaguauuuuccuuca

SEQ ID NO: 4167441 - RNA, 98 nt, Human
ugaagauuccugcucuccugcugagguggagauugcagugagcugagaucgcaccauugcacuccagccugggcaacaagugcaaaacucagucuuca

SEQ ID NO: 4167442 - RNA, 74 nt, Human
ugaagauuuugaggccugugagugaguguucuguuaagaaugugcacuuugaugcagggcucaguaauuuugca

SEQ ID NO: 4167443 - RNA, 59 nt, Human
ugaagcaggugaauggaugucggguggcaaaaaauaaucgacguccaauacccgcuuca

SEQ ID NO: 4167444 - RNA, 61 nt, Human
ugaagccaaucugccaggcagaagggaaaagagaugauuuguuugcucugggauuggguca

SEQ ID NO: 4167445 - RNA, 69 nt, Human
ugaagccaauguugccuggguuucugcuucauccugucagagauaaaggaaccaaggaaccaaggcuca

SEQ ID NO: 4167446 - RNA, 68 nt, Human
ugaagccagccucccagguauggaagucccaggugauauccacagccaucccuuggaagcugguuuua

SEQ ID NO: 4167447 - RNA, 93 nt, Human
ugaagccuguccaaauaaguugcaaaauagugucuagagccugcaauccuguccguggugcuauuuuguuauuugugugagucucagguuuca

SEQ ID NO: 4167448 - RNA, 64 nt, Human
ugaagcucagcaagauuaagcagcuugccugaauucacccagcugaugguuuugcugagacuca

SEQ ID NO: 4167449 - RNA, 82 nt, Human
ugaagcugaggauguuggguuacagauauguguuauugauaaaaucaaaagacacauaugcuuaacccaccaccacagaaca

SEQ ID NO: 4167450 - RNA, 65 nt, Human
ugaagcuggcugaaguucagcuagacuuagcagaagggggauuggcugagguccagguaguuuca

SEQ ID NO: 4167451 - RNA, 91 nt, Human
ugaagcuuagagccacagagaauacugcucuugcuagaagcuaggacccuaauugaccuagggcaaagcggcccuguggccagaagcauca

SEQ ID NO: 4167452 - RNA, 90 nt, Human
ugaagcuucaguuucccacaauaggauuguuuugcagaaauuuuuuucuaggcuccucucacauucuauuguugagauacugggguuuua

SEQ ID NO: 4167453 - RNA, 58 nt, Human
ugaaggaaaauuuaggagaucaugcuucacaaagcacugucugauauguuuuccauca

SEQ ID NO: 4167454 - RNA, 79 nt, Human
ugaaggaacaagucaugaguccucuucugugaaguguguguguuacuuuaagaaaauuauauuuagauuugaccuggca

SEQ ID NO: 4167455 - RNA, 57 nt, Human
ugaaggaagcugcuaagaaacaauggugaauugcuauaaucugggaaguuuccuaca

SEQ ID NO: 4167456 - RNA, 66 nt, Human
ugaaggcagcugugaggacuggauucuuggccuguggauuuccagugacucucacagguggcagca

SEQ ID NO: 4167457 - RNA, 61 nt, Human
ugaaggccaucagagcuccagagcugccuguguaacagguugaggcucuguugugccugca

SEQ ID NO: 4167458 - RNA, 63 nt, Human
ugaaggcuggagaugguuggaauggcucaccuggggcuguauaucuggcgccuccauucuuca

SEQ ID NO: 4167459 - RNA, 68 nt, Human
ugaaggcugguuuccuugauguuucucagcuuccauuaugcuccagcaaauacagaaacuuguuuuca

SEQ ID NO: 4167460 - RNA, 77 nt, Human
ugaaggcuuguguaaauuauuuuuaaugauucccuccuggcacaucauuauguuuguaguugcacacaggcacuuca

SEQ ID NO: 4167461 - RNA, 104 nt, Human
ugaagguagugcuauuaugguagucauuuguagaguaggaaagaguggcuuugagcaguuauguaucuugcccaugcucuuaaucacuauguuauacugccuca

SEQ ID NO: 4167462 - RNA, 130 nt, Human
ugaagguguauauucaguuauuauucccuuaaugcacaagcaagagauaauggauuuuaggaaaccuaguagacucugccauuaucuaauugucauguaucuaaguacuguaauaaagucuaauuagcug

SEQ ID NO: 4167463 - RNA, 103 nt, Human
ugaaguaauaccaaguacaacauucagcuaaugggaauaagaguauuauuuugcauauacucucaguuacuaauaauuggaaauguuggcuacauuuacuuua

SEQ ID NO: 4167464 - RNA, 56 nt, Human
ugaaguauagcagauguuauuuaauucaaccuauuagguagauacugcuaucuuca

SEQ ID NO: 4167465 - RNA, 74 nt, Human
ugaaguauaugucuuuaaucuauucuugaauuaaacuugaagucuuuggagauagaugaagacuuguacuguca

SEQ ID NO: 4167466 - RNA, 78 nt, Human
ugaagucugaaggcaaucugcugacagaauucucucuugcuuggggaaggucagcccuuuguucuguucaggucuuca

SEQ ID NO: 4167467 - RNA, 62 nt, Human
ugaagucuuucagggcuagaaucaagucucuggcauuuuuuucuaguucugaaagccugaca

SEQ ID NO: 4167468 - RNA, 58 nt, Human
ugaagugaagcugaguggacucuggccacaucccuugugagaaauaucagcugcuuca

SEQ ID NO: 4167469 - RNA, 87 nt, Human
ugaagugaguauccuuaugaaccauaguuccuaccuaagcauaacuuugguuggaaguuaggaggaaauaugagcauacuuauuuca

SEQ ID NO: 4167470 - RNA, 89 nt, Human
ugaagugcagcucucuguuuuguuaaugguguguagaaugaucugacaaaaaguuuucacaaacugaggagacaaugagcaucauuuca

SEQ ID NO: 4167471 - RNA, 62 nt, Human
ugaagugcgguaacuguucucauagcagcauggaugcacaaagagggcaggcacccauuuca

SEQ ID NO: 4167472 - RNA, 72 nt, Human
ugaaguggugggggaggcccgugcaggccuacagcuuugucaucugcaacauuccucuccccacuuucuuua

SEQ ID NO: 4167473 - RNA, 73 nt, Human
ugaagugguugguaauugugcacagucuaaaccaauacaagcuggauuguauaauuguauugccaaaucuuca

SEQ ID NO: 4167474 - RNA, 57 nt, Human
ugaaguguuugccugagcugaguuauaacagagugacuauggcuuggcaaagcuuca

SEQ ID NO: 4167475 - RNA, 71 nt, Human
ugaaguuaaucacauuacaaaggacuccagucuacacaggcuguugagucccugugauuuguggggcuuca

SEQ ID NO: 4167476 - RNA, 76 nt, Human
ugaaguuaucugagaaauagauucaugguagauucuaagauaguauuguucuagaauuuuuuuuccuguggcuuua

SEQ ID NO: 4167477 - RNA, 68 nt, Human
ugaaguucuguguuucucccauguuaaaaacuuucucaccuucagaacagaaggaauacagaucuuca

SEQ ID NO: 4167478 - RNA, 62 nt, Human
ugaaguugaggugcaaaccaguuuaaugcaagcuguaccaugcgacgccucucacugcuuca

SEQ ID NO: 4167479 - RNA, 56 nt, Human
ugaaguuuaauuuuggacaugacagaaaugugaugugucauaaaauuaaaacuuca

SEQ ID NO: 4167480 - RNA, 70 nt, Human
uuuguauauauucuuaaagauguuuuugcugaaucaaaagauaugcaacucucuaaggauuugaugcaaa

SEQ ID NO: 4167481 - RNA, 60 nt, Human
uuugucaguuaaaugagguacaagagggacgcucuauuugccccuaauuagcugcacaga

SEQ ID NO: 4167482 - RNA, 79 nt, Human
uuugucauuuacugugaauauuuuauaaauugauggguuuuaauucuaaaacuuaguagaguucauauuaugugauaga

SEQ ID NO: 4167483 - RNA, 63 nt, Human
uuuguccagguuagcuucaaacacauagcaucgccagcuugugcgccaggacaaccugacgga

SEQ ID NO: 4167484 - RNA, 71 nt, Human
uuugucccugagguugguuucuugggcuguguuaucuggacaagguauaugaggccacuaauaggggcaga

SEQ ID NO: 4167485 - RNA, 61 nt, Human
uuuguccugcuugggcuuaaaagggcuuugccuuuauccaaagccucaagcagaagacaga

SEQ ID NO: 4167486 - RNA, 73 nt, Human
uuuguccugugacugacuuauuucauggaucauaauguccucaaggcucauccaugucguaacauaugacaag

SEQ ID NO: 4167487 - RNA, 84 nt, Human
uuugucucaggcuuugggucaggcucugggggugcaaugacgagucacgccacagugcuugcccuuaaaaagcccacaggcaaa

SEQ ID NO: 4167488 - RNA, 75 nt, Human
uuugucucauaguccuugcugggcacagaguagacccaccaugucaacuuuguuggcauaggaacuggagaugaa

SEQ ID NO: 4167489 - RNA, 70 nt, Human
uuugucugcugccuccaaucugugccccggcugggggaggcggggagagggaugggagguaggaggugga

SEQ ID NO: 4167490 - RNA, 61 nt, Human
uuugugaagggaacagaagugucugacuggacacuugaaagaaguuuccuuaaaauacgaa

SEQ ID NO: 4167491 - RNA, 66 nt, Human
uuugugacuugcuucucagaauacaacaaagguaauggaauaucacuucugagauuagguuacaaa

SEQ ID NO: 4167492 - RNA, 68 nt, Human
uuugugagcaauaugugaauuuucuuuuguaacccacuaaagagagugaucuauugcuucucuacaga

SEQ ID NO: 4167493 - RNA, 86 nt, Human
uuugugccaugcugagugguuauagcuuauccaggaaacuaaaguuuccaagaauacagauuugugaacacacagguaugcauaaa

SEQ ID NO: 4167494 - RNA, 57 nt, Human
uuugugcugaggcugauaguggaacugaaaaugcuccuaccuucagaguggcacaaa

SEQ ID NO: 4167495 - RNA, 87 nt, Human
uuugugcugauaccauaggaaaggaucagccuuccacuuguguagaaagaaagaauauuaggcagccuuccuuaugguucauacaga

SEQ ID NO: 4167496 - RNA, 66 nt, Human
uuugugggaaaguuugcuauaaaaugcauuuauuuaaaauguugcagagcauagacuucucaggaa

SEQ ID NO: 4167497 - RNA, 66 nt, Human
uuugugucccugcggcugaggagaaacggcuacuccgcgccaccucauccaccgacaggccacaaa

SEQ ID NO: 4167498 - RNA, 63 nt, Human
uuugugugcccagagcaguggccauguggagaagccaucagccaacugccugaggcucacagg

SEQ ID NO: 4167499 - RNA, 60 nt, Human
uuuguguuguuggauuaguuaacguuuaugccauaugcuugacauaauccauaguacaaa

SEQ ID NO: 4167500 - RNA, 57 nt, Human
uuuguguuuuagcuggugaggcuuuaaacguucaaccuugaaggcuguaagcacaga

SEQ ID NO: 4167501 - RNA, 69 nt, Human
uuuguguuuuuguaaucuuccuuuugcuguugugggguauagcaauagcaggucuacagagagagugaa

SEQ ID NO: 4167502 - RNA, 68 nt, Human
uuuguuauagcaggccaaacuaacuaacacagaaauugauauggggaguaggguguugcuauaacaag

SEQ ID NO: 4167503 - RNA, 77 nt, Human
uuuguuaucugguugucugauuacuuacauaauuucaugcggaauuuaagaugguggucagaaaucucaguggcaaa

SEQ ID NO: 4167504 - RNA, 86 nt, Human
uuuguucaugguaauggcugggauuuccuuugcguucuauuucuauuuaaugcaucuuuguaaacucagcuauuaacuauaauaag

SEQ ID NO: 4167505 - RNA, 64 nt, Human
uuuguuccugccagcucucuaaaggggaaugcuuauggcccugggaagagcugacaggagggag

SEQ ID NO: 4167506 - RNA, 70 nt, Human
uuuguucgggaggauugcuaugaaaaagagguaauagcuucuguaacucaaaguaguuuuauccaauaaa

SEQ ID NO: 4167507 - RNA, 129 nt, Human
uuuguugauauuccgaauggugaugauuuugccuugggugcugucauggggcacggaguauauguuuucuucuucauuccuuggcuucaccacagcauccauggguucagcauagucagaaggaucaaa

SEQ ID NO: 4167508 - RNA, 72 nt, Human
uuuguugcauauucuugucuuuuccagaaauucaaacgauaccugaaacuggaggcagggagaugugauaaa

SEQ ID NO: 4167509 - RNA, 86 nt, Human
uuuguugugauauuggagcuuuuuuauuagguugaaagcuuacuuaaauuucucacuugaaaggaagcucuaaaacuugcaaaaga

SEQ ID NO: 4167510 - RNA, 66 nt, Human
uuuguuuacaguauuacuguguuguuuugguuaacagaaugaaaaacagcacuguaauacuacaag

SEQ ID NO: 4167511 - RNA, 57 nt, Human
uuuguuuacucauucauugauggacacuuuuggcuaucaugaacaugaguguacaaa

SEQ ID NO: 4167512 - RNA, 106 nt, Human
uuuguuuauucauuuauuuauuuggcaauuauuuaaauaucacaggcacugggauauauaaugccuguaauaaugcuaagcacugggagauauaaugauagacaag

SEQ ID NO: 4167513 - RNA, 129 nt, Human
uuuguuucucugaggccaaugggugggaggaaguauaaagaaguguaaacaggaaagccagcugggccuggaguuccaagugcccauauuucaucagcuuccucuccauaacuguggcagggacacuua

SEQ ID NO: 4167514 - RNA, 69 nt, Human
uuuguuucuuacaggcaagggcgcuagcuggugggagccaccccgccaugcugaugucagagaagcaag

SEQ ID NO: 4167515 - RNA, 89 nt, Human
uuuguuugcauucauucagcauuuauuuauuguguaccuacugugugccacacacaguuccagacacaggagauaaagcuguaaacaaa

SEQ ID NO: 4167516 - RNA, 60 nt, Human
uuuguuugucuguguuuucuguguggguggaucacauuaacuagaaagccagaaaacaga

SEQ ID NO: 4167517 - RNA, 123 nt, Human
uuuuaaaagcgauguaacuuggcagguguuaagcugguuucaguaaucuuagcaucuauuuccuuuuccccagugauuuucaaguagcuaaauuagcugccugccggguccagguuuuugaag

SEQ ID NO: 4167518 - RNA, 91 nt, Human
uuuuaaaauuagaaauuauuaugccccucuauaaucauggguguuaugauucaguagauuaagguggggcuaagaauuaacaauuuuaaga

SEQ ID NO: 4167519 - RNA, 66 nt, Human
uuuuaaagggcauuaguguuucaagcaaguaggauggugcucagagaaagauuagucccuguggag

SEQ ID NO: 4167520 - RNA, 75 nt, Human
uuuuaacaugagaaugcauucauguuuugucugugaacauuuacuuucaaaaguaauguaugcucaucguagaaa

SEQ ID NO: 4167521 - RNA, 65 nt, Human
uuuuaacuucccuuccucacucuacuuguuuuucuuacaauggggggaggaagggauaggaaaaa

SEQ ID NO: 4167522 - RNA, 71 nt, Human
uuuuaagauggcaucuccuauagaugguaacugcacaggcccuucuaagcugagaaugccuuuucuugaaa

SEQ ID NO: 4167523 - RNA, 72 nt, Human
uuuuaaggaaauaucacaacaugguauuaaauuguggaagaaguugcucauacucauguugugauuuugaag

SEQ ID NO: 4167524 - RNA, 130 nt, Human
uuuuaaggguuguggguuccggccucuacccguuccugggacuggagcagcccaggaggcccucuccugaggcugagacucuguguccuuccggacggaaccugaggacgcuggacccuacaguuuaaag

SEQ ID NO: 4167525 - RNA, 129 nt, Human
uuuuaauaaguccaaggguagaaaaguccccacuaaaaugucauugugaguuaggcuugugacuguuucuaaggcugucuuucacagggaauguuuugcuugggugaucuuuauucuuguuuauuaaua

SEQ ID NO: 4167526 - RNA, 87 nt, Human
uuuuaauauagugcuauaauagucacagggugcuacugauaugcaggaguagcugccuaguagauugauugggaguguuagguagag

SEQ ID NO: 4167527 - RNA, 97 nt, Human
uuuuaaugcacugaaucaguaucugcaggccuagaguccuuaaauaauacaaguauacuuuggacugcaugaugaucuggaacacaggauauuggag

SEQ ID NO: 4167528 - RNA, 92 nt, Human
uuuuaauugaauuuguugauuucuuccuugucauuagaaugcuuaugguucuagcagaaaaguugggaagaaaaaugccuauucaggugaag

SEQ ID NO: 4167529 - RNA, 96 nt, Human
uuuuacaagcuaguaaguugguaucagucuuuugcccugaggagucuugaauuguaagaccaggaagagauuccaauuuacuuaaaucuuuugaga

SEQ ID NO: 4167530 - RNA, 63 nt, Human
uuuuacaccucagaugagcagagcucaaagguuuggcugcugucucuggaugaggugcugaga

SEQ ID NO: 4167531 - RNA, 76 nt, Human
uuuuacauaauccucacagcaaccuaugguaugauuaucaucaucauuuuauggcugagaggacuaagucuuaaag

SEQ ID NO: 4167532 - RNA, 63 nt, Human
uuuuaccugaaccacacaguauuguguccuagcaugcugauguauauagugauugagguagaa

SEQ ID NO: 4167533 - RNA, 72 nt, Human
uuuuacuaggacugucagccugaguugucauaacugcauuauaaucucuuuuaggacagagccuaaguagaa

SEQ ID NO: 4167534 - RNA, 92 nt, Human
uuuuacuaugauuauuccugacuagugguuuaaaucaagcugauuuaaaccaaguugauuuaaacuacuagucaggaauaaucauaguaaaa

SEQ ID NO: 4167535 - RNA, 104 nt, Human
uuuuacugaacagcuaugcaguuagcaguagcuccccaaauucacacaaauugccuuuggggaaaguuaaugugacuggaugguuuucucuacguuuauuaaga

SEQ ID NO: 4167536 - RNA, 56 nt, Human
uuuuacugcauauagcuuagagcugaaugagccauccuguaaguuauagcagaaga

SEQ ID NO: 4167537 - RNA, 63 nt, Human
uuuuagaaagaucccuggcaggcaauauggagagugauuuagagcccagggagcuuauuagga

SEQ ID NO: 4167538 - RNA, 74 nt, Human
uuuuagaaauacugauuuagugacuuuuugaugguugaccuggauaaagacaguagaugcaguagcuuuugaga

SEQ ID NO: 4167539 - RNA, 63 nt, Human
uuuuagaauguuagcguuaaagggaccucauagaucaucuugucccaugccaucauuuuaaag

SEQ ID NO: 4167540 - RNA, 90 nt, Human
uuuuagagagcuucacucugggccucauccagccacaaccuucccuaaggaugagcuguccaugaggccaagggaaugugcccucuggga

SEQ ID NO: 4167541 - RNA, 126 nt, Human
uuuuagaugguuuagucggagcuguuacauuuggcagcauuccuuguuagcauuugauaaacaauuauugccaaauguuagcaaggaaaccugccaaauguuacagcucagauuuaacugcugaaa

SEQ ID NO: 4167542 - RNA, 89 nt, Human
uuuuagauuuuucugguucuacacuuuucaagucaguagauuuacuuacaaagagaaguuguagaauuguucgcugggaagucuuaaaa

SEQ ID NO: 4167543 - RNA, 109 nt, Human
uuuuagccgggcacauuaggguaagcaugucucuguuccauaaugucugaggccucagcuugcaggaugaaggcagaggcugaaucugaaucugcaauagaggcugaaa

SEQ ID NO: 4167544 - RNA, 83 nt, Human
uuuuagguugaaaaauaugaaguugucaguaugauuguucuucuugaccuauaaaacagcaauucauaugguuuagccuagag

SEQ ID NO: 4167545 - RNA, 59 nt, Human
uuuuaguuuggauuucuaaagcugcuccucuuugaagcagcuuuaagacacagcuaaaa

SEQ ID NO: 4167546 - RNA, 83 nt, Human
uuuuauaaaaacaugaaaucacaauaaucccacuauauaccagcauaaccggguucagcuagaauuucauguuuuuggugaga

SEQ ID NO: 4167547 - RNA, 129 nt, Human
uuuucuuguuucuagauaaauacaucaugauuccauuauacuucugauucaaaaucaggauuacaguuuucugugucuuugcuucacaaguaugguucugacuguuguauggcaaauaggaggagaaag

SEQ ID NO: 4167548 - RNA, 55 nt, Human
uuuucuuuccauacauauugcuaucacuucggugaugguaauguaagagaggaga

SEQ ID NO: 4167549 - RNA, 83 nt, Human
uuuucuuugcagauuucaaggugaugacaaaagagacaacagucuuagcauuuguuaauacccacuugacccacaaaagaaaa

SEQ ID NO: 4167550 - RNA, 102 nt, Human
uuuucuuugccuaccauacauacaucuagagucauaaaaacauuuggguggcauuccaucaguugcucuauguguguucuaugugugugaacagucagaaaa

SEQ ID NO: 4167551 - RNA, 56 nt, Human
uuuucuuuguaagaugagucugggccggcgaacugggaagccucuggcagagagaa

SEQ ID NO: 4167552 - RNA, 72 nt, Human
uuuucuuuuaccaaaguacucugaggcagagaaauuaaauuucuaucuaauacuauuggugaaaacagaaga

SEQ ID NO: 4167553 - RNA, 126 nt, Human
uuuucuuuucuucuaacagaauacgggcagagagaagguuuauguuucaucugauaaucacagcuauuccggauucagaaauacaaaacacuuacuuuuaacgugggaaggagauuuaaaagaaaa

SEQ ID NO: 4167554 - RNA, 89 nt, Human
uuuucuuuuguauaagagcauuuccacuggcacugggacauuauuucucuguggccuuuguuggaggucccuuucuuccuaagagagag

SEQ ID NO: 4167555 - RNA, 57 nt, Human
uuuugaaagccagguuuguauggaaaugcucucacuccacuuggacugcuuucggaa

SEQ ID NO: 4167556 - RNA, 94 nt, Human
uuuugaaaugagaguggacaguaauuucaaaucaauggggaaagaaucaaaucuucagcaaauggcuugagauaauuagcuacacauuucagaa

SEQ ID NO: 4167557 - RNA, 64 nt, Human
uuuugaugugagauuuguauacagcguauacuauacaucuguuuaaccagaucucauaucaaga

SEQ ID NO: 4167558 - RNA, 76 nt, Human
uuuugauguuguugauuugguuuugcugugggaguuaguaagcuauggggcaggcaccagcucagcaauauucuga

SEQ ID NO: 4167559 - RNA, 56 nt, Human
uuuugauuuugaaagaaauuaccucauuuuacagaugagguagcucagacucaaag

SEQ ID NO: 4167560 - RNA, 57 nt, Human
uuuugcagccacugaugaucauugcuuagauacauuauuucauuagggauugcaaag

SEQ ID NO: 4167561 - RNA, 66 nt, Human
uuuugcccccuagaauacugugagcacauuacuggugggggcaguguuccuucuacuggggcagag

SEQ ID NO: 4167562 - RNA, 64 nt, Human
uuuugcccuuucuuuuccuucacuugggaaaguuuagagguggagugaaggaaaggcaguaaga

SEQ ID NO: 4167563 - RNA, 75 nt, Human
uuuugccuauugacaaaucugaacauacggaacauguucuguguucuguauguuccguuuugucacuaggcaaga

SEQ ID NO: 4167564 - RNA, 79 nt, Human
uuuugccugcaaugauaagcuaauguuauaaauacuguuauaaaagucaagcaauaugcagcuuaucuucuagggagaa

SEQ ID NO: 4167565 - RNA, 75 nt, Human
uuuugccuuuucaacuucugugcccuuagcuccaguuuaauuccucgccaagugucagaaacaggaaggggaaaa

SEQ ID NO: 4167566 - RNA, 65 nt, Human
uuuugcugcguccucacacagugggagggcaaaaaagaugaacacuguguccucauguggcagaa

SEQ ID NO: 4167567 - RNA, 106 nt, Human
uuuugcuggacuaacaauguuuuggccauuuggaaguagaaaauaaucuaaucgauuacuuuuugcauaguaagugucuuuaauaccuuguauuuuucaaguaaaa

SEQ ID NO: 4167568 - RNA, 90 nt, Human
uuuugcuuuuuuuguaugcauuuguaguaucuguuuauauaucaauugguuauauagugagagauuacagaagcaaagaaagaauuaaaa

SEQ ID NO: 4167569 - RNA, 77 nt, Human
uuuuggaagcuucccagcccugcauaaaucaguugguacaaauagacugaggaguguggggugcagggagcccaaaa

SEQ ID NO: 4167570 - RNA, 60 nt, Human
uuuuggaggaggaugcauuuguuguuugauggagucuacgaccuugcccucauuccaaag

SEQ ID NO: 4167571 - RNA, 64 nt, Human
uuuuggaguggacuucaugaggccacauuucagauuagugccuagaggagucaguauucugaga

SEQ ID NO: 4167572 - RNA, 65 nt, Human
uuuuggcaaaagauuggguacuuaguuuccuguuacugaguuagcucuauucuuuuggaccaaag

SEQ ID NO: 4167573 - RNA, 59 nt, Human
uuuuggcagauuacuuaauaugucuuucuuggcgugaaauuagugagugauccccaaag

SEQ ID NO: 4167574 - RNA, 108 nt, Human
uuuuggccuucuuauaucuggcuccacuggcucaugaaauugugguauuucagaaagaacugcagaaagcaggaaaugcuaucauagcugagcaugaggaguucaaaa

SEQ ID NO: 4167575 - RNA, 61 nt, Human
uuuuggggagaacgguugcuauuacuuagccugugugcaugguagcugaguucccacagaa

SEQ ID NO: 4167576 - RNA, 60 nt, Human
uuuugggggggagccgcagggaaccguugggagaggggcccugugugugucccuuuaaga

SEQ ID NO: 4167577 - RNA, 75 nt, Human
uuuuggguuccccuagaugugaggggaggggccuuucucccuaugccaaucccuucaagauuuggggaaauaaaa

SEQ ID NO: 4167578 - RNA, 60 nt, Human
uuuuggguuguuuuuauuuguuugaaguagugggauauuuuggacaaaugcaauuuaaag

SEQ ID NO: 4167579 - RNA, 86 nt, Human
uuuugguaccacucaaauguccucugacucagccuugggaaagguugugacaaguuccuugagugaggggcauuagaaaaccgaaa

SEQ ID NO: 4167580 - RNA, 74 nt, Human
uuuugguauauucaguaaacauccacuauuaucauucauuuaugaaaauugugaagguuucugaaauacuagga

SEQ ID NO: 4167581 - RNA, 90 nt, Human
uuuugguuagaauucuuguucacaaugccuuguugaugguauugcggaagcagccaucaaaucagagcauuaaucuuuucuaugccagaa

SEQ ID NO: 4167582 - RNA, 70 nt, Human
uuuuguaaauagcaguacucaugugacccaguuaauaauugucucaguccaugggguugcuauagcaaaa

SEQ ID NO: 4167583 - RNA, 57 nt, Human
uuuuguaacucagacaggaggcaaacagcacauggcauugcugacugagcugcaaaa

SEQ ID NO: 4167584 - RNA, 71 nt, Human
uuuuguaauugacaaauaaugcugucaguuguuuuccuugaagugacagccucacuuuguuaauuuuagag

SEQ ID NO: 4167585 - RNA, 60 nt, Human
uuuuguauagucaaagacaagaacaucacuggaaggagucuuuguuuugaugauacaaga

SEQ ID NO: 4167586 - RNA, 59 nt, Human
uuuuguaugcucugaauuuucaaguuuaaauuugagaaagugaauacagagauacagaa

SEQ ID NO: 4167587 - RNA, 96 nt, Human
uuuugucauuaauauggcuuugguggccagugggaaugggcucaacucuuaaggaaaguuagacgccaaagccacaggccauccaaugagacgaaa

SEQ ID NO: 4167588 - RNA, 70 nt, Human
uuuuguguuaugcauuuuaaagcauuauuuugaggaggguccacaggcuucaccaggugcaugcaugaaa

SEQ ID NO: 4167589 - RNA, 129 nt, Human
uuuuguuaauugcccaaauucaauaucagguuuagaacuaagacauuguuaguagaccaguggcaguuucuucugcugauguagacucauaguaaucaaaguaugaaauugauaugcaaaaauccagaa

SEQ ID NO: 4167590 - RNA, 81 nt, Human
uuuuguucugaaaaucuucccuuaauacaucacauggguuuuugaggcagauguuuggagggcaugauuuuuagggcagaa

SEQ ID NO: 4167591 - RNA, 86 nt, Human
uuuuguucuggaccauuugcuaguaaauugcagagguugcaacccuuuaagcuauguaguuuaguaugugucccuuaagaacaaag

SEQ ID NO: 4167592 - RNA, 55 nt, Human
uuuaccaaauagauuaugucagcuguucaguagucagcuugauauuauugguaaa

SEQ ID NO: 4167593 - RNA, 58 nt, Human
uuuaccacagaaaaaaguaacuucguuuucccucuagguuacuuaauguagugguaaa

SEQ ID NO: 4167594 - RNA, 55 nt, Human
uuuaccagcugucugucacucccuauaucuaugagauucaguuaaggcugguaga

SEQ ID NO: 4167595 - RNA, 83 nt, Human
uuuaccgagggcacaggucaggagaugagauucguuucgcuuuuugaauuaccuuuuggccuguaccaagaugaacugguggg

SEQ ID NO: 4167596 - RNA, 78 nt, Human
uuuacucaaauguuuugcuuccuaguuggguaauaaguauugugcuuacacgucggagaggaugcaagaacgaguaaa

SEQ ID NO: 4167597 - RNA, 100 nt, Human
uuuacucccaauagcuuuaucacuccuucaacuuuuuacuugcccugguuuacccagucaagauagaaauuuugaagcuuaggguuguuccaauuguaaa

SEQ ID NO: 4167598 - RNA, 84 nt, Human
uuuacucgaauguguuggauauuaguggggagcacauaauagagauggccguccagccacguauuaucucacugagagaguaaa

SEQ ID NO: 4167599 - RNA, 85 nt, Human
uuuacucuauuagguaugcagccuauuugccagggugaguuaucuccucuuagaguuugguuauauaccuagucuauuuuguaaa

SEQ ID NO: 4167600 - RNA, 86 nt, Human
uuuacucuguuuaugaauaaaacauuuuaaucagugcuguaucaacacugaucaauuuuuuucauggaaguguaauacagggugaa

SEQ ID NO: 4167601 - RNA, 61 nt, Human
uuuacuuugaaaccuaagauauugaggaguuuuaaauacauguccuagguuugaagguaaa

SEQ ID NO: 4167602 - RNA, 82 nt, Human
uuuacuuuggauguauuggaggaaaccaagaagaaaaggccucuuucucuucacaugcuugcuccaagacucaaagaauaga

SEQ ID NO: 4167603 - RNA, 64 nt, Human
uuuacuuuuaugugaugaaaucugccucuguauuaagaggcaagaacuuguaagugaaggugaa

SEQ ID NO: 4167604 - RNA, 74 nt, Human
uuuagaaauugcagagugggugugggcgugccauguuucuuaaguugccuaagacccaaaagguuauuuuuaaa

SEQ ID NO: 4167605 - RNA, 78 nt, Human
uuuagaaguccaguaauuuguuuuucugaaauugaauauauuuguuuacugucucagagagacaaauauauuucuaga

SEQ ID NO: 4167606 - RNA, 56 nt, Human
uuuagaauaggauccaaacucugcagguuggccuucaaguccugaccuagucuaaa

SEQ ID NO: 4167607 - RNA, 130 nt, Human
uuuagaaucacguggggagcauuugaaaacuacugaugccugggcccuaacccagauuaauuaaauuagaacuucugaggguaggucccaggcauagcuggucuuuuaaagcuccccagcagauaguaag

SEQ ID NO: 4167608 - RNA, 62 nt, Human
uuuagacacguaaaggaaaacugagguaaugugagaccucaggggcuuuucguuguuguuga

SEQ ID NO: 4167609 - RNA, 76 nt, Human
uuuagacaguaccaggccaaaccaugagaaugugacuccaagacuaauggauugugucagguaucugcauucugaa

SEQ ID NO: 4167610 - RNA, 68 nt, Human
uuuagacaucauauugagccucucugugugaucuggaaagcucccuccacagacaggacuugucugaa

SEQ ID NO: 4167611 - RNA, 73 nt, Human
uuuagagacccucugcuauuuuuaaaauuuccuuccuugcuuuguuuuagucaaccuaguaggggguucugaa

SEQ ID NO: 4167612 - RNA, 63 nt, Human
uuuagagcccaugugagugugaucgagugaaagcucuguguuaaugcuccauggguuauuaaa

SEQ ID NO: 4167613 - RNA, 65 nt, Human
uuuagaucucucaugucuggagagugauuagacuagaauuacaaccuagaacugagaaauuuaaa

SEQ ID NO: 4167614 - RNA, 60 nt, Human
uuuagcagaaacuguuacagaaggcacaauugucuccugaauuagcaguuugugucugaa

SEQ ID NO: 4167615 - RNA, 61 nt, Human
uuuagcagagcauaugauauccuugugggcaagaugaaggaguaugauauagucugguaga

SEQ ID NO: 4167616 - RNA, 73 nt, Human
uuuagcagcucacagccucccauugaggaaaggguaauguugauucuggaaauggaggcuuguucugguuaag

SEQ ID NO: 4167617 - RNA, 70 nt, Human
uuuagcauccaagguuaugacugacauuuguacaaggugauacuggucaaguaauccugggugucaugaa

SEQ ID NO: 4167618 - RNA, 67 nt, Human
uuuaggagagagaugccgccuugcuccuugaacaggaggagcaaggcggcaucucucugauacuaaa

SEQ ID NO: 4167619 - RNA, 55 nt, Human
uuuaggcagaagcccugcugaugggagagggcuaggagggagggccgggccugag

SEQ ID NO: 4167620 - RNA, 93 nt, Human
uuuagggaaacacaaaauaaggccagcaugaaugcagcagugagaacuacuuauuauucagucauugauuggccuugauaguauuuaucuaaa

SEQ ID NO: 4167621 - RNA, 84 nt, Human
uuuuaauguauaugcagauuuucaucaucguuucuaucuugcaauaaaugaagcugcgaguaauuggaaauuugcuauuuagaa

SEQ ID NO: 4167622 - RNA, 65 nt, Human
uuuuaauuucuucagugauauagaaagaagguuuuuccuuuuacauuuguugaagaguauugagg

SEQ ID NO: 4167623 - RNA, 63 nt, Human
uuuuacaaggcaguuauuuuccuaaaguguuacauaucaaggaaaguugagcugucuguagga

SEQ ID NO: 4167624 - RNA, 100 nt, Human
uuuuacaaugcaccguucaguuuucuauaugaguuguggcuuagucacaguauuucacugugacagcuuagcuuaagaaaaagaaaggugcaggagaaaa

SEQ ID NO: 4167625 - RNA, 75 nt, Human
uuuuacacagaauuugguaguuauuuuugguaaauaauuuuuacagaggauguuugaucaaauuaaaauguaaaa

SEQ ID NO: 4167626 - RNA, 80 nt, Human
uuuuacagcagcaauuuugguuccuggaguucugcagguuccuuucuggcaggaagauuagaccaagagcugcauuaaag

SEQ ID NO: 4167627 - RNA, 66 nt, Human
uuuuacagcugaaggagcuaguccagaugaauuuaaccauuuguuuuaacgacucagcuuguaaaa

SEQ ID NO: 4167628 - RNA, 61 nt, Human
uuuuaccacugggugacauggaaaucacaauaaggaauucuaaugucauuuguggcugaag

SEQ ID NO: 4167629 - RNA, 73 nt, Human
uuuuacuggaggcagaagaugguauuugauaaguuauucuaaucaacagaauugcugcugccaaugugugaga

SEQ ID NO: 4167630 - RNA, 84 nt, Human
uuuuacuguguaugcuucuguaaugugggaauguuuuuacaagcauguaucacuccuauaauuaaagaugcaaaucuaguaaaa

SEQ ID NO: 4167631 - RNA, 83 nt, Human
uuuuacuucuuuaguuuuucuuacugucugugauccucagcuagaaugcagguucuuagugagguagggauggggagguaaaa

SEQ ID NO: 4167632 - RNA, 130 nt, Human
uuuuagaaauguaggcagacuuuuugcacacugggaccuguuuguguccauuagugacuagaaggaucacaaggauagaaugguucugguugugaaaucauaccucucagccuuucaugcaagaaggaaa

SEQ ID NO: 4167633 - RNA, 87 nt, Human
uuuuagagcaaggcuaauuaugccuuggggcuuuggcgaaugugcuugucuuuaugaaagaguccuuggcaucaucaguaccuagaa

SEQ ID NO: 4167634 - RNA, 88 nt, Human
uuuuagauuccuaguuagcauaauuuguagaaaaucaaagcuagacaguagugaugucucucaaauuuguuugacaagaggucuaaaa

SEQ ID NO: 4167635 - RNA, 64 nt, Human
uuuuagauugggaaauguaaagucaacuuaaagcaguugaaaucauaacauuuccuaacugaag

SEQ ID NO: 4167636 - RNA, 66 nt, Human
uuuuaggaaaggguuuucuaacagaaguugguugcguaagcuuuugaggcaaacucuuuucugaaa

SEQ ID NO: 4167637 - RNA, 55 nt, Human
uuuuaggguagcauguucuuaacuccacggugcccugggcaugcuggcucuagag

SEQ ID NO: 4167638 - RNA, 58 nt, Human
uuuuaguacagaaucaaaagcaaugguagaaaacuaugaugguuuuucuguauuggag

SEQ ID NO: 4167639 - RNA, 88 nt, Human
uuuuaguguguuaaguuaauagggaucccuggagugauguggaaagagccaagucacuggaggaacucuacuaaauuuguaacuggaa

SEQ ID NO: 4167640 - RNA, 77 nt, Human
uuuuauaaagugagaagugcuaugcacagguaaaggaucauuacccaguuaauucaugggauuucugcuuugugaga

SEQ ID NO: 4167641 - RNA, 56 nt, Human
uuuuaucauuacccagcugaaaugucucaggcagucauauuaggguaaugauaaga

SEQ ID NO: 4167642 - RNA, 64 nt, Human
uuuuaucuguuguaccugcauugucucuguaacggggauuacaacgcauguucaauaugugaaa

SEQ ID NO: 4167643 - RNA, 104 nt, Human
uuuuauguuuucagucauugauaggacauuugggcuuaguguuuuuguguaacauuaagaacaugaagucacaaaugcagcuagagaagagacaaagcauggga

SEQ ID NO: 4167644 - RNA, 82 nt, Human
uuuuauuaccauaguacuaucaguuuaagacguucaaaacaaaagaugcuaaaaauaaaugauaguauugaagguagggaaa

SEQ ID NO: 4167645 - RNA, 60 nt, Human
uuuuauucucagcuccagagagcacaacaguucacucacucucaggagcuggauuugaga

SEQ ID NO: 4167646 - RNA, 56 nt, Human
uuuuauugggaguccucuacugcucaauugaaaguugacacaggcucccagugagg

SEQ ID NO: 4167647 - RNA, 70 nt, Human
uuuuauuggguaucuucuuucucaguuguccacacauaggaugauuauacaaggcuggugccuaauugaa

SEQ ID NO: 4167648 - RNA, 58 nt, Human
uuuuauugugucacaggcagcaagagcaggugaguucuuuccuaaugaaacagugaaa

SEQ ID NO: 4167649 - RNA, 88 nt, Human
uuuuauuucauauugacuuuagaacauagcaacagaauuaguugguuuguugauucaaguuuuguguucuugucacuauugagugaag

SEQ ID NO: 4167650 - RNA, 73 nt, Human
uuuuauuucccagagauuggcuugcuggacauuuguaugaugaugcacucugcuuauacucuggagaauaaga

SEQ ID NO: 4167651 - RNA, 96 nt, Human
uuuuauuuggcauuaaaacugcacuuuauuuugucaaaggagagguuuccccuugaauuguaaguacaaaaaaaguguuuuuaaucuuuagugaaa

SEQ ID NO: 4167652 - RNA, 79 nt, Human
uuuuauuuggucugugcaaauaaagagcaacauuaucugaaaauguuuuuaaguuuauuugugacagcaucaaagaaaa

SEQ ID NO: 4167653 - RNA, 81 nt, Human
uuuucaaagaaauuuacagccaguagugauaagguugugaacacugaaagcugccuggcugaugaaaauucuguuugaaaa

SEQ ID NO: 4167654 - RNA, 62 nt, Human
uuuucaagagggaacugaacacaggucaacagaauucugugcugcaauucacuucuugagaa

SEQ ID NO: 4167655 - RNA, 81 nt, Human
uuuucaagugcuagaugaguuuugagaagugaguaagaaaacagugucuccaccaucaagaccuuaucuaguuggagaaag

SEQ ID NO: 4167656 - RNA, 94 nt, Human
uuuucaaucacuguuuagauguugaagagaaauauccauaaggagguuugauuuguccuuacagauauuucucuucaacaacagugauugaaag

SEQ ID NO: 4167657 - RNA, 68 nt, Human
uuuucaccauagucacaggaaguuucaauguauguacuagcgguacauugaguaacugugugggagga

SEQ ID NO: 4167658 - RNA, 58 nt, Human
uuuucacccacuuucaugaguuucaucaaauacugagccuacucaaggguggagagaa

SEQ ID NO: 4167659 - RNA, 71 nt, Human
uuuucacucaaucagguauucucauguagauagcaaaaauggaaaaacugaagauaucugugggauggaga

SEQ ID NO: 4167660 - RNA, 80 nt, Human
uuuucacugacuuuggugguuguguuuugacuugagcuuuccuuaagcagugauaagagcuaccauugaaucagugaaag

SEQ ID NO: 4167661 - RNA, 58 nt, Human
uuuucagauauucugcucugucaucagcuauagacacugacagguauuuaucuggaaa

SEQ ID NO: 4167662 - RNA, 71 nt, Human
uuuucagcaaaguuaagguuucucuuuuuaugcuagaaagacuaacauugagacucuaacuuugaagagaa

SEQ ID NO: 4167663 - RNA, 60 nt, Human
uuuucaguaaugucuacauaauaguacccaucucagggagcucuuguagcuuacugaagg

SEQ ID NO: 4167664 - RNA, 72 nt, Human
uuuucaguugugcucucuaguuaguuuuuuugggaguaaggacaaaccuggaauagauagcaaaacugaaaa

SEQ ID NO: 4167665 - RNA, 76 nt, Human
uuuucauaguuuaaagagagaagacuguaaaucugguuuaucauguucuuaucauucuuucggaaacaugugagga

SEQ ID NO: 4167666 - RNA, 74 nt, Human
uuuucauccuauugcuuuuuccucuggcuucagucuguggcauauuagaaaugggccuggaaagaggauguaaa

SEQ ID NO: 4167667 - RNA, 58 nt, Human
uuuucaucucccaggggcccaaggagcugccuagaggggcugccugggaagaagaaga

SEQ ID NO: 4167668 - RNA, 71 nt, Human
uuuucaugacaaacuaccuacagauguucagauuaguauauccagugggcauccugguguuucagugagga

SEQ ID NO: 4167669 - RNA, 80 nt, Human
uuuucauggaucauaaaugugcuaaaguuaauucucccaagcucaaugauuauauuuuagcagaucuauguaugugaaaa

SEQ ID NO: 4167670 - RNA, 59 nt, Human
uuuucauuuuuauggugaaacagagcuaaaagucaucugugucaugcauuagaugaaga

SEQ ID NO: 4167671 - RNA, 79 nt, Human
uuuuccacagcauuucucuguuguguugaaacauuugaagcauuaucucagcacaaauauaaaaaugucugauggaaaa

SEQ ID NO: 4167672 - RNA, 60 nt, Human
uuuuccacucuugcaagcugcacaaguaccauacuuaguguucugggcugagaggggaga

SEQ ID NO: 4167673 - RNA, 58 nt, Human
uuuuccccauuaacuugcagaguagaccuucuugauacugcaagauggguggggagaa

SEQ ID NO: 4167674 - RNA, 74 nt, Human
uuuucccccagcaugcuucccucacauauccuggccugcaaugcagaggccagggggaaacacuggggagaggg

SEQ ID NO: 4167675 - RNA, 88 nt, Human
uuuucccugguccugucugccauuagcccaguccaggccaucagcuucucuucccuggacuaggccaguggcaaacaggacuggaaga

SEQ ID NO: 4167676 - RNA, 66 nt, Human
uuuucccugugggaguaggaaaguucaucugcacauagcauguuuauuuucauuuccaggggagga

SEQ ID NO: 4167677 - RNA, 77 nt, Human
uuuuccucaggagaaacaaucaucaugugauuugaaucaaacuauuuaaaauauguauuguuuuaaaccagggagag

SEQ ID NO: 4167678 - RNA, 56 nt, Human
uuuuccucugcaauaaaagcagccuuuuucuuaauguuuucuuugauagagggaag

SEQ ID NO: 4167679 - RNA, 78 nt, Human
uuuuccuuuuuucuugugccuaauuuugggccaguucuucugguuagaugauugaggugaccagaacauacaggaaaa

SEQ ID NO: 4167680 - RNA, 75 nt, Human
uuuucgcacuaaauccuguuauuaaaaagcucaggcuaagaucaagccaagggcuguaacggacuugacagagaa

SEQ ID NO: 4167681 - RNA, 58 nt, Human
uuuucuaaaauauccaggacagucuuuggugaauaggucuugguauguauuuaggagg

SEQ ID NO: 4167682 - RNA, 89 nt, Human
uuuucuagaauggagaacuucaggauuauucaaguucaaauucagaaugugaauacagugaggucuaugagaaucauuuuugcagaaga

SEQ ID NO: 4167683 - RNA, 57 nt, Human
uuuucuaguucuuagagaauuggucugccauagaucuuucuacucagaaguagaaga

SEQ ID NO: 4167684 - RNA, 106 nt, Human
uuuucuauacuugacauuucaaucucauuaugggucaaugcucaauuuuugcuuuauauauggguuccaauaaagagaggaaugucuguuucacugucauagaaaa

SEQ ID NO: 4167685 - RNA, 88 nt, Human
uuuucuaucacucaauuauuuuuuggcacaguguugcagccaaacuugaaauacuauguagccaaaauaauguggaguaggaugaaga

SEQ ID NO: 4167686 - RNA, 61 nt, Human
uuuucuaucuccuagaacugccugguuguccaccuccagauugcagaugggagaaagagaa

SEQ ID NO: 4167687 - RNA, 84 nt, Human
uuuucuauuuuuugggcuuauaagaguauauaguguacuauauaauuaguauuugccaauauucuuuguaagcuugauaggaaa

SEQ ID NO: 4167688 - RNA, 100 nt, Human
uuuucucagugcuuacgugcuccuggacauggagcggaggaugaacucgacugcauucucaaugaucucugugcccaggaggcuuaggaauuuggggaag

SEQ ID NO: 4167689 - RNA, 55 nt, Human
uuuucucaucuggaaacagugcuagggauaccuaacugugacccaggugaggagg

SEQ ID NO: 4167690 - RNA, 63 nt, Human
uuuucuccagggaacaaggugaggaacugcaaaccacuuaccuuuauagcaaccuggugaaaa

SEQ ID NO: 4167691 - RNA, 57 nt, Human
uucugucagugauuuuucccccacgugguaaugauggaaaggucuuaacuuacagag

SEQ ID NO: 4167692 - RNA, 91 nt, Human
uucuguccuuccuuuugcuugccucaugcccaauuuuccaagccaaggaaaggauugggaaggcguggaaguagaaggucugggcacagaa

SEQ ID NO: 4167693 - RNA, 121 nt, Human
uucugucuggacuuaucugagucacuuucuauucucugcagcugaauguuuccuagguuucuacacuccagacaucucucugcaaaacgagauugaaagagacucagucuucuacccagaa

SEQ ID NO: 4167694 - RNA, 61 nt, Human
uucugucuucucgguuguuuaccuaauuccccaacagaacaguaagucuuaggagacagag

SEQ ID NO: 4167695 - RNA, 76 nt, Human
uucugugaaaacuaccugaugggucuugguccaaccugaaggaacacaugaaucacugguggaagauuauauagaa

SEQ ID NO: 4167696 - RNA, 75 nt, Human
uucugugacaguggucacuuguaguuucaaaugacauuuugcuggcugcaauaagacuauuuuuauccucaagaa

SEQ ID NO: 4167697 - RNA, 88 nt, Human
uucuguguuuucccauugggucuuaauuugaaaacuucugccauaaacucuuauuuucagaggaagccuuggugggaguaauacagaa

SEQ ID NO: 4167698 - RNA, 122 nt, Human
uucuguuaugguuauuuguuggccagucucuucuugcuagacugagugcccuuggauugggaagaucgcauugcccggcacuaggucugccccagaaggaugcucaauaucauuguacagaa

SEQ ID NO: 4167699 - RNA, 76 nt, Human
uucuguucacccaagggcuugugauuucacgcucauguggaaacaugagguaagcacugggcccaaguggacagga

SEQ ID NO: 4167700 - RNA, 80 nt, Human
uucuguuggagauaguuucuaauguugaaauuaucagugaauguucauuaauucuucauguugaagcugucaccauggaa

SEQ ID NO: 4167701 - RNA, 84 nt, Human
uucuguuuaucaugaaguuuuaccuaauguaggcuuucucuuaaauuuccuauauagaguaauuauuugguguucauggcggaa

SEQ ID NO: 4167702 - RNA, 84 nt, Human
uucuguuuuccaguccauggauucccaaggucauauuggaggguuuauuugaccaaaagccauggggacuucauggauuuagaa

SEQ ID NO: 4167703 - RNA, 56 nt, Human
uucuuaagcaguuuggcauguuuacguuucaaaacucggucaagcuucuuuaagaa

SEQ ID NO: 4167704 - RNA, 64 nt, Human
uucuuaagugagaaagcaggagaaagucagaggaaaaagaauagauuuaccugccauuuaagaa

SEQ ID NO: 4167705 - RNA, 56 nt, Human
uucuuaaguuuagcaacuugugaugaaauaugccacauaaggcuuucacuuaagaa

SEQ ID NO: 4167706 - RNA, 74 nt, Human
uucuuaaucuuguuauucuucauacagacaaguccuguucuuuaggauuuggggaagaaaacacuaaguaggaa

SEQ ID NO: 4167707 - RNA, 67 nt, Human
uucuuagaagaacaucagaaauuggauuuaggggccacuguaaaugcagaaugauuucaucuaggga

SEQ ID NO: 4167708 - RNA, 55 nt, Human
uucuuagaaguuuauggcacggaggcaguaacccucuguugcucagucuauagaa

SEQ ID NO: 4167709 - RNA, 57 nt, Human
uucuuagaauuuuaauccagaaagccuccaaagauguuuaggaugggagucuaagaa

SEQ ID NO: 4167710 - RNA, 78 nt, Human
uucuuagcagaagaacaacaugaucugacauagcacaaaggauaaaaguuagauuuagcaaaucuuacuagcuaagga

SEQ ID NO: 4167711 - RNA, 61 nt, Human
uucuuauauguguuuuuuuguguguguguacacacaugaaauaauauuaugcauauaugga

SEQ ID NO: 4167712 - RNA, 101 nt, Human
uucuuauuauaauuauuagguucuugcaguacuggaguugauuacauaaaacugauuacuuggguuuaauuaauuaauuccacagcaagagauaauaagaa

SEQ ID NO: 4167713 - RNA, 55 nt, Human
uucuucaaaauccagcaugauucaagauacugauggauuuuggguauuugaagag

SEQ ID NO: 4167714 - RNA, 69 nt, Human
uucuucacaguccuggucaguggaaaguucuacaucagacaguccaaccuccauugccaugaucaagga

SEQ ID NO: 4167715 - RNA, 77 nt, Human
uucuucacugaucuguuauaaucucuuuuaugucauuggagcugaauaaauacugguugaauggauuagggaaugaa

SEQ ID NO: 4167716 - RNA, 61 nt, Human
uucuucagcuucuaccugcgucccaauccugaagugggagagaauaggagaaauugaagga

SEQ ID NO: 4167717 - RNA, 77 nt, Human
uucuucaggggaaagaaaaacauggauaccuuaucuagcauugcucauaaaaguacucauguucauccuuuuuggaa

SEQ ID NO: 4167718 - RNA, 129 nt, Human
uucuucaguugguugaacaguaguuaggaaccuucuugcuguugauucaucuucuaauacccacacagauguggguacaugaaaauagaacaaugcaagaacaccucacauuaccaucacaacugauaa

SEQ ID NO: 4167719 - RNA, 63 nt, Human
uucuuccauaauuaaguggagagaaagggggacuuuacuagucaauaacuuaaugugggagaa

SEQ ID NO: 4167720 - RNA, 106 nt, Human
uucuucccaagguuaguuugaggacuaauuaugauggagcguaaaauguaccuguguauguuaaguguaccauauaucaguucuucuucaccuucccccugaagaa

SEQ ID NO: 4167721 - RNA, 70 nt, Human
uucuucccuaaauagagucagauguaauguucuuuccacauuggccaucugcucuguuuuaugugaagaa

SEQ ID NO: 4167722 - RNA, 81 nt, Human
uucuucgaguucaugagagaacuguuucuggggucuuuaaauuuuaagaggaacuuaugauauucuacucaacuauaagga

SEQ ID NO: 4167723 - RNA, 96 nt, Human
uucuucuaaaggaaaaaaacucuauggacauggauuuugucauaaauaauaagggcauguaaauccuucuuuaggccacauuuccauuugggagaa

SEQ ID NO: 4167724 - RNA, 66 nt, Human
uucuucuaggaucugggauuuuugacacugaaggguccuggcugccuuaaauccuuucuagaagaa

SEQ ID NO: 4167725 - RNA, 75 nt, Human
uucuucuccccaggcucucuaugggaaagagacauucauuuucuucuuccaguuauaagagcuuuucaagaagga

SEQ ID NO: 4167726 - RNA, 103 nt, Human
uucuucuugggcuuuugggcuuuuucucuccauaaauauuuucaggacaagugagaauuguccuuuuggcugucuaugguuagagccaaaagcuagggaggaa

SEQ ID NO: 4167727 - RNA, 65 nt, Human
uucuugaacuuuaugaaaaccagauuggggcaugagcauguucuccauugaaucauguucaagga

SEQ ID NO: 4167728 - RNA, 118 nt, Human
uucuugacaaugcuuucagcagccuuucagaaauucuaaggucacaauguuggauuagcuguuuaagcugcaagcaacaugguagauuuugggaagggauguaagcuugaaccaagaa

SEQ ID NO: 4167729 - RNA, 96 nt, Human
uucuugaggcauguaauucauggaugauuuucaaaaugucauauuugaauugggaaaguaacauuucuugaauuaaucagccaauugcuucaagaa

SEQ ID NO: 4167730 - RNA, 59 nt, Human
uucuugauucuuccuugaaggauacugcaugguccauuccuacacaggauaauuaagaa

SEQ ID NO: 4167731 - RNA, 89 nt, Human
uucuugcuuuguuacuugucugucaggucuaaaaugggucucugguagucacccagggaccuagacugauggagaaccacauuccugaa

SEQ ID NO: 4167732 - RNA, 65 nt, Human
uucuuggaugauauguguccuaagcauauugauaucaauauguguccuaagcaaucauccaaggg

SEQ ID NO: 4167733 - RNA, 81 nt, Human
uucuuggccaggcgagguggucaugccuguaaucccagcacuuugggaggccaaggugggcggaucacuugagguaaagag

SEQ ID NO: 4167734 - RNA, 71 nt, Human
uuucauuuggaguagggcuuuagcgauggcgucuuuguggaggugacauuuuaagaguguucucagugaaa

SEQ ID NO: 4167735 - RNA, 62 nt, Human
uuuccaaaacuuauuugaagucaucugaaugggauaucucacuuaguuaaguauuuuggaaa

SEQ ID NO: 4167736 - RNA, 84 nt, Human
uuuccaacagaaucugccuucaguguccucucuaguagacacaaucaguagugcuguagaggauuugaccacugcuguugggga

SEQ ID NO: 4167737 - RNA, 59 nt, Human
uuuccaagucacccuuagggucacaugccugcaaguugaccccuagguuggcucagaaa

SEQ ID NO: 4167738 - RNA, 56 nt, Human
uuuccaccagaguuugauggaaacagagcuguuuccuccauucagcauuguggaaa

SEQ ID NO: 4167739 - RNA, 60 nt, Human
uuuccagccgucagaugugccgcagccugcugggagcuccgguagguuugaggccggaga

SEQ ID NO: 4167740 - RNA, 56 nt, Human
uuuccagcuggaccugcccuagcuccugaggacuaugagggagguagcauuggaaa

SEQ ID NO: 4167741 - RNA, 116 nt, Human
uuuccaggccaggggaguaggaggugggcugccugucucauucugugagcuguggaggagcccacagagcacagggccaaguaaacccuaccuccaaggagcucacaguuuggaga

SEQ ID NO: 4167742 - RNA, 59 nt, Human
uuuccauauucugcgucugccaauaauuaagaguuggcucuauaccaauaauaugggag

SEQ ID NO: 4167743 - RNA, 84 nt, Human
uuuccaucccaaggagcucauauucuuguuggaggcuucccauuuaccacuucagggaugaaccaagaguccuugaaauggaaa

SEQ ID NO: 4167744 - RNA, 64 nt, Human
uuucccaagaaaaauaauuggaguaagaggccagacuacacuuuccaaaguuuuuuguggggag

SEQ ID NO: 4167745 - RNA, 70 nt, Human
uuucccagaagcagagccugaggcagggauucagaugcucaugaacuguuugaggguuugcuuucagaag

SEQ ID NO: 4167746 - RNA, 67 nt, Human
uuucccagaggacuguuggugcuaggccugacugauuuucaccuagcagcuccauuucucuggcaag

SEQ ID NO: 4167747 - RNA, 64 nt, Human
uuucccaggaaguuauuugcuaucuacugagcuaaauggucaguuuaaaugacuuccuuggagg

SEQ ID NO: 4167748 - RNA, 55 nt, Human
uuucccaguucccugcucuauaccaggucauccugcuaagcgcugagaugggaga

SEQ ID NO: 4167749 - RNA, 109 nt, Human
uuucccaucaccuagcaccaucugagaauucuagucacacacauucagagagaccuuucucaugguguuucuacaauucuguugccagucuugacuaggaggcgggggg

SEQ ID NO: 4167750 - RNA, 97 nt, Human
uuucccauccuguagcuagcuuugcuuacuggugucugcaugccuuugacaacauguaucagaaaauagcaaaauuuuggcuuacagauuuaggaag

SEQ ID NO: 4167751 - RNA, 64 nt, Human
uuuccccauaugcuaugugugggcucauccuguggaaacaggccagagcgcgugguugggggaa

SEQ ID NO: 4167752 - RNA, 63 nt, Human
uuucccccaguuuuuggaucuuauaguuccacaggacaagauacaucuaagagaugggggaaa

SEQ ID NO: 4167753 - RNA, 126 nt, Human
uuuccccgucugcgcgccccacauauucgcuuuccgcagguucucucgcugagauucgcguccuucaaacuaauggaacuuugcaagggggcccugcggcggcuucgcgugggagcgccggggaaa

SEQ ID NO: 4167754 - RNA, 83 nt, Human
uuucccuccgcuccugggcuucacugguacaagugggagcucucaggguccacacaugugugcagcuuagaagugcagggaaa

SEQ ID NO: 4167755 - RNA, 66 nt, Human
uuucccuucuuuccugaguaaucguagacugcuuuauuuuacuuugugacagaggaagaggggagg

SEQ ID NO: 4167756 - RNA, 91 nt, Human
uuucccuugugugacucuauggaaguuaacuuuuucuuauggccauagugugaaucgaaggccacaagagaaguuaaggguuauauugaaa

SEQ ID NO: 4167757 - RNA, 59 nt, Human
uuucccuuguuccuuccucugaagacaguaggagcuauaaacaggaacaguuugggaga

SEQ ID NO: 4167758 - RNA, 76 nt, Human
uuucccuuuaagcaaaagggagaccaaaggcuuuugagcaauaaagagacccagucacacuugugcuuuggggaaa

SEQ ID NO: 4167759 - RNA, 87 nt, Human
uuuccgcaagaggaucugcugcuuagcaugugguguccuuguacauuuguccuaggagaaccacaguugaacugauacuuuuggaaa

SEQ ID NO: 4167760 - RNA, 125 nt, Human
uuuccguggugagggaagcacagguggugggagcaggcuuggcagggaggcugguuucuagcggggagcucgccuucuccgcucagcuauuuccauaaaccaauuaucgccgaucaucucgggag

SEQ ID NO: 4167761 - RNA, 86 nt, Human
uuuccuaagcuggugauggcuauagucccagugggcuucuguuuugcuuccagggcucugugacuaucacugccucuaguaggaga

SEQ ID NO: 4167762 - RNA, 66 nt, Human
uuuccuaaguuaaaacuuauuaagcuaguugggcaaaauuaggaaaaaugagaugacuuagaggaa

SEQ ID NO: 4167763 - RNA, 101 nt, Human
uuuccuagucaugcaucaucugagccagagcuucccccgagugugguccggagaucccugggggcccucugguuagucuauaaugcuucaugaggaggaag

SEQ ID NO: 4167764 - RNA, 57 nt, Human
uuuccucacacagaagaucuugaaacuuucucuucaugucuucauccugugagggaa

SEQ ID NO: 4167765 - RNA, 69 nt, Human
uuuccucacuucaugagaguuucugauuaguauucagaaagaguuuucucugauggcauuagugggaaa

SEQ ID NO: 4167766 - RNA, 129 nt, Human
uuuccucagcaaagggcggagggaguggacgugggggaagggcaggugggcauuucuggagcaauacugccaucaagaggaacuggcuuggcaaucccgcgcacccuucgcugugcucgccuggggagg

SEQ ID NO: 4167767 - RNA, 61 nt, Human
uuuccuccuuccugccccccacucaucccuccacaccugagucuuggcaccaggagagaga

SEQ ID NO: 4167768 - RNA, 56 nt, Human
uuuccuccuuuucuucacugauaucaaugaaugggauuacaagguagaggagggaa

SEQ ID NO: 4167769 - RNA, 67 nt, Human
uuuccucgaucuggggugguauggugggugcuagaacaagcuacucagaguuccacucuaaaggaaa

SEQ ID NO: 4167770 - RNA, 97 nt, Human
uuuccucuaugaugacaucgcccuggggaagagaagcugagaggaacuccucacucagcuagcuucaggagccaugacaucaucucuaccauggaaa

SEQ ID NO: 4167771 - RNA, 62 nt, Human
uuuccucuucuucccaugucauuuugucuuccgguaaguuagggaugagguggaggagggaa

SEQ ID NO: 4167772 - RNA, 55 nt, Human
uuuccugagucagagacaccagccaagccaugcccagauuccugacucagagaaa

SEQ ID NO: 4167773 - RNA, 63 nt, Human
uuuccugccugugcuuuuggugucauauucaagaaaucauugccaagagcaaugcuaaggaga

SEQ ID NO: 4167774 - RNA, 56 nt, Human
uuuccuggucuauuuagaauugcccccugggaaugcaaggucuuucagaaaggaaa

SEQ ID NO: 4167775 - RNA, 64 nt, Human
uuuccuguaugucagugaagagcagggcacuucuguucuuggacagucacuggcauaugguaga

SEQ ID NO: 4167776 - RNA, 64 nt, Human
uuuccuguguuaacuaugaagcuguuuggagaugaacaccacaugcaacaggucagccaggaag

SEQ ID NO: 4167777 - RNA, 63 nt, Human
uuuccuguucaggaaaguuguguucuacaaagaaaagguuggaagacacccccugacagggaa

SEQ ID NO: 4167778 - RNA, 57 nt, Human
uuuccuguucuucuauuuaaaagggucacucuucuauuuaaaaagagucacaggaga

SEQ ID NO: 4167779 - RNA, 73 nt, Human
uuuccuuccuuacuccuuucuaccagccaucuccagggcagggauguggcuuggcagggaauauggggggaga

SEQ ID NO: 4167780 - RNA, 76 nt, Human
uuuccuucuuagcgguguucuuuggcuggagaagcagaaggcugggagccuacagcacaucaaagcagggaggaga

SEQ ID NO: 4167781 - RNA, 92 nt, Human
uuuccuugguuauggcaggugcaugguguauuggguucauguuuuuaguugacaacuuuugacacgugugcuaacuuucaggaugaaggaag

SEQ ID NO: 4167782 - RNA, 75 nt, Human
uuuccuugucaggcauuugaagcacuuacaaaaauuaaauguauuuauaaguguaguuucaaauguuuaaggaaa

SEQ ID NO: 4167783 - RNA, 58 nt, Human
uuuccuuuaugacaucaccacucugcaggaaggggcugaggugggguaagagaggaga

SEQ ID NO: 4167784 - RNA, 78 nt, Human
uuuccuuuuaagcagucggccugcccaaguucaagaagauuaguaaacagagauggagaggccuuguuuauagugaga

SEQ ID NO: 4167785 - RNA, 69 nt, Human
uuucgcuagaaggaaccuccuggugggauuaaucauccaaauucccauuagaaaggcuuucuggugaaa

SEQ ID NO: 4167786 - RNA, 80 nt, Human
uuucuaaugaaauugggggcacuuugagacugucaggguuuguuccugucucagaauggcucauaauaaacucacugaaa

SEQ ID NO: 4167787 - RNA, 56 nt, Human
uuucuacauguuuucuauugaaugucccuccuaggccacaauagaaacaguaggaa

SEQ ID NO: 4167788 - RNA, 55 nt, Human
uuucuacuccucauggcagguuguuuuuaaaagauuacauucagaggaguggaag

SEQ ID NO: 4167789 - RNA, 59 nt, Human
uuucuagauguuuuucucugaaauaguugacuggagacagagagaggagaguccaggag

SEQ ID NO: 4167790 - RNA, 59 nt, Human
uuucuaggaaguucagucuauacugauucuuauuuuauggaauggcuauuuucuaggga

SEQ ID NO: 4167791 - RNA, 61 nt, Human
uuucuaggacaugauaggauauuucaaucuguacaugcaaguuauccuucauuucuggaaa

SEQ ID NO: 4167792 - RNA, 56 nt, Human
uuucuaggcacagugucuuccccggcugaagugggaacugcaccuguguuugggaa

SEQ ID NO: 4167793 - RNA, 59 nt, Human
uuucuagugugcauagcagugauccccaaccuauuuuugcugcaaaaugacauuaggaa

SEQ ID NO: 4167794 - RNA, 59 nt, Human
uuucuauuccugaucuuauuggauccucaugguggccccagugugguuuaggauaggga

SEQ ID NO: 4167795 - RNA, 118 nt, Human
uuucuauugaugugggguggccaggacuuuaaguccagcacuacugcuguagggagacuccuaacaaggcuaugagagcuauggcaugaaguccugagcuucuacaagauaauggaaa

SEQ ID NO: 4167796 - RNA, 78 nt, Human
uuucuauuuggauuggguuggaaauaguguggcaauaugaaaaugagcauguuauguaucugcccagcuggagagaaa

SEQ ID NO: 4167797 - RNA, 68 nt, Human
uuucuauuuuguccuugucaugaagaguuaaccaaaaagugccacuguuggucagggauauugugaaa

SEQ ID NO: 4167798 - RNA, 86 nt, Human
uuucucacaauuuggauacagcuaugaggagauuggacaugaaaguuauuuuucaggacacagcugggauuuaaaguugugugaaa

SEQ ID NO: 4167799 - RNA, 72 nt, Human
uuucucacugugaugaugaagcaugguuacauuggcgaauuugaaaucauugaugaucacagagcugggaaa

SEQ ID NO: 4167800 - RNA, 56 nt, Human
uuucucccuccacuacaggcuccuaacacuggagugagcccaaguuaggggagaaa

SEQ ID NO: 4167801 - RNA, 60 nt, Human
uuucucgcguuugagcucucagacuggugggcgccaucaucccugagcaaacuugggaga

SEQ ID NO: 4167802 - RNA, 94 nt, Human
uuucucguuugccuucuuguuguucaucguuuauaacuauaguucuuuuggggcagagucuuagauaagugaccaaugggaggguggugaggaa

SEQ ID NO: 4167803 - RNA, 57 nt, Human
uuucucuauuaugcauuuugcugaugcugacagaagcaggcaggcuggauagagagg

SEQ ID NO: 4167804 - RNA, 85 nt, Human
uuucucuccccuuugcagcacuuuucaguuuccagcuuugucauucuguggccuuugcugugacaaugcugggaaggguuagaaa

SEQ ID NO: 4167805 - RNA, 97 nt, Human
uuucucuguguacuaacuuuguuuuauuaaguuuuggguuuuauuuuaaaugugcucaaagcauaagacaucuaaaguaguuagugggcgugaggaa

SEQ ID NO: 4167806 - RNA, 60 nt, Human
uuucugaaaucucuuuugaggaacucacguuacuuacaauuauagaaggagauucagaaa

SEQ ID NO: 4167807 - RNA, 81 nt, Human
uuucugaauacuuuuugauuuguguggccaaguccucagccaugauccaccaggccuagcaaguacauuaauaucaagaaa

SEQ ID NO: 4167808 - RNA, 77 nt, Human
uuucugacggcuccccaaagauaacggcuucuucuuuuuugcaagccagcaagcuguucuuggagaguacaaagaga

SEQ ID NO: 4167809 - RNA, 105 nt, Human
uuucugaugggaacggaaggugagcuggucuugaguguagcugaaucuaguggaugacaacuuuucacaggcuagcucuuucuucucuucucuguuuugcagaaa

SEQ ID NO: 4167810 - RNA, 65 nt, Human
uuucugcacauuucuaaaguugaaaggaaugagucuaucaucccaaagugagagaauggcagaaa

SEQ ID NO: 4167811 - RNA, 89 nt, Human
uuucugccacugaagcaauugagagauguuucugcuuuuuaaaauauaaagcauauauguaaaacaacuuaauugcuagguuccagaga

SEQ ID NO: 4167812 - RNA, 60 nt, Human
uuucugcuuaguuuaccggaggguauccagaguucuugaaacuuuaguaaacuaaggaaa

SEQ ID NO: 4167813 - RNA, 90 nt, Human
uuucuggaagcauuucuguauuuauggaagagaacaggacuaaagaacgauguguuuagcauguuccuuucauagagagccuuccagaaa

SEQ ID NO: 4167814 - RNA, 124 nt, Human
uuucuggcucagacccagucuuagcaucucaggaucuguuaaguuguuccauuuucuaaaaggcaauuggaacuugagaggaauucuaacauccuuugugcaaauggaugcugcaaaccagaaa

SEQ ID NO: 4167815 - RNA, 93 nt, Human
uuucugggauaaacaggggcaugaaaaaguggaagaugguugugggcacugccauguucuuuggcuucacagcucuuguucugauccgggaga

SEQ ID NO: 4167816 - RNA, 71 nt, Human
uuucugggcaaaugaauuucccugcaaaugaagugaauuauuauauauguaaaaagaucauuucucagaga

SEQ ID NO: 4167817 - RNA, 85 nt, Human
uuucuggguauaggcuguguuuaauaacucgacugaggaaguuuaauaacuuugcuccugacaguuuuaggcucagacccugaaa

SEQ ID NO: 4167818 - RNA, 56 nt, Human
uuucuggguucucacucucugauaggcagaucagaaauguacacgacacccagaga

SEQ ID NO: 4167819 - RNA, 69 nt, Human
uuucugucauugcaauaaaauuucaucagacacuuaaaaguuugagaaauuauaaugaauagacgggaa

SEQ ID NO: 4167820 - RNA, 84 nt, Human
uuucugugccauuccuuguguuaagugcuggggaaagagucaugagucuuccucuuauauagccuuggccaauugguagggaaa

SEQ ID NO: 4167821 - RNA, 60 nt, Human
uuucuguggauuuuccauucaaagaucuuaaucagucucuggaggaauaaagcacagaag

SEQ ID NO: 4167822 - RNA, 72 nt, Human
uuucuguguucuuuauuuagugaugcugguugacuacaagaaguauuuuuaauuagaagagaauuuaagaaa

SEQ ID NO: 4167823 - RNA, 83 nt, Human
uuucuguucccucagucacgucucaggacuuggggauguguggacaguuacauauaucaaauugaggcagcugggggaggaaa

SEQ ID NO: 4167824 - RNA, 96 nt, Human
uucuuuuuccuggacgccaggagcgccgucuagggacaauggagacauuuuucuccagcuuuuucccaguuggcucuggugcaggaaagcaaagaa

SEQ ID NO: 4167825 - RNA, 69 nt, Human
uucuuuuucucccuuuccuggaagauuggaaaccuuuagguuuuuauaagcaagaaagggaaaaaugaa

SEQ ID NO: 4167826 - RNA, 63 nt, Human
uugaaaagacaacagagaugacagacucuuauuuaucucuaggaguggaucuguuguuuucga

SEQ ID NO: 4167827 - RNA, 96 nt, Human
uugaaaaggaauggaaggcguaguagauguagauugaauuuucccugauguuuauaauuauuugcaauuacucaugucauuuucauccuuuuacaa

SEQ ID NO: 4167828 - RNA, 58 nt, Human
uugaaaauuguuguacuugauaauggagccuccuuguggggaaucagcaguauuucag

SEQ ID NO: 4167829 - RNA, 63 nt, Human
uugaaacucccucuccaucagauucugugugcccaaagaacuguccuuggaggagaguuucaa

SEQ ID NO: 4167830 - RNA, 129 nt, Human
uugaaacuggcacaaggugcaguggcucacaccuguaaucucaggacuuugggaagcucaggagggaggauccuuugagcccugcaggucgagguuucagugagcuacggcugccccgcuacacuccag

SEQ ID NO: 4167831 - RNA, 123 nt, Human
uugaaagaacgguuggugucugugugauuuuccuugagucuguucuucagugugucuucugcagcuugccaugacugccugggaaagaguagggaaauacccagagccaaaaccuccuuucag

SEQ ID NO: 4167832 - RNA, 70 nt, Human
uugaaagcaacuucugcuuucuuccuugccacaaaccuguccugaggcaaggaagcagaguugcuaucag

SEQ ID NO: 4167833 - RNA, 76 nt, Human
uugaaaguccaggacuguuucagcugaaccagagggcacacaauuugcaucacugaaacuguccuggguuagucaa

SEQ ID NO: 4167834 - RNA, 61 nt, Human
uugaaauacugcauuguucaguacuccuguuugggagucacuuagagugacgcagugucag

SEQ ID NO: 4167835 - RNA, 107 nt, Human
uugaaauauaaaugauguuugggagcaagcuacuuagggaaugcaugaauaaugcuuguugcauuccuuuuauuauaguuuauuccuagauuaucuuacccuuuuga

SEQ ID NO: 4167836 - RNA, 60 nt, Human
uugaaaucaccacuagcauuuguugaaaugccuucugucggcuaggcuggugauugucaa

SEQ ID NO: 4167837 - RNA, 103 nt, Human
uugaaaucagaaugcugggucgcuucucauucaagcaaaacagauggcccuccuugccacacuucugucaaacuugaggggaaaugauuaaaagcauuuucaa

SEQ ID NO: 4167838 - RNA, 80 nt, Human
uugaaaucauaagauguuuugaaugugagcaaauauugggaaauuuuaaaacucuauuuauggcaucuuuauggcuuuga

SEQ ID NO: 4167839 - RNA, 130 nt, Human
uugaaaucgccuggggagcuuuuaaaaaauuacugauguccaggccccaccccuagagagcucauuuaauugguccaggguggagcuuggacaccaguaauuuuuuuaaaagcuccccaggugaucuuaa

SEQ ID NO: 4167840 - RNA, 57 nt, Human
uugaaaugcagauuccaauccauacaccuagggaggggguuguguucuauauuucaa

SEQ ID NO: 4167841 - RNA, 83 nt, Human
uugaaauuaaaagauaacaguguugaggugcuuguuuccaugcauuugagaaauuuuagcugagccugugcuuuugauuuuga

SEQ ID NO: 4167842 - RNA, 111 nt, Human
uugaaauuaagcuuuugguuucuucuuguuaagaaugugccuuuugguuggcauuauaaaaugcuuaacacaugaaagcaccuucuuuugaagcugguacagugauuacag

SEQ ID NO: 4167843 - RNA, 99 nt, Human
uugaaauuuaagcuaugaaaucauugaagagauuuaauuggauuaacuuaauuuggauuagauuugaugcaauuggauugaagugaauuagaauuuuaa

SEQ ID NO: 4167844 - RNA, 71 nt, Human
uugaacaguuuggaacucuugcaacauaaacucauggaugagaguuaacacaaguaagauuccaggcucaa

SEQ ID NO: 4167845 - RNA, 129 nt, Human
uugaacccgggcagucuaacuccaguguccauauuccuaaccacugugccaaauaaugccuucuauauuaaggaggcacugcaguacagugacuagcauguaacuggaauguauuagauaacucaucaa

SEQ ID NO: 4167846 - RNA, 76 nt, Human
uugaaccuuuuuccaaguaaacaaagaagggauaaugagugaugccauccgacuuguuuacauggagaaucuucaa

SEQ ID NO: 4167847 - RNA, 130 nt, Human
uugaacuaaaugaaaaggugaccugaaaugagauuugauguugcucuuaacaguaugaugccaccaauuauauugcaauagaugcaucauuuuaaagguuuuaaauuacuuucuuugccuuuuuugucaa

SEQ ID NO: 4167848 - RNA, 93 nt, Human
uugaacucagcauucaaggccucacacaacagaugcaucuuuuauggguuuagaaaaugcuuguugagccuugacuaugugcuauguauucaa

SEQ ID NO: 4167849 - RNA, 128 nt, Human
uugaacuucagucccuccugacucgggcacccagcccuggcuuucugcucccuguguacucaaugguggucauagcagaggccguggcaggagaagcacaguggcaggagggcuggcacaagguucag

SEQ ID NO: 4167850 - RNA, 59 nt, Human
uugaagcaaggcgaaucuuguguguuccggacugaacugcaaguuuguucaugcuuugg

SEQ ID NO: 4167851 - RNA, 67 nt, Human
uugaagcagcucaggaggcuuagcuuggauaugagaaagcucagagacaccagagagcuguguucag

SEQ ID NO: 4167852 - RNA, 92 nt, Human
uugaagcucagaauggaaaacagagguuuccauugagguuucagcuaaaauaaauuuaaauuuaagccuuucuuugccaguuugugcuucaa

SEQ ID NO: 4167853 - RNA, 130 nt, Human
uugaaggaugagauauuuugcauugguaaaauguugugauuaaguuaagcuucaaaugcucaaagccuuuuaagcagcaaguguaacugaauauaauuuuaccauugcuugaugaacuagggucuuuuaa

SEQ ID NO: 4167854 - RNA, 74 nt, Human
uugaagggagaaauauguaaagaaagacaagccucuuacugaacagguggacucucauugccuucacucuucag

SEQ ID NO: 4167855 - RNA, 79 nt, Human
uugaagucaggacugugauccguaguauaucgagcuauauuagugauacaugauggguguauaguuuugaaaacuuuga

SEQ ID NO: 4167856 - RNA, 59 nt, Human
uugaaguccuaacucccaguaccucagaauaugacugaaucuggagauagggccuuuaa

SEQ ID NO: 4167857 - RNA, 69 nt, Human
uugaaguguccacugggcuuucucugcaccagguaucacaacuugcagggaaaacccaggaugcuuuaa

SEQ ID NO: 4167858 - RNA, 82 nt, Human
uugaauaaucauuauacaggcagucaagccucacugauuugaaucaguggagugggacuggucugauuauaaagauuuacaa

SEQ ID NO: 4167859 - RNA, 70 nt, Human
uugaauaguagucuuugaugucacacaagagaauacuguuggcuaacagucuggaggcugcuucauuuga

SEQ ID NO: 4167860 - RNA, 65 nt, Human
uugaaucucaucccaauguuguuuuguuguucugcaaaaguggcaagcauggagagagaggucag

SEQ ID NO: 4167861 - RNA, 60 nt, Human
uugaaugauuaaagucaucugaugaaaggugacugaagugugauguauuuaauuauuuaa

SEQ ID NO: 4167862 - RNA, 77 nt, Human
uugaaugcagaugcuuucuuaagucaguagguaguggugggugggccaccuggucaaggagagucucugcaacucaa

SEQ ID NO: 4167863 - RNA, 59 nt, Human
uugaaugcauaaauguacucugaaacggaaaccaaaauggagugcauuuuauguuucaa

SEQ ID NO: 4167864 - RNA, 70 nt, Human
uugaaugcaucuuugagcuccuuuuguccucugcauauguccacugaggagaggagggagguguguacaa

SEQ ID NO: 4167865 - RNA, 92 nt, Human
uugaaugugagguuuuucuucuuugaacuuuuuguaaguuagauucugaaacucugacuucaugaaauguucaauaagaccucaauauucag

SEQ ID NO: 4167866 - RNA, 67 nt, Human
uugaauuaagggccaauccuccagccugugcacacaguuugauaguaaugugagcucuuaauaucag

SEQ ID NO: 4167867 - RNA, 57 nt, Human
uugacagagcuaggucaacucugcuucacaggguguugguugacacuggcucuucag

SEQ ID NO: 4167868 - RNA, 70 nt, Human
uugacaugaugcauccugucaaaggaccacuuacaaaguuggaagguucauuuaugauguaacaugucaa

SEQ ID NO: 4167869 - RNA, 64 nt, Human
uugaccaagaggccacccuaugggucccagucaacccggcagacccauaauugagccuagucaa

SEQ ID NO: 4167870 - RNA, 65 nt, Human
uugaccaaugggcuuggagcauugagaccacacccuauucugaguucuaguguggcccugguuaa

SEQ ID NO: 4167871 - RNA, 77 nt, Human
uugaccagaugaggcucuuggggcugaacccugccugggagcagcuccagagccacauccaucauacagcuggucaa

SEQ ID NO: 4167872 - RNA, 58 nt, Human
uugacccuggcagcccgggcaucgucacucuccauguccaggagcucauccacgucaa

SEQ ID NO: 4167873 - RNA, 61 nt, Human
uugaccucagugagaugcucagcgaaguccaaaggcuauugcugacugucuucugagucaa

SEQ ID NO: 4167874 - RNA, 83 nt, Human
uugaccucaucucugugagauuuguauuaaggaaaacuucacagaagaagugacguuuaauucgggucuuaagaaugaguuaa

SEQ ID NO: 4167875 - RNA, 67 nt, Human
uugacuagugcccucagaccuagaacacucuagcccauaauguucucuguucauggcacuaugucag

SEQ ID NO: 4167876 - RNA, 84 nt, Human
uugacucacgccucgggcuggcucccuaccucucccaggaguucagagccugcguguggggcaguggccugggagcaaagucaa

SEQ ID NO: 4167877 - RNA, 75 nt, Human
uugacugccuggcugugcagucuuccagaagagcacggcauggacuucuggaauucuugcagccacucgacucaa

SEQ ID NO: 4167878 - RNA, 90 nt, Human
uugacuggaauggacccaaggaauacccucccuuuuugccuauugaagaggcuaagcaggagaugggugcuuuucauguuagccagucaa

SEQ ID NO: 4167879 - RNA, 64 nt, Human
uugacuguaaagcuuuucucaugcggaaauauggaugaucuguauagaaagguuuuggcauuaa

SEQ ID NO: 4167880 - RNA, 77 nt, Human
uugacuugacauuguacuaugcauaugaccccaagcuuguuacuaaauaagacuuucauaguauaguauuaaguugg

SEQ ID NO: 4167881 - RNA, 90 nt, Human
uuggaacuuaaugaauuuuagaacauauguguugaauauuugaggacagauuugcaaccucuguaauguucuaggagaaguugagcccaa

SEQ ID NO: 4167882 - RNA, 64 nt, Human
uuggaacuugagaauauuggcugugauuucaaucaggaaugagucuagcucugucuuauuccaa

SEQ ID NO: 4167883 - RNA, 82 nt, Human
uuggaagaauauggggguacagaaguucuaaccuaacaauccaggucaagucaauaaaucugacucccauauuccacuucaa

SEQ ID NO: 4167884 - RNA, 73 nt, Human
uuggaagcagagaccagguccucaccagacacugaccugcuggcaccuugaccuuggacuucccagcuuccag

SEQ ID NO: 4167885 - RNA, 84 nt, Human
uuggaagccauuugucaagguuggcagggcagagauacagccucugaguaucugaugaccuguccugccaguccuggacuccga

SEQ ID NO: 4167886 - RNA, 65 nt, Human
uuggaagcccugugauaggccagaucucauuuauagauauguuucaugaugcucacaggguccaa

SEQ ID NO: 4167887 - RNA, 82 nt, Human
uuggaauuuaauuaccuucaccagcgaauguuuggagaaccucucuccaucaauugauucugaagucagauuuuuauuccga

SEQ ID NO: 4167888 - RNA, 98 nt, Human
uuggacaaggugauuguauaggaaugacgucauuuccuugauugggcaacauaaacccugaggaagcccuugucauuucuguaaguuauauuuuccaa

SEQ ID NO: 4167889 - RNA, 61 nt, Human
uuggacagaauuuugugugugugcuguccacaagccauggggugcauggggugcuguccag

SEQ ID NO: 4167890 - RNA, 58 nt, Human
uuggacaugagcugagugggugugggugugagcccacgcaagcaucaucucuguucag

SEQ ID NO: 4167891 - RNA, 81 nt, Human
uuggaccuuguucauagcacuuguguuaugccuugugccauuaucauuuguauacacacugaguguccccacuagguuuga

SEQ ID NO: 4167892 - RNA, 56 nt, Human
uuggacgcuaaacucugugagcgugaaguucacgccucauuuauuuuuguguccaa

SEQ ID NO: 4167893 - RNA, 91 nt, Human
uuggacuacuuaguaucuaugauccuuuauaucucucaauuuucaucaugugaguaaaggauuagagaugucacccaggaguguuguccag

SEQ ID NO: 4167894 - RNA, 66 nt, Human
uuggacucuuuuucuacguagccauuugagaauugccacuuuauugggcuugggagagggagcuaa

SEQ ID NO: 4167895 - RNA, 60 nt, Human
uuggagaaagacgacugcaauuuguuucuacauguguggagugaguguguguuucucuaa

SEQ ID NO: 4167896 - RNA, 82 nt, Human
uuggagacagcagcuuccugacuguacucauuuacauggcuaaucaccaugagcagcacuugucaggcagcucuaucuguag

SEQ ID NO: 4167897 - RNA, 77 nt, Human
uuggagagcuuuccauguguacuggccagaagcagaagggagcugcuuuagguuuuuucacguggcuaagcuuacaa

SEQ ID NO: 4167898 - RNA, 87 nt, Human
uuggagauagcugaaagaaaguuuagauuaaguuuaucucucaaggcaauuuuauuagauagauuaaguuucuguucauaucucuga

SEQ ID NO: 4167899 - RNA, 66 nt, Human
uuggagauuugaguagaacuuuugcauaaagacuugauuuauuauguaauuuguuugcucuuccaa

SEQ ID NO: 4167900 - RNA, 75 nt, Human
uuggagcagaagcugaagccggaucaaaaaguccuuaagaaagcugggcuugccuacucgcuucagcagcuccag

SEQ ID NO: 4167901 - RNA, 69 nt, Human
uuggaggacagugugagaugauugaggagcaaaugccuuugcccugaauuuuuuaccuagucuuuccag

SEQ ID NO: 4167902 - RNA, 62 nt, Human
uuggaggcuucuggaaagccuggcaguugguggagugcugcuggagcccaggcggccuuuga

SEQ ID NO: 4167903 - RNA, 76 nt, Human
uuggagucagaagguaugaauuggaauacuaguuguacugacugugugacuuucaauagcauacuuuugcucucaa

SEQ ID NO: 4167904 - RNA, 79 nt, Human
uuggaguccuuagcacagccaaaauagagcauggaggggaaaaaauccuguagguucuggcauugcucaguaaacccaa

SEQ ID NO: 4167905 - RNA, 58 nt, Human
uuggaguuccuuugaaaggcucugcuuuuagucagaguagcuauuuugggaacucgaa

SEQ ID NO: 4167906 - RNA, 58 nt, Human
uuggaguuggggcuuccuugccugcuucacaggucaggcugagcucucccagcuucag

SEQ ID NO: 4167907 - RNA, 83 nt, Human
uuggauaaaaggacaaaaugguacagaauguggcagucacuguuaguugucuauucaauauccauuucuucuuuacaaaccaa

SEQ ID NO: 4167908 - RNA, 87 nt, Human
uuggauagaggggugcagguggggaacagggguaccaagggagaucauggaauguuuccccagccugcaaucuccccuccuaaccaa

SEQ ID NO: 4167909 - RNA, 76 nt, Human
uuggauuuuccugaagaacgaagucauguagucugagucaaagcagaauacuugacauuucuuuaggguuauuugg

SEQ ID NO: 4167910 - RNA, 92 nt, Human
uuggauuuuuauguagugugagguagcagcccagcuuuacuuucuucuaauuggaaagcuguuuuuuccucaccacuuaacuaaauaaccaa

SEQ ID NO: 4167911 - RNA, 59 nt, Human
uuggcaaaaccagguagcaaaggagacauguguuaugcagagucccauccuggugccag

SEQ ID NO: 4167912 - RNA, 72 nt, Human
uuggcaauuuguaucuucuaauauuaucuccuucuaaccauacuggggauaauucuagcagauacaggcuaa

SEQ ID NO: 4167913 - RNA, 64 nt, Human
uuggcacucugcaauguggcaagaacauagucacuggcuuguuccagcucauauugaggaccaa

SEQ ID NO: 4167914 - RNA, 75 nt, Human
uuggcacugaccaaagaaguccagugagcaucccuguaccugcucacagggagggaggauucuuugaagugcuag

SEQ ID NO: 4167915 - RNA, 58 nt, Human
uuggcagagggaccagccuacaggaacuacaccugcagaagagcucagccacugccag

SEQ ID NO: 4167916 - RNA, 62 nt, Human
uuggcagcagagaaauuaaacuucugccauugguuuggggauuuguuuuucuguucagucaa

SEQ ID NO: 4167917 - RNA, 78 nt, Human
uuggcagccuggaagagcucauauaugguaacuauagugauuauuauuaccaugaucaggcucauccuuguuugcuaa

SEQ ID NO: 4167918 - RNA, 56 nt, Human
uuggcagugucugcaaaauggaauauuuaauaccuaugaaaugcacucacugucaa

SEQ ID NO: 4167919 - RNA, 64 nt, Human
uuggcauuacaggaacuggauauaaugugagauuguuuucuucauuaauuuuuccagaugucaa

SEQ ID NO: 4167920 - RNA, 68 nt, Human
uuggccaacaaaaacagcugcuucaguacuugaacccaugguuuuggcuccguagcucuuuuagucaa

SEQ ID NO: 4167921 - RNA, 55 nt, Human
uuggccagugaaccaggccuggcuucaucccacccaaggcuuggauuguggccaa

SEQ ID NO: 4167922 - RNA, 76 nt, Human
uuggccauagguauucucuuguuagugguuuggaacagcauuuuucagagucuaugcaacagaauucuguggucag

SEQ ID NO: 4167923 - RNA, 79 nt, Human
uuggcccagugccuggcacccggcgugcccagggccgugagcugggcaugguccugguagcggugugcuuccuggccaa

SEQ ID NO: 4167924 - RNA, 65 nt, Human
uuggccggugggugaagaguacagagggauguuacuauacuuaauuugauucuuccucuccccag

SEQ ID NO: 4167925 - RNA, 79 nt, Human
uuggccugcgggucucgugagcuggaagaaaucaggaaagggaagcugagcauuuaauccuacauagaucacaggcuaa

SEQ ID NO: 4167926 - RNA, 76 nt, Human
uuggccugugagccuuaguuuauagauucucaccuguauggaacuauguaaagagaaggcuuauaaaguggcacaa

SEQ ID NO: 4167927 - RNA, 64 nt, Human
uuggccuuugcugggcuguugagaaugagggcaacuuucccugugaggacacccggcuggccaa

SEQ ID NO: 4167928 - RNA, 95 nt, Human
uuggccuuuggaugauaaugaugugucaguguagguucaucaguccuaacaacuaaaugaaacuaaacuacauaaguuaaacuaaagcuugccaa

SEQ ID NO: 4167929 - RNA, 65 nt, Human
uuggcguauaguguccuauuggcagguuucccauguguacuuguaaguggaagguuauaugcuaa

SEQ ID NO: 4167930 - RNA, 74 nt, Human
uuggcguauuaagggcaaggguugaagauaagauagcaaugucuacuuuauauuuuugguccugacuaugcuaa

SEQ ID NO: 4167931 - RNA, 60 nt, Human
uuggcuaucacuaggcagguuucccaggaugucacccuggucucagccugugagagcuga

SEQ ID NO: 4167932 - RNA, 57 nt, Human
uuggcucaggaccccugugacugccagggcacuggucccagcacugccugagugcag

SEQ ID NO: 4167933 - RNA, 56 nt, Human
uuggcucccacuaacuccagcaguugcacuuugccuggaacacaguaggcagucaa

SEQ ID NO: 4167934 - RNA, 98 nt, Human
uuggcucgacuggguaacuuguucuguuuacucuuguuuugggcagcaccgauugcccuagggcuaagcaggacugccaccccagacucgauugccaa

SEQ ID NO: 4167935 - RNA, 70 nt, Human
uuggcugaagauaagugaagaggcugacuagcaauggccacuagccuacuucucuugcauucuuuaucga

SEQ ID NO: 4167936 - RNA, 130 nt, Human
uuggcugguugaaaggaacacuugauucuuugucagaaagcagccuugcgcuucuaaggggucugcugucugaaagaagccuucgaggcucgcagaccuggggaagaacucaaccugccuucagcccaug

SEQ ID NO: 4167937 - RNA, 71 nt, Human
uuggcuguagggcauuaauaauauuauguacuauuagugcguuaauaacauuaauaaugcccuauagccaa

SEQ ID NO: 4167938 - RNA, 59 nt, Human
uuggcugugcagaucuugccuacuucauaaagaauuugaaguagguuacagccagccag

SEQ ID NO: 4167939 - RNA, 100 nt, Human
uuggcuguuucucccuagcuaggcugggagccugaggcuaggggcuugguaccacuggcaccaggguuuccagccuuggguagcucaggagacggcucag

SEQ ID NO: 4167940 - RNA, 70 nt, Human
uuggcuucauugaucucacuuucuucaaaauacuuuuugaucauuacauugaaguggucaaugaaggcag

SEQ ID NO: 4167941 - RNA, 71 nt, Human
uuggcuucuucgcacagcaguagucuucuaaaucucauuuuggacuuugcuguaaagagaagaaagcacaa

SEQ ID NO: 4167942 - RNA, 55 nt, Human
uuggcuuggagaguugaaauguuaauuugaugugcacaucuauucuuaaagccaa

SEQ ID NO: 4167943 - RNA, 129 nt, Human
uugggaaaaggauauucuuguuuuaggaauccugacuccacuaaucagcaaauguuuaucaaauacuuauguaugaaacauucagcuggguggagcagaagauaccgaccuauaaggaaagcauccuaa

SEQ ID NO: 4167944 - RNA, 83 nt, Human
uugggaaauaagacuuuaaguccuaucugugcgacuuuaaaugagugaugcuagucuugggggcuuaaguagcuuauuuacaa

SEQ ID NO: 4167945 - RNA, 85 nt, Human
uugggaacagaggucaccuuuguaucuuccacaaagcuuugcucgguaagaaugcauaaagguacucaauuuauacuguuccuag

SEQ ID NO: 4167946 - RNA, 63 nt, Human
uugggaagaagggggagaagggugguaaccaggggcaacccuccuuucucucccucaucccga

SEQ ID NO: 4167947 - RNA, 66 nt, Human
uugggagauucauugagccaagauguuauuuuggaaggaucuuugagcuuuaagugauucucucaa

SEQ ID NO: 4167948 - RNA, 83 nt, Human
uugggagcgaggcagggucagcuggcugucaggggcugaaagaggcuuggccacuggcauccagcugccaucccagcucccaa

SEQ ID NO: 4167949 - RNA, 59 nt, Human
uugggaggcugagguuggcagaucaccuaaggucaggaauuugagaccagucugcccaa

SEQ ID NO: 4167950 - RNA, 58 nt, Human
uugggaguagcccagguucagggguuguuaaugcccugggcauggguggggcucccag

SEQ ID NO: 4167951 - RNA, 77 nt, Human
uugggaguugggauucuuagucugaaugggcuuguuuucagaaucucucagaacagcucucagauauccacuaacaa

SEQ ID NO: 4167952 - RNA, 124 nt, Human
uugggcaucacugaauugcauguggcuugucuucaggguucuuguaccuugaaauuaucucucuuaauucccagguucucagaaggcagucacaucuggacagcauuccuugacuacgcaucaa

SEQ ID NO: 4167953 - RNA, 81 nt, Human
uugggccagugacccuuggaguaggauguauagcaacuaaagaaacucauacauuacugagaaggguguaaauuggcucaa

SEQ ID NO: 4167954 - RNA, 64 nt, Human
uugggcuagauaauuauuugugaauagggagcuuuccugugcauuguaggauguuuagcagcaa

SEQ ID NO: 4167955 - RNA, 77 nt, Human
uugggcugagacuuauaaccuggauucuggcacuaaccacaguuagagccauggacgaguuaguuacccucgcccag

SEQ ID NO: 4167956 - RNA, 79 nt, Human
uugggcuuggaggucuuacccagggcuauuaauguuuuguaauugaaaccauggauuuggaugagauuacuuaacccaa

SEQ ID NO: 4167957 - RNA, 65 nt, Human
uugggcuuggucgguuugaggcuuuuucucucccauugacaauugucucgagaccugacccccaa

SEQ ID NO: 4167958 - RNA, 65 nt, Human
uugggcuuucaaaaguauuguuucugaucugggaucaagaacuuauuuuggaaauuagcacccaa

SEQ ID NO: 4167959 - RNA, 99 nt, Human
uuggggaggucgaggccaggcucccacuuggcuuaaagggacauuuucagacauuucuuucugucacuuggggugucuaugccucucaaauuucccuaa

SEQ ID NO: 4167960 - RNA, 85 nt, Human
uugggggaaaaaaugaucuguggaaauuuccugaggcaaacuaugaaguuguuucuugauuuacagacuugucuuuccuagucaa

SEQ ID NO: 4167961 - RNA, 90 nt, Human
uugggugcccugucugugccaggccugggcuggguaucaggaaacaccuuccugccccucaaggccuggugcgcacauucggauacccaa

SEQ ID NO: 4167962 - RNA, 64 nt, Human
uugggugcucugcuucccugcacucacagauauuucccagggucagggaggcagugucaccuga

SEQ ID NO: 4167963 - RNA, 129 nt, Human
uugggugggaaguggcagaaugguuaugcacaaggagaaauagauauugacauacugaggaauacuuagauucgucgauuucucaguguccuucguucuuguuguuucauuugucuugauuccccaaaa

SEQ ID NO: 4167964 - RNA, 87 nt, Human
uuggguuaacuagauucagcugggaaguucucgcuuggggacuuuuugugacugcaaguugaagucccaguugggcuguuuuucuaa

SEQ ID NO: 4167965 - RNA, 97 nt, Human
uuggguucucugcccaggcccuuccucagaagaaccccuagauuaugguuuuagccagaauuuaggguuuuguggauugggcuuaggauggacucag

SEQ ID NO: 4167966 - RNA, 74 nt, Human
uuggguuuaguuggugcucauugcagccacccauacauguguguucagaugcugagaaccacgacugugcuuaa

SEQ ID NO: 4167967 - RNA, 73 nt, Human
uuggguuuugauacaugucuaaucagacugauuucugucacauauagaaauuuagauacuguauuaaaccuag

SEQ ID NO: 4167968 - RNA, 87 nt, Human
uugguaagucacugaacuaaaugauauuuugguuuccucaacucuaacauggggaagauaaucauaucuuuuuuaauggguuaucag

SEQ ID NO: 4167969 - RNA, 60 nt, Human
uugguacaaugugcuagguaggcacuuguucacuuauucagcaagaccaccauguaccag

SEQ ID NO: 4167970 - RNA, 74 nt, Human
uugguacuagccuaaauaugacuauaccaacuuaccaauauaauccgguacuucaauuauuuuggcuaugcuaa

SEQ ID NO: 4167971 - RNA, 59 nt, Human
uugguagaauuuuaauaauggagauguuaacaugcauuaugcugauaagauucuaucag

SEQ ID NO: 4167972 - RNA, 72 nt, Human
uugguagcagaaacuggagagcugccacagaagagugaucuccugggcuugcuccuccagcugaagacacag

SEQ ID NO: 4167973 - RNA, 68 nt, Human
uugguagucuguugggcaccauuugggaaagaaauaaauuggucucaguguagcagacuuguagccaa

SEQ ID NO: 4167974 - RNA, 119 nt, Human
uugguauauucagauuuuuggauaacagacugacaguuuuauuugcauaauuauaaucagcauuguacauagaaaggauacagcugcuuuuuguuaaauccacacuuucuaaaugucaa

SEQ ID NO: 4167975 - RNA, 95 nt, Human
uugguaucuuaaauauaaccucuauauaacuuguuuuucuuuaguguucaaaugguaauguauacuugagguagcaacuuaaggguuugaaccaa

SEQ ID NO: 4167976 - RNA, 93 nt, Human
uugguauucagaguuuggggauuuuggaauugcucauaagagagaacaugagucugucucagucaauuucaccacuaaauaaaugaguuucag

SEQ ID NO: 4167977 - RNA, 61 nt, Human
uuggucacacaauacaaaggaaggcuacaagaagucaaaugcugucauuuguugugacuag

SEQ ID NO: 4167978 - RNA, 65 nt, Human
uuggucacagggaugagcagguaucuaagacugggcugaugauagaacuccaucccucugaccaa

SEQ ID NO: 4167979 - RNA, 57 nt, Human
uuggucacuaaauaucugcagcauguuuuaugacaugcaccagagcagggugcccaa

SEQ ID NO: 4167980 - RNA, 64 nt, Human
uuggucaggcauguggcgcaugcuauuccugagcaggucgggcagcuggugcuugccuggcuaa

SEQ ID NO: 4167981 - RNA, 58 nt, Human
uuggucauauuaauucaaucggugaauaaccacaaauugagcuaguaauauagaccag

SEQ ID NO: 4167982 - RNA, 61 nt, Human
uuggucccugcuaaaucugacugaaaacuguacaguacacagaaauuguguagggauucaa

SEQ ID NO: 4167983 - RNA, 69 nt, Human
uuggucuuugacuuuguuugcaagaauaagugacuuuaagccuuuugccagcacaaguuaagagaucaa

SEQ ID NO: 4167984 - RNA, 130 nt, Human
uuggugacaaaagguaaagcuuucccaccuuccuucugucucauucaucuauccaggauguuuauaccuguagauuagugauaugugacuagaccaggauucggggauuugcaaugcugaccguuaaaaa

SEQ ID NO: 4167985 - RNA, 63 nt, Human
uuggugcaaauuccuguaagagauucuuuuagucauauauuucucaaggacuuugggcacuaa

SEQ ID NO: 4167986 - RNA, 59 nt, Human
uuggugcucucuaugacaugaacccaaucauaagccaggggacaaagggagcccaccaa

SEQ ID NO: 4167987 - RNA, 55 nt, Human
uugguggauccuccugaaagcagaccuaaugacuaacagcccagggugcuaccaa

SEQ ID NO: 4167988 - RNA, 114 nt, Human
uuggugguuauaaaauaccuuaagcucuucagauaaaagggauauuagugcaaaauacuaauaagcauuauuauuauaaguggucugagcacuaagguguuugcuuaguacugg

SEQ ID NO: 4167989 - RNA, 64 nt, Human
uugguuaguaacuaagagaggcacccuuggcaauuucacaaagugucuaacugguuacuucuga

SEQ ID NO: 4167990 - RNA, 80 nt, Human
uugguuauugcauuguaucuaauaauucugaugauaggauugaaguccuguuuguuggcuauugacaguguagaggucaa

SEQ ID NO: 4167991 - RNA, 81 nt, Human
uugguucauuauuuuuuagucuuuugaauuguuuagucauccucagcugacuagauggcuuucugagguauuuagaaccag

SEQ ID NO: 4167992 - RNA, 58 nt, Human
uugguucuggaggcaacuaaccuaguucaugaguagcaugagcuugccuaagcucuaa

SEQ ID NO: 4167993 - RNA, 55 nt, Human
uugguuguuuacacugcagaauuggggugaguuccagcgaagguguggcaauuaa

SEQ ID NO: 4167994 - RNA, 84 nt, Human
uugguuuccuugacucuguuugguaaaggcuguccuaauuguaugcaagagauggcagacacaggcaggcagaggagagaucga

SEQ ID NO: 4167995 - RNA, 64 nt, Human
uugguuugaguccuuacaggcuagucuaggauuuuucuuagaaagcaguugugggggcucccaa

SEQ ID NO: 4167996 - RNA, 89 nt, Human
uugguuuuaguuuuuuguuggguagaacggaaaacacagggcaagauccuaaagccccacaguuccucauccaggaaagcgaaaaccaa

SEQ ID NO: 4167997 - RNA, 69 nt, Human
uugguuuugaaauagcuuauugucuacauguaagaauuaagcaaagacuucggcuguggacaagauuag

SEQ ID NO: 4167998 - RNA, 80 nt, Human
uuguaaaccaauucuuaaaguagaauacaagaccugcaaaaacagguaugcauuuuuacuuuagggaaagagggauacga

SEQ ID NO: 4167999 - RNA, 105 nt, Human
uuguaaaggauguuugaugagauugugaaauauuuaaaauguggucaguaaagucuguuucauauaacuggauauuuucaaaauuauauuuucuauuuuuuuuaa

SEQ ID NO: 4168000 - RNA, 60 nt, Human
uuguaagacauggaauguuggagcuggaaggaaacucccaguucauccccauguuuucaa

SEQ ID NO: 4168001 - RNA, 59 nt, Human
uuguaagcacagaaucucuccuuacgugacugaccuucaagagacccuguagcuugcag

SEQ ID NO: 4168002 - RNA, 76 nt, Human
uuguaagcaucugucucuucugcacuuuucagugaggcuggaaagauggagauguugaaggacuggagcuuugcag

SEQ ID NO: 4168003 - RNA, 58 nt, Human
uuguaagugcuuguuagaaaaucccuggaggcagagauaguucuggauguacuuauag

SEQ ID NO: 4168004 - RNA, 66 nt, Human
uuguaauguucauugauuaaaugaaugaguggacaucucauucauuuaauuaaugaacucgugcag

SEQ ID NO: 4168005 - RNA, 56 nt, Human
uuguacaaauaggaaccucugaugucauucuucaacguuuguuccuguguguacaa

SEQ ID NO: 4168006 - RNA, 56 nt, Human
uuguacacacaggaacaaacguugaagaaugacaucagagguuccuauuuguacaa

SEQ ID NO: 4168007 - RNA, 55 nt, Human
uuguacagacccugaaaagcucccuuggcuauuugauccuuucaguucugugcaa

SEQ ID NO: 4168008 - RNA, 56 nt, Human
uuguagaguacacaacacuuggagccugcuauggcuugaauguuuguccucucuaa

SEQ ID NO: 4168009 - RNA, 60 nt, Human
uuguagauggcuuauuucugugccaaagugucaauacuggaguagaagugugcuauacaa

SEQ ID NO: 4168010 - RNA, 129 nt, Human
uuguagauguucuuuaucaguuuuaggaaguuuucuucuauuccucauuuguugagaaccacaaaacgcaggcuggugguuuucucugaggaaggagagaaggagauggaauugggaagaagcaaaaga

SEQ ID NO: 4168011 - RNA, 85 nt, Human
uuguagccagggaccccugacucauuaggacucaagacaccuaccugguuucauagccuucuaaugaguugucgccggguugcaa

SEQ ID NO: 4168012 - RNA, 62 nt, Human
uuguauauauuuacgggguacaaugugaucuuuugaucaauguacauuguagaaauauucaa

SEQ ID NO: 4168013 - RNA, 69 nt, Human
uuguauguaaaguuauagugggcuugcuuagagauuuuucugcuaaguuacacuuaacuuacuaggcaa

SEQ ID NO: 4168014 - RNA, 59 nt, Human
uuguauuaguaagucagcugcuugguuucaugucaccauagccugacuauucuggacaa

SEQ ID NO: 4168015 - RNA, 90 nt, Human
uuguauucggucagugcaaaaguaauugugguuuuugccauuacuuucaauagcaaaagccacgauuacuuuuguaccaaccuaauauaa

SEQ ID NO: 4168016 - RNA, 112 nt, Human
uuguauuggaagggaagagggguuugaggucaauucuguuuccugggguuuucacgaauuucggggcccacaguaggcuugccaacuuuaacuuuugccuaacacuuuacga

SEQ ID NO: 4168017 - RNA, 78 nt, Human
uuguauuuaucugaagacauaugauauggugcaucauuucacaugcuuauuugcuaucuuauaucuucuuuggugcag

SEQ ID NO: 4168018 - RNA, 69 nt, Human
uuguauuuugcaacacaggcuacuucacguucuauuuuaagcuugaaguuguuaagguugccauuacag

SEQ ID NO: 4168019 - RNA, 63 nt, Human
uugucaagcaccaugauaagugguggaaaauaaugauucugacacuugaaugguguuuuacaa

SEQ ID NO: 4168020 - RNA, 58 nt, Human
uugucaaugcccagauuaaucacaggacagauacucaggaagauuuggucauugauaa

SEQ ID NO: 4168021 - RNA, 130 nt, Human
uugucacacacuggaaaacgagcgaguuucuauuucaggcuguggggugaguuagcgucggcuuggccggcugucuggcagaggcuccgauucaucaaugacagcuaagugugguuugcugugugucagg

SEQ ID NO: 4168022 - RNA, 71 nt, Human
uugucacauuugcuaucccacuccuuagggcgucuucucuuaauaaccaggcaguggugguaacaugucaa

SEQ ID NO: 4168023 - RNA, 73 nt, Human
uugucagcaaagugcuuauuguuuuaaaccauugaguuuuggggugauuuguuaugcagcauuguuguggcaa

SEQ ID NO: 4168024 - RNA, 64 nt, Human
uugucagcuggcagguuaaauucuaaauuagacgcaacaccugaaugagcaugcgagcugagaa

SEQ ID NO: 4168025 - RNA, 75 nt, Human
uugucagguacuuuuggaguauuuucagucuugaccaagucugaaguuaguuaugccuaaaagauuccuggacaa

SEQ ID NO: 4168026 - RNA, 89 nt, Human
uugucaguuauuuugugcuauacacagauggccaauuauucagagaacuugauaaagcaauagauuguguaaugcgaaaauaaagacaa

SEQ ID NO: 4168027 - RNA, 59 nt, Human
uugucaucaagaugcauuggucacauucacugagugacacuuugggucuugggugauaa

SEQ ID NO: 4168028 - RNA, 62 nt, Human
uugucauucugccaauuuguuaguacauaaagaucagcugaaaacaaauuggcaaaaugcaa

SEQ ID NO: 4168029 - RNA, 76 nt, Human
uugucauuggaaucucuuugucccugaguuucagaagcaaauagugaagcuuugggcagaagaggauucaugggaa

SEQ ID NO: 4168030 - RNA, 67 nt, Human
uugucauuuccuuggcauugcuagagauggguugaagaauagucuggcaguaauaggggagagacaa

SEQ ID NO: 4168031 - RNA, 77 nt, Human
uuguccaagacugggagcagagagcggaagaugcaggaaaaacugcuagagucaaaucucugcccccagacugacag

SEQ ID NO: 4168032 - RNA, 59 nt, Human
uuguccagcugcagcugggcagaacucaaggaguuguggucccccacugcagcugacaa

SEQ ID NO: 4168033 - RNA, 73 nt, Human
uugucccugcuguccccugagccuggacaaucucuguccuccugauaugcuuagugacagccuuuagggccag

SEQ ID NO: 4168034 - RNA, 73 nt, Human
uuguccuggguggaugcuucauuguuaccaugaagaauugugggucaggaagugagcauuuaucccagcauaa

SEQ ID NO: 4168035 - RNA, 69 nt, Human
uuguccuggucaggguaguguugcagauugagucagaugaugucugagaacaugcuuugaucauugcaa

SEQ ID NO: 4168036 - RNA, 65 nt, Human
uugucggggucacucagaagcucaucuuuguuuggccauuuguugggcuaagagugaccaggcag

SEQ ID NO: 4168037 - RNA, 69 nt, Human
uugucuauggcuguguucaugcuacaacagcagcaguauguaguuguuacacagaccauagucccacaa

SEQ ID NO: 4168038 - RNA, 64 nt, Human
uugucucugcucaaaggcuggggaggcauccucugugugugcucccuugccagaggggaagcgg

SEQ ID NO: 4168039 - RNA, 60 nt, Human
uugucugaaccaucucccuggcccagcacccgggauuuauccugggagguguucagagaa

SEQ ID NO: 4168040 - RNA, 65 nt, Human
uugucugaaggccugaccuacauugccccuaggauauaggaagaaggacaaggcauuucagagaa

SEQ ID NO: 4168041 - RNA, 58 nt, Human
uugucugagagauggcagaggugggugaggcaccacagcucugucuuucucuuaguaa

SEQ ID NO: 4168042 - RNA, 97 nt, Human
uugucugauguauuuaaauuuauucacagaaaauucauuuauguggaagaauuuggggauaaauuuuugguagauacauagaaaacagagcagacag

SEQ ID NO: 4168043 - RNA, 77 nt, Human
uugucuguccucuugcuuggccucuucucagggugggcucugcucucccuccccagggccaaaggauucagaggcaa

SEQ ID NO: 4168044 - RNA, 68 nt, Human
uugucuuucaguuuuauuguacugcuauccugaaauagauguuagcucagagaacugguaugugacag

SEQ ID NO: 4168045 - RNA, 80 nt, Human
uugucuuuccugaggaguauggcuguaguuacagauacauaucuaacagaaagcagucauaucauuccaacagggaacag

SEQ ID NO: 4168046 - RNA, 68 nt, Human
uugucuuucuugguauaaagcagggauauccaaucuuuugacuucccugccuauauuaaaagaagcaa

SEQ ID NO: 4168047 - RNA, 69 nt, Human
uugucuuuuuguagaacugauaucgaugcugagaucuaaaguagaagaagucagcccuacagagagcag

SEQ ID NO: 4168048 - RNA, 75 nt, Human
uugugaauagucagcauuuuguuagaaucagcccguuguguuaagggcacuauaauugguacugauuauguacaa

SEQ ID NO: 4168049 - RNA, 57 nt, Human
uugugagacucguaagagaagggcuucggucagcugccuucuccacagggucuccgg

SEQ ID NO: 4168050 - RNA, 69 nt, Human
uugugagcaggaaggagcacaggacccugacauuugaugagauacagcaguuugugauccuagcagcaa

SEQ ID NO: 4168051 - RNA, 79 nt, Human
uugugagguguuguuuucuuauuguuuauuaucaagguaaaauacacaauaaacugguaggaaaacaguaaauucagaa

SEQ ID NO: 4168052 - RNA, 88 nt, Human
uugugauaguucacugagaaugaugauuuccaauuucauccaugucccuaaaaaggacaugaacucaucguuuuuuauggcugcauag

SEQ ID NO: 4168053 - RNA, 73 nt, Human
uugugaucccauuuccuaguacaucaucaauguccuacugugcuccaugauccucuagaaaaggguaucacag

SEQ ID NO: 4168054 - RNA, 82 nt, Human
uugugauuuaauuccugcauacauaaucgagaccaguaauaccauuagugucucaggacuguuguggggauugaaugaauaa

SEQ ID NO: 4168055 - RNA, 70 nt, Human
uugugauuuaucuaugauaaacggauggugaagugaauuuccucauuugauuacuaaagauaauucagaa

SEQ ID NO: 4168056 - RNA, 61 nt, Human
uugugcacuggaauuaccuuuaucaggggugcacucugcacacaaguaauuucaugcucag

SEQ ID NO: 4168057 - RNA, 63 nt, Human
uuuucucccucuauuggcuucuguuuagaauacaguggugagcucugaaauagggaaagagga

SEQ ID NO: 4168058 - RNA, 57 nt, Human
uuuucucuuuccguaaguuaguggauucuucugugucuauuccaaggguagagaaaa

SEQ ID NO: 4168059 - RNA, 71 nt, Human
uuuucugacuauacauugaauguuaagguaauccuacaauuuauacuuugaauuuaaguguauacagagag

SEQ ID NO: 4168060 - RNA, 62 nt, Human
uuuucugagcucagugacuuaccaggaagagacacuugugugauguaacugauuucagaagg

SEQ ID NO: 4168061 - RNA, 56 nt, Human
uuuucuggaaaauaauacuuuuuuugaagaaauuuaggguauuaguuuucagagag

SEQ ID NO: 4168062 - RNA, 68 nt, Human
uuuucuguaggacuucugccaacucuccuguaaggaggcaaagucucuggaaguaaaccugcaggggg

SEQ ID NO: 4168063 - RNA, 63 nt, Human
uuuucugucagcaaagugcaaauaauguaccccguuucccuuauugccuuggcugccaggaaa

SEQ ID NO: 4168064 - RNA, 68 nt, Human
uuuucugugugaaugagagaagggaguuaugucuuuuuguuuauucuaucucuauucccacgaggaaa

SEQ ID NO: 4168065 - RNA, 95 nt, Human
uuuucuuaguuuauuuguuguuugguaauauggggguaguuauucuuaaacuauuuugacugcauuacagaacagagaaaaauaaauuuggaaaa

SEQ ID NO: 4168066 - RNA, 85 nt, Human
uuuucuuccucuccuugacccuucccuucaguuggcugggcuuuucaguucauugacucagggaaggggaaaugaagagagaaaa

SEQ ID NO: 4168067 - RNA, 58 nt, Human
uuuucuuccuggauuuuggcauuauauuuaauggugaaaaauuaaaacaggaagaaga

SEQ ID NO: 4168068 - RNA, 65 nt, Human
uuuucuuggaguggcuguccuuuuccucuuagauuauuagaagccagcaguuccucuuaagagaa

SEQ ID NO: 4168069 - RNA, 62 nt, Human
uuuucuuggcacagauauuuacagggaaaguaaugucugagugaucauuuguguaaaggaga

SEQ ID NO: 4168070 - RNA, 58 nt, Human
uuuucuuggcuacugugagauuccagaggagggagauuacuuuggauggucaagaaag

SEQ ID NO: 4168071 - RNA, 55 nt, Human
uuuucuuugcaugacagugcauguauauagacauacacuguuuuuggaaagaaga

SEQ ID NO: 4168072 - RNA, 94 nt, Human
uuuugaaaaaaaugaaguucucaauaaucauguugcaaacaaacuuuuagaaaagacauaauuauaaauggugggcugcauauauuuuucaaga

SEQ ID NO: 4168073 - RNA, 71 nt, Human
uuuugaaaacugauaaggaaagggagagaaucaagcaugcauucuacuuuucccuauacaguuugucaggg

SEQ ID NO: 4168074 - RNA, 122 nt, Human
uuuugaaacagcaaauggauuuggucuguucugaaaaaacaaucuguccuguggcuuguuuggaauaacaucuagaguugcuauagaaggauggaggcagaugacccaugucugauuuggaa

SEQ ID NO: 4168075 - RNA, 130 nt, Human
uuuugaaaccuuuauuaucuauaucugugaugaccucaaaguucaaguaguguuacauggaaaauguuaguuuuauacugugcaagacuuacuuuaauacagguucacucuuuggauucuguuuguaaaa

SEQ ID NO: 4168076 - RNA, 89 nt, Human
uuuugaaauaaaaguaaguaaaguuucuguucgcuuuaauaauuaucaaaauuaaaaggguaagcagcaacuuacagcuuguuacagga

SEQ ID NO: 4168077 - RNA, 104 nt, Human
uuuugaaauuucauuuuaaugucaaaucaguuuuaucagagggaauccugauuaguugcaguuguuuguuuggggauauuuauugacuuuaaaagaaaacaaaa

SEQ ID NO: 4168078 - RNA, 79 nt, Human
uuuugaacacuuaaagauagauggcauuguacccagagccagcugguacaauggcaucuaucuauaauuguguauaaag

SEQ ID NO: 4168079 - RNA, 78 nt, Human
uuuugaacuaaggucuaugaggccagaacaucuuggcgggcgcugcaugucaucugguuucuaggcaguauuuuagaa

SEQ ID NO: 4168080 - RNA, 59 nt, Human
uuuugaacuguggaagaguauucugcaucugcaggaauuacucaucugugguauugaag

SEQ ID NO: 4168081 - RNA, 84 nt, Human
uuuugaagaucauuagcaagucacuauuuuauguuacaaccaagcuguaccuaauagaaagucuugcugauucgaugauuaaga

SEQ ID NO: 4168082 - RNA, 79 nt, Human
uuuugaauccaggguuguuugagcuagaagagccucuagagcuuuugauauagcaagaaguagcucuggauuaacagag

SEQ ID NO: 4168083 - RNA, 88 nt, Human
uuuugacagcaaaauagugguuuggggccucauuuauuauuugaauauuuauuuggauuuccagacagcuuaauuuauucucucagaa

SEQ ID NO: 4168084 - RNA, 104 nt, Human
uuuugacagugucuuauuuaugugucucugaguuuguguaugaguguggguaaguguagguacugcacaagucagaguaacauuuaagguuaauaugguugaaa

SEQ ID NO: 4168085 - RNA, 104 nt, Human
uuuugaccaaugggacauuagcaagcuugauaccaggagaggcacuugcaauggggauucuccuuugcaaaacuccuuggagcugagcugcaugcuaugcgaaa

SEQ ID NO: 4168086 - RNA, 101 nt, Human
uuuugacugauugugacagcuugaguuuuggaugaagugccaaccucuaauuuuuauucccuuggcuacuguaaacuaaagcuuguaauuuuucuucaaga

SEQ ID NO: 4168087 - RNA, 75 nt, Human
uuuugagagacaggcaauauauaaauuaugagcucaugguuuuugaguuuaguauguaguguuuguuuuucugaa

SEQ ID NO: 4168088 - RNA, 95 nt, Human
uuuugagcaugugaggggauggcguggagaagguuggguucaucaugugguuucuuggcacuauuuuucuccaguuucucccuucagugucaaag

SEQ ID NO: 4168089 - RNA, 57 nt, Human
uuuugagggaaaucagcugaauguugaauaucagcauucaucugauuaaccucgaag

SEQ ID NO: 4168090 - RNA, 75 nt, Human
uuuugccuaaaaaacagcacaguauguuugacuuucagaaaauaaacauccaucugagcugucuuuucagcagaa

SEQ ID NO: 4168091 - RNA, 105 nt, Human
uuuugcuccagcagggcacaguugccucugccagaguagagaagguuaacaacagaacugggcuuuggcugggcaaagggaggugugucgguuagggagacaaga

SEQ ID NO: 4168092 - RNA, 64 nt, Human
uuuugcucuuugugcaaacccuagaaucacaaacguagauucuuaguuucauagaauugcagga

SEQ ID NO: 4168093 - RNA, 58 nt, Human
uuuugcugagggagagccucacugggguguccugaugcuggcaguuuccucaccgagg

SEQ ID NO: 4168094 - RNA, 71 nt, Human
uuuugcugguuuaucucuauuaguugguuuuccucuucagucaccuuucuaaaaguggauaagcuguagga

SEQ ID NO: 4168095 - RNA, 75 nt, Human
uuuugcuuagauuauauugaccaguacaauugguacaauuuugccuuuguuucaugguucauauuugaggcaaaa

SEQ ID NO: 4168096 - RNA, 120 nt, Human
uuuuggaaaagaacuuacacuaccugauuucaagacuuucuguaaagcuacaguaaucaagacacuacuguuggcauuaagauagucauguagaucaguaaaacauacuagaguccagaa

SEQ ID NO: 4168097 - RNA, 64 nt, Human
uuuuggaugcuuaaaucguuugaauaauuuggagagacaagauucaaacaguuugacaccagaa

SEQ ID NO: 4168098 - RNA, 73 nt, Human
uuuuggcauuuuguuuguucacuugacagacauuuucuuggguguuuauugugugccaagcacugugccagga

SEQ ID NO: 4168099 - RNA, 66 nt, Human
uuuuggcuaauuuucaucauggguuuaacauuagcuuggcugauguuugacaugaagaagccaaaa

SEQ ID NO: 4168100 - RNA, 72 nt, Human
uuuuggcucugagguuguucuucucaguggcauaucuacauuugccaugcaauauauauccucaagccaagg

SEQ ID NO: 4168101 - RNA, 62 nt, Human
uuuuggcuuuuccucagcaagcuugcccuuagugacaggauugcagaagagagaagcuagaa

SEQ ID NO: 4168102 - RNA, 78 nt, Human
uuuugguagagauggaaucuuucuauguugcccagguuggucccaaccuccuggccucaagcaauccuccugccaaag

SEQ ID NO: 4168103 - RNA, 59 nt, Human
uuuugguauauugugaugaaaagugcaaacauuuacucaggcaucuacaaaugccagaa

SEQ ID NO: 4168104 - RNA, 76 nt, Human
uuuugguauuguguauauuaggacacauucugauuucugcaucagaacgcugagugagugugcacaguaagcaaag

SEQ ID NO: 4168105 - RNA, 61 nt, Human
uuuugguccaguucugugauauugcuguugaucaagggcaaugaaaugaauucgaccagga

SEQ ID NO: 4168106 - RNA, 77 nt, Human
uuuuggugacuaguuuuuuaacuuguggaaaauuaauaauuaguauuauggucauuuguuagugcuuuucaccaaaa

SEQ ID NO: 4168107 - RNA, 80 nt, Human
uuuugguguauggugugagaaaagugucaaauuaauuuuuucauaaguauguacaguuaaucuuaagccauuuaucaaaa

SEQ ID NO: 4168108 - RNA, 129 nt, Human
uuuugguuaaauauugauaacuuugcacagcagaaugcagaauguucauuuuguggguagauagcagacaacuaacagguagagugaagcuuuuuauauucugugaaagugcagaagucauauaucaua

SEQ ID NO: 4168109 - RNA, 79 nt, Human
uuuugguucagagccugcccaguauagcacuacaauaagcugaauuuuauaaauuggguuuugaguuaaggaaucaaaa

SEQ ID NO: 4168110 - RNA, 95 nt, Human
uuuugguugcggggguugcuacuggcaucucguggguaggaggcaggcaugcugcugaacaucuacagugcacaggacagccccuacaaggagaa

SEQ ID NO: 4168111 - RNA, 103 nt, Human
uuuuguaaaauuuggcaugagaaaauuuaacuuugacaccccccucuacuccuauaaggagagauucugagaaguuaaguccaaugccaaauuguagacagag

SEQ ID NO: 4168112 - RNA, 92 nt, Human
uuuuguacuagccacuguaugaugugucugggauauagguuagaaaaauaaacaugacucuuccucucaugcggucauacacuaguggagaa

SEQ ID NO: 4168113 - RNA, 130 nt, Human
uuuugucccucuauaguccaaguaauuucucucauuuguuuagcagcuuuugauguaucaaagaaaacuugcaucagauggauuuaaacaggcagagaauaauuuaagacuauuguaauaggggacagag

SEQ ID NO: 4168114 - RNA, 55 nt, Human
uuuugucugcccugagggaaagaaauuauggucaaucucuucuggggagauaaaa

SEQ ID NO: 4168115 - RNA, 61 nt, Human
uuuugucuuugauguacaucaguuggacacuuuugucucugauguauaucagagaacggaa

SEQ ID NO: 4168116 - RNA, 130 nt, Human
uuuugugagaagaaguaauuauauaccauauuuaaaauaagugcuauuaacaucuauaagcacaagagaaguuacgaguuugcaauuuuaaaugugguaggcuuaaugagaaaaugacauuugaacaaag

SEQ ID NO: 4168117 - RNA, 74 nt, Human
uuuugugcuacaauuucuacugaaccugcauuuggaggaucagcagcagauucagcaggaauggaagcagagaa

SEQ ID NO: 4168118 - RNA, 58 nt, Human
uuuuguggugugugauauacagguaagggauggucuaaucugugcaccugcuacaagg

SEQ ID NO: 4168119 - RNA, 97 nt, Human
uuuugugguuuccauaucuguugcauaucauguucaaacaaagaucucacauuggagcagaaauaugcugauuagaugaauggcauuaaguacaaaa

SEQ ID NO: 4168120 - RNA, 91 nt, Human
uuuuguguaaagaucaauuaugacagacuaauaugaaauuugaccuuuauuuggaagaaaucugucacagguugucauugauuacaugaaa

SEQ ID NO: 4168121 - RNA, 63 nt, Human
uuuuguguagagauggggucuugcuauauuguccaggcugagccacuucuuuucaacacagga

SEQ ID NO: 4168122 - RNA, 84 nt, Human
uuuuguguguguuguuuauaguuaugaaagacugaggcguauauaaaacuuuucagaaaauuuaauuaugaacacaugucaaag

SEQ ID NO: 4168123 - RNA, 59 nt, Human
uuuuguguuugugugugagugugguggagucagcuaccucaagaauguauaacacagaa

SEQ ID NO: 4168124 - RNA, 63 nt, Human
uuuuguguuuucacuagcaguguagauucauuuaaucugaacacuaaaugugaaggagcaaag

SEQ ID NO: 4168125 - RNA, 109 nt, Human
uuuuguuccuuacuauauucacuuuuuaauagggcccaaugagacugauuaaaauuaugaguuauuuuaugcgggcuuuauuuuagguaauucacagcaggauacaaaa

SEQ ID NO: 4168126 - RNA, 92 nt, Human
uuuuguucuuuugaaccuaaugcaguuuccuuucuagucuuuucuuaauaguuugcaaaaagggggaauugcagauugguucaugaauggag

SEQ ID NO: 4168127 - RNA, 70 nt, Human
uuuuguuguuguuauuauugucucccaugaacucuuguguuuucuggucagagaaguagggacaaugaag

SEQ ID NO: 4168128 - RNA, 70 nt, Human
uuuuguuguuguugaaguuugaggguuaagcagaaaauaacaguaaccaggaaauuuggcaacaaagaga

SEQ ID NO: 4168129 - RNA, 76 nt, Human
uuuuguuuuauagguccugugagauucaugcucaaagagguucuguuuugauguguuuccaggauuuguuucaaga

SEQ ID NO: 4168130 - RNA, 84 nt, Human
uuuuuaaacugauuguuggaugauagugcugcugguaaauuuugcaacccauauuccacugcuuuucagacaguuauuuaaaaa

SEQ ID NO: 4168131 - RNA, 72 nt, Human
uuuuuaacaugcaguauguuuauuggaauaaauucaauuuuauugaaagauaggcuacugugguguuagagg

SEQ ID NO: 4168132 - RNA, 63 nt, Human
uuuuuaacccaaucauuguuucagcaugcaucauuugucaaaugcuauguuugguguuggaga

SEQ ID NO: 4168133 - RNA, 79 nt, Human
uuuuuaaccugguaugcacauugguuuccucauuagcaaaaucgggauaguaauggugccuaccuaauagaguuaugaa

SEQ ID NO: 4168134 - RNA, 56 nt, Human
uuuuuaagagauucuccagucucuggagaucccuuauucuggaguauccuugaaaa

SEQ ID NO: 4168135 - RNA, 75 nt, Human
uuuuuaaugucuuaguaccuuaauuuccucauguccaaagugaggcuaaaaacagggugauugugacaagaaaaa

SEQ ID NO: 4168136 - RNA, 84 nt, Human
uuuuuacacauggcaugagacaagagucuaaauucauauuuuuugcauguggauauucaauugugucagagccauuuguugaaa

SEQ ID NO: 4168137 - RNA, 68 nt, Human
uuuuuacugaccuccaaucccacucauucugacuaguggauucuagugggcuuuggggucucuaagaa

SEQ ID NO: 4168138 - RNA, 63 nt, Human
uuuuuagaguaguaaccauuagaaguaaaauuaaauucuucuaauaaauaaaugcucuaggag

SEQ ID NO: 4168139 - RNA, 84 nt, Human
uuuuuagauuccuuuucuuaaacauauguggcuaugagaaauaaggaagucaguaauuuaagauaaggaaugcauuuuuaagag

SEQ ID NO: 4168140 - RNA, 80 nt, Human
uuuuuagccuguugucugugaaaaggugaacuuacuguaaauuucaguaacucuccuuugacauauuuaaagguuaagag

SEQ ID NO: 4168141 - RNA, 61 nt, Human
uuuuuaguuguacugucaacaguuucaaaacaaagaagaaacugcgacuggcaaaugagga

SEQ ID NO: 4168142 - RNA, 63 nt, Human
uuuuuaguuugauguucuacuccuugcuuuccagguguaggauguuggacaucaugcuaagaa

SEQ ID NO: 4168143 - RNA, 74 nt, Human
uuuuuaguuuguaugcauaccauuuccauguuacauuaauaguauugaugcuuuggugaugguggaacuaaaag

SEQ ID NO: 4168144 - RNA, 78 nt, Human
uuuuuauaauuaggcaggucauauuagauuagggcccgcucuaaugacccuauuuuaacuugauuaccucuguagaga

SEQ ID NO: 4168145 - RNA, 129 nt, Human
uuuuuauaucuuucagaagcuuggaaugcucaaacaugcaguacauacaaacacugauuucuuuaaaccaugaggugguauuugccuuuguacugcacagugacaaguuuccauuuuaaugauguuuga

SEQ ID NO: 4168146 - RNA, 100 nt, Human
uuuuucaccaaauaucuauagcauauacagauaagcuguguguguguguguguguguguguguguguguguguguguguguguguguguuuggagaaaga

SEQ ID NO: 4168147 - RNA, 60 nt, Human
uuuuucacgugacaagaaguccugagguugagcugcuuaggguguuaagucagugauuga

SEQ ID NO: 4168148 - RNA, 61 nt, Human
uuuuucagacaagagggucaagcucagcaauauucuuuguuguaacuccuggucugaaggg

SEQ ID NO: 4168149 - RNA, 60 nt, Human
uuuuucaugugcuguauucuguuuggcuccaacuagcagaaauacccagcauuuggagag

SEQ ID NO: 4168150 - RNA, 73 nt, Human
uuuuuccugaauggcgaguuaguuaguuagaauaacuucucucagauuaaacuauugcuauuuuaagggagaa

SEQ ID NO: 4168151 - RNA, 118 nt, Human
uuuuuccugccccuagcauguaugcccugugugugcaagcacugucuggcgaaccacuguacacccagugucuggcacauagcaggugacccauacauauuugcguauuaaggggaaa

SEQ ID NO: 4168152 - RNA, 66 nt, Human
uuuuuccugugugaaugugugugugugugugugugugugugcauacacacgugcacgugggaaaga

SEQ ID NO: 4168153 - RNA, 68 nt, Human
uuuuucuaguauguguggcugaagagcagaggcaugcuugagcagacuggucuucagccuuggaagag

SEQ ID NO: 4168154 - RNA, 91 nt, Human
uuuuucucaccugcaucucugaacaguacuuuucacccauucuccacccagauaugggucaugugauguucaaaggauggggaaugaaaga

SEQ ID NO: 4168155 - RNA, 74 nt, Human
uuuuucucaguauuugcauuaucucacuuauauauguaugugucacuugagaauguaagcuccuuggagaaaag

SEQ ID NO: 4168156 - RNA, 104 nt, Human
uuuuucuguuaccaaguaaguuuuaaagaacaguuucaguuacugaugaguaugcacuuaucuuauuuuggucaguguacugggcugcccuuuggucagaaaaa

SEQ ID NO: 4168157 - RNA, 56 nt, Human
uuuuucuuucugcuugcccuuugaacuuugaggucugagcagugcaggaagaagag

SEQ ID NO: 4168158 - RNA, 70 nt, Human
uuuuugaaagcagguugcaauuacagugcuucauuuuguggaaguacugccauuauccugcugaaagaaa

SEQ ID NO: 4168159 - RNA, 76 nt, Human
uuuuugaacaagcugggguugugaugccauuuauaaguguaauaccauuucaaaacaacacucagguguaagaaaa

SEQ ID NO: 4168160 - RNA, 56 nt, Human
uuuuugagggcuaguagaccuaucuuugugauuaccccugcuuuaggccuuaaaag

SEQ ID NO: 4168161 - RNA, 64 nt, Human
uuuuugccagagugguauuacucaguuuggugacccaggcuuauuaauaugauucugcugaaaa

SEQ ID NO: 4168162 - RNA, 122 nt, Human
uuuuugcccaggugugaaaaccuuauuuguauaagccuugucuacgggccaugggguuuccuucuuuaugcaucucuaggaagggccaugucacaggaaggggagcacauuuggggcaaaga

SEQ ID NO: 4168163 - RNA, 78 nt, Human
uuuuugcccugcuuucuauuauauucuuauuuacuuuuaguggaugaugguuuuauuaauaggacccaauggcaaaaa

SEQ ID NO: 4168164 - RNA, 55 nt, Human
uuuuugcugaguauacucauacccugagucugguucagguccugaucagcaagga

SEQ ID NO: 4168165 - RNA, 66 nt, Human
uuuuuggaaagcuauuugugaguuauagacaccugucaauuucucagaaauggucuuaucuggaaa

SEQ ID NO: 4168166 - RNA, 75 nt, Human
uuuuuggcuugcagacuguuauuuuaauaggaauguguuaaauauccauuugaaagaacaguccagagauagaaa

SEQ ID NO: 4168167 - RNA, 84 nt, Human
uuuuuggggccucucacacauaucaaaugauaagauuaaacaaauagcauaauaauucauaaauauuugugggggcuuuuuaaa

SEQ ID NO: 4168168 - RNA, 91 nt, Human
uuuuugguuguuguuugaugacgacauuguagaaaaaauagauacacaagcuauugaagaauucuacggguugacaucagauacucaaaga

SEQ ID NO: 4168169 - RNA, 73 nt, Human
uuuuuguaaauguaaguuggguuuagcauuaggaaaucaauuagugcaauuccccauacuaacagauuaaaaa

SEQ ID NO: 4168170 - RNA, 78 nt, Human
uuuuuguaccugaggggugagggcuguagggaacacaacuguguagggucuggagcuuccucauuuacagugcaagag

SEQ ID NO: 4168171 - RNA, 70 nt, Human
uuuuugugcuguuucugaacacccugaccucucuccagggcuagguggaagcuccgaggcaccauaaaaa

SEQ ID NO: 4168172 - RNA, 130 nt, Human
uuuuuguuuugucuucagauuucccaaaaugaaagaagauucauuucaauacuaucugagaauuauuuugauuuaagaugugaugaaauucuacugaucauauggguauaaaucugauagagguuaagaa

SEQ ID NO: 4168173 - RNA, 88 nt, Human
uuuuuuaaagcaagauuucugguacauucauuucugagaagguaaauaaggauugacaggucuuugggaguauauuugcuuuaaaaaa

SEQ ID NO: 4168174 - RNA, 129 nt, Human
uuuuuuaacccauuauaaauacauguaaauguugcauuuauggguagacagaacuaaaagaacaaaauuuggccuacuuuugagaugcaagauuuaucuggcauaaugcauugaacagguuauuauuga

SEQ ID NO: 4168175 - RNA, 74 nt, Human
uuuuuuaucuaugguaguaccaucaagaguaauucacuaucagaaaucuuaccuggauugccauuuauagaaag

SEQ ID NO: 4168176 - RNA, 77 nt, Human
uuuuuucaaagguuaauguugucauguuauuuuacucauguaauuauugccauggaagauuaacucuacugggaaga

SEQ ID NO: 4168177 - RNA, 108 nt, Human
uuuuuucaggcuuuacauugcaguaaucuggugaaauuguugacagugcuacugugacccauaaauacauuuuauucagauaccugcagauugaaauuucugaggaag

SEQ ID NO: 4168178 - RNA, 66 nt, Human
uuuuuuccaccaggagauauuucaaaaugucuggaaauguuuugauugucacacuggaggggaaaa

SEQ ID NO: 4168179 - RNA, 97 nt, Human
uuuuuuccgucuucuauaguguuucuuccugccucuagaaauaugaagccccuugggugugguuaguggagcaggaaacaucuagaggcagaaaagg

SEQ ID NO: 4168180 - RNA, 80 nt, Human
uuuuuuccugugguuuacaugacaguuauuaauggcucuccuacuaggagccugacaucauggugagcaucgagaaagga

SEQ ID NO: 4168181 - RNA, 83 nt, Human
uuuuuucuuacauucccacguguucuuugcuucuauucucaauugaaggugauggguaggaaauguggcgaaaugagaagaag

SEQ ID NO: 4168182 - RNA, 86 nt, Human
uuuuuuggcacauaguagaaauauuuaucucugagaguccacagauuucauuacuccuuaggcuaguuucuguuguagccacagaa

SEQ ID NO: 4168183 - RNA, 113 nt, Human
uuuuuuggguuuuauuuuguauuuggcagcuacuuccccagugccuacaguggugccccaugcuccauaagccugggggaauauuuguugaaugaaugaaugagugcaagaaa

SEQ ID NO: 4168184 - RNA, 123 nt, Human
uuuuuugugacucguuucuucuguauuagguuggugcaaauguaauugcgguuuuuaccauuacuuucaauggcaaaaacugcaauuacuuuugucccaacccaguaaaaggguaauaauaaa

SEQ ID NO: 4168185 - RNA, 86 nt, Human
uuuuuuuaacgguguguggguucugaucccaggacugcuacuguggcagucauggguagaacucaagaaaaugcauccgaaagaaa

SEQ ID NO: 4168186 - RNA, 77 nt, Human
uuuuuuuugagaagaggucuuuugggaugcauggugcuccacauacagcuucacaaaauauuucauuauaagagaaa

SEQ ID NO: 4168187 - RNA, 56 nt, Human
uuuuuuuugcacagcuuauaguacagaaaugugauauacagcuauggcaagacaaa

SEQ ID NO: 4168188 - RNA, 66 nt, Human
uugugcagcuauaaagaaauggguauucuauauuuuuaaauagcccauugcuuuuuagcuacauaa

SEQ ID NO: 4168189 - RNA, 73 nt, Human
uugugcaggaagcauagaagaaugccaagaucauuccagaucaaggcaggaugcuuauguccuuucuggacaa

SEQ ID NO: 4168190 - RNA, 75 nt, Human
uugugcagucaggaauagcauagaguuaaaaugcaggaggucugccuuuguauucucuugguaucuacuguacaa

SEQ ID NO: 4168191 - RNA, 61 nt, Human
uugugcaguuucuauguuguccaaacccuuugccccaggagugggugagaagcugcagcaa

SEQ ID NO: 4168192 - RNA, 65 nt, Human
uugugcccaaggaggaggcugcagugagccaagaucaugccacugcacuccauccugggcaacag

SEQ ID NO: 4168193 - RNA, 80 nt, Human
uugugcuaaauauaaguuggcaauaauacuguaauagugauaggaaccaucuauuccagugugcuuuuauguuagaauaa

SEQ ID NO: 4168194 - RNA, 59 nt, Human
uuucuucuaugugugauauuuugguauuaaagagccgggguauuaaaaugaaggagaaa

SEQ ID NO: 4168195 - RNA, 61 nt, Human
uuucuugacagaggacaguguuuaucaaguagaauuuggaacacuagaaucuguacugagg

SEQ ID NO: 4168196 - RNA, 68 nt, Human
uuucuugaucugagaucuaaaccagagguuguuugaaagaccucuggugaauuaguccagaccugaaa

SEQ ID NO: 4168197 - RNA, 62 nt, Human
uuucuugccagagaaaaagaguuaaacaaaaucaauagccagaguuuauuuuuggcaagaaa

SEQ ID NO: 4168198 - RNA, 60 nt, Human
uuucuuguaaagucaaugauuucuccuggagugauuuuauuccuucauuggcauaagaaa

SEQ ID NO: 4168199 - RNA, 61 nt, Human
uuucuuguuucauggugucucagcuccccaaaaggagaucuaggacgcccaggacaagaaa

SEQ ID NO: 4168200 - RNA, 62 nt, Human
uuucuuuagacuacuaugcugccagaaaaacacauaguucucugggagaguagauaaaggaa

SEQ ID NO: 4168201 - RNA, 75 nt, Human
uuucuuucaaaaggcuguuuucugugucauuacaaaguguauuaguuaacaagagaacagucguggugagagaaa

SEQ ID NO: 4168202 - RNA, 60 nt, Human
uuucuuucaaugcuuguaagggaaagcuuguaagaauucccuuacaagcauugaaagaaa

SEQ ID NO: 4168203 - RNA, 56 nt, Human
uuucuuucauuuguagaacacuguaugaguuuuacagacaacacugaugagagaaa

SEQ ID NO: 4168204 - RNA, 89 nt, Human
uuucuuuguuuucuggagcucaguuauuuugccacucagauuuuaucuccuccccaagggcagcaaacuggcuucaggcuacagcaaaa

SEQ ID NO: 4168205 - RNA, 67 nt, Human
uuucuuuugacccgagcugaagaaauucaccacacaccaaaucuucaauaacucggguuaaaauaga

SEQ ID NO: 4168206 - RNA, 57 nt, Human
uuucuuuuuaauuuuauguugcaucauugguuuuugaagcagcugcuugaaaagaaa

SEQ ID NO: 4168207 - RNA, 72 nt, Human
uuugaaagagugugugugugugugugugugugugugugcgugcaugcacagaauaauauauguucuuauaag

SEQ ID NO: 4168208 - RNA, 67 nt, Human
uuugaaaggagauggagauuuggguaagguuuagucuggauacacuaaaucuucaucuuuuagaaaa

SEQ ID NO: 4168209 - RNA, 89 nt, Human
uuugaaagugcacuugaucuagacagauucccuugccuauuaauaugcaaaucagccucaguuuuucuuuguuuauugcaacuuucaga

SEQ ID NO: 4168210 - RNA, 87 nt, Human
uuugaaauguuucaaaugaaagcaacuuauuugagauggccauuucauggguugauucucauuuggguuucuuucucacauuuugaa

SEQ ID NO: 4168211 - RNA, 59 nt, Human
uuugaacaaguugcccaacuauggagguagaaauagauauugauaggcagcuugucagg

SEQ ID NO: 4168212 - RNA, 61 nt, Human
uuugaacuguucuaggauuuaaaacuguacuucagcaauuaugauccagcaacaguuuaga

SEQ ID NO: 4168213 - RNA, 61 nt, Human
uuugaagcucgaguguggacugauuuugcuccugcuuuugggcuuugcucagcuuaccaaa

SEQ ID NO: 4168214 - RNA, 106 nt, Human
uuugaauaaacaucacacuuuaaaacugacagcccuuggguuucacuucgcacucaggaggcacagcucugucagauuuuaagugaaaggauauaguuuguuuaag

SEQ ID NO: 4168215 - RNA, 74 nt, Human
uuugaaugcucugcacguccuuaguuaaauacaguccugcagucuguaaccugggauguagcacagacuucaga

SEQ ID NO: 4168216 - RNA, 56 nt, Human
uuugaaugcugugauuuauuaaguaucaaaaaugcuugaaaguuauuucauuugaa

SEQ ID NO: 4168217 - RNA, 81 nt, Human
uuugaauucuccagguaguuauuucaagaacauccuuuugcauguuucuuggaaacugauuccuuguugugugaauucaaa

SEQ ID NO: 4168218 - RNA, 101 nt, Human
uuugaauugguguauacauuagaggguaggaauuuacuucccccugcuucuauaaggggaaagauaaucaauuacuccuuguguauauuuaugaaaucaga

SEQ ID NO: 4168219 - RNA, 56 nt, Human
uuugacaaauaggggaauaaggcucaauuacuuugccuauuuguuuauuuguuaga

SEQ ID NO: 4168220 - RNA, 61 nt, Human
uuugacaacagcaaaugucacacaacuaaaaugaguuggaugguucaucacugaugucaga

SEQ ID NO: 4168221 - RNA, 59 nt, Human
uuugacaaccaggcagguaagaucggaggagguaaagaaucugcuuagguuuguucaga

SEQ ID NO: 4168222 - RNA, 57 nt, Human
uuugacagagcucuuagucucuaacaccaacuggagaacaggcaagcaucuggcaga

SEQ ID NO: 4168223 - RNA, 81 nt, Human
uuugacagaugaaauuagaaauauguaugggcauuuaaaaauguuuguauaagaacauucuagcauuuauggcaugucaaa

SEQ ID NO: 4168224 - RNA, 64 nt, Human
uuugaccucagagagccaucaaaaaugugcugcaaggaacaauucugugguugucuguggcaga

SEQ ID NO: 4168225 - RNA, 85 nt, Human
uuugacuagaugguucucuggcauaaaaucuacacuuucaggcaaaaugagagucugaaugcucagaguuggauaucuggucaaa

SEQ ID NO: 4168226 - RNA, 87 nt, Human
uuugacuauuuggaacccuagguuuauugauuucagaauauuuuuaaugaaucauccugaagucaauaaaguuccaugacuugcaag

SEQ ID NO: 4168227 - RNA, 74 nt, Human
uuugacucaagccuuucuuuaggagacacaggagggucccaagaaguuuccagaagaaaugccaggaagucaga

SEQ ID NO: 4168228 - RNA, 92 nt, Human
uuugacucaguuuugacagcaugagagaugccagugauuccagaacuacuguaugguacaugcuggcuaaaauauucaaaauugcaggagga

SEQ ID NO: 4168229 - RNA, 57 nt, Human
uuugacucccaaacugugauuuuuucaguauuagacaagaucacuugggauguuaaa

SEQ ID NO: 4168230 - RNA, 84 nt, Human
uuugacuccuuuguuuuugacaacuuucuuuuuaagguaugaaugaaaauugaagugaucaggaacuauauaauuggagucaag

SEQ ID NO: 4168231 - RNA, 69 nt, Human
uuugacuuggacugguacuacaccaucagcucuuuugguuuucuagcuugccaguugaagaucuucaga

SEQ ID NO: 4168232 - RNA, 63 nt, Human
uuugagaaaggggauuuaauuccacgguaauacagaaauggcauuaaguaaucuuuucuuaga

SEQ ID NO: 4168233 - RNA, 68 nt, Human
uuugagaccagccugggcaacacagcaagacccccaucuaccaaguggaacccagguuggccuacaga

SEQ ID NO: 4168234 - RNA, 99 nt, Human
uuugagagcguuuggaaauuggaagacuugguggcgaacgagggucaggaccugcauccugccucagaguuaucgacguauccggaaugugggaucaga

SEQ ID NO: 4168235 - RNA, 55 nt, Human
uuugagagucagauccgaagaugugguauauccgccaucuuuagcaacuuucaaa

SEQ ID NO: 4168236 - RNA, 59 nt, Human
uuugagcaggacccuccaagggaccauccuuauucugcucucugagaggucugcuuaga

SEQ ID NO: 4168237 - RNA, 87 nt, Human
uuugagccagggaagucaagccuguagugaauugugauugugccacugcacuccaaucugggcaacagagcaagacccugucucgaa

SEQ ID NO: 4168238 - RNA, 76 nt, Human
uuugagcuccaggagggauugggcugugggucacccaaagggggcuuccagagucuagacccuggugaugcuggaa

SEQ ID NO: 4168239 - RNA, 104 nt, Human
uuugaggcaggagaaucacuugaaacaggaggcagagguugcagugagcugagauagcgccacugcacuccagccugggugacagagugagacuccaucucaaa

SEQ ID NO: 4168240 - RNA, 58 nt, Human
uuugagucucaguuuuccugcuuauuaugugcauaguaguaaacccaugaggcuuaaa

SEQ ID NO: 4168241 - RNA, 107 nt, Human
uuugauagauuuuucccuccagaauguuugcaucuauucacaugugcaucagcagugcauuuguaguuaaauguguaguuaacguucuguuuuuaaaacuauacaaa

SEQ ID NO: 4168242 - RNA, 83 nt, Human
uuugauagcugguuugucaugcaagguuuuaauucucuuuccuucagaaauagcauguucaugauaaaauaagacagaucaaa

SEQ ID NO: 4168243 - RNA, 117 nt, Human
uuugauauuuguuagccuugauguuugaaguacucaucggugaccaauaagcuguuauacagccuugaacacugacugaagggggucugaaauaccauggggauuaaaaauagcaaa

SEQ ID NO: 4168244 - RNA, 64 nt, Human
uuugaucagguggacuguguuggaguugaccuucuggcacuccacccagcaguccaggaucaga

SEQ ID NO: 4168245 - RNA, 69 nt, Human
uuugauccagggcuuacacauaccaagagacuucguuacaaucaccaaaugugucaggcccugauuaaa

SEQ ID NO: 4168246 - RNA, 93 nt, Human
uuugaugcaacuaguaacaucaacaugaauuucucugaagauaaauaauauguguuucaggauuuuucuaugugaaucagcuaguugaugaaa

SEQ ID NO: 4168247 - RNA, 71 nt, Human
uuugaugggugucuauuaaaaguuaaauacuuguuuguuuagcuuucguuccuuagacacauauaaucaag

SEQ ID NO: 4168248 - RNA, 66 nt, Human
uuugauuaagaugcagauucugacucauuaaaucugagaugggcaagagucugcauuucugacaag

SEQ ID NO: 4168249 - RNA, 81 nt, Human
uuugauuccacagccgauaccaugacuacuaagcuauacugucucccucuguggaucacugggcgugcugugugaaacaaa

SEQ ID NO: 4168250 - RNA, 80 nt, Human
uuugauuucuucuaauacacgguaugacuuugcucguuuuucauacaaguagacacugaaauguauugaagaguauuaaa

SEQ ID NO: 4168251 - RNA, 62 nt, Human
uuugcaaacggcccugagucccccaguuuaugucuuaauucgcagccagggcugauuguaga

SEQ ID NO: 4168252 - RNA, 86 nt, Human
uuugcaaacuggggcuuuuucuucuaggugugccugcauuuacucaugugcuguaugucuauggaaaagacuguuaagcugucaaa

SEQ ID NO: 4168253 - RNA, 116 nt, Human
uuugcaaguucuuuguuugggguugugaaauugaaagauagugaagccagccucucuggagggaagaggugagaggaggcaucgugauuguuuuuuaccaugcugagagcuucaga

SEQ ID NO: 4168254 - RNA, 57 nt, Human
uuugcacacauucuuagaaauggauauuaucuguuuuuagcaagagugucguguaaa

SEQ ID NO: 4168255 - RNA, 55 nt, Human
uuugcauauccuccaacacauggauuuuacugauucaauuauggaugugugcaaa

SEQ ID NO: 4168256 - RNA, 123 nt, Human
uuugcaugguguaaaauacucucacuguggcugauuucaaccuaacaguaugaccucacggagcauguaguugggaagaaaagcacaguagcacaguauuauaugguauuuucaccauccaga

SEQ ID NO: 4168257 - RNA, 67 nt, Human
uuugcauguaccauggaggcuuaggagucaauuucuaggaaugucuucaucuccaugcacagacaga

SEQ ID NO: 4168258 - RNA, 58 nt, Human
uuugcauugccucugacuuaugagcuuacuauccuagaaaucagcaggcauauguaga

SEQ ID NO: 4168259 - RNA, 127 nt, Human
uuugccaauguuuggccauagagggcaaauucucaaucuuagacaagggcuccuuaaaagguaaauuaucagaaaauagacacugagcaccuguuauagguuaggaauuaugcuaagcauugggaaa

SEQ ID NO: 4168260 - RNA, 130 nt, Human
uuugccacucugcuaagcauuuguguuugcuaauucuuaaucccauaaagugaggauaauuguuuucuucaguuuuaagguuugagaauugaaguaaagauauauuaaaccuuagccaguaaguggcaga

SEQ ID NO: 4168261 - RNA, 100 nt, Human
uuugccuauccucaccuggaguggaauuuuuaccuaugaaugauuuuguagcaucaugcauucauuauuuuaaaaauauugcuucacugaguuaugcaaa

SEQ ID NO: 4168262 - RNA, 75 nt, Human
uuugccuauggauguuuaucuacaggcuccaaauaauauggauuuauucugguaauauacagaccauuugguaga

SEQ ID NO: 4168263 - RNA, 63 nt, Human
uucuuuguccucuccaacagccucuguguacacugcacaguagagaguuggugagggccugaa

SEQ ID NO: 4168264 - RNA, 71 nt, Human
uucuuuguucagaguuaggggugggcgagugucaaccuugauauucuucauuguugauucauguucaugaa

SEQ ID NO: 4168265 - RNA, 63 nt, Human
uucuuuuaauccaucugguaaaccucagcaacaacugcaggaauugggcacggagugaaagga

SEQ ID NO: 4168266 - RNA, 76 nt, Human
uucuuuuaauuucuauguucuaagucucaaggcccuggcaggguguggguagccagagaaaguggggagggaggaa

SEQ ID NO: 4168267 - RNA, 78 nt, Human
uucuuuugcucuuucucauugucagcagaacaauacgcaaaaugugacugacaagaaagagaaagaggagcaaaagga

SEQ ID NO: 4168268 - RNA, 57 nt, Human
uucuuuuggacucaaagagaacuguaaagcaauacaguucucuuuggguccagagaa

SEQ ID NO: 4168269 - RNA, 76 nt, Human
uucuuuuucacucuagccaugauuucauuaaucuuuugguccagaaugaaauaguuggcuguagagggaaaaagga

SEQ ID NO: 4168270 - RNA, 63 nt, Human
uucuuuuucuuauucccacacugggauauuaugucccuggugcggcaugauugagcagaugag

SEQ ID NO: 4168271 - RNA, 69 nt, Human
uucuuuuugcaucuggugaagaccagcagaggcaacucucaaacuguuuucaccagauugcaaugagaa

SEQ ID NO: 4168272 - RNA, 57 nt, Human
uucuuuuuguuucuuauagcgacacugaugucagcuaaugugauagagcagaaagag

SEQ ID NO: 4168273 - RNA, 93 nt, Human
uucuuuuuuguggucuccagauacuuagccaucauugauugcuauaauccuuauuaaguauuugaagauguugaguaccauccacugaaggag

SEQ ID NO: 4168274 - RNA, 87 nt, Human
uugaaaaacuucuggcacuaauagacagcuuuuuaaaaaccaauuuaaaagcucuucuguugaguuaaaaagcaagaaggcuuucaa

SEQ ID NO: 4168275 - RNA, 96 nt, Human
uugaaaaaucauacuccauucacuuauuuuuaaggauguuugaauaacuuuuaaggauguuugaauaacuuggauauauugaaugugcuuuuucaa

SEQ ID NO: 4168276 - RNA, 64 nt, Human
uugaaaagcaaaugauggguagugugaugaagcauuaaaaccauaucccaucagaguuuuauaa

SEQ ID NO: 4168277 - RNA, 84 nt, Human
uugaaaauggccucagagaagaggaaagaggaaagacauggggauuccaugucaccuuuacccuuuuauagacuggcuuuucag

SEQ ID NO: 4168278 - RNA, 127 nt, Human
uugaaagaaggagcguuuugcugccuuugaucuguuuccacugggcacggggccagcgguguaggagcuaucucacugcccugugcacaggaaacugaagauggaguuucucgccugucguuuucag

SEQ ID NO: 4168279 - RNA, 71 nt, Human
uugaaaggcagcaauugaaaucauuguggagaagauucaaucuuguagcagggauugucaaugcugcucaa

SEQ ID NO: 4168280 - RNA, 67 nt, Human
uugaaagguaucauguccauacaguccuuugcugcccucaucagcauuugauacauguaccucucgg

SEQ ID NO: 4168281 - RNA, 90 nt, Human
uugaaaggugcgauauuccaaucuugugguucaggauggcacugggaaucgaucacaggcuuuucugacauaggcuugggauuaguucaa

SEQ ID NO: 4168282 - RNA, 79 nt, Human
uucugaugcggucccucugcucaauggcucagcagauuugucaggagcauuucugggcaaaggcuguaacccaucagag

SEQ ID NO: 4168283 - RNA, 62 nt, Human
uucugauucuuuuggcagucaaaggcagcucugugcugcugagggcuguuaaggaagcagaa

SEQ ID NO: 4168284 - RNA, 72 nt, Human
uucugcacaugcacggcaccaucuucugugagcacccaugggaggucaugccugaugacuacuucugcagag

SEQ ID NO: 4168285 - RNA, 81 nt, Human
uucugcagguucacaguuaggacaacugcuucacacuuguuaaauguguuaaguugugguucuaaccaugugauaucagag

SEQ ID NO: 4168286 - RNA, 68 nt, Human
uucugcauucugcucucccucuugucuccucccugcucuacuggcagcccucgagggcagaggcggaa

SEQ ID NO: 4168287 - RNA, 62 nt, Human
uucugcccuaauucagugcuuaggguaguguucuugccauuaggcacuuaguagggccagag

SEQ ID NO: 4168288 - RNA, 57 nt, Human
uucugcccuggcuccucccacgcuggggaucucagcacauggauggaguuaggagaa

SEQ ID NO: 4168289 - RNA, 69 nt, Human
uucugcccuugggauuuagguaaggcuggcaaugggggagacauuugaccugggucucuagggaaugga

SEQ ID NO: 4168290 - RNA, 72 nt, Human
uucugcuaacauuaccugcaacucccauggugaugcucaaaucccauuugggaauucagugaacuagcagaa

SEQ ID NO: 4168291 - RNA, 63 nt, Human
uucugcuuagagggcauuugcaauuagaaauaaacauuucugugugaguccaucugagcagaa

SEQ ID NO: 4168292 - RNA, 56 nt, Human
uucugcuugcugcgugcucuaaaauggacauacuugaggcaaacauguaaguagga

SEQ ID NO: 4168293 - RNA, 89 nt, Human
uucugcuuuuguaacaugaaugcagccauaacacuauguaaaugagugaguauggcuguguucacauaaaauuuuuuuauaaaauagga

SEQ ID NO: 4168294 - RNA, 73 nt, Human
uucuggaacucccugacucguuuugggaagcuguugauuggcccacaguggguuccugagcagggaucuggaa

SEQ ID NO: 4168295 - RNA, 55 nt, Human
uucuggaaggguggaguagcuucuuuauauucuagccucuaaacucuucucagag

SEQ ID NO: 4168296 - RNA, 66 nt, Human
uucuggacugaauggaagauauauggauaaucacugugaauuuaguguacuuccauucauccugaa

SEQ ID NO: 4168297 - RNA, 66 nt, Human
uucuggcagagacugguauuagggcuccuuuaacugaaagcaaauucuauuuccaguccuucagag

SEQ ID NO: 4168298 - RNA, 56 nt, Human
uucuggcaucuguuuucauauuuauuuuauugguaggaacugagcugaugucaggg

SEQ ID NO: 4168299 - RNA, 58 nt, Human
uucuggccaugcccagagucucuguggcaucacucauggaggaaguggcuggccagaa

SEQ ID NO: 4168300 - RNA, 70 nt, Human
uucuggcccuguccucauuucaucucccuuugacacaaucucauugauggaggaguaaggacaggcugaa

SEQ ID NO: 4168301 - RNA, 75 nt, Human
uucuggcugcaauaguaaauuacggaggagaguaaaucccuacugguucgucucuuuuacaguucacacccagaa

SEQ ID NO: 4168302 - RNA, 121 nt, Human
uucuggcugcacaugagaaucacaugggagcuuaaaacauagccagacugagccccacuucagacugugaaacugauguauuuuuaaaaugcuucccagguguuuucaugugcagucagga

SEQ ID NO: 4168303 - RNA, 75 nt, Human
uucuggcuggccggaggcaucccuguuguuccagcacaaggcucuucagaggggacccuccacagccagccugag

SEQ ID NO: 4168304 - RNA, 127 nt, Human
uucuggcuuagagaaauguuccaggcaugaaagcaagaagugaguugagaaccuaccccaucauccccuucucaccucucccauuucucugcucuuucacuugcucugcauuucacuguacccagga

SEQ ID NO: 4168305 - RNA, 75 nt, Human
uucuggcuuuacagaccaaagaccuacagauccaacuacacuggcugugcaggggauuugguuauaaggaaagaa

SEQ ID NO: 4168306 - RNA, 95 nt, Human
uucugggaaagaugucguguuucaguaaggauacagaggcaggccaaucccguucuaccucuggacauuguggagcauggcuauaauaccuggaa

SEQ ID NO: 4168307 - RNA, 75 nt, Human
uucugggcauuucucauagagcugaugguuugaacccucccaggaggcuccagccaaugggucugugcucuagga

SEQ ID NO: 4168308 - RNA, 110 nt, Human
uucugggggcagggggcugugguuuagcuuugaaggauaugguucaugguggaauuuaauuauguccuuagagacuaagagccaagcaaaacccuguagaguuaccagaa

SEQ ID NO: 4168309 - RNA, 101 nt, Human
uucuggguauuuuuagagagguuuacugagggugcugguuuucuccacccauugagauaacuggagcuaacaguagaagacucagaaagggucacuuagaa

SEQ ID NO: 4168310 - RNA, 72 nt, Human
uucuggguuuacaucugacuucugauuggguucuuauccguuaaaaaaguuaaaaugucaauuagcuuggaa

SEQ ID NO: 4168311 - RNA, 102 nt, Human
uucuggucauccgaguauucuguuuauuucugugggucccuugguaaacaggaauuuacaguacccagcaaagauaaacuuauggaacucauuaccccagaa

SEQ ID NO: 4168312 - RNA, 67 nt, Human
uucuguaaauauugucccaugagcgauaacauuacaaaguccuuaggagugaggaguguuuacagaa

SEQ ID NO: 4168313 - RNA, 118 nt, Human
uucuguaucaaggcacauuaguaugaccuauuagauuuccuugccagaaauugauguugagcaguaggagguaaguuugagaacuaguuauucacauacuaauagcacaaauacugaa

SEQ ID NO: 4168314 - RNA, 61 nt, Human
uucugucaaaacuuuuuuauguggccacagagacacuguagcagagaaaguuugggcagaa

SEQ ID NO: 4168315 - RNA, 67 nt, Human
uucugucacagcauccuaugcagggugugcacaaccaagcaccaauaaaagugaguuguugaaagaa

SEQ ID NO: 4168316 - RNA, 63 nt, Human
uucugucacagugcugguaucagaacccagauccccugacuccuuguccaguacuguuuagag

SEQ ID NO: 4168317 - RNA, 56 nt, Human
uucugucauccuuucuagaugugagaauuuagguucauuuaggagcuauggcagaa

SEQ ID NO: 4168318 - RNA, 91 nt, Human
uucugucauuuuugggggauuguucauugcuaguacuuucccaugagggcauaaagugguagacaaagauaauuggucaauauuguuugag

SEQ ID NO: 4168319 - RNA, 86 nt, Human
uucuguccaguggcuacacucacacuuuaaaucaaaucuucuaacauuccuugaaguaaagcagucuguguaugugaacugaagaa

SEQ ID NO: 4168320 - RNA, 66 nt, Human
uucugucccacuggucuguuugucuaucccugugagaaccacagagcucaggccuuugagacagaa

SEQ ID NO: 4168321 - RNA, 57 nt, Human
uucuguccccacacucuaagguccugguuuccacugcagggcugagaaggggaagag

SEQ ID NO: 4168322 - RNA, 63 nt, Human
uucugucccuccuggcaccaaagucaccuaucauaaguaacuugaguuucagaggggaaggaa

SEQ ID NO: 4168323 - RNA, 112 nt, Human
uucugucugugagauuguccugggcuuacgaccucugacuggcaguugaaucuuugcaacacucuuacaguagcagagucagucguguguuagcagucucaugaacacagaa

SEQ ID NO: 4168324 - RNA, 77 nt, Human
uucugugaccaaauuuauauuaagauucuuguuuccugucaaauucaauggagucauauuuauauguuggcacagag

SEQ ID NO: 4168325 - RNA, 97 nt, Human
uucugugagagagcauaaagucucauaauucacuuagauugauuuaauauacuagguuacugaauuaucaggcuuugaaauagucuuuccuuuagaa

SEQ ID NO: 4168326 - RNA, 89 nt, Human
uucugugggcccagcaacagccccucuucucuccucggagccagggccaggcuauuccaggaggacugagggggcuggaucuaucagag

SEQ ID NO: 4168327 - RNA, 66 nt, Human
uucuguguuccagaaggugacucagggaguugugcaaaugacugacucauauuucauggauacgag

SEQ ID NO: 4168328 - RNA, 64 nt, Human
uucuguuacauggggcacagugaaucagcucucugaucagcccugacauugucuccuagcagaa

SEQ ID NO: 4168329 - RNA, 55 nt, Human
uucuguuacuguuggucauaacugagauaucauuaaagauuaaucaguggcagaa

SEQ ID NO: 4168330 - RNA, 84 nt, Human
uucuguucacuuuuauauucuuggcuucuaacacguaguagguacucauuaaauaucuguuagcuaaugaaugagugaaaugaa

SEQ ID NO: 4168331 - RNA, 64 nt, Human
uucuguuuuagaaauaaguagucuuagcaauaugagaaaaaacggacuuguucuaaaaucagga

SEQ ID NO: 4168332 - RNA, 97 nt, Human
uucuuaaaaugguaauuauguccaaaugaacuaagagucauuaguguaggaaauuuucuuccacaauaauguuuuuagguuauuuaguaucaaagaa

SEQ ID NO: 4168333 - RNA, 73 nt, Human
uucuuaaaguaacccugaauguuuauuauaucaauuaauauaagcagauacugaggcucaggguguuuaggaa

SEQ ID NO: 4168334 - RNA, 93 nt, Human
uucuuaaguagggagcaucccuaggaaauuuaaaauaugauuugauuuaucauagaucaguuuauuaauuuucuaggagcuucugccuuagaa

SEQ ID NO: 4168335 - RNA, 61 nt, Human
uucuuacagcccuauuacuaaaucugcagguaacagcagugauagaguaauacuguaagga

SEQ ID NO: 4168336 - RNA, 75 nt, Human
ugguuagggagcuaucuguauucugacagucacuuuaggguauggggugaccagggucaguagcuuucuuugcca

SEQ ID NO: 4168337 - RNA, 79 nt, Human
ugguuauuuuuuguaacagcuguuuauauaguaaggauaucaacccuaugcuugucauaguuguuacaaauauuuauca

SEQ ID NO: 4168338 - RNA, 94 nt, Human
ugguucacuggguccugaauuggccugucaguuuucccuugugauugauugauaggggcugacuggaaagugccaugacagauuagugaugcca

SEQ ID NO: 4168339 - RNA, 84 nt, Human
ugguucagggccuucagggccuggagucagggaaagcaaggcuggacccuggcugugccucuuuccaggccagggccuugucca

SEQ ID NO: 4168340 - RNA, 88 nt, Human
ugguuccaaagucagcugccagucccaauuccacauggugccuauacacuuggccccuaguguugggcuggguugacuucuccuucca

SEQ ID NO: 4168341 - RNA, 86 nt, Human
ugguuccugaagagaugguagacuauggaacguaggcguuaugauuucugaccuauguaacaugguccacuaacucucaguaucca

SEQ ID NO: 4168342 - RNA, 91 nt, Human
ugguugaaugaaaaauggcuuuucacagaggguucugagcaaaugaauagaacagaauuucccagaauuggccguuuaaaaaauacgauua

SEQ ID NO: 4168343 - RNA, 101 nt, Human
ugguugauguggucggcaccuggcuggcuaguugaaaaaggaacaccugcaucuuuuaucaaacaaauuauccagccuaccugcagcugcuggcccaacca

SEQ ID NO: 4168344 - RNA, 79 nt, Human
ugguugcaggagaaugcuggaagguaaggagccaaggaaucccugggagucagucguucucagaggucccugcaugcca

SEQ ID NO: 4168345 - RNA, 57 nt, Human
ugguugccucucagagauuccgaggcugggccaggcggagccucuggcagggggcca

SEQ ID NO: 4168346 - RNA, 59 nt, Human
ugguuggagccaaaauucaaagccaggcagucuggcuccagagcucaugcucucaacca

SEQ ID NO: 4168347 - RNA, 78 nt, Human
ugguugguagaugucagagaugaaauucaaauacagauuuguaugaccacaaucugacgucuauuacaugauagacua

SEQ ID NO: 4168348 - RNA, 81 nt, Human
ugguuguauauuacuaccaucugcuacuauuaguaacaguaccaguacuagcaguagugauaguaguaguaagaauaauca

SEQ ID NO: 4168349 - RNA, 77 nt, Human
ugguugucagugguuaauguugugaggcagaucuguguuagggcacugagagaugugucacagcaggacgucagcca

SEQ ID NO: 4168350 - RNA, 69 nt, Human
ugguuguuguugccacugaaccagucuugcacaagccuguguaccuuuuucugugcaugcucucaacca

SEQ ID NO: 4168351 - RNA, 59 nt, Human
ugguuguuucuguuucugaccaauuagacauuuagaggcaacagcagcugaagcagcca

SEQ ID NO: 4168352 - RNA, 86 nt, Human
ugguuuaguaaggugaacugguaaugacagaaguuguuuuauacuguaguuuuuugugauugcuucaguuuuuucuugucagacca

SEQ ID NO: 4168353 - RNA, 57 nt, Human
ugguuuaugcuguugcagcucucugggaucaggccugugagcugaacugcaugacca

SEQ ID NO: 4168354 - RNA, 63 nt, Human
ugguuuccaaacagcauuccaagacagcuucaucacaugucuggcauuuuggcugggaaacua

SEQ ID NO: 4168355 - RNA, 69 nt, Human
ugguuuccuaagauagauacuucaguuuaucaguguuccucucacugguguugccugaacucuaaacca

SEQ ID NO: 4168356 - RNA, 76 nt, Human
ugguuugacuuugggcucuaacucaaacuugccuucaaauucugguuuugucaugagugggcacauugugaaauca

SEQ ID NO: 4168357 - RNA, 104 nt, Human
ugguuugaugagucuuguggguuguuuacagucugucuugggcuuuaaggaagucaccuguuugcuggagugaagucuggcagcuugagggcuuguuauggcca

SEQ ID NO: 4168358 - RNA, 80 nt, Human
ugguuugcaagcccagcuauuacuuuuuuuggacuuuaccacagucaguuagggccacaguaaugcugaguaacaaacca

SEQ ID NO: 4168359 - RNA, 55 nt, Human
ugguuugccaauuaucuauaaauacauugguagguauuuaaggauaagcagacua

SEQ ID NO: 4168360 - RNA, 67 nt, Human
ugguuuggaggugcaaaucaagaguuccauauuuagacaugcuacauuugagaugccuuuuagguca

SEQ ID NO: 4168361 - RNA, 59 nt, Human
ugguuuguauauguuugugagaucuagcuucugaggaaucucauacauaguaggaacca

SEQ ID NO: 4168362 - RNA, 59 nt, Human
ugguuuuaagacauggcuuugcuguauuacuguacugcuuugugauaguguuaagacca

SEQ ID NO: 4168363 - RNA, 58 nt, Human
ugguuuucacaguaaauguguaggguguauguuacuuacaguaggaguuggaaaacca

SEQ ID NO: 4168364 - RNA, 64 nt, Human
ugguuuuccaguucagaugcaacagggauacauuuguucucuguuguaugagaaacugacacca

SEQ ID NO: 4168365 - RNA, 60 nt, Human
ugguuuuguuccagacuugagacccgggagaacggaugguuuaguucaaguacagaacca

SEQ ID NO: 4168366 - RNA, 102 nt, Human
uguaaaagacacuuacauuuggguauucugugauugacauguggcuuuauaaugguuuucugguucuucagucacaucacagaaauucccaugucuucaaca

SEQ ID NO: 4168367 - RNA, 73 nt, Human
uguaaaauccgagaaaccagaaguugccuuugcuacucacucaguggcugcuugcuguuucuuggauuagaua

SEQ ID NO: 4168368 - RNA, 93 nt, Human
uguaaacaacauugaagcauggagaugaggcaaggaauaguacucacugaaguugaaaugacugcccacuucaaaaucuucauuguguuuaca

SEQ ID NO: 4168369 - RNA, 69 nt, Human
uguaaacagugccagugcacagaaccuuuauauauuuuuugaagccaguacugugcucugcauauaaca

SEQ ID NO: 4168370 - RNA, 83 nt, Human
uguaaacauuagaagagaagagguauugaggaaauuuucuucuauuuuuuccacauuauguuucuccuuucuuguucuuugca

SEQ ID NO: 4168371 - RNA, 100 nt, Human
uguaaacauuuuccaaaacaagugguuugcauuuauuagucuucugaaggaguauuuuagaagucaugaaacuauuuguuccuugaaguaaauuuuuaua

SEQ ID NO: 4168372 - RNA, 62 nt, Human
uguaaagaaauagcauuuguaggaaaaucaccuuggguguguauagauccugguucuuugca

SEQ ID NO: 4168373 - RNA, 95 nt, Human
uguaaagauagcuacuguguuaagaaauuaaucaaggcugcaagacagugaugauucaacuuucauaacaaaagguaaagcugaauaucuuucca

SEQ ID NO: 4168374 - RNA, 58 nt, Human
uguaaagguaggugcaaaaugaugccuuuuauaagagaaauugccacuuaccuauaca

SEQ ID NO: 4168375 - RNA, 58 nt, Human
uguaaaguauacguuucccagcaccugccaccagcagguaaggaacaaauacuaugca

SEQ ID NO: 4168376 - RNA, 71 nt, Human
uguaaaucagggagaaauauagaguuagaguuaaauucaacaaaauauauuuuuccagugauccauuuaca

SEQ ID NO: 4168377 - RNA, 70 nt, Human
uguaaauucagugagugaaugaaugaauguuggcauuuuugcacauucaguuagaucauccuaauuuaua

SEQ ID NO: 4168378 - RNA, 64 nt, Human
uguaaauuguccucccccugguauuuaugaccuacaguuucccaauaccagaguacaguuuaug

SEQ ID NO: 4168379 - RNA, 124 nt, Human
uguaacaguaguuuuacuccaacauauaguguuaaaaagauguccaaguaaaguuaaauauacaauuauuuaaaauugggacuuuuuuccguagcguaguggguuuuguggaacacauguacca

SEQ ID NO: 4168380 - RNA, 80 nt, Human
uguaagaaagaacagucuagugcauuaaugugaauauucuaagauagauguuuaucuuaauggacucagagguacuuaca

SEQ ID NO: 4168381 - RNA, 73 nt, Human
uguaagaaauagagacaauguuuggucuacacuugccauauaguagguguuuaggacauguuaucuucuuaua

SEQ ID NO: 4168382 - RNA, 97 nt, Human
uguaagaacuaccagagaaccaucugcuugaggaauccuuuaaaaauugccaugggucguuuagcaguucaugguuccaucuugcucuguucuugca

SEQ ID NO: 4168383 - RNA, 69 nt, Human
uguaagaggacauucuggacaaggcaagcuccuggcauuugacagaugcuaaugcugcuucuuuuugca

SEQ ID NO: 4168384 - RNA, 67 nt, Human
uguaaggaggauauuugagcucagugggugaugaaugauuugagcuggaaaauccaagaccuuggca

SEQ ID NO: 4168385 - RNA, 63 nt, Human
uguaaggcuguggauggcaaaugaauuccaaaaugaaaucagccagccagcuacaggcuuaca

SEQ ID NO: 4168386 - RNA, 79 nt, Human
uguaauaacguaccuuuucuggaagcaucuugaggcguucagcuaaaaggaaggucucagaaauacuauguugucagca

SEQ ID NO: 4168387 - RNA, 106 nt, Human
uguaauaauuuguaaaaaugcguguauuuuuaggaaugcgcuauuuccaguaagggaaguauugacauuuuuaaggaacugugcugcauuaaaauccacaguugca

SEQ ID NO: 4168388 - RNA, 68 nt, Human
uguaauaguuucauauaccaagcacuugaguugagacuucaauuuggggccauuaugaagcugguaua

SEQ ID NO: 4168389 - RNA, 130 nt, Human
uguaaucccagcacuuugggaggcugaggcgggcagaucaccugaggucaggaguucgagaccagccuggccaacauggugaaaugcugucucuacuaaaaacacaaaaaauuagcuggacaugguggcg

SEQ ID NO: 4168390 - RNA, 66 nt, Human
uguaaucccagcuacucgggagagugaggcaggagaaucgcuggaacccgggaggcggagguugca

SEQ ID NO: 4168391 - RNA, 66 nt, Human
uguaaucccagcuacucgggaggcugaggcagaagaaucgcuagaaccugggaggcggagguugca

SEQ ID NO: 4168392 - RNA, 111 nt, Human
uguaaugauauugauuuacagaccagagaaaccaagcccauuacuuuacuuuagacauaacuccgaaacaaggaaauguuugguugcaugguuauagcucuaauuauuaca

SEQ ID NO: 4168393 - RNA, 78 nt, Human
uguaaugcacuguguuuuucugaguugguccauuugagauugaagaguggauauuuacauuaagcacauugcauucca

SEQ ID NO: 4168394 - RNA, 70 nt, Human
uguaauuaauguaaggaucuccuggauuaucuggguaggacccaaauccaguggguccucaugagagaca

SEQ ID NO: 4168395 - RNA, 63 nt, Human
uguaauuggaauuuagggaauauucaugauuauuauggagacuucccugauuucccuuugaca

SEQ ID NO: 4168396 - RNA, 73 nt, Human
uguacaaaauuaucugguucccucgccuucuagauucugguugaauuuggccacuugggaguccagguugaca

SEQ ID NO: 4168397 - RNA, 91 nt, Human
uguacaaucucuggaaggaaagguagcagagaagucauauuugacccauucauuuauuuccuuuccuccucuagauuuucguaguugugca

SEQ ID NO: 4168398 - RNA, 80 nt, Human
uguacacauuuuauauacaugcuacauuuguguaaguguuuuauguguauaugaaaauguacauguguauaagugguaua

SEQ ID NO: 4168399 - RNA, 66 nt, Human
uguacacccauuaaacaauuagaggcuaauacaaaguaguaaucaguugcuaaaugguguagugca

SEQ ID NO: 4168400 - RNA, 83 nt, Human
uguacagauguuugccucccuugagaguuggccaauugcucuugcaaggcaggccaguuucaaggccauucagaccucgggca

SEQ ID NO: 4168401 - RNA, 55 nt, Human
uguacagucugcagcuugcuguggcccacauggagaaguaagcaaagacuuuaua

SEQ ID NO: 4168402 - RNA, 88 nt, Human
uguacaugaugugccauccugcaggaccuccauauauagcuuguauuuuguacagugugguggucucaggauagucacauuucuuaca

SEQ ID NO: 4168403 - RNA, 64 nt, Human
uguaccagaugucuaaagccaucucagcuaagcaugugaaaaacugagcuucagauaucgugca

SEQ ID NO: 4168404 - RNA, 65 nt, Human
uguacccaaagacugucuggaauacaggacuauuuggccccuaggguucagacagacuagguaua

SEQ ID NO: 4168405 - RNA, 72 nt, Human
uguacccuaacacccuucagcuuucuuagcucagaggcauuuugagguauggauaucuggagaggaaguaca

SEQ ID NO: 4168406 - RNA, 85 nt, Human
uguacccuuggcagccuucucugagaaggugacacagaugacacuguggccccuccaggaggugucaagacaaauuugggugaca

SEQ ID NO: 4168407 - RNA, 58 nt, Human
uguaccugguuucuuaaacccaaaugccuccaauucuggaguuugaagaucagguuua

SEQ ID NO: 4168408 - RNA, 129 nt, Human
uguacuccauguucagugugacacuggggcaguauagugccauucaagagguaguucuuacaugguugagagguaucuaggcagauggaccugaguuugcaccccaguucccuguggccuuggugugga

SEQ ID NO: 4168409 - RNA, 77 nt, Human
uuggauuccgcucuucaggaggucauugguaaccauggaggaggaaauuucaguggugucgugggaguggaagccag

SEQ ID NO: 4168410 - RNA, 58 nt, Human
uuggauuucaacagagcuuuccugcauauuugccaaaaggccacugaagaaaucacaa

SEQ ID NO: 4168411 - RNA, 60 nt, Human
uuggcaauuaguuauaucugcaaaugcguaauugcaggugcaacccagcugguuagccaa

SEQ ID NO: 4168412 - RNA, 57 nt, Human
uuggcaccagcacuugggauggcuuaugcucagagucaaaccuacugugcgguccaa

SEQ ID NO: 4168413 - RNA, 85 nt, Human
uuggcacuugugaagcaccaugcaucuuuuuacauuuaaaauagaauguaacugaaggaaaugcauguuugaguuuauaagccaa

SEQ ID NO: 4168414 - RNA, 62 nt, Human
uuggcagaaugggcagcuugagauauuaaaugacuauauuucaagcagucugauuuuaacag

SEQ ID NO: 4168415 - RNA, 64 nt, Human
uuggcagaugagccgcgcuccaagaaccagcuguugaacguuugugagugcaggcuggugccag

SEQ ID NO: 4168416 - RNA, 76 nt, Human
uuggcagcaaauauugucagcuguuuccuugaagugacagacucacuuauuucauauuugagaaaauuucugccaa

SEQ ID NO: 4168417 - RNA, 63 nt, Human
uuggcagcugcacagacuccaugagcacugaaaugcuuagguauuauccaugugagcugccaa

SEQ ID NO: 4168418 - RNA, 95 nt, Human
uuggcaggaucaguugcccacuggcuguuggucagaggccucuucugguuccuggccuugugacccucuccgaugggcagcucacagccuggcag

SEQ ID NO: 4168419 - RNA, 79 nt, Human
uuggcagggucaguuuaucaaugauuuuuggauguuuuaaaccacaugacacaaaugcagcauaaagugaacuuguuaa

SEQ ID NO: 4168420 - RNA, 78 nt, Human
uuggcauguguaacagugagggcagggacugugucuauuuuacauaucuuugucacucuacugucuauaccauguugg

SEQ ID NO: 4168421 - RNA, 67 nt, Human
uuggccaagugguuaaucuccaucuuccaaucccucccggagguuggaccaauaucacauggcucaa

SEQ ID NO: 4168422 - RNA, 99 nt, Human
uuggccaggcuggucucggacuccugaucucaggugaucugccugccuuggccucccaaagcgcugggauuacaggugugagccacugugccuggccaa

SEQ ID NO: 4168423 - RNA, 65 nt, Human
uucuaaauuugaagaucacucuggcugcuaugagucagcaaggccagaggggcacaaaaguagaa

SEQ ID NO: 4168424 - RNA, 84 nt, Human
uucuaacauccuuugguaucuuacuaguauuuagcauaggaaacuaacaaggaauacauggcagggagucaucugauguuggaa

SEQ ID NO: 4168425 - RNA, 72 nt, Human
uucuaaccuugagaccaagacuauaaugagagggcagcuuucugucaccccuguuucuggcuaaggcaagga

SEQ ID NO: 4168426 - RNA, 109 nt, Human
uucuaacggccgaaagagugucauaucucacgguuaugaugucuucaaaaggugauauuucuggcugugucaucauagcugugaaaagcauuuucucagcaucuaagaa

SEQ ID NO: 4168427 - RNA, 55 nt, Human
uucuaagagucauuaauggccuugacuucaaggaauuaauaaugcauuguuggaa

SEQ ID NO: 4168428 - RNA, 59 nt, Human
uucuaauacuuccuagucugggcaguauucucccagaucuaaguccaaaguacuuagaa

SEQ ID NO: 4168429 - RNA, 100 nt, Human
uucuacacaccauaccacagaacguuuggcccuuugucugugggcaauaauagagaaucugggaagauguuaaguugggugaguguuuaaguguguggag

SEQ ID NO: 4168430 - RNA, 55 nt, Human
uucuaccaacauugaaagccggaugucaccaagacaucaugcuuguguuggagaa

SEQ ID NO: 4168431 - RNA, 80 nt, Human
uucuacccucucugcccaaguuccuuagaggcauacaacaggcacucaaaggaagcuccuugauggcguaagagacagaa

SEQ ID NO: 4168432 - RNA, 62 nt, Human
uucuaccuauuucuucuauuggugaaauuagaagcaaaguuaucagugaagagugggaagga

SEQ ID NO: 4168433 - RNA, 81 nt, Human
uucuaccugugcuucucacaucacuguugucuccauugcccacgggagcaacaucuuuguguaugugagacccaaucagaa

SEQ ID NO: 4168434 - RNA, 57 nt, Human
uucuacuauaauggaguuagucauaggugagccaaguguuacucugcugaaguagaa

SEQ ID NO: 4168435 - RNA, 69 nt, Human
uucuacuauggcucaauucuagugguuuuuagacucauacuugaccugauagaaugagucaugaaugaa

SEQ ID NO: 4168436 - RNA, 88 nt, Human
uucuacucugauggccuggggauuccugagcaucaaacgaaaauuuguaucacaaugugaguguccuagcuagguuaauagacuagaa

SEQ ID NO: 4168437 - RNA, 109 nt, Human
uucuacuuauagucaaacaaaaagagcugagaaguuuuuuuuaaccauuuccccacaauauuuggcuuaagaauaccucucagcucuuuuuguuagacuauaacuagaa

SEQ ID NO: 4168438 - RNA, 68 nt, Human
uucuacuuggcaaagagaugcauaaggacucuuuucauuaugagucuguucaugucuuuuuaagugag

SEQ ID NO: 4168439 - RNA, 60 nt, Human
uucuagaacauucauacuccuuaggguagucuggccugagguuuuuggauaguuguagga

SEQ ID NO: 4168440 - RNA, 55 nt, Human
uucuagaggcugggaaguccuaggucaagggacugcaucugcuuggccucugggg

SEQ ID NO: 4168441 - RNA, 122 nt, Human
uucuagagggcugggccuaugggucuuggcuucaaucucaggccugcgggaagucguggggagcuggaugauugaggcaauaguacugauggucucugccaaagccacagccaauucuagaa

SEQ ID NO: 4168442 - RNA, 60 nt, Human
uucuaggcaggugggagugauuccuuuaacuuaaugaagaagacuuccauuugcuaagag

SEQ ID NO: 4168443 - RNA, 62 nt, Human
uucuaguaggggucagaugcauaugaaauagaauagaaaaaugcuuucagacucuuacagaa

SEQ ID NO: 4168444 - RNA, 67 nt, Human
uucuaguugcucuccuuuaaaccuggagacugagaagucaaggugguauuuuggaaagcagcuggag

SEQ ID NO: 4168445 - RNA, 66 nt, Human
uucuauaagguuuucuuuuguucccuuagaauucauuggagggaugcaguaaaaacuguaguagaa

SEQ ID NO: 4168446 - RNA, 99 nt, Human
uucuaucacguuuugcaaaucuuacauauaaagcugacucaugaaacuuuaauauugaaguuugaguuaggcauuauagcuagguuggguaugaaagag

SEQ ID NO: 4168447 - RNA, 61 nt, Human
uucuaucucaagauuauuggguuucuauaaggaaauguauuucagugauuuugaagaggaa

SEQ ID NO: 4168448 - RNA, 76 nt, Human
uucuaugaaugacacagauaauagaacgaaaaccauguucuuuucuuggaauauugcuuugugucauaagcaagaa

SEQ ID NO: 4168449 - RNA, 56 nt, Human
uucuaugcuucugaucuugguugauuguacugaggcagcuaggagaaagcauggag

SEQ ID NO: 4168450 - RNA, 61 nt, Human
uucuauuagaaucuuuagagucucacuggaaaugacagugauaauaagaguucuaacagaa

SEQ ID NO: 4168451 - RNA, 74 nt, Human
uucuauuagauuauucucaaggacugauaaauacuuuggauucuagguauccuuggugcaaaugauuuaaugaa

SEQ ID NO: 4168452 - RNA, 86 nt, Human
uucuauuuauucucauuagucuguauucccuauuucuauuauccguucgaaccgagagggaauucaguacagugugauauauagaa

SEQ ID NO: 4168453 - RNA, 62 nt, Human
uucuauuuuccaucugaccuggauggugcaaauuccagucgcuacuaacagggaaaauagaa

SEQ ID NO: 4168454 - RNA, 65 nt, Human
uucuauuuuucuuuguuaguucaguugcugccuaaaagcaagacuaggcucucauagagguagaa

SEQ ID NO: 4168455 - RNA, 92 nt, Human
uucuauuuuuggaaguuaucaaguauuuguuugaggcauugcaaagguuucucaaguucagauauuugaaagagccaccagacuucauagaa

SEQ ID NO: 4168456 - RNA, 76 nt, Human
uucucaaacaggggugacuuugucccccaggagacauuugggaaugucuggagacuugggucaucaaaacugagaa

SEQ ID NO: 4168457 - RNA, 74 nt, Human
uucucaaauugucuucugugcauuccuagggguucauuggaggcacuucuggggcuaauacagaggucagagaa

SEQ ID NO: 4168458 - RNA, 86 nt, Human
uucucaagacuccuaaauaaagcauuuccccugugugggcgaccccugggucccauguggggucaguguuugggucucucugagag

SEQ ID NO: 4168459 - RNA, 57 nt, Human
uucucaaggacaaaaugacaugacuucaugcuucaugauuuucauugucuucgagaa

SEQ ID NO: 4168460 - RNA, 67 nt, Human
uucucaaugggagcaccaaguaggaagaaaaaugaaauuggcuucuuggacuacucacuagagagaa

SEQ ID NO: 4168461 - RNA, 86 nt, Human
uucucacaauguguagcaucauuuauucaguguaauuaaacaaacccacuuugcacuaagugauucuaagcaucuugcugugggaa

SEQ ID NO: 4168462 - RNA, 55 nt, Human
uucucacaguaccuaacauguaaucgcgaauagcacuuaaauguuugcuggagaa

SEQ ID NO: 4168463 - RNA, 72 nt, Human
uucucacuguauaccagggccugugcugaguagacgaucucuuugagaccaccacaguccuacgggugagga

SEQ ID NO: 4168464 - RNA, 71 nt, Human
uucucagacuuccagcaccagccugguccuccuuuuucaaccauuucagguugaacaugugagucucagga

SEQ ID NO: 4168465 - RNA, 62 nt, Human
uucucagagcacugcugacaaagacaacagccuccaggcauugcagacagccgcucggggaa

SEQ ID NO: 4168466 - RNA, 66 nt, Human
uucucagagugaaaaaguaauucaacuuagcaauguugcuaaacaagaaacauuuucuguugagaa

SEQ ID NO: 4168467 - RNA, 72 nt, Human
uucucagaugccacauucuguugaggcugggucacuccgaguggcuccagggauagggugagggucugggaa

SEQ ID NO: 4168468 - RNA, 55 nt, Human
uucucagccccaauuugcccucuuggcucugccaggagguacagggugcugggaa

SEQ ID NO: 4168469 - RNA, 87 nt, Human
uucucaggcaggguuuucuuaacucuucauagaacagaaacguucucucuugaagauugaagacaaagguaaacacuugccugggaa

SEQ ID NO: 4168470 - RNA, 57 nt, Human
uucucagggucuggauggccugacugagaaaguuccaggccuuaaggacucggagaa

SEQ ID NO: 4168471 - RNA, 61 nt, Human
uucucagucucuugcuucauuaguuggcccucaggcuagugcuagaagcaaagacaaagag

SEQ ID NO: 4168472 - RNA, 62 nt, Human
uucucagugcaagugacugaucaagggauauggaugcugugggagaagcuagcacaggaggg

SEQ ID NO: 4168473 - RNA, 74 nt, Human
uucucauuaugcaaauguuucuuaucuauuguucaacuuucauaugaccacuggauaucagagauguaugagaa

SEQ ID NO: 4168474 - RNA, 69 nt, Human
uucucauugcaaucuggugaaaacaguuugagaguugccucugcuggucuucaccagaugcaaaaagaa

SEQ ID NO: 4168475 - RNA, 84 nt, Human
uucucauuucaugauucuggggcaaaagcugggcuuuaagauggggccgacuucaauagccccagagcacugagcaccugagaa

SEQ ID NO: 4168476 - RNA, 98 nt, Human
uucuccaagaagaggaucagauuacuuaaaauuguuggagaauucugguuguuugugcaauaaucauagugauuuacauugcuuuucuucuuucagag

SEQ ID NO: 4168477 - RNA, 62 nt, Human
uucuccagcacauuuucuuugauucagagcuaauaaaaaucaacaacaauguguuuggggga

SEQ ID NO: 4168478 - RNA, 60 nt, Human
uucuccaggccgcgcagggggcugcagagcuuuccggcgcuggcugccuggccuggagaa

SEQ ID NO: 4168479 - RNA, 59 nt, Human
uucuccaucuguaagauaggggaaauugucauuuucacugucuuuuaaggugguuagaa

SEQ ID NO: 4168480 - RNA, 69 nt, Human
uucucccacuccgugcuucaguuuccuuaucaguaaaaauggcuuugaaacacgcccaaguggaaagga

SEQ ID NO: 4168481 - RNA, 63 nt, Human
uucucccuccgucgucguucaccucugagcagauguucagggugaaccaggcaggaaugagag

SEQ ID NO: 4168482 - RNA, 117 nt, Human
uucuccgcauucuguuuuguuaaugugcaagucgaauggcauuaauuugggguuaaggaaguuacaaaauuccugucauuugcacuuucauucuuauuaaaaucagucaacacugaa

SEQ ID NO: 4168483 - RNA, 67 nt, Human
uucuccuaguuguugaauuaguugacugugucgcagugaaagauauuagucagaguucaccagagaa

SEQ ID NO: 4168484 - RNA, 57 nt, Human
uucuccucacugcagccuuucaugagcacuccacagaaaggaacuugugagugggag

SEQ ID NO: 4168485 - RNA, 84 nt, Human
uucucuagccauuaaagugcauguuuugcacugaauuggguugucagaagcaguaugacauguucuuucauggcuaauagagaa

SEQ ID NO: 4168486 - RNA, 84 nt, Human
uucucuauaauacaaugcuaugcaauggcacaugacaugauugcagugccaugaugcagagcaaugucuugcggucucagagaa

SEQ ID NO: 4168487 - RNA, 70 nt, Human
uucucucuaccccgcuaggauuaggauuaauccuagaaacuaggauuaggccugugcuggcaagagagga

SEQ ID NO: 4168488 - RNA, 115 nt, Human
uucucucuccucaguccucacccagggcuucugaugcugccagucaaucccaagucaugcuugguguuuggggaccacggcagugcaaaaccucugagggccuggggagaaggaa

SEQ ID NO: 4168489 - RNA, 55 nt, Human
uucucucuggaccugggaugcgcuuagcaagucccuucuuggaguccagagagaa

SEQ ID NO: 4168490 - RNA, 77 nt, Human
uucucugcacaaacuggcuggcuuguucacugacugggcaaccuuccccagcuucagaagaagccgugaggcaggaa

SEQ ID NO: 4168491 - RNA, 59 nt, Human
uucucuggccugaggcgaggccccucagcaggaaggggcccuugguuggggccauagga

SEQ ID NO: 4168492 - RNA, 101 nt, Human
uucucugucauucucugagacacucugucuaucaugcaugagacuaauuguuucugcaagcgucacaugauucugcagagcuuagaaugagcugcagugaa

SEQ ID NO: 4168493 - RNA, 68 nt, Human
uucucugucauuucuuuagcaaugggaacauuaaaacaauggcuacccaaagaagaagaugaagggaa

SEQ ID NO: 4168494 - RNA, 92 nt, Human
uucucuucagacccuccucagggauuaaggucaaaggugggaggaagaaggcuuccauuggccuuuuauccuagagguucuaauggagggga

SEQ ID NO: 4168495 - RNA, 70 nt, Human
uucucuucaggacauccccucuuuaggaggacaaauuuuuucuccagggaaaggggcguccgccucagaa

SEQ ID NO: 4168496 - RNA, 64 nt, Human
uucucuucuugauuuucacuggauagcuccuuucaggccguuuauaaaagaaucaggaaaagag

SEQ ID NO: 4168497 - RNA, 59 nt, Human
uucucuugacugcuaaaauuagaaagugucaauuuugaccucuguggcuguggggagga

SEQ ID NO: 4168498 - RNA, 63 nt, Human
uucucuugagcuggucauguuucucucagaauaauguuguagugugugccuaguuuuagagaa

SEQ ID NO: 4168499 - RNA, 72 nt, Human
uucucuuuacucuguguuauuguuuagaagcuaaaggagaaauagcugucagcauaacaagguaccagggag

SEQ ID NO: 4168500 - RNA, 60 nt, Human
uucucuuuuacugaguacuacagcugugaacaaagccaaguacuuucuuccgagagagaa

SEQ ID NO: 4168501 - RNA, 62 nt, Human
uucucuuuucaccaguugcuaaguuucuuggugucagaauaauagcaugggugaggguagag

SEQ ID NO: 4168502 - RNA, 58 nt, Human
uucucuuuugguaaauugaguaaaggaaagaauguauucagguguggccagaggagaa

SEQ ID NO: 4168503 - RNA, 96 nt, Human
uucugaagaccccugcucuaaaucucauggaacuugcauuaaucagcuuggcuaccauaacaagaucccauagagcagguggcuuaaacaacagaa

SEQ ID NO: 4168504 - RNA, 73 nt, Human
uucugaaggucagcagcuugguacugugccguaucuaauuuucucagccugucaugcugcugaaccuucagga

SEQ ID NO: 4168505 - RNA, 65 nt, Human
uucugaagugcauaaaggaaaaacugaaggccccaguguuuuuuggccuuugugcauguuuggaa

SEQ ID NO: 4168506 - RNA, 69 nt, Human
uucugaauucucuggcagacaccucccugaguacaggaucucgaggcagcuaucuuuagagacacagaa

SEQ ID NO: 4168507 - RNA, 66 nt, Human
uucugagaaggcuguggacacagacacaaugggcaugcugcacuuuguuccagcagcuucucugaa

SEQ ID NO: 4168508 - RNA, 67 nt, Human
uucugagaccuuggggagcccuguuggcuucuuucucggccaaacggagucagcaucaagggaagaa

SEQ ID NO: 4168509 - RNA, 55 nt, Human
uucugagaugcguuagaaauuuuuggaaacuagaacauucuaugugcauucagaa

SEQ ID NO: 4168510 - RNA, 59 nt, Human
uucugagccacaguaaggaucuaguccagcccuaaaugaguccuugacuguauucagag

SEQ ID NO: 4168511 - RNA, 78 nt, Human
uucugauccaaaugcuuuuaugguuguuggcuccuugaaccugccguuagauaauaacaagcauauaauggauuggaa

SEQ ID NO: 4168512 - RNA, 71 nt, Human
uucugaucucagggagccagcuccaccauccuccucacguggaguugggguagagccgcgcccugggggaa

SEQ ID NO: 4168513 - RNA, 117 nt, Human
uucugcaaaacaagaauuauuuuucugacuguaaaguuacuuuugaaaggacccuguuucccucuagaauuccuaucauauggcuuucauuuugagaagauggcucuuuauguagaa

SEQ ID NO: 4168514 - RNA, 78 nt, Human
uucugcaaacaauauggcuuaugcugaacaccugcucuuuuucugggagucuggaauuuuuguauaugcuaagcagaa

SEQ ID NO: 4168515 - RNA, 92 nt, Human
uucugcaaaccccaucucuuucgucucuggguucccuguuaaauuuccccacaaggggacacuagauggagaagggaaggugggaggcagga

SEQ ID NO: 4168516 - RNA, 67 nt, Human
uucugcaaauagugaaacagaugggggaugaauugagcugucccucacuuccuccuaauuccuagaa

SEQ ID NO: 4168517 - RNA, 99 nt, Human
uucugcacaugaguaauugggggcagaggcugacccugcuguuguauaaaaguaauugacggcaguaaauucagcccuuuguguugcucagguauagaa

SEQ ID NO: 4168518 - RNA, 73 nt, Human
uucugcacuaaauaucaaauaucugaaaugaaaggauuuaugggagguuuuauguuugcuauuuaggcaugga

SEQ ID NO: 4168519 - RNA, 76 nt, Human
uucugccugcaugcccgcccccuucuaguacuggaaguaaacaucuuacuugauagggggaugggguuagggagaa

SEQ ID NO: 4168520 - RNA, 56 nt, Human
uucugccuggcaggaggacuguggcccgguuguccaaucgauaaugcccagcagag

SEQ ID NO: 4168521 - RNA, 69 nt, Human
uucugccuugcucuccuacagggccuugcucuucucuggcaguuccuacaguggaaagcgcaggcugaa

SEQ ID NO: 4168522 - RNA, 60 nt, Human
uucugcucaucagccgagcagggcgauuuaucaagaguccugacggcugauuggccugga

SEQ ID NO: 4168523 - RNA, 55 nt, Human
uucugcugacagcccugcuucagguuggcaaagccucuauguggcugucagagaa

SEQ ID NO: 4168524 - RNA, 65 nt, Human
uucugcugcaguuggauaaagauacuucagcucauaccacugaaguugguagccaggugccagaa

SEQ ID NO: 4168525 - RNA, 78 nt, Human
uucugcuuauucuguagccuuuauuuuuaacauguuaaaagaaugauuaggcuggcagaaccugauaaaugaacagaa

SEQ ID NO: 4168526 - RNA, 60 nt, Human
uucugcuucugcaggagcuccugaugccgggcgagcaucuccacucgggcaggggcagga

SEQ ID NO: 4168527 - RNA, 56 nt, Human
uucuggaaaugaaugcuaggaacagaagguuuuccguggccagccauuuccuggaa

SEQ ID NO: 4168528 - RNA, 108 nt, Human
uucuggagcuagguaaauugggaucauuccuggcuugucacaucuacgugggacauuuagacuauccacgggcuggauaccuuaggaaaguuccuucuggcucuggga

SEQ ID NO: 4168529 - RNA, 84 nt, Human
uucuggaguuuguggaaauacagauauguaugcacuuuuugucccucccaaauugugcuguuguguuguacccaguagccggaa

SEQ ID NO: 4168530 - RNA, 56 nt, Human
uucuggaucagcaucaugagauaauuugcuuaggguauccaggauguugauuugaa

SEQ ID NO: 4168531 - RNA, 97 nt, Human
uucuggccccaacaauauauaagcugaugagccacagugauauauaaaaccugucaaccaaguauuugugaaucagcuguauagauuguuggcagga

SEQ ID NO: 4168532 - RNA, 74 nt, Human
uucuggcccuuugcauuauccuugauugagccugugagcuucaaggacaggagauaauauaaagauaaacagga

SEQ ID NO: 4168533 - RNA, 91 nt, Human
uucuggcuacucacagugugucuuggaucaguagcaucagcgucucccuggagcugucuagaaaugcugagucucaggccccacuccagaa

SEQ ID NO: 4168534 - RNA, 60 nt, Human
uucugggagagaaagggccuugaauguaggaucaagggacauaggcuuuuucuugcagga

SEQ ID NO: 4168535 - RNA, 58 nt, Human
uucugggauguacaguuuugccuuauccuuucaguuuggcagcugugcauucuuagga

SEQ ID NO: 4168536 - RNA, 108 nt, Human
uucugggccccaaggcagagcauuucaugcagagcuggggacuggauuggcucccucugagcuacaccagcuugccugggcucucaagcagcucugccuggcccugaa

SEQ ID NO: 4168537 - RNA, 102 nt, Human
uucugggguaaugaguuccauaaguuuaucuuugcuggguacuguaaauuccuguuuaccaagggacccacagaaauaaacagaauacucggaugaccagaa

SEQ ID NO: 4168538 - RNA, 59 nt, Human
uucuggguggccuuguucuaaauuaggcagaaaggauaaguugaagaaggaaucuagaa

SEQ ID NO: 4168539 - RNA, 86 nt, Human
uucuggguuauucuuagggaaaguuagaaugauaucaacgauauuuucugucuuugaauucaaacuguucaaaagaauguucagaa

SEQ ID NO: 4168540 - RNA, 56 nt, Human
uucuguaacacauuuuuguaccuuaaagggcagaggaccauuaugugguuauagaa

SEQ ID NO: 4168541 - RNA, 63 nt, Human
uucuguagacugcugaaugagacuugagugguuuauaucauugaaaacucagcaucuacagga

SEQ ID NO: 4168542 - RNA, 58 nt, Human
uucuguaggucacaaaguucuuaggaaaaauucuaaagaaacauugagaccuggggga

SEQ ID NO: 4168543 - RNA, 77 nt, Human
uucuguauccucaacauucauauauagccacauccaguagaaauaaguguggcuagugaugaauauuguagauugaa

SEQ ID NO: 4168544 - RNA, 71 nt, Human
uucuguaugcucuggguccagaaaagcuuguccucuucagagcagucacugugucucagagcaggacagaa

SEQ ID NO: 4168545 - RNA, 110 nt, Human
uucuguauuaauaaaggcauagaggcauaaaaguguuuaacauguucaagaaacauaauaugguuuguguuagauguguuggcauaugugcuuguuguguacuugcaggg

SEQ ID NO: 4168546 - RNA, 87 nt, Human
uucugucaaagcucuggaagcccugguaguuacuguucuuaauugguaugucagucucaacaccaaugcccuuccuggcugauggag

SEQ ID NO: 4168547 - RNA, 69 nt, Human
uucugucagauacuguggcuuaugggcuagacauagucugugcccuuggauaauacaguaccugaagag

SEQ ID NO: 4168548 - RNA, 57 nt, Human
uucugucaucagauuguuccaggagcagugaugcucuuaauuaagcugagaucugag

SEQ ID NO: 4168549 - RNA, 66 nt, Human
uucugucauguuuccauuacaugucuuuacauaguuuuggauuacauguaggaaacauagauggaa

SEQ ID NO: 4168550 - RNA, 82 nt, Human
uucugucccacuguuucccugaggcucucuggcucacacauuccaaagagaguugaagaaccucuggauacaguuuaaagag

SEQ ID NO: 4168551 - RNA, 87 nt, Human
uucuguccuuaagcuguccaugucuggccucagucuucuuaucuguaaaaugggacugggccacauagaccugcuguacuggcagag

SEQ ID NO: 4168552 - RNA, 55 nt, Human
uucugucuucucuaacuuccccuuuggggcaggagucacacagagaagauaagaa

SEQ ID NO: 4168553 - RNA, 66 nt, Human
uucugugaaucauggauaaauagcuuaacuuugguugcuauuguuucccaugauuuaacuuuagaa

SEQ ID NO: 4168554 - RNA, 58 nt, Human
uucugugacccaguuccuggcacccagcaggcgcucgguggacggauggguggcggaa

SEQ ID NO: 4168555 - RNA, 68 nt, Human
uguggcucuggagaccugcauuuauauuuauuccuuuagaugccaguccagcaggucacuaggcugca

SEQ ID NO: 4168556 - RNA, 55 nt, Human
uguggcugauugguaccaucuucagagaccccaucugagugcuccauucugccca

SEQ ID NO: 4168557 - RNA, 55 nt, Human
uguggcugcagacacuggagccugggagauaagucagaccaagucuggagccaca

SEQ ID NO: 4168558 - RNA, 56 nt, Human
uguggcugccacccugaagccgugaggggacccagccuucagaagaagcagcuaca

SEQ ID NO: 4168559 - RNA, 65 nt, Human
uguggcugggcuaauaggcaaagccagggacuauuucaaacuggaguuucugcagcccagcagca

SEQ ID NO: 4168560 - RNA, 57 nt, Human
uguggcuugaaaggcacgcucaugaggucauuuccuuugaguggccacugggucgca

SEQ ID NO: 4168561 - RNA, 123 nt, Human
uuggcuacacauuggaaucauuugagguagguugaaagauagauucugauuuaauugucuaggaugcauccugagcaucaggauuuuuuuaaaucuuuccguaugaagcuuacaaauagucag

SEQ ID NO: 4168562 - RNA, 56 nt, Human
uuggcuagcaggaaaacgccucauagccuuggaugugagugccaccugcuggccaa

SEQ ID NO: 4168563 - RNA, 72 nt, Human
uuggcuauuaugaauaaugcugcuauaaauguuuguguacaggccauucauauuuuagcauuaauuagucaa

SEQ ID NO: 4168564 - RNA, 81 nt, Human
uuggcucaugauacccaaguaccuagaaauauuuuugaagcuaugugucuguaugugugucuggguauguguuaggguuaa

SEQ ID NO: 4168565 - RNA, 61 nt, Human
uuggcucaugcuguuuugugcagugcacaaauugcacaacuguauacagcaacugagccag

SEQ ID NO: 4168566 - RNA, 93 nt, Human
uuggcugagucaaugccgaauaguauauauggugguugaugggguguugacauucuuucuaacagcaaauguuuaucugguguugcuggcuga

SEQ ID NO: 4168567 - RNA, 87 nt, Human
uuggcugugcuucaugggguggaguccgggcagcgcucugagaagugcgugcagccuagggccuuucucaccgagagcucagaccga

SEQ ID NO: 4168568 - RNA, 121 nt, Human
uuggcuucacuucaggacuggcagcuuuuccaggaacaaacucaccuuauucucugaacuggauaaucuacauaaaggcugaggugguuuguaucacuggguguguuaguuuuaaggccaa

SEQ ID NO: 4168569 - RNA, 60 nt, Human
uuggcuucucuuaacccuaaagucuacaguacuuagauuggggauuaaauuggaagugaa

SEQ ID NO: 4168570 - RNA, 63 nt, Human
uuggcuucuuuucuagacagaaguuccccaguggaaaaugugucuaugagaaguucaggcuag

SEQ ID NO: 4168571 - RNA, 97 nt, Human
uuggcuuuggaguuguaaagaccugaauuugaauacugauucugcuacugaauaugguagaaucuugggcaaauucaucuaucucuccaucagucaa

SEQ ID NO: 4168572 - RNA, 129 nt, Human
uuggcuuuuagaauuugauuauauuuaggauuaggguacauuuuguugucaaauguuucuaaggccacaacagggacaauggcuugcaaauggguccauauucuuacauauucucucuucccgaaccaa

SEQ ID NO: 4168573 - RNA, 94 nt, Human
uugggaacgcagcagccaccagaccaccaagagcaacuguagguugggcuugguggugcugguuuaguguuguggcugaugagguguaacccag

SEQ ID NO: 4168574 - RNA, 73 nt, Human
uugggaacucuccaggguauuaaugauuuauuagucuuauuaauauagcucacuauaccauggagguuucuaa

SEQ ID NO: 4168575 - RNA, 79 nt, Human
uugggaacugcuguucuggagacacugaugaagcugguggcaauagacaguucaugaggucuaagccagaauuugccaa

SEQ ID NO: 4168576 - RNA, 130 nt, Human
uugggaaugagggccuauucccaggccacacacagaaccgcucgccacuugaacccuaacuucuaaucuuccaguggcucaaguggugggcaguucuguguguggccugggaauaggcccucauccccaa

SEQ ID NO: 4168577 - RNA, 80 nt, Human
uugggaauuccuuggguauuuuucacaguucacugcuuuguagcaugacacagauuagagacauaccaaagaacucucag

SEQ ID NO: 4168578 - RNA, 76 nt, Human
uugggacuuugggggucacugguccgcugcccccucugcuuuagagguggggaaaccagcgaucccagaggcccgg

SEQ ID NO: 4168579 - RNA, 65 nt, Human
uugggagcaccuugagggcagaaaccaggucugacucaucuuuauuccccucaaggaguuccugg

SEQ ID NO: 4168580 - RNA, 98 nt, Human
uugggaggauugccugagccugggaggcagagguuguagugagccgagauugugccacugcacuucagccugggugacagagcaaggcccgcucucaa

SEQ ID NO: 4168581 - RNA, 58 nt, Human
uugggagguaauggagccaagugaaugacacuuuuguagcuauucaucugcuuuccaa

SEQ ID NO: 4168582 - RNA, 60 nt, Human
uugggaggucugggugggaggauugcuugaagccagaaguucucaaaaccagcuugacaa

SEQ ID NO: 4168583 - RNA, 112 nt, Human
uugggagguuaaaaaaaucuccgugccuuggucccaacccccauccccgagacugugauguaauuggucugggguggggccuaggcauggggauauuuacaagcucucccag

SEQ ID NO: 4168584 - RNA, 85 nt, Human
uugggaguggugaggaagggcagcugguuaaguuugcauuguaaucaguguggcugucccgcugacuuccagcucucccuccuaa

SEQ ID NO: 4168585 - RNA, 60 nt, Human
uugggauaagucauuuggagccacuggaggguuuugagugcgaaaaaugacuugaucuga

SEQ ID NO: 4168586 - RNA, 74 nt, Human
uugggcacaugacacaggccuggccaaucagaggagucucauaccucugguugaagggaugugcaugugaucaa

SEQ ID NO: 4168587 - RNA, 68 nt, Human
uugggcuucucugaucaauauuucacagaacucuacaauaaaauaugugagucacagaagaagcugaa

SEQ ID NO: 4168588 - RNA, 100 nt, Human
uuggggagggauacuuaaagacuccaggaugcagagguuuuuaauacauuuguaguauuucacagacugcaaagugccuuugcaucugugacuucuccaa

SEQ ID NO: 4168589 - RNA, 76 nt, Human
uuggggauacccuuaaacagaaugcguaagaaguggcuauaaucaggugcuuccaauucaaaucugugguccucaa

SEQ ID NO: 4168590 - RNA, 93 nt, Human
uuggggccacuguguuguacaaugccagggaacaccauuuacaucaucuuugagaaugggucccucuggaguaguacaguugcacugcuugga

SEQ ID NO: 4168591 - RNA, 62 nt, Human
uuggggcuaacuuucugaggguaguuguuuuaggacgauuggcagcagggaguuggccgcaa

SEQ ID NO: 4168592 - RNA, 73 nt, Human
uuggggcugacauagugugauuugaggagucuaaggaaggucaguucccaaagucaagcugugucuuucccag

SEQ ID NO: 4168593 - RNA, 77 nt, Human
uuggggcugcuggaagcaugcgaugaaggauguguaugaacgugcuuuauaaacuaugaugcauccagcaggucuaa

SEQ ID NO: 4168594 - RNA, 72 nt, Human
uugggguauuuggaugcacuaaauaaaauaugauauaucgcagauuuuggcaaugcauauaaguuaccuuaa

SEQ ID NO: 4168595 - RNA, 68 nt, Human
uugggguuccuggcuguaagcguguuuccuaggaaaccuccugggauugagugcagcaggcucucuga

SEQ ID NO: 4168596 - RNA, 92 nt, Human
uugggucacugcuuuggaugacuggugcagguucaaccuagcaaaacaauuaggaaaccaguuuagucaugcuguaagcgguaucacaccaa

SEQ ID NO: 4168597 - RNA, 74 nt, Human
uugggugugaaggagcccucuauagccaaaaucucaaaagggguuucauguuaguugguucuuggaauauucaa

SEQ ID NO: 4168598 - RNA, 72 nt, Human
uuggguuuccaagagaguuguaguucaagcaagcaggcaggcaguagaauuacauaguuucuagguucuuaa

SEQ ID NO: 4168599 - RNA, 88 nt, Human
uugguaucuuagcuguuaaguuguuuggaaagucagauaaaugucucuuacccagagcuuuuuaaaauucuuagcagcaaagucccga

SEQ ID NO: 4168600 - RNA, 79 nt, Human
uuggucagacaaaggagaauguuccaugaagcccuuguucccgggacccaccuugagcaaucuucaauuugucagccaa

SEQ ID NO: 4168601 - RNA, 108 nt, Human
uuggucagggguuuauccagacacagcagaucuggcuacagguuaaagguacaaggcaaucuagagugcuaggucuguguaaaagugacugaugaaaauucugaccaa

SEQ ID NO: 4168602 - RNA, 61 nt, Human
uuggucaguccaaugauuguaggacauuaccuaauaauuucuuuuaucuuggcugauacaa

SEQ ID NO: 4168603 - RNA, 61 nt, Human
uugguccugcccccuccagguccuugaaggcuccagcuggaagcugcuggggcagggccga

SEQ ID NO: 4168604 - RNA, 73 nt, Human
uuggucuaguaaauguuugcugaugauucugauauuuaauucuuucagaauuuauuuuguuuccuaugaccaa

SEQ ID NO: 4168605 - RNA, 68 nt, Human
uuggucucugcauguagcuaguaauaaaaugcguaaacuacagggcuuuggggugugcagagaugcaa

SEQ ID NO: 4168606 - RNA, 72 nt, Human
uuggucuugaauauucuuggaaaugauugaaugcugcagcuuucaauacaaagaaaggaauuuugauaccag

SEQ ID NO: 4168607 - RNA, 56 nt, Human
uuggugaaaguaaagcaacugguaguacuauuucuacuaaccuuaaccaucaccag

SEQ ID NO: 4168608 - RNA, 92 nt, Human
uuggugaaugucuugugagucuguaugucuuccaugcacaggcauuuuaaccugugcaugaaagacauacagauucagggcuauguuuucaa

SEQ ID NO: 4168609 - RNA, 64 nt, Human
uuggugacuccccaccaugaugucaggagcagguucuagcccaucagugagggggaaucacuaa

SEQ ID NO: 4168610 - RNA, 59 nt, Human
uuggugaggacaugugcaacuucuuuggacaaugauugucccaugugaugucucauuaa

SEQ ID NO: 4168611 - RNA, 74 nt, Human
uuggugcaaaaguacuugcggauuugccaucaccuuuaccuuuaauggcaaaacugcaguuacuuuugcaccaa

SEQ ID NO: 4168612 - RNA, 68 nt, Human
uuggugcacuucccuuuuggcauaaaugaacuucagaaguuccaugacaccgagggaagucucuccaa

SEQ ID NO: 4168613 - RNA, 70 nt, Human
uugguggggaagauuguaggagguuaaggaucaaggaaccugagauaucaccuucugaauuaccuaccaa

SEQ ID NO: 4168614 - RNA, 85 nt, Human
uuggugucaugagucaggugucuaucuaaccuggucaaucagcuauggcugugggccaggcuggaaagaacagacauggcagcag

SEQ ID NO: 4168615 - RNA, 66 nt, Human
uugguguugaaguugggccacuguggggaaagaaaugagugguccagaagauauucaaccagccaa

SEQ ID NO: 4168616 - RNA, 78 nt, Human
uugguuaccaugccuaaguaaugaagcugugaauuccuugacaagaaucguugccuuggagugagcagugggugccaa

SEQ ID NO: 4168617 - RNA, 59 nt, Human
uugguuaggaauaagaccauccuaauaauuagccauuagaaaauggucucacugagcaa

SEQ ID NO: 4168618 - RNA, 76 nt, Human
uugcuucuuucauuuauucaacacguguuuaucgauggucucauaugggccagcacuguucuaaggaaacaggcaa

SEQ ID NO: 4168619 - RNA, 76 nt, Human
uugcuugaacccagaaggcggagauugcagugagccaagauugcgccauugcacuccagccugggcacuagagcaa

SEQ ID NO: 4168620 - RNA, 76 nt, Human
uugcuugaacccaggagauggagguuguggugagccaagaucacgcuacugcacuccagccugggugaagaagcaa

SEQ ID NO: 4168621 - RNA, 76 nt, Human
uugcuugaacccaggaggcagaaguugcagugagccgagauuaugccacugcacuccagccugggugacaaagcaa

SEQ ID NO: 4168622 - RNA, 76 nt, Human
uugcuugaacucuggagguggagguugcagugagccaagauugugccacugcacuccaaccugggugacagagcaa

SEQ ID NO: 4168623 - RNA, 76 nt, Human
uugcuugaauucgggaggcggagcuugcagugagcugagaucgcgccacuguacuccagccuuggcgacagagcga

SEQ ID NO: 4168624 - RNA, 77 nt, Human
uugcuugacaacgucaggcuacacucuuuucauggaucucaucuccaagguguucuuuagccugauguggucagugg

SEQ ID NO: 4168625 - RNA, 76 nt, Human
uugcuugagcccaggagguugaggcugcagugagccaugaucaugccacugcacuccagcccgggcaacagagcaa

SEQ ID NO: 4168626 - RNA, 72 nt, Human
uugcuugagcccaggggacaauguggugagcugagaucacgccacugcacuucagccugggugacagagcga

SEQ ID NO: 4168627 - RNA, 69 nt, Human
uugcuugaggcugaggaggucgagguugcagugagccaagauugcaccacugcauuccagccugagcaa

SEQ ID NO: 4168628 - RNA, 88 nt, Human
uugcuugucacaacgcaagaguuucuuacuggcaucuauuggguagagaccauggaugcugcuaaaauucuaacggcucacaggacaa

SEQ ID NO: 4168629 - RNA, 129 nt, Human
uugcuuuagguacuuugaggauuuuucuggugcauacauguuuaaguuuguuauaugcacauauauauuauauuuauauugagauuugagcauuguguccuuaugaaaugucuuuuuuaucucugguaa

SEQ ID NO: 4168630 - RNA, 79 nt, Human
uugcuuucuuucaugaacagacaaggaacuucugauuuucugcccauagaccguucgcuuggcuuucuuggaaaagcaa

SEQ ID NO: 4168631 - RNA, 60 nt, Human
uugcuuugaugcuggagaacuaaucacccagagagagcuggucuccaggcaggugagcga

SEQ ID NO: 4168632 - RNA, 64 nt, Human
uugcuuuguuacugcaguuuccacucuuucagcuccagcugggcugacugcagcugcagggcag

SEQ ID NO: 4168633 - RNA, 66 nt, Human
uuacacauaccaauuagaguuuguugcagggaauagccacucaaacuagccugacugguauuguaa

SEQ ID NO: 4168634 - RNA, 64 nt, Human
uuacacauuaaaauccuaacuuccaauguaauacuauuaggaagugggaccuuuugagagguga

SEQ ID NO: 4168635 - RNA, 129 nt, Human
uuacacauuagacauauuucucagaaaccuuaacauaacuuuuccuugacccucaaaacagauaaaugguuaagggggaugauggaaaagucuguuaucaaaguuuuuacauuauauggauguccguga

SEQ ID NO: 4168636 - RNA, 83 nt, Human
uuacacauucgugugggcaugccugcgcagugcauguauguuuacauguaguguauauggggugcaaaagcaauuaugugugg

SEQ ID NO: 4168637 - RNA, 57 nt, Human
uugucucacguccuccuccccacccuucucagggcucagaggagcuaucggagacag

SEQ ID NO: 4168638 - RNA, 57 nt, Human
uugucuccuccauuugaccauagauguugaaguuaucagggucaggggcggagagaa

SEQ ID NO: 4168639 - RNA, 70 nt, Human
uugucucucauguuucugguacuccuuggauagcucguccagggcuguaaaauggauauaugagcgauga

SEQ ID NO: 4168640 - RNA, 81 nt, Human
uugucugccucaugcuguggucuggcagacagcaacucguuuaagucuucuuccagccaauagcguccuugaguaagacaa

SEQ ID NO: 4168641 - RNA, 72 nt, Human
uugucuguugauuguggauuuuuauauauacauuauauaauuauguauaaguacacagucggaauugaacaa

SEQ ID NO: 4168642 - RNA, 63 nt, Human
uugucuguuuguauacuggucuaauccacaucggauguaccaggaggaggacaaauuagacaa

SEQ ID NO: 4168643 - RNA, 58 nt, Human
uugucuuaugcugcauagacuauucaccuccuaacuugaaggucuaaucauaagacaa

SEQ ID NO: 4168644 - RNA, 62 nt, Human
uugugaauagugcugcaauaaacauacgugugcaugugucuuuguagcagcaugauuuauaa

SEQ ID NO: 4168645 - RNA, 56 nt, Human
uugugacuuuuucuuguuuuuggccaaaggcuuuugcaaaagcaaugaaguuauga

SEQ ID NO: 4168646 - RNA, 60 nt, Human
uugugagaguuuaccuugaccaagcacccucaugucaaugugcucauuugggccucacaa

SEQ ID NO: 4168647 - RNA, 76 nt, Human
uugugagaucgaucuguccuggcaguuaacacgaugugcaacaguguguuagcauggaacagaacgcuuuucacaa

SEQ ID NO: 4168648 - RNA, 129 nt, Human
uugugaugaggugaauucggaucugauccaggccaguagcuccugcaaaacugggauaguuccaugcccacaguuaaugggggcucuucugggauggauauaacaugguuccuggguuccuguaucaaa

SEQ ID NO: 4168649 - RNA, 81 nt, Human
uugugauuugaauuagguuucauggaguaugggucauaggaguuugacucaauacccagggacucuagacucuaaugacag

SEQ ID NO: 4168650 - RNA, 58 nt, Human
uugugauuuucccugauucuguagaaaaaugcuuuuccagggcuagagagaaugacaa

SEQ ID NO: 4168651 - RNA, 60 nt, Human
uugugcaaggucuggacuauaguuuuuuagcaucuacuguuuaucaggcacuugacauaa

SEQ ID NO: 4168652 - RNA, 60 nt, Human
uugugcaauccccucauuuuauagaucagaaaacaagucuagagagguuaaguugcacaa

SEQ ID NO: 4168653 - RNA, 92 nt, Human
uugugcacacacauuuuucuggauugauugcucugugaacuucaaacuuugacuuacaucagaaucacccaggaagguuuguuuaaacacag

SEQ ID NO: 4168654 - RNA, 69 nt, Human
uugugccuuucugggccucaguuuccccaucucuacaaagacagggugggcccagcccagagaagccaa

SEQ ID NO: 4168655 - RNA, 65 nt, Human
uugugcuaaauaaguggaauagacaccuugcauuuacaauggacugucuauuuuauuuggcgugg

SEQ ID NO: 4168656 - RNA, 64 nt, Human
uugugcucaggauucucgacacucacagagagcuugaggaguccgaggaucccgagaaacacga

SEQ ID NO: 4168657 - RNA, 124 nt, Human
uuguggauguuacugcacauuuuuauuauuaacacuaguuuaucugcauaaauguuuauaugcauguuuuuugacaguuuauguaaaauuaguaaugaaugauggcaauggcuuuaaccuauaa

SEQ ID NO: 4168658 - RNA, 81 nt, Human
uuguggauuuaauagucauaguuuugcuaauuguaaaccacucuuugguacauauuuaaauugugagcuauagaucuagag

SEQ ID NO: 4168659 - RNA, 64 nt, Human
uuguggcugccaucuguguaauacggaauuaaaugucuuucuggcucuacagaaggcaccacaa

SEQ ID NO: 4168660 - RNA, 57 nt, Human
uuguggcuuauucuaauuuaaagcugucuggcuuagugaauuucgguauggcuauaa

SEQ ID NO: 4168661 - RNA, 62 nt, Human
uuguggcuugagggaaauaacugaugcuuuccuugaaaggcauggcauuccucaagcaauaa

SEQ ID NO: 4168662 - RNA, 63 nt, Human
uuguggggaguggugaugguauucgugguuaaagauccauagagcauuaugacaaccccauga

SEQ ID NO: 4168663 - RNA, 91 nt, Human
uugugggggcuguccuaugcauuguugaauauuucauagcauccguggucucuacccacuagagauaucagcagcaugcucagccccccag

SEQ ID NO: 4168664 - RNA, 70 nt, Human
uuguggugggacuucugcuucccucagccuuuucagaguggguggggaagaaccgggauucccauuuuag

SEQ ID NO: 4168665 - RNA, 63 nt, Human
uugugguugcuccaugacaaccuguaucaccaaguggaugcugucaugaugugcacaccacag

SEQ ID NO: 4168666 - RNA, 56 nt, Human
uugugguuucuuuauuuggaucuuuaauaaggaggauggauuuaaacaggccacaa

SEQ ID NO: 4168667 - RNA, 76 nt, Human
uuguguaaugaacacagaauuucacuuugggauaaugaaaaaguuuugaagucagaggaugauguugguugcacaa

SEQ ID NO: 4168668 - RNA, 60 nt, Human
uuguguacuguugguugauauuuucuaaguagaugaagauguaagucaaaaguugcauaa

SEQ ID NO: 4168669 - RNA, 90 nt, Human
uuguguaggagcuuguuggaaauguagauucucagaucacaucccugaccuacuguaucagaaucugcauuuaacaaaaucuuuggauaa

SEQ ID NO: 4168670 - RNA, 64 nt, Human
uugugucauguuccauugaaaaguuucuggauaucagaaagaaagucaaccugauaugaugcaa

SEQ ID NO: 4168671 - RNA, 68 nt, Human
uugugucuuuggcgucccuggggcuugccugcaaggaggcagguguugggagacaccauggggcagag

SEQ ID NO: 4168672 - RNA, 83 nt, Human
uugugugauuaauuggauguucucuggaagcaugaaauaugaacugauuucuaguuuuuguaaggacgcuaguuaauuuauaa

SEQ ID NO: 4168673 - RNA, 56 nt, Human
uuguguggcugacaaccacuggaggaggcuucuugcuuccugguucagccauggaa

SEQ ID NO: 4168674 - RNA, 83 nt, Human
uugugugguuuaugcuucuuguauauaaaaaucauuugcccuuguggccaaaugaaguuaugcaaaaacaaaguauuaugcaa

SEQ ID NO: 4168675 - RNA, 69 nt, Human
uuguguguguguauaauguauguguguguauauauauauacacauauauuugcauauacacacauacaa

SEQ ID NO: 4168676 - RNA, 70 nt, Human
uuguguguuuguucgugacuccaaagacuaaaugcagucuugaauguccuguggcaaaguuuacacauaa

SEQ ID NO: 4168677 - RNA, 75 nt, Human
uuguguuaaggugcaucuagugcaguuagugaagcagcuuagaaucuacugcccuaaaugccccuucuggcacag

SEQ ID NO: 4168678 - RNA, 55 nt, Human
uuguguucagugcggcggaaaucugagccucccuccaccagcugcgcugaaccga

SEQ ID NO: 4168679 - RNA, 70 nt, Human
uuguguucauucugagcccuugucuucaugguaagaacuguguccacggcugagaaugauuaaagcacaa

SEQ ID NO: 4168680 - RNA, 90 nt, Human
uuguguuuccugacauuccaagaaguccugcaaaacugaaaaauacaaucaucgcugcaaggugcuuuuuggugucacagauaugcacaa

SEQ ID NO: 4168681 - RNA, 59 nt, Human
uuguguuucuaugcuaagaaagugccacgcugcuaacucuuuagagcucagaaauacag

SEQ ID NO: 4168682 - RNA, 87 nt, Human
uuguuaaaaauacagauucuuggacccacauuagaccuaaagaauuaggaucucucugaaagggcuaaauaauuuggauuuuaacaa

SEQ ID NO: 4168683 - RNA, 66 nt, Human
uuguuaagugcuacugaaauugcuuuuuaucauccaaauaagaagcaguucacaaguaaaaugcaa

SEQ ID NO: 4168684 - RNA, 82 nt, Human
uuguuaaucaugaaaauuuccuggccuuaacuugauggcaauuaagucuaugguagagccugggaauuugcauguuuaauga

SEQ ID NO: 4168685 - RNA, 130 nt, Human
uuguuacaucugccugagaagucuuugggcuaaucacaaauuuagacagagcugaauucuucaaucugucuucuuuugugguuuugugauccuagaaggcucucggggguaaagauccagaaguauccca

SEQ ID NO: 4168686 - RNA, 61 nt, Human
uuguuagguauucagucaguccuaauuagcaguucugaaaucaauuuugauuaucugacaa

SEQ ID NO: 4168687 - RNA, 58 nt, Human
uuguuauggagcauaucugcaucauuuuuaugguugaugauguuugcuugaguaauaa

SEQ ID NO: 4168688 - RNA, 123 nt, Human
uuguuauugacuugucucuaccucacacugugcuagucacuagaguugcaaucauggacaauaagaaauaugccugucauuaugaggauuacaauacaguggggcaggggacauaaauaauag

SEQ ID NO: 4168689 - RNA, 83 nt, Human
uuguucaaaggauuaagaugagauuagcauuugguaaacccuuuaagguuuacacagugcuuuuauaucauuaauccuaacaa

SEQ ID NO: 4168690 - RNA, 77 nt, Human
uuguucacaguucugcaggcuguacaagcagcaugaugccaacauuugcuucuggugaggccucaggaaguuuacaa

SEQ ID NO: 4168691 - RNA, 59 nt, Human
uuguucacuguuucaucccuagcacuuaggagagugccuggcacauggaagguguucaa

SEQ ID NO: 4168692 - RNA, 63 nt, Human
uuguuccacaucacacuacuugauuuguucaaaccaagaucuaaagucauguuugugggagga

SEQ ID NO: 4168693 - RNA, 89 nt, Human
uuguucugguuugccuugaacugagcaguuuccugggacguggggcugccagugcugaaaccgugacaguuccaugcaaacugggacag

SEQ ID NO: 4168694 - RNA, 62 nt, Human
uuguucuuggcuuggaacuaagugggagcauucuuuauucuacuuugucaugcuaagaguga

SEQ ID NO: 4168695 - RNA, 63 nt, Human
uuguucuugucuuugccuucaccuaagaaaauaaugaagggugguaaacaaggauaagaagga

SEQ ID NO: 4168696 - RNA, 61 nt, Human
uuguugcagagaugaaugacauagguguaaauagggcugaacucauucaaucucugaacag

SEQ ID NO: 4168697 - RNA, 89 nt, Human
uuguugcccaggcuggucuggaacuccuggcuucaagugauccuucugagucaccaggauuucaggcauaagccaauauggcucagcaa

SEQ ID NO: 4168698 - RNA, 65 nt, Human
uuguuggugugaaaauaaugcuaauuuuuacuaacacgaaacugauguauaacuuacaccagcaa

SEQ ID NO: 4168699 - RNA, 68 nt, Human
uuguuguaaauggaaauccaagucaccguaguuuuagcagaugguggguuauuuuccuuacauagcaa

SEQ ID NO: 4168700 - RNA, 67 nt, Human
uuguugucaauccaaaaaccuggggaaggcuaaagugaacuccuucuauuuguuuauguggcagcaa

SEQ ID NO: 4168701 - RNA, 55 nt, Human
uuguugugguuuaucaaagugguaucacauacaucacauuugaaccucacagcaa

SEQ ID NO: 4168702 - RNA, 83 nt, Human
uuguuguguuuaaccucccccaccugaggacagucuuauuuuaaaauaaggcuuuuguucagcguggguguauuuuauaauaa

SEQ ID NO: 4168703 - RNA, 59 nt, Human
uuguuuaagucacuugaucugugguguuuuguuacggcagacagagcagacuaagacaa

SEQ ID NO: 4168704 - RNA, 110 nt, Human
uuguuuacaaacagguuggcagacuuucucuguacaguaccagauaguaaauauuuaacuuuauggguuauggucacuguugcaucugucuuguuuuuguuuuuaaacaa

SEQ ID NO: 4168705 - RNA, 62 nt, Human
uuguuuauugcuuccuuugcugcacagaagcacuguuuuuugcaaagugugggcauaaacag

SEQ ID NO: 4168706 - RNA, 60 nt, Human
uuguuucagcccagaucuuuacuaaauuuugugagaucagcauuguugggcuugaauuaa

SEQ ID NO: 4168707 - RNA, 68 nt, Human
uuguuucauuaguacugacaauaaaaauaccuaagguagaagguuguugugaguauuaaaugagauaa

SEQ ID NO: 4168708 - RNA, 84 nt, Human
uuacacauuuggauuacauagcuucuaccacccgaaugcuaauaaaggguuuugacaguauauauagucuaaaagcuugcguga

SEQ ID NO: 4168709 - RNA, 68 nt, Human
uuguuuugagauggagucuugcucugucauccacgcuggaguaguggcgagaucuccacucacugcaa

SEQ ID NO: 4168710 - RNA, 60 nt, Human
uuguuuuggaaauacagcaguuacuuucuuguggagaggaugccuuauguuuccacacaa

SEQ ID NO: 4168711 - RNA, 65 nt, Human
uuguuuuuaagcaugcucuuggggggucucauucuuuacucucaaaguauaucccuucgaaacaa

SEQ ID NO: 4168712 - RNA, 65 nt, Human
uuguuuuugagauggauuuagcucuuguugccccggcuggauggcgcaaucucaucucacugcaa

SEQ ID NO: 4168713 - RNA, 64 nt, Human
uuguuuuugagugccuacaaucaccaagguuuuucucugggcuuugggauucagcaugagacaa

SEQ ID NO: 4168714 - RNA, 66 nt, Human
uuguuuuuuccagccauguauagcuacaaaggugguggcacaaaguggguggaaaacuaaagacaa

SEQ ID NO: 4168715 - RNA, 88 nt, Human
uuuaaaaauuuuauguagacuuugaugacgccaguggaagcuguccgaggagauauauucaaaaguuucacauagagauauuuuuaaa

SEQ ID NO: 4168716 - RNA, 81 nt, Human
uuuaaaacuacagaugucaggacccuacugcauugacuaaguaaguuuugagguuagaaccuggaaauguguguuuuuaaa

SEQ ID NO: 4168717 - RNA, 65 nt, Human
uuuaaaacugugaggaugugcaaauucugccuacgaauagauuggauuugcccuccaggauuaga

SEQ ID NO: 4168718 - RNA, 59 nt, Human
uuuaaaagaucacuggcugcuuuacugggguaagaguggaagccaaagaucuguuugga

SEQ ID NO: 4168719 - RNA, 81 nt, Human
uuuaaaaucuuuuaacacauuuuccucauacggauguuacuguuacagucccuugugagaacauguguugguuauguuaga

SEQ ID NO: 4168720 - RNA, 84 nt, Human
uuuaaagauuagaagucucugucguagaucagcguuuuauagaugaggauacgcuaucaaucuagacaaagaagcuuauuuaaa

SEQ ID NO: 4168721 - RNA, 75 nt, Human
uuuaaagcacacuacaguuaaaggacugguugcuauguuuuggagcagcaugcuauauugauuguagucuuuaaa

SEQ ID NO: 4168722 - RNA, 78 nt, Human
uuuaaaggagugagguuuaggcaugcagaggcagggaacuuuuagcaccugcacaguuugauuucuugcuccuucaaa

SEQ ID NO: 4168723 - RNA, 64 nt, Human
uuuaaagucuccugcuguuggaacauaccuacauuuguucuuugaaguuuagagagacucuaaa

SEQ ID NO: 4168724 - RNA, 95 nt, Human
uuuaaagugcaagguugacaaauggauuuuaauguuacagaguaugaaaacauacugaugugauuucaaauuccacauugcaacuaaucuuuaag

SEQ ID NO: 4168725 - RNA, 59 nt, Human
uuuaaagugggcaaacucucauggucuuguaauuuaaguccauuuugacccuuuuugaa

SEQ ID NO: 4168726 - RNA, 129 nt, Human
uuuaaauucuaaagagcaaaaugcaucugcuaacuucugaauagcaauaguaccaaauuuggugccugcugauugaauucagaugugguugcagcuggaaaucauuguggccucuuaguuacuagauga

SEQ ID NO: 4168727 - RNA, 74 nt, Human
uuuaaauuugcaugggggucagagcagugaaagauguuguuuauagucuccugagccuugacugcaauuuuaga

SEQ ID NO: 4168728 - RNA, 89 nt, Human
uuuaacaagagcuucagugaaucuuucaucugcgaagcuuacagagcuucccaaacuuguggauagaaucaccuggggaucuugcuaaa

SEQ ID NO: 4168729 - RNA, 88 nt, Human
uuuaacacauaacuagguuuuucagggcucuuaaaagguaccuugcuuaaacuaagaguuacugguuuagaaccucugaauguuuaaa

SEQ ID NO: 4168730 - RNA, 83 nt, Human
uuuaacuguuuccugacacuagggaccaauuaagauguauaaauuaugcauuuaauagaugcucccugccuaaaagaguuaaa

SEQ ID NO: 4168731 - RNA, 71 nt, Human
uuuaacuuuggcuugaaaaauuaauucaauacacuuaaccuuuuuguucuugguuugcggccaaaguuaaa

SEQ ID NO: 4168732 - RNA, 79 nt, Human
uuuaagagcuaugugccaagaaauggggaaagaagaccaaaauauauauuucuuaucauaucauacauggcuauuuaaa

SEQ ID NO: 4168733 - RNA, 79 nt, Human
uuuaaggacuuuaaagucaagguacuguuucacagaugauuauuugcagacaguuaauucuugaguuauugucuuggga

SEQ ID NO: 4168734 - RNA, 96 nt, Human
uuuaaguugggaaacgugguuguuuaggucguggauccagugggagaaaguccacauuagagcaugucagaauagccauuaauccuuauucuuaaa

SEQ ID NO: 4168735 - RNA, 60 nt, Human
uuuaauacuauggggaugaacauguaagcaaaugcaacucuaucuccccauaauguugga

SEQ ID NO: 4168736 - RNA, 56 nt, Human
uuuaauaguccuauauguguaucaaugcaccaugcauugauucaagggcugaugga

SEQ ID NO: 4168737 - RNA, 67 nt, Human
uuuaaucgacaaaugggcugccauggaaaugacuuucaaaugcaccucucauuuguucaagguuaaa

SEQ ID NO: 4168738 - RNA, 62 nt, Human
uuuaaucuucaaaauagucuuauguuguagcuucuuuugcuguuccuauuuuggagauuaaa

SEQ ID NO: 4168739 - RNA, 83 nt, Human
uuuaaucuugagagauacuacaugaaugggaauuaugcuuaauaucauaguaguuuaccauuguguaguacuucacaguugaa

SEQ ID NO: 4168740 - RNA, 65 nt, Human
uuuaaugauagucuuacgaaaaugaaaucacccaguaguccuuuucaagugaggcugucuuuaga

SEQ ID NO: 4168741 - RNA, 68 nt, Human
uuuaaugauugucauuccaaaaaguucucucuggugggaagauguuucacuggaaugacaguaauaaa

SEQ ID NO: 4168742 - RNA, 58 nt, Human
uuuaauuaggaaaugggcagggccucauucugugccccuaaauguuucgcuaauuaga

SEQ ID NO: 4168743 - RNA, 70 nt, Human
uuuaauuauuucaggaacauuuaaccacagggccagcaggcuggaucuugauauguguuucuuaguugga

SEQ ID NO: 4168744 - RNA, 62 nt, Human
uuuaauucaacauuguucacagugguagaaaacuagaaagccauagugaguagugaauuaga

SEQ ID NO: 4168745 - RNA, 60 nt, Human
uuuacaaccucauauucugauguuuguauacauagacgggcuuuagggugaaggugugag

SEQ ID NO: 4168746 - RNA, 72 nt, Human
uuuacacagaccuagcacucuagauugccuuguaccuuuaaccuguagccagaucugcugugucuggauaaa

SEQ ID NO: 4168747 - RNA, 76 nt, Human
uuuacaccugugucuguggaauagcgaaugaauauucccaucauuguccgacuccacagacaucuccuuguguaaa

SEQ ID NO: 4168748 - RNA, 65 nt, Human
uuuacagaguggugagaucuuuugaaugagugucuagaguacaaagguuaugaaccacuuguaaa

SEQ ID NO: 4168749 - RNA, 57 nt, Human
uuuacagaugaggaaacugagaugcaaacaagucaaguaaccugccacaucuguaaa

SEQ ID NO: 4168750 - RNA, 55 nt, Human
uuuacaggaagcugaaaaacauugcuauucuaaguagcuuucuucuuccuguaga

SEQ ID NO: 4168751 - RNA, 91 nt, Human
uuuacaggcuuccacuuuugggaacagugaguaggugugccuuuucuuacuccucucgcugagacuauaaagcugggacauugcauguaaa

SEQ ID NO: 4168752 - RNA, 60 nt, Human
uuuacaggugguaaaaauauuguugguugacauaccaauaaguuaaaccuaacuuguaaa

SEQ ID NO: 4168753 - RNA, 60 nt, Human
uuuacaguuaagaaauguuaccggaaaggccuacagcauguggcaucucucaauuguagg

SEQ ID NO: 4168754 - RNA, 71 nt, Human
uuuacauuucauuauggacguuaauuuuggaaugcuuguggcuuucagucuugauuuuuauuguguguaaa

SEQ ID NO: 4168755 - RNA, 78 nt, Human
uuuaccuccuaauucucagcaugaacuggucauuucuucuuuuaaaaccaucaacuguaugggaauuuuggaggugaa

SEQ ID NO: 4168756 - RNA, 60 nt, Human
uuuaccuuugugggucucccuccagaacugaaggcuugggaggaguuuccaauggguaaa

SEQ ID NO: 4168757 - RNA, 75 nt, Human
uuuacggacucagcucuuuuucacacaacaugcugccaacccaagucuuguaugugugcagcagaguuuuguaaa

SEQ ID NO: 4168758 - RNA, 69 nt, Human
uuuacgugaaaggcaguuuaaaaugugcuaaaguguaaaacaaaugcauacagcuuucuuucacaugag

SEQ ID NO: 4168759 - RNA, 73 nt, Human
uuuacucauuuuuuaacuaccagugccuguagaaaacuaagcauaugaaauaugaguugaacaaaugagugga

SEQ ID NO: 4168760 - RNA, 81 nt, Human
uuuacucuucaacauucagcagggcauacugagccuaggaaucgcucuuuaggcccagcuccuguuggguugacuggugaa

SEQ ID NO: 4168761 - RNA, 59 nt, Human
uuuacugauuggucuuuuaguuagcacaguuuacugcugacugaaauggcgacagugaa

SEQ ID NO: 4168762 - RNA, 86 nt, Human
uuuacugucuauuuuaguuuaggaacaaguaguggaaaacagaacugcuagagcucccuacauguuuuuaggcugagacugguaaa

SEQ ID NO: 4168763 - RNA, 80 nt, Human
uuuacuguguuuguacagaugaccuuuuguuuagauugaauugucuccccagaaguaagauuacugugagacauggugaa

SEQ ID NO: 4168764 - RNA, 63 nt, Human
uuuacuguuugaaaaaugaauguuaguucagaaguaccaauauggcauuuucaagucagugga

SEQ ID NO: 4168765 - RNA, 76 nt, Human
uuuacuugucacuguuuuacauguuauuuaauaauuuacaguuauuuaaaagugguaagauuccaaggcaaguagg

SEQ ID NO: 4168766 - RNA, 77 nt, Human
uuuagaaaauaagucugagagaaacucucucaggucaagucaaacguggagaaaaacuuucagacauguucucuuug

SEQ ID NO: 4168767 - RNA, 62 nt, Human
uuuagaaauguugaauacaucaggaauauuuucauauuucugcauggucaaggcuuucugaa

SEQ ID NO: 4168768 - RNA, 93 nt, Human
uuuagaagaugguuuggguuauuuugguugucuaaggcugagaaagccuuccagaucuugacuuacagguuaacaaaaaguauccauucuaga

SEQ ID NO: 4168769 - RNA, 59 nt, Human
uuagagaaaggguuugauuccguuauuugaaaggaugucucuccaagcccuuucuauaa

SEQ ID NO: 4168770 - RNA, 64 nt, Human
uuagagaagaugaaccaucguuuacagguuaggaauucuagaaguguuggcguauuuucuuuaa

SEQ ID NO: 4168771 - RNA, 88 nt, Human
uuagagaaggcagauacaaaaagggagaagauuuaaauugacuuuaacauuuaccuaauuuguauuuaguugccuaaacaagcucuga

SEQ ID NO: 4168772 - RNA, 101 nt, Human
uuagagacaucgcuuggaaaaggcugucuuuuccucuucccacaccuuccacccgcucuugcuugugggcagaggaugaggcagcuugcccaacccucugg

SEQ ID NO: 4168773 - RNA, 67 nt, Human
uuagagccuggauagccuuguuccagaagcgacuuuuccaauggagcaaauguccaugaggcucugg

SEQ ID NO: 4168774 - RNA, 71 nt, Human
uuagaggaagauguugacucaagggaagacggggccaagccucaagucugauggguuagguuagccuccga

SEQ ID NO: 4168775 - RNA, 74 nt, Human
uuagaggacuuuccuuggagugcuauuggauguuuuuugcacuucaaacucacacuagggagacgggccuuuga

SEQ ID NO: 4168776 - RNA, 69 nt, Human
uuagaggcaugauucaguaaagaugugagauuucaccuauucaagcacaugaucugaauuugcaucuga

SEQ ID NO: 4168777 - RNA, 64 nt, Human
uuagagggaggaagggaauauauguauuuauacaaagauacauugaguuuccuccugauuuuaa

SEQ ID NO: 4168778 - RNA, 62 nt, Human
uuagaggugugaccuugggcaaaucacuuaauuugucauugccuuaguuagcacauuucuaa

SEQ ID NO: 4168779 - RNA, 72 nt, Human
uuagagguuauuagcucaagcucuauaguuaaaacagaccuaggcuugacugcugauuuugccaguuucuaa

SEQ ID NO: 4168780 - RNA, 58 nt, Human
uuagauaaagugauguaggcuauauuuugcuuaugaguuuuuauauuacuguaucuga

SEQ ID NO: 4168781 - RNA, 107 nt, Human
uuagauacuuuuuggaaagccaacaagguacaaaacagagcacaaaguuuagauucagaaaucaugugcucuaaugugcuuuguucccuaagcuaaauaguauguaa

SEQ ID NO: 4168782 - RNA, 57 nt, Human
uuagauagcaaugcaauucugggaaauacaacuccauuauuugcuuggcucaucuaa

SEQ ID NO: 4168783 - RNA, 57 nt, Human
uuagaugugcaggaauaggcauucugccugcuuuuaaaugucuagcugcacagcuga

SEQ ID NO: 4168784 - RNA, 69 nt, Human
uuagauguuaauucugaaaugagauauaagguagcauagcuguuuuauuuacauuucagauauuucuaa

SEQ ID NO: 4168785 - RNA, 63 nt, Human
uuuaggucaucugauguaacauuacagaccagaccuuggauaauacugcuucagaggcuuaga

SEQ ID NO: 4168786 - RNA, 58 nt, Human
uuuaggugucugcucauugaagccgucccagggaaagcccucagaggagauaccuaaa

SEQ ID NO: 4168787 - RNA, 71 nt, Human
uuuaguagaaauauuugggccuauggauugagagugaguaagucuccaccuuuccagauguuucugccaga

SEQ ID NO: 4168788 - RNA, 68 nt, Human
uuuaguagaauaguauaucaaauggaauuuguauaagcucuuuuaagugugauuacuauuuugcugag

SEQ ID NO: 4168789 - RNA, 63 nt, Human
uuuagucagguaagaugcaggguguagagguguuaaccuuuccuuaaaauuuuaauggcuaga

SEQ ID NO: 4168790 - RNA, 72 nt, Human
uuuagucucugguuuauaaaucuguggccaguuacuaguggcauuuuuguuagccugaaaaaagagacugaa

SEQ ID NO: 4168791 - RNA, 65 nt, Human
uuuaguggcugauuugcugcugacuugcgcaggaaacugaaucagcuugugggucagccucugag

SEQ ID NO: 4168792 - RNA, 80 nt, Human
uuuagugugggcccuugaugauuuuuucugagugccugccucacucagucacucagagucaauguuaauggcagacuaaa

SEQ ID NO: 4168793 - RNA, 63 nt, Human
uuuaguguuauauugggaaauguuuucuaaaagaauaggguagcugcccuuuaugaugcugaa

SEQ ID NO: 4168794 - RNA, 100 nt, Human
uuuaguguucauuguuccugcugguuauucucuuggccuaauuaugugaggaaaacagaaugaaggcaaagggaugggaagcaagggcaauguggcuaaa

SEQ ID NO: 4168795 - RNA, 82 nt, Human
uuuaguguuuuggagggauuucugugaaaugaacgagcaucucuuuagauugaaguuuauaacauagccuccuugcagugag

SEQ ID NO: 4168796 - RNA, 56 nt, Human
uuuaguugaaggcaguccucaaaugaugacuugucaguucauuguuuucaauuaga

SEQ ID NO: 4168797 - RNA, 58 nt, Human
uuuaguuuaggugggguagacagagaaggccucucugaaaagaucauuuuaagcugag

SEQ ID NO: 4168798 - RNA, 58 nt, Human
uuuaguuuuguuuugacacagaugagucuggagagucaugaguggcugcggggcugag

SEQ ID NO: 4168799 - RNA, 75 nt, Human
uuuauaacaguauagccuaacauuuccugcacuuugggauuuuagggagaugucuaugucuauacuugggguaag

SEQ ID NO: 4168800 - RNA, 70 nt, Human
uuuauacuuguuuaaauaagauagcaguagccaugcuuccaguuacuguauguuguugaagcaaaaugag

SEQ ID NO: 4168801 - RNA, 67 nt, Human
uuuauagcugugagaccuugggcaaauuacuuaaccuguuugugccucagauuucaagucauauaaa

SEQ ID NO: 4168802 - RNA, 85 nt, Human
uuuauaggaacaguacucuacagaaugaauaccuguugggaaacagguauucauucuguagaugggaaacacuggaccauauaaa

SEQ ID NO: 4168803 - RNA, 78 nt, Human
uuuauaguuaaagauucuguuaagagcuaagugauuuaaguacaucugggauaaaguggccuuggcuuuaacuaugaa

SEQ ID NO: 4168804 - RNA, 59 nt, Human
uuuauauuguaaaaaugguucugaugucuccuggcagcaaugcagaacuacaauguaaa

SEQ ID NO: 4168805 - RNA, 56 nt, Human
uuuauauuucccaggauuggcccauagccaagggcuaacugauaugggaauaugaa

SEQ ID NO: 4168806 - RNA, 96 nt, Human
uuuauccaaaucuacucuuugcagauuacuggacugauuccauuggauguagguaaaugggauggaguuggggucugcagaguuaauuaagauaga

SEQ ID NO: 4168807 - RNA, 127 nt, Human
uuuauccauugaucuguuguuggauauuuaguucauuucuacaucuuggcuauuguguauagugcugcaaugaacaugggaguacuaauaucucuucaagauccucauuucaauucuuuuggauaaa

SEQ ID NO: 4168808 - RNA, 106 nt, Human
uuuaucuaauaaagcaaauuccauuuaauuacaaaacacauagguuggccaaacugaagucaacaaauguguuuuguaauuaaagauaauuguguuauuagauaaa

SEQ ID NO: 4168809 - RNA, 70 nt, Human
uuuaucucaugcuauuuauacauaagucuuugcaccccacacagcuuauggugaaguaguagaggguaga

SEQ ID NO: 4168810 - RNA, 95 nt, Human
uuuaucuuguuugagcuacacugauucauuuguucauuuucugucucuuauuuucaguugaacuuuaucggaacagguacucauaacaagaugag

SEQ ID NO: 4168811 - RNA, 79 nt, Human
uuuaucuuuuaugcucuccucccagucccagcuaggaaugcaguugagggagauaggaaggagggcacagggagaugaa

SEQ ID NO: 4168812 - RNA, 123 nt, Human
uuuaugaggggauuuuguuucugcauugaccucuuguggugcuccuuucagaguaugaaaaauggcaucaucugauuccagaaggggcauacaggacaguguucucaucaaaaccauuauagg

SEQ ID NO: 4168813 - RNA, 129 nt, Human
uuuauggaaaggagcuagaaacagugcugggcacaaaggagggcugacaaauggcagugaccgcuaauuaaucccggccaguguucuucacccccucugccuugccuguugucuuuccucuuccaagag

SEQ ID NO: 4168814 - RNA, 116 nt, Human
uuuaugguaggucaugccaguuuaaagguauuggucuggucuuccugcuuaaaauaaugaauggcagaagagagaaccauauaucuugggaucugaacuggugaccuaaacauaag

SEQ ID NO: 4168815 - RNA, 130 nt, Human
uuuaugucauacauuacaucaugcgaauuuuuguguuugugccacuuaguaauauaucuguuagagaacagauggaaggcauagagguuuuaaacagcaggagcggugauuuaaucagauuuguacauua

SEQ ID NO: 4168816 - RNA, 87 nt, Human
uuuaugucccaagggugccagagugccaucagugccaucuaguggcagucauggugaacugaggguaccuggccccuaugauguaaa

SEQ ID NO: 4168817 - RNA, 70 nt, Human
uuuauguggacuguuguuguuugguuuauuucaauugaaaggaaaagaucaauagauaaagcuacauaaa

SEQ ID NO: 4168818 - RNA, 129 nt, Human
uuuaugugugcucuucaagaugauacagauauggagaacucaaaaagugaccagauuuaaacccagaugugaauaauuauuuucacuuauuugaguuuucagcuuugguuuucuuguugauuacaugaa

SEQ ID NO: 4168819 - RNA, 66 nt, Human
uuuauguuuguuuuugaaauaaaggauuuaguuuaagauucuaaauuuuagagaaacaaacguagg

SEQ ID NO: 4168820 - RNA, 55 nt, Human
uuuauuaauguagcauccauggugcucuuaagacguggcugcuuuuauuaguaaa

SEQ ID NO: 4168821 - RNA, 70 nt, Human
uuuauuagaggaaagcaaucuaguuccaauucugguucuccggaguuacuggauugugucugaggauaaa

SEQ ID NO: 4168822 - RNA, 65 nt, Human
uuuauuauauauacaguagaguuuguaaguacuaaauucguaucacagaacuguauagugauaaa

SEQ ID NO: 4168823 - RNA, 58 nt, Human
uuuauucacuggggucugcccguggguuccagucuaaggguuugcacuucugaaugag

SEQ ID NO: 4168824 - RNA, 64 nt, Human
uuuauucacuucagugccaaagagcaaauuccugugcuacuuuaggaagacuugaaugaguaga

SEQ ID NO: 4168825 - RNA, 59 nt, Human
uuuauucagcagcagcaguggucuuugguuaagacugacauucugacugacugaauagg

SEQ ID NO: 4168826 - RNA, 123 nt, Human
uuuauucauucuacauuucagaacucuuguaguuuauguagaugugucuguauauuauuauacuuuuauuuuacuuuaaagcgagagaaaagacugauaugugaaagguuucuauugaauaag

SEQ ID NO: 4168827 - RNA, 113 nt, Human
uuuauucccaacugguuuucauuuaacccucccagacuuauugcaacuccuaaauagagaacauuucuauguuaguaugggucuccgagaagcagaugccaagaugggauaaa

SEQ ID NO: 4168828 - RNA, 97 nt, Human
uuuauucuaguucccaagccaaauuaaucuagagguuguauuaacauaguaucauguuuauggcuuuuaauuaguugcuuccauuagacuagauaaa

SEQ ID NO: 4168829 - RNA, 77 nt, Human
uuuauucucggauguauuccaagugccuagaagaguugguacucaauaaacacuuguggaaugaaugaaugaaugaa

SEQ ID NO: 4168830 - RNA, 73 nt, Human
uuuauugauugcuuauuuuaugccaggcacuguucuagguucuggggacauaacaguaagcaagacagauaaa

SEQ ID NO: 4168831 - RNA, 82 nt, Human
uuuagagugaauaaacaaauaugugugauaauaccuugaaaaguugcaauuuauuaucagagcuauuuggaauuaaucugag

SEQ ID NO: 4168832 - RNA, 72 nt, Human
uuuagaucacagcagccuccucacuggcaucuuucaaggcuccaagcugacugugcuguugugcuguuuaaa

SEQ ID NO: 4168833 - RNA, 72 nt, Human
uuuagaugauggagguuggauucaggugcauccccuggaaugggguuuggcauuagcuucacguggucuaga

SEQ ID NO: 4168834 - RNA, 58 nt, Human
uuuagauuagaccacuguacuaaaccuuugaggguuuuaguacaauguaugauucaga

SEQ ID NO: 4168835 - RNA, 61 nt, Human
uuuagcacauuucucaaagaauugucaccagugagguaggcuacccuuagaaagugcugga

SEQ ID NO: 4168836 - RNA, 61 nt, Human
uuuagcagcuaagucaugcugcaaguucauucugaccuugcagucaacucuaacugcuaag

SEQ ID NO: 4168837 - RNA, 69 nt, Human
uuuagcaggucuguugauuacagucauauuugggucauaaucaugacauggaaaucaauggaugcuaaa

SEQ ID NO: 4168838 - RNA, 73 nt, Human
uuuagcgggcuuucagccaaaggacaaccuggagcauguuucggcccugaagcugaggguguuaacugcugaa

SEQ ID NO: 4168839 - RNA, 75 nt, Human
uuuagcucuugagaacaggguuagguaacuugggcucccucuggugucggccucguuccuuuuucaguagcuaaa

SEQ ID NO: 4168840 - RNA, 87 nt, Human
uuuagcuuagucuuggucauuuagcauuucucugccuaggugcuuuuucacaaggacuucagaaaauguugaauguuucuaguuaaa

SEQ ID NO: 4168841 - RNA, 67 nt, Human
uuuaggaaagucugaaagaugcuaacaucaggagaugaggugggguuuuuucagacucuauccuaga

SEQ ID NO: 4168842 - RNA, 62 nt, Human
uuuaggauguuaugaugucauuuucuucucuuuguagaagagaauaaaucaaauguccugag

SEQ ID NO: 4168843 - RNA, 70 nt, Human
uuuaggcacagggaguugguuuauauuuaucuaauccagguaauagaguauuuaauuuccugucacuaaa

SEQ ID NO: 4168844 - RNA, 65 nt, Human
uuuaggccagauuuauuugacaucuccacuuugauauuccacggagaguucaaacucugucugaa

SEQ ID NO: 4168845 - RNA, 61 nt, Human
uuuagggaaauugaggguuaagcaacaaugagaacaaggcuugccccugaguuuuucugag

SEQ ID NO: 4168846 - RNA, 80 nt, Human
uuuagggugugucauguaugucuaucuaccugcucagugacauugagcagagugccccaucacaaggauacaccucugga

SEQ ID NO: 4168847 - RNA, 100 nt, Human
uuuagguaauuuauaacgugcagccaggguugaaagccagugcuccaauuuccuggucuuuauuauuaaaacccaugguuuaugaauacauuacgcuaaa

SEQ ID NO: 4168848 - RNA, 66 nt, Human
uuuaguagacuggaacugucuucaggaugauauauuucuuaaaggcuuuauuuuccagucauugga

SEQ ID NO: 4168849 - RNA, 76 nt, Human
uuuaguucucuaucaugcaugguacucuugugcaucuacuauguagaaggaaauguguaugguauuggaagcuaaa

SEQ ID NO: 4168850 - RNA, 64 nt, Human
uuuaguuugccaguauuuuauugaugauuuuugcauugauguucaucaggaauauuggccugaa

SEQ ID NO: 4168851 - RNA, 127 nt, Human
uuuauaaaauuccuuauacuaagacauuucuuuccaaaucauaacuagagugaaauguugaaauuuuaauuguuacaucaaguuauaaggaaggguauucuauagacuuucagagggauuguaucaa

SEQ ID NO: 4168852 - RNA, 86 nt, Human
uuuauaacaugcacuacuagaugcaaaaguuuacaucaaaguuuacuuuaaauaucauuugguagggacuaaaugugugugauaga

SEQ ID NO: 4168853 - RNA, 75 nt, Human
uuuauaucuugauuagccuccuugucucaugcgcugguacuuucagucacauggguuuuuaggagaguguauaaa

SEQ ID NO: 4168854 - RNA, 94 nt, Human
uuuauauguacuaauuuguuuaaucuucaggacagucuuuugaagcagguaucuguagauugucaugaggauuaaauaaauugauaccuguaaa

SEQ ID NO: 4168855 - RNA, 74 nt, Human
uuuauauucacaaaaucaaaugccuuugauggucucgugggauauguaaaugugagugaugcggugaauaggaa

SEQ ID NO: 4168856 - RNA, 78 nt, Human
uuuaucaucauuuucagguacacaaucaagccaaaagauacgcuuuggugaaugauaauguucgagaaugaagaagaa

SEQ ID NO: 4168857 - RNA, 55 nt, Human
uucagaaugacuuauguaaggcgaagggcacuugcaaacgugagugauuuuugga

SEQ ID NO: 4168858 - RNA, 81 nt, Human
uucagagagaaaaccuccccagcauucugacuuccugacccagauuucaagaagucccaugcuggugagaaagucccugaa

SEQ ID NO: 4168859 - RNA, 61 nt, Human
uucagagcccaaauggagauuaucucucaauuuugacauuuauuuguauuuuggcuuuggg

SEQ ID NO: 4168860 - RNA, 56 nt, Human
uucagagcucagaaaagugucucuuuaaggagaugacauuuaaguugaagccugag

SEQ ID NO: 4168861 - RNA, 55 nt, Human
uucagagggcuugcuauguacaguguaaugcuucagcauagcugaccuuccugag

SEQ ID NO: 4168862 - RNA, 69 nt, Human
uucagagucuaaggaaaaauagaguauuaugguucaaugguguucuuauguagucuuaugauucuugaa

SEQ ID NO: 4168863 - RNA, 67 nt, Human
uucagaguuuacagaaauaagcuguaugguucauuuucaugccugcuugccaauaaacauaucugag

SEQ ID NO: 4168864 - RNA, 86 nt, Human
uucagauagcacacaucacacuaauuuuucaagaguuuuucauuguauuuauuguauggaaaauauugguaggaugcuuguuugaa

SEQ ID NO: 4168865 - RNA, 111 nt, Human
uucagauuuagcagcaggcaguuuucaauuuauuagcauuucauuucaagaggaaggauaaaaccuccaugagauauacuaauaaucaaacugugcaugcagguugaugaa

SEQ ID NO: 4168866 - RNA, 90 nt, Human
uucagcaaucauguuauuuguccccuuuuuuugguaucaaaagggccuuuucuuuaugaaaugauggggaaaauagaugguaguuuugga

SEQ ID NO: 4168867 - RNA, 82 nt, Human
uucagcaauuaccaauuugguuuauguguucagaccuuauauggaucauuguauuguaugaaucaaaaggugaaucguugaa

SEQ ID NO: 4168868 - RNA, 56 nt, Human
uucagcaccuggaauagcaccuaguaaaugguuggugcuccauaaagguguaugaa

SEQ ID NO: 4168869 - RNA, 84 nt, Human
uucagcagucaagcucagugugucuaugagguaaugaauaaacuuuuauauacauguggagauaacugaagcacguacucugaa

SEQ ID NO: 4168870 - RNA, 76 nt, Human
uucagcauuaauuacaguagcaaaagaccggaagcaacuuuaaugcuuauugggggcuuaacugaauaaauuugga

SEQ ID NO: 4168871 - RNA, 117 nt, Human
uucagccugugggccaguuuuccaaucucugauuuacagcaucucugagauuucuuacugaacagggaguguuauagauaggaaugauugauggcuaaaagcuccauaaaggcagag

SEQ ID NO: 4168872 - RNA, 55 nt, Human
uucagcuaaaaaugcccacuuguuuagacuuccgcagcuugggcaugaagcugga

SEQ ID NO: 4168873 - RNA, 56 nt, Human
uucagcuagcaucucacuuggucaugguucuuuaucuggugggauuaauugcugag

SEQ ID NO: 4168874 - RNA, 61 nt, Human
uucagcucccugagccugugcuauggggaguaauagcaucugccaaggcucagaggcugga

SEQ ID NO: 4168875 - RNA, 65 nt, Human
uucagcugaaaaagcuacauaauauugggcuggugcaaaaguaauugugguuuuugccaguugaa

SEQ ID NO: 4168876 - RNA, 88 nt, Human
uucagcuuccaaagaucucagaugcccuugcaucaccucccugaagagggugggugaagcuuuggugucugaagagaauuuggcugga

SEQ ID NO: 4168877 - RNA, 59 nt, Human
uucagcuuuugugugacuaacaguugggaagggacaauccuagaagcagggaagcugag

SEQ ID NO: 4168878 - RNA, 71 nt, Human
uucaggaaaguucuguguugugacauucuagagacagcuugccucuagaauacugugacaugccaccugga

SEQ ID NO: 4168879 - RNA, 74 nt, Human
uucaggaguuccuauacucacccuucuacuuuuaagaaagugguuuucaaagugugauuuguagaaugccugag

SEQ ID NO: 4168880 - RNA, 90 nt, Human
uucaggauagugagguaaugaggggagaaggcacuaaccagguguuuagccuucauccagugcucuucccccaucacacuauuucuugag

SEQ ID NO: 4168881 - RNA, 90 nt, Human
uucaggcccagagacacaauuuccccauccuaccauuugaagcacaggaugccuacugggauuaggggaauugauuuuugugcuacugaa

SEQ ID NO: 4168882 - RNA, 57 nt, Human
uucaggcucuacacuugacacaccugcugacaagugugucauaaaggagacuaugga

SEQ ID NO: 4168883 - RNA, 76 nt, Human
uucagggaaauuaaugacugguuggaguuaauggacuaaggagcaagcccuuccaggcagucauuaaucucuagaa

SEQ ID NO: 4168884 - RNA, 64 nt, Human
uucagggagaaaugagggaauggagaauaucagagaagcagcucccucagaaauucucucugaa

SEQ ID NO: 4168885 - RNA, 66 nt, Human
uucagggauauuuagcauauugcagaggaaguguuauuucacgucaauacacuaaacuucucugaa

SEQ ID NO: 4168886 - RNA, 96 nt, Human
uucagguguuggaaguucucuuuucuuucuggauaaaauaaauguuaacuguguguuuuggcuucuuggagggcaggaaggcuucaguuaucugaa

SEQ ID NO: 4168887 - RNA, 62 nt, Human
uucaguaaauuaucucaucucuguagcugagucauuaacucacaaggaagauaguuacugag

SEQ ID NO: 4168888 - RNA, 85 nt, Human
uucaguaggcuacuuuguguauaguuucuuaguuacugagaauaacuacuuaggcgaguaagagauuauaaauauuaucauugaa

SEQ ID NO: 4168889 - RNA, 56 nt, Human
uucaguagggcccucacacagucacucaugcugugaaguuauuuuggggcacugga

SEQ ID NO: 4168890 - RNA, 61 nt, Human
uucaguauacauuaucuaauugugcauaccagaugcagaaaaggauaaagugcaugcugaa

SEQ ID NO: 4168891 - RNA, 57 nt, Human
uucaguccagcggccccaggcagggacagguggcuucccugccaguccuggucugaa

SEQ ID NO: 4168892 - RNA, 62 nt, Human
uucagucccauccacauucucugagugccuaauaugugccaggcgcugugcuuggggcugga

SEQ ID NO: 4168893 - RNA, 64 nt, Human
uucaguccugcugucaggcuucagcugagaucacauccucuuugauucuccaguaugggcugag

SEQ ID NO: 4168894 - RNA, 76 nt, Human
uucagucuaaguuagggcccgaggcaggaugugggaucugcugccugggucuggcucaguccuagcuguagaggaa

SEQ ID NO: 4168895 - RNA, 80 nt, Human
uucaguggcacaauugcagcaauaaacaaagacagaugacaauucagcuuagauguuucugcugcagucuugguccugaa

SEQ ID NO: 4168896 - RNA, 76 nt, Human
uucaguguuacuaguauuuaauauguggauugauauugguguccuguuauauguuggguagucaugguacauggaa

SEQ ID NO: 4168897 - RNA, 94 nt, Human
uucaguuacuucaggccaucugggcauauacgugcaagucacaggggaugcgauggcuuggcuugugcucagaggccugacaguuuccacuggg

SEQ ID NO: 4168898 - RNA, 86 nt, Human
uucaguuccccauuagagauuaugaauuccuaggucuguaucucuggacuccacuggcugggucauuuucuuucauaggugcugag

SEQ ID NO: 4168899 - RNA, 65 nt, Human
uucaguuggccauaccccuagaagagauuuggaaugcugauucacuagaggguggguuugcugaa

SEQ ID NO: 4168900 - RNA, 62 nt, Human
uucaguuugaauucuguagaacagacugcuaagaauuguuuuuucacagaucucuaacugag

SEQ ID NO: 4168901 - RNA, 64 nt, Human
uucaguuugccaguauuuuauugaugauuuuugcaucaauguucaucagggauauuggccugaa

SEQ ID NO: 4168902 - RNA, 59 nt, Human
uucaguuuucuuuagaauguagagaaugaaagaacuucugcauucuugaggaaauagaa

SEQ ID NO: 4168903 - RNA, 82 nt, Human
uucaguuuuuccaggacuuuaagcuucagagggaugccacaaaaucaucuucagagaaguuuauggugcuuguaaggcugag

SEQ ID NO: 4168904 - RNA, 74 nt, Human
uucauaaguacacacaguagaauagagugaggcucucauuuggaccuuaaacugcugcuggugucacugcugga

SEQ ID NO: 4168905 - RNA, 57 nt, Human
uucauacucacuccaauaacuggauaacacaggccuuggggggauuuugaguuugaa

SEQ ID NO: 4168906 - RNA, 130 nt, Human
uucauagacucaauucuuguguguuaggaaaaucuuuaguauaggggacccacuuauggagaggaaaauaauucuuucuagucuucccuaccucccguuuuucuuucaaacaaggguuuguaaaaaugaa

SEQ ID NO: 4168907 - RNA, 115 nt, Human
uucauagagcaggguuaucugcauuuuggugucuucuggcauggauuugagugucuuuaccuuuuggucaggcacgucuaugcuuaggucucugccugccuuucugcuggaugaa

SEQ ID NO: 4168908 - RNA, 67 nt, Human
uucauagcaaugaugaucgcuuuggcagauuccagcaucuaaaagccugucuggucauagcuaugga

SEQ ID NO: 4168909 - RNA, 116 nt, Human
uucauauccuauccuccgcugggcuaacauuuuacaauccuuccacaggcuguuaucagcuaacaccuugcagggauuaugacagcuggcucaggggaggaacacguggaaaugga

SEQ ID NO: 4168910 - RNA, 65 nt, Human
uucauaucuacccuuaagauggucuuccuuaucuggaaaaaggcuggagcaagggggcauaugga

SEQ ID NO: 4168911 - RNA, 110 nt, Human
uucauauggaugcagagcuuuuuaaccauaucaaagagaaggauaggagcuuaaaauaugaaacuccugcuuuugauaugcuuaaauucugggucugauaucuuuuugaa

SEQ ID NO: 4168912 - RNA, 58 nt, Human
uucauauuucagauagcccuuugguccuugugccuggcuacccacugaaauaucagag

SEQ ID NO: 4168913 - RNA, 68 nt, Human
uucaucagaauacuaucaacagugauaaauucugcugcuagucuauaucauugauagaaugugaugag

SEQ ID NO: 4168914 - RNA, 62 nt, Human
uucauccagauacaugaggcacaguucuacaugcuggugcuggccaaaguguaccuggagag

SEQ ID NO: 4168915 - RNA, 84 nt, Human
uucaucuauggcaaacuacauuuuugaaauauuaauuguguucagucccaaaugagcuguugcagaauuaguuugccugaugga

SEQ ID NO: 4168916 - RNA, 57 nt, Human
uucaugagguaccugugaucaucagcuaugccugagagacacaggcaguccucagag

SEQ ID NO: 4168917 - RNA, 61 nt, Human
uucaugauguuuuuuguuagucucugauggagaagagacuaguacaguuuuggcacaugga

SEQ ID NO: 4168918 - RNA, 75 nt, Human
uucauggacucugucacuccaaccucuacggcaggaguucuuaaucuggggaagaaguuggaggauguccaugaa

SEQ ID NO: 4168919 - RNA, 77 nt, Human
uucauggcuucaugggagucugcaaaugacugacaagccuuaagguugcaggcuggcagauaucucaugcuacugag

SEQ ID NO: 4168920 - RNA, 59 nt, Human
uucauguguugucucauuuaauccuugcaguaaugugaugggugugagcugacugugaa

SEQ ID NO: 4168921 - RNA, 83 nt, Human
uucauguuugcacugaaaucaagcuagaagucauuuguauguauuucugcaaacugcauucuauagcuugaugcauuugugag

SEQ ID NO: 4168922 - RNA, 76 nt, Human
uugcucuauugcccaggcuggagugcaguagcacaaucuuggcugacuacaaccuccaccucccggguucaagcaa

SEQ ID NO: 4168923 - RNA, 78 nt, Human
uugcucucaguucuguccuccuaccaggcauuuauuuaagagagcuaaguuucuggaggcagaauaaugagaaggcaa

SEQ ID NO: 4168924 - RNA, 62 nt, Human
uugcucucuuuccucagccacagucuagaggaacucuaaggcccugaggagggaggugucaa

SEQ ID NO: 4168925 - RNA, 62 nt, Human
uugcucugaucugugccuuaggccugugaaagagacagcgccuauuugugaagacagcguaa

SEQ ID NO: 4168926 - RNA, 76 nt, Human
uugcucugucacccaggcuggagugcaguggcgcgaucucggcucacugcaaccuccgccucccggguucaagcaa

SEQ ID NO: 4168927 - RNA, 56 nt, Human
uugcucuugugcuuuuuucauugcuaguuuagaagcuugagggacauugggagcag

SEQ ID NO: 4168928 - RNA, 71 nt, Human
uugcugaaaguggcaagaaguaaccaggaucugucaacauaaauuauaucuacuuuuuccccugacagcaa

SEQ ID NO: 4168929 - RNA, 70 nt, Human
uugcugacucugccuuaguccuggggcuggcuauucagugggcuccucacuucuggcaguguaauagcaa

SEQ ID NO: 4168930 - RNA, 58 nt, Human
uugcugagggcagaugaauuagaggucucugacugagcucuuauuuuucccuuaacaa

SEQ ID NO: 4168931 - RNA, 83 nt, Human
uugcugcagaauuugaggggaaguuuuccugauuccuuaaaggagguucucaggaagaaauucuguaucuuuccucuguacaa

SEQ ID NO: 4168932 - RNA, 75 nt, Human
uugcugcucuuaaauuauuuugaauuguggcuugauugacaagcuucauagaacagaaauuuaauagcugaguaa

SEQ ID NO: 4168933 - RNA, 62 nt, Human
uuccaaggaaguuugcacuauuggccguuuggaauugcuuguuuaugacaacuuucuuggaa

SEQ ID NO: 4168934 - RNA, 67 nt, Human
uuccaaggcccagcagagaggauuguggggucuuagucccuccugcauauucauguuggcuuaggga

SEQ ID NO: 4168935 - RNA, 68 nt, Human
uuccaaggcuagguuguaaaggugacacaacuucugccuaccucauuuuagaacacuugcucuuggaa

SEQ ID NO: 4168936 - RNA, 89 nt, Human
uuccaagggaaggcacaugaccuaggccuggccaaucagcauauuccauauuuauggccaaagccagguugauguguaucaacugggaa

SEQ ID NO: 4168937 - RNA, 102 nt, Human
uuccaaguuaucucugaauuuaguuauagcagugucuuuauuuauuuuacuuaacuucauagaugauuuuaguugacuaaacuuaagaagaagaacuuggaa

SEQ ID NO: 4168938 - RNA, 75 nt, Human
uuccaauggcuccagguacucauuggcuguuagauuacaccuaauggccaaugaguaccugaacccaaaugugaa

SEQ ID NO: 4168939 - RNA, 130 nt, Human
uuccaauuauucaugucccuuuguuauugugcuauuaucuuuauguuuauuuuguuugacuguuuugguaaagacagaacaggcugagaaaaacaugaauuugaaaugguacagcguggguacccuggaa

SEQ ID NO: 4168940 - RNA, 89 nt, Human
uuccaauugcuucauuuccucaggcuuuacuauguugcugcuacagaaagaaauacuuggggacagugggguaaaaaaacacuuuggga

SEQ ID NO: 4168941 - RNA, 71 nt, Human
uuccacaaugcauaucacagucuccaugugcuuaggaacauuagagcacacuucagcaguaugcuugggag

SEQ ID NO: 4168942 - RNA, 74 nt, Human
uuccacacagucaaaccugcaacagugaacaccccauccaccucuaacugugccaaucugcugacugucuggaa

SEQ ID NO: 4168943 - RNA, 66 nt, Human
uuccacaguuucagaauuuaugcagacaauucaaggagauugcugcaguuauugaaacuaugugaa

SEQ ID NO: 4168944 - RNA, 61 nt, Human
uuccacauuuuugauacucucacucugccacagcgagugggcuuacugagggaguguggga

SEQ ID NO: 4168945 - RNA, 82 nt, Human
uuccaccagaaagcaucauugugauuucucucauuaucuaaaaugaauaagaauuauuauaaugauaaauuaguggcaggag

SEQ ID NO: 4168946 - RNA, 58 nt, Human
uuccacuccaccccugcaaauccugagcugcaugcagauggggcagggguggguggag

SEQ ID NO: 4168947 - RNA, 76 nt, Human
uuccacuccuccuggugggguggagggaccacaucagcacgaugucugaguugccgcucuacaacaggggagggaa

SEQ ID NO: 4168948 - RNA, 69 nt, Human
uuccacuguaauaaugguccccaaacacugacccacaaacugggccaaguuggaccauauuucaaggaa

SEQ ID NO: 4168949 - RNA, 130 nt, Human
uuccagaaacuucgguuccaguucuucuguuccaugagcugcagggcuuggguuuccccggaggaguuggaggaggugaguggggccuggggagguggaggagguggggaggaaucaggugggcuggagg

SEQ ID NO: 4168950 - RNA, 119 nt, Human
uuccagaaagaaccuuuguuuauagucuaaugcugugguucccagaguggaucagagcacccugagcacuguggggaacucacagaguuaccacuggauaguccaaauuuuuuauggaa

SEQ ID NO: 4168951 - RNA, 63 nt, Human
uuccagaaaucuuucagcucaaaccuugcaaaauacuaucuugagcugaauauguucuagggg

SEQ ID NO: 4168952 - RNA, 57 nt, Human
uuccagagcaugucaacuagcuuuaugcuuugcauuaaaguuaaccauucucuggga

SEQ ID NO: 4168953 - RNA, 69 nt, Human
uuccagaggcaacaggaaaccacaugaucaggcggucauuugggaaauuuccuuuggaagacuuuggaa

SEQ ID NO: 4168954 - RNA, 98 nt, Human
uuccagaggucaucccugugucuucuaacugcauuugucugucucaauugaucaguaaaaugagcaauuacagucggagcagcacugggauucuggag

SEQ ID NO: 4168955 - RNA, 76 nt, Human
uuccagauauaucuaaguuaggaacacugucucuugaaagauagagaucaguuagauagcuugaugugaccuggaa

SEQ ID NO: 4168956 - RNA, 66 nt, Human
uuccagauggacagagcugagcuccaccuucaguuugggguguggugcuccuguccaggcagggaa

SEQ ID NO: 4168957 - RNA, 71 nt, Human
uuccaggacucguucuggcucaucugcagccauggaugaauaaaaacucgaucaggacgcuggucuuugaa

SEQ ID NO: 4168958 - RNA, 62 nt, Human
uuccaggacuggguguuugaaggaggagaaaauaacuuacccuucugcucuagagucuagaa

SEQ ID NO: 4168959 - RNA, 62 nt, Human
uuccaggcuagaaacugaggcacaguugggaacugaugcaauuagauuguaauuuccuggaa

SEQ ID NO: 4168960 - RNA, 69 nt, Human
uuccagggcagcuguaucugagcuuauuugccccaaguacagacucagaagcaaguaaugccacaggaa

SEQ ID NO: 4168961 - RNA, 61 nt, Human
uuccaguaaaacccauaagauuuaggcaguucaucccugaaguaugugugggaugcuggga

SEQ ID NO: 4168962 - RNA, 109 nt, Human
uuccaguaccaauuaucacacuuaagcaguuuuugaaaaaggguauaauucucugcuacagaaggcaugaccuuuuuucagaacucuaaaggagauacuccuacuggga

SEQ ID NO: 4168963 - RNA, 62 nt, Human
uuccagucuggccugugcuuagagaaaaauucacaggauaagcacaacacauuuuucuggag

SEQ ID NO: 4168964 - RNA, 58 nt, Human
uuccagucuguuucugagaaacagaaccuguuccucagguucuguugaaauacuggaa

SEQ ID NO: 4168965 - RNA, 77 nt, Human
uuccaguguugauauuguguaaauguguaagucagaauguggcuuagaaagcuuuccauagucaauuggcauuggga

SEQ ID NO: 4168966 - RNA, 114 nt, Human
uuccaguucuaacauuacaaaacucuggggcuccugggagaaguuuuauuacaaagcagauauuuugaguaccuagugagucauagacacucuuuguaaggugggcaacuugaa

SEQ ID NO: 4168967 - RNA, 59 nt, Human
uuccaguugguagaauguaagggggaaaucugucucucucucucucucauaagcuggag

SEQ ID NO: 4168968 - RNA, 60 nt, Human
uuccaguuugcaguugacacuaacguuuuguugguagugaauaacaagcuuauaagggaa

SEQ ID NO: 4168969 - RNA, 60 nt, Human
uuccaguuuuguucucucuuacucagaaaugaggaaaaguccugagaccagaaaauggaa

SEQ ID NO: 4168970 - RNA, 74 nt, Human
uuccaugaaauaugcuaccugucuucccucugcugcagugcuucagugaggaaagggcauuugugcucauggaa

SEQ ID NO: 4168971 - RNA, 83 nt, Human
uuccaugagcuucaguuucauuaucguaaaaggggauaaaaugccuauguuaggaaguuauaguggaaaugaagucaaaggaa

SEQ ID NO: 4168972 - RNA, 116 nt, Human
uuccauuaauagaguaaaucacauugauuggguuucuaaugcuuaaccaagcuugcauuccugagauaaacccaacuuaaugaagauguauuacccuuucucuaauauuaauggaa

SEQ ID NO: 4168973 - RNA, 71 nt, Human
uuccauuaauccacagauauaaacuauaguaguguuucugcauuaccauaauuauuucugcagagcaggag

SEQ ID NO: 4168974 - RNA, 58 nt, Human
uuccauuaucuauuuuugucgccucaccuagguaaugacaauaaagugauacauggga

SEQ ID NO: 4168975 - RNA, 55 nt, Human
uuccauucaccuaucucaucuuauaaaauagaauaggugaacaaggagaauggga

SEQ ID NO: 4168976 - RNA, 80 nt, Human
uuccauucuugauuuucuucugguggccgaagggcuggacacagacuucucccaaccaucagagggcacagaguguggag

SEQ ID NO: 4168977 - RNA, 100 nt, Human
uuccauuuccagggcauauugauuuugaauauuaaagaagagcugcauccauucauucaucaaauguguucugagucagugcccuguucuggguauggga

SEQ ID NO: 4168978 - RNA, 130 nt, Human
uuccauuuguuuguauccucuuuuauuucauugagcagugguuuguaguucuccuugaagagguccuucacgucccuuuuaaguuggauugcuaaguauuuuauucucuuugaagcaauugugaauggga

SEQ ID NO: 4168979 - RNA, 75 nt, Human
uucccaacuauugauggaugugacaugcccacucuaaaauaugaaagaguacaaaaugcagcaucaucaugggaa

SEQ ID NO: 4168980 - RNA, 65 nt, Human
uuggauuggccagguguaggucacaccucucaucagagguaccagaggagcacauggccaaccag

SEQ ID NO: 4168981 - RNA, 71 nt, Human
uuggauuucuccuagagcaaaccgcaaaccaaggacuugggugcaaguaacuuguuugggagguaauccaa

SEQ ID NO: 4168982 - RNA, 67 nt, Human
uuggauuuggaaguugcucagcaaaauaguuaauugcuaaaugucagaguagcuugcauguaucuga

SEQ ID NO: 4168983 - RNA, 81 nt, Human
uuggcaacauuugucaucacugaggagagagguaacuagaggaugauuuauugcaaccuuuucuggugugauaagagccag

SEQ ID NO: 4168984 - RNA, 78 nt, Human
uuggcaagucuguuugucguucugaauaaccugaguccuccaacauuggccuuauucagauuggcuacaggaugccaa

SEQ ID NO: 4168985 - RNA, 73 nt, Human
uuggcaaucagaaaucacuuaaugaacguagguuaaaucacguaaaugaaagaaugauugacugaaugaccaa

SEQ ID NO: 4168986 - RNA, 56 nt, Human
uuggcaaugucuaaacacauuuuugguugucacaacauguggagagugguugcuaa

SEQ ID NO: 4168987 - RNA, 87 nt, Human
uuggcaauuaugaauaaagcugcuuuaaacaucuaugugcagauuuuguaugugcauaaguuuucagcaccuuuggguaaaugcuaa

SEQ ID NO: 4168988 - RNA, 85 nt, Human
uuggcagaggaaacuguugaucucaguuagcuagaaacagcugcuuuucuauuuuuauuuguaguuaauguuuuccaagugucaa

SEQ ID NO: 4168989 - RNA, 61 nt, Human
uuggcagcccagcuuacuagcagcucuucugucuucagagugcagugaggggagcugucag

SEQ ID NO: 4168990 - RNA, 62 nt, Human
uuggcaggaugauagcuuugugauaauguucccaauuucuuccauuguuauuguucuguuag

SEQ ID NO: 4168991 - RNA, 71 nt, Human
uuggcauaaguguauuuuauuauuuaacugguagaguggauucugcuauuugaaaccaagaaugccgccaa

SEQ ID NO: 4168992 - RNA, 97 nt, Human
uuggccaggauggucucgaucucuugaccuugugaucugccugccuuggccucccaaagugcugggauuacaagcgugagacaccgcgccuggccga

SEQ ID NO: 4168993 - RNA, 58 nt, Human
uuggccagguugggcuuugcagccauggaaacaagcuguaggggaaagcguuggcuga

SEQ ID NO: 4168994 - RNA, 62 nt, Human
uuggccagugucggaggccaggagggcuggaaggaagaguucuggaagaggacauuggccag

SEQ ID NO: 4168995 - RNA, 60 nt, Human
uuggccaucuaagcccagccacccacuaaacauggcaggaauucugggguuagaggccaa

SEQ ID NO: 4168996 - RNA, 86 nt, Human
uuggccauucccccaaggaagaggcagugccaaagucucccauuuggcagcaucaauccaugcuucuccuagggagggaucguugg

SEQ ID NO: 4168997 - RNA, 77 nt, Human
uuggccugacagcagagagagguaaggauuggguauuuaauuccaaggucuguggccaccucugggacugcagccaa

SEQ ID NO: 4168998 - RNA, 92 nt, Human
uuggccugccguggaagcuuuuauuaaaaucuugccauuuaccaagaauguguaauuuuuaaaugaaaguggagaaagucaugcaaugucaa

SEQ ID NO: 4168999 - RNA, 79 nt, Human
uuggcgagaaccagugggcaucuccuuggaagccaguccccaagguggcucuagauggcuuacuccugcaucuugccaa

SEQ ID NO: 4169000 - RNA, 70 nt, Human
uuggcgugccuggaagggaaauucagaucuucaguuugugcuguucaucuguuucuuuccucaacgcuag

SEQ ID NO: 4169001 - RNA, 92 nt, Human
uuggcuacaggccauuacuguugcuaauaugcaacucuguugaauauaaauuggaauugcacuuuagcaauggugauggauuguuaagccaa

SEQ ID NO: 4169002 - RNA, 74 nt, Human
uuggcuaccaauguguagggugccuguuuuugucuugaaccagauauacccuauccugcacacuugauugcuga

SEQ ID NO: 4169003 - RNA, 57 nt, Human
uuggcucacaugauuauggaggcugagaagccucaaggucuauagucagugagcugg

SEQ ID NO: 4169004 - RNA, 62 nt, Human
uuggcugaagguuaagugcuggaaauaaugacugaacgugcagacuuagaucuuuagaccaa

SEQ ID NO: 4169005 - RNA, 67 nt, Human
uuggcugaaugaggucaccuuucuuuaauucucuuagaugaagccuaagaaaacuauauuuggccag

SEQ ID NO: 4169006 - RNA, 58 nt, Human
uuggcugcuaauggcugacagcugccccuuucuccugaacauugcccuuggcggccag

SEQ ID NO: 4169007 - RNA, 90 nt, Human
uuccuaguaagccugagaguacuuauaugaacauuugucacauacaauauuuaacagaugucucauuucaguguuucuauuacuagagag

SEQ ID NO: 4169008 - RNA, 78 nt, Human
uuccuaucuuucuaacuugagauuguugagugauuuaaaaucauguuaaucauuucaacauucucaguuguaggggaa

SEQ ID NO: 4169009 - RNA, 81 nt, Human
uuccucaaaacuugaaagguacuguugguuucauuuuauuuacccugaaugggauuaacuguacuuucuaauuuuggagaa

SEQ ID NO: 4169010 - RNA, 56 nt, Human
uuccucaaagaauucagcuccauacgauaaguguuaaugcuuuauuucuuggggaa

SEQ ID NO: 4169011 - RNA, 91 nt, Human
uuccucaaagcugagaugcuauacauuguaagacacauucugauuucacagguauugauuuauaaaaugugugcaucuuagaauugaugaa

SEQ ID NO: 4169012 - RNA, 57 nt, Human
uuccucagcuguuugggcucauuaggagacucugacuuagacaugacggcaggggaa

SEQ ID NO: 4169013 - RNA, 91 nt, Human
uuccucagguguagccaugagauuauaugcccugaauggcugucauagcauugaaagcaaggaaauguaguccucaucuccaucuguugaa

SEQ ID NO: 4169014 - RNA, 68 nt, Human
uuccucaguucagaaggcagcaaaugaaaaccacgcuugugauuccucauucuagucuucaaggggaa

SEQ ID NO: 4169015 - RNA, 56 nt, Human
uuccucaucugugcaccucacuggcagacuucuaaggagauggacagaugaagggg

SEQ ID NO: 4169016 - RNA, 64 nt, Human
uuccucaugcuuguucucagcucaaauuucaucuagauguuucagaguuaguagagcaugugaa

SEQ ID NO: 4169017 - RNA, 77 nt, Human
uuccucccugcaggcagaggaagucugggucugaggggugggcugguauuuacccaaagaggcuuccuugggaggag

SEQ ID NO: 4169018 - RNA, 62 nt, Human
uuccucguuagguauauuacuuggaaauauauugcauucaaaguaccguacuuaauggagaa

SEQ ID NO: 4169019 - RNA, 83 nt, Human
uuccucuacagcauaaugugugucauacagacuuuggcuuuaauccuuagcuuuguauuugagcauacgaggccuguuaggag

SEQ ID NO: 4169020 - RNA, 55 nt, Human
uuccucuauucuaacaaaaguaucacacuggugcaggauguugauagugggggga

SEQ ID NO: 4169021 - RNA, 60 nt, Human
uuccucucugaacugugcucaccaguguuugaauccauuuaagucaguucugaggaggaa

SEQ ID NO: 4169022 - RNA, 128 nt, Human
uuccucuuccuuuuucuuggugguccacagugacugcuugagaaggaacaaauugcuuucacuucugucauuuccacuuucucaagucuucuucuguuaccacuauaacuuccugaaaaugaguagaa

SEQ ID NO: 4169023 - RNA, 59 nt, Human
uuccucuucuggacuccuauaacuuggauaguuauaggaaaaguucuagaaaaguggaa

SEQ ID NO: 4169024 - RNA, 71 nt, Human
uuccucuugcuguaggcacaacaaggaagugagcaaaaacccuucuaguuacagugcauagcaagauugaa

SEQ ID NO: 4169025 - RNA, 77 nt, Human
uuccugaagcgccugcggugugagccugcugugaacagccucauccaguguaggcugaccccagagcggcccgggga

SEQ ID NO: 4169026 - RNA, 60 nt, Human
uuccugaccucgugaucugccagccuuggccucccaaagugcugggauuacaggcaugag

SEQ ID NO: 4169027 - RNA, 82 nt, Human
uuccugacuuccugguuuuauguuauagauggauugauuaauuuuaucucccucuaaacuguaagauucuugaagacaggga

SEQ ID NO: 4169028 - RNA, 55 nt, Human
uuccugagcuccaccucaaauucugauuuacgaggucuggggugaagcccaggaa

SEQ ID NO: 4169029 - RNA, 74 nt, Human
uuccugaguacaaucuuuaguuuccugaaauagaguacuggguauuucaugcuuuggguuagaaaccuuuggaa

SEQ ID NO: 4169030 - RNA, 96 nt, Human
uuccugauucuucuugugauuccuuuucucuagaggaacauagaucaacuucucuauggaaauucuguaagggauuuauucugaagaacucagggg

SEQ ID NO: 4169031 - RNA, 56 nt, Human
uuccugcaggccauagagccugccacaaaccagguagauuccauuggcccagagaa

SEQ ID NO: 4169032 - RNA, 56 nt, Human
uuccugccggaucacugggcucugccaacuucaguccccagagguugcggcaggag

SEQ ID NO: 4169033 - RNA, 59 nt, Human
uuccugccugaggcuccuggugggagugaugcuaccuugggggagucucaggagaggaa

SEQ ID NO: 4169034 - RNA, 80 nt, Human
uuccuggaaggugaggcuggcuugccuucuugauuuauguggccaaaggguagcagccaccucugcaaagguccagugaa

SEQ ID NO: 4169035 - RNA, 65 nt, Human
uuccuggauccuaggagguggguauuugcauugucuuuaauugccaugcucauagggucgaggga

SEQ ID NO: 4169036 - RNA, 65 nt, Human
uuccuggccucaaguccuccuaccuccucagcuuucuagagguauuuggacuacaggcacaggga

SEQ ID NO: 4169037 - RNA, 64 nt, Human
uuccuggcuaaucuuaaggcuuuugcuaaauuuaauuagcacauacugcaaagauuacuaggaa

SEQ ID NO: 4169038 - RNA, 58 nt, Human
uuccuggcucacagcaguggggucaccuccccaggguucccacuuaguagcugaggaa

SEQ ID NO: 4169039 - RNA, 62 nt, Human
uuccugggagcuagccacaucugacugcuacaauaccauagauccuggacagauuccaggga

SEQ ID NO: 4169040 - RNA, 73 nt, Human
uuccugggcugcagagagcaccuugcucgucagaauuugcugcugucccauggcuuuuuguauggcccaggaa

SEQ ID NO: 4169041 - RNA, 56 nt, Human
uuugaugugcaauagucugauguucaaucucaauucaggaucaguagcauaucaga

SEQ ID NO: 4169042 - RNA, 64 nt, Human
uuugauguggacaaguucaaguaaugcagcuaaguauuaaaaauuacaaauuguccucaucaag

SEQ ID NO: 4169043 - RNA, 59 nt, Human
uuugauuaccuggggcccucugcuuccucacaggugucagcccugccccaggaaucaaa

SEQ ID NO: 4169044 - RNA, 59 nt, Human
uuugauuccuggggcagggcugacaccugugaggaagcagagggccccagguaaucaaa

SEQ ID NO: 4169045 - RNA, 59 nt, Human
uuugauuucauagauuguaaaucccugcaguacugcaagaagccauuuaugaaauugag

SEQ ID NO: 4169046 - RNA, 87 nt, Human
uuugauuuuaaugagaaugcuuguuuggagaugaaauuggugagacacaagaaagcugaauaaccacaggcuucuuuugaaaucaga

SEQ ID NO: 4169047 - RNA, 83 nt, Human
uuugcaaaacauggcaugaauaauguguacauuacuugcauaauugguuuugugcguacauauggcacaugcuauuuuggaaa

SEQ ID NO: 4169048 - RNA, 69 nt, Human
uuugcaaauaccaugaaacuugagugcugugugugcaucauuaugggcaguuucccuguuauuuguaga

SEQ ID NO: 4169049 - RNA, 64 nt, Human
uuugcaaauuagccacccuguuuugaggaagccaaagggcuucauggggaggcccauuuggaga

SEQ ID NO: 4169050 - RNA, 67 nt, Human
uuugcaagagaaaagccccuuuguuccaacuucaagccucuguugguccacgaguucucuuagcaaa

SEQ ID NO: 4169051 - RNA, 60 nt, Human
uuugcaauauggggauggaggggagcaguguuuaaaagaugcugaagauucccaugcaag

SEQ ID NO: 4169052 - RNA, 63 nt, Human
uuugcaauugaugagucugagauucauggauguuuaaugaguccaaggccauacaguugugag

SEQ ID NO: 4169053 - RNA, 81 nt, Human
uuugcaauuuagauuuuuccccauuuuagugucuuaaagccuaaagagugacagcagaaugugaagauuuugaauuaugaa

SEQ ID NO: 4169054 - RNA, 58 nt, Human
uuugcacaagaaaucauggacugaauuuccaagaguucaggucucaauucuuugcaga

SEQ ID NO: 4169055 - RNA, 59 nt, Human
uuugcacacugugaauuugcauauguacauauaaauuuauguaauuucauaggugugaa

SEQ ID NO: 4169056 - RNA, 88 nt, Human
uuugcacagcugcuugauggaggggccaggcuuugaacccucgcauuuugacuguagagucugugcuuucaucaggaggaucugcaga

SEQ ID NO: 4169057 - RNA, 63 nt, Human
uuugcaccagggaagagaugccccagcaccugcuucaggccacagcucuuucuuuggcacaaa

SEQ ID NO: 4169058 - RNA, 60 nt, Human
uuugcacuggaaguacaugcauucaaaauggauaccuaaguguauauuuucugguguaaa

SEQ ID NO: 4169059 - RNA, 63 nt, Human
uuugcacuguaccauagguaagcucagagaagaggguucuugcuuaagauggcauaguacgaa

SEQ ID NO: 4169060 - RNA, 75 nt, Human
uuugcagagcaaagugugguggaggaggaggcuggcagggccugucuccacagucccaccucgcuuuccugcaga

SEQ ID NO: 4169061 - RNA, 106 nt, Human
uuugcagauggaauuaagguuacaaauuagcucacuuuaagauaggaaaaauacucucaauuauaaaguuggggcugaaguaaucacaugaacccuuaaaagcaga

SEQ ID NO: 4169062 - RNA, 60 nt, Human
uuugcagcaaggagagagcauucgcacuucauucuuggguuaugcacaccuagcugcaaa

SEQ ID NO: 4169063 - RNA, 58 nt, Human
uuugcaggcacggaggcagcuggacauccuucgcuucaccagccucugggccugcaag

SEQ ID NO: 4169064 - RNA, 75 nt, Human
uuugcaguucccauaggagauaaaacaagucucuuuucaaacaugaagagauuuccuaugguaauuauaggcaaa

SEQ ID NO: 4169065 - RNA, 55 nt, Human
uuugcaguuucauugcugaaaugauucuucuuauuucagcacuuuaggcagcagg

SEQ ID NO: 4169066 - RNA, 127 nt, Human
uuugcauauugaauaccaaguacugaaggauggaagagauguggcacagcacaguaagaggagacuucugucauucuuacauuagucugugcuuucaacuagcuuuguaaccaugggaaagugcaaa

SEQ ID NO: 4169067 - RNA, 61 nt, Human
uuugcauuuucuagcuaguuuacuugggaagagagcugaguaaaggcuuuagaauggcaaa

SEQ ID NO: 4169068 - RNA, 101 nt, Human
uuugcauuuuggaaauaagaaacuaaagcucagagagauagugaaguuuguggcuaauugucauccuucagcucucuauuuagaugucauuuccuugcaaa

SEQ ID NO: 4169069 - RNA, 69 nt, Human
uuugccagcuggcuuucuauuuggugcuaucucuccauaggaagucccggagaaggaucggaaggcagg

SEQ ID NO: 4169070 - RNA, 130 nt, Human
uuugccgcuuaguggggcuccggcggugggaugggucucugccgugagcuuucgcgagccgcucuuggcagccuggaaugcgaggcuagcucacgcuucucuuacaccucucuugcccuucuggugguaa

SEQ ID NO: 4169071 - RNA, 70 nt, Human
uuugccucugguuaucugguaccuggccguggggcaauuagggcaggugcacaguggccuggagugugag

SEQ ID NO: 4169072 - RNA, 90 nt, Human
uuugccucuuuuccucccuuucugccuucuaaaauaagcaggcacaagcuccuuugauaagguagaaaugguuuggaaggaacaggugga

SEQ ID NO: 4169073 - RNA, 55 nt, Human
uuugccuggacccccagcaucaugguuucccauuucauggggucucucagguaag

SEQ ID NO: 4169074 - RNA, 109 nt, Human
uuugccuuguuuaccaacuuugaguuuagcaacaggaacuauuuguauuccauuauguuuauaaaagauggaaauauauuuucuguuuuuucuugguggaaggggcaaa

SEQ ID NO: 4169075 - RNA, 74 nt, Human
uuugcgcgacccuccaggcgguucccgagcagcucaccgaacaggcucugcagggccgcuggaggucauggaaa

SEQ ID NO: 4169076 - RNA, 62 nt, Human
uuugcggauguccacgucacacuucaugauggaguugaagguggucuuguggaugccgcagg

SEQ ID NO: 4169077 - RNA, 76 nt, Human
uuugcucauuguuaaaaagguggaaaugcuucccaucuuucauuguauucucaaaauuuuugacaacuugaucaag

SEQ ID NO: 4169078 - RNA, 106 nt, Human
uuugcucuauucugcuguucuauuccccuuaucugugacucaaagaggugccaagaaaagagucugagaugacuuugggaagaaagagagggcagaagagagggaa

SEQ ID NO: 4169079 - RNA, 56 nt, Human
uuugcugugcccuucuuguggcagcacuuucugcuacaagagcaagcauggacaag

SEQ ID NO: 4169080 - RNA, 56 nt, Human
uuugcugugggauauccaugugcacccugccuaaagcacguuuuuccacuagcaaa

SEQ ID NO: 4169081 - RNA, 130 nt, Human
uuugcuucacaaagaccaaacagcauguuaaaccgcuucaugauauagaguuuguuuuucagauauuacacauaaacaaagcuuuaugacuuggagacaguuauagaaaguaguuugcugguaaagcaga

SEQ ID NO: 4169082 - RNA, 85 nt, Human
uuugcuucccaguuuuacccuagguccagauuguagaauccuggagucaccauguucugcaggagcccuaguguaugggagcaga

SEQ ID NO: 4169083 - RNA, 55 nt, Human
uucauuccuuguugucugaaaugucaaaucauuuuaccagaauagcaggggagag

SEQ ID NO: 4169084 - RNA, 66 nt, Human
uucauucuuggcccguccucacgcaaaggcaagagagccaggugcugggauggagccagauuagag

SEQ ID NO: 4169085 - RNA, 83 nt, Human
uucauugaugugguuuaauguauauuccuguaaucuuucccuguuuuauaaacuuacaaucauaauugagccacauuagagag

SEQ ID NO: 4169086 - RNA, 76 nt, Human
uucauugcagacuaacaaucucaaaagaauagauuggugcucgacugaacuguguccugagauguuucuaaaugaa

SEQ ID NO: 4169087 - RNA, 55 nt, Human
uucauugugauucuuggcuagcuuuugacuuggagauagucaugaucacagugga

SEQ ID NO: 4169088 - RNA, 83 nt, Human
uucauuuaacaaaucaggaaauugcaacagucugagcucaaacauauaacuggugcuuacauugucuuaguuuucaaaaugaa

SEQ ID NO: 4169089 - RNA, 117 nt, Human
uucauuuaacauccauucaaagucugacuguauguuuuccaguucuuuaguucacaucaagccuccaaccaaaggagaaaacauacaggacuucgaaaaaagggaugaagaaaugga

SEQ ID NO: 4169090 - RNA, 101 nt, Human
uucauuuagaauucaugguaacagaauucuaaauguaauuuagaauuuauaguaacagaauucuaaauguaauuuagaauuuauacauggagagagaugaa

SEQ ID NO: 4169091 - RNA, 91 nt, Human
uucauuuauucucucacucauuuguuaaauauuuauugagugccuucauuguuguaggcauuuuguuaagcauugaggaugcaaaaaugaa

SEQ ID NO: 4169092 - RNA, 72 nt, Human
uucauuuccuuuaggaaugagaaagaauuagaugaguuucagcuggauccauuuuauuucuaaaggagagaa

SEQ ID NO: 4169093 - RNA, 96 nt, Human
uucauuucuugaugcaaccuuccuuaguguuagauucugugcuguaguuggauuggaaagucaugauccacuaggggagauaagcauuuaugugaa

SEQ ID NO: 4169094 - RNA, 67 nt, Human
uucauuugccccuggucagaggaggcugggaggaccccaaucccugaucagaggagccuacaaugaa

SEQ ID NO: 4169095 - RNA, 82 nt, Human
uucauuuguaaaaagggucacaaaggguguuucuauaauuuauauuccuagcauacacccuaaacugcuuaaagcaaaugaa

SEQ ID NO: 4169096 - RNA, 91 nt, Human
uucauuuuuugguaauguuucauugcagauauguagacacuuuguucagucuuaacuugcccuuuguaaugauaauguuaaauuagaugaa

SEQ ID NO: 4169097 - RNA, 67 nt, Human
uuccaaaaguuguugcuaagauuaugcuauuucuggagaaauagcaucuucccugguaaccauggaa

SEQ ID NO: 4169098 - RNA, 130 nt, Human
uuccaaaauuucucacaguaaaagagaagcguauguggguucaguugaaacagacaaaugaaauucucauccgagaacuugguauuccuuuuaacaagccaccacccaucuugucacugaugaaguugaa

SEQ ID NO: 4169099 - RNA, 62 nt, Human
uuccaaagcugcuuuauuuaguugagcaacgguacauaccauuggaagaagcagcuugggaa

SEQ ID NO: 4169100 - RNA, 69 nt, Human
uuccaaccuuucauuucacuugguagcuguuuccuuuuagcugcaguaugaggcugguggggaccggaa

SEQ ID NO: 4169101 - RNA, 72 nt, Human
uuccaaggucccaguaaauauaggaacguggaaugacagcauuuuggaauauguaugcagggcaccagggag

SEQ ID NO: 4169102 - RNA, 77 nt, Human
uuccaauaccaccucauucuggaggcugccggaggagcugaagcaauuuugucccaugggugaggugguggaaggaa

SEQ ID NO: 4169103 - RNA, 82 nt, Human
uuccaaugacagagcuucuuugcacacuggaucuuguggacuggauuucuggaagauucccagagaaguuccacauugagag

SEQ ID NO: 4169104 - RNA, 85 nt, Human
uuccaauuucaguuuuuuguuggcugagagcaacccauuuuauuugggacuuucagucuuuacaagguugcuucuacuuugagaa

SEQ ID NO: 4169105 - RNA, 64 nt, Human
uuccccuaagauacaaaugucaauauuggauuuagucuaguugaauggaugugucagaggggag

SEQ ID NO: 4169106 - RNA, 66 nt, Human
uuccccucagcauugcucauaaacguauaacaguuguuuucagguuuacagcaauguuagcaggaa

SEQ ID NO: 4169107 - RNA, 60 nt, Human
uuccccugucacagugguucucaacguucacugcauauuagaaucaccuguggagcagaa

SEQ ID NO: 4169108 - RNA, 102 nt, Human
uuccccugugaagucauaaucccccauuugugacaucacagucuuuccacugcaaucaacagugauguuucaagcuggggauuaaaugcuucagaagaggaa

SEQ ID NO: 4169109 - RNA, 95 nt, Human
uuccccuugcuagucucccuugcagucuguguagaagccuuugaccuaggcuccaccagucaggugcauccaugggagauuucaguuugggagaa

SEQ ID NO: 4169110 - RNA, 55 nt, Human
uuccccuuuuugugugcagcugaguguaucucucguuugccagaagggaggggaa

SEQ ID NO: 4169111 - RNA, 61 nt, Human
uucccggguguguauguguguaugugaugagcucauaugcauaaagaaagcuaucugggaa

SEQ ID NO: 4169112 - RNA, 89 nt, Human
uucccuaagggaaaucaggaugauguuccagaauaccauuuuuaacaacccccgcuguucuuugauacucccugauuugcuugggggaa

SEQ ID NO: 4169113 - RNA, 93 nt, Human
uucccuaggacucaucuuuguuaucucagaucuuguugguuuaagaaaaaugguacaacuagagcagauugcagaguaggugcuucuggggga

SEQ ID NO: 4169114 - RNA, 64 nt, Human
uucccucgugcagaugcggccaggaauaucuuaauuuauuggugugcuggcaugcaagagggaa

SEQ ID NO: 4169115 - RNA, 61 nt, Human
uucccucucagagucgccaggcuggggcaucuaucccaggaaauuggcuauuugggaugaa

SEQ ID NO: 4169116 - RNA, 129 nt, Human
uucccucucugauaagguccccucaggaguccuggcugccuagucccucagccucaccaagggcacuuugcuaaggcacguggguggaguggacggccagguuccuaugaagccauaucagaguuugag

SEQ ID NO: 4169117 - RNA, 64 nt, Human
uucccugcccuccacgcuucaccacuuggaggaucaucaaaggcagagcgcagagggcagggga

SEQ ID NO: 4169118 - RNA, 109 nt, Human
uucccuggagauggcagugggggacggcggagcccgggccacacuuuccucccguaacuuaucccagggaaagauguugcugcuccgcccuccucccuucucccgggag

SEQ ID NO: 4169119 - RNA, 77 nt, Human
uucccuucaaagcaauguuuuuccuuccauauugguuccuuugauaaacaguguugagagaguauugcuaaagggaa

SEQ ID NO: 4169120 - RNA, 126 nt, Human
uucccuucaauuacugcucccugcccgucuuggcacagcuugucauaaacucauuuauacuaaugugugaguggcuaagugugccuucgaacuuggccggcagaggggugaaucugauggagggaa

SEQ ID NO: 4169121 - RNA, 55 nt, Human
uucccuuucugaggcugccauacugccacuguccagguggagcuaagaaaaggaa

SEQ ID NO: 4169122 - RNA, 130 nt, Human
uuccgaugcacugcaauucuuuacagugggugcaacaaaggucuggaaacagcagggagaaucagggauaucucaccugccuccaggcucuagaugugaagacggcaggagagaaaagaaaaggaaggaa

SEQ ID NO: 4169123 - RNA, 85 nt, Human
uuccgccucagccucccaaauagcugggacuacaggcgcccgccaccaugcccggcuaauuuugguauuuuuaguagagacgggg

SEQ ID NO: 4169124 - RNA, 101 nt, Human
uuccgccucccuugugcguguucugugcaucuagccaguaugggcacuguccuagccugugcaggcugccuucacagagccccacagacuggcuggcugaa

SEQ ID NO: 4169125 - RNA, 81 nt, Human
uuccgcugccucccucugauuguuggauggacccucaaccagaggccuggugggccccagcacgucuggggaggggcugag

SEQ ID NO: 4169126 - RNA, 73 nt, Human
uuccgugccaagccaagaguuaacuauuugugagaagaaaaacagaaauacauucucugguguguguuuggaa

SEQ ID NO: 4169127 - RNA, 117 nt, Human
uuccguuccuuuccccugccggacuccgcgcucugauauauacaggagaggcccuggaggggagaaggcguccucacugcagugcuccgagcagcggccgcaggaagaggcguggaa

SEQ ID NO: 4169128 - RNA, 86 nt, Human
uuccuaaaggaaaagugggaacucucugggaggcaucaugcuagcaaagccagagaucucuuggaaguuuuaacuuucuuugggag

SEQ ID NO: 4169129 - RNA, 67 nt, Human
uuccuaacaagggguauucauccacugacucuccauuggucauugucugagugucgcuucuugggag

SEQ ID NO: 4169130 - RNA, 55 nt, Human
uuccuacaggugcaaacccuccuaguaucacccgcaggcuccuguaccugaggaa

SEQ ID NO: 4169131 - RNA, 74 nt, Human
uuccuacuuugucuucauuaucugguuacuuuucucuauuguagcuaaguuuccaaaaggagacagggaaggaa

SEQ ID NO: 4169132 - RNA, 76 nt, Human
uuccuaggacuggaccagaaaggacauggcuuuguaagagcuuuccuagcaaugucuuuuuggccaucugugggaa

SEQ ID NO: 4169133 - RNA, 57 nt, Human
uuccuagguguuuacauucaacauuuuguauugugaaguaugugagcaucuauagaa

SEQ ID NO: 4169134 - RNA, 76 nt, Human
uuccuaguacucaguccuuggaggauucucuugcugacugaaaaguaaguuggaaucuggaacugaucaaaaggaa

SEQ ID NO: 4169135 - RNA, 67 nt, Human
uuccuaguccuuauucuuucaauuugacuacugguaaugcccacauaguaugcaagaagauuaggaa

SEQ ID NO: 4169136 - RNA, 117 nt, Human
uuccuauaaaacauggucaaagaaacgaaguuaaaguagauaggcaagguaaacacagauuuaacaguaguuuaguguuacauauaccugagcuuauaugcuuuuuaccaauaggga

SEQ ID NO: 4169137 - RNA, 59 nt, Human
uuccuaugauagaaauguuggagcauucuuuaguucuaagaucuacuauacauguggaa

SEQ ID NO: 4169138 - RNA, 93 nt, Human
uuccuauugcuccuuuuguugcuauuuagcaccugugcacaccaggcauuagucggugcauugggagucagugcugaacaaaggggguaggag

SEQ ID NO: 4169139 - RNA, 64 nt, Human
uuccuauugggauuuggguugguuucucauuaauuuaauuagccaggcuugacccuagugggaa

SEQ ID NO: 4169140 - RNA, 105 nt, Human
uuccuauuuuaaaugguuccuacuuugauugcaagcauuuauuauaauuaucaagagauuagucugcugugauagaauccuuguaauggaaccauuuaaaaggaa

SEQ ID NO: 4169141 - RNA, 87 nt, Human
uuccuauuuuugcuggaggagcauggacuggagucagaucuacuuggcauugaauccuaguucuguuucuucaucaacaaauaugag

SEQ ID NO: 4169142 - RNA, 64 nt, Human
uuccucagaaagcuuuuacuuaaacaggacaucuuccugucuugugagauuauuucaauaggaa

SEQ ID NO: 4169143 - RNA, 71 nt, Human
uuccucagaccugagauuuugaggcucaugacccugguaagugcagaaaggauaucuuguggucugaggag

SEQ ID NO: 4169144 - RNA, 58 nt, Human
uuccucagagggcgcuggggaaagagaggggaccugauuucuucgacccucggaggaa

SEQ ID NO: 4169145 - RNA, 58 nt, Human
uuccucaggcugcuuucacauaaccugucuuuaggcugugugaguaaggcugagagag

SEQ ID NO: 4169146 - RNA, 74 nt, Human
uuccuccucucgggaagagcuccucauugccuuugcuuuuugucaguuggcagggguucauuuugucuuaggaa

SEQ ID NO: 4169147 - RNA, 86 nt, Human
uuccucuacuacccgcccaucaguggcaaauaaacaccuuaccaugacauucacugugaguauugcuagcgggagaaguggaggag

SEQ ID NO: 4169148 - RNA, 80 nt, Human
uuccucuagguccacagauuugguuucugcuggauuguugccauuuucccagggguaaagccagagguggauuuggggaa

SEQ ID NO: 4169149 - RNA, 71 nt, Human
uuccucuccucccaccaggugaacaauucuauauccugcuucuccauggaaauuccugagugggagaggaa

SEQ ID NO: 4169150 - RNA, 58 nt, Human
uuccucucgcucuccggggccccugugcaaagagggucuuccccccgagcagcaggaa

SEQ ID NO: 4169151 - RNA, 101 nt, Human
uuccucuugaucuacaauugaacuucacggaauaguaguuuugcaauacauuaucagcuauuaugugaagaaagugcuucauggauaaagaaauauaggaa

SEQ ID NO: 4169152 - RNA, 130 nt, Human
uuccugaaauacuuuaugucuccuccacaccauggagaacaguucuguguuggugagaagcaagccaaggcagaagauggcucuuguguggugcaguuuacaaaagagagacaaaauuugauagcagcca

SEQ ID NO: 4169153 - RNA, 65 nt, Human
uucccuggauauauguagauccaggcacauauuccagguuucuuuuaaaauauguagacagggaa

SEQ ID NO: 4169154 - RNA, 123 nt, Human
uucccuggccuuugaagggaagauguugcaauguacaggcaguuggaguguuuugccuaauucaucaaaacauucacauuugcuaguaauacaaugcaucuaugaugagaaggacuuagggga

SEQ ID NO: 4169155 - RNA, 129 nt, Human
uucccuggugaauuuguagaauuuaaccacuuuaaauaacaguauccccauuugcaagaugaagauaauauuucugcuuuaugacuguuuggggaggauuaaaugagacaauauagauuaaauauugaa

SEQ ID NO: 4169156 - RNA, 85 nt, Human
uucccuguugcuguccuuccuggauaacuggggcaauuuuauucuuaaaguuuuccuguguccaagauggcagccaagcagggaa

SEQ ID NO: 4169157 - RNA, 72 nt, Human
uucccuuaauucaugaguagaaucuauauacauauauuauucugguuuucuauugaugaaguacauggggaa

SEQ ID NO: 4169158 - RNA, 99 nt, Human
uucccuuucagcugcguuccugaauugcuagcgcaccaauucugcuuuacugaccacaauuggugcagcugggauggcgaaggagcaacugaaaaggaa

SEQ ID NO: 4169159 - RNA, 110 nt, Human
uucccuuuccuauuugucuuuucuuuaagacucugcucuuggugcuccagcuugugucagcaccagacuucccagaguuauaaacagcagaagaaaaggaaggaacggaa

SEQ ID NO: 4169160 - RNA, 72 nt, Human
uuccugugaaggccaguggauaaaaccucuuauguuauucaugagggguauucaucugcccuaaagcaggga

SEQ ID NO: 4169161 - RNA, 65 nt, Human
uuccugugucuucuguuuugaaguuauuuuauugugaaaaacuaaauacacagaagcacagagaa

SEQ ID NO: 4169162 - RNA, 58 nt, Human
uuccugugugucagaugcacaguauuuacuuuguacuaugauuuggauaugcagagaa

SEQ ID NO: 4169163 - RNA, 61 nt, Human
uuccuuagggaaagggauaaggcauagccagauaugggagugagaucccuucucugaugag

SEQ ID NO: 4169164 - RNA, 62 nt, Human
uuccuuaggggacagggggauaccagaaagagucucugcccuucuguuaaccaucugggggg

SEQ ID NO: 4169165 - RNA, 77 nt, Human
uuccuuagugugagugccccaugggguacauuuaggggcuaugugagccucucuuccaggaggcacugacagaggag

SEQ ID NO: 4169166 - RNA, 64 nt, Human
uuccuuauaugaguugauuuuuagaauacucaaugugucugacuuuauuaauucacauuuggga

SEQ ID NO: 4169167 - RNA, 82 nt, Human
uuccuuccauucccucuuuuccaacaguuguguugauuuucaggauagcugcugcagagaagagaauucaaagauggaggaa

SEQ ID NO: 4169168 - RNA, 57 nt, Human
uuccuuccucuuucacaacagccaguucuguuuuccccccugugauagaguaaggag

SEQ ID NO: 4169169 - RNA, 70 nt, Human
uuccuuccuuaucccuacuucaccugauuggcuagguuucuuaucaggugggaccaugauagggcaggga

SEQ ID NO: 4169170 - RNA, 71 nt, Human
uuccuuccuugagaagcaauuccucacaccacggagaaugcucagaggaauuugcucuuucacuucaggaa

SEQ ID NO: 4169171 - RNA, 85 nt, Human
uuccuucugcuggacauguuccaagggccaaaaccucaaauaaugugacuuuguagauuggagagugugugaccacagaaaggaa

SEQ ID NO: 4169172 - RNA, 66 nt, Human
uuccuugacuuuaaagccugacauuuuaagcuuuguaugaaauacuguugccuugagggaaaggaa

SEQ ID NO: 4169173 - RNA, 75 nt, Human
uuccuugcucugguagcaugucuuuuuagccuuugcaacauaugcagggcucagaaaugucuacggguagaggag

SEQ ID NO: 4169174 - RNA, 79 nt, Human
uuccuugguuuuaaacucuuaacugccuuaucuguguuaugucaacaucagaacaaaucgguuaagaacuugcaaggaa

SEQ ID NO: 4169175 - RNA, 63 nt, Human
uuccuuguuauuugaaggauuaauuagcuacaaaaugcuacauugauauuucaaauacaggaa

SEQ ID NO: 4169176 - RNA, 77 nt, Human
uuccuuucacagcuguccagugugucgugcuggagacuucccacagcuugccugccacuacagcugaagaauaggaa

SEQ ID NO: 4169177 - RNA, 73 nt, Human
uuccuuucacuuuuuacuugacauaaaugaguuuauguauugugugccaauuuguucagguaaguacugggaa

SEQ ID NO: 4169178 - RNA, 61 nt, Human
uuccuuucccuugcuucugugcaguuacaucaucuucuguccacuugccagggaaauggga

SEQ ID NO: 4169179 - RNA, 63 nt, Human
uuccuuuccucuuauuuucccagugaugucuucugagauaugacaggcccaggagaaaaggga

SEQ ID NO: 4169180 - RNA, 73 nt, Human
uuccuuucuagcucuaauuuuagguuuaacuccuuucucagagaauugaggagagaaucagaguggaaaggaa

SEQ ID NO: 4169181 - RNA, 65 nt, Human
uuccuuucucugucccuaaucacccucuucucuuggugaugugugggcaugcagacaggcaggga

SEQ ID NO: 4169182 - RNA, 55 nt, Human
uuccuuucuugagaccucucuacccauguuggaugaggucagccauaagacggaa

SEQ ID NO: 4169183 - RNA, 67 nt, Human
uuccuuuuucuaaacagugguguugguacuugaacaaaaucggcauuuguuaagaaggaaaaaggaa

SEQ ID NO: 4169184 - RNA, 60 nt, Human
uucgacaggagcuggagaagcucaggaaaugaaucacagaugucuccacuucugugagaa

SEQ ID NO: 4169185 - RNA, 79 nt, Human
uucgagaauguaaaccgugcacucccaggaaaaugcagacacagcacgccucuuugggaccgcgguuuauacuuucgaa

SEQ ID NO: 4169186 - RNA, 55 nt, Human
uucgagucuagugcacuuaaguguucagaauuuuacagaggcaaggagacuugga

SEQ ID NO: 4169187 - RNA, 84 nt, Human
uucgcccuucuucuugguaaugucacauuuccuguacccucaggcuaucgaggaagccuggcauuaaaaagcaaaaagagugaa

SEQ ID NO: 4169188 - RNA, 61 nt, Human
uucgcuugguguuuacauggcuuaaacugucuaauuuauagacucugaaagcaccggugaa

SEQ ID NO: 4169189 - RNA, 126 nt, Human
uucggaagugaggcugcagccagggauugagcauuggguuucugcaugcaucugcacauuuccucaaaugcaguccacaggccacagugcaauuaaacacccaaacugccaaguugaguuucugaa

SEQ ID NO: 4169190 - RNA, 74 nt, Human
uucggagagaccaagauuuggcaacuuugucauucugcagaggaaagagucugccagaucccuuuauuccagaa

SEQ ID NO: 4169191 - RNA, 76 nt, Human
uucggcugacuuuuucucuuuuuccuauugcuggucuuccaggacuucaaagcgugauaaagauaaggcagaugag

SEQ ID NO: 4169192 - RNA, 57 nt, Human
uucggcuuggguauuucucaggcacaugaccucucugagugugaacccaagccagaa

SEQ ID NO: 4169193 - RNA, 97 nt, Human
uucgggggauuggcuucuagucuagacucuugcuggguuaguguuuccaucauucugucaaggauccagcucuaaggcugauagccacuucccugaa

SEQ ID NO: 4169194 - RNA, 129 nt, Human
uucggguaaagggggaguauuugugugggcauggcuccauagcuucguuuaguaucagcccuaaacuuuuguggggaggagucuuucaaugagcccggggccauagucacgcacucuucccaacccgga

SEQ ID NO: 4169195 - RNA, 57 nt, Human
uucgucuggcaguugcacuguuuauguguguugauugagauggugaaggccagggag

SEQ ID NO: 4169196 - RNA, 74 nt, Human
uucguuuuaaugaacaugcaucguguguacgugugugcgcgugcauguguguguguguguguuuauauaaugag

SEQ ID NO: 4169197 - RNA, 71 nt, Human
uucuaaaccucaggcucucuggacaaugcagcucagccuucagcuccaccagagaggcugcagugugugaa

SEQ ID NO: 4169198 - RNA, 68 nt, Human
uucuaaagcagagauccuccacuucagcacaauugguguccugggcuggauaauucuuugcuguggag

SEQ ID NO: 4169199 - RNA, 81 nt, Human
uucuaaaggcuugccaaaaauucugauauuugaacaugugccauuguauuagucaggaccuuuugguuucaaguaacagaa

SEQ ID NO: 4169200 - RNA, 88 nt, Human
uucuaaaugauaaucugauuuacauauacaaaagauuugccuaugcuaucuggguugugauguaaaauauuuaguuguacaucuagaa

SEQ ID NO: 4169201 - RNA, 56 nt, Human
uucuaaaugggucagcucacaaaauaaaguggaaugugugcugauacauuggagaa

SEQ ID NO: 4169202 - RNA, 61 nt, Human
uucuaacucaaagcuucuuucaggagcuacucaacuccugagauuggcuuugcaguuaggg

SEQ ID NO: 4169203 - RNA, 58 nt, Human
uucuaacuccugggcucaagugaucuuccugucacaugagucucccaaguaguuggaa

SEQ ID NO: 4169204 - RNA, 58 nt, Human
uucuaacuuuugaggcaaugugacucccacuggaaacauuguucaaugaaaguuagga

SEQ ID NO: 4169205 - RNA, 69 nt, Human
uucuaagcuaaguagacuguugaacuugguuccucagggggaaucuccuccaaaccucugcuuuuagag

SEQ ID NO: 4169206 - RNA, 106 nt, Human
uucuaauaaacauaacaugaaugaaccucaaaaacauguugaguugaaaguagcuagauacaaaggacuauauauacuauauguuuuuauucauauguuuuuagaa

SEQ ID NO: 4169207 - RNA, 71 nt, Human
uucuaaugaagacaucauggagaggauagaugggcaagccuuuucuacaucuuuuccaauguugucuggaa

SEQ ID NO: 4169208 - RNA, 86 nt, Human
uucuaauguauccccaaggcuagcaagcaguagucauucaacuaacaauuguuugacuagagcugcagccuaagcaguauguugaa

SEQ ID NO: 4169209 - RNA, 71 nt, Human
uucuacaacauacauauuucaguguccauaaacuccagccauguggauauguuuauauguugucuauggga

SEQ ID NO: 4169210 - RNA, 114 nt, Human
uucuacuccuacauguuacgcuuuuagaucugucuuggagguacaaagacuucuggaauuagagaaguuugguccuucuaagaagagaaaaaugaauaaguagagaagucagaa

SEQ ID NO: 4169211 - RNA, 64 nt, Human
uucuacuguauucauugccuaaaguguguuagaaucuuuaaugcaugcagggaagacaguagaa

SEQ ID NO: 4169212 - RNA, 93 nt, Human
uucuacuuuucuuccaugaagcuccuguugucugauguacauaugcugaacacauauuauaaaauuacuggcagggaucugggggugguggga

SEQ ID NO: 4169213 - RNA, 81 nt, Human
uucuagaauauuauauaaauggaauuaugcaacaugcauacuuuguauaaggcaucucucaguuagcagaguguucuggaa

SEQ ID NO: 4169214 - RNA, 65 nt, Human
uucuagacacagacaguuagagguaauucacaaagaguuguaaaauugcucuguugugucuagaa

SEQ ID NO: 4169215 - RNA, 66 nt, Human
uucuagacauuauuucuacccacaauuuacuuuugugcuuugugugugcauguguaugcuuuggaa

SEQ ID NO: 4169216 - RNA, 80 nt, Human
uucuagacauuccuuaauuauuugguuauucuugaguaacuaucaaauuuaagaguaagugauuaagaagaugauuagaa

SEQ ID NO: 4169217 - RNA, 60 nt, Human
uucuagacuguguacagauucagaauuaagaaacuuaugaacucuuacugcagucuggaa

SEQ ID NO: 4169218 - RNA, 57 nt, Human
uucuagcuguucauguggcuuuaugcugauagugucagucaaaugaacaagcuugaa

SEQ ID NO: 4169219 - RNA, 75 nt, Human
uucuaggcagaaauuggcagagaagaccuagcguucaaggguucuagacuucucuuggcuauauuauuguuugaa

SEQ ID NO: 4169220 - RNA, 77 nt, Human
uucuagggcugccauaaugaaguacuacaaaugagguggcuuagacaaaagaauuuuauugucucccaguucuggaa

SEQ ID NO: 4169221 - RNA, 64 nt, Human
uucuaguuuccauuuuaagacagcugugaagcuacagucaauguguagaaugugguacguagaa

SEQ ID NO: 4169222 - RNA, 118 nt, Human
uucuaugacuguaacagaaauaggaaacucucagcuggucaucacuucuauuugguauaagaguggcaucauauguacuuagcuggcauuuccugauugacuguugguuuuuauagaa

SEQ ID NO: 4169223 - RNA, 79 nt, Human
uucuaugcaguauaagccaauggauugguugcuuuugcuuuucucaguagcaucauuauuuuggccauacuuuauugaa

SEQ ID NO: 4169224 - RNA, 79 nt, Human
uucuaugcuguuagaacauuuuuagaccaauaagaaggacaauuucauauggucucucaaaugugcuucuugcaaugaa

SEQ ID NO: 4169225 - RNA, 87 nt, Human
uucuaugguuaaagcuuugcaaugcuucauuauuauccuucuuuauuauccuugguauauaaugcagcuuuucaauggcccauagga

SEQ ID NO: 4169226 - RNA, 57 nt, Human
uucuauguaaacuguuggauuugacaaggaggaguugucaaaggcagauuacuggga

SEQ ID NO: 4169227 - RNA, 116 nt, Human
ugagcucuuugccuguaggccaagagguuuguugaaacccauccuguccgcagucuuggggaagugggaagcugugguguuuucaagcccuggcuuacugagcgccaagaaacuca

SEQ ID NO: 4169228 - RNA, 84 nt, Human
ugagcuggcucauuaauuacuaagcacaaugcaaugugauauuugcagaucguuugugugcuuguuaauuuauucagucauuca

SEQ ID NO: 4169229 - RNA, 55 nt, Human
ugagcuguaaggcugucacugaacauaaguggacaugaccagucuggcagaguca

SEQ ID NO: 4169230 - RNA, 62 nt, Human
ugagcuucagcugccaugacugucacacgcaggaagccgaucagucuugguagcugugccca

SEQ ID NO: 4169231 - RNA, 83 nt, Human
ugagcuuugcaauuagaaagaccuagaugugaauucuagcuacuccauuaacuagcugugugcauuugggucucagaggcuca

SEQ ID NO: 4169232 - RNA, 61 nt, Human
ugaggaaagaaaggcaugcaugaaggcuccauuccuuuucaaacauaauuuucuuucuuua

SEQ ID NO: 4169233 - RNA, 65 nt, Human
ugaggaaauggcacucauauaggcaaaauuacaggcuuuuuguuugaaugggucuauuuuucuua

SEQ ID NO: 4169234 - RNA, 78 nt, Human
ugaggaagagugugagucugggaaaauuuuggaucaccgaggugcagccauaccuuccacagccaucacuguugcuua

SEQ ID NO: 4169235 - RNA, 84 nt, Human
ugaggaaggggcucaaauucauucuuuucuauguggauauucaguuguccuagaaccauuguugaaaagaauagucuuuccuca

SEQ ID NO: 4169236 - RNA, 85 nt, Human
ugaggaagguguccaggaagcagagucagguccaaggacuggggugccuccuuucaccuggccagacucugacccaccuaccuca

SEQ ID NO: 4169237 - RNA, 100 nt, Human
ugaggaaugccacuugagagaugcugagugugaaguauaguggucuccaggccacuugacauuuucauuaagaaaccucuugccagugguaauuaccuua

SEQ ID NO: 4169238 - RNA, 97 nt, Human
ugaggacaaguauuggcccauucaauaccuuagagaaaagaaaacuaugggaaaauuuuuuucugagaguauaugccugagccaaauucuucacuca

SEQ ID NO: 4169239 - RNA, 63 nt, Human
ugaggacaccaagcccugagagguaaagugauuuucuuaaggucccagggccaggugccauca

SEQ ID NO: 4169240 - RNA, 76 nt, Human
ugaggacaugagauuugggaggggccaggggaagaaugauauaguuuagcucuguccccacccaaaucucaucuua

SEQ ID NO: 4169241 - RNA, 68 nt, Human
ugaggacugucuacuaacaagaagcccagaccuuuaaugggccuuggaaagcuggagcaguuugcuua

SEQ ID NO: 4169242 - RNA, 65 nt, Human
ugaggaggcagucugucccuuagcacagcuagagcacugugcugagagaucugcugcucucuuca

SEQ ID NO: 4169243 - RNA, 85 nt, Human
ugaggagguagcaugugagguaaaaucgguaagauguagaaauccauacuuugcugauuuacuauuacuuagauuuuucuccuua

SEQ ID NO: 4169244 - RNA, 66 nt, Human
ugaggauaguaugaauuaaaucaugagagaaaaaaugucuauucaugguauuuuuuauuaugcuua

SEQ ID NO: 4169245 - RNA, 71 nt, Human
ugaggaugacuccgauaugcccagagccugggguuaccaggauaugccugcugauuggaguugaauuguca

SEQ ID NO: 4169246 - RNA, 57 nt, Human
ugaggaugauggaaaaagaucagucaaggauaaugccuagacuuuucaucaaccuua

SEQ ID NO: 4169247 - RNA, 56 nt, Human
ugaggauggucccgaggacacuuguaauaaaccaagauuccuccaagcacuccuca

SEQ ID NO: 4169248 - RNA, 101 nt, Human
ugaggcaaaagaauugcuugaacccaggagguggagguuguggugagcugagaucgcaccacugcacuccagcccgggcaacagagcaacacuuuuucuca

SEQ ID NO: 4169249 - RNA, 102 nt, Human
ugaggcaaaguuuugcccuuguugcccaggcuggagugcaguggcacaaucuuggcucacugcaaccuccgccucuuggguucaagcgauucuccugccuca

SEQ ID NO: 4169250 - RNA, 97 nt, Human
ugaggcagaagaaucacuugaacccaggaggcagaggcaugagccaagaccaugccacugcacuucagccugggugacagagugagacucugucuca

SEQ ID NO: 4169251 - RNA, 101 nt, Human
ugaggcagaagaaucacuugaaccugggaggcagagguugcagugagccgagaucgcaccacugcacuucagccugggcgacacagugagacucugucuca

SEQ ID NO: 4169252 - RNA, 100 nt, Human
ugaggcagaagaaucccuugaacccaggaggugaaggcugcagugagccaagacggugccacugcacuccagccugggcacagggcgagacucugucuca

SEQ ID NO: 4169253 - RNA, 96 nt, Human
ugaggcagaggaaaugcuaauuucucagaccagagaggugugcuucucuacagcacgcuuuuacuauuuugagcucucuguauagcuuuuuuuuua

SEQ ID NO: 4169254 - RNA, 101 nt, Human
ugaggcagcaggauugcuugagccaggaagguugaaacugaagugagccaugaucgugccacugcacuccagccuuggcaauggagcaagacccugucuca

SEQ ID NO: 4169255 - RNA, 60 nt, Human
ugaggcagccugguuugaauggaaggaaagagccuggaccacagcagauaggcuguguua

SEQ ID NO: 4169256 - RNA, 101 nt, Human
ugaggcaggagaaucacuugaacucaggaggcggagguugcagugagcugagauggugccgcugcacuccagccugugcaacagagugagacucugucuca

SEQ ID NO: 4169257 - RNA, 102 nt, Human
ugaggcaggagaaucgcuggaacccaugagguggagguugcagugagcugagaucacgccacuguacuccagccuggguaacaagagugaaacuccaucuca

SEQ ID NO: 4169258 - RNA, 100 nt, Human
ugaggcaggagaaucgcuugaacccaggagguggagguugugguaagccaagauugugccauugcacuccagccugggcaacaagagugagucugucuca

SEQ ID NO: 4169259 - RNA, 102 nt, Human
ugaggcaggagaaucgcuugaacccgggaggcggagguugcagugagccaagaucgugccacugcgcuccagccugggugacaagagcgaggcuucaucuca

SEQ ID NO: 4169260 - RNA, 101 nt, Human
ugaggcaggagaaucgcuugaaccuggcaggcggagguugcagugagccgagaucaugccacugcacuccagccugggcaacagagcgagacucugccuca

SEQ ID NO: 4169261 - RNA, 101 nt, Human
ugaggcaggagaaucgcuugaaccugggaggcggagguugcagugagcugagaucgcgccacugcucuccagccucggugacagagcgagauuccgucuca

SEQ ID NO: 4169262 - RNA, 98 nt, Human
ugaggcaggagaaucgcuugaacucaaggcggagguugcagugagcugagaucgcgccacugcacuccagcugggugacagagugagauucugucuca

SEQ ID NO: 4169263 - RNA, 95 nt, Human
ugaggcaggagaaucgcuugaauccgggagguggagguuggcugagaccaugccacugcgcuccagccugggcaacagagugagacuucgucuca

SEQ ID NO: 4169264 - RNA, 100 nt, Human
ugaggcaggagaauggcaugaacccgggaggcggagcuugcagugagcagagaucgcgccacugcacuccagccugggcacagagcgagauucugucuca

SEQ ID NO: 4169265 - RNA, 101 nt, Human
ugaggcaggagaauggcgugaacccaggaggcagagcuugcagugagccgagauugugccacugcacuccagccugggugacagagcaagacucugccuca

SEQ ID NO: 4169266 - RNA, 101 nt, Human
ugaggcaggagaauggcgugaacccgggagguggagcuugcagugggcuaagauugcgccacugcacaucggccugggcaacagagccagacuccgucuca

SEQ ID NO: 4169267 - RNA, 100 nt, Human
ugaggcaggagaauugcgugaacccaggaggcagagguugcagugaaccaagaucgcaccauugcauccugggcgggcaacagugugagauucugucuca

SEQ ID NO: 4169268 - RNA, 101 nt, Human
ugaggcaggagaauugcuugaacccaggagauggagguuguggugagccaagaucacgcuacugcacuccagccugggugaagaagcaagacuccaucuca

SEQ ID NO: 4169269 - RNA, 101 nt, Human
ugaggcaggagaauugcuugaauccgcgagguggagguugcagugagccaagauuuugucacugcacuccagccugggcaacagaguaagacucugccuca

SEQ ID NO: 4169270 - RNA, 101 nt, Human
ugaggcaggagaguggcaugaacccaggagguggagauugcagugagccgagaucgugccacugcacaccagccugggugacagagcuagacucugucuca

SEQ ID NO: 4169271 - RNA, 100 nt, Human
ugaggcaggaggaucacuugagcugggaggucaaggcugcagugagcugugaucccgccagugcauuccagccugggcaacagagcaagacccugucuca

SEQ ID NO: 4169272 - RNA, 118 nt, Human
ugaggcaguggguucugcagggugggaugugggugacuccucccugcccugcuggugcgugugcacccuggcaggguguggaguugggacacacacguguguagggcugguugcguca

SEQ ID NO: 4169273 - RNA, 74 nt, Human
ugaggccuacuccuugcugcgucucuggguagauguugccugugaaugcauuaaugagugguaaagaaaccuca

SEQ ID NO: 4169274 - RNA, 76 nt, Human
ugaggccuccaggcugcuccaggguaggaaagaggcagagcgucugcuccucagccaggauagccaggaggcccca

SEQ ID NO: 4169275 - RNA, 99 nt, Human
ugaggcgggagaauggccugaacccaggagguggagcuugcagugagccaagaucucgccacuguacuccagccugggggacagagcaagacugucuca

SEQ ID NO: 4169276 - RNA, 56 nt, Human
ugaggcucagagaagugcuguuacuggcccaaggucacacagcguaucugaccuca

SEQ ID NO: 4169277 - RNA, 62 nt, Human
ugaggcucauucugcaugccaaauaauccuugauuuuuucuugguguuguaggagagucaca

SEQ ID NO: 4169278 - RNA, 66 nt, Human
ugaggcucugugcaaguauuugacauuuucugaagaaaauuuagaauugcaugcauccacuccuca

SEQ ID NO: 4169279 - RNA, 67 nt, Human
ugaggcucuuuccaaguaauacuucccaggcugggcucugggaucuuagggcuuuggaaagguagca

SEQ ID NO: 4169280 - RNA, 61 nt, Human
ugaggcugaugaaaguugaaagacugguuaauuuucuccuccuucucuugcuucagcuuca

SEQ ID NO: 4169281 - RNA, 55 nt, Human
ugaggcuguggcaccgugaccacaugcaugagcaaaauggaugccucaugccuca

SEQ ID NO: 4169282 - RNA, 65 nt, Human
ugaggcuuuaugcacagcagaugguaaaugcauguaaaagcaugagacucgguguauaaagauca

SEQ ID NO: 4169283 - RNA, 90 nt, Human
ugagggaccagagaccucgugcuucuuugcuuggcacuggccugauggcaaguccaaggagagacagcauuucuucauucugguugauua

SEQ ID NO: 4169284 - RNA, 66 nt, Human
ugagggacccugcagagcugaaugucggugaaagugaugcucagcuggugccaggguccaagcuca

SEQ ID NO: 4169285 - RNA, 69 nt, Human
ugagggagcuuuuucaugugucuauagcauguucuggauguaaugggagugaggcagagucuauccuca

SEQ ID NO: 4169286 - RNA, 130 nt, Human
ugagggauaaaauuauuucuuaaauugaaggaaaauuuaucacuuaagguaauuguugcugaaauuguuuuauaguuuuaguugaaauugcuuguuaauaauuccuggcauuuauucaauucaucuuuca

SEQ ID NO: 4169287 - RNA, 65 nt, Human
ugagggcuggucccggguccuccggcugccgcaucagcgagugcaggagggaggggaagccucca

SEQ ID NO: 4169288 - RNA, 58 nt, Human
ugaggggagaucgugccacugcacuccagccugggagacagugugagacuccaucuca

SEQ ID NO: 4169289 - RNA, 66 nt, Human
ugaggggcggccugcagaggccacacuuaaacucucuugugggcuucucuguccagcugcacccca

SEQ ID NO: 4169290 - RNA, 55 nt, Human
ugagggucuggaaucugggcuuggcuuaacuccauccucugacucagaucucuca

SEQ ID NO: 4169291 - RNA, 76 nt, Human
ugagggugaggggccaagaguagggcacccagccaugugugcugaaagcugccuucugcuuggaacucccacccca

SEQ ID NO: 4169292 - RNA, 130 nt, Human
ugaggguugucaaggacacucaggcaggauuugacccaaaagagaugaagguccugacuguacuccaguauggcugcagcauaaucagauuuuccucucucucugucacugucucagaaagcagccuuca

SEQ ID NO: 4169293 - RNA, 68 nt, Human
ugagguacgaaauacacuguacuuaaauuuccuguccuggaugugaauauauguguuuuucugcuuca

SEQ ID NO: 4169294 - RNA, 122 nt, Human
ugaggucauuggagugccaggaaaaguacuagagacuguuuagagagaccuugagaccacucagaugugggaugcaauucuuuguagaagcucuccuuccucuggcacugcauuuaaucuua

SEQ ID NO: 4169295 - RNA, 58 nt, Human
ugaggucccagggguagugugccccacuuugggcauggaagacaucauggagaccuca

SEQ ID NO: 4169296 - RNA, 84 nt, Human
ugaggucuucuggcaggguguguauuuacaguuuuucacaguccccaucacuccuuauuuaucauaccuuguccaauuugccca

SEQ ID NO: 4169297 - RNA, 68 nt, Human
ugagguggcagaauaauugaaggucagacucaaaauagagaggccuccauaaauauuuucucaguuca

SEQ ID NO: 4169298 - RNA, 75 nt, Human
ugagguggcuuuuguaugauuauaaaguuuuaacaguuuaaauugagagaacauuugucaaaaagccaacauuca

SEQ ID NO: 4169299 - RNA, 101 nt, Human
ugaggugggaggauugcuugagcccgggagguuggggcugcagugagcugagguagcaccacugcacuccagccugggugacagagcaagacccugucuca

SEQ ID NO: 4169300 - RNA, 75 nt, Human
ugagguguuaauuuuaauuauccaacucauccguuuuaaaacgcaugagguccagggaaguuaaaucacagcuca

SEQ ID NO: 4169301 - RNA, 74 nt, Human
ugagguuaguuuauaauucauuucugucuguugugccuaaaaucuuggcuauucagaaugaugacggcuccuca

SEQ ID NO: 4169302 - RNA, 76 nt, Human
ugagguuauaaaccacuccugauucacuucauuaagaaugugucuuggaguuuaacuggggugagaugugaccuua

SEQ ID NO: 4169303 - RNA, 79 nt, Human
ugagguuguugcagacacuccacagucgacauuuaguuuaguugcuauuucugguggcacgugucuugcaugggccuca

SEQ ID NO: 4169304 - RNA, 80 nt, Human
ugaguaauuuuugccagaaauacuagugcugauguaaaauaaggguuaggauuagggaaggauuuggccugaauaauuca

SEQ ID NO: 4169305 - RNA, 71 nt, Human
ugaguaccucucucuucuuugcuucugcccuuuuuuucuggcaaagauauuagaauagaguagaaacauca

SEQ ID NO: 4169306 - RNA, 59 nt, Human
ugaguaccugcauaagggguaauagcagaaaugcuauuauccaacacccaguuacauca

SEQ ID NO: 4169307 - RNA, 69 nt, Human
ugaguacugauuuaagauacacacaugugaaucauucucucuguggcugugucucaagucagagcauca

SEQ ID NO: 4169308 - RNA, 111 nt, Human
ugaguagcugggucuauaggugcuugccaucaugcguggcuaauuuuuuaaucuuuuuguagaguuaggucuugcuguguugcccaagcuggccucaaacuccuagcuuca

SEQ ID NO: 4169309 - RNA, 70 nt, Human
ugaguaucauagcauaaagaauacauuucuagcauuucagacuuggugauucuuccugcuggcauacuua

SEQ ID NO: 4169310 - RNA, 83 nt, Human
ugagucaccuguccuccauucagcauuccauuuucacacucuucuagggagaguuugggugggacagcuuggaccagguguca

SEQ ID NO: 4169311 - RNA, 94 nt, Human
ugagucacugccuucucagccccacacgggcacuuggggcaccaucagcauccaggaaagcacugggcugggagggaacaaggguuaguggcca

SEQ ID NO: 4169312 - RNA, 62 nt, Human
ugagucagagaacacagaggugauguuugggacuguuccacauuauaaauuuguuuugacca

SEQ ID NO: 4169313 - RNA, 96 nt, Human
ugagucaggcuaacagauuauggauauauguggacuggauucaagccgaugagcaagcacuucauuaguucauugaucuaaguuagcaagaaauca

SEQ ID NO: 4169314 - RNA, 82 nt, Human
ugagucauucuguccgcuuguuuguuagagccccuuuaaugguggaaguucucugauacauguugugauacaaagacccuca

SEQ ID NO: 4169315 - RNA, 57 nt, Human
ugaguccagaugggccagcagggaggaaaaccgcagccuggugccuucugcgauuua

SEQ ID NO: 4169316 - RNA, 63 nt, Human
ugaguccauucuguuuuccuggaccugaauuucuccaacugccagaagacaagaauguucuua

SEQ ID NO: 4169317 - RNA, 55 nt, Human
ugagucccccugggaaaaguaaaacuuugcauuucaaacauuccugggagacuca

SEQ ID NO: 4169318 - RNA, 129 nt, Human
ugaguccugucaccaucgccgucaucgugggccugcaagagcggagaagccagccagcccuccccauggcagcugugcagcuuggcuucaggccuggugcuugauggccugcgauccuucaguuacuca

SEQ ID NO: 4169319 - RNA, 72 nt, Human
ugaguccuuuacauuuuaguuaaccugugauaugucacucuaaccuagggaaaguguggagagccugauuca

SEQ ID NO: 4169320 - RNA, 70 nt, Human
ugagucuaauaugcuuuggaacuuaaauccuugguuuguugaccacagauuauuucuaaacaggagcuca

SEQ ID NO: 4169321 - RNA, 79 nt, Human
ugagucuguaccuucaccacuguguccaugguaccugacauguaguaguuguacacagagugguggaagaaauggacca

SEQ ID NO: 4169322 - RNA, 55 nt, Human
ugagugagacauccugucuuaacagcuagaauguucugggcaaauugucuucuua

SEQ ID NO: 4169323 - RNA, 78 nt, Human
ugagugccagaggcagugaggaguuguuccucugcaagaccucccaguuccccagccccccacugccaucugggacca

SEQ ID NO: 4169324 - RNA, 74 nt, Human
ugaguggcuuuaacaacagaaauuuauuuucucacaguucuagaggauagaagucugaaguuaaaguguuagca

SEQ ID NO: 4169325 - RNA, 71 nt, Human
ugaguguauaucaggagagagcuuuaguuuuugucuuuaaaugauuguucucauuccugcaguaacucuca

SEQ ID NO: 4169326 - RNA, 57 nt, Human
ugagugucaaaugugugccaagcugcugcugcagacuugcucucuuuugacagcuca

SEQ ID NO: 4169327 - RNA, 102 nt, Human
ugaguguguagagagcaaaagaauguggugggaaauaauuaggauuaucaggagacagacaagccuaaaacuuuguuauuguguuuuuguucuuuuaacuca

SEQ ID NO: 4169328 - RNA, 81 nt, Human
ugaguguguguucuuuugcuucacagaaaauauucugccaguuuucagaaccaagagagacaucaauuuauuuagcauuca

SEQ ID NO: 4169329 - RNA, 63 nt, Human
ugaguguucugugaggcagagcugaauaacccacccacgcccuguagcugacaggaucacuua

SEQ ID NO: 4169330 - RNA, 76 nt, Human
ugaguuaaaugagaacaugaaagaggcauuuacuuuucaccuuuugugccacugauuucccauuucacuuaacuua

SEQ ID NO: 4169331 - RNA, 85 nt, Human
ugaguucugugugaccagagaagacuaucacauuuuaaagacaccuguuuuugaagcacaaugucuuuuaucaguaugaaauuca

SEQ ID NO: 4169332 - RNA, 57 nt, Human
ugaguucuugggcccaggaccauguuuuaugcucuuuaauaucugccccagagcuua

SEQ ID NO: 4169333 - RNA, 87 nt, Human
ugaguugauuuacuguguuuggcuuuagauggcagggcuaaguacaauggguaaaaguuauaggaaggcagauuuuagcucaacuua

SEQ ID NO: 4169334 - RNA, 80 nt, Human
ugaguuuaaccugccagugaauacuaucuugaauguaacacaaacacagaagaguacacugaucguaaguauauaacuca

SEQ ID NO: 4169335 - RNA, 78 nt, Human
ugaguuuacuauugggcugcccaccucggagagacgaugaguuugucccaguuuugcagguuagaaauagaaagcuca

SEQ ID NO: 4169336 - RNA, 76 nt, Human
uccugaaaaucccagguguccuggaguugguacugucagcaucuucaaacauccccaccagggacuuucuauaggg

SEQ ID NO: 4169337 - RNA, 75 nt, Human
uccugaaauucugguugucacuuguggguagaaacauaugguuuacaaauggguugaugauuauuauuucaagga

SEQ ID NO: 4169338 - RNA, 59 nt, Human
uccugaaggagcaguugcugggcaguaaugcagugccaccuagcuucccuccugcggga

SEQ ID NO: 4169339 - RNA, 62 nt, Human
uccugaagguuauacauuaugagaaaugugagauuucuguauuuugucauaaccuccaaggg

SEQ ID NO: 4169340 - RNA, 130 nt, Human
uccugaccucuaacaauccuccugccuuguccucccaaagugcugaaauuacaggggugggccccugugcccugccugacuuguguauuuuacauuuaccaggaaacccuggcaucuguugaggugguga

SEQ ID NO: 4169341 - RNA, 70 nt, Human
uccugagcacaagggagcuuugagucauuccaucagcccaauggugcucaaauccuaaugugcaucagga

SEQ ID NO: 4169342 - RNA, 56 nt, Human
uccugagcaccuaugccauggcacacaagugcuggggccacaguuagggcucagga

SEQ ID NO: 4169343 - RNA, 92 nt, Human
uccugagcccauuuuccuuugagcccugaccuagccuggccuuaccucauuaagguuugguuaaagcaguggaaaggaggaggaggcagggg

SEQ ID NO: 4169344 - RNA, 68 nt, Human
uccugagcucagcuuccucuccaugcugcuagcccaccuggcagguaggaggggaggugggugaugga

SEQ ID NO: 4169345 - RNA, 58 nt, Human
uccugaggccucugugaugugaggaagcccaacguagcccauacagagaccucaagga

SEQ ID NO: 4169346 - RNA, 56 nt, Human
uccugagggcugcagucauaggggacccuacacuucuaugaguauuacuuucagga

SEQ ID NO: 4169347 - RNA, 58 nt, Human
uccugagggcuuccuugucccggggaaccauuucuuuggguuucagaagguuuccgga

SEQ ID NO: 4169348 - RNA, 128 nt, Human
uccugaguccaugugacuaaauuucaagagggcagguuagaaaaagcaaaguugauggggcauuaccugugguuugaacuucuaccugucauauuucaggaaaucaccaugaggagcuugacuuagga

SEQ ID NO: 4169349 - RNA, 55 nt, Human
uccugaguguuuggccaggccagguaugaaaggcacuuaggcuggauaccuagga

SEQ ID NO: 4169350 - RNA, 77 nt, Human
uccugauaccugggcuucaggccaauuuuguaaugcuuuuaaaucaaagguggucuuacugaugguauaggaaagga

SEQ ID NO: 4169351 - RNA, 107 nt, Human
uccugcaggagguuuaggguccaggucugggggguggccagcacaucacucacaugcauauuuugguggccagaacucagacauguggccccaucuaacuugaggga

SEQ ID NO: 4169352 - RNA, 70 nt, Human
uccugcaggccaagcccucgcagagagggccuggggugagagcaggcaucuccgugcagcuuggccagga

SEQ ID NO: 4169353 - RNA, 103 nt, Human
uccugccagcucuuugguuuccuuugugagccguggcaggcggacgcuguccccagaggccagggggcucacaaauguuauuccagggcugggcucggcagga

SEQ ID NO: 4169354 - RNA, 95 nt, Human
uccugccccaggcagaugucugucaccccaugcugggaucugacacccuugcugggcagcgucccacaugggcacccuccucugcuugagccggg

SEQ ID NO: 4169355 - RNA, 62 nt, Human
uccugccuucugaucuucucuuggcaccuuuacugaaaccauuuagaaguuggagggcaaga

SEQ ID NO: 4169356 - RNA, 77 nt, Human
uccugccuugguaaaacugucuuaaauuuggaauguaagugucugaauugggaagguuguaccagagagcagcagga

SEQ ID NO: 4169357 - RNA, 98 nt, Human
uccugcugaguaucucugcuaagcaugaacaauuaagaaacaaagccauuagucguaauugaagaauucauguuuauauguagcaguuuuucacaggg

SEQ ID NO: 4169358 - RNA, 84 nt, Human
uccugcuuaaucauuaggcauucugaaugagguccucugauaacugacaagaucgauucagugugccuaccccagaaguaguga

SEQ ID NO: 4169359 - RNA, 87 nt, Human
uccuggagaaggucgcagcagcgggacccagccucccuuccugaaucugaggguggaagagcugggaccgucuggaaguuccuggga

SEQ ID NO: 4169360 - RNA, 60 nt, Human
uccuggagccaugauuccccucuuagcaucuagccuggagaggauuuaaguuuaaaagga

SEQ ID NO: 4169361 - RNA, 55 nt, Human
uccuggauaaaugcuuuaguuggaagucacuuucccuacuuuauuugucccaggg

SEQ ID NO: 4169362 - RNA, 58 nt, Human
uccuggccacacauuaauagugcauagggaguguuuaauauaaauucuuggcucagga

SEQ ID NO: 4169363 - RNA, 64 nt, Human
uccuggcccuguggccugcaguuugaguuucccucgaccagcugugggaccgggggagccggga

SEQ ID NO: 4169364 - RNA, 122 nt, Human
uccuggcucccuggcagaucaacagcuccccucucuucgcagcuccuauucacacucuggcuuuauggggaaugaaagggaaccugcuggacuggaagcugguucugcugaggggaguagga

SEQ ID NO: 4169365 - RNA, 61 nt, Human
uccuggcugaguucccaagucgugaucaucgcuuagugucugacuugagacucuguuaggg

SEQ ID NO: 4169366 - RNA, 56 nt, Human
uccuggcuuccacaccugucauuucucauuuacugugcgggcgggccgggccagga

SEQ ID NO: 4169367 - RNA, 63 nt, Human
uccuggcuucugucuccuuauuagacccugcccaauguaauagggaagcacaggggcuuugga

SEQ ID NO: 4169368 - RNA, 56 nt, Human
uccuggcuuuucuuggcucaucauguaccaacugacuguaaucagauuggccagga

SEQ ID NO: 4169369 - RNA, 95 nt, Human
uccugggacucucuucaugcugggcucuucucacccuguuucagagaagacuugcggggagaaggggucagagaggugaguccaccugcccagga

SEQ ID NO: 4169370 - RNA, 58 nt, Human
uccugggaggcugugccuggcuucccaacugagagggcccggcacagccccgcggaga

SEQ ID NO: 4169371 - RNA, 113 nt, Human
uccugggauguuccucccccuggaauuguuuugcugaguuaggaggagaggggaauucugcuuugaaaccugcucugcagaagccaguuuuucagguuugaggguccccaggg

SEQ ID NO: 4169372 - RNA, 80 nt, Human
uccugggcucaagcgaugcuccugccucagccucccaggaggcugggaggcugaggcaggaggaucacuugagcuuggga

SEQ ID NO: 4169373 - RNA, 85 nt, Human
uccugggcuuuacagcacaugggaucuguuuacauguggucuccgcagacucgugucaagauccuaagucagugaaucccgaggg

SEQ ID NO: 4169374 - RNA, 63 nt, Human
uccuggggaaagccagcccugcuuccucucccaggugggggcucugggccuggcugcgcagga

SEQ ID NO: 4169375 - RNA, 56 nt, Human
uccuggggccccaggggcuaagucugccuuagcauacugcaucugaagucccagga

SEQ ID NO: 4169376 - RNA, 61 nt, Human
uccuggguccauggcagccgaaggaccaacaacuucaucaucgcuguuaaggacccucgga

SEQ ID NO: 4169377 - RNA, 60 nt, Human
uccuggucagcuuugagguugucuguaucagugaaggaauuccucuaagcccaccaagga

SEQ ID NO: 4169378 - RNA, 68 nt, Human
uccugguggcuuucccugccuuuuccuaggauacucagccuggucugagucaaaggaagcugccagga

SEQ ID NO: 4169379 - RNA, 55 nt, Human
uccugguggugccagcugcaggcugugugcuugggcagcuggcacuacccuugga

SEQ ID NO: 4169380 - RNA, 58 nt, Human
uccugguguuuaugucacauagcauccugaauggaaucugugggaccaagcacuggga

SEQ ID NO: 4169381 - RNA, 67 nt, Human
uccuguccccugguguuuguuguaugugucugugguauggcucagcagauggugucaugggauggga

SEQ ID NO: 4169382 - RNA, 127 nt, Human
uccugucucuuaguuccuuuuuccugaacucuuccuccagaguuguggguguuucucuuccaauaagaaaagaaaccuaucagccacauggaauucuaagggggagaguauuuaaugagagacagga

SEQ ID NO: 4169383 - RNA, 80 nt, Human
uccugucuggcuuuggcagccucagcugcagggcacaaacaacuagggcugcugggcuggagcugccagggccaggagga

SEQ ID NO: 4169384 - RNA, 81 nt, Human
uccugugcaccaggcccaccgcaugcuccugugccauccccgcucugccaggugcugugcauugggccaacaggcacgggg

SEQ ID NO: 4169385 - RNA, 64 nt, Human
uccugugccucaguuuaccccucuuguauaauagagagagcuuggagagacugaggacacagga

SEQ ID NO: 4169386 - RNA, 76 nt, Human
uccugugcuggugaaacccacagagacccucacgcugaccugcacucucucuggguucucacucagcacuucugga

SEQ ID NO: 4169387 - RNA, 70 nt, Human
uccuguggucccuuggcucacaaacagcuccucagagcugcacugugaaguucauaggggcucaacagga

SEQ ID NO: 4169388 - RNA, 67 nt, Human
uccugugguucccugagaaugcauuccuagaagaauggggcauccuccauauaggugaauagcagga

SEQ ID NO: 4169389 - RNA, 69 nt, Human
uccugugucagcaagacaucagagugacuuauuuaaaugauuaguuuguaaugugcuucuguuuuagga

SEQ ID NO: 4169390 - RNA, 56 nt, Human
uccugugucucagcgugaagcaucacgagaugcacgagaugcuccugggacaagga

SEQ ID NO: 4169391 - RNA, 76 nt, Human
uccuguguucugcucacaaaccagccugacaaccagacuuaucugccagaguuugcaagggcagaagcccgcaggg

SEQ ID NO: 4169392 - RNA, 75 nt, Human
uccuguuaacacaauguuucuuguaaccagugaguugugccaaaacucacuguaaaguaauacugucaggugggg

SEQ ID NO: 4169393 - RNA, 83 nt, Human
uccuguuccucagugcuucuagcuugaugaggucauuacugugcuuccauacaagccaggaucaccauucuuugugaacugga

SEQ ID NO: 4169394 - RNA, 104 nt, Human
uccuguuuacucugugaaaauuauuuguuuacauaugucugucugcaccuguauuaggaguugaagacuaguaaauuauguuauucaguuuacaggguauagga

SEQ ID NO: 4169395 - RNA, 65 nt, Human
uccuguuucaacccuuacacugaauacuuaauaccaccaccaucagggcuggguuaaaagcaggg

SEQ ID NO: 4169396 - RNA, 64 nt, Human
uccuguuugaauuuugcuaacgugugagguggaauuuuaauuauacugaguuugguucaaggga

SEQ ID NO: 4169397 - RNA, 65 nt, Human
uccuuacagugcagugugaugaguauucuaauggagggauguacuaggcuugcugcaguggagga

SEQ ID NO: 4169398 - RNA, 56 nt, Human
uccuuacaguuaaaaugggagugaugcuagcugucauguaucccauggugugagga

SEQ ID NO: 4169399 - RNA, 67 nt, Human
uccuuacaugcuuccuuauacauauuugcuaguguuucccuaagcuagcuauauggaagugguagga

SEQ ID NO: 4169400 - RNA, 65 nt, Human
uccuuagcaacugucauagagcaugacacauuauaaccauguuuuuaaaaaaguuuguugaguga

SEQ ID NO: 4169401 - RNA, 80 nt, Human
uccuuauggaacugucauaauuuuuuuaagucagaacaagcucuggcuuguuuugagaaacuuaagauauuuccuuugga

SEQ ID NO: 4169402 - RNA, 81 nt, Human
uccuuauuuauuuguguuuuuuaaacauacucauacuucccucuauuguuugugucauagagagcacaaaucagauuugga

SEQ ID NO: 4169403 - RNA, 94 nt, Human
uccuucaccgcucugucucuggcagcagcugguaccuuaugcugaggaaggauugggaaugaggcugccaagggcaagaaaaaugggagaaggg

SEQ ID NO: 4169404 - RNA, 95 nt, Human
uccuucacuugcaaagaauuuuacauucuaaccaaagauuccugagaaauaaaucuguaaauguagaaauguaggcuuccugacagguaagagga

SEQ ID NO: 4169405 - RNA, 81 nt, Human
ugaguuucuguucuguuuauaauuugcaguuguccagaauggauuaacgcaucuggaaacaggacagguuucuguaauuca

SEQ ID NO: 4169406 - RNA, 66 nt, Human
ugaguuucuugauagagugcuuucagaguuuugaguaaccugaaacaucuucuguaaauaggcuua

SEQ ID NO: 4169407 - RNA, 68 nt, Human
ugaguuugaggcuggauugaagaaagggcugauggaguuggcuuauugaguuuacagcuuuagaaaca

SEQ ID NO: 4169408 - RNA, 84 nt, Human
ugaguuuggaaaauuaucaucugaagauugcuguucaacuuuuggagagugauauucagaugcuuugaagacuuccaauauuca

SEQ ID NO: 4169409 - RNA, 62 nt, Human
ugaguuuugauguccuguaaugagguuguuugcagaauauauuacuagauugucaagauuua

SEQ ID NO: 4169410 - RNA, 73 nt, Human
ugauaaaacagucaaaggccuaagcuauugucaaaaacaguauaaugccacuagcuuuugaguguguauguca

SEQ ID NO: 4169411 - RNA, 109 nt, Human
ugauaaacaguuuuaaccucgaugcucauuuuggcauuguuuuguucuaaacacauguguuacaaagauaguguuagaguaaauuaguugagggaaaagcuuccuauca

SEQ ID NO: 4169412 - RNA, 102 nt, Human
ugauaaauaaagcuuuuauuuauagaaagacuaacuagaaagugcacucuuaagugcagcucaaugguuggcuuuaauagaaguagauauuuuauauuauua

SEQ ID NO: 4169413 - RNA, 68 nt, Human
ugauaacugcauucagaaagcucacucauaagaaaggaugaugaauaguuaugcugagucagugguua

SEQ ID NO: 4169414 - RNA, 98 nt, Human
ugauaagguacuauaguuuugcaagauguuaccauuguuacucaggaaauugagugaaagguguccaauauuucucuguacuacuucguauaacugca

SEQ ID NO: 4169415 - RNA, 75 nt, Human
ugauaaguauacauucugagaaaugcauugucaggcaauauuguccuugucugaacaucauagaguguacuuaca

SEQ ID NO: 4169416 - RNA, 58 nt, Human
ugauaauaucugguuuauucacccucuucugcagggaaugaagaaauagaugguguca

SEQ ID NO: 4169417 - RNA, 68 nt, Human
ugauaaugugaaugguuugugacuaccuaauggaauucauagguagucacaaaccauucauaugauca

SEQ ID NO: 4169418 - RNA, 129 nt, Human
ugauaaugugucguagcugucugggagcagagcuccgggaacgcauggggcacauacgaaagccaggcugucugugccucacccugcucuuggcggcucuggggccagggcucugaaucacauuacugg

SEQ ID NO: 4169419 - RNA, 61 nt, Human
ugauacaaguuuauccaucauuguuggaguucaccagcaauguaaacccugaaguugauca

SEQ ID NO: 4169420 - RNA, 85 nt, Human
ugauacaauaagucagaaauaucugccaucaccaauugaauaugaaagugcaugaugcauguguuucaugaaauucacuguguca

SEQ ID NO: 4169421 - RNA, 84 nt, Human
ugauacagauggaacaugcugccuuucuacgaguaguugcucaugcuuauuagcaagguauuauguaaguaucaacuguuguua

SEQ ID NO: 4169422 - RNA, 57 nt, Human
ugauacgcugucucaauguggguuacucaaaguaugcccaucuucuagcagcuguua

SEQ ID NO: 4169423 - RNA, 78 nt, Human
ugauacuugguuuuaagacucuuguaguacacacucaguugugguacucaaaguguggucuugcaacuagcaguauca

SEQ ID NO: 4169424 - RNA, 87 nt, Human
ugauagcuauggggaauauaggaccucugggaacagaaaauuaauuugucucauuauuuucuauaucucacuauucccuaagcugca

SEQ ID NO: 4169425 - RNA, 75 nt, Human
ugauaggcuuaauuuuccugucaaauguggacuucccuuguaaacaugucaauugaggaaaguucaagcuuguca

SEQ ID NO: 4169426 - RNA, 62 nt, Human
ugauaguaauuuuuacacucucaguuccauucauaauuacugagaaccaugaaaagcuguca

SEQ ID NO: 4169427 - RNA, 70 nt, Human
ugauagugacuuauuguuuagaacuuuuuaagaucaacuuuuaagaucaagauaagcaauaaggugguca

SEQ ID NO: 4169428 - RNA, 78 nt, Human
ugauaugaaagcauggccccaaaucccaugcauagccauccacuccacuguguaggguggagccaugugaacagauca

SEQ ID NO: 4169429 - RNA, 56 nt, Human
ugauaugaagauguguuggagauucuucccggcuucucagugacacucuucauaca

SEQ ID NO: 4169430 - RNA, 87 nt, Human
ugauaugagugauuuguuggcuaauauaaccagaaguuccagaggaugaauggauuauauuuggcucaguuuagcagcucaguauua

SEQ ID NO: 4169431 - RNA, 79 nt, Human
ugauauguacauauuuugugugugcucacauagauguguggcugcguggauauuuguguggguaucuauauacguauca

SEQ ID NO: 4169432 - RNA, 95 nt, Human
ugauauuuugugaauaguuuuaucacggggcauaguuuuaucaaccaggcuggaggcuagugaacuguggcccgugaacuggauacagauuguug

SEQ ID NO: 4169433 - RNA, 56 nt, Human
ugaucaaagccaaaguugagaucucagcaguaugaacaucggcucuggcuuuggca

SEQ ID NO: 4169434 - RNA, 69 nt, Human
ugaucaaagcuaugcuuuaguaauauucucagaaaauacuuaguugauguucuggagguagaaggauca

SEQ ID NO: 4169435 - RNA, 76 nt, Human
ugaucacauuguucacuagcuugcagacucaaugacagugcaaagcaaguuacauaaucugugaauuuuguuguca

SEQ ID NO: 4169436 - RNA, 65 nt, Human
ugaucaguauguugacuuauucuuggagcaauuuuggcucuuuauaagauauuaacuacugccca

SEQ ID NO: 4169437 - RNA, 83 nt, Human
ugauccaagggcaggaguuugccaaaguaaugcacucgaguauuuguccuacugcccagcaaacauccacugcccuuguaucg

SEQ ID NO: 4169438 - RNA, 68 nt, Human
ugaucccaggugcacaagagagaugaugacucagucugacaacauuuccauuuccuugguaaggauca

SEQ ID NO: 4169439 - RNA, 128 nt, Human
ugauccuaacuggagcauauuuuccuugaauuuaaagucaacuuauacgaccuucaugcuggacuacacagugaguaucacaggcuauguggguuuuguuucugauuuuucaagcucuaaguaguuca

SEQ ID NO: 4169440 - RNA, 62 nt, Human
ugaucucaagcucuugggcucaagcgacccacccgauugggccucucaaagugcugggauua

SEQ ID NO: 4169441 - RNA, 80 nt, Human
ugaucucuagaaagauauagauaaaacuaugcaagcuguuaaaaauucagccugauacagaauugauaucugagagauua

SEQ ID NO: 4169442 - RNA, 101 nt, Human
ugaggcaggagagucguuugaacccaugagguggagguugcagugagccaagauugugccacugcacuccagcuugggugacagagugagacuccgucuca

SEQ ID NO: 4169443 - RNA, 73 nt, Human
ugaggcaggaggaucacuugagcccaggaguucaagaccagccugggcaacauagugagaccuugugucuaca

SEQ ID NO: 4169444 - RNA, 101 nt, Human
ugaggcagggggaucccuugagcccagaaggucgaggcugcagugagcugugaucaugucacugcacuccugccuggguaacagauugagacccugccuca

SEQ ID NO: 4169445 - RNA, 106 nt, Human
ugaggccaagucggcugaacucuaaugggccuggccucucuguccaugccugaccccagagugcaggcaaaagggccaggccacuguuggaaaggccguggcuuca

SEQ ID NO: 4169446 - RNA, 56 nt, Human
ugaggccaggaucccaggcucucauucuuccccugagucugguguccucggguuca

SEQ ID NO: 4169447 - RNA, 71 nt, Human
ugaggccaggcaaaggcgaucucggccagaggccacuuccugccucuacucagaccuuuccuaaggcuuca

SEQ ID NO: 4169448 - RNA, 66 nt, Human
ugaggcccaucugagauuuugauaguuguagcaguuauuuugucauauucaaaaacucggcucuca

SEQ ID NO: 4169449 - RNA, 55 nt, Human
ugaggccucgucauugacugagguucuggcuuuuacaguuaaugacuaggcauca

SEQ ID NO: 4169450 - RNA, 89 nt, Human
ugaggcucaauggcaugaggugauaaagcugggauuuauauucauaacaucagucauccuauaguguccuagcccugccauugaccuca

SEQ ID NO: 4169451 - RNA, 59 nt, Human
ugaggcucagaaauguaaguuuguaacacuaaguuauuaauuaggucucugugccuaca

SEQ ID NO: 4169452 - RNA, 101 nt, Human
ugaggcuggagaauugcuugaacccgggaggcagagguugcagugagccgagaucgcgccacuguacuccagccucggugacagagcaagacuccgucucg

SEQ ID NO: 4169453 - RNA, 89 nt, Human
ugaggcuggguagaugaaguaugcuaauuaacuagcacuggggacaugugcugauuuccauggcaugaauuucagcuaccaacaauuua

SEQ ID NO: 4169454 - RNA, 68 nt, Human
ugagggacccaggcccaaggcugccagguaguaagggcagccugugcaguggggcucuggguucucca

SEQ ID NO: 4169455 - RNA, 61 nt, Human
ugagggacugguccaggaucucacagcuagcagagcugggacucagaccaguucugucuca

SEQ ID NO: 4169456 - RNA, 57 nt, Human
ugagggagcacacacugaagugcugauccacugcaccauuuguuguugcuuccuuca

SEQ ID NO: 4169457 - RNA, 86 nt, Human
ugagggaggccuccugcacagagcuggacuccgcggggccacuuccugcaaaggcaagcgcugugcagaugaggacccucuccuca

SEQ ID NO: 4169458 - RNA, 71 nt, Human
ugagggaggggccuggacuccgggcucugagccuacuggggcacaggccugugaguugaggccccuucuca

SEQ ID NO: 4169459 - RNA, 76 nt, Human
ugagggauuucuaaggaggcugaacuugacagguggaacuguggaguucugccaacuuuuagaaaagauucuauca

SEQ ID NO: 4169460 - RNA, 66 nt, Human
ugagggcaccugggauuaauggcaaaggcaauccucagagcaccucucuccagaucccaguccuua

SEQ ID NO: 4169461 - RNA, 65 nt, Human
ugaggggagguuggggcacaucuugcaccugcucguuuugauuuggccuccacacucaccccuua

SEQ ID NO: 4169462 - RNA, 60 nt, Human
ugaggggcuggguggguuccaccugaggaggcgccacgacucugcccaccccggcuccca

SEQ ID NO: 4169463 - RNA, 62 nt, Human
ugaggguauauauuguguggagugaucaaauguaaccucucaaauacuggguuaugcccuca

SEQ ID NO: 4169464 - RNA, 58 nt, Human
ugagguaaaaaagagguuaaguaacuugccuaagguuauauaacuacuauuuugcuca

SEQ ID NO: 4169465 - RNA, 85 nt, Human
ugagguaacaccacuuuauguccaccagacugcaaaaaaguaaaaaggagcuauugcggguggggauguagcaaagugucucuca

SEQ ID NO: 4169466 - RNA, 69 nt, Human
ugagguaauaguuccauugccgaaauuccuuuauguuucaauaauuuuggucauugcuauuguuucuca

SEQ ID NO: 4169467 - RNA, 61 nt, Human
ugagguaggugucgagagagguugggucugccagguucaaauuuucuuggcacuuaaauua

SEQ ID NO: 4169468 - RNA, 71 nt, Human
uccuucagcugcaaguccaaaggaauuagcuagcaaggcugaccuuccuaagaggcuggcagagaggagga

SEQ ID NO: 4169469 - RNA, 66 nt, Human
uccuucagugucccgcucaggugcagccuccucccuaaagcucaucucagcuuuugaucugaauga

SEQ ID NO: 4169470 - RNA, 58 nt, Human
uccuucauucauuaauuuagcccuggacccagggcugacuccuauuggaugaacugga

SEQ ID NO: 4169471 - RNA, 77 nt, Human
uccuuccauguuguuaugugaacugaaauuuggaaugaagaaugcaaauguguagguuuacauauucccaggaagga

SEQ ID NO: 4169472 - RNA, 81 nt, Human
uccuucccacccgcacacccgucuucauuuauagucuuucauccuuuauacaugacaccucuggcugggugccuggaaggg

SEQ ID NO: 4169473 - RNA, 119 nt, Human
uccuuccgaguugggcccugggccacuucuccuaggagccccuuccucuggguccacacugggugcuagcgagguguuucuaggacuguuuccccagcaggcucucagcucuuucggga

SEQ ID NO: 4169474 - RNA, 62 nt, Human
uccuuccuagugucuacuuuggaggcuggcugggggcucacagaaauggcacugggguagga

SEQ ID NO: 4169475 - RNA, 69 nt, Human
uccuuccucuuggccucguaugucucuuguaggcuguggagacccagagaaaagaggccaaggauggga

SEQ ID NO: 4169476 - RNA, 58 nt, Human
uccuuccugcauugugccagaguuggucaaugugaccaacaggauauaguagaaggga

SEQ ID NO: 4169477 - RNA, 59 nt, Human
uccuucuauaugacuucuaggcaggucauagaaccucuguaagccuuagucuagaugga

SEQ ID NO: 4169478 - RNA, 78 nt, Human
uccuucuauuuugagaacuuugguauuuuccuuuuugagugaaaaauacuauggauucuggauuaaaauagcacagga

SEQ ID NO: 4169479 - RNA, 130 nt, Human
uccuucucccugucucugugaaguccucugcacaauggccaccagcagcugacaaagaugaacaaugccugcaugcuucaucuagugugcucguaacggaugcaagaggaauagaggaaggggcugagga

SEQ ID NO: 4169480 - RNA, 58 nt, Human
uccuucucugguuuuuacuguaauccacaguagacagacagaacacagcccagaggga

SEQ ID NO: 4169481 - RNA, 129 nt, Human
uccuucugauagcauguuuuagauacuuauuccuagcacugcuuuuucuccucacuggucugccugucacucuuugagagcuagaagcaauaggacuaggaaguggccacagagcuuccuauggaaaaa

SEQ ID NO: 4169482 - RNA, 63 nt, Human
uccuucuuucaccucauagucaguuuggccuuaaaacucuuccuuagugaugugauagaugga

SEQ ID NO: 4169483 - RNA, 93 nt, Human
uccuugaaggacagaaaccaugccuuacuucguuuguuuguccccagagcagcugguacaggaacgaauguacauuguuuccuucucuaagga

SEQ ID NO: 4169484 - RNA, 58 nt, Human
uccuugauugaauauucccuugggccugccaguccaggcuccuguuauuuaaugagga

SEQ ID NO: 4169485 - RNA, 64 nt, Human
uccuugcugcaccuguccugugugaugcuguuacugcaugcaaagcaaucaggaguagcaugga

SEQ ID NO: 4169486 - RNA, 57 nt, Human
uccuugcugugaauucugucaguucuauggagaaagugcagagccucacugcaaggg

SEQ ID NO: 4169487 - RNA, 63 nt, Human
uccuugcuguuauccauauuaucuuuagccaggcaugguauuaggcacaugguaauauaagga

SEQ ID NO: 4169488 - RNA, 58 nt, Human
uccuugcuuaaaaagaaaugaaguacuggccaggaccucagagucucaggagcaaggg

SEQ ID NO: 4169489 - RNA, 74 nt, Human
uccuuggaauguucugagugcagcuuaauaaacuuaaaaaguaauuuuaaagcugagcccucagaagcucagga

SEQ ID NO: 4169490 - RNA, 58 nt, Human
uccuugggaaugaggccauuguccgaaaggccaacucuuggccaaguauccaacugga

SEQ ID NO: 4169491 - RNA, 71 nt, Human
uccuugggcugcuguaagcauucauuacgcaugugaaugaccauuguaaacugcugcaggagugccaagga

SEQ ID NO: 4169492 - RNA, 81 nt, Human
uccuuggugaacaguuguaaauucauagcuuauaaaauuauugcaauuauuagguauguauauacagaacaaugcuaagga

SEQ ID NO: 4169493 - RNA, 73 nt, Human
uccuuguccucaucagaaaucuaggauucagaaucuucuggguucagucuuagauauuuuguugggaugaaga

SEQ ID NO: 4169494 - RNA, 78 nt, Human
uccuugucucccuggcuucugggucugugagagcaaccugaggcucucauuuuaccaaggucggggacuggauacgga

SEQ ID NO: 4169495 - RNA, 66 nt, Human
uccuuuaacaaauugguugcuucaacauguuaugacugcgauauguuaaauagccauuuguuugga

SEQ ID NO: 4169496 - RNA, 61 nt, Human
uccuuuaucagacuaugaaaugaauauuacugccacauuucauaguuauggagauuaagga

SEQ ID NO: 4169497 - RNA, 120 nt, Human
uccuuuaugauaugugucuuugaaaggcaaggaguggcaguaagcagagugauauaaacauggggccugggcuuuaauucugucugcccucauccuuuaugaggcgcaugauuuagaggg

SEQ ID NO: 4169498 - RNA, 66 nt, Human
uccuuucaaaguucugagaagcaguuuacucuuucacacuagagauugcuuaaauagagcugggga

SEQ ID NO: 4169499 - RNA, 78 nt, Human
uccuuuccauuuuuagcaccucucaaggagaaugguuuauggaacuugggagcaggaagcaggaaguaggaaacagga

SEQ ID NO: 4169500 - RNA, 75 nt, Human
uccuuuccuucuggccaugcaaccucuucugcuccauggccaguucagaggacacaugacuccagcaggagggga

SEQ ID NO: 4169501 - RNA, 56 nt, Human
uccuuucuccagcuggcauugucauuuuugugacuuguuaucagaggaagagagga

SEQ ID NO: 4169502 - RNA, 128 nt, Human
uccuuucuccucccugggccucauuccuugacaugugcaugaugguuuagaugggguuaccugagugagucuggcuaaacaacaucaugccucaagaaguugaugcucuaucgagguggagaauagga

SEQ ID NO: 4169503 - RNA, 84 nt, Human
uccuuucuccuguguaagccgcccagcacuggaaaccacaggguaucugaccauggggcuugcagaccuccaggggaccaggga

SEQ ID NO: 4169504 - RNA, 63 nt, Human
uccuuucucugaaggcuguguugaugggugagggcacuggcacagcccauucagagaagaggg

SEQ ID NO: 4169505 - RNA, 100 nt, Human
uccuuucuguugacagugcauagaaaagcucaacucagccaugcagugcuguacacaaugaggaggggcuuuucucucuagcacugauaacagccccgga

SEQ ID NO: 4169506 - RNA, 78 nt, Human
uccuuugcuuucccuacucaccaucuugggucuccugggggauagcaggacccagaaggugcagcagagacagcagga

SEQ ID NO: 4169507 - RNA, 60 nt, Human
uccuuuggccuaauaauccuucucuuaagaguuccacacugguuuuauugaggccaagga

SEQ ID NO: 4169508 - RNA, 78 nt, Human
uccuuugguaacauuccaaccuuccugcagguuucagcgcuuccugucaucuuaagguuuggguguuggcuauguggg

SEQ ID NO: 4169509 - RNA, 108 nt, Human
uccuuuguucgguuucucuaaugcuccuuuuucugccuugggcuguguugcuagcacagcagggcucuguggaggguggcugugaguuagggaaagccugagaagggg

SEQ ID NO: 4169510 - RNA, 101 nt, Human
uccuuuguuuuauuugguccacucuguggaguaguguugagagcaccaaagucauagaggagcucuccuagguaacagggugguuugagugaaagaagcaa

SEQ ID NO: 4169511 - RNA, 56 nt, Human
uccuuuuaucuuuugcuuuguacaucgugcugaugggugaaacaaacuuaaaagga

SEQ ID NO: 4169512 - RNA, 59 nt, Human
uccuuuuccaaaugaacauuugaacuuauggcagagacaaaaguuugacaggaaaggga

SEQ ID NO: 4169513 - RNA, 70 nt, Human
ucgaaacuguggaacgucaguugucacaugugacaaccuucacaugugaaggacuuguuccauugugaga

SEQ ID NO: 4169514 - RNA, 83 nt, Human
ucgaaagccuggagccaggaccuugcccagcacaucaagugacaucacccugaggcucaaggucugguggaggugcauuucgg

SEQ ID NO: 4169515 - RNA, 62 nt, Human
ucgacgucauuuuuuaaaugcaguaauuguuugauuaguugcaguguuuaacaaugacuuga

SEQ ID NO: 4169516 - RNA, 67 nt, Human
ucgagccugggcugcggugguagguuguagauucuucaacaggggcuguugcggugcuaggagguga

SEQ ID NO: 4169517 - RNA, 73 nt, Human
ucgaggggagagcagggaggcugcucuguugcccaugggccucaggaagccaggccuuccugccgccgcugga

SEQ ID NO: 4169518 - RNA, 85 nt, Human
ucgauccucccucuaaggucuugacaguuagagaaccuaaaagucauuacaaauuuucuaaggagccaggacuauuagagauuga

SEQ ID NO: 4169519 - RNA, 93 nt, Human
ucgaugcagauuuauuuagaaagggaggcuuauauucaauuuuucauaaguacugauaugagaucccuuuuccuagagacuucucugaaugga

SEQ ID NO: 4169520 - RNA, 58 nt, Human
ucgauuccaucuguguuguuuauuuugagcuggauuuacugcacacuaugugaauuga

SEQ ID NO: 4169521 - RNA, 129 nt, Human
ucgauuugggagcugagaggagagggggaugagagcgggugugcgucucgcucggauuuauuaaacacaaugccuucaagaugccagggacgcggcgccucgccgggccucccucucagucucccucug

SEQ ID NO: 4169522 - RNA, 78 nt, Human
ucgcaccugcccggagccaggcgggucuuugcuccuucccgcgaaagggguuagccuugccugcgccccaggaagcga

SEQ ID NO: 4169523 - RNA, 56 nt, Human
ucgcagcacuagcccugcauugcuaaugcacagagcuguugggacuauugcugggg

SEQ ID NO: 4169524 - RNA, 102 nt, Human
ucgcaguucuccaugaaagaguaggaucucaccauggccauacucugauaucugacucaucugaauugcuugcugagauuaaagcuugaaauggagagucga

SEQ ID NO: 4169525 - RNA, 128 nt, Human
ucgccacagcgcgaccaggccagcgaugagggacuggcauccggaggcuucacccuccgcuccacagggucggcagcagagcggggccuccggaagcuccgccccacgcguucccggggcgcaugcga

SEQ ID NO: 4169526 - RNA, 87 nt, Human
ucgccagccgcagcugggccaaggccgagagcaugcaccaccaggucgaguaugaggugcugcaggccuuggcugggaaggcugaga

SEQ ID NO: 4169527 - RNA, 75 nt, Human
ucgccggaacucgcuuucaggugggucuacaauuaguugggaaacaacggguugcaaggcugaccuggucuggga

SEQ ID NO: 4169528 - RNA, 83 nt, Human
ucgccuaggcuguagguacccucuccccucuuuccuuuuacuuuauagaggucuauagaaggguagggacuuauccaagguga

SEQ ID NO: 4169529 - RNA, 89 nt, Human
ucgccugggaacuuguuagaaaugcagaaucccaggacaggccagcccuccugaaugacaaucugcauuuuaacaagauccccagguga

SEQ ID NO: 4169530 - RNA, 57 nt, Human
ucgccuuacucaucacagacuaaguuuggaaacaagauguuuccuuggguguaggga

SEQ ID NO: 4169531 - RNA, 64 nt, Human
ucgcgcagccagggcuguuagcugcugcucuuaugauugaggccagcugccacccgguccguga

SEQ ID NO: 4169532 - RNA, 59 nt, Human
ucgcggauaagcagugaacggucuaugaauggugagggcaauaacgagcuugucucuga

SEQ ID NO: 4169533 - RNA, 70 nt, Human
ucgcggcugggcuggccgccgagaucgccugacggcaggccgagaacggcugggcgggcccaggccggga

SEQ ID NO: 4169534 - RNA, 66 nt, Human
ucgcgggcucugaccagucuccgggcugcagcugucucccagcagccuccaggagcagagcccuga

SEQ ID NO: 4169535 - RNA, 62 nt, Human
ucgcgguggcucaugccuguaaucccagcacuuugggaggccaagacaggcagaucaccuga

SEQ ID NO: 4169536 - RNA, 60 nt, Human
ugauuagaagcgugaauccuuucaaaugugugugucacugaaauggaauguaucuaauca

SEQ ID NO: 4169537 - RNA, 83 nt, Human
ugauuagccuagguccuucgccacauauugguacauucaccccaggaguggaagucccuguguguggccuucugaacugguca

SEQ ID NO: 4169538 - RNA, 71 nt, Human
ugauuaguuaucuucuucuguggccgcuauucccuuaacaucaauggcaccuucaagaagaaaauaaauca

SEQ ID NO: 4169539 - RNA, 64 nt, Human
ugauuauaccucaguaggaaguacagacuauaaaguuuaauaacuuauucugagauuaugauca

SEQ ID NO: 4169540 - RNA, 75 nt, Human
ugauuauaguggacaguaaccucuccucugaagggagacauuaacucucucuuccaagguugcacacuaucauua

SEQ ID NO: 4169541 - RNA, 124 nt, Human
ugauuauaugauuggacugcuaacuccauuggacauucuguaacucacucagccacucaucccccauagaggugagaggaacaggcaguagguuuuauuagucauguuacagucauaguaaaca

SEQ ID NO: 4169542 - RNA, 80 nt, Human
ugauuauccauucagguuaaaucaggcaucauuucagucaccuccagguauuaauguguaugauauaaauuggaaaguca

SEQ ID NO: 4169543 - RNA, 66 nt, Human
ugauuaugugagguucagcuuuaucucuugaaaaacaagugugauaaucuccaucucauauguuca

SEQ ID NO: 4169544 - RNA, 124 nt, Human
ugauuauuauggcaucacuuagguuacuagaauaagauugagucagggacuuccaaaguguuaggauucacuuugaaguccaucuggcccagugguuaccagucaugacuacauaucagaauca

SEQ ID NO: 4169545 - RNA, 76 nt, Human
ugauucagagucguuacggugggacccaaaagucuacauccagguggcccugaggacccagugugggaaugaguca

SEQ ID NO: 4169546 - RNA, 93 nt, Human
ugauuccaaugagaugcugaaaacucaaccauugugacaauuuuuccucuguauaauggacaggauuucagcuuauuuguccuauugccuuua

SEQ ID NO: 4169547 - RNA, 68 nt, Human
ugauucucacugaaaauaauuuugucccauagaggaggguacuaaaaaaugaucaguuuggggaguca

SEQ ID NO: 4169548 - RNA, 70 nt, Human
ugauucucauccaguaccauggaaggcaccucaggaaaccuccugcccgcauggugguggugacuuauca

SEQ ID NO: 4169549 - RNA, 130 nt, Human
ugauucugaguccccuccgccuuuuugcccugaguagugccaguggcugguguguugcccuuggcacccacugggggcaccaccaccaucggcaccuccuugggagcaguuuccaagauggcagccuucg

SEQ ID NO: 4169550 - RNA, 121 nt, Human
ugauucuggagagucuaaagugggauuucaagcagagauauuucaagauacgucucuuggaaaucuugauguuuuuccuugacuucucucuuuccuucaggcucuuacauccaauaaauca

SEQ ID NO: 4169551 - RNA, 73 nt, Human
ugauucuguguuagccuuguagagcaccuucccagaaggaagaacaggggcuucuauucuggcacaagaauca

SEQ ID NO: 4169552 - RNA, 95 nt, Human
ugauugaaacagggccaacuagagucuuccugugggauuuuucaaugccauccugacaggcguuuuucucuaguaugguauugcuguaaggauca

SEQ ID NO: 4169553 - RNA, 55 nt, Human
ugauugaagaggugaggaaguuucucccuuagcuuuaauccccucugucuaguca

SEQ ID NO: 4169554 - RNA, 57 nt, Human
ugauugaggggaugugcuguggcauuucugcaggcuuuacauguuucccuuuaagca

SEQ ID NO: 4169555 - RNA, 62 nt, Human
ugauugcgucugugucaccuucaggguuccucuucccuguucuugaaggacagugcacauca

SEQ ID NO: 4169556 - RNA, 66 nt, Human
ugauugcugcaguuuuguaagggauaaauuacuauuuauauacuugauuuaacugagcauauauca

SEQ ID NO: 4169557 - RNA, 129 nt, Human
ugauugcuucaaacucugcuuaauaugggaagaagcagacaggaucugccuaaauuacauccaggcugucuccugguaggcucccagaucguuugcuguuauccuaaaaaggagaggcacagguaguca

SEQ ID NO: 4169558 - RNA, 76 nt, Human
ugauuucaauaguauguuuuucugugacauccuuauggaucacaaagucacaauggcauaguauaaaauggaauca

SEQ ID NO: 4169559 - RNA, 126 nt, Human
ugauuuccagcagccaagacagugacugauuaucaaaugcacugaacacauguuguuacauaaaggaauaauuaugcuauagagauggguuuaguuauaaggugauacaguuaagcugggaaauca

SEQ ID NO: 4169560 - RNA, 56 nt, Human
ugauuuccuggcuuuggaguucacagaccguaagaaacaaucaaaguuggaaauca

SEQ ID NO: 4169561 - RNA, 75 nt, Human
ugauuuccugggcacagcguugggcucuugcaguaggccccugcacagagggcccuggcuggcuccagcuccuca

SEQ ID NO: 4169562 - RNA, 64 nt, Human
ugauuucggacuuuagcccuucggaacuuaaauaaacuucuguaagcuaccaaguuugugguca

SEQ ID NO: 4169563 - RNA, 113 nt, Human
ugauuugaaauucccuaaauugcaggugugcugaauuacgugacugcccaaaggcacccaggcauuuauguguucagaugcacccucaccuucuauuaggacaguuucauuca

SEQ ID NO: 4169564 - RNA, 100 nt, Human
ugauuuggcuuuauauaaagacuuuuaaacaguguuucauguggggcugugcucaugcggccccaaacaucugaucuguuuggugaagucagucaaguca

SEQ ID NO: 4169565 - RNA, 55 nt, Human
ugauuugguuuccaugucuagaggccagaugccuacugggaggucuuccaaauca

SEQ ID NO: 4169566 - RNA, 72 nt, Human
ugauuuguuuuaacuuccagcuccccuuucuuaguauucagacgggaguccaugcagcuugagacagguaca

SEQ ID NO: 4169567 - RNA, 130 nt, Human
ugauuuuaacucguuuauuucagagcucuuugccucaccuuuauuuuuagauuuagucguguuugcugaaauaucaguugcuucuucugugaaugaagugugggaacuugcucucgucgcaguuaaugaa

SEQ ID NO: 4169568 - RNA, 101 nt, Human
ugauuuuauuagugaaagaugaaguuggugcucauuucuaggcuaacugaguaaguucuggucuaaauauggcucuaaaucauaaauuauuucgauaauca

SEQ ID NO: 4169569 - RNA, 129 nt, Human
ugauuuugcccaacuguaggccaauguaaauguuguaaguacaucuaagguaugucaggcuaagcuauagacguuugguagguuagauguauuaagugcauuuucaacuugugaauuauaguggguuua

SEQ ID NO: 4169570 - RNA, 61 nt, Human
ugauuuugucauguuucugauaaguccuccucucaggaauguaagaaauauuauaaaauca

SEQ ID NO: 4169571 - RNA, 74 nt, Human
ugauuuugucugaacgaaguagguccacuggcacuauuuggccuguggcccuuuguuuugauaccucuaaauua

SEQ ID NO: 4169572 - RNA, 70 nt, Human
ugcaaaaacugaggagagaucacguggugucuauuauaagaaaguuuaggugacucacuucaaacuugua

SEQ ID NO: 4169573 - RNA, 67 nt, Human
ugcaaaaaugacaagaguugugaaucugaaugaggggcauaccagaguucuuuacgaccuuucugca

SEQ ID NO: 4169574 - RNA, 64 nt, Human
ugcaaaacuucucagagccuuucauaugcuaaugugcauuacaaagcucuaagagagguaggua

SEQ ID NO: 4169575 - RNA, 62 nt, Human
ugcaaaaguaauugugguuuuugccauuacugucaaugguaaaaacugcaauuacuuuugca

SEQ ID NO: 4169576 - RNA, 62 nt, Human
ugcaaaaguaauugugguuuuugcuguuaaaagcaacaacaaaaaccgcaauuacuuuugca

SEQ ID NO: 4169577 - RNA, 73 nt, Human
ugcaaaauauguggccauucuguuugugucucuuucaaaugugaaauauauacauaaugguauaaguuaagca

SEQ ID NO: 4169578 - RNA, 77 nt, Human
ugcaaacuauacaagauuagggauuugggucucucuuguucacugccuuaucccuaacaucuguauagugacuugca

SEQ ID NO: 4169579 - RNA, 59 nt, Human
ugcaaagcacuggagaugccagaguguuggggaaauauuuuggggaaucuaggcuggca

SEQ ID NO: 4169580 - RNA, 82 nt, Human
ugcaaaguguuuugugugcaucuguguuuaauauguaggguggcauuaaguaaguacaaauguauacauaagcacacaugca

SEQ ID NO: 4169581 - RNA, 58 nt, Human
ugcaaauauuuccuuauagccagagcuugagugugcagggguaaaaggcaguguugca

SEQ ID NO: 4169582 - RNA, 97 nt, Human
ugcaaaucaagcuccccuaguagcuaaucuaauucaucaccugccaugguuaugauuuaggaaacagcuacagguggcuaaagagcauugacuugca

SEQ ID NO: 4169583 - RNA, 72 nt, Human
ugcaaauguauuuuaaagacugccagccuaccuacauuucacaauauaggauuaggucuuuaaaauaaugca

SEQ ID NO: 4169584 - RNA, 58 nt, Human
ugcaaauugcaugauguguaucauuuacaaacauaguucuauacauaugcaauuugca

SEQ ID NO: 4169585 - RNA, 69 nt, Human
ugcaacauacucccuggggcuauuaugaggcuccuggggcuauuaugaggcuuagggaugacaucugcg

SEQ ID NO: 4169586 - RNA, 79 nt, Human
ugcaacccugagaagcaggauggaucuaguguucuccugaccaggaggcaagaucuaaucuuacuucccagagguagca

SEQ ID NO: 4169587 - RNA, 124 nt, Human
ugcaacuaaguguaucaucagagccugagccugaagguacuuuuguuaaguuuuuaaacaagggcuccugcuugcuguuuugacaaagauauauucaugcuuugcucgauuguacauuucugua

SEQ ID NO: 4169588 - RNA, 77 nt, Human
ugcaacuagguuaauccuuuuuguugcuucuuucuuucuuuccggaaaagaacucagagaggauuuuacuguaggua

SEQ ID NO: 4169589 - RNA, 62 nt, Human
ugcaagagaaggugaggaagccgguggagcaggaugaauucucgacuucucauuucucugca

SEQ ID NO: 4169590 - RNA, 59 nt, Human
ugcaagcaaguuuuugaagugggcaugcaugaauucuuucauuucaguaaugguuugca

SEQ ID NO: 4169591 - RNA, 103 nt, Human
ugcaauaguuuucauucugguacaugcaaacauguuuccucuaaggugcaaugccagaaaccuagaggaaaaugugucuugguuuuaucugagaaaacuggca

SEQ ID NO: 4169592 - RNA, 76 nt, Human
ugcaauccaauaaaagguuuugaguacaaauauuuaagagaaaucuuuauauuagaugaggaacuuauugguagua

SEQ ID NO: 4169593 - RNA, 77 nt, Human
ugcaaucuccuuguuguuggagggugccaugcacagggcugggcuccuccagucugcacaucccccaaaguauugca

SEQ ID NO: 4169594 - RNA, 105 nt, Human
ugcaaucugugauuugugggaauuucuugcuuucucuccguucagacaccccaguuugacagauggggcacaaagccacagagcaauccauaacuccaguuugua

SEQ ID NO: 4169595 - RNA, 67 nt, Human
ugcaaugaugcguuuuuauuugugugagcguuccuuuugaauacauugcuagaaauguauuuuugca

SEQ ID NO: 4169596 - RNA, 65 nt, Human
ugcaaugcagagacaauucuaagguagcucacuuuauuggcuaaaagaaugcuuuuugcauugca

SEQ ID NO: 4169597 - RNA, 65 nt, Human
ugcaauucagguuuaagggccaggauggaacuacaaauuggauaucaguaaaccuaaagauugua

SEQ ID NO: 4169598 - RNA, 62 nt, Human
ugcaauuccaaacagugcugcagacuucuccaagcccggagucaguguaaguuuggaaugca

SEQ ID NO: 4169599 - RNA, 85 nt, Human
ugcaauucucacuuguugugauuuaguuuaaucuguuuucuuugguuccaaguauaagccaaaaucaggacacagagaaggggca

SEQ ID NO: 4169600 - RNA, 74 nt, Human
ugcacaaaguucuuagauuaaucacugauugggcuagaaaucagugcacaaaaauaucuaggaaugcuauggca

SEQ ID NO: 4169601 - RNA, 71 nt, Human
ugcacaacguucugccccugggauuggggcuucaggcccuuagauuucagggugcagaugaugacacugua

SEQ ID NO: 4169602 - RNA, 79 nt, Human
ugagaccaagcagccaaaugaagauuuuacuuauagauaaucuguccuaguagacacuguauuugaugcuuuagguuca

SEQ ID NO: 4169603 - RNA, 89 nt, Human
ugagaccauuugcugguuuuagggaaucaaucuauaggugggaaguuuucuuuugcagaaacuaauuuagaacuaagccuuugguguca

SEQ ID NO: 4169604 - RNA, 101 nt, Human
ugagacggagucucacucugucgcccaggcuggagugcagugacgugaccucagcucacugcgaccuccaccucccggguucuagcgauucuccugucuca

SEQ ID NO: 4169605 - RNA, 130 nt, Human
ugagacguggaggggaaggaaagagcugccucaaauguggaaggauuucuucucucccaagaggaucucuguccucacagggcaggaaggaggggccgaccagguuaggcaacuugcccgccagagcucg

SEQ ID NO: 4169606 - RNA, 77 nt, Human
ugagagacaaagcuggaaaaggaggcugggaccuggcugggaaggucugagcccagagaucugagcuauguuuguua

SEQ ID NO: 4169607 - RNA, 70 nt, Human
ugagagacucaggaggaagguuccauguagcaaaugccccuucguccaggcagcccuuccugacucuuca

SEQ ID NO: 4169608 - RNA, 71 nt, Human
ugagagagaaacuuggaguuauucuggauuccuuuccuuaucacauccaaaugauuacuaauuucugucca

SEQ ID NO: 4169609 - RNA, 80 nt, Human
ugagagagaagugggugucaccuugaaguugauuucauucacuuuaggaaucucuaauacucucaaacaacuucucucca

SEQ ID NO: 4169610 - RNA, 77 nt, Human
ugagagagcugcauauucauuaguuaaaaccuggggauuucuucuuagaauaaguugaugauauauguggcaaucca

SEQ ID NO: 4169611 - RNA, 58 nt, Human
ugagagagggaugcacccuccugucuccuguagagaguagagugccccccaucuucca

SEQ ID NO: 4169612 - RNA, 59 nt, Human
ugagagcaagagguauauagucagauagacccaaauuuuaauauaaccucuguuacuca

SEQ ID NO: 4169613 - RNA, 57 nt, Human
ugagagccuaguagguggaaaaacuuggugccaaaggucucccacacugggcuuuua

SEQ ID NO: 4169614 - RNA, 101 nt, Human
ugagagggagucucacucuguagcccaggcuggagugcaguggcgccaucucggcucacugcaagcuccgccucccggguucacgcuguucuccugccuca

SEQ ID NO: 4169615 - RNA, 64 nt, Human
ugagaguaaaggggcuucaucuaaucaguauguuuaaauaugauacucccuuuuaguucucuca

SEQ ID NO: 4169616 - RNA, 61 nt, Human
ugagagugggcugagcuugcuggguguucagccugagcacuaagucaacagccucucuuca

SEQ ID NO: 4169617 - RNA, 101 nt, Human
ugagaguggugguuuuauuuauuuugaacuugccuuuguugugacaccauccauuaaaaugcacaguaaaaagccuuagaauuucagacccguaacucuca

SEQ ID NO: 4169618 - RNA, 75 nt, Human
ugagaguuuguaucacuccaccagcugagccacccagcuuggcagaggcaucagcugagggugagcagaaucuca

SEQ ID NO: 4169619 - RNA, 83 nt, Human
ugagauaacauauguacaguccuuaacuuaaagccuggcaaauaggaguuuaaaaauguuagcugccauuauuguuaucauca

SEQ ID NO: 4169620 - RNA, 115 nt, Human
ugagauaauguucugaagaguauuaaaggugucuauuaacacaagaaaggaaaggagaguguggucccccuccuuuacuuucuggaagugucaacagacaacugucaggacauca

SEQ ID NO: 4169621 - RNA, 66 nt, Human
ugagauacauucugagaaaugcauccuuuggugacuuaauugugcaaacaucauagaguguacuua

SEQ ID NO: 4169622 - RNA, 70 nt, Human
ugagauauguuuguuaucacaacuagguagugcuaguggcauccagugaguagaagacagagauaguaca

SEQ ID NO: 4169623 - RNA, 68 nt, Human
ugagaucacuuacguggcugcaguuauuuaguggcucaacugcaguucaacgauguaaugugaccuca

SEQ ID NO: 4169624 - RNA, 56 nt, Human
ugagauccagagaccuuagaaugcuuggcaagggcaguucuguuaugcuggacuca

SEQ ID NO: 4169625 - RNA, 100 nt, Human
ugagauggagucucgcucugucacuaggcuggagugcaguggcaugaucucggcucacugcaaccuccgccucccggguucaagcgauucuccugccuca

SEQ ID NO: 4169626 - RNA, 58 nt, Human
ugagauggagucuugcucuguugcccaggcuggaguguaauggcgugaucucugcuca

SEQ ID NO: 4169627 - RNA, 102 nt, Human
ugagauggaguuuugcucuuguugcccaggcuggagugcaauggugcgaucucggcucaccgcaacguccgccucccggguucaagcgauucuccugccuca

SEQ ID NO: 4169628 - RNA, 79 nt, Human
ugagaugggugauuguugguggugauuaucauugagccuuucuugguguucuuaaaaucacagucacccaguauccuca

SEQ ID NO: 4169629 - RNA, 87 nt, Human
ugagauggucugaaaaaccauauugugcaucuguuugugcacaguucagcucacauugcagacguauauuauuuuacccuaugcuca

SEQ ID NO: 4169630 - RNA, 64 nt, Human
ugagauggugacagcauuuugaaguuguacaaagauagguacaaaauugaucuguucuauuuca

SEQ ID NO: 4169631 - RNA, 55 nt, Human
ugagauuaaaccaauccugauucaucuucuauggucagagaauggccuacucuca

SEQ ID NO: 4169632 - RNA, 58 nt, Human
ugagauugggucuugcucugucacccaggcuggagugcaguggcgugaucucgacuua

SEQ ID NO: 4169633 - RNA, 78 nt, Human
ugagauuugauggguguguaucuaggaaauggucuauuucaauucuauuaccuggaauuuauauagcuauguaucuca

SEQ ID NO: 4169634 - RNA, 105 nt, Human
ugagauuuugagaaacugagguucuaagugguuccuuuaaauagaucacacuacuugaaauguuugaagaccacugaguuacugaaauuuucuuccaaguucuca

SEQ ID NO: 4169635 - RNA, 63 nt, Human
ugagcaaaacagcaucaccccauaacauuguccuaguguugccugguauguugucaaugcuca

SEQ ID NO: 4169636 - RNA, 73 nt, Human
ugagcaacauugagucuaaguaccaaucaagggauagaaagccugguucuuagacuucaugucucagagcuca

SEQ ID NO: 4169637 - RNA, 78 nt, Human
ugagcaaugucacccauuuuuaaauauaacuuggagaauagcuaaguaguauguuuaacaagggcuugagaauguuua

SEQ ID NO: 4169638 - RNA, 79 nt, Human
ugagcaauuuauaagagugaaggccagguuacaguuaauuagcuuaacaugauuuuucuuugacucuacaaauuguuua

SEQ ID NO: 4169639 - RNA, 55 nt, Human
ugagcacacuccuggugagcgaggcagaaaagcuccuuuccaggagcuguguuca

SEQ ID NO: 4169640 - RNA, 55 nt, Human
ugagcacuggguguuuucugugguuuuccucuuuggggaaaauacucugggcuca

SEQ ID NO: 4169641 - RNA, 74 nt, Human
ugagcacuuccugccaugggcuguccugcuacaacggcucuaaagcucccuuggccacaguccaugcaugccca

SEQ ID NO: 4169642 - RNA, 89 nt, Human
ugagcagacacucggaggugucuugagauuaucauccgcugaggguggaaggggauagagcagacacuccgcaggugucuugaggcuca

SEQ ID NO: 4169643 - RNA, 60 nt, Human
ugagcagacucugcagagccacaaacaaugccgccuuaugagcucuggucagucugguca

SEQ ID NO: 4169644 - RNA, 55 nt, Human
ugagcagagucgcuccagagugagccaugggugcugaucugggcgaucucucuua

SEQ ID NO: 4169645 - RNA, 55 nt, Human
ugagcagaugugccaaacuguaaccacaaaagguugguguuuuguuuucuucuca

SEQ ID NO: 4169646 - RNA, 115 nt, Human
ugagcagcuggaagaggaugguggagcagaagguuuaauuucacauacaguuggcuucuguuugugauaacuuuuacauuuucgcagauagcuugucuuuuucccuguugacuca

SEQ ID NO: 4169647 - RNA, 55 nt, Human
ugagcaggacucacugcagccucaaauuccuggggucagcgauccuccugccuca

SEQ ID NO: 4169648 - RNA, 56 nt, Human
ugagcaggcaaacaaugguuauaauuuacuuucaaucaaagaguuugccuggcuua

SEQ ID NO: 4169649 - RNA, 81 nt, Human
ugagcagguuaggagcaguugggcucuaggaaguuuaaggauagcacugauuuccagccuaaaggcuuuguauuugaguca

SEQ ID NO: 4169650 - RNA, 68 nt, Human
ugagcaguaggucugaauagugggcuuaaaauauucaguaacccuugcuauaaacagaugugcuguca

SEQ ID NO: 4169651 - RNA, 63 nt, Human
ugagcauaaggauuuuggguucauacuauagcaugcaugaacuucauuccuuuuuaugacuca

SEQ ID NO: 4169652 - RNA, 64 nt, Human
ugagcaucauuguccacauguguacuccuguuuuuguauacucuguagauguggaaaugcguca

SEQ ID NO: 4169653 - RNA, 85 nt, Human
ugagcaugaauggaaaucccagcuuuugcacaacuggcuccguggguguggucaacuugcaagaugcugggcuucagcaucuuua

SEQ ID NO: 4169654 - RNA, 55 nt, Human
ugagcaugaggaugcugagggccugcuccuaacccugcaccacacucacugcuca

SEQ ID NO: 4169655 - RNA, 104 nt, Human
ugagcaugguggugcuugccuguaguuccagguacucagggggcugaggcaguaagaacacuugagcccaggaggccugggugacagaguaagacccugucuca

SEQ ID NO: 4169656 - RNA, 79 nt, Human
ugagccaacagcaucccugaagauaaccagagccaaauguuuacucaauggaagucauuauucagugagcugcugcuua

SEQ ID NO: 4169657 - RNA, 58 nt, Human
ugagccaagauugugucccugcacuccagccugggugacagaguaagucucuggcuca

SEQ ID NO: 4169658 - RNA, 68 nt, Human
ugagccagguuaagacaggagcauaucuguuuugcucacuagaauaaaaugucugaccugggaccuca

SEQ ID NO: 4169659 - RNA, 61 nt, Human
ugagccagguuuuccaucauucaguugauuuccccuucugaaaggauguacaucuggcuca

SEQ ID NO: 4169660 - RNA, 72 nt, Human
ugagccagucugucugggugaaauuuuuagcuccccauauacuaacuaugugaucucaggcaagacagcuua

SEQ ID NO: 4169661 - RNA, 61 nt, Human
ucuagcaagccuaccacgaaacugggaauacaguuaccuugucguggcuugcucuuaaaga

SEQ ID NO: 4169662 - RNA, 56 nt, Human
ucuagcagaguagccaaugugggaauuguucagugccugcuugggacacugccaga

SEQ ID NO: 4169663 - RNA, 65 nt, Human
ucuagcagccagacaccucucgggaggggagcuuggagccacuugaaagguagcuggcagcuaga

SEQ ID NO: 4169664 - RNA, 82 nt, Human
ucuagcccucucuucccagcucggaugggcccuuggccccaggucuccaguggcaaguccgggcgggcuccggggccauaga

SEQ ID NO: 4169665 - RNA, 86 nt, Human
ucuagcuacuaugauaagacaucauuaaacagcaauaagaggaaaaacuuaucagcauucccaaaugaugugcuuguuuggcugga

SEQ ID NO: 4169666 - RNA, 72 nt, Human
ucuagcuucggggccagugccucucuuccccugcugggaugggacagggcuggcuggucccuggauacugga

SEQ ID NO: 4169667 - RNA, 59 nt, Human
ucuaggcuggaggaagcagugccugggaauaagcucuccaggguccccuccugcuuaga

SEQ ID NO: 4169668 - RNA, 78 nt, Human
ucuagggaaauugguuucacauaauuuuaaauuguggacacucugcaccacauguuuaaguuuaaugaaaaccuuagg

SEQ ID NO: 4169669 - RNA, 66 nt, Human
ucuagggagaaauaaugccaguccaggaggagaagcuuccuggccauaggcuauuucagaccugga

SEQ ID NO: 4169670 - RNA, 62 nt, Human
ucuagggcucuggugggcucuguuuucacucacucuguugauagaauucucagagcccagga

SEQ ID NO: 4169671 - RNA, 63 nt, Human
ucuaggucauuuaucuccuuccuaaugugcccacaucuuauaagcaaggcagguugaccaaga

SEQ ID NO: 4169672 - RNA, 112 nt, Human
ucuagguuucucugggauguacaugugcacgugugacuuugugccugugccugagugucaucugagugcauauuucucuugcauccuguguugaguuuaagcgggaccuaga

SEQ ID NO: 4169673 - RNA, 55 nt, Human
ucuagucguaaauaugacuagacauauaggccaugaguaaauauuuaugacuaga

SEQ ID NO: 4169674 - RNA, 69 nt, Human
ucuagugcuucagcucaggcuugagggucccuuggcugagccaauccucagaccucagcaaagccugga

SEQ ID NO: 4169675 - RNA, 70 nt, Human
ucuaguggaaacuaacuggaauuaaaaugggcacaaauuccauucaagugcuaguuauuuauucauuaga

SEQ ID NO: 4169676 - RNA, 70 nt, Human
ucuagugggcucaggccucuguggggccugggaaucuggggcccugcaggggaccugcagccuccguaga

SEQ ID NO: 4169677 - RNA, 87 nt, Human
ucuaguuuucuuuuccucaccuaucucucucccaucagagagauagagguagagauagagagggauguggugggagagaaagagaga

SEQ ID NO: 4169678 - RNA, 65 nt, Human
ucuaguuuugguaugagaugcaggccugcaacgugauuuagccuucauuucuuucuugggcuggg

SEQ ID NO: 4169679 - RNA, 67 nt, Human
ucuauaagaaaguguuaacacuggcuacuuuugcaaagaaggccuaggaguugacaugggggguaga

SEQ ID NO: 4169680 - RNA, 75 nt, Human
ucuauaagagaauugguaagcaagauggcaauaccauuaugucuccauuuagcuugccuguuuaacucuuguaga

SEQ ID NO: 4169681 - RNA, 76 nt, Human
ucuauagaaagcaaaauccuaccaagaaauucccucuuuccuuuaugggauuugcuugguggauuugcuuggugga

SEQ ID NO: 4169682 - RNA, 91 nt, Human
ucuauaucuuuaauuuuauugcuaucucuauauccauuuaucuguauaugcagaaagaguaagggauggucagaggagaaaaaggaagaga

SEQ ID NO: 4169683 - RNA, 69 nt, Human
ucuaucagacuucguugcaggucugacuugugaaggagagagaaaaggaaggaaggaaguuugcaugga

SEQ ID NO: 4169684 - RNA, 66 nt, Human
ucuaucagguuuccauuauuuuaugggugggcuuagcauuauugggaagauaaaggaaacaauaga

SEQ ID NO: 4169685 - RNA, 57 nt, Human
ucuaucuagagcagugguucucaaccaagggugauugugcagccacuuucuaugaga

SEQ ID NO: 4169686 - RNA, 78 nt, Human
ucuaucugcgcacauuagaaguaacuaauguccacaucugcccuuaagacauguaucccuaauuguguuaaagauaga

SEQ ID NO: 4169687 - RNA, 61 nt, Human
ucuaugaagugcgaagaggcacagccagggagcucuccuagccuccagugggcuucguaga

SEQ ID NO: 4169688 - RNA, 57 nt, Human
ucuauggaguugguauuagucauguggauaagaauagcuaauauucuacucuaagga

SEQ ID NO: 4169689 - RNA, 88 nt, Human
ucuauggccuuggcaacagacaguagacaugggagcucuuaacucccuccuaaauguaacuguuauauuuuguugcuauggcaauaga

SEQ ID NO: 4169690 - RNA, 80 nt, Human
ucuauguggccaggaaaaggagauggaauuagugggcaucuagcccaucucugccacaguccauuuuacuggucaccaga

SEQ ID NO: 4169691 - RNA, 76 nt, Human
ucuaugugugugugugauauacacauguauauuucuauauguaauauguauauguguauguacauacauacauuga

SEQ ID NO: 4169692 - RNA, 75 nt, Human
ucuauguugcugaggauauuuuacugcaguucaaguuguaauaauagcucuguuuaagauccgucagucacuuga

SEQ ID NO: 4169693 - RNA, 94 nt, Human
ucuauuacgguucaaauugccaguguaaacuaauauuuaaaaucauuuuagugugguguuaaaaugcuuuauaguagauuuugccugugguaga

SEQ ID NO: 4169694 - RNA, 90 nt, Human
ucuauuauuaugaugucaauauuugaccauguuugaccugugaaagaguggaagguugaagugguucagugucauauuaacguauaaaga

SEQ ID NO: 4169695 - RNA, 75 nt, Human
ugccuuuuggugauuggaauaugcagagagcaugaauagguaacccugugauaaucugcauaccaguaaaaggua

SEQ ID NO: 4169696 - RNA, 95 nt, Human
ugcgaccauuugcuuguugugaugagguggauucaaagcagacaucaaaaagaagccuguuuccaccuucauggcuaaagaaccaaguggcagca

SEQ ID NO: 4169697 - RNA, 64 nt, Human
ugcgagucuauagcucugcagauuugcuaucucugggaguggaagagcagagcugggauuccca

SEQ ID NO: 4169698 - RNA, 55 nt, Human
ugcgaucauggcaaaggccuugaagauggcgucuguggggccugugauggucaca

SEQ ID NO: 4169699 - RNA, 71 nt, Human
ugcgcaaucaaccuugugaggaucaaaugaaacacguacaguuuucacugcagcccaugaagggaugugca

SEQ ID NO: 4169700 - RNA, 65 nt, Human
ugcgcccgcggcuccccucccuggggcugcgcugcgaccccagaggaaggggcgccgggcgugca

SEQ ID NO: 4169701 - RNA, 66 nt, Human
ugcgcucuauucuggguaccaaacuucaagaaaaauaauucauuugaagauacagaaaagagggca

SEQ ID NO: 4169702 - RNA, 72 nt, Human
ugcgcuggaaagaauuccuaugguucaaacacuuguuagugaauucugaaugaauagaauuguuccagccca

SEQ ID NO: 4169703 - RNA, 64 nt, Human
ugcgcuguaugagaaacagauguaagcucucugggaauugggcaggcauuucucuuuacagcca

SEQ ID NO: 4169704 - RNA, 95 nt, Human
ugcggauauugugauuaaacagacaguaaaugaaacaaaugggcagaggggugugugucuguagguuucugugugucuguuugugugugucugua

SEQ ID NO: 4169705 - RNA, 68 nt, Human
ugcggcuguggcauuuggaaagagcacuagaguaacugggucuggccaaagguuauucucuggccgua

SEQ ID NO: 4169706 - RNA, 58 nt, Human
ugcggggagggcaaagggagcgcaccaagaccaccaggcugcuccaggccuugccgca

SEQ ID NO: 4169707 - RNA, 111 nt, Human
ugcgguccaagauucaaagagccugcuuccucagggaacaagcagaacccuugguacaaaagccuguauuuaauugucccuggaaaguaugcucucuggucuucagcugca

SEQ ID NO: 4169708 - RNA, 68 nt, Human
ugcgguguuuccaguggggaaagaguaauuuuugaacauagccccuguuuucccacugaaagcuccca

SEQ ID NO: 4169709 - RNA, 56 nt, Human
ugcgguuuugacagcaauuauaagaaaaauuuauaagcuuccuguuagaaaccgua

SEQ ID NO: 4169710 - RNA, 63 nt, Human
ugcguguguguuuugugugugugugugugugugcacgcauguguucuugaaaggccacaugua

SEQ ID NO: 4169711 - RNA, 111 nt, Human
ugcguucaguguugaugagcuguuguacuggguucuguaugggugaugggagauaaguaagauguguuccuugcccucugggaucuugcugcagcuggcgagacagacgca

SEQ ID NO: 4169712 - RNA, 89 nt, Human
ugcguuucauagucuaccuguuugggcaagugauuuucucugugagcuugcaugagacagcuuaauugguggucacuagaauagaugca

SEQ ID NO: 4169713 - RNA, 68 nt, Human
ugcuaaaugcauuuuauuauaugugacuuguuugaaaaacugucacuuucugugagauguaguuagua

SEQ ID NO: 4169714 - RNA, 65 nt, Human
ugcuaaccccuccucuucuggcagcugggcaaugaugagcgcucccaggaagagaagggccagca

SEQ ID NO: 4169715 - RNA, 56 nt, Human
ugcuaagauauggguagucaagagguugauaaaaccuagcuucucauuucuaagca

SEQ ID NO: 4169716 - RNA, 78 nt, Human
ugcuaauucgagaaugaaagggguugaguuacagcuacugcacugggagcugcacacaauccuguuccuccaagggca

SEQ ID NO: 4169717 - RNA, 64 nt, Human
ugcuacagauaggaggaaucugaaagagccagcgggaccucuccuuucccacugucugugggca

SEQ ID NO: 4169718 - RNA, 120 nt, Human
ugcuacauaacaaccucucugaaccucgguuuucuccuguauucagaauucguccuacucucugaaguaagugcuugaaugaagggaugaccgaagggcccugagagcuuggaaagagca

SEQ ID NO: 4169719 - RNA, 66 nt, Human
ugcuacaucaaggccugaguggcuuugccacggcucuucuugugacugcaggccuuggugccagca

SEQ ID NO: 4169720 - RNA, 70 nt, Human
ugcuacccaggguagaaccucagagcaagagagaagacuaggcucugaacuuccaccuuuucagggggca

SEQ ID NO: 4169721 - RNA, 66 nt, Human
ugcuaccugccuuuggggaguuagagggcagugagggugcccaccccuggacaggugaguguagca

SEQ ID NO: 4169722 - RNA, 107 nt, Human
ugcuacgagggcuucagcugcuugaacaaggauaaauuugagaaaauaaauaaauguuguucaggucaguuucaaugaagccauuuuucuucuauuauuccauggca

SEQ ID NO: 4169723 - RNA, 71 nt, Human
ugcuacgcuuucccugcuuguggccuccauaggacacacacauggaugccaggagauggagcagaguggca

SEQ ID NO: 4169724 - RNA, 86 nt, Human
ugcuacuaguaggaauagaacuaacagcccacauuaccuuccccuagaagugauugggcuggauuaggacuguuccaguuugagca

SEQ ID NO: 4169725 - RNA, 81 nt, Human
ugcuacuuggaaaugaaaugagugccuggaggugggagaccuuuucaacaguauuacauuucagaaauaucuaauaaagca

SEQ ID NO: 4169726 - RNA, 69 nt, Human
ugcuagaauuugcagaagcauaaauaacugcuugggcugcugcuccgaagugcuuccucgcaaguugca

SEQ ID NO: 4169727 - RNA, 63 nt, Human
ugcuagcacugugcagucuacggauuagauuauaaacugaaaagacccugcauauguucagua

SEQ ID NO: 4169728 - RNA, 86 nt, Human
ugcuaggcaucugagcuuggccugaggauauucaccagcaugauugagaaaacaugcuuguccucaggaaggcccaagucuaagca

SEQ ID NO: 4169729 - RNA, 57 nt, Human
ugcuaggggucagcaccauaucuggacccuuccaugacacaguggugugccuuggca

SEQ ID NO: 4169730 - RNA, 66 nt, Human
ugcuagguuaaucauucucuguugcuauguuaacagaagugauagcagcugugguuuaccuuagua

SEQ ID NO: 4169731 - RNA, 59 nt, Human
ugcuaguagaaggcaaagaaggcucgaccuagauccaagccuguguuuuuucuauugca

SEQ ID NO: 4169732 - RNA, 69 nt, Human
ugcuagugaucuguuucuagaauugcucucugcucacuagagguucagacgcauaauaggcacucagua

SEQ ID NO: 4169733 - RNA, 108 nt, Human
ugcuaguuuguuuguccauucaucuguuggacauucaucugcagguuguuuucaggccuuggcuauuaugaaugcuguuaugaacaugaauguacaaauauucuuuca

SEQ ID NO: 4169734 - RNA, 55 nt, Human
ugcuauaagagucacuuuuccucccaguccuuaggaaaagugauuuuuucuggca

SEQ ID NO: 4169735 - RNA, 81 nt, Human
ugcuauaauuuggcuuucauaauguuaucuuccacaaguggggcucuugugaagguuaaauaauaugaugcuuguaaggua

SEQ ID NO: 4169736 - RNA, 84 nt, Human
ucuccaugaaugaauggacaggagagcauagucacccuuaaacagugagcucugcaguccuguccuucaagaaacaauaagaga

SEQ ID NO: 4169737 - RNA, 63 nt, Human
ucuccauguuugcugcauuccacacaauuacugguagugugugccagauacaagcacugggga

SEQ ID NO: 4169738 - RNA, 59 nt, Human
ucuccauuucaacaugaccacuugacacuaaguguuugucccguuagaaaugucagaga

SEQ ID NO: 4169739 - RNA, 84 nt, Human
ucucccagcuucugagggccuuugcuuccaauugacugcacuugaucauuuucuggacggcugccuucagaacacuggagugga

SEQ ID NO: 4169740 - RNA, 130 nt, Human
ucuccccguccagcugggccggccugcucucggccgcggggcuccgcggcgcgcaccggcaguuggcggcgcuguggccgccucuggagcgcugcuucccgcggcugccgccggagcuggacgugggcgg

SEQ ID NO: 4169741 - RNA, 89 nt, Human
ucuccccuuuucuguguucguagcagcuggcacaagcccagcacugggcucugcuccuggugccagugcugccuacugaugugggggga

SEQ ID NO: 4169742 - RNA, 57 nt, Human
ucucccuauuuggguguuaucuccccugccagaucaccaaugccucaaauugggaga

SEQ ID NO: 4169743 - RNA, 74 nt, Human
ucucccucagcucauauuuaugcccuuuugugccgcuuuuaacuuucacauggugcucauaugggugggggaga

SEQ ID NO: 4169744 - RNA, 71 nt, Human
ucucccuuuguuuucugcagucucucagaagccccugcuagugguaaaauucugaacuguaguuagggagg

SEQ ID NO: 4169745 - RNA, 59 nt, Human
ucuccgaaucggcugccggggcuuagggauggaggggguccagggcgggcgcacggaga

SEQ ID NO: 4169746 - RNA, 69 nt, Human
ucuccgaggcagcucugaugaugcucuggacagacagugggccgaggcaggguggagccgccucugagg

SEQ ID NO: 4169747 - RNA, 64 nt, Human
ucuccucaucacuacagggcgggucugagauggcacucaacaugcauuugugggauggaauaga

SEQ ID NO: 4169748 - RNA, 59 nt, Human
ucuccuccuguacacaauuccgaggauaagacauuaccgcaaaggauguauaggugaga

SEQ ID NO: 4169749 - RNA, 75 nt, Human
ucuccugcccaugaugcagaauccuagaguguccgucaaacuuagagggaaccaggucugaucaaggucaagaga

SEQ ID NO: 4169750 - RNA, 81 nt, Human
ucuccuggccccuguaaaauguacauguauaugcagcauauaauauuuaucuacaguucagagaugcaugggcccagauga

SEQ ID NO: 4169751 - RNA, 95 nt, Human
ucuccugggcucugugccaccuggauccugcugaacugggcuugugccaagcaggacacaugggcuuagcaggcaggggugcagggaccuagagg

SEQ ID NO: 4169752 - RNA, 56 nt, Human
ucuccugguacccuuccuagcaucaauucuguauuuguaggaguccaaucaggaga

SEQ ID NO: 4169753 - RNA, 56 nt, Human
ucuccugguacccuuccuagcaucaauucuuuauuuguaggaguccaaucaggaga

SEQ ID NO: 4169754 - RNA, 121 nt, Human
ucuccugucauuugagauucaagacuauugugagugugucuuugaagaaguagaucaauaacucucuuccuaguuacauaugcacaaagaaccugggaugaauucagagugacuuuggaga

SEQ ID NO: 4169755 - RNA, 62 nt, Human
ucuccuguugcucuugcccccugcaaguuucaagucugaaugguggcuagaaagcagugaga

SEQ ID NO: 4169756 - RNA, 61 nt, Human
ucuccuucaccccagcuuugaugcaccuauaccagguuugaucaguaagguuggaggaaga

SEQ ID NO: 4169757 - RNA, 79 nt, Human
ucuccuuccauccugaaugguguaauagguuuaagauaacuaccucuaaaauuaacuaucacuuuugugaggaagguga

SEQ ID NO: 4169758 - RNA, 99 nt, Human
ucuccuucccuugcaacaccugcucuggggaagccagaugucauguugugaggacacucaggcagccuccagagaggcccguguggcaaggaguggaga

SEQ ID NO: 4169759 - RNA, 67 nt, Human
ucuccuuccucucuugcccauaagagucuacuuaauauguuuccucuuuggaggggaggacaggagg

SEQ ID NO: 4169760 - RNA, 71 nt, Human
ugccaauuuuucugcagauggcaguguaacugcauuuuuaugcuaauguuuguggaagauacuugaaugca

SEQ ID NO: 4169761 - RNA, 59 nt, Human
ugccacacuccccugcugcagucaguccgugccucccugauugguugguugguguggca

SEQ ID NO: 4169762 - RNA, 64 nt, Human
ugccacagagacuuucauuguaaagccugguacugaaguuuggacaaagguguguuugugugca

SEQ ID NO: 4169763 - RNA, 74 nt, Human
ugccacauaagguguuguauccagagacagaguaacagcaagguggagcuggauggggcagcuuagguguggca

SEQ ID NO: 4169764 - RNA, 128 nt, Human
ugccacaugcuugaagcuuucacugccccauucagcuucucagcaugaagguuuccaguuccuggcacuugaucuggaagccguaggguuugggaaaugaggacagaugaugaagcggcugaguggua

SEQ ID NO: 4169765 - RNA, 60 nt, Human
ugccacaugucaugugcucaguagccacaugcgccaguggcugcugcaugggacaaggca

SEQ ID NO: 4169766 - RNA, 58 nt, Human
ugccaccagccagcuuggcuaucaaaaauggucuuccagcugggugggcugagugaca

SEQ ID NO: 4169767 - RNA, 55 nt, Human
ugccaccuguacaugcuaucugaaggacagccuccagggcacacagaggauggua

SEQ ID NO: 4169768 - RNA, 57 nt, Human
ugccacuggaggcacuuucuucccacucaccaaugaagaaacugacuccuagaggca

SEQ ID NO: 4169769 - RNA, 130 nt, Human
ugccagacaaggccagcuggaggagccuggaaggagguggggcggggcucugagaagcaucgacugcggcugcccucccucccugccuccaucuccacccuccaccaccaggccgguguaaucagggcua

SEQ ID NO: 4169770 - RNA, 86 nt, Human
ugccagagagagccuucagcugaccaaaugccuacaguuaucagagauagaaggacaccuauggugcaagcugagguuuguuggca

SEQ ID NO: 4169771 - RNA, 58 nt, Human
ugccagcagguagauauuggccaugauaacauggaccaguggagaggcaugcuuggca

SEQ ID NO: 4169772 - RNA, 92 nt, Human
ugccagcaguuaagugguggaauugggauuugaauccaagcucacuccguuccaaauucuauguucuuuccauaaucccaugcugcugagua

SEQ ID NO: 4169773 - RNA, 61 nt, Human
ugccagccauaaacccagaugacuuuuauaugugggaguacacuggcaaauguggugggca

SEQ ID NO: 4169774 - RNA, 78 nt, Human
ugccagcucuuucccuagugaucuuauuaguugucugcuacaugucuaaauaauaagauacuaagggaguuguaggua

SEQ ID NO: 4169775 - RNA, 55 nt, Human
ugccagcuggcacuuugggcugaauggccagcuaccaaagaacugccauuuguca

SEQ ID NO: 4169776 - RNA, 58 nt, Human
ugccagcuguaggugguggguugccuugacaauucacagaaacguacgugccguggca

SEQ ID NO: 4169777 - RNA, 58 nt, Human
ugccagcuuuugacuaucuuaguucacucagcugaaaugauggcuuuagaagcuggua

SEQ ID NO: 4169778 - RNA, 84 nt, Human
ugccaggaacauaccaaguuuuguauacagcuagacacucaagagcaaguauagcuguuuaucaaguucuugagucuucuggca

SEQ ID NO: 4169779 - RNA, 75 nt, Human
ugccaggcgugguggugcgcaccuguagucccaacuacucgggaggcuaagcaggcggaucauuugggcuuggua

SEQ ID NO: 4169780 - RNA, 83 nt, Human
ugccaggucagagagcuguucagcagccagguugugugcagaaccggagccccagcugccugaacuugcaguuggccuuugca

SEQ ID NO: 4169781 - RNA, 86 nt, Human
ugccaguauccuucugagacccauucuuaacuuuauggcuuuuuuucucuucucuugucucacaaucuuugaaggaaucucaggca

SEQ ID NO: 4169782 - RNA, 55 nt, Human
ugccagugaaacguggucucaucaguaucucaggcucugaccaaaucgcuuggca

SEQ ID NO: 4169783 - RNA, 63 nt, Human
ugccaguguggaacuaggaagaccaacugggccucuuaccucuuuaucuguuuuacauuagca

SEQ ID NO: 4169784 - RNA, 62 nt, Human
ugccagugugugccuuaagcucacuugcuucuguaagccaucucuuuagacacaccuggaca

SEQ ID NO: 4169785 - RNA, 96 nt, Human
ugccaguuucaacuuuuccuggagauggaguuguuuucaauaauggagugaacuggauuuccugaacaagccucccagugaagaggaagcacagca

SEQ ID NO: 4169786 - RNA, 57 nt, Human
ugccaguuucugauucugaaugaacagccuaacaggaggcuucagggcagaauggca

SEQ ID NO: 4169787 - RNA, 73 nt, Human
ugccaguuuucacuuauagggauguuauugaagaauuuuagaauaaugcagagauuuccuaaaagugauggca

SEQ ID NO: 4169788 - RNA, 59 nt, Human
ugccauaaagaggaggcugaacuuccugcacaauguccguuuuuccuucucuacaggca

SEQ ID NO: 4169789 - RNA, 83 nt, Human
ugccauaagaggaaaagucaggggaguguugaagacucugccuccuacaaauaugugaguuuuucuccccuggcuucauggua

SEQ ID NO: 4169790 - RNA, 64 nt, Human
ugccaucacaauagcaauguggcuuagaaguuacuucucaagcuacaaccauauucauugugca

SEQ ID NO: 4169791 - RNA, 58 nt, Human
ugccaugagugcuauaugugaagagauauuaagucucauuuguaauuaguucucagca

SEQ ID NO: 4169792 - RNA, 71 nt, Human
ugccaugcaggaaguuucauguggagguagacugguguagcuguucugaacagucuggcaugaugcaggca

SEQ ID NO: 4169793 - RNA, 69 nt, Human
ugccaugugacauuuuggaauucaucacaaaaccuggugugugacugaccagauaugucauaccuugca

SEQ ID NO: 4169794 - RNA, 58 nt, Human
ugccauuuagugcaucauuaguuuaauagagacuuaugcucuaguguaccaaauggua

SEQ ID NO: 4169795 - RNA, 71 nt, Human
ugcccacucuuuggccacagauccuuggggguagggauugugucauauucuucuguguacaaugaguagca

SEQ ID NO: 4169796 - RNA, 122 nt, Human
ugcccagauauuuucaaaguaggcaaagcuggcaagguugcaugcuucuagggucucacuaaaucgaggaugggggcauggaccagccuggcuggcccaaauauuugccguguugcugggua

SEQ ID NO: 4169797 - RNA, 69 nt, Human
ugcccagcacauaguguuuugagagacagcugacuggcugucucauacaaggcccugcucuguugggca

SEQ ID NO: 4169798 - RNA, 90 nt, Human
ugcccagcagcaccuuggggugaaugcauuaagaagggggaacugucaucucauucucccucucagauuuauucacagucuccugcggca

SEQ ID NO: 4169799 - RNA, 55 nt, Human
ugcccaggauugugaggucagggcaggaugccaagaugaacuacauuuccuggca

SEQ ID NO: 4169800 - RNA, 57 nt, Human
ugcccagugucuccaacaucagaugucgucacauucacgucuggagaccugauugca

SEQ ID NO: 4169801 - RNA, 64 nt, Human
ugcccauaaauggaagacuaggggcacuuugacuaguuaacaggcucacagucauuucauugca

SEQ ID NO: 4169802 - RNA, 58 nt, Human
ugcccauggaccaagcaaggggaaagagcaauagauccuucuuguaaaaccaagggua

SEQ ID NO: 4169803 - RNA, 112 nt, Human
ugcccaugggagucucgugcagauccaagguaggcucaggguuguucugccuuugggaaagcggggacagaguagcaaaggguuaaucucaggggcuugugcucucugggca

SEQ ID NO: 4169804 - RNA, 56 nt, Human
ugcccaugguaagucucugagcucguaaggccuuaaugaaagguugcacaugggca

SEQ ID NO: 4169805 - RNA, 78 nt, Human
ugcccauucucucuacuuguuuucaacauaguucuggaaaccuuagagcaauugagcaagagaaagaaaugaaaggca

SEQ ID NO: 4169806 - RNA, 98 nt, Human
ugccccacucaugaaauuauuguucuggcuucucucugucuuugcucaaauaggaauagagcaaagauacagacagagccaaaauaaugugaguugca

SEQ ID NO: 4169807 - RNA, 87 nt, Human
ugcccccugcucuggcuggucaaacggaaccaaguccgucuuccugagagguuugguccccuucaaccagcuacagcagggcuggca

SEQ ID NO: 4169808 - RNA, 60 nt, Human
ugccccucuaggcccuguucuaaagcugagugcuucagauguggagcugggucuggggca

SEQ ID NO: 4169809 - RNA, 81 nt, Human
ugccccuuuggcuccagccaggagcccacgcuucauuaaaaacugugagcugugccaaucugucuggggcuuuauggggua

SEQ ID NO: 4169810 - RNA, 67 nt, Human
ugcccucauuauaagaggcucacaggaauaccugauauugagaaauacucuuauuuucugaguggca

SEQ ID NO: 4169811 - RNA, 74 nt, Human
ucucuguugccuaggcuggaaugcaguggcacgaucucuguccacugcaaccucugccuucuggguucaagcga

SEQ ID NO: 4169812 - RNA, 86 nt, Human
ucucuuagcucaguaaaugaaugaauauaugcaugaaugaauacaugcgugaaugaauggguuugcuuaacaugcuaagcacuaga

SEQ ID NO: 4169813 - RNA, 56 nt, Human
ucucuuaggagaaauucauaaaaugugaaucaauuuuaugauguugaucuaagagg

SEQ ID NO: 4169814 - RNA, 58 nt, Human
ucucuuauuuugccuuugacaaguuuauauugagcauguuaucaggcaaugugggaga

SEQ ID NO: 4169815 - RNA, 119 nt, Human
ucucuucacguuuuuagccaugcagcauuuacaacucguaugguagcaaaaucaacucaaauugagguuuggguuuauaauuuacuacuugugauaacugaaugguucacaaacagaga

SEQ ID NO: 4169816 - RNA, 89 nt, Human
ucucuucauccuugcuauggcccucuccuuaggucagcucccaacacggcagcuggcuuccaucagagggugagcaaggaaguaagaga

SEQ ID NO: 4169817 - RNA, 56 nt, Human
ucucuucauuugcuaugggucauguagauauggaccaucgaaggagaugaagaaga

SEQ ID NO: 4169818 - RNA, 82 nt, Human
ucucuuccucucuggucucuucaggagcuugagcgccuuaaccaggugcuggaggccgagaagcagcaguucgaggaggugg

SEQ ID NO: 4169819 - RNA, 55 nt, Human
ucucuucuuguguuuuccugccucuucagacagccugagacuagcuaagaagaga

SEQ ID NO: 4169820 - RNA, 64 nt, Human
ucucuugcuaugauccuuaagaacccaugcccuaaaugaaugggaaagggucacaagcagcaga

SEQ ID NO: 4169821 - RNA, 86 nt, Human
ucucuuggccauuauuccauucaguucaacaaguauuuacuggaccaccuuguauguguucagacuguaguaaugggccuuggaga

SEQ ID NO: 4169822 - RNA, 62 nt, Human
ucucuuuaaaaauagugaaauaccuggcaacuaguccaauuuuuugcuguuuuagaaugaga

SEQ ID NO: 4169823 - RNA, 70 nt, Human
ucucuuuaguugucuccucaaggguacuagucacucaguagaguaccauuugguugggcagccaaagaga

SEQ ID NO: 4169824 - RNA, 102 nt, Human
ucucuuuccguccuccucccugaacucugugcccagcucccugacugcuguuuuauaggggaggggucucuggccaagaagcacgaggagggcacagagaga

SEQ ID NO: 4169825 - RNA, 120 nt, Human
ucucuuugggcacucaaccaaccgaaucucuuucuuacaaacaagaucauugaccaguuaggaucugucucaaugugugugugggaagagguucucucccccacacuuuucccaacaaga

SEQ ID NO: 4169826 - RNA, 72 nt, Human
ugagggccugggguagcuuacugcgaagcagccucagggaauagaggcuucagcagggcaucuuggccccca

SEQ ID NO: 4169827 - RNA, 72 nt, Human
ugagggcggguguuuuacccuugcagagacauuuucuugaauucuggagggcccacauccacaaugcccuca

SEQ ID NO: 4169828 - RNA, 80 nt, Human
ugagggcugcguaagacaggguggcucgggccuggggugcugggccccaggucucccugcagcccugaacgaugcucuca

SEQ ID NO: 4169829 - RNA, 62 nt, Human
ugaggggaccugggcuucaaggguugagaggggcacacccgaccccuccccgggucucuuua

SEQ ID NO: 4169830 - RNA, 92 nt, Human
ugaggggcugggaguggcagcagauuucuagauuuuccagguuugugcaaccuaaugggagauaaagcaucuguucuugauccugcuccuca

SEQ ID NO: 4169831 - RNA, 77 nt, Human
ugagggggcagaugguagcaguagcuugcuuaggucuuuugcccugagcuuuggagacugacuccauccucuccuca

SEQ ID NO: 4169832 - RNA, 55 nt, Human
ugagggguguuugaggguggggcggucagcuucuauagaucaguaaauaucucca

SEQ ID NO: 4169833 - RNA, 61 nt, Human
ugagggguuuucuucaaaagucuagaagcaaacaacuuccauuuuagaagaaaauccacca

SEQ ID NO: 4169834 - RNA, 60 nt, Human
ugaggguaacaggcaucuagaaaaaugaaaaaaccaggcgcuagcugccuguuaccucca

SEQ ID NO: 4169835 - RNA, 81 nt, Human
ugagggugagagcuggaaucagaccucaggugucccgacuucugacgcaggccugauugucucuugcagcacucacaauua

SEQ ID NO: 4169836 - RNA, 59 nt, Human
ugagguaaauguuagggcuauuauuaauaucuuuauauggcacagccugaaaugccuca

SEQ ID NO: 4169837 - RNA, 61 nt, Human
ugagguaagaguuuuccauuucugaaggacugcuaacagagaaaguaaagauucuaccuca

SEQ ID NO: 4169838 - RNA, 76 nt, Human
ugagguaaguaacgcauucauucauucauucauugcgucauguauuuagugaguauuuguugagugcuaggcuuca

SEQ ID NO: 4169839 - RNA, 57 nt, Human
ugagguagaagccuggguugaguaaggcccacuuagcccucucccagucucuaccca

SEQ ID NO: 4169840 - RNA, 101 nt, Human
ugagguaggagaaucgcuugaacuugggaggcagagguugcagugagcugagaucaugccacugcgcucuagccugggagacagagagagacuccaucuca

SEQ ID NO: 4169841 - RNA, 94 nt, Human
ugagguaggagaauugcuugaaccuggaggcagagguugcagugagcugagaucaugccacugcaccccagccugggcaacagacuccgucuca

SEQ ID NO: 4169842 - RNA, 74 nt, Human
ugagguaguucuaauauuaaagacauauauguggauaugcauucagauuaaauuaaauguucagaacugcuaca

SEQ ID NO: 4169843 - RNA, 71 nt, Human
ugagguaugugaugucuuuuagcuaaacauucaucaaaacaaauuauuagaguaaaagcacgagugccuca

SEQ ID NO: 4169844 - RNA, 55 nt, Human
ugaggucaagcccagagcagcacugacagcucaacuacaugcucuucugaccuca

SEQ ID NO: 4169845 - RNA, 122 nt, Human
ugaggucuguaauuucuuuaauaguuuuguucugguguugggucuugcuuuuagucauugugcuaugguuagguaagauguuaacagcugagauaacugggugaagaauauucagaaacuua

SEQ ID NO: 4169846 - RNA, 61 nt, Human
ugaggucuguccugucuuuggagugagacauaauauuccugcaaagaacuaagcagccuua

SEQ ID NO: 4169847 - RNA, 77 nt, Human
ugaggugaagaugaggcucuuccuguuggcuggagucucagcagaggcucuagaagcugaggggcccaagcaccuca

SEQ ID NO: 4169848 - RNA, 94 nt, Human
ugaggugagacagaguuucacuccacaugcccaugauccacaacccggggucaugcugugaaucagugcucugcucugcucucacucagccuca

SEQ ID NO: 4169849 - RNA, 59 nt, Human
ugagguggaguuuugcuguugucacccaggcuggagugcaauggcaugauuucagcuca

SEQ ID NO: 4169850 - RNA, 66 nt, Human
ugagguggugcaggccagcaggggcgagguucauuucucacuguugguccugcaaguuuuaccuua

SEQ ID NO: 4169851 - RNA, 84 nt, Human
ugagguuaagauuugcagauuaaaacacugagcuugagacaaauugcuuaauagugaaaucagguuuugacugcagugaccuca

SEQ ID NO: 4169852 - RNA, 65 nt, Human
ugagguuucaaguuguuuauauccagaguuuagggacucugguauccucuuagaaacagaacuca

SEQ ID NO: 4169853 - RNA, 87 nt, Human
ugagguuuggaguuuuuguuacagcagcauagccuaacccaaccugguuaauacacugcuuuuuguaacuauacaagcucuaacuca

SEQ ID NO: 4169854 - RNA, 69 nt, Human
ugaguacuuuggagauugcguaaguugccuugcugcaugccuguuaacuuaguucaauaucagugcucg

SEQ ID NO: 4169855 - RNA, 77 nt, Human
ugaguagaauagggguauugcuucagauucugacaaaucauacacagaaaaugaaaaugcccucuaugucucacuca

SEQ ID NO: 4169856 - RNA, 76 nt, Human
ugaguagacccucuugcaguugcgcagugcaugcucugcauagcuguacccggcagcucugagauaguccaauuca

SEQ ID NO: 4169857 - RNA, 75 nt, Human
ugaguagaggagugugugcaggcuccaguccccaaagucucuaggacuguccuagaaccugcagcucaucuguca

SEQ ID NO: 4169858 - RNA, 55 nt, Human
ugaguagaugacuggcuuaggauucaccuguaguuccugggccagaaucagcuca

SEQ ID NO: 4169859 - RNA, 58 nt, Human
ugaguagggaggaaagugugagccuugugucuugguuuucucuguuccccacuacuca

SEQ ID NO: 4169860 - RNA, 99 nt, Human
ugaguagguguagaaugaauuauuuuuuguaccagguuggggcuaggaaggagcagagguucagcuagcucuagcacuggauaauccuucuccugccca

SEQ ID NO: 4169861 - RNA, 62 nt, Human
ugaguauccaugggggauugguuccagaacccucugaggauaccaaaauccauggauacuca

SEQ ID NO: 4169862 - RNA, 64 nt, Human
ugaguaugaguucaggaaaggcuuucuaagaagguauuauuuaacuucugggcauucauauuua

SEQ ID NO: 4169863 - RNA, 79 nt, Human
ugaguauggggugaaucuuuguuguccgcugaguagggaccuaagcuguggacgauugaaagaugcucuggggugcuca

SEQ ID NO: 4169864 - RNA, 63 nt, Human
ugagucaaugaguuaaauaaugggauaugcugugggcaugucacagucugacucagugacuca

SEQ ID NO: 4169865 - RNA, 62 nt, Human
ugagucaccucucagaagccaccagcccaaaauaggacuauugcuugcggacagguggcuca

SEQ ID NO: 4169866 - RNA, 64 nt, Human
ugagucacugacccccagcucagcaccggccugguggcaguggcagcugaggggguauggcucg

SEQ ID NO: 4169867 - RNA, 69 nt, Human
ugagucaguauuuauuacuuagcuguauugaauucucugccagacugagaucaauaaauaacugacuca

SEQ ID NO: 4169868 - RNA, 79 nt, Human
ugaguccaaauucuguugaguagaugacuuggagagaucaauuuauuccagguagauuuauuccagccagguauucuca

SEQ ID NO: 4169869 - RNA, 70 nt, Human
ugagucuaggggaggcggggagcagggaagccucccacagccugaccugcccuucuuuccccagcauuca

SEQ ID NO: 4169870 - RNA, 66 nt, Human
ugagucucaggcaucuguguggcacagauacuuuuauguguuguugaaagagcuggcugagcuuca

SEQ ID NO: 4169871 - RNA, 94 nt, Human
ugagugaaaauuaggcuguuauguggguggcuguuaagggugcuucauuuccacaucggagagcugcccacacagcagauuuuaguagcacuua

SEQ ID NO: 4169872 - RNA, 81 nt, Human
ugagugaggagggauuggggagauagucacgguugcacagcagacgcugagccaggcacugcuccuggauuaacucacuca

SEQ ID NO: 4169873 - RNA, 74 nt, Human
ugagugagucagcuuugggggucucaggagacucugggugcgggguuucucggaggucaggguugaggggcuca

SEQ ID NO: 4169874 - RNA, 84 nt, Human
ugagugauggacagaagguagcaccuaugaacgucagauuuuccuguuugcagaggcauagugacuacuuuaaucuauaauuca

SEQ ID NO: 4169875 - RNA, 59 nt, Human
ugagugcucuguaugugccagacucuguacuaaaaguucggcacauguuauugcauuua

SEQ ID NO: 4169876 - RNA, 63 nt, Human
ugaguggcggggcuuguuggagccgaugcauggccuggcucccaaggagcuccugccugcuca

SEQ ID NO: 4169877 - RNA, 63 nt, Human
ugaguggcugcagcacauguaguggcuggaauuugacauaacaccugugcuguagucacuaca

SEQ ID NO: 4169878 - RNA, 122 nt, Human
ugaguggucgccaauguuucagcuccucuucugaguaccagggacguggguagaacuuugauccuaucuuauccuuacaggauauugagaggagaggagagaaguugacauggcaccaccca

SEQ ID NO: 4169879 - RNA, 90 nt, Human
ugagugguuuggcagggaugguaaauauguaaaguaagguguaaaacggaggauugugcuuuaccuaaaugccuuuccuaaaaccauuua

SEQ ID NO: 4169880 - RNA, 117 nt, Human
ugagugugauuauuuaauaguuuacugucuugcacagugcaaguagugacugagugugauuauuuaauaguuuacugucuugcacagugcacuucacugcucuaaguaacagacuca

SEQ ID NO: 4169881 - RNA, 72 nt, Human
ugaguguguagcauuuggcaggcagccuggcaugaaccaagugcccaaugcaugucagcugcugcucaucca

SEQ ID NO: 4169882 - RNA, 63 nt, Human
ugaguguguaugugucaguguagcuuaaacaguucauuguaugcugcccuggcucagcauuca

SEQ ID NO: 4169883 - RNA, 60 nt, Human
ugaguguucacauguacaugaauauucauuauugaguguucacauguacaugaauauuca

SEQ ID NO: 4169884 - RNA, 129 nt, Human
ugaguuaggcuguaaaacauaaguuaaacgcagaguguccuauauugaauuagacccuaaaaugugcuauauuuucgggucuaauucaaguaacaagugcuauaaucaccuuuccauaggcuaacagaa

SEQ ID NO: 4169885 - RNA, 75 nt, Human
ugauuagaguuuucuguguugucauuauuguaucuccuguuaauacagugucugacacguaggaagcacuaauua

SEQ ID NO: 4169886 - RNA, 58 nt, Human
ugauuauauaccuuucuaggugcugagaauucagcaguaaagaagaugaaugugauca

SEQ ID NO: 4169887 - RNA, 70 nt, Human
ugauuauccaggcagaaauuuuguuucauuguugcucuauaaugauaagaauuuguguuuauugugauua

SEQ ID NO: 4169888 - RNA, 58 nt, Human
ugauuaucuuuuacugccagaggccagggaagaacugagaggcagugaaaagagauca

SEQ ID NO: 4169889 - RNA, 108 nt, Human
ugauuauggguucguuggugaauguacucaagaauuuggauaagaaauguuuuucucuacgauguugccuguuuaguuucuuuaaagcauucucacaaucuauaauua

SEQ ID NO: 4169890 - RNA, 74 nt, Human
ugcucuccugcugagguggagauugcagugagcugagaucgcaccauugcacuccagccugggcaacaagagca

SEQ ID NO: 4169891 - RNA, 58 nt, Human
ugcucucucaggccuggcccacaucuuccagucaaugugaaaaccagguuuuagggca

SEQ ID NO: 4169892 - RNA, 66 nt, Human
ugcucugagguccucagagggaaagguucgggaucccccgugccucucccugcagggcccagggca

SEQ ID NO: 4169893 - RNA, 76 nt, Human
ugcucugcucacuaaacuaugaucuaauccuugguguccuguuuaaaaaugcaggacaauagacauaagcagagca

SEQ ID NO: 4169894 - RNA, 75 nt, Human
ugcucugugaucguuuauuuaagcuugguuuuacuaucuaaguacuacagcaguuaacgaucagacucagagaca

SEQ ID NO: 4169895 - RNA, 109 nt, Human
ugcucuucaucuaaucauugucugaauuacugaaggucaacuuaucugauaaaauaggugagcuuugugguaaugaagucagauaaugucuuauauucgugucagggua

SEQ ID NO: 4169896 - RNA, 101 nt, Human
ugcucuucucuuuuguacuuuucugcagaugaucucuuuccaguagaaucaaggcagccaucugcaggaaggagaaaagagagauaaacagaaaaagagca

SEQ ID NO: 4169897 - RNA, 60 nt, Human
ugcucuugcucugcaguccagacaguagaauuuauggaucaaagauucagagcaauugua

SEQ ID NO: 4169898 - RNA, 93 nt, Human
ugcucuugugguccuuccaauauuacaggugucaagaguaguaauuauauguuugccuguuuguacagugauguuguaugccauucaggggca

SEQ ID NO: 4169899 - RNA, 60 nt, Human
ugcucuuugaggucucuugaccgcauucauggaugauauggcagagcccagaacugagca

SEQ ID NO: 4169900 - RNA, 67 nt, Human
ugcucuuugguugguuccugaugccugaagucuuuuucuucuguguacaguuagccaccaaauugua

SEQ ID NO: 4169901 - RNA, 124 nt, Human
ugcucuuuuggacaucagucuugauaguaucacugccagguuuccagccagcugggcacacuucccuauguuugucagugaacuggaaggccugaacuagucucaaagucucauccacagagca

SEQ ID NO: 4169902 - RNA, 120 nt, Human
ugcucuuuuucccuucuacccuuucuaccuggcuucuuucauggaaggaaaaaguuuuguuuggagagcuugcuguauuuucuggaggaaaauagaaggaaggccuagaggaaaacagua

SEQ ID NO: 4169903 - RNA, 68 nt, Human
ugcugaaguggcagccuuagaaggagauuaaacugaugcccuaaucaaaggcugugagcaacccagca

SEQ ID NO: 4169904 - RNA, 64 nt, Human
ugcugaauugguaguacuguugucagggcuaagucagauagcagguaaacaugcccauucagca

SEQ ID NO: 4169905 - RNA, 64 nt, Human
ugcugaauuuccucuaaaccccugagccaggaugaggcaagugguuuaugggaguuccaaugca

SEQ ID NO: 4169906 - RNA, 65 nt, Human
ugcugagagucacugucugcauuuccuaaccuuuguuaggacucuguggccucagugacacagua

SEQ ID NO: 4169907 - RNA, 55 nt, Human
ugcugagccuggacuacauguuccuaaugcaugcuuuuaugucacauggucagca

SEQ ID NO: 4169908 - RNA, 79 nt, Human
ugcugaggguuagcuugauucauggcacaagcagauggcauccugcuucuggcaaaacaggcagaaaauuccuuuagca

SEQ ID NO: 4169909 - RNA, 76 nt, Human
ugcugagucauguaauaaugcugcuaaugaugcugacaaugagcagaaacacagagcccuuauuacaugaugagca

SEQ ID NO: 4169910 - RNA, 82 nt, Human
ugcugauacaauuuacagagguguccugcauugacaucaguccaguccaguccaauccucaauguaccuuguccaucaugua

SEQ ID NO: 4169911 - RNA, 120 nt, Human
ugcugauccugacuuaaguacaacacuuacgagacuaaaucugauuucccagguugcauccucuccagcuuuagaauuucauguuuggucuuuguaggaguugaacuuugggaaggggca

SEQ ID NO: 4169912 - RNA, 91 nt, Human
ugcugaucuccuucucagaauugugaacgcaccuggaccacagccgucagcaaugaccaaggccaggccagggcgugcacugaaggcagca

SEQ ID NO: 4169913 - RNA, 56 nt, Human
ugcugaugcuuucugugguugcccuuggguggggaugguacaggaaaaguguuaca

SEQ ID NO: 4169914 - RNA, 102 nt, Human
ugcugcagccacccagaucauuguguaguagagguggcaccauuuuacuauguguccucccugcacucagugaagucugugaagggaggggucagugcagca

SEQ ID NO: 4169915 - RNA, 71 nt, Human
ugcugcagccaggagccaggucuucacccacuucccagggagucacaagagccuggcugcuaggcucagcg

SEQ ID NO: 4169916 - RNA, 59 nt, Human
ugcugcaucacuccccgacuagaaagcaagauuucuguaugcagggcuuguaugcagua

SEQ ID NO: 4169917 - RNA, 73 nt, Human
ugcugcauuggaugcucuacaggaaacauggaucugaauggucccuguucuuucaguuagacacagugcuuca

SEQ ID NO: 4169918 - RNA, 55 nt, Human
ugcugcauuuaucuucucaaacauaucuuggucguguugagaagauugugcugca

SEQ ID NO: 4169919 - RNA, 73 nt, Human
ugcugcauuuugcauuuugcuaggaaaucuaacugccucugcaugagaucauuuggcagaagcaacgguagca

SEQ ID NO: 4169920 - RNA, 56 nt, Human
ugcugccacugguagucucauuucaaagaguaaaaugugaaaauccaauggcagca

SEQ ID NO: 4169921 - RNA, 82 nt, Human
ugcugccagcagucuagcugccagccaacuugcugugccucuuccuccagccagcaguccugcugugugccuguuugcugca

SEQ ID NO: 4169922 - RNA, 61 nt, Human
ugcugccuggagcuacuggacacugagagcgugcaucucagaccagaguucuaggccugca

SEQ ID NO: 4169923 - RNA, 65 nt, Human
ugcugccuugcuguuugccucucccuacuuagaacgccuccuaggagaugguggaagcuggugca

SEQ ID NO: 4169924 - RNA, 67 nt, Human
ugcugcucaagcugcagcaaaagaggaagcagacacugcucucaagaguguugcagcuugaucggua

SEQ ID NO: 4169925 - RNA, 65 nt, Human
ugcugcuugggcucacguaccuuggggccuucugucuguuauggccccugggagcccugucagua

SEQ ID NO: 4169926 - RNA, 75 nt, Human
ugcugcuuucagugaugucacauuggcagcuugacaucagcugugauggaaauauugacaccacagaaauuggca

SEQ ID NO: 4169927 - RNA, 63 nt, Human
ugcuggaaagagaguuucaaugagguaaacaaccuguuuauggaaaaugcucuaauuucagua

SEQ ID NO: 4169928 - RNA, 77 nt, Human
ugcuggaaagugaggugaaugagcgagugacuucccccauaaauuaacccucaccgugauucucuuacucucacaca

SEQ ID NO: 4169929 - RNA, 57 nt, Human
ugcuggaaauuccuaggagguagggaccgcaucuuacucaucuuugaauuuucagua

SEQ ID NO: 4169930 - RNA, 56 nt, Human
ugcuggaauuucaguugggcacaggcuccuaccaaugcccagcuguucuuccacca

SEQ ID NO: 4169931 - RNA, 71 nt, Human
ugcuggacuacagcuguguguuuaugugcagugcacaccugcaggggccugacaaauagcuguaguaugca

SEQ ID NO: 4169932 - RNA, 66 nt, Human
ugcuggauggaguaaaacuggagggcaaaacgagcaagagagcccuucuccuucuugauccaagca

SEQ ID NO: 4169933 - RNA, 62 nt, Human
ugcuggcaggcaccuccuggggaaaauggcuuuuggcuuuuaggagguugucuaagccagua

SEQ ID NO: 4169934 - RNA, 83 nt, Human
ugcuggcauccagccaaggcugccagagggcaagccccggcucaucagcccucugcuggccucaccucggcuaaugccaagca

SEQ ID NO: 4169935 - RNA, 73 nt, Human
ugcuggcauuaauauauguaauacucacagcaacaacucugugagauaaguacuguuauuauugccauucgca

SEQ ID NO: 4169936 - RNA, 55 nt, Human
ugcuggcuccugggugggcagguccaugaccuucacagcauccgugagcucggca

SEQ ID NO: 4169937 - RNA, 58 nt, Human
ugcuggcuuccugugcacagcaaagccuaaugaugcugacaggucauauaagcuugca

SEQ ID NO: 4169938 - RNA, 76 nt, Human
ugcugggagaagagucuauuggaacuagacaugacauguucauguuuguguuauaagaaucaucuucaaugcagca

SEQ ID NO: 4169939 - RNA, 66 nt, Human
ugcugggcaucguaggagguacugaaaacuugugaggaaaaguuccuauuuucaaugauuuuggca

SEQ ID NO: 4169940 - RNA, 59 nt, Human
ugcugggccugccccugucagccaaucuccuaggcccucgaucuuugcagguccaugua

SEQ ID NO: 4169941 - RNA, 58 nt, Human
ugcuggggauccguaccaacccaugaugguagcagguggucacuggaugccccgcgca

SEQ ID NO: 4169942 - RNA, 56 nt, Human
ugcugggggcuuucuggauaccgugaaacuuugucucagauuaugaggucucagua

SEQ ID NO: 4169943 - RNA, 58 nt, Human
ugcugggguuugaaccuacucauucuggcuccagagucccagcucagaaccacuagca

SEQ ID NO: 4169944 - RNA, 62 nt, Human
ugcugggugcuuacuuugugcuagacacuguaaagugcuaaagauaaggaaaguauccuuca

SEQ ID NO: 4169945 - RNA, 83 nt, Human
ugcugguagaagagaaucuggggcugacuggugacgauuauucacugucuuaauuguuggaaauagauuauuuucuaccugca

SEQ ID NO: 4169946 - RNA, 62 nt, Human
ugcugguugggacacauuuaggucaaucacagcuaagucagguacuuaaacuguccccagua

SEQ ID NO: 4169947 - RNA, 109 nt, Human
ugcuguacaggaguuacauguagcacagggcuccucaacccaccaccaucuggggcuggagaauucuauguugaggggugccuugugcacuggagcaugacuagcagca

SEQ ID NO: 4169948 - RNA, 61 nt, Human
ugcuguagcccugcacagugcaagagagcaagcuuguuggaaugugcuggguuacugggca

SEQ ID NO: 4169949 - RNA, 61 nt, Human
ugcuguauuuauggccacugaaaucugaaauucguaucaucuucagugucauaaaacugua

SEQ ID NO: 4169950 - RNA, 55 nt, Human
ugcugucaagaaaacaagcaauggcaagagaaucuggcuuguuuucacaauagca

SEQ ID NO: 4169951 - RNA, 81 nt, Human
ugcugucauucacauuuguuccucugcacuuagcacaauaccuugcuccuaauaaguacgcaauaaauguuuguggaagua

SEQ ID NO: 4169952 - RNA, 57 nt, Human
ugcugucccuaagucucuucaauacuaaaauccauuggcaaaaagcuuaggguggca

SEQ ID NO: 4169953 - RNA, 67 nt, Human
ugcuguccuguuuuggaguaauuaugucuggaaaacugccagucauuauguucuuaaacugauggca

SEQ ID NO: 4169954 - RNA, 76 nt, Human
ugcugucguucauggauucagucucacccugggcauagcuugggacagggacaugaggccauagugauugagagca

SEQ ID NO: 4169955 - RNA, 124 nt, Human
ugcugucuuugccugaagccaaggaguuggaauuuguauacauguuacauuugaauaggaagauuuauguuuggaaugcauacaaauucugauucacguugaaacaguaguagacacaacagca

SEQ ID NO: 4169956 - RNA, 68 nt, Human
ugcugugaagggcuaagaaauguguucaucccacagaggaugaaacaacagacuuggucaaaaaagua

SEQ ID NO: 4169957 - RNA, 68 nt, Human
ugcugugacccaaaaaagaccuaaagucuucuggucuuuccuuugcuugguuauccuuccccccagca

SEQ ID NO: 4169958 - RNA, 60 nt, Human
ugcuguggcuggaauaauaaaugugagcauuuaucaucauuaaacauccagccuauggua

SEQ ID NO: 4169959 - RNA, 68 nt, Human
ugcugugggggagagugcaagcaugaaagacugacaucggcaaauucauucauucguucacucacaca

SEQ ID NO: 4169960 - RNA, 114 nt, Human
ugcuguuuacucugaaauguuguugugagagacccuugaaacaguauauaugaaacuucuuuguuaacuuuaauauacaauuuuacgggcuuacaagguuuuaaguagauggca

SEQ ID NO: 4169961 - RNA, 77 nt, Human
ugcaggcacccagggcugugccugcccaucagccccgauagcagcaauuacacaguccgugggugugaugagcugca

SEQ ID NO: 4169962 - RNA, 56 nt, Human
ugcaggcucuuggugacguggguguccaggcugcgcgccagguuccagggcuugca

SEQ ID NO: 4169963 - RNA, 68 nt, Human
ugcaggcugggguagccccacuuggagacacuccacuccucucaaaguccgcauaaacccagccagua

SEQ ID NO: 4169964 - RNA, 56 nt, Human
ugcaggcuguagacaccaaacuauacuuuauagaacaugugaaaauauagccugua

SEQ ID NO: 4169965 - RNA, 86 nt, Human
ugcaggcuugacaacuaaggguucccuagcauaucuguagcuuaguaacuggucaaauguguagagcuuuuggggacucaccugua

SEQ ID NO: 4169966 - RNA, 57 nt, Human
ugcagggaguauugcuggccaucacaucaugugaagacuggucucugucucuuugca

SEQ ID NO: 4169967 - RNA, 55 nt, Human
ugcagggauuagaggccggggaugcggagaggggcagcgccugguuauccuugca

SEQ ID NO: 4169968 - RNA, 80 nt, Human
ugcagggcauaugaaggcagugugacauauugaaaggaaauugaacccauuuuuaggucugccucuauugccuaccugca

SEQ ID NO: 4169969 - RNA, 61 nt, Human
ugcaggguaaaggagacggggucaaaaucugcugacagugcccagugccuuugcccaugca

SEQ ID NO: 4169970 - RNA, 64 nt, Human
ugcaggguuagaguggcuuaaauaauacuuuugaaauuuuuaagccucucaaagaaacccugua

SEQ ID NO: 4169971 - RNA, 66 nt, Human
ugcaggugagggguauuguugucaggcgucguuauguuuuucaacguguaaucuuauuuaaaugca

SEQ ID NO: 4169972 - RNA, 57 nt, Human
ugcaggugcuccgggggugccccauccaagcuuggcacauucuuggugcaccuugua

SEQ ID NO: 4169973 - RNA, 61 nt, Human
ugcaggugcugugucaagagagcugucucauuguugagaucuugcuguacggcuacuugca

SEQ ID NO: 4169974 - RNA, 66 nt, Human
ugcagguggaagcagcagacucagcauaggucucacugcccugaccgucagcugucuuccauuuca

SEQ ID NO: 4169975 - RNA, 65 nt, Human
ugcagguguagaguugggcucccucugcguuguauuccuuugacguugccccaacuugcaucuca

SEQ ID NO: 4169976 - RNA, 125 nt, Human
ugcagguucuuaaacacuuauuuuaugagucuuuuaaagauuuagggccaguuuacauuccugaggauguuucugucuuugaguuugaaugagaugcucugauuuaugguuugguuuauccucca

SEQ ID NO: 4169977 - RNA, 62 nt, Human
ugcagguuuucugacauccagcagcaugcaguuccccugccccugccugucaguagaucuca

SEQ ID NO: 4169978 - RNA, 79 nt, Human
ugcaguaaaaaaggauaugugcagcuaguuuuccacuuuuaaaaccaaaccacagaugacacauuuccuuuccacugca

SEQ ID NO: 4169979 - RNA, 55 nt, Human
ugcaguaaauaauuuuguguauaugccuuugggcguaugugcaaguauuucugca

SEQ ID NO: 4169980 - RNA, 73 nt, Human
ugcaguaguuacucugaguaugugcgcuagacaggaauguguauaugugcgcacauguucagaugugugagca

SEQ ID NO: 4169981 - RNA, 62 nt, Human
ugcaguauuauaugguacauauuauaugguguuuccaccauauaaacaccagauagauugua

SEQ ID NO: 4169982 - RNA, 77 nt, Human
ugcagucaugaagggggagaauuaccaaaagcgcuuccagaaguguucuaaaauucucccccgggggugacacagca

SEQ ID NO: 4169983 - RNA, 130 nt, Human
ugcagugagucggguauuucuaguaugcagaggaaauacacuacuaagcacagauugaaauauguagggaucuuuuuauuuguuguugguuuugugucauuuugcccuaugagaaaggagaccauuugca

SEQ ID NO: 4169984 - RNA, 62 nt, Human
ugcaguggaagagguggagaucauggcaaagggaauggggugccacagagcuuccacuugca

SEQ ID NO: 4169985 - RNA, 70 nt, Human
ugcaguggaagccaugauaaccaguguggaagaacuucaucuacauuuacacaguuaggcuuaaacuuca

SEQ ID NO: 4169986 - RNA, 78 nt, Human
ugcaguggagaauguugauagcaccuauuuugaaccaaaaagagauaugucccugucuaauauuucaacuccauuuca

SEQ ID NO: 4169987 - RNA, 74 nt, Human
uggagcaugaggcagguggaggcugccauuuauagcucaggagugagcuucccuccugcacuacaaccucucca

SEQ ID NO: 4169988 - RNA, 71 nt, Human
uggagccaccuuuaaugagcaccagccgaagcaauauugucuuugcagggcaucuuugaaguguggcuuca

SEQ ID NO: 4169989 - RNA, 79 nt, Human
uggagcccagagaaggccccugacccugccgggcccccuucagccucugggccugcagggugaugggcugccugcucca

SEQ ID NO: 4169990 - RNA, 57 nt, Human
uggagcccaggagaggauaaacaguaucuguuaucauacucauuauccuuggcuuca

SEQ ID NO: 4169991 - RNA, 73 nt, Human
uggagcccaguaggcaaagcugcagaccgggacuuccgucuuugagcauguacgcucugcuuguugggcucua

SEQ ID NO: 4169992 - RNA, 73 nt, Human
uggagccuuacuagaaugugagcuacaaaacaguagagcuauucucuauucaaugcugcaucuguagggccua

SEQ ID NO: 4169993 - RNA, 61 nt, Human
uggagcuaggcgccggcagggcaacugggcaugcucagaagccgggcagguuuuggucuca

SEQ ID NO: 4169994 - RNA, 65 nt, Human
uggagcucugcgagccucaaagauguccaggcaguccuugaaauuuuaggccuugcaauguacca

SEQ ID NO: 4169995 - RNA, 61 nt, Human
uggagcuggcagcggaaaagggcacguuccacuccuuccuauuuccgucaucuuagcucua

SEQ ID NO: 4169996 - RNA, 56 nt, Human
uggagcuggcccucugaguuuguacaagugacauagaaacaccauggucaguucca

SEQ ID NO: 4169997 - RNA, 74 nt, Human
uggagcugugagaauccuccacugugagguggauucacuguccacaggaaggccuucucacaaugcaauuucca

SEQ ID NO: 4169998 - RNA, 77 nt, Human
uggagcuuuccagggagagccgcugcuccacaugugugcuguguggccauggcugucccuguacacuaaagccucca

SEQ ID NO: 4169999 - RNA, 62 nt, Human
uggaggaaggccugccaggcugcacucucaggcaaaagucugcagagggaaggcuucagcca

SEQ ID NO: 4170000 - RNA, 68 nt, Human
uggaggaccugcccuggggucuggagcagcaaaggcauuguguucaaaucccaggagcaugaacucca

SEQ ID NO: 4170001 - RNA, 71 nt, Human
uggaggagcagggcgcugucuggccagcggugccauagcaaccacuggcuccgaugcugccaccaccucca

SEQ ID NO: 4170002 - RNA, 73 nt, Human
uggaggaggggacaguacuugugccaggccagggcgggggcagcgggcggaacagcacuguuccuucucucca

SEQ ID NO: 4170003 - RNA, 78 nt, Human
uggaggcagagcucauugcagcccagagcgcaggaccccagagaagucugggcuuugcuaccuggcaguucuccucca

SEQ ID NO: 4170004 - RNA, 55 nt, Human
uggagggauacaaagaugaaaaagacugguuuucucucuuuauagaucuccucca

SEQ ID NO: 4170005 - RNA, 93 nt, Human
uggaggguuuguuaaaugcagggugcugggcuccaccccagaggcugugagucaguggcucuggcgugaagcccagaauaugcaucucuacca

SEQ ID NO: 4170006 - RNA, 62 nt, Human
uggaguaagagccaccagccaaggaaugugcacagccugcagaagcugguggcucuccucua

SEQ ID NO: 4170007 - RNA, 58 nt, Human
uggaguaauucugguuuugauguuaucuuugaaaugucaaggaaggucuguugcucca

SEQ ID NO: 4170008 - RNA, 59 nt, Human
uggaguaugcuuggcccugcagucacccccaggaugauuuccacagucaggggugccca

SEQ ID NO: 4170009 - RNA, 63 nt, Human
uggagucauuauugcccucaauucaagugucugaaagcaugacugaugaaagguaagacucca

SEQ ID NO: 4170010 - RNA, 64 nt, Human
uggagugaagcaggagcugcugcaggggcugagaaagcaggaaggagcucuuugcugcauucca

SEQ ID NO: 4170011 - RNA, 71 nt, Human
uggagugugugcccaggggacuuggagccuuggcuugcucacaugggcuccugccuccuggcaccucucca

SEQ ID NO: 4170012 - RNA, 64 nt, Human
uggaguucauccaugacagcuucgguuuccuaauucucagaaaggucugucaugggugacugca

SEQ ID NO: 4170013 - RNA, 55 nt, Human
uggaguugguaagauccauaggugaaauccuccuaugcaucuaucuucuacucca

SEQ ID NO: 4170014 - RNA, 79 nt, Human
uggaguuguucuggguucaaggggagucugcagugugguuaacugcccugcccuguugaaacuagauauaucauuucca

SEQ ID NO: 4170015 - RNA, 80 nt, Human
uggauaaacaguauuaucaauauauuucugggcaaaauauauaaagcaggaauauguuuuguuugauacauggauggcca

SEQ ID NO: 4170016 - RNA, 67 nt, Human
uggauacuuuggggguuaguguagagauuaacucuuucaaacucagcuccuaacuugacuggugcca

SEQ ID NO: 4170017 - RNA, 69 nt, Human
uggauagcucuuaccaagaaagggcucaccaaaaucacuucuguauuugaggagugcuuuuucuaucca

SEQ ID NO: 4170018 - RNA, 56 nt, Human
uggauaggagaucaauaugcaauuuuuacuagauuguucuuuuggucuuuugacua

SEQ ID NO: 4170019 - RNA, 68 nt, Human
uggauagucuuagaucagauaaaguagcaaugucucaagaauugaacucucuggaacugagcuaacca

SEQ ID NO: 4170020 - RNA, 55 nt, Human
uggauccagcugcuccuaugaggugucuccgcaagcaggagcugccuggaaacca

SEQ ID NO: 4170021 - RNA, 65 nt, Human
uggaugaaugugagcaggugcuggcugcugagcccaaggccaaggaccccuucacuuaccaucca

SEQ ID NO: 4170022 - RNA, 85 nt, Human
uggaugcuggaaaaagauuguguuuuucagcaucugcagccugggcuguuuuccacaggaauaaauacaguuuuuuccagcucca

SEQ ID NO: 4170023 - RNA, 57 nt, Human
uggauggcauguugggcucuguucuuggcugcaugcuuaacugcccaauauccuuca

SEQ ID NO: 4170024 - RNA, 130 nt, Human
uggauuaaguuguuaaugagaacuagggcacaggcucaguucacuggauuuucacuucuugagacauggaaucauguacugaauaaaucaagugcaacuggcuucaccuuagccucaaugaccagcacca

SEQ ID NO: 4170025 - RNA, 80 nt, Human
uggauuacuaugaagaauguuggccauuuguguguuggggagauuucagcccacucugguaacuuucagcauggugacca

SEQ ID NO: 4170026 - RNA, 77 nt, Human
uggauuagucuaugcuaagugucagcagcggugagggaaguucagggcugucugagaacaugguggaagaguaucua

SEQ ID NO: 4170027 - RNA, 58 nt, Human
uggauucaacaaauauuucuuggaucccuauuaugugccaagcaauguugugaaucua

SEQ ID NO: 4170028 - RNA, 79 nt, Human
uggauuccucuccuaguuuugaauaaagaucacaugcagcaacuuccuguugauucuauggcuccgggaguggaaucua

SEQ ID NO: 4170029 - RNA, 55 nt, Human
uggauugauaaaaugggauguugaguggaaauuuuccaauucuauuaucauucca

SEQ ID NO: 4170030 - RNA, 83 nt, Human
uggauuuaaguauaauuuacauuugguauucaaaaucuuuuagcauuuauuaauagcaaugauguagguuaaacugagauuca

SEQ ID NO: 4170031 - RNA, 80 nt, Human
uggcaaaguuugcuucucuacuuccuggaagggguuuugugagaaccugugcuccucucaaaaguagguugacuuuucua

SEQ ID NO: 4170032 - RNA, 72 nt, Human
uggcaaauaagagcuggagacagaaacagcccgugaugcugugcccugaaauuuagcauuuacauauuucca

SEQ ID NO: 4170033 - RNA, 102 nt, Human
uggcaaaucuaacacacccaauaguaucugugguugcugguuccagcacagcaaggccgagaggaugcuauucugggucugaaaugugagaaagauuugcca

SEQ ID NO: 4170034 - RNA, 68 nt, Human
uggcaaauuccaaaguuaauucaaggucaaaagacugaauuuagaauuugauuuuaggaaguuuguca

SEQ ID NO: 4170035 - RNA, 56 nt, Human
uggcaagagcaaaauguacaguuagauauuaaauuauuguaugaaaacucuugcua

SEQ ID NO: 4170036 - RNA, 88 nt, Human
uggcaagugaugauuuggaugugcacacucacuagaaccagcuuccacggguuuugcucugaaccacaccaucacacuccuccugcca

SEQ ID NO: 4170037 - RNA, 62 nt, Human
uggcaauguaggcaagaacauucccucaaggcaauaccugugggugucuugguuauauucca

SEQ ID NO: 4170038 - RNA, 64 nt, Human
uggcaauguggcaucaacgaagucacuguacuucucagucauuuguguagagugauauugucca

SEQ ID NO: 4170039 - RNA, 77 nt, Human
uggaccucccaggcauugccauuuucccagucugaguccaugaaccaggaaaauggcauugccuaggggacuuucca

SEQ ID NO: 4170040 - RNA, 61 nt, Human
uggacgggcauuucacagacuucuccaccaggaagcagcagggugauagugcccaggucca

SEQ ID NO: 4170041 - RNA, 66 nt, Human
uggacuaagauacauuguuuuugguagugcauguaaaauaacugagaaauagcaagugucucucca

SEQ ID NO: 4170042 - RNA, 77 nt, Human
uggacugaugaauggaccuuaaauugcuucagguuguucaacuugaacaguuuugucagguucacuuucaucuuuca

SEQ ID NO: 4170043 - RNA, 84 nt, Human
uggacuggcugauauggcuaggaaggauuggcccuuacacauaugcagcuucuacuuccuugucuauaugcaaugccacgucca

SEQ ID NO: 4170044 - RNA, 60 nt, Human
uggacuuacagaauguucuuccaacagaaauuauuugucgggggaggaugcuguucucca

SEQ ID NO: 4170045 - RNA, 65 nt, Human
uggacuuggggagaugaaaguauauauuuuacuucuagguuauauauaguauuucucugaauuca

SEQ ID NO: 4170046 - RNA, 78 nt, Human
uggacuuuucaugcugacuuuugauuggaaagauuggggucaguaacuacagggaagagccagcuagugaagaggcua

SEQ ID NO: 4170047 - RNA, 121 nt, Human
uggagaaaguucuagauucuggccuggcagaugcugucuuauuucucaucccacucaggagcuggaaacuaagagagccuuggguuggaagcaggaggcaccaggcucuagaaccauccca

SEQ ID NO: 4170048 - RNA, 67 nt, Human
uggagaacuggggccaggacccuggggucucugccaaugccucaaaggccuggcaccagaaguccca

SEQ ID NO: 4170049 - RNA, 83 nt, Human
uggagaaggcaggcagagaauggaugggggccggcaggucagggagagugacccauccacucgcugccugccuuguaccucug

SEQ ID NO: 4170050 - RNA, 75 nt, Human
uggagaauaacaaugaaccaaauuuaccaauuagggaaccauuucaggaauuguuggauggugaauuuuucuuca

SEQ ID NO: 4170051 - RNA, 71 nt, Human
uggagaauaggggccacuggugaggcuucacuuccuuccaugcuuggccagggcccugcucaauuucucca

SEQ ID NO: 4170052 - RNA, 72 nt, Human
uggagaauauaacugggugccugguggaugugugaauccuauuuuuacauuacacugugguccuguucucca

SEQ ID NO: 4170053 - RNA, 63 nt, Human
uggagaaucuggaaacuguugacuuucucuacuucuucugagaaacaguuccaaaucucucua

SEQ ID NO: 4170054 - RNA, 59 nt, Human
uggagaaugguucuggcccagaugccaauagcaucccuguggguccugcacauucucca

SEQ ID NO: 4170055 - RNA, 92 nt, Human
ucuguggauacagaauacucacuuggacaugggagaaacagaugauaaagucucuugacuguuucuuauccaaguggucugucuccaacagg

SEQ ID NO: 4170056 - RNA, 61 nt, Human
ucuguggcaaaugauaccucccagaguggucauucuacaaugggaccuagcuuugcacagg

SEQ ID NO: 4170057 - RNA, 63 nt, Human
ucuguggcccaggcuggggugcagugacaugaucucgauucacugcaaccucugccucccagg

SEQ ID NO: 4170058 - RNA, 80 nt, Human
ucuguggcccuaauguguuggacagcuucuacugugaccuuccucagcuucucagacuagccuguaccgacaccuacaga

SEQ ID NO: 4170059 - RNA, 111 nt, Human
ucuguggcuugucuucucauucucuggagaucagugguuuuuacacuuucuucugcugaagccaaguauuguggaagaagccauggggucaccagaggauaggugcacagg

SEQ ID NO: 4170060 - RNA, 59 nt, Human
ucugugggccugaggcaucagaagcacuuauguaaaaauuacugggucuggguccugga

SEQ ID NO: 4170061 - RNA, 115 nt, Human
ucugugguuggugguggcuggggcagggcuuggaucuguggucaggacucaagggauccugagaaguuacuacaaccagcaccuuggguccaaauuaguugacagcacccaugga

SEQ ID NO: 4170062 - RNA, 62 nt, Human
ucuguguggcuuuagacaaaauucugaaucaucucugaacuuuguuuuauagcacauaagga

SEQ ID NO: 4170063 - RNA, 56 nt, Human
ucugugugugugcauaugcaugcauguguguguguguguguguccucauuugcaga

SEQ ID NO: 4170064 - RNA, 127 nt, Human
ucuguguuccuaccaccuuccugcuggcauggucuuggcagcacggggaacgucugugcccggcccagaacauccccacugcuaccucguagccaggaugccacuguuaggucagugaggaaccgga

SEQ ID NO: 4170065 - RNA, 106 nt, Human
ucuguuagacagcugguagaguacauuuucuuaaauauuugcaggacauagccauguguuaguuguucauguuaagaguagccugugccacuguuuccuagacaga

SEQ ID NO: 4170066 - RNA, 103 nt, Human
ucuguuagcaccaugaaucuuggcugagagcugcucugcagaucugagaauucugucuucuuuuccaagcacucugggcugaguuuuucaggggauuaaugga

SEQ ID NO: 4170067 - RNA, 79 nt, Human
ucuguuagucaugaggccaaccuuuucauaaaugugacuccauuggucucuauaugaaaagguggccaauguagauaga

SEQ ID NO: 4170068 - RNA, 99 nt, Human
ucuguuccaagagggaagccaggcggggcuggcagaagcccccagggcgcccagagcugcagcagccuccagccuuggguuuccagaguagagagcagg

SEQ ID NO: 4170069 - RNA, 79 nt, Human
ucuguugaucuauguccacuuggauuguuuucacguuuuggguauugugaauagugcugcuguggacaugguguacaga

SEQ ID NO: 4170070 - RNA, 129 nt, Human
ucuguugcacucuugggggacaaggggagccaugggagagggucaguguagcgcucaaaggaaagagauuuuuugauucucaauugcccucugucuucuccuuuccuacuuuugugcaugaagcauggg

SEQ ID NO: 4170071 - RNA, 58 nt, Human
ucuguugcugguggcccugguuaugcuaacaaguagauaguguagcugcagcagcaga

SEQ ID NO: 4170072 - RNA, 70 nt, Human
ucuguugguuugcucuguguuugugaggcccgccaggcacugugggggguaacacaggguuaccaucaga

SEQ ID NO: 4170073 - RNA, 93 nt, Human
ucuguugucaauaacuggauucaaguuuuagaaauaucuggaugguguaaaaaugauuuaaauguuguaaaaccagaaaguuaccauaacaga

SEQ ID NO: 4170074 - RNA, 78 nt, Human
ucuguuguucagagaagaaagugacuauaauaggguaagcuacuaaggcacaauuuucucauacuaguagacaacaga

SEQ ID NO: 4170075 - RNA, 74 nt, Human
ucuguuuaaacgaaauugcucagaagcccuauauguaaaauagguauaaauggagcagcuuugguugaagcaga

SEQ ID NO: 4170076 - RNA, 59 nt, Human
ucuguuuagaaaucucaugcauagauuauuggucagauugcagagauaucugaagcaga

SEQ ID NO: 4170077 - RNA, 62 nt, Human
ucuguuuaucauguacauuuccacacuuaaauuugacucuggaagggcuaugaauaaacaga

SEQ ID NO: 4170078 - RNA, 76 nt, Human
ucuguuucucaucaucacucuggcaagcaucaagcagcaagcaauguuugcuuucagagauggccagaaucacaga

SEQ ID NO: 4170079 - RNA, 66 nt, Human
ucuguuucuuuguagauauucuuugcagcuuaucuguaaagaagauaaauuuuacaaagcaaugga

SEQ ID NO: 4170080 - RNA, 67 nt, Human
ucuguuuguaggguaguaccaugcugccagguuaccgcuggguaguuuccccugcccugcagcauga

SEQ ID NO: 4170081 - RNA, 76 nt, Human
ucuguuugucuguuauugguguauaagaaugcuugugauuuuuguacauugauuuugggcgaaggacaugaacaga

SEQ ID NO: 4170082 - RNA, 63 nt, Human
ucuguuuuacacaccuaugaaagacuaagaaccucagucugggaaguggguggguggggugga

SEQ ID NO: 4170083 - RNA, 125 nt, Human
ucuguuuuaccaauuugcacagacuuggacacagcagagcugacaguuaaauggggaugguaauaacugccuugaaagauuguugaguugauuugugaucaguuuugugcuuauuggcacauaga

SEQ ID NO: 4170084 - RNA, 63 nt, Human
ucuguuuucuuccuccugccucaccugggcaaaugguuuaggcaguggaaggagaaagcaaga

SEQ ID NO: 4170085 - RNA, 63 nt, Human
ucuguuuuugcaugaaccaguucauucuccgccuguuaaggcaacugguucaauucaacuaga

SEQ ID NO: 4170086 - RNA, 72 nt, Human
ucuuaaaacaacccggcuuguaauccucgcacuuugggaggcugaggauuacuugaagucaggaguuugaga

SEQ ID NO: 4170087 - RNA, 65 nt, Human
ucuuaaaggcauguuaggguccuuuggguuaauuauacaagguuugcugacagcgccugauaaga

SEQ ID NO: 4170088 - RNA, 60 nt, Human
ucuuaaaugauuguguuuuuugauuuugcacagagcgaaguaccuacacauuauuucaga

SEQ ID NO: 4170089 - RNA, 59 nt, Human
ucuuaagaaagugacaaauaggggcuuuacaucaguuuuuaauugucugccuuuuaaga

SEQ ID NO: 4170090 - RNA, 86 nt, Human
ucuuaagauacugaaauaguaucaacguguugaguauuaaaaagugacacaauugagugguacuaugccacuucaguguacugagg

SEQ ID NO: 4170091 - RNA, 58 nt, Human
ucuuaauagugcuaaaccauugacuaugaaauugguuugagugguaguauuauuuuga

SEQ ID NO: 4170092 - RNA, 55 nt, Human
ucuuaaugccaacaaagugauuuuuauauaaaaauaagcagaauuggcauuagga

SEQ ID NO: 4170093 - RNA, 55 nt, Human
ucuuaauugagaacaguguaggacaauucuccuauuacaauuggucuuauuaaga

SEQ ID NO: 4170094 - RNA, 107 nt, Human
ucuuacagauggcggcuucucagcuucuucaucuuacaccacagcaggugugugucuccauggugaagcaggguacagcacaaagccgccucauucaugucugcaga

SEQ ID NO: 4170095 - RNA, 127 nt, Human
ucuuacaucaaaauagaaagcccuggcaaacaguaccuuuagccacugaagcagaggccagaacaaaauuucuuucaguuuaaguguguugaagguaauaaagacugugguuuuaguugaaggaaga

SEQ ID NO: 4170096 - RNA, 61 nt, Human
ucuuaccaggaucauguuuuuguuguuggacaggugaaaaagacaaugaguccugauggga

SEQ ID NO: 4170097 - RNA, 74 nt, Human
ucuuacggugagcugccaguaguuggagcuccaaguuugacuuggagggcaaaaccugcaguuauuauuuaaga

SEQ ID NO: 4170098 - RNA, 64 nt, Human
ucuuacucuaagugccccucuugacccaaacuaagugucaagcaaaagggaguuuuagggaagg

SEQ ID NO: 4170099 - RNA, 62 nt, Human
ucuuagaauaaaagggggcuauaggagugaaaguauuacuauauucccucuuauugcuaaga

SEQ ID NO: 4170100 - RNA, 56 nt, Human
ucuuagaauugaagucagagggucaucuacuccggucuguaagcucaguccuaaga

SEQ ID NO: 4170101 - RNA, 85 nt, Human
ucuuagagaccacuugcauacacuucaaaugagcaugguuuuguucuguuuuauguuuguuuguuuguuugcuugcuuuuuaagg

SEQ ID NO: 4170102 - RNA, 66 nt, Human
ucuuagagacugucaaaagagauuauauuaagcaacuugagugauuauuuuuugccaguuaaaaga

SEQ ID NO: 4170103 - RNA, 64 nt, Human
ucuuagauuucagcauuuaugucuuugacagccuguaugacugaagauguuuugaagucuugga

SEQ ID NO: 4170104 - RNA, 85 nt, Human
ucuuagcauuacucuuggcacucagcaaguguuaauuaaaucuuauuugcuauuauuauuguugauguuaggguuauuguuaaga

SEQ ID NO: 4170105 - RNA, 82 nt, Human
ucuuagcuucauguucugccuguggaagaagggaaugcugagcugcuucacugaaacuuccggggcugacaauggggcagga

SEQ ID NO: 4170106 - RNA, 102 nt, Human
ucuuagcuuuuuauuuccucucuaauaggguaaauaucugugucuuuugccugucucaucccuuuaagacuagcugcccuaaagugggaaaugugaguaaga

SEQ ID NO: 4170107 - RNA, 99 nt, Human
ucuuaggguuugucaucuaagaugaugguuuuuccuccuggcugcacuguagccugugcagccaggauggagaacuguugguaugagagaaccugaaga

SEQ ID NO: 4170108 - RNA, 55 nt, Human
ucuuagguucuggaggucagaagucugaaaucgguuuucuggucuggaaucaagg

SEQ ID NO: 4170109 - RNA, 65 nt, Human
ucuuauaaaguccaucugaacaaggaccuuuuuugucauuguuuuuugagacuuucuacaugagg

SEQ ID NO: 4170110 - RNA, 55 nt, Human
ucuuauauguaaguuccccugggugagaaaacccagccaggacucccauuuagga

SEQ ID NO: 4170111 - RNA, 70 nt, Human
ucuuaucuacucuuuggaaaccaaccaaaguuuuaagcagaagaaugacaggaccagagaguaguuagga

SEQ ID NO: 4170112 - RNA, 60 nt, Human
uggaugcuauggaguauuuagauggaaaguuccucaaauguuaugaauuuccagcaucca

SEQ ID NO: 4170113 - RNA, 57 nt, Human
uggaugcuccuaggcccaauguaauagagcuacuccacaggccuuaggggccauuca

SEQ ID NO: 4170114 - RNA, 64 nt, Human
uggaugcugcucuugcucugugacacaucuguuucugcucaacaggcaauaaagggagucucca

SEQ ID NO: 4170115 - RNA, 92 nt, Human
uggauggcugaugaaaagcaugggaguuuucucugaugcucacacaaauagaguuggggugggguagggugggagaauuuccauuagcucca

SEQ ID NO: 4170116 - RNA, 91 nt, Human
uggauguaaaaagucauugcagaacaugaggucuucuagauuuucucuuauguuaucuucaggaguuuuaugguuuuguguuuuacauuua

SEQ ID NO: 4170117 - RNA, 69 nt, Human
uggaugugcaggcagacugcaaaaaucgcuuacuucgcaaguguacauuuuguaauuuccugacgacua

SEQ ID NO: 4170118 - RNA, 58 nt, Human
ugcagugugaccuguagcgagcucagacaggccuguggacauguggucacacucagca

SEQ ID NO: 4170119 - RNA, 67 nt, Human
ugcagugugccuaacacguaauucaccaggacgugucuucugggagucaucguguuuggauccugca

SEQ ID NO: 4170120 - RNA, 62 nt, Human
ugcaguguggauuuaguugugcuuuuuucuugcugggagagcacagccaccauuuacaagca

SEQ ID NO: 4170121 - RNA, 56 nt, Human
ugcaguguuuagaaagcuaucagcaagaucaagcuggagcagcuguuugcauugca

SEQ ID NO: 4170122 - RNA, 58 nt, Human
ugcaguuaauaaccuugcacauaaauccuuuaacaagugugugggcauaucugcugca

SEQ ID NO: 4170123 - RNA, 74 nt, Human
ugcaguucauugacuugaagaaaacaaugucuuaggaagauuagccugguuuuauuguucaaggcaaugaagca

SEQ ID NO: 4170124 - RNA, 57 nt, Human
ugcaguuguuucuaauagcaagauagauuuguuugugcagauaggagacaaucugua

SEQ ID NO: 4170125 - RNA, 68 nt, Human
ugcaguuugcauaacaagagauucuaaauucuuugaaguugaauaacuccaugauaugcuuuauugca

SEQ ID NO: 4170126 - RNA, 83 nt, Human
ugcauaaaguuacagcuuacauuuaccucguaauauauguauauauauauauuaggaguuaaauguauuaggagguaaaugua

SEQ ID NO: 4170127 - RNA, 55 nt, Human
ugcauaaaucuuggaaguuguuguuccacccucacauuuauuuccagauuaugca

SEQ ID NO: 4170128 - RNA, 56 nt, Human
ugcauacaguguauguugugucuauuuguguaaccaugacauacauucugucugca

SEQ ID NO: 4170129 - RNA, 68 nt, Human
ugcauacauaaagugcuaucaugugaucugugguuguagcagcuauuuauagcagcuuuuauugugua

SEQ ID NO: 4170130 - RNA, 57 nt, Human
ugcauagaggcaaaauggcuguacugguaaaaacguguaugccaauguuuuuaugua

SEQ ID NO: 4170131 - RNA, 129 nt, Human
ugcauagggacugagguacaguacuagcuaaaaauguagauuccugguccccacccaagaccuaauggcucuagggauggaaacuaggaaucuauguuuuuggcagucagccaaagugaaucuuaugca

SEQ ID NO: 4170132 - RNA, 63 nt, Human
ugcauauuauaaagagaauuagguugauucuuggaaacuugaaacucaucuuagugaugugua

SEQ ID NO: 4170133 - RNA, 64 nt, Human
ugcaucaaaacuggacuccuucaacucagacucagcaaucugguaaaggagcaauuuugaagua

SEQ ID NO: 4170134 - RNA, 118 nt, Human
ugcaucaaauguuugagugugaaguucgguccugacagcaucugugauucucuguggagacauccgcagugcaguuucccagaugcugucuguauucacacgagaagaguuugaucca

SEQ ID NO: 4170135 - RNA, 71 nt, Human
ugcaucacauuuacuuuuaucccuugggccaaaauaaguuuuacgaucaagccaaaagucaagguggugca

SEQ ID NO: 4170136 - RNA, 94 nt, Human
ugcaucaggaucucugguguguuuguugaaggugcagaaucccagaaggcaaaguccuuccaccugcauuuuuaacaaggcuaauucugaugca

SEQ ID NO: 4170137 - RNA, 60 nt, Human
ugcaucccuaggggcagagucccugcccagaugagcagugcuggcugucccagggaagca

SEQ ID NO: 4170138 - RNA, 130 nt, Human
ugcaucgcuuggccuggggcuggcuuucuucuagcagauagagacagagagcaauuagcguuugaaagcauaagcaagccaaucuguuuuguuuauacagagaguuucccccagaagugaggcagaagca

SEQ ID NO: 4170139 - RNA, 68 nt, Human
ugcaucucaucagugagagucagcagccuucugugucuagcuguggggcuggcuuuccuggaugugca

SEQ ID NO: 4170140 - RNA, 97 nt, Human
ugcaugaacagaucauggaggugcaaaagggcauggcaagaucaggagaccaggcaagugucuggcaugugugccaugcucccucuuucugccagca

SEQ ID NO: 4170141 - RNA, 103 nt, Human
ugcaugaaugaaaggcaagcccugacuaugaagacauaagaaucaaggucaacuuaugugucuccauagccagcuagcuuuucccagauuacuccauucugca

SEQ ID NO: 4170142 - RNA, 57 nt, Human
ugcaugaggaccugaguauggaaaaagagcauccgugcuggcauggucuuggugaca

SEQ ID NO: 4170143 - RNA, 86 nt, Human
ugcaugcgugccacuuguucagcuguaucuugcugcacuugcuaucaccagggcaagcagcaugcuaugcugguggcugcagagua

SEQ ID NO: 4170144 - RNA, 59 nt, Human
ugcauggaacggucuccuggucauggccccaucccacugccacccacaucuuuuaugca

SEQ ID NO: 4170145 - RNA, 75 nt, Human
ugcauggagggcccccuuugccaagugcaggggucugggucccccacucccugugggcagaggcugccuccagua

SEQ ID NO: 4170146 - RNA, 65 nt, Human
ugcaugguuaagcgaaaauauguggaaccugggaaagaucugcaaucuucacucuuaacugugca

SEQ ID NO: 4170147 - RNA, 55 nt, Human
ugcaugugucgggccugugcuagauccugggguugcagcacagacaagaccagca

SEQ ID NO: 4170148 - RNA, 58 nt, Human
ugcauguuagacugcagagucugguagggaaaacagacucuaaauagauaaccaugca

SEQ ID NO: 4170149 - RNA, 101 nt, Human
ugcauguuuuuaaguaaguuggaugucagagguaacaauuuggauugguuaauuucuucaacagugauggccuuuguauuuaauagcuaugacaauaugca

SEQ ID NO: 4170150 - RNA, 75 nt, Human
ugcauuauacauggaucuaaagguaaacacuaucaccugagucucauuaccagcauuggauacuguguauaugua

SEQ ID NO: 4170151 - RNA, 70 nt, Human
ugcauuaugcuacccagaagcuugacucaccagcugccaacaaagcuucauuaauguagcauguucugca

SEQ ID NO: 4170152 - RNA, 81 nt, Human
ugcauucucacugcuguauaguaguccauuguaugcauuuaccacaauuuauccauuguauaguugguggagauuagggca

SEQ ID NO: 4170153 - RNA, 80 nt, Human
ugcauugauagaaacagcaaaagacaagaacuuaagccagcuuugccuuugauuuuuuguuguauuuucccuauagugca

SEQ ID NO: 4170154 - RNA, 93 nt, Human
ugcauuuaaauuguucauauaugagggcaaagugaauagaauggcuuggccugucuccuccuuuguucuuaaaaugauaauucucuuaaugua

SEQ ID NO: 4170155 - RNA, 63 nt, Human
ugcauuucucagucuccaaauuugggcccagagcccuggagacccaggaggcugagaagagca

SEQ ID NO: 4170156 - RNA, 60 nt, Human
ugcauuuggaaacaauuauauucuuauaggacuauauaggagaagagauuuccacaugca

SEQ ID NO: 4170157 - RNA, 73 nt, Human
ugcauuuguaacauucaagaaugcucauaaccuucggggaaauaggucuuuguuccugaguauuacaaaugca

SEQ ID NO: 4170158 - RNA, 116 nt, Human
ugcauuuucuuuguuuuaauugaagcccaguaccuucagugagggagaugauggcuccaacuuauuaagaaugggccugcucaauuaccacucaauacacggacaaacugaaagca

SEQ ID NO: 4170159 - RNA, 59 nt, Human
ugcauuuuucugcugugcucggaccguuguggaugcuucuguuccaguagaaaggugca

SEQ ID NO: 4170160 - RNA, 63 nt, Human
ugccaaaaauaaaggaacuguuuucccaguugaguugauggaaaauaaaucuuauuccuggcg

SEQ ID NO: 4170161 - RNA, 65 nt, Human
ugccaaaacaggaguugaccaaguacaguccauaagccagacucugcccucugccuguuuuugua

SEQ ID NO: 4170162 - RNA, 59 nt, Human
ugccaaauaugcacguguaugcauguguuuguacgugugugcacgugugugugugugca

SEQ ID NO: 4170163 - RNA, 76 nt, Human
ugccaaccaacuagagcccucaguccagaauccagaacugggucaaaaacucucagacucuuuagugaagguggca

SEQ ID NO: 4170164 - RNA, 67 nt, Human
ugccaacgagggcucuaccaaguaacucuggcauuuucugccagggauggucagaguccucggagca

SEQ ID NO: 4170165 - RNA, 92 nt, Human
ugccaacgucagggaaaggauucugcugucggucccacuccaaaguucacagaauggguggugggcacagaaucuggacucugcuuguggca

SEQ ID NO: 4170166 - RNA, 59 nt, Human
ugccaacugucauugagcacuuugaacaugugaaguuaagugcuugaucauaguucuca

SEQ ID NO: 4170167 - RNA, 71 nt, Human
ugccaaguagccugcagugacuggaaugcaagaugcauggggaaaaaaaugguuauugcugagguuaugca

SEQ ID NO: 4170168 - RNA, 67 nt, Human
ugccaauccagcaggcagucauauccuuugccccuucagguaugaaauggcagcugcuguagaggca

SEQ ID NO: 4170169 - RNA, 57 nt, Human
ugccacauauaaccguacgugucaugcauugucaugacacccucauugugugucgca

SEQ ID NO: 4170170 - RNA, 70 nt, Human
ugccacauugcgcuaaacccacucccgguaauaagcaaccuaaguguguacauuuggugcaguuguggca

SEQ ID NO: 4170171 - RNA, 56 nt, Human
ugccacauuuugcuuugccuagguucaggucagaacuuucagauaaaaauguagca

SEQ ID NO: 4170172 - RNA, 66 nt, Human
ugccacccagcaugugauacccgccuggacacauccaggaaacacucaagccaugcuggggaggca

SEQ ID NO: 4170173 - RNA, 62 nt, Human
ugccacccagccaggagugggacccgugcucugaaauggucaucccuguuggcugaggggcg

SEQ ID NO: 4170174 - RNA, 81 nt, Human
ugccaccucugccaacaccaggggcagagaccaaaguggaagccacugucugcuggccccugguuaggugacaugguggca

SEQ ID NO: 4170175 - RNA, 64 nt, Human
ugccacucuucugcuuguccuuagaaaccugggccaucauggaugaggaugcagacagagggca

SEQ ID NO: 4170176 - RNA, 77 nt, Human
ugccagaucaaugcuucaggcuccuuauagucaaaccuguuuuccugauuauaagguagacccugaggcuuuuagca

SEQ ID NO: 4170177 - RNA, 64 nt, Human
ugccagaugcaggagguaaggcuggagguucgugaccaguuuggacauagcugcugcucuggua

SEQ ID NO: 4170178 - RNA, 60 nt, Human
ugccagauguagauagcaagguaggaaucagcaguccugccucugccucccuagucugca

SEQ ID NO: 4170179 - RNA, 65 nt, Human
ugccagccaguccagcauugguguagacagcuacuugcgauacuuaugacgagggcuggccugca

SEQ ID NO: 4170180 - RNA, 63 nt, Human
ugccagccuggccugagucuuuucugucucccagccguuaaagguuuuaggaccaggcaggca

SEQ ID NO: 4170181 - RNA, 63 nt, Human
ugccagcuacaggguugaaauccuggcuguuucuggacagcucuucuucaagccuggcuggca

SEQ ID NO: 4170182 - RNA, 60 nt, Human
ugccagcuaguacaaugggagagcaaugagacagugcuuuuccaucucuacugucaggca

SEQ ID NO: 4170183 - RNA, 77 nt, Human
ugccagcuuuggcacaggguggugccccuuuucauucuuaucuccaucacccuugauugccaagccuucccuuggca

SEQ ID NO: 4170184 - RNA, 57 nt, Human
ugccaggaaccuguucuuguucacugcuuauccccaaaccuagagcaguaccuggua

SEQ ID NO: 4170185 - RNA, 57 nt, Human
ugccaggacggugaaugggcuaccuggggugguggcccagaaacauuccugcaagca

SEQ ID NO: 4170186 - RNA, 58 nt, Human
ugccaggaugaggucaauguuugguuacugaugagaacaaacaggccucaguccugca

SEQ ID NO: 4170187 - RNA, 84 nt, Human
ugccaggcaaucuugggacaugugcucugggagccuugggccgccauaucaggagccagcugucccaaccaggaucugaaggua

SEQ ID NO: 4170188 - RNA, 118 nt, Human
ugccaguaauugcaaaauauguccuaacuacagagaauucaaauugugauaugaugugggucuuggaauugaugauuuucauaaugguuaauauauauugagcauuuacaauauggua

SEQ ID NO: 4170189 - RNA, 62 nt, Human
ucuucagcaacuccccaaucugccugcagccaagccucagaaucuguugggguugcagaaga

SEQ ID NO: 4170190 - RNA, 77 nt, Human
ucuucagcaucuuucucuucuggaguuguagcuuguucuuugugucaccacucaagcagguggggaagguuuggagg

SEQ ID NO: 4170191 - RNA, 108 nt, Human
ucuucagcauuuuuacuuuucuaacgaagacaucauggagaggauaaauagauuggcaagccuuuucuaugucuuuuccaaugcugucuggaaucaauuuguugacga

SEQ ID NO: 4170192 - RNA, 69 nt, Human
ucuucaggaggagcauuagcgucucaaagagauuaacgaguuaaaugaguguaggugcuuccuguuaga

SEQ ID NO: 4170193 - RNA, 57 nt, Human
ucuucauccuucaccuugguucugagugacagcuccaagccagaagaaggcuggaga

SEQ ID NO: 4170194 - RNA, 68 nt, Human
ucuucauccuuucagaugggcauggaccgaacauuauauuucugucucagcucuuuggaaaaagaaga

SEQ ID NO: 4170195 - RNA, 125 nt, Human
ucuucauucgucccucuugggaguaaagcaaaauguagagauugugcaagguugaagcuucucauucccaguccucagcauuuuguuuucuccuugaaacuccugagaguggagggccuggaaga

SEQ ID NO: 4170196 - RNA, 58 nt, Human
ucuucauucucgccuuugucgucagcauuuauggagcuaggcacugugugagugagga

SEQ ID NO: 4170197 - RNA, 56 nt, Human
ucuuccagcuccccacgguguccacaacccccugagggcagaugggagauggagga

SEQ ID NO: 4170198 - RNA, 90 nt, Human
ucuuccaggauauuuugagggcuuggcacugggaauauggagcaauacccaacacagucccagccuguaggauuggguucauaugggaga

SEQ ID NO: 4170199 - RNA, 90 nt, Human
ucuuccaucuacuuuucccucucauucucccauacucacccaggagccuccaacuccuccaaggcagggggagagaaggaaggaggaagg

SEQ ID NO: 4170200 - RNA, 60 nt, Human
ucuucccucuucugccaaauacaucucucuccaugggaagagacagguaaagauggaagg

SEQ ID NO: 4170201 - RNA, 72 nt, Human
ucuucccuuacuuucuuguccuuuagcugcuguuucuuguuccuccuuagucagcugcagaggugaagaaga

SEQ ID NO: 4170202 - RNA, 66 nt, Human
ucuuccgaucugggaugaaaccucaaauaaguuaauguuuccauccacauuaacagauacggaaga

SEQ ID NO: 4170203 - RNA, 55 nt, Human
ucuuccugguuucugggccaucaugccugaaagccuggucuggagccagugagga

SEQ ID NO: 4170204 - RNA, 90 nt, Human
ucuuccuucaauucuucuucaauauucaguggaaaagccauugcaugggaaugaacacaauggccauugacacaggaggaugaaggaagg

SEQ ID NO: 4170205 - RNA, 96 nt, Human
ucuuccuuccugucaucuguuccuucagcaaguccugagcaccugacaugugauagcaucuugcuaguauuuguugagcggaugaguggaugaagg

SEQ ID NO: 4170206 - RNA, 80 nt, Human
ucuuccuucuucauuuggcuugaggugucuuggacaugcugccuaaguauuggccuauagcuagaaggggcuaaggaaga

SEQ ID NO: 4170207 - RNA, 68 nt, Human
ucuuccuuuauuauucucuggagaauguaacuucaagaguuggcaaaggagaaaauaguaaaugaaga

SEQ ID NO: 4170208 - RNA, 68 nt, Human
ucuuccuuuccuuuccaaaauucugccuuccagagcaguugaggcagagugaugcugggaauauaaga

SEQ ID NO: 4170209 - RNA, 56 nt, Human
ucuucguuaagcuccagucauuccagcucucaugggaaugaucagcauagcaagga

SEQ ID NO: 4170210 - RNA, 85 nt, Human
ucuucuaacuuuaggguguuucugucuacucagccauuuaaaacucuuauguugguuagugauaggacuuuaaagccuuuauaga

SEQ ID NO: 4170211 - RNA, 87 nt, Human
ucuucuaugcagccucuuauucuccaggacuuguuuacauggugauggugguaagggucucagaagagugaggggaaguguacaaga

SEQ ID NO: 4170212 - RNA, 69 nt, Human
ucuucuauuuagguuagucuaaaaguauuuguguuuugcagucauuuuuugcaccaaccuaauagaagg

SEQ ID NO: 4170213 - RNA, 69 nt, Human
ucuucucuauaguacacuuagguacuucaagcuaauguuagcuuaacugccauguauugcuuagggaga

SEQ ID NO: 4170214 - RNA, 56 nt, Human
ucuucucuccugcuuggcagaaacugaacgaucagcagucagacagagagagagga

SEQ ID NO: 4170215 - RNA, 107 nt, Human
ucuucugaacccugcuucccgcugcugucuggaacugugauccagguggcugauaguugcucugggccucaccuucuuggcagcccuggguuucaguaacugggaga

SEQ ID NO: 4170216 - RNA, 87 nt, Human
ucuucugaguaugguuauuuuucugcauuggguuucagcaaacugugcucacaugcuugaggaaagaaaaaccauucuaucagcaga

SEQ ID NO: 4170217 - RNA, 80 nt, Human
ucuucugcaucucacagccagugcucauugucagccaauuccaugccaggcacugcaccuggcucugagaucuggaauga

SEQ ID NO: 4170218 - RNA, 84 nt, Human
ucuucuggaagcuucuuagaaaugcagaaucuuaggccucagauuuacugaauaagaaucugcauuuuaacaagauccauagga

SEQ ID NO: 4170219 - RNA, 73 nt, Human
ucuucuggaugagagcggaggcugggaagagggugggcccgguaaccagggccuccugcacucugccagaagg

SEQ ID NO: 4170220 - RNA, 77 nt, Human
ucuucuggcuccuggcuccacugcccuggcucugugcucugugcuggccgugguagccggagggaggacccaggaga

SEQ ID NO: 4170221 - RNA, 70 nt, Human
ucuucuuacaaggcuugugaauuuuuuguuggaaauggugacaugccaucacaaagcuuugauaagcaga

SEQ ID NO: 4170222 - RNA, 75 nt, Human
ucuucuucauaggcaguccuguucuuuguagcuccgggggucucauaaccaaagaaugggacuucagaaagaaga

SEQ ID NO: 4170223 - RNA, 80 nt, Human
ucuucuuccccuggguugucaccgcagcugucacugcuguucucacugcugcagguccagccccuuuguaggggagggga

SEQ ID NO: 4170224 - RNA, 70 nt, Human
ucuucuugccugcccugugucguaaaaugggggucccuuacugcauuaucaaggggaaggcaagacugga

SEQ ID NO: 4170225 - RNA, 109 nt, Human
ucuucuugguuugcaagaucaucuaucuagucaguauauuuugaauuaauucucuucugauacagagauacucuagaucaaauggauugaucugaaccaauuucaaaga

SEQ ID NO: 4170226 - RNA, 70 nt, Human
ucuucuuguagcuuuuauccacugcuuuugguuuuguaucuagaucuagguauaugaaagcauauuaaga

SEQ ID NO: 4170227 - RNA, 95 nt, Human
ucuucuuuaacuacaguaccaagaauuaagaauuuugauguggaucuuuagcuucacagagaaacuggauugauuuuggaaacuguaucaggaga

SEQ ID NO: 4170228 - RNA, 91 nt, Human
ucuucuuuucugagaaaaagauaaaauggagaaacuguuacuauuaagcaaguuucacuaaggucuguguguucuuuuuccagaaggagga

SEQ ID NO: 4170229 - RNA, 64 nt, Human
ucuucuuuucuuaguuguuggguucuucauccauugaaaguuagaaacaaguaggaauggaaga

SEQ ID NO: 4170230 - RNA, 78 nt, Human
ucuugaaaauccauuuagugucguuuuauucaaacugaagugcuucaggauggucagaugcauugucuaggaucagga

SEQ ID NO: 4170231 - RNA, 55 nt, Human
ucuugaaguccuuacauuugauccuuauagauggaucacagaugaaaguucaaga

SEQ ID NO: 4170232 - RNA, 85 nt, Human
ucuugaguauuuacaaagcacaugaguaguguaguaggagaauuguaucaguuaagauaauaaguaugucuaugugaagccaagg

SEQ ID NO: 4170233 - RNA, 90 nt, Human
ucuugaguuuccuugacagcuagaccuccuccucggggccagcccugcagugugguccugggguguguuuugcugcucaggggcucggga

SEQ ID NO: 4170234 - RNA, 78 nt, Human
ucuugaucuuguuugaaaggagcuuuauccagaauacaauuucuuuauucagaaugaaauuucuuucagauauuagga

SEQ ID NO: 4170235 - RNA, 57 nt, Human
ucuugauggugauguugugucauugcuucauuuuuggcacucagucacuacucaaga

SEQ ID NO: 4170236 - RNA, 90 nt, Human
ucuugauguauucuauaaccugcugcaagugaugcuuguuaguuuuauuaauucuaacaagucauuccauuugacaguaaaacauugaga

SEQ ID NO: 4170237 - RNA, 62 nt, Human
ucuugauuugaauugcaguuguaaauggcgaauugaaggggcaauugcaguugcaaaaaggg

SEQ ID NO: 4170238 - RNA, 58 nt, Human
ucuugcaggcaugaaaggacucggggcugaaauugccaagaaucucauccuggcagga

SEQ ID NO: 4170239 - RNA, 72 nt, Human
ucuugcaguggugagccagucucuuuauccaccaagccugacccagcaggcaggagaggcccaguaccaaga

SEQ ID NO: 4170240 - RNA, 65 nt, Human
ucuugcauccucuuagcugaagguuccuuuaacuggagucuucacuuagcugaggggacugaaga

SEQ ID NO: 4170241 - RNA, 67 nt, Human
ucuugcauucauuacauucaaaaggcauuucugcagugggaagucuccuguguguuaugaagcuaga

SEQ ID NO: 4170242 - RNA, 67 nt, Human
ucuugcauuuaaguagauguuacacacuuagugaaaugugcaucugcuaaaauuuccggaggcaaga

SEQ ID NO: 4170243 - RNA, 91 nt, Human
ucuugcauuuuugugaaguaugcauugcugcuuucaaaacaauuucgaaaauuuuuaugaaagagaauguguaucuuuuggggagaaaaga

SEQ ID NO: 4170244 - RNA, 74 nt, Human
ucuugcuaaaguuuuugcuauauggaauuggucauucuagagaugucaguuaccuagcacaagaauugcaaaga

SEQ ID NO: 4170245 - RNA, 65 nt, Human
ucuugcugacuucaguggcuggcaucaaaguaaaaauuacaccagacaaagugaagcaggcagga

SEQ ID NO: 4170246 - RNA, 79 nt, Human
ucuugcugaguaccagcugcugcugaagucaacuaauuacaacauuccacuugauaucacacuggauacacaugcaaga

SEQ ID NO: 4170247 - RNA, 58 nt, Human
ucuugcuuuccuaaacauaaaaaggcugugaugugcuuuauggagaaggaaaguaagg

SEQ ID NO: 4170248 - RNA, 58 nt, Human
ucuugcuuuucugugcuuuccucagacuguaacaacagcagccacagaacuugcagga

SEQ ID NO: 4170249 - RNA, 68 nt, Human
ucuuggaaggaccugauuuugagcaucuucauuaauugugaacucaggguucaagucccuucucuuga

SEQ ID NO: 4170250 - RNA, 61 nt, Human
ucuuggacacaaugguuuuccauaugggcaaagacucuaaaugaaggccauuuguuccaga

SEQ ID NO: 4170251 - RNA, 69 nt, Human
ucuuggaggcaguaacugagcaacauauuccccgacaaaaaaggguuguugaaguaacuguuacauaga

SEQ ID NO: 4170252 - RNA, 63 nt, Human
ucuuggcuacuuuccugucugcuaauucauuucaacucuagcacuuuuggguaguggccagga

SEQ ID NO: 4170253 - RNA, 55 nt, Human
uggcagcagcaaauggcauaucaucuuccgugaucuuggagucaucaugcugcua

SEQ ID NO: 4170254 - RNA, 72 nt, Human
uggcagccacaugagugagccaucuugaaaguggauccuucaccccagguugagccacuucaguggaugcca

SEQ ID NO: 4170255 - RNA, 72 nt, Human
uggcagcugcaggccuccugaggcccuggcucagaacaugcacugccucccucaggcugucugcugguucca

SEQ ID NO: 4170256 - RNA, 68 nt, Human
uggcagcugcuggagagcgagacuguuccugagccgcccauuaaacgugucuccugcagcaguggcua

SEQ ID NO: 4170257 - RNA, 115 nt, Human
uggcagcuggcugggauugaagugugaauguugauaugaguacagaaauaucugggcuaccccuucugauucauucacacauuaucacaugauugccuuggccuugauaauguca

SEQ ID NO: 4170258 - RNA, 78 nt, Human
uggcagcuguuaauguuuuguugauccuccuaacaauccccugauuaauaauaaccacagaaauaauaauaguugcua

SEQ ID NO: 4170259 - RNA, 64 nt, Human
uggcagcuguucagcaacucgcagagcagucucucuucuccaucugccucgcuaacagcagcca

SEQ ID NO: 4170260 - RNA, 62 nt, Human
uggcagcuuccugcucauaggaaaccucguccuuuagcuuucucuggagucaagagcuucca

SEQ ID NO: 4170261 - RNA, 95 nt, Human
uggcagcuuguaguucccagagcaguacuccaggaggugaauuccaccagccucuuaggguagucugacuuuuuauuggcagcuuauaguuccca

SEQ ID NO: 4170262 - RNA, 55 nt, Human
uggcaggaaauacccugccuagaacaaauacuccugcugcagggauuucuugcca

SEQ ID NO: 4170263 - RNA, 83 nt, Human
uggcaggcuagagucucucauuaaucuguauuuucauuuuaaaaugaguacuuugcauuaguaaguaauuuuaauuuuugcca

SEQ ID NO: 4170264 - RNA, 107 nt, Human
uggggaaaucaaauauuuagaaguucaugcgaauuauuuaaguuuuacuucaacaaauuaacagagugcuucuagcaagagcuucauaugaguuuuuuuuuuuacca

SEQ ID NO: 4170265 - RNA, 59 nt, Human
uggggaagaaggcagcugcuugacacccacaggucuguucaaggaguuucucuuuucca

SEQ ID NO: 4170266 - RNA, 89 nt, Human
uggggaagcuggggaaaagaaggaugggagaaauccuaugggauuacuucaggacuucuuagaugccuuccguuaccuaguggccacca

SEQ ID NO: 4170267 - RNA, 89 nt, Human
uggggaaggcugggcuggaggucgcgcgggugcugcaguguugugagcucacgcugcaguguucagugaucucuccacugcuuucugca

SEQ ID NO: 4170268 - RNA, 65 nt, Human
uggggaagggguuguuacuggccucuaaggaagacccaaaggaaaguacaaaaauuccuuucuca

SEQ ID NO: 4170269 - RNA, 76 nt, Human
uggggacagcagacuguaaagggccagaaaguuaaaauuuuagccuuuguggguuuuacaaucucuguugcaacca

SEQ ID NO: 4170270 - RNA, 62 nt, Human
uggggacauucaugcagguuguuggcaggaggucucaguuccugcauguaugaacgucucca

SEQ ID NO: 4170271 - RNA, 86 nt, Human
uggggagaccuaggcucuagauguggucuuugccccaauucacagugcaacagagggcaagacaucucuaugggccuguuucccca

SEQ ID NO: 4170272 - RNA, 129 nt, Human
ugaaucaaaugaaaugauuuggguaaugugucugggacagaguaauugugucuggcacacugauuauuguuaagcugccagauucagucugcuaaauccagucuccucaucaguuaccuuaugauucug

SEQ ID NO: 4170273 - RNA, 60 nt, Human
ugaaucaguauaaauucucaaauaugggagaaauuuuguucuugagaauuaucugaguca

SEQ ID NO: 4170274 - RNA, 89 nt, Human
ugaaucauucugcuuggcuggaaauagguugagaugaaucugauuuguguuugacuuaauaaaacuccauuucacuuagaaugucuuua

SEQ ID NO: 4170275 - RNA, 70 nt, Human
ugaauccgggaggcggagguugcagugagucaagauugggucacugcacuccagccugagcgagacuuca

SEQ ID NO: 4170276 - RNA, 60 nt, Human
ugaauccuaguugaagauaaggucaccaaccucccagagccuaucuuccacugggacuca

SEQ ID NO: 4170277 - RNA, 67 nt, Human
ugaaugaaguaacagaggggguguugcugguuuuaugacuagaagcauugaucuuuuuauuaauuca

SEQ ID NO: 4170278 - RNA, 122 nt, Human
ugaaugaauaaauaccuugagaaaaugcauugguuucuacuuguaagucaacgauuuaaaugcuguugaaaaggccuuaagucaaccuaaugcaugugauuuuuuucagguuuuucuauuca

SEQ ID NO: 4170279 - RNA, 67 nt, Human
ugaaugaaucauccugaccacucagcuacuuggugccuucaggagcugaauuacggugagucauuca

SEQ ID NO: 4170280 - RNA, 96 nt, Human
ugaaugaauuucugauguuugaggcuauaaauauaauuguuuuuauacaaaaggauaauuggcauuuguaggcauuugcuuuuggaaauguauuua

SEQ ID NO: 4170281 - RNA, 77 nt, Human
ugaaugacucuuuuguuuagacauuuaaggaagaaccuauugguguucauuuagcaugcuaaaccugaguguuauca

SEQ ID NO: 4170282 - RNA, 67 nt, Human
ugaauggcuuauggguccucccucuucccugggcuugcacugaagagggguggucugugaggauuua

SEQ ID NO: 4170283 - RNA, 71 nt, Human
ugaauggguauauagauacauuagguaacuuguggaaguccauauuacauuuguuuaucuacaucuauuua

SEQ ID NO: 4170284 - RNA, 86 nt, Human
ugaauggucucucacucuagguaacacaacuaauucaaaugcaauguuaggagaguuguuuuugccuagaugaaauaagaucuuua

SEQ ID NO: 4170285 - RNA, 94 nt, Human
ugaaugguuacgaugauuguucucugugcuuuugagaggaaggacuaaguccugugggugaaaguuacaggaaaacagauuucggaccaauuua

SEQ ID NO: 4170286 - RNA, 74 nt, Human
ugaaugguuugugucuucaggcaaucucauuauucuccccaaagcagaagugcugaaugaagacacaaacuuca

SEQ ID NO: 4170287 - RNA, 82 nt, Human
ugaaugucagcagugugcccagaggcuggauccauggaaugggaaccaacagcugaacugugcaugcuuacagcugacauca

SEQ ID NO: 4170288 - RNA, 57 nt, Human
ugaaugugaaaaaugccuuccgugacaucauccuuacaggaacauucuuuacauuua

SEQ ID NO: 4170289 - RNA, 72 nt, Human
ugaaugugcuauuacacauuuauuuauguagugcuaacaagauaaauguauguguaaaaagcuagauauuua

SEQ ID NO: 4170290 - RNA, 129 nt, Human
ugaauguuucuuccaugccuauaccugugcuaugcauaguggaauuagcaaaacuuaugacauaauccaaaaccugagguuuauaaucccauuuguaaagucaaggcauacaccacuggaaugacaaaa

SEQ ID NO: 4170291 - RNA, 57 nt, Human
ugaauguuuguucugcugauggguugaaucaucucuucacaguuggccaggcauuua

SEQ ID NO: 4170292 - RNA, 58 nt, Human
ugaauucugaaauaaauguguccuccaauuuguugggggagcauaaacucagauuuca

SEQ ID NO: 4170293 - RNA, 62 nt, Human
ugaauucugggucagcagcuugcaaugugccccauguaagcauguuaaugacucaaaguuua

SEQ ID NO: 4170294 - RNA, 78 nt, Human
ugaauugaaguacauucaaacgauuuauugauugaauuaucuuuaaucauucaaaugauuuggagguacugcaguuua

SEQ ID NO: 4170295 - RNA, 65 nt, Human
ugaauuggagccccagaagcaagguuaaagugaguuacuacugaguuucugguguuccuaacuua

SEQ ID NO: 4170296 - RNA, 81 nt, Human
ugaauuggcagaaauguucagcgagggaugcuagggaacuuccucucugucuccuuauucugaauugucaugccuauugca

SEQ ID NO: 4170297 - RNA, 103 nt, Human
ugaauuggcagcugcagaauguuugaaucaaagcugaaguuuucaaagagaaugacuaugggauucugcaguuuugauuuuaauauccugaaaaugcaaauca

SEQ ID NO: 4170298 - RNA, 102 nt, Human
ugaauuucagaugaauaaugaauaaugguuuaacauaugcuugagucaaauauuacaugggacaugguuauacuaaaauauucguuguucaucugaaguuca

SEQ ID NO: 4170299 - RNA, 60 nt, Human
ugaauuuuuuucagcauuuccuuuuaaagagguuauaaaguuaagcuguaaaaggauuca

SEQ ID NO: 4170300 - RNA, 68 nt, Human
ugacaaagcccagggaauggucgggagagacugguagauccagcacuccuauuccuugaggcugguca

SEQ ID NO: 4170301 - RNA, 86 nt, Human
ugacaaauugcauuguuauagcauuacacaccauagaccccauuuugaaugggaggugugaaauguucaguguuacaaaugaguca

SEQ ID NO: 4170302 - RNA, 66 nt, Human
ugacaacaucuuaagauagaaggggaagcuguguaagacaguaagucucuuuccuugagaugguca

SEQ ID NO: 4170303 - RNA, 90 nt, Human
ugacaaccauaaauacuuaguuuugugucuaauucaguuaaguguucuuguuuguucauggaccagaaaaaaaguuuucguguguuuuca

SEQ ID NO: 4170304 - RNA, 110 nt, Human
ugacaacugugaaacacaaugcuucugagggaauuacagcauauuacuuuuugcuuuauuuuauuuaaucuucuguuucucuccucaggaaguguuauuuauuauccuca

SEQ ID NO: 4170305 - RNA, 57 nt, Human
ugacaagauagauugaguuuuacaucaguaauugacacucgagugucuauuuuguua

SEQ ID NO: 4170306 - RNA, 55 nt, Human
ugacaagguuggagagguucacucacuuuagagggauuuacacaccugccuguca

SEQ ID NO: 4170307 - RNA, 86 nt, Human
ugacaaugauuuccccuacacagaagaaacagaagaaaccauuuuuuuaugaccugaagcuucuguugcaguaugaaaucauguua

SEQ ID NO: 4170308 - RNA, 58 nt, Human
ugacaauugugggcaguuugugugaugcuguguggcagaaacucuaccucaaucguca

SEQ ID NO: 4170309 - RNA, 66 nt, Human
ugacacaagagcccuguuugcugauuuccuuugaucaucuuuucaguaucaaagggcaugugguua

SEQ ID NO: 4170310 - RNA, 64 nt, Human
ugacacaagaugcugaccucuugaaaucccuuggauggaccauuucaaagagugggcauuguca

SEQ ID NO: 4170311 - RNA, 55 nt, Human
ugacacacagggggauggaguugguccuuguccauucucucacccuugcugugca

SEQ ID NO: 4170312 - RNA, 63 nt, Human
ugacacagaaauuaagcugucaacaucuugaucauucaaaagcggucauugaucuuuguguca

SEQ ID NO: 4170313 - RNA, 75 nt, Human
ugacacaggaggagagggagcacccagggaaguugugucugggaaagugugcuccccuccagaccuuuagugcca

SEQ ID NO: 4170314 - RNA, 75 nt, Human
ugacaccaagucugaucauuucuucuauaugcugcuguuucauauaugaggaaucugguacagaauauauaguca

SEQ ID NO: 4170315 - RNA, 63 nt, Human
ugacacugaauaauugagaguugauuguguuuaggaagaucaacaaucccaugguucaguuca

SEQ ID NO: 4170316 - RNA, 80 nt, Human
ugacacugugaaaguuacagaaaccauuagugagaugccuuucucaguauuaugcuaacugcagcuuuugcgaguguaca

SEQ ID NO: 4170317 - RNA, 117 nt, Human
ugacagagagagggcaaguuuagugagauccaugcaacaccugccuuguggaggggaagcagggcugacaguggcguggcguugagcuaaguuuagcugccugugugaucucugcca

SEQ ID NO: 4170318 - RNA, 58 nt, Human
ugacagagccaagaucaguacucaaauaaucuggcguuagaccuggggcucuuaguca

SEQ ID NO: 4170319 - RNA, 68 nt, Human
ugacagcccuuccaggcagaauucuagcacaugcuuauggguuaggauccuguauggagaagcuguca

SEQ ID NO: 4170320 - RNA, 58 nt, Human
ugacagcuuggacaggucccucuucccaggaaugcgaggcuccuccucucagcucuca

SEQ ID NO: 4170321 - RNA, 58 nt, Human
ugacagguucguuagucauguugcugggauaauacaagcuacaaucugaaaccuguca

SEQ ID NO: 4170322 - RNA, 78 nt, Human
ugacagucuucccugugccagaguguuuaauaagaccuaaugaccuuuacacacuuuggagggcagggagagacacca

SEQ ID NO: 4170323 - RNA, 56 nt, Human
ugacaguuugcuuucgacuggagaaaaauaagaaaucucccaggaagcaaauguca

SEQ ID NO: 4170324 - RNA, 65 nt, Human
ugacauccugaagucagucauuugagggcuuccaacuccagcagaaaauugcccuucagggguca

SEQ ID NO: 4170325 - RNA, 94 nt, Human
ugacaucuaauaaguuuucaauauaugauagugaugggaguaguaguuguugaguuuguuauuauuauguauuuaggacauuaaacagguguua

SEQ ID NO: 4170326 - RNA, 82 nt, Human
ugacaucuaugacaaaauuagcugcaaaggauguuaucuaccuugaugauuuccaguuguugcuaagauuauagauuuauca

SEQ ID NO: 4170327 - RNA, 60 nt, Human
ugacaucuuauacaagggaauaugugcacauaugcauuucuucaaaguguaugauaugca

SEQ ID NO: 4170328 - RNA, 130 nt, Human
ugacauguaaaauccagucauagcuuggguuucccggaagcagucccugagacagagauuuuagugcaacaguuuauuugggaggcgauccugggaaacaccagaagggaaguggaaaauugaaaugucg

SEQ ID NO: 4170329 - RNA, 62 nt, Human
ugacauguaagauggaaaagcgcaacuugaugugauuaguguucccuucuuagacuauguca

SEQ ID NO: 4170330 - RNA, 55 nt, Human
ugacauguauguauuuguuuauggauuaaaaaauagaugaaugacuuauauguca

SEQ ID NO: 4170331 - RNA, 87 nt, Human
ugacaugucaacguaaguucaccaguuguaauaaguguaccacucugaugggugaucuuaauaauaggugaggcuauguauguguca

SEQ ID NO: 4170332 - RNA, 64 nt, Human
ugacauucacagguaaacauuccaucaaucaggguaucugaggagaguuagaccuguguuguca

SEQ ID NO: 4170333 - RNA, 65 nt, Human
ugacauuuaagccucugauuuccauuugguacauauucuggugugagaagugagguauagaugca

SEQ ID NO: 4170334 - RNA, 64 nt, Human
ugacauuuugcauuaguuugaaucacauaugaaaucacauguguucaccaaaguguagaaagca

SEQ ID NO: 4170335 - RNA, 73 nt, Human
ugaccaaaugucucacaggaagaggugucuaucucuuuccgaaagagaauuccuccucugggacacuugguca

SEQ ID NO: 4170336 - RNA, 69 nt, Human
ugaccaccccuguccuuccagccgaaaucuaaggccucacuuggagauaggcugaggcagggcugagca

SEQ ID NO: 4170337 - RNA, 58 nt, Human
ugaccacuggacagaggaaauauggaggaccaccuccagauuccguuuauucagguca

SEQ ID NO: 4170338 - RNA, 62 nt, Human
uggggacuugagccaugcagucaucccucuagaaaagacugcagggcaaguuagagacccca

SEQ ID NO: 4170339 - RNA, 88 nt, Human
uggggagacaguaccauggaaggcuuuaugacucaaagcguacaccuugaccugugagucagaauuccuuucuaaggguuguccccca

SEQ ID NO: 4170340 - RNA, 58 nt, Human
uggggagaguuacaaggaaucuucuuaaggaugggggagauuauaaagaaccuucuua

SEQ ID NO: 4170341 - RNA, 56 nt, Human
uggggagguaugaggaacuuugaggaacccagaccuucugcuggcauacugcccca

SEQ ID NO: 4170342 - RNA, 77 nt, Human
uggggauaauauuuguacuagcucaggaggauuuaauuagaugagugcuccaaagguuggucauuguuauuuugcca

SEQ ID NO: 4170343 - RNA, 101 nt, Human
uggggaugggcaucccacuugugaauugggcaguccacagucccagagcuaaugagcuuagguuggaugaggcuggguuaggcagguaggaaccaaaacca

SEQ ID NO: 4170344 - RNA, 68 nt, Human
uggggauuucuucucauaacugagaccaaaacaguuuugugcagucucagaaaugacaggagguacca

SEQ ID NO: 4170345 - RNA, 78 nt, Human
uggggcaggugaacugcugaguuuuaucaucucugcacagugacaugauugaugcuggguuguucccuuuugacccca

SEQ ID NO: 4170346 - RNA, 110 nt, Human
uggggccaguggacuuuccagugggccuuagaagguucccucuacuguaggagagugucagaggagcugggaggcccucguuuaaugacugagaagagauuccaccccca

SEQ ID NO: 4170347 - RNA, 76 nt, Human
uggggccauuuccagcuccugcaucauggggccuccuuguccccuuucccaugaccaggcccugaaaaugcuccca

SEQ ID NO: 4170348 - RNA, 55 nt, Human
uggggcgcgcggucccucccgcaggucuccgagggagccaggaccucgcgcccca

SEQ ID NO: 4170349 - RNA, 89 nt, Human
uggggcucaggggcuagggaacaagaugcccaggggacaccugcgugggacuccuggcuccucugcucaccuagcugccccaagcccca

SEQ ID NO: 4170350 - RNA, 65 nt, Human
uggggcucuagucauugccagaacacugaaguauuuucacaccagcugguaaagacuguccccca

SEQ ID NO: 4170351 - RNA, 61 nt, Human
uggggcugaaaauauagauaaaggucagaguguggaagaccuuaucugucaaucugucuca

SEQ ID NO: 4170352 - RNA, 62 nt, Human
uggggcugaugggagcuggcucaccccgagacacuuggggagugacaccaccccucacccca

SEQ ID NO: 4170353 - RNA, 57 nt, Human
uggggcugcugugguuuacaccauugugggcacaauggaggccaugccagagcccua

SEQ ID NO: 4170354 - RNA, 59 nt, Human
uggggcuugaaaauucauagguauuugcauccagaugccuagagaagcuucaacuccca

SEQ ID NO: 4170355 - RNA, 79 nt, Human
uggggcuuuggggaggggauuaggcuaugaggguaaagccuucaagacugcgacuaaugcccuuguaaaagaggcccca

SEQ ID NO: 4170356 - RNA, 70 nt, Human
ugggggacccucaggacugcgucuccaggucucggaagggaggggaccgguggcuuccucggguccccca

SEQ ID NO: 4170357 - RNA, 73 nt, Human
ugggggcagcucccuuaggccuugccgggagauaacagguguuuccaguugcgugagggugcugaggccccca

SEQ ID NO: 4170358 - RNA, 57 nt, Human
ugggggccucaugaggucuuuucuguuuucugugaagaaccucacgagauuccuuca

SEQ ID NO: 4170359 - RNA, 58 nt, Human
ugggggcugagggguaucucaugggagaaugccaucccugcugucaucucagcucuca

SEQ ID NO: 4170360 - RNA, 59 nt, Human
ugggggcugggaugucacuuucaugguuccccuauuuauaacaagugauucagcccuca

SEQ ID NO: 4170361 - RNA, 75 nt, Human
ugggggcuguguacccacgugggcaccccgcgcacaggcagugcggcguccugcuaggugcacagcuuuauacca

SEQ ID NO: 4170362 - RNA, 56 nt, Human
uggggggaagauggauguuaaguuaauucuuagaucugaaaaugcucuucuucuca

SEQ ID NO: 4170363 - RNA, 59 nt, Human
uggggggagccagaauucacaaucugauuuuucugauuccagagucuguguucuuucca

SEQ ID NO: 4170364 - RNA, 97 nt, Human
ugggggggggcuuuccaaguaaugucucuugagaggcgaaacagcuugguaguugaaagcacaggcucaggaacagacuugcugggcucaaauccca

SEQ ID NO: 4170365 - RNA, 56 nt, Human
uggggguacccauuugucgccagugucgggaaacacaguguguucugggaccucca

SEQ ID NO: 4170366 - RNA, 114 nt, Human
ugggggugauggucguaaguggucagauuccagggcuguuuugaaaacauccucagcaacaucaaggacagauuucaaggccuucugguucaguccacuccagccucagaucua

SEQ ID NO: 4170367 - RNA, 60 nt, Human
ugggggugcuauccuuuugacauaaucugaaccuaauuacuuccaaaggacccaccucca

SEQ ID NO: 4170368 - RNA, 97 nt, Human
uggggguggggguggagggguaaccugggggcgucugggcugaagggauugacagcuccuggcucgcugaccucaggggccuccuucccacucucca

SEQ ID NO: 4170369 - RNA, 93 nt, Human
uggggucaggcaauucucugcagagcaauucucaaggaggugucuuagcuugacuugccccagaauugcugcuggggagucccagcugcccca

SEQ ID NO: 4170370 - RNA, 63 nt, Human
ugggguccauccccagggggcugcuccuuggaucuggagcuggccacuggagguggcacccca

SEQ ID NO: 4170371 - RNA, 66 nt, Human
uggggucuggucaucggaaagaucaaagcaugaugagaugguuggagcuuucagugccacccucca

SEQ ID NO: 4170372 - RNA, 90 nt, Human
ugggguggagaguucuguagaugucuauuaggucugcuuggugcagagcugaguucaauuccuggauauccuuguuaacuuucugucuca

SEQ ID NO: 4170373 - RNA, 126 nt, Human
ugggguggccugagacuucagagcacaaaucacaucucugagggcguccuuuagggugaugacuacauuaaccacagagcccccucagauggcuguguugguuugaagaagucagaguccaugcua

SEQ ID NO: 4170374 - RNA, 100 nt, Human
uggggugguguggaggguucagaaggugcagccugggccccccaugacauucccugcugggggcgccaggccugcucucuuuaccucuagcagagccuca

SEQ ID NO: 4170375 - RNA, 77 nt, Human
ugggguguccauguuuguugcaugucccaggguaugugcauguggagucugacaugugagcaagcgugcggccccug

SEQ ID NO: 4170376 - RNA, 70 nt, Human
ugggguugguggggaggaagcucucaguuccaagucuuuacuuggcacagaccuuaucuucucugcccca

SEQ ID NO: 4170377 - RNA, 69 nt, Human
ugggguuuuucuucaauugcuaacaaggaagaaugcaguaucuucuuuaucaggugaagagggacucca

SEQ ID NO: 4170378 - RNA, 81 nt, Human
uggguaagaugcuuuucuagaaacauuaucucuauaaaguuuucuguguaaggugaauuucugggagguuaaucuggcuca

SEQ ID NO: 4170379 - RNA, 93 nt, Human
uggguacaucaaaucagcuugcaaauaggggacaacucuuugcugcuuaucccucuuccucagcacagaccuauggcagcugccaugaaccua

SEQ ID NO: 4170380 - RNA, 62 nt, Human
uggguacccccuucugugucuguccacagucccugugucuuuccuacaggaagggguucucg

SEQ ID NO: 4170381 - RNA, 59 nt, Human
uggguagagugcugacaaugccugcuccuggcugggguacaugugucaguucucaccca

SEQ ID NO: 4170382 - RNA, 130 nt, Human
uggguaguggagagaaggaagaggagugaccugguuuugauuaguuaauucagauuagggaguaaauucugauuucacagcugcuguucagguucaauggcacuaccaauuuuuccauuuccaguuccca

SEQ ID NO: 4170383 - RNA, 83 nt, Human
uggguauagaguuucaguuuugcaagaucaaaauaauucuggagaaggauugcagugaugguugcauaauaugaauguacuua

SEQ ID NO: 4170384 - RNA, 75 nt, Human
uggguauauccugcucacagcgugaugaauguagcguuaucaucaguaauguaauuauuaacaccugugcuccca

SEQ ID NO: 4170385 - RNA, 112 nt, Human
uggguccaacauuguuuucuuugaagaucacauguugcucuucucuuuuugguggacgccagagucuuccgggggacagugacuucaagugacuuagagacaaucagaucca

SEQ ID NO: 4170386 - RNA, 74 nt, Human
ugggucggugcaaaaguaaucacaguuuuuagcauuauaauggcaaaaacugcgauuacuuuugcaacaaccca

SEQ ID NO: 4170387 - RNA, 71 nt, Human
ugggucuaaauuuagaguguucacucugagcugauguaauaagcucaaagaauauucagaaugaagaaaca

SEQ ID NO: 4170388 - RNA, 66 nt, Human
ugggucucugugcccccauuuccguuucagagcuguugggcuuaugugugggaggucagagagcca

SEQ ID NO: 4170389 - RNA, 65 nt, Human
ugggucucuuuuauggugaguugaucuuugagugagaggacacacuugcagagaggagggacuua

SEQ ID NO: 4170390 - RNA, 86 nt, Human
ugggucugaagacugcugagaaguuacucccaagacuuugcucuucuucugguaauuuaaucuucuuagcucuucuucauaauuca

SEQ ID NO: 4170391 - RNA, 70 nt, Human
ugggucugucaaaaguuuucaauaaacuaccuuuucugaacccaguuuauuuugaaacaugauaagccca

SEQ ID NO: 4170392 - RNA, 55 nt, Human
ugggugaaaauuuugguggcacucuuaucccagaguuagccagucuucucaucua

SEQ ID NO: 4170393 - RNA, 61 nt, Human
ugggugaaucaaugaauugcacuucaacagcaaaauuggauuguauugauugguuggcuca

SEQ ID NO: 4170394 - RNA, 70 nt, Human
ugggugagaaaaaugaguaugauuuugaggaagaacugguaugcccauaauuuugcacuuuucucaucua

SEQ ID NO: 4170395 - RNA, 62 nt, Human
ugggugcaagaaggggagacuggguacaaaagcuugagcucauuucuguuucuugcaacuua

SEQ ID NO: 4170396 - RNA, 59 nt, Human
ugggugcaggaaaauuaccuggaguacuggcaggugcccagaagugauccugcaugcua

SEQ ID NO: 4170397 - RNA, 81 nt, Human
uggguggcagagggagagaaggaggaggauuugacccauuuacguuaaaucucaugagcuucuugucccaacaauuaccca

SEQ ID NO: 4170398 - RNA, 58 nt, Human
uggguggcauguuuaugucagaauagauguggucuauuuuuccuggaacagucaccca

SEQ ID NO: 4170399 - RNA, 72 nt, Human
uggguguggcaguuccgcacugaccucggugcauuccugcucuggagucuagcaugggaaaaucacagccca

SEQ ID NO: 4170400 - RNA, 66 nt, Human
uggguuaggcagugugguauagcagauaugugguuaacaucauugcugugucauuuguuuaaucug

SEQ ID NO: 4170401 - RNA, 57 nt, Human
uggguuagggccuggucucugagaagucacuucuuccuggaacuuggccuuuaccca

SEQ ID NO: 4170402 - RNA, 102 nt, Human
uggguugagggguacagcuggcaggggggcaugaauaacuuuugaacacaucuauacaaguuacuuuaagccacaagccccgcucauugcugccucaaccca

SEQ ID NO: 4170403 - RNA, 57 nt, Human
uggguuggucagcauaagauggccaggaagguggaaaucaggacugcuggcaaucua

SEQ ID NO: 4170404 - RNA, 70 nt, Human
uggguuguagcacuggaugggcugguacauggaguagaaucaguccuuggcauuuaggagcuacaagcca

SEQ ID NO: 4170405 - RNA, 62 nt, Human
uggguuucuugauuagcuguggcucagcugaguuuggcugggcuuagguucaagugggcuua

SEQ ID NO: 4170406 - RNA, 81 nt, Human
ugguaaacauuuauuuucagcugggaaaucugcuauuaauucauauagugacuuucccagcugaaauaaugagucaagcca

SEQ ID NO: 4170407 - RNA, 70 nt, Human
ugguaacaggaugauaaaggauggccaaggauaaaccuuaacuuuuggucaaaccaguuaucuguaauca

SEQ ID NO: 4170408 - RNA, 109 nt, Human
ugguaagcucagcacacauaacugaauuucucuuuuuacguuuuugcaccucagccuguccaauugugcaaagaaggggaggaggauuaaauaugcaacugaguagcca

SEQ ID NO: 4170409 - RNA, 59 nt, Human
ugguaaggcccagcuggaguccuuuaaucacaggauucaagaggggaugggccuuagca

SEQ ID NO: 4170410 - RNA, 55 nt, Human
ugguacauggguagguaucucuucuugacuagaagacaauccuacaaauguggca

SEQ ID NO: 4170411 - RNA, 58 nt, Human
ugguaccagcuucuuuggguuucuucgguagcaggguggagucagguggcuggugcca

SEQ ID NO: 4170412 - RNA, 130 nt, Human
ugguaccagggaaaaauaaaugucuuaauguguucuucauguauuuugaugugccauagguauguauagaagcuaagcauuucacaguauauucaaaauuuuugcagaaggcauuuuuucuguggugcua

SEQ ID NO: 4170413 - RNA, 130 nt, Human
uggggccaugucuagaugcucacucugaauggggcaggcccagagcucugggggagcuagaguccuugcuugucggccugcuaggcucugggguacugccucccaguguuccggagugucacaggccuca

SEQ ID NO: 4170414 - RNA, 76 nt, Human
uggggccgagugaguggagacucaucacguccagccuccuggaggcugccugggagcccuccucuuccucgcccca

SEQ ID NO: 4170415 - RNA, 99 nt, Human
uggggccugcaggggacagagccugguggacacugggcaucauggaacugcccagcugauggccuuuuucaccaggcuccaguccugccucuagcccca

SEQ ID NO: 4170416 - RNA, 57 nt, Human
uggggccugugacggguccagagucacagagcuacggaucagcuucacugggcccca

SEQ ID NO: 4170417 - RNA, 80 nt, Human
uggggccuugcaacucuaaauguggucugcagauaugcaguguccguguugaugaccacaauuuaugcugccagucccca

SEQ ID NO: 4170418 - RNA, 80 nt, Human
uggggccuuuaagagcugauuaagucaugaggguugagcccuuaugaaugggauuaguucccuuauaaaagaggccucca

SEQ ID NO: 4170419 - RNA, 63 nt, Human
uggggcucaccuaggcuggaagcaucaagaaguacacgugguugagaucugggugaugcccca

SEQ ID NO: 4170420 - RNA, 116 nt, Human
uggggcucugccacucugcuuuauuggaacggcuccgcgucugagagcacagcaggcucaacccugcuucagaguggaggccggaccaggcuggugggugaccagcaggacucacg

SEQ ID NO: 4170421 - RNA, 77 nt, Human
uggggcuggggaaagggauggcucccgccucggggcagcaugggcuggcuggggaagccucgcuuuucccggaccca

SEQ ID NO: 4170422 - RNA, 76 nt, Human
ugggggaaugcaaggguuuggcuggagaggucuagcccuuauguauacuccagacagaucuucuagcagguccuua

SEQ ID NO: 4170423 - RNA, 56 nt, Human
ugggggcuaaaacaaguuugcuuagcuauagcuacagcuugccaauuagccuuccg

SEQ ID NO: 4170424 - RNA, 71 nt, Human
ugggggcugcuaaagcuguucagugcagaaaggaaaucuuuuccucugaacagacuuuaaauaugucccca

SEQ ID NO: 4170425 - RNA, 72 nt, Human
ugggggcuucacccuccccuacaagcagcccuuaaccaaugagugacaggggcugguggauaaaugucccca

SEQ ID NO: 4170426 - RNA, 63 nt, Human
uggggggagagugcuacuggcaucuagugguuagaggccagggaugcugcugcacauccugca

SEQ ID NO: 4170427 - RNA, 56 nt, Human
uggggggauacuugcuacuggcauucaaugggcagguggcagaguugucccaccca

SEQ ID NO: 4170428 - RNA, 84 nt, Human
uggggggccuugggccugcacacuuaagcuugcugcuaucccacggagggcagcuggaagguggcuucccuggggcccagccca

SEQ ID NO: 4170429 - RNA, 75 nt, Human
ugggggucaggcuaugccaugugagcccugcugcauucuacaugccucccagccacuggcaaagccuguuccuua

SEQ ID NO: 4170430 - RNA, 75 nt, Human
uggggguuccgcuguacuucccguaucacccuccaaaccccacaugacacagggcaugcagcagaacccaaccca

SEQ ID NO: 4170431 - RNA, 65 nt, Human
uggggguugcuggcauuccuuggcuuguggcuguaucaugccagucuucaaggccagcaucuuca

SEQ ID NO: 4170432 - RNA, 70 nt, Human
ugggguaacaucuuuuacucugguucggguuuaaaagaauccaggugacagagacaggauaccugcccua

SEQ ID NO: 4170433 - RNA, 90 nt, Human
ugggguaagcacaagacuguggccugcuguaugggcucagccuguaguuggggccccaggaaggucaggccgcuccugcagcuaacccca

SEQ ID NO: 4170434 - RNA, 55 nt, Human
ugggguagggaaaagaagucgaguccugauggccaucuucuuuccucugcaccca

SEQ ID NO: 4170435 - RNA, 67 nt, Human
ugggguaugugcuguuucuuugugcccagguagcccccuguacuuccccaaugacagcacuauucca

SEQ ID NO: 4170436 - RNA, 91 nt, Human
uggggucagauuccucugugaugggcucugcagcugagugccccucccucacagcaucaucucagggcgacaucaugugggaucugcccua

SEQ ID NO: 4170437 - RNA, 58 nt, Human
uggggucaguagcaaauacagcugguugaagccaugucaugaaaugcuacuaacucca

SEQ ID NO: 4170438 - RNA, 130 nt, Human
ugggguccucagcuacugcagauucucccucgucccgggccaggaagcgccacucggugaucugcagcauggccucccgggccuggcugauggugaauggaaugcacugcggaggcgagagaggaucuca

SEQ ID NO: 4170439 - RNA, 100 nt, Human
uggggugaaugccaauggaauauuaugaucgugacucaaggauuaguuuccacaguggagucugauucauagccuacauauuccacuaacugguaccgua

SEQ ID NO: 4170440 - RNA, 76 nt, Human
ugggguggccucuggaagcugaaaaaaagcaaggaaacagauucuccuuuacagccuccagaaggaacaagcccua

SEQ ID NO: 4170441 - RNA, 67 nt, Human
uggggugggacucuuuggccugagcacuaaaucugaucuauugcuugaugucaucuggcccauccca

SEQ ID NO: 4170442 - RNA, 57 nt, Human
ugggguuugccaacucuuguccaggaaccuauugggcuagaguggaggggaacugca

SEQ ID NO: 4170443 - RNA, 94 nt, Human
ugggguuuuuuuguguguggugacaggacguacaggcaauucuuucuuucauguguuugccuucuggcaucacucgcaagagcacuuagcccca

SEQ ID NO: 4170444 - RNA, 71 nt, Human
uggguaacugcagaaugugccucagaauuguccacuugagauggagcuggggagaguacuguauuuaucca

SEQ ID NO: 4170445 - RNA, 65 nt, Human
uggguaaguaacuggcuggauuuagggggcuacagaaggccacugaacauuagagcuagugccua

SEQ ID NO: 4170446 - RNA, 56 nt, Human
uggguaccuugugagggaggagaugaaauucuaaguccagcucucauaguguucca

SEQ ID NO: 4170447 - RNA, 130 nt, Human
uggguacggauaaucuuuguucuuaaauaagguuuagacagcagagaacuuuagaggguggcuguuagcccguuagccuuacguaagacuuugcugugaaccuuuuaaaguuuuuaauucuucuggcaca

SEQ ID NO: 4170448 - RNA, 64 nt, Human
uggguagacauuuggcaugguuuucaaagccuccuuuuuagagccaguuacaaggucaagccca

SEQ ID NO: 4170449 - RNA, 63 nt, Human
uggguauacauagguaacaacaugguuaugcaauuuuuauguaugcuugaguguguauacuca

SEQ ID NO: 4170450 - RNA, 72 nt, Human
uggguauauugcaugaugcucaaguuuggaguauagauggucccaucacccagauagugagcauaguaccca

SEQ ID NO: 4170451 - RNA, 103 nt, Human
uggguaugauuuuccuggaaaugcauguaacaguguuaugaacucauucuuaaaagaguucaugccuuuugauguaauaauuuuacuucuaggaauauauuca

SEQ ID NO: 4170452 - RNA, 76 nt, Human
ugggucacacguuaacaaugguuuccauuggaguacuuuuauuugagaaauucuaguguuuccauuacaagaccua

SEQ ID NO: 4170453 - RNA, 110 nt, Human
ugggucauguaauuguagcgaggugacagaguuuuagaucucauaagcaagucauuuaaauugugugagccucagauucuucaucucuaaaacagagaaaauaauaccua

SEQ ID NO: 4170454 - RNA, 67 nt, Human
ugggucccucaggaaacagaaaucuuauuguuugguagaaaacaucuuuuuguuugcugaaauccua

SEQ ID NO: 4170455 - RNA, 59 nt, Human
uggguccucuggagcagcagcaggacuauuugucuuuugaaaaugccccagcaggccca

SEQ ID NO: 4170456 - RNA, 79 nt, Human
ugggucucgugggcuugggacagcaacgguucuguuuagucagcuggugcaggugguuggcccagccgaugagaacuca

SEQ ID NO: 4170457 - RNA, 79 nt, Human
ugggucugcagcagggccugcuucuucagggcugccucgacccuucucucugccagcugcaggcccaugcucaguccca

SEQ ID NO: 4170458 - RNA, 70 nt, Human
ugggucugguuuccauuuggagcucgcagccuggcacccagcuugacagacagaugguagcaaaggccca

SEQ ID NO: 4170459 - RNA, 100 nt, Human
ugggucuuuccauggcuaacugcugugacagcugccguguuaagaauggcaggagccucuaaacagcaagcuguccagugaaaggaggugggaaggucca

SEQ ID NO: 4170460 - RNA, 70 nt, Human
ugggugaaucuugugcuggaaaagguuccugaaaggaagccccugucaucuuguccagccaggcaacuca

SEQ ID NO: 4170461 - RNA, 60 nt, Human
ugggugacuuauauugagcccagcccugguuaaguugcaaagagucauguaagucaccca

SEQ ID NO: 4170462 - RNA, 57 nt, Human
ugggugagcggggcugggcaccaggccccucuggugcuggcuuuuaucuggucccua

SEQ ID NO: 4170463 - RNA, 62 nt, Human
ugggugaugcaugccauagaacuugaaagaacucuuccaggcaguucucgugugugucccca

SEQ ID NO: 4170464 - RNA, 58 nt, Human
ugggugcaggacgccuccgcuccacgccugggugggcuggagacaacguccugcccca

SEQ ID NO: 4170465 - RNA, 79 nt, Human
ugggugcgcucaccuuguccugcagccucucuuccccuuggugguggggaaggcggugcuguggacagugacuaacuca

SEQ ID NO: 4170466 - RNA, 78 nt, Human
uggguggcagaagaguaggaugggcacacgcauuuuuaucauaucugcuuaccugacugcccuuucuucuuccaucua

SEQ ID NO: 4170467 - RNA, 57 nt, Human
ugggugggaaugggcacacacucccugagccccauuguuuaaggccauuuccaccca

SEQ ID NO: 4170468 - RNA, 90 nt, Human
ugggugggaugaaggaaagacauauaaaugacuucuuucugcuguggagucaaaacauguacuuuccuuaaccucauuuacacccaccua

SEQ ID NO: 4170469 - RNA, 58 nt, Human
ugcuguuuucccauagcuggucauucucuguuuggcugaaugcuaaaggaaaacagua

SEQ ID NO: 4170470 - RNA, 68 nt, Human
ugcuuaaaauugagaguuauagaugguuucaucuuuagaccgugucuuccaugaccucaauuaccgca

SEQ ID NO: 4170471 - RNA, 56 nt, Human
ugcuuaaacauccagacaguaugauguuuucuaagcaucuaucugaugauugagca

SEQ ID NO: 4170472 - RNA, 77 nt, Human
ugcuuaaguguugaucucugacuuguuuuccaaauaauggucauuuuuucaugguucaaucaguuggcauuugagca

SEQ ID NO: 4170473 - RNA, 85 nt, Human
ugcuuaauauguguuauccacuguaauaucauuguggugaggguguaaauaagaucaggcguggaaaacacugaacacuuaagua

SEQ ID NO: 4170474 - RNA, 103 nt, Human
ugcuuacaauauaaagcuuauucugucagaucuuacuggauaguuuacuuuuuaacauugagaauauugugacagugugagugugcguguguuucuguaugca

SEQ ID NO: 4170475 - RNA, 60 nt, Human
ugcuuagucuauugugugcccagcuguuauccauugccucacacaguagcaauuagugca

SEQ ID NO: 4170476 - RNA, 64 nt, Human
ugcuuagugagugucuaccaugugccaggcaccguguuagguguugggaguacaaucaugagca

SEQ ID NO: 4170477 - RNA, 55 nt, Human
ugcuuauuaacauguauaucucauauaugugugggagaaacucugggaaugagca

SEQ ID NO: 4170478 - RNA, 83 nt, Human
ugcuuauucugucucauugucaggcuucacuugaugucaaagaacaugaagugaagaaauacaugagaauuuucaggaaggua

SEQ ID NO: 4170479 - RNA, 76 nt, Human
ugcuuauuugaauuuauucucauaaggggauuuuagauggcauaguuuagaaaagagagaaugaauuuaaguagca

SEQ ID NO: 4170480 - RNA, 109 nt, Human
ugcuuauuugaguaguaggaaguaaacagauaagaaaucugaauaauccauaaugcaaacuauucccugaugccaucuguguguuuacuauuuaucauuugaagcugca

SEQ ID NO: 4170481 - RNA, 62 nt, Human
ugcuuauuuggcaaauaugguuggcacugcuagauguugaaaaacauguaugcaaauaagca

SEQ ID NO: 4170482 - RNA, 61 nt, Human
ugcuucaagccgcuuucugcagauuccuauuaucuuuaccucugcucaguggcuaaaagca

SEQ ID NO: 4170483 - RNA, 59 nt, Human
ugcuucauggaacuguauaaaggcacuugcuacauaggcuaguggcagaucuggaagua

SEQ ID NO: 4170484 - RNA, 62 nt, Human
ugcuuccaauggaaucaugucuugauaacuacuguuaagcaacaagaaucccauuggcccca

SEQ ID NO: 4170485 - RNA, 73 nt, Human
ugcuuccugaucaacuuguuccucagugacaccaaacaucaaugacucaggaacauaaugugagucaggagca

SEQ ID NO: 4170486 - RNA, 97 nt, Human
ugcuuccugccuguuuuuguugcagagaggccacuuucgcuuuuuaguauuauuuagucuaagucgcacuguuuagcaauaagacaggcacguugca

SEQ ID NO: 4170487 - RNA, 56 nt, Human
ugacucauucccauccaggaggaaauaauucagccucuggaggagaggaaaaguca

SEQ ID NO: 4170488 - RNA, 86 nt, Human
ugacuccagcuuagcuguuuuugucugcugauccugguuguugagcuuguggacacugacagacagaaagggaccugcugguguca

SEQ ID NO: 4170489 - RNA, 58 nt, Human
ugacucuacacuguagaauuauaaggaccucaagccuuggcaagacaguggaggguca

SEQ ID NO: 4170490 - RNA, 66 nt, Human
ugacucuccuugcauuuccagguuaccuuuuggggaggaauguggcaaucuucaaguuauggguca

SEQ ID NO: 4170491 - RNA, 81 nt, Human
ugacucugagaggaggaggagaagguuucagagaaggguaguugaauggcuggccuggacuuucauuuccccuugggguca

SEQ ID NO: 4170492 - RNA, 67 nt, Human
ugacucuguuuccuugcuuccugccuucugaggauuugaagacagugcccaaaggaacagaaaguca

SEQ ID NO: 4170493 - RNA, 56 nt, Human
ugacugaaccugauccaauauuuacuccuggaaagagggcaaaggggcagguguca

SEQ ID NO: 4170494 - RNA, 73 nt, Human
ugacugccuccccagcauggcuugaguguuuccuggauguguccaggcggguaucacaugcuggguggcauca

SEQ ID NO: 4170495 - RNA, 67 nt, Human
ugacuggauccugugccccagaaccagcccuuuccuugaagcaugucugggcagagggucuuaguca

SEQ ID NO: 4170496 - RNA, 111 nt, Human
ugacuggccugguguauauggcaggggcuuuaugagccuugugaaggaguguggcauuucuucugaaguguuuauucugggaguuccugucuccugccugaaaggccuuca

SEQ ID NO: 4170497 - RNA, 77 nt, Human
ugacuguggccgggugcucgaggucagcaucacaacagggaaacaucauguuggcagcggggacccuggcuguggca

SEQ ID NO: 4170498 - RNA, 69 nt, Human
ugacuuagcuuguuuucaccuaagacucugagauucuauucuguuuaugugagauuugggcugaguuca

SEQ ID NO: 4170499 - RNA, 79 nt, Human
ugacuuaguuuccuguggugugaaguuauaugaauuaaaucauauagucuaugaaaaacaccuaggauaacuuuuguua

SEQ ID NO: 4170500 - RNA, 98 nt, Human
ugacuucaucugccucagaagccacaggaaagcagcuucgucauccuaaacugaaugucuuuuaaccucuggacuucaacuggcaaagacuggaguua

SEQ ID NO: 4170501 - RNA, 94 nt, Human
ugacuucucgugagggcucuugcuacugaaguccugguuucuguccuuaucacuauaguauuccagggcagccagguucaaguccuuauaguca

SEQ ID NO: 4170502 - RNA, 61 nt, Human
ugacuugaaucaggcauuucaaguuaauccaaaaguuugaguuaacuggugccuucaguca

SEQ ID NO: 4170503 - RNA, 67 nt, Human
ugacuugcgccaggcuggagccaaccaaggcuugguuuggguggcugucagcugccuggugcgagca

SEQ ID NO: 4170504 - RNA, 72 nt, Human
ugacuugcuguagagaccacccauaggccccugucccuaagggcaguguugugguucucuauguaucaguca

SEQ ID NO: 4170505 - RNA, 65 nt, Human
ugacuuggagacuggugcagauaggcuuuuccauccaucccucccucugcaccuccuuccaauca

SEQ ID NO: 4170506 - RNA, 63 nt, Human
ugacuuucuccagaaaaccaaggaacaguccagacacggcaucuaaggugguuuggaggguca

SEQ ID NO: 4170507 - RNA, 75 nt, Human
ugacuuucuucaguagcucaagaaauuuuuauuaauuuggaaaaauguucuuaagaggguuaagugaagaaagca

SEQ ID NO: 4170508 - RNA, 129 nt, Human
ugacuuuuauguugaaagggcaaauaucauugagagcuuuagcgcacaucacagggggaacuaggagaauuuggaacucuuuccaccugugcugugguugucucccuaccucuauguccauuggcugca

SEQ ID NO: 4170509 - RNA, 128 nt, Human
ugacuuuuccaaguuuugguucaaguucaauaaagacauaaaacaagugggucagguuccaggaaaaacauaaucauuuguacuugugugcuuguauuuaaaucaaugaacuaggagcggggagguga

SEQ ID NO: 4170510 - RNA, 76 nt, Human
ugagaaaaauauucaagagauaauguuaagugcaaaaauagcauaagugagcaaaucuaugaauguauauuucuca

SEQ ID NO: 4170511 - RNA, 112 nt, Human
ugagaaaacaucuaguauguuaugaucagcuauuccugagagcuugguuguuaaucuauauuucuauuucuuagugguagucaucuuugaugaauaagacuaaagauucuca

SEQ ID NO: 4170512 - RNA, 57 nt, Human
ugagaaaaguguggaggucaauaguuaagcugcaauugcuccauuaaaguuuucuca

SEQ ID NO: 4170513 - RNA, 75 nt, Human
ugagaacagugaagcuuguuuggaucaggaaaaugcacuuuacauguacaagguaaauuagcuucaaguucugca

SEQ ID NO: 4170514 - RNA, 130 nt, Human
ugagaacauacaggaggcugaaaggauucuuuagggaggcuuuuuaguggccucauucucuaauaccuauggacagcaacuggaagcuucaaagaagaaggaugaacuuucaccuuccuguucuguucca

SEQ ID NO: 4170515 - RNA, 56 nt, Human
ugagaacggauacuaagggcugggaagaaugcccaguucugaccuaaccuuucuca

SEQ ID NO: 4170516 - RNA, 75 nt, Human
ugagaagagagggguugcauggaaauuaugucacaagaaugcuuggucaauuuucauugcauucagcucuauuca

SEQ ID NO: 4170517 - RNA, 61 nt, Human
ugagaagcuaauuguauggaggugccauuugguaucuuacacgauaacuguuaguauuuca

SEQ ID NO: 4170518 - RNA, 59 nt, Human
ugagaagcucugaaacaguaucuugguuuaggaacuugcagaaucagagcaguuucuca

SEQ ID NO: 4170519 - RNA, 63 nt, Human
ugagaaggguuggagaaauaaugagaaaugcaaacuugacccagaguuucuccuuccaucuca

SEQ ID NO: 4170520 - RNA, 93 nt, Human
ugagaaucuaacuaagcccgaugaucugagguacaugaaacuguuccaccucaguucauguuaguuagauucaucaccuuaguuagauucuca

SEQ ID NO: 4170521 - RNA, 77 nt, Human
ugagaaugaugagaaugagaagggagagcauauuuauuaagcauauauuauguacuaacuuucauucuagguuuuua

SEQ ID NO: 4170522 - RNA, 103 nt, Human
ugagaauggcauauuuacauuauuuagugcugauucuagauuaaaacacugaaaaauguacauagaggguaauagcaucaagaagguaaauguguuccuauua

SEQ ID NO: 4170523 - RNA, 100 nt, Human
ugagacaaagucucguucugucaccaggcuagagugcaguggcgcaaucucgacucauugcaaccucugccuucuggguucaagcgauucuucugccuca

SEQ ID NO: 4170524 - RNA, 129 nt, Human
ugagacaaguaaaggcaggccgggcucacaguagacaucauguaaguaguggcuagcacccucauccugcccucgucauugucuugauaugauugucaucuuguugcuucucccuccuucaacaucuca

SEQ ID NO: 4170525 - RNA, 79 nt, Human
ugagacaccugagcucacuggugaacucugcuuccaaguacuccugcaaagcacauuacaagcucaguccauguucuca

SEQ ID NO: 4170526 - RNA, 101 nt, Human
ugagacagagucuugcucuaucacccaggcuggagugcaguggcgcaaccuuggcucacugcaaccucugccucccggguucaagcgauucuccugccuca

SEQ ID NO: 4170527 - RNA, 56 nt, Human
ugagacagcagucagggaaauaugacaucgaaguuuuguuaugacugcuugucuca

SEQ ID NO: 4170528 - RNA, 102 nt, Human
ugagacaggagaaucacuugaacccaggaggcggagguugcagugagccgagaucgcaucauugcacuccagccuuggcaacaagagugaaacuccgucuua

SEQ ID NO: 4170529 - RNA, 102 nt, Human
ugagacaggagaaucgcuugaaccugggagguagagguugcggugagccaagauugugccauugcacucuagccugggugacaagagcgaaacucugucuca

SEQ ID NO: 4170530 - RNA, 101 nt, Human
ugagacaggagaauuacuugaauccaggaggcggagguuguggugagccgagauuacaccacugcacuccagccugggugacagagugagacuccuucuca

SEQ ID NO: 4170531 - RNA, 118 nt, Human
ugguggagaauggguuaggaaucauguagacaugggagaccuacauuaugaaacauagaaaaauaucauauuagacacuuauguccacuggacuucuuucuuagccucacuucuacca

SEQ ID NO: 4170532 - RNA, 72 nt, Human
ugguggauuuucucucaaaccuuaaaaugcucucaauuaaaaaacauuuccagagagagaggaaaauugcca

SEQ ID NO: 4170533 - RNA, 60 nt, Human
ugguggcagagcaagagcuggagugauaucaccugucuccagcuuuugacaaaaccacua

SEQ ID NO: 4170534 - RNA, 104 nt, Human
ugguggcaguugcagcacaguggcccugguggaagccugggcucagaccucacauaccuagauuugaguucuggcuccauggucagaauuuuguaacuucauca

SEQ ID NO: 4170535 - RNA, 121 nt, Human
ugguggccaccucucucuugccuucucugccagagggcacugggcugccuggucccaggguggggcugcagagcuggugcccuggccuggccgauggguggcuggaguguuggagccacca

SEQ ID NO: 4170536 - RNA, 64 nt, Human
ugguggcccagaauaaagaauacauuucucaucuagguguggacauguguuaaaauucucacca

SEQ ID NO: 4170537 - RNA, 94 nt, Human
ugguggcuauuaacugcucuaauugugcuguaggcucguuaacaaguuuguugaaguugcacauuauaauuuuaaaggaguuaauugaauacua

SEQ ID NO: 4170538 - RNA, 94 nt, Human
uggugggaagugccggcuggguugggguuacaugacugcuauccucaaugcaguccuggccagccuccugcccaucaucagcuggccccacaca

SEQ ID NO: 4170539 - RNA, 73 nt, Human
uggugggagaucagauaagcaaguaucgagagauugaaauuuaaugauuacaauugucuuagauuucucauca

SEQ ID NO: 4170540 - RNA, 75 nt, Human
ugguggugcgggguguagggguagcgggggauuauauaguucccagcuccuuguuugcaucuccuucucauacca

SEQ ID NO: 4170541 - RNA, 85 nt, Human
uggugguggggugaaggaagauucuguuggaaucuuuauaagcucaaauaucuggcacuuauagaauuuuccuacuuggcuacca

SEQ ID NO: 4170542 - RNA, 55 nt, Human
ugguguaaucaguuucuagcucuaaaauuuguugaauagauacugaugaacucca

SEQ ID NO: 4170543 - RNA, 72 nt, Human
ugguguacaagaguuggaauaaaaguuucuggcaaacugucguuuugcuuuuauguaauaaacuguacacca

SEQ ID NO: 4170544 - RNA, 76 nt, Human
uggugucuuccauauuucugcuuaggacucuguggaccaugaguguauaaacuuaagcaggaaccuaggagagcua

SEQ ID NO: 4170545 - RNA, 68 nt, Human
uggugugggcuugcuuauuuucuccaaugucaaugcugugcuugggggaaguaacagacacacacaca

SEQ ID NO: 4170546 - RNA, 73 nt, Human
ugguguguaugaaagaacaagggcuuaaaacuagaaaucuggacguaagucuuaguuuugccauuauuugcca

SEQ ID NO: 4170547 - RNA, 65 nt, Human
ugguguuaaccagcuaaacuuugcuugaacccucaguccauugcagaggagcaagcuggacacca

SEQ ID NO: 4170548 - RNA, 64 nt, Human
ugguguuaauucagaucauauuuauagcuuucuuugguaagcugcauuugagucugaauaccca

SEQ ID NO: 4170549 - RNA, 95 nt, Human
ugguguugggcaggaagaagaaaggggcaaggcaccuccuuaugugagugcucaugcugagguuguuguccuauuuuaauguucauccaacucca

SEQ ID NO: 4170550 - RNA, 91 nt, Human
ugguguuguuauacaagcucuugaguaaacuaguuuuccagcaaacuguguuaaaacacuaguggauuucugggcuuacaggacaauauca

SEQ ID NO: 4170551 - RNA, 69 nt, Human
ugguguuuguaccaaggcugugucucccauggguagcuccuggcaaggaagagccuggugcagacacua

SEQ ID NO: 4170552 - RNA, 97 nt, Human
ugguuaaauucugugaacuagcagaucuaugcuuuagaaacaacugugauaacuuuccuuucugaugcaugggucucuguuuuccaccacggagcca

SEQ ID NO: 4170553 - RNA, 61 nt, Human
ugguuacagagggaucagaaguguaaauuauacuaauuuuauagcaagcucuuuguaacca

SEQ ID NO: 4170554 - RNA, 82 nt, Human
ugguuaggugcugacauguauaagcuuuaaguaaauggaacguccacuuguauuuuauugcuugucacaaacccucaaacca

SEQ ID NO: 4170555 - RNA, 100 nt, Human
ugguuaugauucuaguccauacauagcuuuagaagacacucuguuuuuaggaucgcuugagcccaggaguuugaggcugcagugagcuaugaucaugcca

SEQ ID NO: 4170556 - RNA, 80 nt, Human
ugguuauguaaaauuaagauguucccauuuaauuuuuaacaaucaaaacaguuaaugagcauuuuggaauguacaagcca

SEQ ID NO: 4170557 - RNA, 85 nt, Human
uauuaacuuuugaucagugugguaugucuucuuucuaaaguuauuuacauucuuugcagaaaucaagaugaaucaaagguuaaua

SEQ ID NO: 4170558 - RNA, 100 nt, Human
uauuaauuuaagaaccauuacuauguuacucguuuggauguuucauggcacugcaugaaacauucauaugagaaaccuaguaaugguucuuaaauuaaug

SEQ ID NO: 4170559 - RNA, 76 nt, Human
uauuagauuggugcagaaguaauugcgguuacuuuuuaauugcaaaaaucacaauuacuuuugcaccaacauaaua

SEQ ID NO: 4170560 - RNA, 111 nt, Human
uauuagcacguaaccuugggggagucacaaagccuuucuuauugucaaucuuuucauuuguacaaugaggauauuuguagaauuagacaaccucuaguuuaauggcuaaug

SEQ ID NO: 4170561 - RNA, 64 nt, Human
uauuagcuccaguacuguugccaugccauucacucuaggcugcaguuuucuaacagagcuaaua

SEQ ID NO: 4170562 - RNA, 84 nt, Human
uauuaggcugaacuacaugaaguugccgcuuuauagaacaaaaauggucuaaauauuggcaauuucauaugguucaagcuaaua

SEQ ID NO: 4170563 - RNA, 63 nt, Human
uauuagguaggugcaauuaaaaguaguggcaaaaacugcaauuacuuuugcaucaaucuaaua

SEQ ID NO: 4170564 - RNA, 83 nt, Human
uauuagguugaacucuguaauucuauaugcaguuaacaauucugucuuacguaaucagggaguuagagauucuguuucuagua

SEQ ID NO: 4170565 - RNA, 84 nt, Human
uauuagguuggugcaaaaguaauuguggguuuugccauuacuuaaaauggugaaaaccacaauuacuuuugcaccaaacuaaua

SEQ ID NO: 4170566 - RNA, 84 nt, Human
uauuagguuggugcaaaagucauugcagcuuuugccauuauuuucaauggcaaaagcugcaaugacuuuugcaccaaccuaaua

SEQ ID NO: 4170567 - RNA, 63 nt, Human
uauuagguuggugcaaaauuaauuguggcuuuuaauggcaauuacuuuugcaccaacauagua

SEQ ID NO: 4170568 - RNA, 59 nt, Human
uauuagguuguugcaaaaguaauugugguuuuugccauuacuuuugugacaaccuaaua

SEQ ID NO: 4170569 - RNA, 65 nt, Human
uauuaucagcaaugguucauguguuggguccagggaagccauuuccagcagccauucuaguagua

SEQ ID NO: 4170570 - RNA, 57 nt, Human
uauuaugaucccagcccuggagagaaagggcacuuuacaguuuuggugaugaugaug

SEQ ID NO: 4170571 - RNA, 65 nt, Human
uauuaugggccuagugcaguuaaauugccugacacaguagggaaucuauacuuaggcugguaaua

SEQ ID NO: 4170572 - RNA, 98 nt, Human
uauuauggugacuuuguuuuaaaugugucuuuauuuucaauauaucacugcacuagagauaacuacacuuaagacaacccacuuuaggucacugaaua

SEQ ID NO: 4170573 - RNA, 59 nt, Human
uauuauugaaucaguucuuugacaauagcacuucuguuuauaguacugauucuguagua

SEQ ID NO: 4170574 - RNA, 96 nt, Human
uauuauuguuaguguuauuaaauuagauuauguauguuaguauucacccugaugccuggcacaugguuaaucauaauuccagucacuaauagaaua

SEQ ID NO: 4170575 - RNA, 77 nt, Human
uauucacaagaguuucacugcaaacugacuuuucagggcaaauucaccacccaaaagucuguagugaaaggugaaug

SEQ ID NO: 4170576 - RNA, 61 nt, Human
uauucacaguuaacaauguguacaucucuguggggggaauaaaaauuguuuacuguagaua

SEQ ID NO: 4170577 - RNA, 75 nt, Human
uauucaccacuguaucccuagcacuuagaacaguguucagcacaaagaaagugcucagggaacauuuguugaaug

SEQ ID NO: 4170578 - RNA, 73 nt, Human
uauucagaggguugaugugaggcuuagcugcuccugauaacaauggcuaauguguccugaaagcuucugugua

SEQ ID NO: 4170579 - RNA, 78 nt, Human
uauucauaaguuguugaauggauaaauaaauuauauuuauguaugcaguggaauacuauucagcaaugaaaaugaaug

SEQ ID NO: 4170580 - RNA, 70 nt, Human
uauucauugccuguuacauuccauucuauguuuuacuugacgaaaacuucuggagucugacagaugggua

SEQ ID NO: 4170581 - RNA, 129 nt, Human
uauuccaaccaauucucccccaaccuugaaacccugacacucuguuccuggacagucuuuagccuugggaauaaugaagguguuucaggagugcugguuuuuaucuuucuagggagcaggggaagaaug

SEQ ID NO: 4170582 - RNA, 62 nt, Human
uauuccaacugucauagucauaacaaggccuuccuaaaaguuuaggcuaugcauuuggggua

SEQ ID NO: 4170583 - RNA, 88 nt, Human
uauuccaucugaagcuaucugcacuucauaugagggccaagugaaaauguggcagauagcuuccgaauuucagucuccucuugguaua

SEQ ID NO: 4170584 - RNA, 57 nt, Human
uauuccccuaucuuguagauuggaaaacagaaaacuggucugcaguaagagggaaua

SEQ ID NO: 4170585 - RNA, 60 nt, Human
uauuccuuggcugaaaaacuagaucauugauaaacuuggaacagucucagcggaggagua

SEQ ID NO: 4170586 - RNA, 56 nt, Human
uauucuaaaugugguagucauaagagccccaguucugaaucugucauuuuaggaua

SEQ ID NO: 4170587 - RNA, 77 nt, Human
uauucuacacaaaugguuguagacauuaacuagggaacacccgcuuaccugcagccaucuguauaaucucuaggaua

SEQ ID NO: 4170588 - RNA, 75 nt, Human
uauucuacuuauuguugaacugaaucaaggcuuuuauggaaauaaaugugaugguaguuuaucaaaaagagggua

SEQ ID NO: 4170589 - RNA, 94 nt, Human
uauucucuacccugucccuauuuuucuguacccuaauuuaauguuugauuguuaauucugaguugggaaggagagggacuacagguaggagaua

SEQ ID NO: 4170590 - RNA, 92 nt, Human
uauucucugccaacaucagaacuuaagagucuucaucacaaaaauuauuacauuuauuaggugauaauugaugaggcuuuggacagagcaug

SEQ ID NO: 4170591 - RNA, 66 nt, Human
uauucugacauuugucaaaaugauaagaaagacuauucaggauuauugugauaggugucagugaua

SEQ ID NO: 4170592 - RNA, 108 nt, Human
uauucuguuuaugcacuuacugcuaguggagauggcuggcagguagaugaaaccaucuucauuuagcuggcagaagccuucuaaaacugcucagaagucgauagaaua

SEQ ID NO: 4170593 - RNA, 130 nt, Human
uauucuuuuaucuaauauuauucuauuuauucauuuaccugacauuuacugaauacugauuaaugaugacgaugaugcaauagagagauagauagguagauggauagaugaauggauagauagauaaaca

SEQ ID NO: 4170594 - RNA, 72 nt, Human
uauucuuuucaguggcuugcauauguuggcuucuguaugcugcuaaauaugugaucagugaauaaaugaaua

SEQ ID NO: 4170595 - RNA, 114 nt, Human
uauugaaagugcacaggauucuuggcugggucuguggcugcuccuuagcaaguaaaauuagcuaacacugcccaaggauccauuggcuggaguuaagaauccugagaguuagug

SEQ ID NO: 4170596 - RNA, 64 nt, Human
uauugaauuucagaguagguaaaacauaguggauaugcauuauccugcauccuggaacucagua

SEQ ID NO: 4170597 - RNA, 74 nt, Human
uauugacauuucuuuauuuuuaucagaagcacuuugagcugcagugcuucaaauucgaggaguagaugucagua

SEQ ID NO: 4170598 - RNA, 70 nt, Human
uauugaucaguucugcaagcguuuaucaaaaauuuauucuauggcagucgcugugugcagacugaaaaug

SEQ ID NO: 4170599 - RNA, 73 nt, Human
uauugcauauuauucuaguggcuuuuaucucuuacgaaacauacugugguaaaaugacuagugauuugcaaua

SEQ ID NO: 4170600 - RNA, 60 nt, Human
uauugcaucaguaauuuagugugugugugugugagcacucagaccaaaugugauguugug

SEQ ID NO: 4170601 - RNA, 75 nt, Human
uauugcauguuucuauucuucccccagcucaucgagauucccuccugucaauggaagaagggagugcguguaaua

SEQ ID NO: 4170602 - RNA, 55 nt, Human
uauugccauggcuugguauccacugacuggaauagcaccaggcuuauggucagug

SEQ ID NO: 4170603 - RNA, 56 nt, Human
uauugcguggagguuuuuuccugauuaauguaucaugaaaaauuuuccaugucaug

SEQ ID NO: 4170604 - RNA, 87 nt, Human
uauugcuaacuguauaauuuuauuaggcuuuuauagggaugauaaugucucucauuggaaaagaguuuaaucaaacagaauguaaug

SEQ ID NO: 4170605 - RNA, 78 nt, Human
uauugcucuagcaaucagcuauugagaugugcgugccucauugaggcuuugcaaaaguuaauuguugacuaagcaaua

SEQ ID NO: 4170606 - RNA, 82 nt, Human
uauuggaauuuuauucuaaaugcuuuuuucaucaugcagauauuacagcaguaggaaaacugugauuagaaugccuccaaua

SEQ ID NO: 4170607 - RNA, 66 nt, Human
uauuggucagaacaagcaaauaauaggauguuuuacauuuuauuuuguugcugguuuugguuggua

SEQ ID NO: 4170608 - RNA, 61 nt, Human
uauugguggugaggacaugccagugagcuuccuguucagcuugguagaugcagcaccagua

SEQ ID NO: 4170609 - RNA, 71 nt, Human
uauuguaaaggaguuauaagugcauuuggguaaauacacuuagucaaagcuuagauaauuucuuuaagaug

SEQ ID NO: 4170610 - RNA, 93 nt, Human
uauuguacuaguucugucaugauuagcugaagaauaugcuggcagagacacgaauaacgcucagaauuuuucacucaaucuucuagugcagua

SEQ ID NO: 4170611 - RNA, 78 nt, Human
uauuguauacaagcuuaauuguuaauauucccuaaacacaauuuuaugaagggagaagacauugguuuguugacaaua

SEQ ID NO: 4170612 - RNA, 106 nt, Human
uauuguaugucacagaauuuuucuuaaguaauaaauuuauggcagcaaaauuggaauagccuuugaagcacauuucuugagaugaacauuagguugauguauuaua

SEQ ID NO: 4170613 - RNA, 70 nt, Human
uauuguccaguaguuuuugguuuugcuaucuagcucccugcggaucuuggcagauccaaaaaugacaaug

SEQ ID NO: 4170614 - RNA, 62 nt, Human
uauugucuaucgcugcuuucaugguacaacaucagagcugaaugcuugugauagagacagua

SEQ ID NO: 4170615 - RNA, 57 nt, Human
uauugugaguuguaguucuguuacaccucuccuugugaacagcacacauucgcauua

SEQ ID NO: 4170616 - RNA, 82 nt, Human
uauuguggcuuucucuuuggauauauauuucagucucccccgagagaaaagaaaugucauauuuaaguaggaacauacuuua

SEQ ID NO: 4170617 - RNA, 55 nt, Human
uauuguuggguaguuuguucagcuuauuuccagcuuuauaguucucccaacauua

SEQ ID NO: 4170618 - RNA, 64 nt, Human
uauuuacugaucucaggcugcuuaccucuuuaggguaagucauuaggcugaguucaauuaaaug

SEQ ID NO: 4170619 - RNA, 78 nt, Human
uauuuagaaacaucuuuguaguguucuccuucguucuuuuguaucuaggaugcauuuuaacaaggaguauucuaugua

SEQ ID NO: 4170620 - RNA, 129 nt, Human
uauuuagaggucuagguagauacacaggauuugugugugugugugugugugugugugugcaugugugcaugcauauauacauacacaguccugucauauuuccccuuucuauuuuauuccugagagaua

SEQ ID NO: 4170621 - RNA, 60 nt, Human
uauuuagcaccucaauuuugcaaauagggaaguuauuuuauaugcaaugaggugggagua

SEQ ID NO: 4170622 - RNA, 118 nt, Human
uauuuaucugauaaccagcucaaaucuauggaaaagggauggaucuuggcccuggaagcuccuggauuuaagcuucugcccugccauucacuggaagagagccaaccuuggaugagua

SEQ ID NO: 4170623 - RNA, 56 nt, Human
uauuuauguggaccauaagccuucucuaaucaggagguguugggccuauauaaaua

SEQ ID NO: 4170624 - RNA, 71 nt, Human
uauuucacaaguuucaggauucugcagcuuuaggacagaauguuuucccagaaaucugaaaucuagaaaug

SEQ ID NO: 4170625 - RNA, 85 nt, Human
uauuucacucucaguuuuccacaugugaggcuacgguuaucuuaacuguacaucuuaaauggaaaaauucuugagagaaaaaaug

SEQ ID NO: 4170626 - RNA, 58 nt, Human
uauuucagcucuuuggauuaucugugguggaggccaucacgucuuuggaguggaggua

SEQ ID NO: 4170627 - RNA, 59 nt, Human
uauuucauugccauaaggugggauggacacaccagacccccuuuaauggaagugcuaug

SEQ ID NO: 4170628 - RNA, 58 nt, Human
uauuuccaaaagccuauuaugaauacuuagaaaaucucauagcaggcaauuggaaaug

SEQ ID NO: 4170629 - RNA, 83 nt, Human
uauuuccuacauuaguacauugauucauuaugucauuucuaaaagagggacaauauuaugacucaugagcauggagggaaaua

SEQ ID NO: 4170630 - RNA, 75 nt, Human
guuuaucgcaauguuuagaauuuuguuauguucaaucgaggacuuuacaaaauuguguuaaacuuuaugauggau

SEQ ID NO: 4170631 - RNA, 59 nt, Human
guuuaucugguuggagagagaagaagauacaucucuacucuuaacacagcuaggaaagc

SEQ ID NO: 4170632 - RNA, 64 nt, Human
guuuaucuguuuaacaaaguaucuaacauagcaauccuguuagauucugugggaaaagguaaau

SEQ ID NO: 4170633 - RNA, 81 nt, Human
guuuaugagagcguuucacagcccagaaagccuaaggggguuaagucuccauucuuucugaggcugccaacucucacagac

SEQ ID NO: 4170634 - RNA, 119 nt, Human
guuuaugcaguuauuauaaauucaucauuaugggcagggcaguguauaagaaagccagaauccacaacuugaaaagguaaucacugaugcaacuguuuugucuacauaacugcauaaac

SEQ ID NO: 4170635 - RNA, 67 nt, Human
guuuauguuagauaauauuucccagagguaacacugcuggguagaaguauuagucuaaccuuuagac

SEQ ID NO: 4170636 - RNA, 88 nt, Human
guuuauucugaaugcauacauuuaaauaccuauguuucuauaccauucauauuuggaggagauguuuguguuuauucagaaaguagac

SEQ ID NO: 4170637 - RNA, 77 nt, Human
guuuauugaggggacuuaagccugccuguccugccaguagccaggaagggcugggucugguuaacccuugguguggc

SEQ ID NO: 4170638 - RNA, 70 nt, Human
guuuauuucuacuauuuugccugauuuuuuucuaaucagaaauaaggcaaguuuuuaguggacaugguac

SEQ ID NO: 4170639 - RNA, 56 nt, Human
guuuauuuuggucaauacaguaagcagguguggcuugaagauaggccaggaugagc

SEQ ID NO: 4170640 - RNA, 61 nt, Human
guuucaaauagguuucagcaaaguaauuuaauuagaauuugaaugaacgcuuauuugaagc

SEQ ID NO: 4170641 - RNA, 63 nt, Human
guuucaaguagcugcugauuaugacuuacaauucaucucccuagauccugcagcuaauggaau

SEQ ID NO: 4170642 - RNA, 67 nt, Human
guuucaaguguauguguguuugugugaauguguacacaucccacagaaacauacauaauauuggaau

SEQ ID NO: 4170643 - RNA, 59 nt, Human
guuucaauuugaaugcgaggcuaucacauaagugagcuccaaaguacauaaguugaaau

SEQ ID NO: 4170644 - RNA, 95 nt, Human
guuucaauuuuuaaaugaaaggauaaauggaaggauaauagcauagaaaaacaugugauuaacugucuauuaaucaugucuggaaaguaagaaac

SEQ ID NO: 4170645 - RNA, 58 nt, Human
guuucacagguuggagccagcaucuuccuacaagaugaacagcugccaccuuuggagc

SEQ ID NO: 4170646 - RNA, 129 nt, Human
guuucacuguguuggccagacuggucucgaaccccugaccucgugauccgcccgcuuuggccucccaaagugcugggauuacaggcaugagccacugugcccgacccacaauagcacguuuuaagaaac

SEQ ID NO: 4170647 - RNA, 68 nt, Human
guuucacuugacauauagcauaaggauaagagcuccauuuugaauuuagauuguauguugaguuagau

SEQ ID NO: 4170648 - RNA, 83 nt, Human
guuucagaaacacuuguagagaaguuuguuucauuuccugcuuuuacuuuguagcauugcaaacuucuuuaaguuuuugaaac

SEQ ID NO: 4170649 - RNA, 80 nt, Human
guuucagaguuugagggaacccaaauaggaaaauugauggagucauuuuccucugcugguguucaagucagauuugaaac

SEQ ID NO: 4170650 - RNA, 61 nt, Human
guuucagaucacaaggggccacauaauugccauggcugagcuucaaaguuggaucugagau

SEQ ID NO: 4170651 - RNA, 57 nt, Human
guuucagauuugguuucagaaggguuuugucagcuuucuguaaacugcgucuguaau

SEQ ID NO: 4170652 - RNA, 107 nt, Human
guuucaggucauugaugcacaguguaaucucuaauuuaaaaaguaacacacaaugguguuuuauuuucaaaguuagagcucuuuuggguucucaaugugaccagagc

SEQ ID NO: 4170653 - RNA, 69 nt, Human
guuucaguagcccuugaguucauguagaaauuccauuugcucugcaguugcucuugaggcacuuuggac

SEQ ID NO: 4170654 - RNA, 70 nt, Human
guuucauaacaucuuauuggcaaagauauuuaaaucugauaauaucaaguguuagggagaugugggaaac

SEQ ID NO: 4170655 - RNA, 100 nt, Human
guuucauaauacagcauggucugguaguuugcaaaauggugugcuuuuggggagauacacuagcaauuuuuuuaaaaacuggaacagugugauaggaagc

SEQ ID NO: 4170656 - RNA, 101 nt, Human
guuucauauuuaagcugaauugagaaacuuacaaauccagauugucuaacaaacucuggcaaacugaauucaaguauccaguuucgacugcauugugagac

SEQ ID NO: 4170657 - RNA, 80 nt, Human
guuucaugaguucauaaaucuggagcuguggccaacacugggaccucuguuggaaacuuccagcuuuauaauucaguagc

SEQ ID NO: 4170658 - RNA, 75 nt, Human
guuucauuauuuucaagaacagcagcauuccauauuuuaauguggcaucucuugauuuuugaaaaugauggcuac

SEQ ID NO: 4170659 - RNA, 130 nt, Human
guuucauuguuuucuugucaucucauucagugcaggaggaagccccauugaagccaggccauggcuugggcaggugcagguuuucaaguacugagaggggaugguuagcucaacaggucagcagugggac

SEQ ID NO: 4170660 - RNA, 57 nt, Human
guuuccaccuucucccgaagccgguucugcagcuaagcuguagacgggagaggaagc

SEQ ID NO: 4170661 - RNA, 60 nt, Human
guuuccacugaaggaucuagggaagaauguuuccuuuccuucuuaccuucuagugguugc

SEQ ID NO: 4170662 - RNA, 72 nt, Human
guuuccaugaaaauguuucugcuuguuccaaugggcaaaaauaaaguugcagaaccauaaauucagguaagc

SEQ ID NO: 4170663 - RNA, 60 nt, Human
guuuccauuucuguaaauagggaaaggucuaugugaacccgccuauggcaggauggaggc

SEQ ID NO: 4170664 - RNA, 96 nt, Human
guuucccucuuugguaguuaaagaucauaauauuuaucucauggggcuuuuaugaagaugaaauguaugucaucaaucuugcacauaggaggaaau

SEQ ID NO: 4170665 - RNA, 63 nt, Human
guuuccgcccugggccugugggauugcgugacuccuggagcacugggcccaggguguggaggc

SEQ ID NO: 4170666 - RNA, 58 nt, Human
guuuccucagcuagacuguggguaucauaacaacggcucacagaauguugaagggaau

SEQ ID NO: 4170667 - RNA, 75 nt, Human
guuuccucuccaaggcuggccuuugauuaucuuaaucugugucaaagcuauuuguuaugagagaaccaaggagau

SEQ ID NO: 4170668 - RNA, 55 nt, Human
guuuccugucugcuuuacuauagcagguguucuagguaagaaagggcaagggaac

SEQ ID NO: 4170669 - RNA, 57 nt, Human
guuuccuuucuauugccuugauuuucucuuuaaguaugucauaaggagagaggaaau

SEQ ID NO: 4170670 - RNA, 78 nt, Human
guuucggcuuuguuugauagaaguguucuagggagucaaacccuguagaaaauuggagcauucauacauugcugaaac

SEQ ID NO: 4170671 - RNA, 71 nt, Human
guuucguguuugcguuuaguuucaagacacgucgacaaaacgacugucauuaaugaauguaauaacgaaau

SEQ ID NO: 4170672 - RNA, 65 nt, Human
guuucuaagggagagcugccagcugguuaaaccugucuccgguaacuagcuuucucuguggaggc

SEQ ID NO: 4170673 - RNA, 69 nt, Human
guuucuacuuucuaagacauacaacuuugcuuuccaacaagguaucugcauucuuggaaagaaggaaac

SEQ ID NO: 4170674 - RNA, 82 nt, Human
guuucuaguaacuuaaauucaacuccuggcagccuacuucacauucugauuugggcuucugauguugagugcugagggaagc

SEQ ID NO: 4170675 - RNA, 56 nt, Human
ucacccagaaaagacagcagaugggaugccaugccuugccuguucuuccugguuga

SEQ ID NO: 4170676 - RNA, 73 nt, Human
ucacccagcagggccagcacuccuggcaggauaagaacucauggugccagaccaggcauggccagcaggguga

SEQ ID NO: 4170677 - RNA, 100 nt, Human
ucacccagcuaugggaaaugcucuggaugaccuuggauuucuaugcaguuagcuggaccucaucccaggguuacagccagggcaucccugagcuggguga

SEQ ID NO: 4170678 - RNA, 70 nt, Human
ucacccccaucugagagcaugugcccgcccucugucccugaggucacugcaggucugagaugggggagga

SEQ ID NO: 4170679 - RNA, 56 nt, Human
ucaccccuggcccagucuuggagagaggauaaccacugcugguaaacugggggugg

SEQ ID NO: 4170680 - RNA, 98 nt, Human
ucacccuaaucuugauuaauaccuuagcccucuucugacugaccaauaagcgaggaugaguuucgggaggguaaagagaggucaagauccuagcuuga

SEQ ID NO: 4170681 - RNA, 76 nt, Human
ucacccugagcagcuguuacagagugucucugauauuaaucacacacucccuccaauggcagugaccuuaggguga

SEQ ID NO: 4170682 - RNA, 69 nt, Human
ucacccugccuccaggaggggcagcucuggugcauucacacuccagaguccacccuggggucaggcuga

SEQ ID NO: 4170683 - RNA, 88 nt, Human
ucaccuauuaagcaaauauugacuucuuaaauuaaauuguaaugccucuugcaacagaagucaauaguuguuugaugacaucugguga

SEQ ID NO: 4170684 - RNA, 92 nt, Human
ucaccuccgagaaucaccaccuuccugcgugucucuucacucauguaagacuugaccagguugaaggcuacggcgaauagcuugggggcuga

SEQ ID NO: 4170685 - RNA, 60 nt, Human
ucaccucucaggucuuccucauaugcagaauguuccucaugugcaaacuggagaugguga

SEQ ID NO: 4170686 - RNA, 60 nt, Human
ucaccugcccuuaggaauccucuggucaacuguacgagaagaaggaagggggcaagguga

SEQ ID NO: 4170687 - RNA, 73 nt, Human
ucaccuggcuuuagguuggagagcugaugaauccuuccugggaucccagcuuucuaccuuaggcaguggguga

SEQ ID NO: 4170688 - RNA, 90 nt, Human
ucaccugggagcuuguucaaaugcagaauaccaguccccacuccgaccugcuggaucagaaucugcauuuuuaacaagauccccggguga

SEQ ID NO: 4170689 - RNA, 108 nt, Human
ucaccugggagcuuuuauggcucuggagguucaggcugcacaccugagcaaugaagucaggguccugaggguggggccuggaugcagguauuaaaguucugcagguga

SEQ ID NO: 4170690 - RNA, 90 nt, Human
ucaccuggggaucuugucaaaaugcagauucugauucaguaggucuuggguggggccugagauucugcauuucuaauagcucucagguga

SEQ ID NO: 4170691 - RNA, 122 nt, Human
ucaccuucuuacaccgcauauaagauuuuuugauagcaggaacaugaguguggauuaaaaucugugcugccauuggauucuaaugcacuucaaauuguugugguacaguuuuauguagcuga

SEQ ID NO: 4170692 - RNA, 76 nt, Human
ucaccuugaagugucucuuguaaaagauaacucccugcauuguagaaaugucuuugacaagagaggauuaggguga

SEQ ID NO: 4170693 - RNA, 76 nt, Human
ucacggacaaugucagucugucuucaugggggcaguuaagggaauguccucagaauccaaacugcaguacuguaga

SEQ ID NO: 4170694 - RNA, 84 nt, Human
ucacgggcuaguaaauuccuugagacgcagguuucuucuacugaggcuaauaacaaaaccucuuuuaaggaguuguuguuugga

SEQ ID NO: 4170695 - RNA, 86 nt, Human
ucacgugucagcaagggagcuaauuccauacacucagacaggcugggucugacugucuugcuaugagcucccaucacggcguguga

SEQ ID NO: 4170696 - RNA, 76 nt, Human
ucacguuagaagugguaaguagaaagaugaagacuuccagcuccuucuguuacucuucccaccacuucuguucuga

SEQ ID NO: 4170697 - RNA, 91 nt, Human
ucacuaaagacaugguguaggugaacaugagauuggauaccauaaaucuguacuggcuuccaucuguacgaccacauggugucugcagugg

SEQ ID NO: 4170698 - RNA, 117 nt, Human
ucacuaauacuuaucauauggauuuacaccaagacuuucauuuggucaguccgaugucacauguaauguuuauauuggucugcuuaaguggauuucuggaccauauuaaguauuuga

SEQ ID NO: 4170699 - RNA, 80 nt, Human
ucacuaaucuuccucuuauaaguuuucccaggauuugugacuaaccagaauccuggagaagcuguaccuggauacaguga

SEQ ID NO: 4170700 - RNA, 73 nt, Human
ucacuacagaaucaaauacgggcuuaaaauuucaaacggaaaaauauugccaauauguugauucuauguagga

SEQ ID NO: 4170701 - RNA, 84 nt, Human
ucacuagcauccugggggcaggcuggugugaugcagagccugagggggcagccauacucagaccugggcccagauugguggugg

SEQ ID NO: 4170702 - RNA, 63 nt, Human
uaugcaagguuggguaacagcagguccugaccuguaggacuggcuggcagaaacugaagcaug

SEQ ID NO: 4170703 - RNA, 56 nt, Human
uaugcacccucaucugccgcucuacuguaaacuaggccuugguaaagggaugcaug

SEQ ID NO: 4170704 - RNA, 62 nt, Human
uaugcagagcaugacuguaccagcuuuguacaggccuggugacuuucuuaugucucugcaug

SEQ ID NO: 4170705 - RNA, 55 nt, Human
uaugcaguguaugcacugagaucuacaugccucagucucaguguagaucugugua

SEQ ID NO: 4170706 - RNA, 55 nt, Human
uaugcaucugugauguacugccucaugauuucagugcagucugucacagagcaug

SEQ ID NO: 4170707 - RNA, 125 nt, Human
uaugcauuuucagacacauucacuucagugucacauuagauuggugcaaaaauaauuguggcuuuugccguuacuuuugcaccaaacuaauauaacaccgaaggcaaauuccugaguuuaucaua

SEQ ID NO: 4170708 - RNA, 81 nt, Human
uaugccccaaccauugggucaugggaucccagcauccagauccuggauccuagacuccuaugccccaaccacugggucaug

SEQ ID NO: 4170709 - RNA, 56 nt, Human
uaugccuuuugguucaagcaacauauauggcaauguuucuugagccaaaaggcaua

SEQ ID NO: 4170710 - RNA, 86 nt, Human
uaugcgaacaaauuggcuggauauugaauuguaccucuuaaugaacaggggaaauacagaaggaaguuuagcuaaauguuaacaua

SEQ ID NO: 4170711 - RNA, 63 nt, Human
uaugcgugauucuagguccauuauuugcaucucauuggugaagauuaaauaggauccugcaug

SEQ ID NO: 4170712 - RNA, 66 nt, Human
uaugcgugcuuguuagcauggaaagaucaauagggauuaauagcuuucucuggucaagcacacaua

SEQ ID NO: 4170713 - RNA, 79 nt, Human
uaugcuggcuacuggaguauuguuuaauaccagagugcuuuauugccucugguggagaauaguucaguacuaaagugua

SEQ ID NO: 4170714 - RNA, 97 nt, Human
uaugcuuacuguaugccaggugguguucuacaccguaucuugugaggauugaguucauauaaaguguuuagaaagcugccuguacucaguaaacaua

SEQ ID NO: 4170715 - RNA, 61 nt, Human
uaugcuuucuggugccuuuggaacugacagcacccucuaauuaaaggcaguggguggcgug

SEQ ID NO: 4170716 - RNA, 56 nt, Human
uaugcuuuucucuuggaaugugauuauauuuucuaaauucuacaagaauaagcaug

SEQ ID NO: 4170717 - RNA, 85 nt, Human
uauggaacauagugagagggugugaacacuggcugugcaaccucagaaagggucuaccuaguguugacuucucuucuuucacaua

SEQ ID NO: 4170718 - RNA, 107 nt, Human
uauggaacauucuuuggggucaguuuugaauaaucacugggcauuaucggauuucuaucacuauuuuuugcauguucuugugauuauucaccagggaacauuuuaua

SEQ ID NO: 4170719 - RNA, 60 nt, Human
uauggaacuauaaaccauugucaacuuuaacacacauuagguagacuuuggaguuucaua

SEQ ID NO: 4170720 - RNA, 59 nt, Human
uauggaaguuagggaugaauaaagugucaaggaugacucuuugguuucugacuugcaua

SEQ ID NO: 4170721 - RNA, 70 nt, Human
uauggagaguggauaugggagcaaagcagaagcaugauguaucuuucucccagccauccucucuaucaua

SEQ ID NO: 4170722 - RNA, 106 nt, Human
uauggagauuuuugugagauucauuaauaggacagguuggcaagguuagaacagauucuagcaucagccacaccuuguacucagaaucucucuaaguaucuccaua

SEQ ID NO: 4170723 - RNA, 95 nt, Human
uauggagggcuaacuauguuccagagaugggauuaaucauguuuuauguaauuuguccucauauuaaaaccaucagcuguaagauagccucuaug

SEQ ID NO: 4170724 - RNA, 129 nt, Human
uauggauucugugcaaaaugccugguagagugccuggcaguuauauugccuuagggacacauccuaugaauugcucccauagguagcuaugaacucuggucugaaucugcauaggcaagccagaucaua

SEQ ID NO: 4170725 - RNA, 55 nt, Human
uauggcaagagaaucaacugaagaauaaacaucuuuaguaaaucuuuugcucaug

SEQ ID NO: 4170726 - RNA, 59 nt, Human
uauggcuucaucuuuuaguccuuauggagucaggucaggggacacaaagaugaguaaua

SEQ ID NO: 4170727 - RNA, 85 nt, Human
uauggcuugcuuuaggggaggagagagcagaagggcagagggaccucccugcuuccgcuguuuucucagaugccaaguugccaua

SEQ ID NO: 4170728 - RNA, 117 nt, Human
uaugguaaaagacaggguuauugugauggaauauagaacauuuacaaauccuucugcagaaauaaacuuuguuccaauaaggaguugaaauuauccaugcggugcccuaguaccaua

SEQ ID NO: 4170729 - RNA, 118 nt, Human
uaugguagacaaugaagacugaauuuguuggaaaugaagagagaauuuucuguucaaugcagugcuugaccagaguuuuauuaguucuaagacacaguuuaccuucucaucuaugaua

SEQ ID NO: 4170730 - RNA, 95 nt, Human
uaugguggcauaaugcugugguggcaugauagugugaaugcacgauagcgugaaugcaugauggugugaugguaugauggugugauggcaugaug

SEQ ID NO: 4170731 - RNA, 69 nt, Human
uaugguggcuucagucucaucuuggaaggcugguuuucuccgcacuuaaauccacaagauugccccaua

SEQ ID NO: 4170732 - RNA, 58 nt, Human
uauggugggggcugggggaugauggcauuggagggcuuauccuagcaccuggcacaua

SEQ ID NO: 4170733 - RNA, 61 nt, Human
uaugguggguaaaacuggaaaugcaccuggagccagacuguaaaccauuuugcaucccaug

SEQ ID NO: 4170734 - RNA, 84 nt, Human
uauguaaaguagaaauguaagaaggauuauggaaguaauugaauuucucuuuuuuaguuuuuuuugacauaucuguauuauaug

SEQ ID NO: 4170735 - RNA, 69 nt, Human
uauguaaauggccagcaacaggagugaagguguugggguugcauucacucuccuaggcuaaagcucaug

SEQ ID NO: 4170736 - RNA, 74 nt, Human
uauguaaauguacuuaugacagaauuaugcuaaauuuaaaaugcaguaugcaaaugucauaagcauguuuugua

SEQ ID NO: 4170737 - RNA, 83 nt, Human
guuucuauucaacuuauaagauauuaaugguccuaauccacuggaaaagauugauucuguaagucaacaaugagugaggaagc

SEQ ID NO: 4170738 - RNA, 99 nt, Human
guuucucacgguaauucauucaacacauauuugccaagcccuugcugaguauuaaauaccgagcgagguuuugcagauacagcagugaacgaaagagac

SEQ ID NO: 4170739 - RNA, 58 nt, Human
guuucucacuuaccaacacauguguaaaauguagcagguguguuaguaaaggagaagc

SEQ ID NO: 4170740 - RNA, 61 nt, Human
guuucucaggugcuauacgcaacuguggugaauaccaaagugauuuaaguaccucaggaau

SEQ ID NO: 4170741 - RNA, 92 nt, Human
guuucuccccucugguguagcuguccagugagucccuuugaaauaaagguaugauacugugacaugcuugcaaaaaguauacauggagaagc

SEQ ID NO: 4170742 - RNA, 60 nt, Human
guuucuccugcagucagcagucucacucccugccagugggaaaagcagauagagagugac

SEQ ID NO: 4170743 - RNA, 87 nt, Human
guuucucuggaaugaagcuauguacauugauaugaaaaugagauguaaucuuuauggcuugauaaacugacuccuuuuaagagaaac

SEQ ID NO: 4170744 - RNA, 70 nt, Human
guuucucuucuugaaagaggaauucaaaugacaaugaacauuuuugggguccucuuuuauggaguuugau

SEQ ID NO: 4170745 - RNA, 117 nt, Human
guuucucuuucuuugauauuccuagaaaaauacuuuauugugaugggaucagaaccuuagaguuggaaagacccuuagaaaaaacgucuucuagugaauaaauaaagaaguugagac

SEQ ID NO: 4170746 - RNA, 66 nt, Human
guuucugcccugcuggagaucacaguggaccccagcucaguccagcuucccaccagggcagcaggc

SEQ ID NO: 4170747 - RNA, 68 nt, Human
guuucuggcacagacauuuaauagccuucaauggucucugaaggaaauuagucaguguugccaaaaau

SEQ ID NO: 4170748 - RNA, 67 nt, Human
guuucugucugcuaugcuuguugucacugcaccuuaguucaucugauagcacaaguagauagcaaac

SEQ ID NO: 4170749 - RNA, 71 nt, Human
guuucuuaacagauuagggguuucaucucaauuugcaauugggacuuaauaugcccuugauuuccggaaac

SEQ ID NO: 4170750 - RNA, 61 nt, Human
guuucuucccuuuagcauauaguaguuuaguaugacuuguauaccguaaagggagagcagc

SEQ ID NO: 4170751 - RNA, 106 nt, Human
guuucuuguuuaugagaacaagacauuuuacauucuuccauuguagguuucauaaccucagggauacacaggaaucuaaaaugucaguggcucggcuggaagagac

SEQ ID NO: 4170752 - RNA, 110 nt, Human
guuucuuuacagugacuggugguaguuccaaguucucuucuuugucucagaauauacugguugguuccauucacaaagaagggaaguacaucugcugaaguuaaaggaac

SEQ ID NO: 4170753 - RNA, 88 nt, Human
guuucuuuagccauggguagagaguggauggagcugcgaagcugccaaaacaguauucaaguuucccucuuggaacagcuagaggagc

SEQ ID NO: 4170754 - RNA, 55 nt, Human
guuucuuuagggaucauacagggcccauuucugggcccuggacuccugagcaaac

SEQ ID NO: 4170755 - RNA, 73 nt, Human
guuucuuugugggaauguuacaauggguuauaagaaaaauauuacagccuuuaaccauuucuuccaaggaaau

SEQ ID NO: 4170756 - RNA, 81 nt, Human
guuucuuuuguauuaauaguuccuacuuugcacuaauaggauauuccuauuugaaaggggacuauugcaaacaacaggaau

SEQ ID NO: 4170757 - RNA, 74 nt, Human
guuugaaccccaggaaguggaggucauggugagccaagauugcgccauugcacuccagccugggcaacaagagc

SEQ ID NO: 4170758 - RNA, 67 nt, Human
guuugaagaucugucaaccccauauuugcuuacaaaggaagcuguauaaaggcacagguuuucugac

SEQ ID NO: 4170759 - RNA, 82 nt, Human
guuugaagcagccacagcaacaagugcaauuaucauucuuacauucaaucagagauuguccuuucauguggcuauuucaugc

SEQ ID NO: 4170760 - RNA, 125 nt, Human
guuugaagcugaaguugaauggucacuccuacuucuacugugaaucuggacuugucugugaagagaucuguuucuuuagggcaguuuuagaggccacugggaaggaccacaggccugcuucuuau

SEQ ID NO: 4170761 - RNA, 58 nt, Human
guuugaaugaauucuacuuccagauguguucaaguauauuuguagcuuucauucagac

SEQ ID NO: 4170762 - RNA, 64 nt, Human
guuugaauggugagauugccauuucagaguuucaauguauugaucugacaaucucauuucaaac

SEQ ID NO: 4170763 - RNA, 103 nt, Human
guuugacagcuauuuccuuuucaaaguucuggcuucuuagguguucagagauagcucuuuauccaccagggacuaggacuaggaggcuauaguucugucuggc

SEQ ID NO: 4170764 - RNA, 83 nt, Human
guuugagagauuuaaguagaggugauaggacucuaauugcaauucacucacaguaagaguucucucucauuugagcucaagac

SEQ ID NO: 4170765 - RNA, 72 nt, Human
guuugaguuuuguuuugagucaacuccacgggcagcucugugaaggauggauuucaaagggacaagucugac

SEQ ID NO: 4170766 - RNA, 124 nt, Human
guuugauaaauuuaggaguauuuuaauuucauaggcuaauuucuaaggauuuucucagacuucaucuuaugagaugacuuaauguuggucauaucauugaagcuuuucuauuuuuccaucaaau

SEQ ID NO: 4170767 - RNA, 64 nt, Human
guuugauacaggccuucuagaugauagggauuuaaacuuauuuuuuaguuuuucuguguuuugc

SEQ ID NO: 4170768 - RNA, 87 nt, Human
guuugauacucacagagagcuugcccuuguauauuccaugucaauaaaccgaauauacaaagggcaaccucgcuuuaaguaccaaac

SEQ ID NO: 4170769 - RNA, 68 nt, Human
guuugcaaaauuuaaaaucucuguagaccaaacaaaacuggucuucaugccaaaugaguuuuguaaac

SEQ ID NO: 4170770 - RNA, 102 nt, Human
guuugcagaagacacauuucugauguggacugggaugacuuggaagaggguguggucucucccacaggacaguuaaugugcaguguugugucuuuuaaaaac

SEQ ID NO: 4170771 - RNA, 57 nt, Human
guuugcauguauuaagucaauaguaauguacuguguguuauuuauuuacauguaagc

SEQ ID NO: 4170772 - RNA, 96 nt, Human
guuugccaugcuuuugcauugguuuaauuuugcuuuggguuuuauucaauuaauaaaguaaggcagugaaugagauuacguaucuguauggcuaac

SEQ ID NO: 4170773 - RNA, 57 nt, Human
guuugccuuuuagauaggaaugcugaaaauaaugagacacuucugucuggaggaaac

SEQ ID NO: 4170774 - RNA, 65 nt, Human
uauucacagaugaggaagagucagccaaggacuauuugguuuaugucuaccugcaucucugaaug

SEQ ID NO: 4170775 - RNA, 91 nt, Human
uauucacuaugauuugggcaucuaauuuggcuucauuuguucugcuucagguaaugccaauuuaaugauccauuuauguaaccguagaaua

SEQ ID NO: 4170776 - RNA, 72 nt, Human
uauucacuaugcacacuccuagaccaaaagguggccaaggaccaacugugggagugggagugggaguggaua

SEQ ID NO: 4170777 - RNA, 67 nt, Human
uauuccauggcaacauaugcuuucaugagguacuuuuguauuuucuagaguauguguucugguagug

SEQ ID NO: 4170778 - RNA, 75 nt, Human
uauucccaggaugcuuuuaagugccccaugcaaauguauucucagcauguccacuuugucagugucauaggaaua

SEQ ID NO: 4170779 - RNA, 64 nt, Human
uauuccugcauuggucaacccauccacuuauacugaauccggauggucuccuaguucaggaaug

SEQ ID NO: 4170780 - RNA, 66 nt, Human
uauuccuuuucccaagucuccaaugugggaagaauauaauuccgggacuacugaggaggggguuug

SEQ ID NO: 4170781 - RNA, 84 nt, Human
uauucgguuggugcaaaaguaauugcgguuuuugccauuaaaaguaauugcaaaaaccacaauuacuuuuacaccaaccggaua

SEQ ID NO: 4170782 - RNA, 60 nt, Human
uauucuacucuccuacaggucuacucacaaaugaaguugauuugcagaagguguagagug

SEQ ID NO: 4170783 - RNA, 70 nt, Human
uauucucugugugugugcacauguguguaucggucugucuaucugacuguguguaauauguauaagaaua

SEQ ID NO: 4170784 - RNA, 77 nt, Human
uauucugaaguguuuauaugaacuucauacccaggaucucccuugaagaaauuauuuuauauagucacuuggggaua

SEQ ID NO: 4170785 - RNA, 78 nt, Human
uauucuucuauaucuauuaucucuuuacugcuacuacaaagaucuuuugaugguggagagacaguguauuggggaaug

SEQ ID NO: 4170786 - RNA, 70 nt, Human
uauucuugacugcuuacuaugugccuuacaauguagauuccaaggauucuaugguaaccagacaagaaug

SEQ ID NO: 4170787 - RNA, 73 nt, Human
uauucuuucggagcuuguguaguuuccacauuaauuuaccagaaacaagauacacaucucucuuugaggagug

SEQ ID NO: 4170788 - RNA, 66 nt, Human
uauugaagagauaagugacagaacuuucccugguuauuuugggggaguauuauuuaucauuuagua

SEQ ID NO: 4170789 - RNA, 71 nt, Human
uauugacacgugucuaucaggagguguggucaggguuccuuccccuuuucucugggugggcugugucuaua

SEQ ID NO: 4170790 - RNA, 87 nt, Human
uauugacuucuacuguguagcuuuccuucaucuuucccuucuuccccaugcaaagaaagaugaagaacaugagcacacuguacaaua

SEQ ID NO: 4170791 - RNA, 69 nt, Human
uauugacuugccaagcagaauuauuuauuuggcaccaguaaugugcucuguauucuauggcaguuggug

SEQ ID NO: 4170792 - RNA, 130 nt, Human
uauugagauaaaugcuacaggcuugggggaaaaccucauuuaaaguaauuuauaucaaauuauguggaaaauauuuaggugaaugauguucaagcuaugcucuugaguggaaucugaagcugguuucaaa

SEQ ID NO: 4170793 - RNA, 83 nt, Human
uauugagguagaucagaagugguuuucagugucucguaaaaagucaaaggugcccuguauaacaucuuuuguuucccuuaaua

SEQ ID NO: 4170794 - RNA, 57 nt, Human
uauugaguuaaugguguauccccaauacuaccauuggggaacacuguucauucugua

SEQ ID NO: 4170795 - RNA, 63 nt, Human
uauugaucaggauccuuuuccacaaaaaugagacuuacuggaaaggcuauuucagggucagua

SEQ ID NO: 4170796 - RNA, 60 nt, Human
uauugauuuuguugcuaccugggcugaaagauacagccacaggcagaaaucaagacggua

SEQ ID NO: 4170797 - RNA, 61 nt, Human
uauugccugugcugcuguacugauggugauaauuguccgguggcagcagcauuugguaaua

SEQ ID NO: 4170798 - RNA, 83 nt, Human
uauugccuguuuuugcccucuuuguugaugugucuucccuuucccagagggauauacagagaagggaggcaaaauaaccaaug

SEQ ID NO: 4170799 - RNA, 63 nt, Human
uauugcgaauguuuagcccaucgugauuauuacaaaaucagaacagcgagaauauucacagua

SEQ ID NO: 4170800 - RNA, 61 nt, Human
ucacauaacccagaacagaauuuuucagaggaagaaacugaggcuuggauagguuauguga

SEQ ID NO: 4170801 - RNA, 60 nt, Human
ucacaucugcaaaaucccuuuugccauauaagguaacauucacaggagauuaggaugugg

SEQ ID NO: 4170802 - RNA, 78 nt, Human
ucacaugacuuuaucuuguccuuccugcucccaagagccagagcaagggaagcaggauugggcagagggugaagguga

SEQ ID NO: 4170803 - RNA, 58 nt, Human
ucacaugcccuguauuuaccagugaccaucuaggcucuggaaauacagagguaaauga

SEQ ID NO: 4170804 - RNA, 70 nt, Human
ucacauggccaaggaugcucaaccaugaaucgcagugaaagguuuguggaugugcuucuugauaugauga

SEQ ID NO: 4170805 - RNA, 89 nt, Human
ucacauggccaucccucucugcaugacugugucuuucuccucuucuuguaagggcaccagucauguuggaguaggguccacccuaguga

SEQ ID NO: 4170806 - RNA, 80 nt, Human
ucacaugucggcauaaagcucuuaaauugaccugcuuuagauuaaagcacaauauggguuuuauaguuugccucagguga

SEQ ID NO: 4170807 - RNA, 55 nt, Human
ucacauguucucuucuuccuuuugaucuuaaaugaggaaggggcaaaguguguga

SEQ ID NO: 4170808 - RNA, 56 nt, Human
ucacauuauucuaaagagguacugggucaguucccaguagcucaaagaugguguga

SEQ ID NO: 4170809 - RNA, 70 nt, Human
ucacauuuaagcuucaaagaacauauuggaaaugagcuuuucaguaugaaaguugugguugcuuauguga

SEQ ID NO: 4170810 - RNA, 71 nt, Human
ucacauuugccaguguaauuucagggcugcuuuuggaguagacauuaaauuacacugaagagugaaugaga

SEQ ID NO: 4170811 - RNA, 91 nt, Human
ucaccacagggcacaguuugccuucucuucccugggagcucuuguucauuugucaggagaccuaaaagaaggcuacuauguacaguggugg

SEQ ID NO: 4170812 - RNA, 74 nt, Human
ucaccaccucucaugugccaguaauuucuagggccccuauagaaaucugacugcugugcacauagagggacuga

SEQ ID NO: 4170813 - RNA, 68 nt, Human
ucaccacggaagcagcagaguagacagagcccugggugaguccaggcugucccugcugcacuagguga

SEQ ID NO: 4170814 - RNA, 59 nt, Human
ucaccacugcuauguccccagcccaggcuaaaugccaggcacugggaaugcagugauga

SEQ ID NO: 4170815 - RNA, 86 nt, Human
ucaccagagacuucaaaucaugcuaaaccuaaugggucauuuuuccucugaguuuggccccaugguucccagguucccauuguuga

SEQ ID NO: 4170816 - RNA, 117 nt, Human
ucaccagcaaggcaucguguccucuuuguguccugagaugccuucucacuaagccucuuuccagaccuuugguccuggggaucugcagugagcagagaggcagcuccuugcggguga

SEQ ID NO: 4170817 - RNA, 121 nt, Human
ucaccaguggggcuccaauuaugccagggaaggggacucuuuuucccuuucuagguucucaugaucaucucccaaggcacagaaagagucccuguggccggcuuaggaucagucacuggga

SEQ ID NO: 4170818 - RNA, 55 nt, Human
ucaccaguuaaaauaacaguaaccauauuuauuggcucuguuuuugcuuugguga

SEQ ID NO: 4170819 - RNA, 58 nt, Human
ucaccauuggcaauuauaaaacuucacuauagaaagaaaauauagauggcagugguga

SEQ ID NO: 4170820 - RNA, 77 nt, Human
ucaccauuuauuaagauaauaccaugggccaggcucugugcuaagugccuugcauauauuauaucuuugauguguga

SEQ ID NO: 4170821 - RNA, 90 nt, Human
ucacccaggaacuuguuagaaagguagaauguuggguccuacacagaccugcugaugugggaucugcaguuuaacaaaaucuucagguga

SEQ ID NO: 4170822 - RNA, 57 nt, Human
ucacccaugcaagaugcauuccucagguuucugagucagcugccuccagcaggguga

SEQ ID NO: 4170823 - RNA, 120 nt, Human
ucacccccacccccugccucuccuuuugcuuuauauucaagagaggagcagucccaccuugaugcuucucaucuaaguuauaucaguacaggugacagaggucaggggugguggggguga

SEQ ID NO: 4170824 - RNA, 60 nt, Human
ucacccccucuuccccucauugcuuagacacagcuaagcagugacucucagaggcagugg

SEQ ID NO: 4170825 - RNA, 55 nt, Human
ucaccccuaccaaggagcacugaaguuuauacacugcccugggaguuggggguga

SEQ ID NO: 4170826 - RNA, 80 nt, Human
ucacccugugggccucaaauguggagcacuauucugauguccaaguggaaagugcugcgacauuugagcgucaccgguga

SEQ ID NO: 4170827 - RNA, 77 nt, Human
ucaccguauuggccaggcuggucucaaacuccugaccucaggugauccaccagccucggccucccaaagugcuggga

SEQ ID NO: 4170828 - RNA, 75 nt, Human
ucaccuagagggcuuguuaacauagagauuagugugcucauaccuacagagucuucuuuaguaggccuugggugg

SEQ ID NO: 4170829 - RNA, 56 nt, Human
ucaccuagcauuccucuuccucauguucagaugugaaugaaggggcagcuggagga

SEQ ID NO: 4170830 - RNA, 79 nt, Human
ucaccucaaggcagucauuuaaucccugcaugccuuaaauacucugcaaaacaggagaguaaugcuguugugaagucga

SEQ ID NO: 4170831 - RNA, 90 nt, Human
ucaccuccccagggaaugcucaagcccagcuuucaccccucugggaaaucggagcagcaaaagcaugggccaaugggcaaggggaguugg

SEQ ID NO: 4170832 - RNA, 63 nt, Human
ucaccugagagagugagcccugacacccuccccucugaguguccccagcuaacucuucaguga

SEQ ID NO: 4170833 - RNA, 73 nt, Human
ucaccugagcccaggcacaaauugcagugagccgagauugcuccgcugcacuucagccugggugucagaguga

SEQ ID NO: 4170834 - RNA, 68 nt, Human
ucaccugaggcuggguggcggagguugcagugaacuaagauggcaccacuacacuccagccuggguga

SEQ ID NO: 4170835 - RNA, 57 nt, Human
ucaccugcucuuagcacuucuucagagguuuacucuggagugaaugaaguaguguga

SEQ ID NO: 4170836 - RNA, 99 nt, Human
ucaccuggagccugcauuguuuccucuuuaaaugcuuuuaucuggcuccccaugaugagccauuagcagcacuguaaagugaugcaagcuaccuagugg

SEQ ID NO: 4170837 - RNA, 77 nt, Human
ucaccuggauuggggucugacacugcuuguguucagcagagggugcaguggcagugugacgcuguucuccgugguga

SEQ ID NO: 4170838 - RNA, 78 nt, Human
ucaccugggaguuucuuagacagacauuaucucugacuccacccagaccuacugaaucaaagaguguucccuagguga

SEQ ID NO: 4170839 - RNA, 92 nt, Human
ucaccugggggaucuuguuaaaaugaauauugauuagcaggucugagauuggccugccauucugcauuuauaacaagcucccacccagguga

SEQ ID NO: 4170840 - RNA, 130 nt, Human
ucaccuuuguucaaaauauuaucuucacuuucugcuuuacugacugugccaggaagaacccaguaguucuacaguugauuaacacugagauuuuccugacaccaguuuucaggcuuuugaacaccuuaga

SEQ ID NO: 4170841 - RNA, 121 nt, Human
ucacgaaugaagggcuguggcuggauuuggccaaaggguuguaguuugcugaucccugacacuggcaaaucagcaucuuuaacaauuaccccucauaucuguuacaguuccugucacguga

SEQ ID NO: 4170842 - RNA, 110 nt, Human
ucacgagaaagcugaucaagaaggcggaccagaagggagugaccaucaucggaccugccacugugagcuuccccuccggaaagccuuuuacguucgaugcuaucuuauga

SEQ ID NO: 4170843 - RNA, 88 nt, Human
ucacgagcccaauacugcaugaggaacuaguaaaugaauaucagauauaagcuaaauuucucaaggugucauguauuugggaggguga

SEQ ID NO: 4170844 - RNA, 66 nt, Human
ucacguucaccucucccugggauuuaucuuacuuuccaccaccuagacaggaaggggcgaaucugg

SEQ ID NO: 4170845 - RNA, 97 nt, Human
ucacuauaguuuugccaggcagagcucaugccugcaccucucauacacugagagcaggugccuguagcucucucaggcuggaauugaacacugguga

SEQ ID NO: 4170846 - RNA, 84 nt, Human
ucacuaugauugugguauguggugauggaauagggaauauguguuugcaguggguuuguucacuaugacugugguaugugguga

SEQ ID NO: 4170847 - RNA, 77 nt, Human
ucagaacuaaaacaguacuuccaguguaggcauaccagcaaagcauacaugugggacuccugcuguuuuuauucugg

SEQ ID NO: 4170848 - RNA, 62 nt, Human
ucagaagagucauagagacauugauuucauucauaaaaucauguacugcuguggcuuucuga

SEQ ID NO: 4170849 - RNA, 57 nt, Human
ucagaagcauguggggagccuguuaaaaauacacagauuccuagaaucuucuucugg

SEQ ID NO: 4170850 - RNA, 61 nt, Human
ucagaagcguugugggaacuugucagcccagcaugauuguuuuaguucccugauguacuga

SEQ ID NO: 4170851 - RNA, 83 nt, Human
ucagaaggccagauuuacagauuugcccuggaucuuacuacacaaacaagaaggaaggaggagaagugaauuuggcauuuugg

SEQ ID NO: 4170852 - RNA, 59 nt, Human
ucagaaggcugaggugggaugaucgcuugagcccaggaguucacauucagccuugcuga

SEQ ID NO: 4170853 - RNA, 63 nt, Human
ucagaagguuuuuagcaaaggaaaaggcuuaaccucauuuguacuuuuguaagaucuuucuga

SEQ ID NO: 4170854 - RNA, 58 nt, Human
ucagaaguacugugcuacaauauuaugcucuagugauucucaaaguauugucuucuga

SEQ ID NO: 4170855 - RNA, 56 nt, Human
ucagaagucccagaauucacaucuccaggacugaagugggucaugugacuuucuga

SEQ ID NO: 4170856 - RNA, 66 nt, Human
ucagaaguugagauauucagggacaggcaaucuugccuuaggaccaagaaugucuccuacuucuga

SEQ ID NO: 4170857 - RNA, 57 nt, Human
ucagaauaaacaugggcauggguugcuucuugcugccacuguccauguuguuccuga

SEQ ID NO: 4170858 - RNA, 57 nt, Human
ucagaauaugcuaaugacauuuaggaggggaaaaaacucauuuuuaguauauucuga

SEQ ID NO: 4170859 - RNA, 126 nt, Human
ucagaaucacuuggccaguuugucgaagcacagauuccugggucccacccccagaguuuaugauucaagaggucugggauggggccugaaaaugugcacuuccagcaaguccccaggugauacuga

SEQ ID NO: 4170860 - RNA, 58 nt, Human
ucagaaucucuggaggcuuggccaugugcauuuuaucaagcuccacaaaugauuuuga

SEQ ID NO: 4170861 - RNA, 130 nt, Human
ucagaaucucugggaggacuuguuaagacacaaauuacugggccucaaucucagaguuucuaauguaauagaaaauauggggugagcccagagaauuugcaauuucuuucaaguuuuugggugauguuga

SEQ ID NO: 4170862 - RNA, 117 nt, Human
ucagaauggaagggguggggaaaagcaaacaggagaagagcugucaccaauucuaaugaaagaauccaauacucaaguucuacugucucugucuuccucuuuauccuuucaucuuga

SEQ ID NO: 4170863 - RNA, 57 nt, Human
ucagaauguucccagucucaguacauucuccccagugaugcuggagugacauucuga

SEQ ID NO: 4170864 - RNA, 60 nt, Human
ucagaauuaagcucuuggucaguagcacugauuaauaacuugaccagagcccuguucugg

SEQ ID NO: 4170865 - RNA, 66 nt, Human
ucagaauugcuuaauucugaaaauauagugugggcaggcaccuauguccugagaguggagcauuga

SEQ ID NO: 4170866 - RNA, 64 nt, Human
ucagaauuggacaauagaagcacggugguuauguaccauagcucuguuaacaguccagcuuuga

SEQ ID NO: 4170867 - RNA, 63 nt, Human
ucagaauuguuugauggguuuguucagaugcagauaucugggugcuacaaacaguauuucuga

SEQ ID NO: 4170868 - RNA, 123 nt, Human
ucagacagagagaguagacuugacaccccucaacuggauauauuuagagauguuuucuuccauaaggagacacuggaaaguauuacaaggggucauucauuguacuccauuuuaaaagucugg

SEQ ID NO: 4170869 - RNA, 64 nt, Human
ucagacagcuugggauaacugaguuaccauaaaaccugcaauguugucucacccacugucauga

SEQ ID NO: 4170870 - RNA, 79 nt, Human
ucagacaucaugaguuccugcuuugcaaagcggagagagagcagcugugcagugcaugucggaacucauuucuguagga

SEQ ID NO: 4170871 - RNA, 88 nt, Human
ucagacauuuuccaaagaaagccaggcaugcuuggacagugggaucuggccacugucagcauccagcgccuggugcucugaagucuga

SEQ ID NO: 4170872 - RNA, 59 nt, Human
ucagacucucaucugguuccucagaucacccugaggacauuucaauacugagggucuga

SEQ ID NO: 4170873 - RNA, 65 nt, Human
ucagacucugcccgugccuuucccaguccgggacaaaggaccauugagagucgggcggggcuuga

SEQ ID NO: 4170874 - RNA, 70 nt, Human
ucagacugauaauuuaagucuugggggcugugauuuuggcaggcccucuuauauuagaguuaccaucuga

SEQ ID NO: 4170875 - RNA, 71 nt, Human
ucagacuuccugcacccgcccucagccuuaccgugcugcagagcuccggcggcggcgggggcaguguccga

SEQ ID NO: 4170876 - RNA, 62 nt, Human
ucagagaaaggccaaaauaucaucaccuuuguuuuacuugguaagaaauggccuguuucuga

SEQ ID NO: 4170877 - RNA, 62 nt, Human
ucagagaaaguaaacacuaaaaugacugcgugaccucauucagucauguuuuuacacuuuga

SEQ ID NO: 4170878 - RNA, 55 nt, Human
ucagagaaguaagguggggugcaaaucgacaggccaucugccuuuuacucuuuga

SEQ ID NO: 4170879 - RNA, 56 nt, Human
ucagagaauccguaagucacaacguuacccugcagguugugaacuucauuuucuga

SEQ ID NO: 4170880 - RNA, 56 nt, Human
ucagagagccucaggcacugccauccuacugauggagaacucugaugcucuucuga

SEQ ID NO: 4170881 - RNA, 58 nt, Human
ucagagauaacugcuacagauaggaaccucuccuucuguggcgcauaguugucucugg

SEQ ID NO: 4170882 - RNA, 56 nt, Human
ucagagauaaugaacauggcuuuggaaagcugaaaacugauguauauuaacucuga

SEQ ID NO: 4170883 - RNA, 71 nt, Human
ucagagauagacggccucuuaauuaaaacaauuggaaagaccaauuuguaaugagaagcuuuguuuccuga

SEQ ID NO: 4170884 - RNA, 130 nt, Human
ucagagcaaaaagguacaagcuuuacuugccaccagcagcugccagaguggaggccuuauguaauuacuucggcuucagccuuggcagcuuuuguuagcccaaaguggauuugcuauauuugugcuuuga

SEQ ID NO: 4170885 - RNA, 72 nt, Human
ucagagcacagaaaguauugacugaauauauauuuuaaaauaauuuguuaacuuucaugugcuauagacuga

SEQ ID NO: 4170886 - RNA, 82 nt, Human
ucagagcacuugugaugugcucagagaugauauuaaauguuuuauaucauuuuggccaugauacagacacauuugccucuga

SEQ ID NO: 4170887 - RNA, 79 nt, Human
ucagagcaucuguucccucucacuuaaagcuuggaaucaaauuagauucuguccagaaagggggcaacaaguauucuga

SEQ ID NO: 4170888 - RNA, 78 nt, Human
ucagagccugccccuccaccaggaugcugcagcgcuuuuauuuaaggcauucuguggucacaggggcagcagcgguga

SEQ ID NO: 4170889 - RNA, 91 nt, Human
ucagagccuguucacucugggggcugccgcugccugccagggagccuggugggggcugcucggcagcuccugagccagcugcacccucuga

SEQ ID NO: 4170890 - RNA, 77 nt, Human
ucagaggagaaggggaaggggcaggggugaaauggaaauucuccaauuccucaggcuucccuuuguccuucccuuga

SEQ ID NO: 4170891 - RNA, 66 nt, Human
ucagaggcagcugauguucugucuaagcuuuguacauguggugugauuugucagcagugcuacuga

SEQ ID NO: 4170892 - RNA, 66 nt, Human
ucaucuucccuccuccuccacugagcaaagcacugaaaggcucaagguugccaggaaggaagagga

SEQ ID NO: 4170893 - RNA, 64 nt, Human
ucaucuuucuuuauggaaauacaugguuuggagccccugguuuuguuucacaaagagagcguga

SEQ ID NO: 4170894 - RNA, 64 nt, Human
ucaugaaccugaggucacaucgcucaucgaagucaggggagcaagauuuaaacccaggucaugg

SEQ ID NO: 4170895 - RNA, 82 nt, Human
ucaugaaggcagcuccuauuagacacugaaugcuaagauaaacaaccagucuugucuaguuggaaccaagcagaccucguga

SEQ ID NO: 4170896 - RNA, 95 nt, Human
ucaugacaccugaggagucuaguuuauggcuucacuuggaauucaaguaacagagaagaagccacuauagauauucuaagcaggaauugucuuga

SEQ ID NO: 4170897 - RNA, 56 nt, Human
ucaugagaauuagagucauuuuuaacuaaugggaaaugacuaaauguucuuauaga

SEQ ID NO: 4170898 - RNA, 58 nt, Human
ucaugaucaaaaugucugauuaauguacacagugcauuaagcacacuuuugaauguga

SEQ ID NO: 4170899 - RNA, 55 nt, Human
ucaugaugucacagagaagcacaguugauugugcucuaccucagugucauuuuga

SEQ ID NO: 4170900 - RNA, 66 nt, Human
ucaugauuggaauggaauauguaggggcuucugggguguuggucauguucuguuucuuaaucuuga

SEQ ID NO: 4170901 - RNA, 105 nt, Human
ucaugcccucaauuuugaucuucaugauuuugucuuguguuaauaauugauaaggaauaguuaauaaagguauagaaucagggaagucaucaaaacggauuauga

SEQ ID NO: 4170902 - RNA, 56 nt, Human
ucaugcucugguuuagcuguuuuuguucuccugggaauacauagccuuagaguuga

SEQ ID NO: 4170903 - RNA, 63 nt, Human
ucaugcugaaacaauaacauacuggggaaggacauuccuuaguguuuauaguuuguagaguga

SEQ ID NO: 4170904 - RNA, 59 nt, Human
ucaugcugacauuguggcugauguacuggaggcguuuagcagcuucaaugucagcuuga

SEQ ID NO: 4170905 - RNA, 55 nt, Human
ucaugcugugaacuguauacauaugcauaccugcaauguauauuacuggcuguga

SEQ ID NO: 4170906 - RNA, 74 nt, Human
ucaugcuuggauuuccuaaggcgcagcugagucaucugcgugacugugccgugccccuaggacauaaggugcga

SEQ ID NO: 4170907 - RNA, 84 nt, Human
ucauggaaaggaacacuugccuugggagccagcaugccagucuucccugcaacagcugaccuuccccagggaccuucuccguga

SEQ ID NO: 4170908 - RNA, 87 nt, Human
ucauggagucaccuugucacagucaccgccuggggcagugugucaggaaggagguggcaacugucgacaggagacucagaagcauga

SEQ ID NO: 4170909 - RNA, 91 nt, Human
ucauggcaguuagcauuauauuaucuggugguuaugcucuuccucccuuuuuuaauaaguagcaugugcacaguaauuuucauugucauga

SEQ ID NO: 4170910 - RNA, 78 nt, Human
ucauggcuuccaguggcaccaacaugcaucaagacaagaaauuuaguucauguagugcucacuggaaaauccuaauga

SEQ ID NO: 4170911 - RNA, 57 nt, Human
ucauggcuugcuaguggcccaaguuuacaugacaaauaugugccaagaaagcuauga

SEQ ID NO: 4170912 - RNA, 99 nt, Human
ucauggcuuugagagaguagccucuuuggauggaaaauguauuccuggugucuaggccauuuucauuaauauuuaaaaaguacuuccuccccaccauga

SEQ ID NO: 4170913 - RNA, 65 nt, Human
ucaugggauugcuguguaaucuaaaugagauaaauguguaauaucucacacaugguaagcuauga

SEQ ID NO: 4170914 - RNA, 61 nt, Human
ucauggggaaagcccgcccucacacuugaccaaugagaaagggucuuugauuucccucuga

SEQ ID NO: 4170915 - RNA, 69 nt, Human
ucaugguaacuucauaaaguuacccaaauuuuacagccgauggcagugagacuuugugaggugaaguga

SEQ ID NO: 4170916 - RNA, 85 nt, Human
ucaugguguaaaugacuaauuauaacuaguuuaaugcucucuaggagauacuuacaguuuuagagcagaacuuguuaacaccaga

SEQ ID NO: 4170917 - RNA, 84 nt, Human
ucaugguuucaucaugauuuucuucauuuuuaggaguaacccuuauaugcacuccugagaaauaagcaaguaaugaaaauauga

SEQ ID NO: 4170918 - RNA, 60 nt, Human
ucauguacauguuucccaauuccucuggaauuuuccaucugagggaaaacauguaguuga

SEQ ID NO: 4170919 - RNA, 87 nt, Human
ucauguauugagugcuccaguggacugggggaggcaggccugcccgccauggccaccacccagccacugcauagcuugccaaacuga

SEQ ID NO: 4170920 - RNA, 67 nt, Human
ucauguauuuuagguaagagcagaagagacuagauugaagucuguuuauuacguaauuaauauaugg

SEQ ID NO: 4170921 - RNA, 93 nt, Human
ucaugucagaucuuuggugcuuguccugacacagcugucagccuuccagcucugugcaguucagggacacacaacaaagaggcagugacauga

SEQ ID NO: 4170922 - RNA, 59 nt, Human
ucaugucccugucccugguuucagauacaaaucacucuuaucagaggauagggaagugg

SEQ ID NO: 4170923 - RNA, 91 nt, Human
uaaagaaugaaguaauuccuccugguacuggcugauuguuuacgguuugccugaucuucaaggaaaaaauacaguuacuuuaugaucuuug

SEQ ID NO: 4170924 - RNA, 57 nt, Human
uaaagaguuucaguuaugcggcuaagaaauggcugccuuuagaacggaugcucuuua

SEQ ID NO: 4170925 - RNA, 90 nt, Human
uaaagcaggcugagugguaauacuagaaagcugagcaucucacucaguguuuauucaauguuauucauucagaaaacauaaccugcuuua

SEQ ID NO: 4170926 - RNA, 61 nt, Human
uaaagcaguguugggucggacgcaauuguggaccagaaaaauaauccaaugcacugcuuua

SEQ ID NO: 4170927 - RNA, 62 nt, Human
uaaagccaauauaccuagcauauaguuuauauaguuguugagauaugcuggguguugcuuua

SEQ ID NO: 4170928 - RNA, 68 nt, Human
uaaagcccuccugagaauuuucaguuggauauaaacacuauucaauuguauugguccaggaaucuuua

SEQ ID NO: 4170929 - RNA, 72 nt, Human
uaaagcugcuguguuggcauuggauagaaugguuaaggaauuaacugucacucuggcaacccaguaauuuua

SEQ ID NO: 4170930 - RNA, 62 nt, Human
uaaagcugcuuggcauugguaaagaaucuagauuggauuuggaaugugaugugaagccuuug

SEQ ID NO: 4170931 - RNA, 56 nt, Human
uaaaggaguaacugccggucaccacuuggaggucaucagcaggaagggcaccuuua

SEQ ID NO: 4170932 - RNA, 58 nt, Human
uaaaggagugugaugaaagggaccggauaauucuuuuccuauuucugugccucuuuug

SEQ ID NO: 4170933 - RNA, 63 nt, Human
uaaagguaugucuuaaucaaacauugcucacuuuugcguuugggacuuggggggauaucuuug

SEQ ID NO: 4170934 - RNA, 103 nt, Human
uaaaggugagcaaacccaugagcaguuuuuaaauugauguguuuuagucuacacaugaacaaauucuguuugaggguuaaagaagcuauuauuuuguccuuua

SEQ ID NO: 4170935 - RNA, 57 nt, Human
uaaagguuagaaagaaauuggaguuguaauuacuucuccagggaauuucaacuuuua

SEQ ID NO: 4170936 - RNA, 68 nt, Human
uaaagugacauuuuuguacaaagucagugcagaugcugucugccuugauaauaaaaauggucacuuua

SEQ ID NO: 4170937 - RNA, 78 nt, Human
uaaagugcagacucccggaaacaacaacuuauuuaucaauuaaaacagcagaguuggguuccagagaucugcauuuua

SEQ ID NO: 4170938 - RNA, 64 nt, Human
uaaaguguaugccaucucucaucaguaucucucauccaguuaauaggagaggauggcagcuuug

SEQ ID NO: 4170939 - RNA, 60 nt, Human
uaaaguguuacagaaacaaaugaacuccuauuaguuuucuauuguugcuguaacgaauua

SEQ ID NO: 4170940 - RNA, 63 nt, Human
uaaaguucaaagcugcaguaauggaaauuggaagaguaaguuuccuaugaguuuugaauuuua

SEQ ID NO: 4170941 - RNA, 61 nt, Human
uaaaguucuggcauuuucugucuucaaguuaugcugagagcacgguuuuuguggaacuuua

SEQ ID NO: 4170942 - RNA, 64 nt, Human
uaaaguuggaccugauuuuauugccaguuuucauucgaauccacugggaaaucggacgauuuua

SEQ ID NO: 4170943 - RNA, 72 nt, Human
uaaauaaaaguucuaagaugcuccacagagaagacaaaugacuucuacugggaacuuuuggaaugaauuuua

SEQ ID NO: 4170944 - RNA, 61 nt, Human
uaaauaaagggauucaacaugggggcaacagaagugcugagcagagcuaucccuuuauuua

SEQ ID NO: 4170945 - RNA, 66 nt, Human
uaaauaaugagauaaagcuaccauguugauuuucuuaggaaaucaagaguuauauuucauaguuug

SEQ ID NO: 4170946 - RNA, 130 nt, Human
uaaauacaaggaagcgaccugagaugaaugggaucauaucuguagcacacuggagccaacuugaagggacucccauugccauagauaggacaauuagaucauuaaaaggaauaaugccugcaaugguuga

SEQ ID NO: 4170947 - RNA, 79 nt, Human
uaaauauaucagugccuggaccccaugacauaucaauuaaaucaaaauaucuguggagggguuuaggcauucguauuua

SEQ ID NO: 4170948 - RNA, 87 nt, Human
uaaaucagaacgugcaugguguaauucuaaugcugcauugcugaaacugcuguagugcugggcuaucuacugcuacauucugauuug

SEQ ID NO: 4170949 - RNA, 78 nt, Human
uaaaucauggggaugagaucuuuaagaagaagaaaaccaaguugucuuccagaaguguuuucagaacccccuguuuug

SEQ ID NO: 4170950 - RNA, 70 nt, Human
uaaaucuccuguuuuucaucuacacagaagauguuguguuuagccaccagauggcgaaagaggauauuua

SEQ ID NO: 4170951 - RNA, 77 nt, Human
uaaaucucuugagcgauuuucauuuuuugcaaggccgcacugcugguguccuggaaaaauggagaguuagagcuuua

SEQ ID NO: 4170952 - RNA, 56 nt, Human
uaaaugauuaguaugugagguggugucuaugcuaauuaucuuacuuuagucauuug

SEQ ID NO: 4170953 - RNA, 82 nt, Human
uaaaugccaguguaaagaauuguggugucaguuauaggcaauagagaguuuccaucauuaacaccacaaggagcagcauuua

SEQ ID NO: 4170954 - RNA, 102 nt, Human
uaaaugguaguacaucuuggcaguggaauaccaggaacaguagaaaagaacugaaguucuggagucccacagccaggguuuaaauucugguucugccauuua

SEQ ID NO: 4170955 - RNA, 65 nt, Human
uaaaugucaaugugauuuauaagaugugugagaaaguaauuacaacagagguuaauugacauuua

SEQ ID NO: 4170956 - RNA, 58 nt, Human
uaaaugugucuauggacccgccugguaguaaguucccugccacccaaggacacauuug

SEQ ID NO: 4170957 - RNA, 87 nt, Human
uaaauuaauuuuuguaauucuguguuuuacuccaauuauauuuaaugguauaggcagagacauggagugggcagggagaugaauuua

SEQ ID NO: 4170958 - RNA, 72 nt, Human
ucaggcugugggaaucuguaaacauccagcauguuuacuucucugaauguuuuacccuuugcacaaaccugg

SEQ ID NO: 4170959 - RNA, 63 nt, Human
ucaggcuuaggagucagccugcuggguacuagcuguguggccucggcagguuccuuaguuuga

SEQ ID NO: 4170960 - RNA, 69 nt, Human
ucaggcuucagcauccacuuaguugccaguauaaaccauuggugacacaguucaugcaugaggucuaga

SEQ ID NO: 4170961 - RNA, 58 nt, Human
ucaggcuuccaacaaugauguugaaggauaaagaguuauaucuccagugggagccuga

SEQ ID NO: 4170962 - RNA, 81 nt, Human
ucaggcuuuuauucauggcuguguuguuccucugaagcucauuuugccuucuggagacccagcaacagggccauguucuga

SEQ ID NO: 4170963 - RNA, 87 nt, Human
ucagggaagacauaauugugucguuugauuuguucaccaaagagcaggucagauggaaagguuacuguccucuuaaaaauauucuga

SEQ ID NO: 4170964 - RNA, 73 nt, Human
ucagggaagauuucauugaguauagggguauacuuaaugaaaguauucuuauacucagugagcuauuccuaga

SEQ ID NO: 4170965 - RNA, 58 nt, Human
ucagggaauaaguagaugagugaaugaaugaauacacuugaauggcauuguuccuuga

SEQ ID NO: 4170966 - RNA, 124 nt, Human
ucagggaccacccuagccaggcccuccaggagacacccuuguguguacucaagagcaugccauuuacauaggcugucacauacauggugcuuucuuggugugccgcgcagugugucaacccuga

SEQ ID NO: 4170967 - RNA, 70 nt, Human
ucagggacccuccuggccuuuggcagccagcuuccuauugcaggagcugagggucuaggaggguucaugg

SEQ ID NO: 4170968 - RNA, 122 nt, Human
ucagggaguugggaaaggagauguaacuuccaucaugggccugagccgauucuugagagauggucagggcuggguaugaagaguugggaggagacacauuccaggcaccgagaacacccuga

SEQ ID NO: 4170969 - RNA, 77 nt, Human
ucagggauggguggggcagaggcgcuuccaaaugcuuuucuucauuugaauauagugucuguguuuucuauugcugg

SEQ ID NO: 4170970 - RNA, 56 nt, Human
ucagggcaaugucccucagaaggaaggucaccuacugaagaaugacagugcuuuga

SEQ ID NO: 4170971 - RNA, 61 nt, Human
ucagggcagcaaaguuugaccucaacuuuuaauucauaauuuugacaggcuguugccuuga

SEQ ID NO: 4170972 - RNA, 68 nt, Human
ucagggcuguuuuucagugugugauuuacucucuccccuuuaauuacccuggagauagcaagccguga

SEQ ID NO: 4170973 - RNA, 76 nt, Human
ucaggggacuuuuccaucuauuuguuucugccccuggcaaggcagcaggcagccauuuggaaggcacagccccugg

SEQ ID NO: 4170974 - RNA, 77 nt, Human
ucaggggccuggcccgggaguuuugaagagucaucuaacuugggaaugaugacugauuuggcugggucagccccugg

SEQ ID NO: 4170975 - RNA, 95 nt, Human
ucagggggaguggagguuggccuagagguccaaagcucugccccaaggcagaagcaugcuaaggauucucagagggcuccgccacacccugcuga

SEQ ID NO: 4170976 - RNA, 77 nt, Human
ucaggguggagcagggcggcuauugugggggucagccugggaaggcguccacaaaccugccagcccugcccuccuga

SEQ ID NO: 4170977 - RNA, 123 nt, Human
ucagguacauuugcauuuccgacaaacagaaucauuuuguauuguaauuaugucccgugcaauaauugggacauacuuaacauuaaagucauuuguuguucaucugaaauucaguguagcuga

SEQ ID NO: 4170978 - RNA, 90 nt, Human
ucaggucuauguacauauucucauaaggagcaagcaacccagaucccuccuuugugcuccuaugagaaucuaaugcuaccacugaucuga

SEQ ID NO: 4170979 - RNA, 81 nt, Human
ucaggucuuugucccaggccaggaauuuuugaacgacaggauccccugugaaaagagagccugugucagggugagaagugg

SEQ ID NO: 4170980 - RNA, 118 nt, Human
ucaggugauuugcccgccuuggccucccaaagugcugagauuacagguguagcugggcaugguggcgcaagccuguaaucccagcuacucaggaggcugaggcaggagaaucgcuuga

SEQ ID NO: 4170981 - RNA, 77 nt, Human
ucagguggaauaaccuuacuuauuacaugggucuucucugaguucaguuuuaaguuuagguucuucuuuuaccuuga

SEQ ID NO: 4170982 - RNA, 80 nt, Human
ucaggugggcuugagaacuguugcucuaaccaggggaucucaaagggaagucucaggacagcagcaucagccucaccuga

SEQ ID NO: 4170983 - RNA, 84 nt, Human
ucagguguauggguugugccucagaaucauuuaucaucuuauaaucaaugggauugauuuagcuucugaacacuaugcaucugg

SEQ ID NO: 4170984 - RNA, 99 nt, Human
ucagguuccagcuccuaguccuaacauugugaugauguggcuauuacuggacaugugcauaaacauauuguuggaggugcugggaauauuggaauuaga

SEQ ID NO: 4170985 - RNA, 66 nt, Human
ucagguugcagaggagagaaguggcucugcuguuuuacugggccaggaacucagcucugcacuuga

SEQ ID NO: 4170986 - RNA, 93 nt, Human
ucaguaaguuuagagagauuuuucugggauuaaugaucugccagagcaucuucagcauucuggaaagcuauucucucuggguuuguuuacuga

SEQ ID NO: 4170987 - RNA, 93 nt, Human
ucaguacauauguugauguucauuagugaaacaguuaucaaucuggccagaauugcccugaguacuguguuuuacuucagcauauguuucuga

SEQ ID NO: 4170988 - RNA, 79 nt, Human
ucaguacuucugcaucuuccagauuacucagcuguuucccagauuuauuacagucucuggaguauggagaaggaucuga

SEQ ID NO: 4170989 - RNA, 116 nt, Human
ucaguagcuuuaucucuggguaucauauugguuaggaacacaggcucuugucaggacauaccugggcuucaaucuuggcucugccauuuccuagcugcaugaccugagauaacuga

SEQ ID NO: 4170990 - RNA, 90 nt, Human
ucaguaggcucagugauggggacaucacgguaaugaauggcuggguccagcggccaucagaagugcuguccuuaucccugucaccucuga

SEQ ID NO: 4170991 - RNA, 74 nt, Human
ucaguauuugauacaugaaaugguggcaucuguccauuuuucucuuugcucaucuucauuuuguccaguacuga

SEQ ID NO: 4170992 - RNA, 63 nt, Human
ucagucagccagcuggugcggcagagcggggcucaggccgggcuccuccucaguugggacugg

SEQ ID NO: 4170993 - RNA, 77 nt, Human
ucagucaugggaaggauaccuuggaacauuuaauaauuuuuuggaguuucagcuugauucucccaaaaugugacuga

SEQ ID NO: 4170994 - RNA, 77 nt, Human
ucaguccuauauagcagugcacaguaggacaccauaaugauuugguugagccuuuuguguauguucucagguuuuga

SEQ ID NO: 4170995 - RNA, 66 nt, Human
ucagucucaucaacucuauuccuuugaaucccaaauacuaaacaguucagauaggugauggauuga

SEQ ID NO: 4170996 - RNA, 55 nt, Human
uccacuguucaguguaguugaacaagcacuugagcaauuacuaugaaccaguuga

SEQ ID NO: 4170997 - RNA, 78 nt, Human
uccacuuaagaguugagugauccugggaaagcuacuucaagugcugaagcuagaaguaccucauaggguuauuuugga

SEQ ID NO: 4170998 - RNA, 97 nt, Human
uccacuuauucauucagcaaacaguuucuggggaucuacuacgugauguauuaaaaugauuaggacccaaauuguguuguugaggaauuagucuggg

SEQ ID NO: 4170999 - RNA, 63 nt, Human
uccacuuccuugcucuaucucuguaauguucauuccagagguuaccuagagcaagaaaaugga

SEQ ID NO: 4171000 - RNA, 78 nt, Human
uccacuuuuugcugucccuauuccuugauggaaaauaaugucaacacuugauaauuccagaggaggacaguccuugga

SEQ ID NO: 4171001 - RNA, 70 nt, Human
uccagaaaccaugacugcucugggcucccaugacaucucauggguuuucucaaguagucaccuuuuugga

SEQ ID NO: 4171002 - RNA, 64 nt, Human
uccagaaauaaaguggacagaguaguuaacugggcuacuucuucucauucacuucauuuuuuga

SEQ ID NO: 4171003 - RNA, 64 nt, Human
uccagaagagcgugaaacagagguccugaccuauuuugggcuuucaacacaggcuuuccugaga

SEQ ID NO: 4171004 - RNA, 60 nt, Human
uccagaaucuucgguaacuggaagacaaguuguagucuaccaacagcugaaauucaugga

SEQ ID NO: 4171005 - RNA, 88 nt, Human
uccagacacuuucuuccuucaguucagggaacccucaauacacaguaagaaugaagagguugcaggucugagcuugaggaggacugga

SEQ ID NO: 4171006 - RNA, 69 nt, Human
uccagacugcuucuaggaugaguggccucaagcagcuacaucaucuuuauacuccuaaagcaucaagga

SEQ ID NO: 4171007 - RNA, 56 nt, Human
uccagagaauucuacgcagugcuguuacauuguucagcugcugaauuagcucugga

SEQ ID NO: 4171008 - RNA, 56 nt, Human
uccagagcuaauucagcagcugaacaauguaacagcacugcguagaauucucugga

SEQ ID NO: 4171009 - RNA, 55 nt, Human
uccagaggcuggguucaccucagauacuuacuugaaucuuauccaagccuccgga

SEQ ID NO: 4171010 - RNA, 60 nt, Human
uccagagggacguuaccaguucauguacaccucccauucuggauuuaugcuccuucugga

SEQ ID NO: 4171011 - RNA, 67 nt, Human
uccagaucaugaaguuugguucuuaaccuguagaagacagaaauaugaucagacuugcauuucagga

SEQ ID NO: 4171012 - RNA, 58 nt, Human
uccagaugauuguuagguagcuguugucuucugagagggaucugaggccucaucuggg

SEQ ID NO: 4171013 - RNA, 56 nt, Human
uccagaugcauucccuuuugcccuggagaaggcccugcaccugaaugcaucuugga

SEQ ID NO: 4171014 - RNA, 68 nt, Human
uccagauucucaccaagucccaugauggggcucuggaccuguccugggacccugggugcagagaggga

SEQ ID NO: 4171015 - RNA, 71 nt, Human
uccagcaagcauauuucagucuaagauguguucccuuucaaacagggacacauugaacauagcuugcugga

SEQ ID NO: 4171016 - RNA, 56 nt, Human
uccagcagggaauuaguagucuacgaaaagugaccuugcugccuucuuugcuugga

SEQ ID NO: 4171017 - RNA, 59 nt, Human
uccagcaggugucuagcaagggucuacugugugcugggcucugugcugggccugcagga

SEQ ID NO: 4171018 - RNA, 58 nt, Human
uccagcagguuggucaggugcaggcuuucagcucaaccuggcugcucaaccugcaggg

SEQ ID NO: 4171019 - RNA, 83 nt, Human
uccagcaucuccaguuagcaguacugauuuuuuuuccccccaacaaaggaacacuacaucaacacuguuggcggggaccugga

SEQ ID NO: 4171020 - RNA, 58 nt, Human
uccagcaugaaggggcuuuuauagccacagaagccaugaggggcccagcauccuguga

SEQ ID NO: 4171021 - RNA, 65 nt, Human
uccagcccucuggcccgcggugugaugccucuacucauggcaacaggcguggacaggugcugaga

SEQ ID NO: 4171022 - RNA, 90 nt, Human
uaaauuuaaggcccaucaguuuuaucugacaaaauaguuauuaucuaugucaaacuuuuugucagauaaaacggaugagucuuguauuua

SEQ ID NO: 4171023 - RNA, 81 nt, Human
uaaauuuauauauguuuucugggaagaaaagcuauuuuacaauauuaagucuuucuaucugagaagauaucuauuuguuua

SEQ ID NO: 4171024 - RNA, 129 nt, Human
uaaauuuuaugucuuauuuucagaaguagcagcucugugguaauaagaaacagcaauuauuuuagggcuaaaauagaagcucucugguucucagacugucacuugagcugaaagacauuaaaggaccug

SEQ ID NO: 4171025 - RNA, 59 nt, Human
uaaauuuuccaccuucuaaccuauaauuaaagacacugugggugaggauggagaauuug

SEQ ID NO: 4171026 - RNA, 102 nt, Human
uaacaaaccauccaaacuguagugacucaaaacaaaagccaucuauuuuacacauuauuauuuaagguggcaagcuggguuggguagccagugguucuguua

SEQ ID NO: 4171027 - RNA, 82 nt, Human
uaacaaaguaaacugagcaagauuuacagacaacuucggcgugguuucauacgagauguauugaagcacauuuauuuuguug

SEQ ID NO: 4171028 - RNA, 63 nt, Human
uaacaagaugauccaggaaagcuccugccaauuugguuguggagugucauuugaucauuguua

SEQ ID NO: 4171029 - RNA, 97 nt, Human
uaacacaccucuacccagguuggagaucugucuauggcagugcagaaauuuucccagucauuacaagauuuccaauuugaauguauuggugauguug

SEQ ID NO: 4171030 - RNA, 62 nt, Human
uaacacaguucucuguugcacagaauuucuaaugggugaauggcuacagagcaauuugguua

SEQ ID NO: 4171031 - RNA, 69 nt, Human
uaacacuacagggccauuggaggauuauaugagcuacugcaugugaagaauuucccaagguccuuguua

SEQ ID NO: 4171032 - RNA, 66 nt, Human
uaacacuguaaaccuagauguugcuaugguagcuccaaacugaauugucuagcuuugacaguguug

SEQ ID NO: 4171033 - RNA, 57 nt, Human
uaacacuguaacagcaucauuuucuaauguauggagaguuuguuaguacagcuguua

SEQ ID NO: 4171034 - RNA, 88 nt, Human
uaacacuuuuuauuuaguuuuuugcuguguuucauuggacauuugcuaguuauccaucaagcacaguaaaagcagauuuuagguguua

SEQ ID NO: 4171035 - RNA, 67 nt, Human
uaacagaaaggggacagaaauaagaauuugaaugaaaauaguugcuuuuaugucuuugguucuguug

SEQ ID NO: 4171036 - RNA, 80 nt, Human
uaacaggaugaaaauuacagauauuuuaagauucucuccaacaaguaucuucaaaugaguguggauuauucagauuguua

SEQ ID NO: 4171037 - RNA, 71 nt, Human
uaacagucaugugcuacugcuaaugagccugacccaaauugcauauuugugagcaaagcaaaugucuguua

SEQ ID NO: 4171038 - RNA, 80 nt, Human
uaacaguguguacauugacaagaacaccgguuugagcuuuaaguuaaaugaaauucaaaucccaguucuaccacuuguug

SEQ ID NO: 4171039 - RNA, 108 nt, Human
uaacauagguuaaaauggguagagguggcuccuucagggaauauggaaauuaagaagcaguacuuuauaugaaugacugacgcuuuucugcaauuuuaguuuuuguug

SEQ ID NO: 4171040 - RNA, 129 nt, Human
uaacaucagccucuagcuguuuaaaauguauuauuuagcaagguagguccauggacaucacaauuuacuggcguacaggacaccuaugcucaaauuuucauuuuuuauuuuggagacuuuuuuuuuuug

SEQ ID NO: 4171041 - RNA, 84 nt, Human
uaacauccuaucuguuauuuacccaucucugugaaacugauuaugagauuuuucccaggugacuagcaggaagcaggucuguua

SEQ ID NO: 4171042 - RNA, 61 nt, Human
uaacaugauauuguuugaggcuaauggccaccauguuugccuccuagcaguaaacauguua

SEQ ID NO: 4171043 - RNA, 85 nt, Human
uaaccaagacacaaaacucuaguuaugaaguuugucuguguaacaaaagauccauaauuggaguuaauagagaugugauugguug

SEQ ID NO: 4171044 - RNA, 79 nt, Human
uaaccaggcuauauauauuuauuaggcacuagaaugucaauugguaugccaaacaucugguuaccuagggucuggcuua

SEQ ID NO: 4171045 - RNA, 102 nt, Human
uaaccauguuguuuuucuagaccuuaaaggccacccugugaagcugcugccuggguauuguggucucuuaaaaugguccuggugaaaaaaacaacuugguua

SEQ ID NO: 4171046 - RNA, 99 nt, Human
uaaccauuccuuuuuacuuuauuuaaggaaagccaaaaugaauuugccucagaaaagcaaauguugacaauuuccugaugagaaaagaagggauaguug

SEQ ID NO: 4171047 - RNA, 79 nt, Human
uaacccucuaagcucugaaguagauucguugcaucuuguuuggauaaaugacaacaccugcuuuugacuuggaguauua

SEQ ID NO: 4171048 - RNA, 81 nt, Human
uaaccuaaccuuaccucauuacaucugcaaugaccuauuuccaaaugaggucagacucugagguacuggguuaagggguua

SEQ ID NO: 4171049 - RNA, 55 nt, Human
uaaccuuugaccuugcuugugcuugugaaggcaggaugcuggaggucaaagguua

SEQ ID NO: 4171050 - RNA, 55 nt, Human
uaacuacccuuacauuccucaggaaauaaugucuugagguacaaugggucaguua

SEQ ID NO: 4171051 - RNA, 75 nt, Human
uaacuacuagguuuaggccaggcaggcccaggccuaguuucgggccuggcgccgggcugccugucuuugguuuua

SEQ ID NO: 4171052 - RNA, 84 nt, Human
uaacuagaauggcaugggaaaugcaguggccuuuaagaaaucugguuuaugccacugucuuuuccaggcugaaauuucuuguua

SEQ ID NO: 4171053 - RNA, 75 nt, Human
uaacucagaacaguaaaauuaagggcaguuaauguuuauauuaauguuggcaugcucauuuuauuuuaagaguug

SEQ ID NO: 4171054 - RNA, 118 nt, Human
uaacuccacagcugcugugaucuuuguccauacaauguaacaucuuugagccucucuuugccuccagaaugaaggugauaccguaucucauaaaauucacagaggccugaaugaguua

SEQ ID NO: 4171055 - RNA, 57 nt, Human
uaacucucacagugcaacaugaagagggccaggugacccugcacgugaagagaguug

SEQ ID NO: 4171056 - RNA, 55 nt, Human
uaacucuuuugucuccuucuacugcuuuaaaaugcuggcggggaugagggaguua

SEQ ID NO: 4171057 - RNA, 64 nt, Human
uaacugcaugcuuuuauaucuguuuaaaagugauuucaauuaggcagguuagaagauacaguug

SEQ ID NO: 4171058 - RNA, 83 nt, Human
uaacuguauuuuaggucucauucuuuguauaugccuugacaauuaugauugcuugauuaaagaaagagcuuuugugcuaguua

SEQ ID NO: 4171059 - RNA, 55 nt, Human
uaacuuauuuuucccuaccugagaaaacugagucucagaaaggagaaguaauuug

SEQ ID NO: 4171060 - RNA, 75 nt, Human
uaacuuuuucuaguuaguuguugaacauggaugugaugguucuccuuucaugaaagacagcaacugugaugguua

SEQ ID NO: 4171061 - RNA, 74 nt, Human
uaagaaaaagcuguagcugugcugauuucuagucuuccuuugagucugguccucuucacaguggcauuuuuuua

SEQ ID NO: 4171062 - RNA, 67 nt, Human
uaagaaacugucacaguacuauccauagaguggaaaacaaugaaguacucguugacaguugcacuua

SEQ ID NO: 4171063 - RNA, 72 nt, Human
uaagaagacccucucuguggcaauuagcauuauuuuaaaaauugucaacagauacuagagagcuuuuuuuug

SEQ ID NO: 4171064 - RNA, 79 nt, Human
uaagacccuuuggugaaccucugaaaggcagugacuaggagacccucucugcuggacaaagggguuuccgacagucuua

SEQ ID NO: 4171065 - RNA, 56 nt, Human
uaagagaugguuaucaaaagcacuugcaugccaauguuuucuugugccauuucuua

SEQ ID NO: 4171066 - RNA, 57 nt, Human
uaagagcagaacagcaacauauagggagaggugcauauguguuuguuuugcaucuua

SEQ ID NO: 4171067 - RNA, 81 nt, Human
uaagaggauccgggguucauuuucacugagaggacggaagaccuuuaaguugauuauaaccacuggaguaaagcucucuug

SEQ ID NO: 4171068 - RNA, 89 nt, Human
uaagagggguaagagacucaucauaauauggaaucuuguucugacaucuucggaaaaguucucuaugguguaaaaacuucaaccucuug

SEQ ID NO: 4171069 - RNA, 66 nt, Human
uaagaguaucuauuaaguacuuugcacaauaucugaugcauauugaguacuuaaaagcuauuguua

SEQ ID NO: 4171070 - RNA, 73 nt, Human
uaagaucaaagaagagaugugggcugcugugcauugugcaugccaguguauuuaguccagucucucaugcuua

SEQ ID NO: 4171071 - RNA, 61 nt, Human
ucaggaagugccuaggcuggccaagucuggggaaagugggcuggcccggggcugcuccuga

SEQ ID NO: 4171072 - RNA, 67 nt, Human
ucaggaauaaacuuagaaugucuacucuuaccaugccuauuaacaugguacaagauguucuaacuga

SEQ ID NO: 4171073 - RNA, 90 nt, Human
ucaggacagggaggcagggccaggagcaagccaggcucugggagggacccgggagcaauggcagcuucugauguggucccuugcuuuuga

SEQ ID NO: 4171074 - RNA, 57 nt, Human
ucaggacauuugucagcaggagccaaaugggaaauucugagcaacagguguuccugg

SEQ ID NO: 4171075 - RNA, 65 nt, Human
ucaggaccaagcaaaguuucuuugcuaggcaaaacuccaacuggaaggaaaagcuuggucucuga

SEQ ID NO: 4171076 - RNA, 86 nt, Human
ucaggaccacaguggagauugcagauucaguucuggcaaaguaggacuuuaagagaaucacuggaauuguuuuuuacagguucuga

SEQ ID NO: 4171077 - RNA, 82 nt, Human
ucaggaccuggcucugugcagucagggcucagucccaggcaggccugggacuggccuggggcugggcacagcagguccauga

SEQ ID NO: 4171078 - RNA, 55 nt, Human
ucaggacgaugaucaucuucauaggauucccgaccugugccuggcuuuguccuga

SEQ ID NO: 4171079 - RNA, 68 nt, Human
ucaggagcuggguuccuuuggugggaaauuggcauuuuuugaagccacugaaggauuucagcaaauga

SEQ ID NO: 4171080 - RNA, 57 nt, Human
ucaggagggaguguggauagaguggauuguuguccccaguuuuccacacccuccugg

SEQ ID NO: 4171081 - RNA, 61 nt, Human
ucaggauccauagacucccaaaggccuccacagauaaacuugagaaucucauggacccuga

SEQ ID NO: 4171082 - RNA, 70 nt, Human
ucaggaucuaaaguuagaaagcccauaaagauaggacacuugucugccaugcuaacuucaguauccuaga

SEQ ID NO: 4171083 - RNA, 60 nt, Human
ucaggauucuccucagaguacagcauuggauugauucuaagauuugaggaaauguccuga

SEQ ID NO: 4171084 - RNA, 64 nt, Human
ucaggcaggacccaaccucccugcucugugcucucacagugccuggcugauggguccugucugg

SEQ ID NO: 4171085 - RNA, 63 nt, Human
ucauaaaguucuaagaauuguagaaaccauaaaguugagguuuauaguuuuuagaauuauaga

SEQ ID NO: 4171086 - RNA, 79 nt, Human
ucauaaauacuuuaugcgauucacagcuguaaccuaaugaguucucauauuguuccugagagucaguggagugguguga

SEQ ID NO: 4171087 - RNA, 55 nt, Human
ucauaaauuggguuggcuggguacuucauguguucauuccacccauauuuaucga

SEQ ID NO: 4171088 - RNA, 67 nt, Human
ucauaaugauuccuuuuaauuuaagcuaaaacuauaguaguuuuguaaaaggaggaagcauggauga

SEQ ID NO: 4171089 - RNA, 83 nt, Human
ucauacaccagaauucagaucaugaaugacugacagaauauuuuguugggcaguccugauuuaaaacuaauacuggcuugugg

SEQ ID NO: 4171090 - RNA, 71 nt, Human
ucauacuaauuuacacugccauuaguuaguauauucucugacuguaagguaaggauaaaaccuugguaaga

SEQ ID NO: 4171091 - RNA, 65 nt, Human
ucauacugugaauuuuccaauauuccguuaggaaagcucccuggaauuucagaagagcagcauga

SEQ ID NO: 4171092 - RNA, 77 nt, Human
ucauagacauuaauuucuuugguaauuuaaaacuaguaaauccuaguaauuaucaggguaaggagauuaagauguga

SEQ ID NO: 4171093 - RNA, 56 nt, Human
ucauagucagugggauaaugucaguaaagugucuugauuucuuccaaagacuaugg

SEQ ID NO: 4171094 - RNA, 68 nt, Human
ucauaguuacacaaaagcaagugugugugcguguguaugcacgucuaugcuugugugagaaaauguga

SEQ ID NO: 4171095 - RNA, 111 nt, Human
ucauauaauuuuguuguuuugaguucuaucuucaggauacugguucuaaaauuggaauucccaagucccaggcuggaaucaauauucuggcucuuacugacuauugugugg

SEQ ID NO: 4171096 - RNA, 62 nt, Human
ucauauagcauuuugcaaaauggcaguuagcaaaaaauggcugcucaguaaaugcugaguga

SEQ ID NO: 4171097 - RNA, 65 nt, Human
ucauaucaaauugacauaugcuguacuugcuuaaaagugagucagccaguuaagucaagaaauga

SEQ ID NO: 4171098 - RNA, 129 nt, Human
ucauauguaaagucagcccaguauccaggaaagguagaagauucauuuccucugaauuagucguaggaaguggcauauucaggucauuuggaucccugccugcccugggcugaauucacagcucuuaca

SEQ ID NO: 4171099 - RNA, 105 nt, Human
ucauauucuuuguguccaucagucucucauugcaguauguuguauaucauguaaaaaugaugccuaugaauuguaaugugaaauugcaaauauuucaagaguuga

SEQ ID NO: 4171100 - RNA, 89 nt, Human
ucauauuuagcacuugcugguggcauuuacaguuugccuucuagccauuggaaugcacacccagaaaaauccaauugcugagguuauga

SEQ ID NO: 4171101 - RNA, 74 nt, Human
ucauauuucuacuugccaaaugacacauuguauuuucccugucaaugcaaucaguaagcaaguggagaaaaugg

SEQ ID NO: 4171102 - RNA, 107 nt, Human
ucaucaacauuggccaggcgcgguggcucacgccugucaucgcagcacuuugggaagccgaggugggcggaucacaaggucagggaccagccuggccaauaugguga

SEQ ID NO: 4171103 - RNA, 58 nt, Human
ucaucacuccccucaucaggacuguucuuuacaccccucaggggaccugugagccuga

SEQ ID NO: 4171104 - RNA, 66 nt, Human
ucaucacugccugccccugccccccagccagguuugcugaggguccaggucuucaggcagagaugg

SEQ ID NO: 4171105 - RNA, 78 nt, Human
ucaucagcuugucuuuugauagcaugaguauuaacuaugaaaugguuauaaauugcuaugcagaaugaacagcuguga

SEQ ID NO: 4171106 - RNA, 117 nt, Human
ucaucagggcaaagagucacagugagaaugggaagggagagcccuuggcugugucacacacagggauccaguguccuuccuuuccauggaaguggcuuuugagccaagacaggauga

SEQ ID NO: 4171107 - RNA, 69 nt, Human
ucaucaguguagaguugcuggauuggcuggacacuuuccagcucugauccauaauuuauaccaagaugg

SEQ ID NO: 4171108 - RNA, 81 nt, Human
ucaucaguucccaucgcauuugagcaaucuuuuccuaccagggugggaagaugcaaaauagauguagugaauacgagaaga

SEQ ID NO: 4171109 - RNA, 75 nt, Human
ucaucauggcuguagcccugugaauuagugccuugaugauagggccacagaacagcuacaggacacccauggaga

SEQ ID NO: 4171110 - RNA, 76 nt, Human
ucaucaugggcauucuuggaagcccucugcaagauccuguuucaaguucugcaaguuugggguccaaccuguguga

SEQ ID NO: 4171111 - RNA, 89 nt, Human
ucaucauguucucaugacuagaguauuaguucaaugucuuccgugccauggcuguugaaaguggagaaccugguugugaagauggauga

SEQ ID NO: 4171112 - RNA, 58 nt, Human
ucauccaccauaagcaccuacugugugcuccaggcccaggggacaguaugguggauga

SEQ ID NO: 4171113 - RNA, 67 nt, Human
ucauccagaccauggucauacucgagucagcauguugugucaguuaccugacagugguuaugaauga

SEQ ID NO: 4171114 - RNA, 89 nt, Human
ucauccgcagcaauuggacgccugccuuuugccuacacuuugugagcaacguguggcagaggaggcagcguccccgcggcugccguuga

SEQ ID NO: 4171115 - RNA, 93 nt, Human
ucauccuauuugggucuucuguuacuugcaaccacaggaugcuaguuaauaaacccacuuguaguuuuaaagcaugagccccaaauuauuuga

SEQ ID NO: 4171116 - RNA, 67 nt, Human
ucauccuucuaccuaggacuauuuuucagacuuugacccugggagguagagcuccaguagaaaaugg

SEQ ID NO: 4171117 - RNA, 58 nt, Human
ucaucgccucgugcaucuuggcucugaaaugaaguugccccagguuugcaggcguugg

SEQ ID NO: 4171118 - RNA, 129 nt, Human
ucaucguguccauuccuacauaauucacauugaaggugcuuucuucauuuugauacacuguaggauuuuaguagaggaaaaagaaagcauuaaagugaauauuguucuguggagauuuccuuauagugg

SEQ ID NO: 4171119 - RNA, 67 nt, Human
ucaucuccuuccuuaggcaauuugggagaguacuaaguguaacuccuuugcuuugccuaguugaugg

SEQ ID NO: 4171120 - RNA, 87 nt, Human
ucaucuccuuuugagcuggagguuaucagagagcaucucaauuuauagaaauggaaucugaggccuucagcaugaaucuuuggguga

SEQ ID NO: 4171121 - RNA, 80 nt, Human
ucaucucuauuggaacugagcaauggcaugaaauuaggagaaaaguaauuucauugagaguugaguuccuguggagauga

SEQ ID NO: 4171122 - RNA, 74 nt, Human
ucaucucuucaaccaugaaaucacaagcugaggacuuaggggagucauuagagauugguuugugguaagaguga

SEQ ID NO: 4171123 - RNA, 111 nt, Human
ucaucugaagauugaacuggguaucuauuuccaagagcuuuaauuguugaccgaauuugguucgucaagggcuguuggacuagagaaugcccucaguuccuugucauauga

SEQ ID NO: 4171124 - RNA, 59 nt, Human
ucaucugcauguguuauauuugguucaucaacagggaaaaaaauagacacaugcauuga

SEQ ID NO: 4171125 - RNA, 64 nt, Human
ucaucuguaagauuuuuggcuuucgagguacuuauuugaaagcuaaaugaggucuuacagaaga

SEQ ID NO: 4171126 - RNA, 78 nt, Human
ucaucuucaguguuggcuacaucugccuggcagcaacauggcugcaacaauuucaggcaggguuaacaucuggaaaga

SEQ ID NO: 4171127 - RNA, 63 nt, Human
ucaucuugcugccauugcuuuaguuuaaacuggacccacaaaucugagcaaugucagcaauga

SEQ ID NO: 4171128 - RNA, 78 nt, Human
ucaucuuuuccaagauuuauacagaaauuuuauaaucagagaaaagguagugggaagagggguauaaagaagggauga

SEQ ID NO: 4171129 - RNA, 68 nt, Human
ucaugaagcuuacaguaugaucaacuuuucaccuguggaaaaauauaauuaugcuguaaguuguuuga

SEQ ID NO: 4171130 - RNA, 63 nt, Human
ucaugacaugugaauugaauauuauuugcugcucacugcaaacauuuucagcauaugguauga

SEQ ID NO: 4171131 - RNA, 82 nt, Human
ucaugacuaucauauuuucaugacuaccuuaaauaagcacaaagcuuauuucaggggguacaagaagauaggguaguuuuga

SEQ ID NO: 4171132 - RNA, 114 nt, Human
ucaugagcaauuacauucacauuucucugaaauauauacaggaauugaauuguuuaaacaaauaauuuaugguauguguguaauaguggauauguauugauggguguguacuga

SEQ ID NO: 4171133 - RNA, 55 nt, Human
ucaugaggaugcacaaaacaacuuuuccuuugcuugugcaauaguuuucucauga

SEQ ID NO: 4171134 - RNA, 100 nt, Human
ucaugagggucaaauaccuugagauaacagaguugggaagugaaaccagauugguuuuacuccagaauuccuauucugugacguucaaauaacuccguga

SEQ ID NO: 4171135 - RNA, 85 nt, Human
ucaugauuccguuuauguguuuacuauugcauaaauaccuccaagggcuuuggcucuaguaaauauaaccugacuauugaucuga

SEQ ID NO: 4171136 - RNA, 74 nt, Human
ucaugcaauguuaguuugaaagcaccgguucauuaaggauauuaauuuucugauaacuacacauuuaagcauga

SEQ ID NO: 4171137 - RNA, 58 nt, Human
ucaugcagauaagaauaaguaaggagauaacuaaaugauuuggucaaugucugcguga

SEQ ID NO: 4171138 - RNA, 62 nt, Human
ucaugcccauguugggguucuuugaacuggccccagauuauagugggcccaacauggcgugg

SEQ ID NO: 4171139 - RNA, 60 nt, Human
ucaugccugagacuguuaauuggcucagcauucaggcacauuugagacauccaggcaugg

SEQ ID NO: 4171140 - RNA, 74 nt, Human
ucaugcgguuaggaaauguaaaaguagauaagaauuacggguuuucuuguacaaaugcauauuccugggcgugg

SEQ ID NO: 4171141 - RNA, 90 nt, Human
ucaugcuaccagcuagguaauagacuugcagcccaugggaacaaagaggacuuacaugcagcugcucuguuucuuagcuggguaaaauga

SEQ ID NO: 4171142 - RNA, 81 nt, Human
ucaugcugagcccuuauuuguagaauaauaucuuucuggaguaggcauuguagagagccauguuuuacaacccagcaauga

SEQ ID NO: 4171143 - RNA, 85 nt, Human
ucaugcuuaagauauuaaugacaugugagaggaaugaccugaaagacaagcuucuguucacauuuuaucuauuuuaagucaauga

SEQ ID NO: 4171144 - RNA, 60 nt, Human
ucauggaccaacaucugacugaucccuaagaaaucugaaggucagaggauuuggcuauga

SEQ ID NO: 4171145 - RNA, 56 nt, Human
uacugucagaaugucaaagcaaugaauuuaauaauguuuugauagcaaagacggua

SEQ ID NO: 4171146 - RNA, 76 nt, Human
uacugucuuuccauccuugccuggucuggaauugagaacagaagaccuaugggggcaucaaggagggaaaguagua

SEQ ID NO: 4171147 - RNA, 95 nt, Human
uacugugcagcagaggucugacacugaaugguacuaccagucagaaggcuggggaacaaucauacaugcuuuagaccucuaagagccuagcagua

SEQ ID NO: 4171148 - RNA, 62 nt, Human
uacugugguaacauuuuaaauugccauauguagaggcaaaauugguuaaaaaugcuacagug

SEQ ID NO: 4171149 - RNA, 87 nt, Human
uacugugguucagggacuguccuacauggagagguccaguaccuggacuuuggggucugauaguccuagguuugaauuucacgugug

SEQ ID NO: 4171150 - RNA, 62 nt, Human
uacuguguaguauuguugugaugauuaaaugcgugaacacaucuacagcugucugcacagua

SEQ ID NO: 4171151 - RNA, 59 nt, Human
uacuguguugugcugaaagggagaaugguuguuuucccucacuuguguucaauacugua

SEQ ID NO: 4171152 - RNA, 61 nt, Human
uacuguuauuucuuccuguccuucaaacaccccugcaagacagacaggaaggcuaccagua

SEQ ID NO: 4171153 - RNA, 72 nt, Human
uacuguuuuacagugauagagaguagcuaugagaaaauuucaaaguaauacuaaauaucaccuagaaaagua

SEQ ID NO: 4171154 - RNA, 64 nt, Human
uacuuaaaacugauagaaucucaucauuuagaugaauccauaauugugucagugaauuugagua

SEQ ID NO: 4171155 - RNA, 73 nt, Human
uacuuacaaaggagaggagauagguaccaaagacuaacgcuauaagaaaucucuccaucuccuuuuguaugug

SEQ ID NO: 4171156 - RNA, 84 nt, Human
uacuuacauacccagcuggggaaguggggcauaugguucuacauaucuuauuuuauuucuccaaaacaugcuaagugguaggua

SEQ ID NO: 4171157 - RNA, 83 nt, Human
uacuuauuuuuuauagacaaguaugagaaagcuauuaccuccugaggagcaauagccuacaugcgucagagacagagugagug

SEQ ID NO: 4171158 - RNA, 108 nt, Human
uacuucaaaaguauguucuugacauagauguuuuaguaauacugucauaaacaaagacuuaggugaugguacuaaaauaguuuauucaaggcuaaacucuuuugagua

SEQ ID NO: 4171159 - RNA, 61 nt, Human
uacuucacaguaaauccagaagaaauuaugcacuuaauuuuucugggugaauuguguugua

SEQ ID NO: 4171160 - RNA, 56 nt, Human
uacuucuguaagugcgccaaggggccgcagguacuuaggcugcacuugaggaagug

SEQ ID NO: 4171161 - RNA, 129 nt, Human
uacuucuuccuuuagagucagguguugugugucucuuuuuccugccuuauuguacuggagaggauaccagugcaauauucaaaguggagaggaguuuuuucaauaaacaaacaaauauuaaaguagaua

SEQ ID NO: 4171162 - RNA, 97 nt, Human
uacuugagacugccacagaauuaaagagcaacaaguuugguuuuaggaaacuaaaauuccagccucaguucuauuauaugugugugcucucuuggua

SEQ ID NO: 4171163 - RNA, 64 nt, Human
uacuugaguagcaugauucuagguauugauauaugcaauaaaagagaucaaagcuugccaagua

SEQ ID NO: 4171164 - RNA, 93 nt, Human
uacuuggugacuugugaguuguugauacgggagcuagauuacaugucaguaaacaugagaauagaaaugugauaauagcuuaaggaacuagug

SEQ ID NO: 4171165 - RNA, 72 nt, Human
uacuugucacuguuuuacauguuauuuaauaauuuacaguuauuuaaaagugguaagauuccaaggcaagua

SEQ ID NO: 4171166 - RNA, 116 nt, Human
uacuugugcuuuuauucauuuauucaaaaagugcuaaauaagcccugaaggggcuuuuggggggucauuuggggcuuauuuagcacuuuuugaauaaauaaauaaaagcacaagua

SEQ ID NO: 4171167 - RNA, 81 nt, Human
uacuuguguaaacaucaguacaaagacuaaaagcucauuguaaugaauauguuaguuaauugacuauguugcauacaggua

SEQ ID NO: 4171168 - RNA, 68 nt, Human
uacuuuauauaugagaaagcugaacuucagaggguugaaaugaaguuccugagcucauauagcaagua

SEQ ID NO: 4171169 - RNA, 76 nt, Human
uacuuuguggugucuauauuuuuauucguggagaucugucuucaaacugaaaauuuagaaugaacauuucaaagua

SEQ ID NO: 4171170 - RNA, 63 nt, Human
uacuuuucuuugucaugcaucuuucuguuggagaaacugaccacugcauacagaggggaagua

SEQ ID NO: 4171171 - RNA, 80 nt, Human
uagaaaagaaggccaagaggcuccaagaucuuaagaaccuguguuuuauaucaagaagcguuuuugcuuucuucauuuua

SEQ ID NO: 4171172 - RNA, 65 nt, Human
uagaaaagguauuggcuggaagccgagagaccugaugugauccuggcucucccaauaccuuucug

SEQ ID NO: 4171173 - RNA, 55 nt, Human
uagaaaaguaugggacugacauacacauuaaaguauggucccucacuaaauucua

SEQ ID NO: 4171174 - RNA, 101 nt, Human
uagaaaauaaaguagagcucuugcuaaaccauuucuagggaucauaaaguagaaucuugcuaacuauuccuaaagaucaaggguuuaauuuguuccuucua

SEQ ID NO: 4171175 - RNA, 101 nt, Human
uagaaaauacagugagauuugcuggguaaauagguuuugaaccaugaaaaaauugauggcaugcaagaucuuccucaauagaccuaagagucucauuucua

SEQ ID NO: 4171176 - RNA, 59 nt, Human
ucaugaaaacugaaauucagaguggcagcugcugcuggcugacucuggucccaguauga

SEQ ID NO: 4171177 - RNA, 91 nt, Human
ucaugagcucucugaaugcaaggccuguaucugauuuacuuuugauucccugguccgaggccuuaguauauaaagagccaucagcucguga

SEQ ID NO: 4171178 - RNA, 60 nt, Human
ucaugaguggcugauguccucuagucuugcuuacugaccaaaauaucagcuacuucaugg

SEQ ID NO: 4171179 - RNA, 55 nt, Human
ucaugaguuuucuggucaccuugguuguaagagcaaaagauuagaaaacacauga

SEQ ID NO: 4171180 - RNA, 63 nt, Human
ucaugaugagggucccuggggaugcacuaagaaugcaaugccaccugagacuccucaccauga

SEQ ID NO: 4171181 - RNA, 57 nt, Human
ucaugcacaugugucaccaucagcauuuuuaugugccaguaaugcaucuguguauga

SEQ ID NO: 4171182 - RNA, 74 nt, Human
ucaugcacuagcuaaauaaccaguugcgcucauguacccugaagcaaauuguuuagccugacccauguguaaga

SEQ ID NO: 4171183 - RNA, 58 nt, Human
ucaugcagcaauaugcauuaggugccuguaauguacuagaugcuauuuuagcugcugg

SEQ ID NO: 4171184 - RNA, 60 nt, Human
ucaugcagugaaucuuucuugccagagagacuaaaaaggcagagagcuagaacuucauga

SEQ ID NO: 4171185 - RNA, 86 nt, Human
ucaugccuaaaauuacuucauuauuggaaccaguguuugaucugugauuaagagcuggaugaagaaaucaaguaaucagccauuga

SEQ ID NO: 4171186 - RNA, 71 nt, Human
ucaugcuaccauuauugaucuuaggcuuuuggggauaacaaccuaagcucagagguagauaauguugcaga

SEQ ID NO: 4171187 - RNA, 73 nt, Human
ucaugcuaugugccauucaauucuacaaguauagagagcgaucugucuuguagacugaaggcuucaggcagga

SEQ ID NO: 4171188 - RNA, 61 nt, Human
ucauggagagguguguucuugaaguuuucccaagggaaagaaucuauauaucaccaccaga

SEQ ID NO: 4171189 - RNA, 81 nt, Human
ucauggauucguuugcuagauuuugaauucagugaucuaauucaagagaauucaguuaucuaauucaagaagaucaaauga

SEQ ID NO: 4171190 - RNA, 70 nt, Human
ucauggcauccucuccagugcugucaucccuuccaccaaguggguuucagggagucacgcuggugccaga

SEQ ID NO: 4171191 - RNA, 71 nt, Human
ucauggcuugggggcuacccuaacauugccuguaugaaaugcaggcuuugacuuggggcagccaggccaga

SEQ ID NO: 4171192 - RNA, 55 nt, Human
ucaugggcugcugacaggggcucagggaugcucccuggccccauccauccuauga

SEQ ID NO: 4171193 - RNA, 83 nt, Human
ucaugggggcugccuugggcagaguuacggagccgcucacucagcgcucaugucggcaggacucgcccauugugccacccaga

SEQ ID NO: 4171194 - RNA, 81 nt, Human
ucaugggucugcugggaaggucugcucaguucugugguugcagguguuuacagcugagcccucaucccuaguuuccgguga

SEQ ID NO: 4171195 - RNA, 72 nt, Human
ucaugguucaaucuggccugacugcagcauccacggcauuguggaaaugcucgccuuggccgagacacguga

SEQ ID NO: 4171196 - RNA, 59 nt, Human
ucaugguuggagucaaaucccagcgcuaccuacuggaugugcuguguggcccagcauga

SEQ ID NO: 4171197 - RNA, 72 nt, Human
ucaugguuuugagccuauuaugcuguuaguaugaucagcauugccccacaauuuaggcuuucaaaugccaga

SEQ ID NO: 4171198 - RNA, 83 nt, Human
ucauguaaauguaaguugccaaaggucauagucuuggaucauauacuccagugagaauucuaaacuucuuggcaauuuuaugg

SEQ ID NO: 4171199 - RNA, 82 nt, Human
ucauguaauacauuaucuucagugaauggcaagaucuauucuaauacguugaacaccuucacuggaugaauguaauacaaga

SEQ ID NO: 4171200 - RNA, 55 nt, Human
ucaugucaaaaucuaaugccagcccauuuuuccuugauauuagguuuugucauga

SEQ ID NO: 4171201 - RNA, 56 nt, Human
ucaugucucuaugugccuauuaccuaaucugguaguaguuacugaauaaaggcuga

SEQ ID NO: 4171202 - RNA, 77 nt, Human
ucaugucugggaguccuauauucuuuuaaaauuugcauuagauuaauuguggaaccuguauggucucucuugcauga

SEQ ID NO: 4171203 - RNA, 67 nt, Human
ucaugugacaggcacuguucugaguguuaaggaugcagcagagaaaagacagucccugucuacauga

SEQ ID NO: 4171204 - RNA, 82 nt, Human
ucaugugguacucuucucaagagggaggcaaucauguguaauuagauaugauugacaccucugugaguggaguaacacauga

SEQ ID NO: 4171205 - RNA, 70 nt, Human
ucaugugucuagugcuaaagcaacucccuggguaggcuuuucuaacagauguggaacacuagacugcuga

SEQ ID NO: 4171206 - RNA, 56 nt, Human
ucauguguuaaacuccaagauagguggaaucucaccauccugacauaaccacauga

SEQ ID NO: 4171207 - RNA, 58 nt, Human
ucauguguugcacugaggaccugccaccuuaugugguguuuuugccaaaaaugcauga

SEQ ID NO: 4171208 - RNA, 64 nt, Human
ucauguucugggagaucugacuuuacaaccaaaauucuguguuagaauuuacccagcaacgugg

SEQ ID NO: 4171209 - RNA, 79 nt, Human
ucauguuuucaggaagugcugccuggugucuaaccugaaggcguccugcugcaguauaagccauuccuuccucccauga

SEQ ID NO: 4171210 - RNA, 66 nt, Human
ucauguuuuugccauaugacucuacuuuccugacuguagaugucuugccugggggcaaauacauga

SEQ ID NO: 4171211 - RNA, 66 nt, Human
ucauuaaaaugcagauucugacucagugaaucuggagugggaccugggaaucugcauuucuaauga

SEQ ID NO: 4171212 - RNA, 69 nt, Human
ucauuaagggauuuagagccagagucuuuuuccaaagagaaaaaggacugaauaauucucuuucguuga

SEQ ID NO: 4171213 - RNA, 60 nt, Human
ucauuagaaccgucaauaguaaaugaaagcagugagaugccucauuuacgguuuugauga

SEQ ID NO: 4171214 - RNA, 56 nt, Human
ucauuagcagcuaugucagcagaggccacacuccugacaagaagaccugguaauga

SEQ ID NO: 4171215 - RNA, 84 nt, Human
ucauuaggacuuuggcauuuuaaauaguucagcuuguaaacccagggccaucugugcaggugaccuaauccaugucucugauga

SEQ ID NO: 4171216 - RNA, 85 nt, Human
ucauuagguuggugcaaaaguaauugugguuuuugcaauuccuuucagcuacaaaauugcaauuacuuuugcaccagcuuauaga

SEQ ID NO: 4171217 - RNA, 79 nt, Human
ucauuauuguauucuguuacagcaacauaaagacaaugcucuauguuucugagauuaauagagauagcaguuagaauga

SEQ ID NO: 4171218 - RNA, 95 nt, Human
ucauuauuuauuuugaaaccuuaaguauguuuacacaagucuguccagcauagauuuagcugugaacagcuuggcuuuaaaaugcuagcugauga

SEQ ID NO: 4171219 - RNA, 62 nt, Human
ucauuauuugcuuuaguuauguucuauaaagucaccaagaacacugacuuggugaauacuga

SEQ ID NO: 4171220 - RNA, 60 nt, Human
ucauucaccauaaccaacaugucaguuucaggguaaacaggcaagaugggugguggggga

SEQ ID NO: 4171221 - RNA, 94 nt, Human
ucccauuuccaggagggagaugccuuuggcucggaggugacauauugguugaguuacccagugaagccgaggcagaacucccugugagauggga

SEQ ID NO: 4171222 - RNA, 86 nt, Human
ucccauuuccuuugucguugauugguuuagguauggguaaugugauuuaauccuggacaaugagaugucaggggaaauuuguagga

SEQ ID NO: 4171223 - RNA, 70 nt, Human
ucccauuuguucgcccagcuccaagagaagucaucgccuucauuguggguuguuuugggcaaaugaugga

SEQ ID NO: 4171224 - RNA, 94 nt, Human
ucccauuuuuggaaggccccucacagcuuggggcaggagagggugagggguggcucccacugucugucuugcugcaggguuggcggggauggga

SEQ ID NO: 4171225 - RNA, 55 nt, Human
uccccaagcagcagaacccauggcagcucgagacagcgucuguguggcuugggga

SEQ ID NO: 4171226 - RNA, 82 nt, Human
uccccaaggccuaggcugggccugccuuccagggggcugaaauauggacacccuuugggaaaggcacagccaggacaaggga

SEQ ID NO: 4171227 - RNA, 130 nt, Human
uccccacagcagcccucccuucugaugagggacucagccugacuccuuggaucugggagguucuucaccuccaggcccauggagcagagcugagccgcucaaguuuccaggcugggaaaauccuguccag

SEQ ID NO: 4171228 - RNA, 65 nt, Human
uccccacaguuuauaaaaugcuuuuuccaacucagagaaagugaccuugaaaacugguuggguga

SEQ ID NO: 4171229 - RNA, 60 nt, Human
uccccacaucucugcaucaggcugucuugcaaauuccugacuuguuaggggaugagggga

SEQ ID NO: 4171230 - RNA, 60 nt, Human
uccccaccuaagauacccaucucccauuccucgggccagagggaagagcuuagaugggga

SEQ ID NO: 4171231 - RNA, 63 nt, Human
uccccagagucucauuuggacaaggacagagccuuguccuuuacuugagacucaaugugggga

SEQ ID NO: 4171232 - RNA, 130 nt, Human
uccccaucugcagaaaggaucugggcacccuuccuccagccuaagccucgccuggcccccaggaguguccaagucauccuagggucaguguggcaggagaaggaggugccuguaggagagaugcagccga

SEQ ID NO: 4171233 - RNA, 129 nt, Human
uccccaugcauacagcucagucaauguccugugguuccucagggcagcuguacucugugucagggacaggugagaugaggaacaccugcagugaccaaggccuggcugaggcugguaagaggcaggaaa

SEQ ID NO: 4171234 - RNA, 55 nt, Human
ucccccaacucuuagcacuguagccagguguaguuauaaauaaacguugggguga

SEQ ID NO: 4171235 - RNA, 57 nt, Human
uccccccagauccccaugugaccugcucaucagaggaggcccagagucuugggggga

SEQ ID NO: 4171236 - RNA, 72 nt, Human
ucccccccgaccccgaccucgcaaagcgcacucccgggcaggguguggucuggaaggcggggcuggcgggga

SEQ ID NO: 4171237 - RNA, 106 nt, Human
uccccccucaaauacccuaguggcuccuucaaucugggccacuuccucaggggaaacaggaugucuucuccaggcuugggccaggucucuggggucugggguggga

SEQ ID NO: 4171238 - RNA, 63 nt, Human
ucccccgugugcaucgcuggcugaucccaguuccaggggugugagaagggcaugcagggagga

SEQ ID NO: 4171239 - RNA, 82 nt, Human
ucccccuaaagcagugggcaccuugagggcagaaccuugccgcgggcaucucuggccccugggguccgagcacugagcggga

SEQ ID NO: 4171240 - RNA, 56 nt, Human
ucccccucauuaccucauucaacucucucaauagccuugugaguaaucagggagga

SEQ ID NO: 4171241 - RNA, 60 nt, Human
ucccccugcccagggauauggccugggcaugucuauccauauccugggcauggcauggga

SEQ ID NO: 4171242 - RNA, 60 nt, Human
uagaaaauggccaagcaggacuugaaucuaaguucacuauucugcugugccaugccucug

SEQ ID NO: 4171243 - RNA, 59 nt, Human
uagaaacaaugacaugcuuguagcaauaagcacagcuagcacccaggucuuuguuucua

SEQ ID NO: 4171244 - RNA, 56 nt, Human
uagaaaggcaagcgugaaauaugaugguauugcccucuauuucaaagugccgucua

SEQ ID NO: 4171245 - RNA, 67 nt, Human
uagaaauaagaugugcuugaguuuggagucuuacaauuucacaaaauaucaagcacuuuuagaacua

SEQ ID NO: 4171246 - RNA, 80 nt, Human
uagaaauacaaauuauaggccccauccuagaucuacugaaucagaaacucuagggauggggcucagcaauuuguuaccug

SEQ ID NO: 4171247 - RNA, 96 nt, Human
uagaaauaucccuguuuucaguagaaaggagcauuuuagacuacuuuuaaagauaauaaacuggcaaaugcuccuuccauuacaguuuuguuucua

SEQ ID NO: 4171248 - RNA, 61 nt, Human
uagaaauauuccuuguggcucguaggcugccuaugcgguaaagacagccuucaggauucug

SEQ ID NO: 4171249 - RNA, 58 nt, Human
uagaaauccccagucucauaguaucuuuuguuacuuuugucagggcugggggauucug

SEQ ID NO: 4171250 - RNA, 63 nt, Human
uagaaauguacaccguggguuuuuuaauuuuuaaaauuaaaacaucaugguuguacauguuug

SEQ ID NO: 4171251 - RNA, 83 nt, Human
uagaaauuguuuacauuucccccuuggaggcugcuaagcccuuagagagccucagaggaggggcagugugaaaauaaaggcua

SEQ ID NO: 4171252 - RNA, 83 nt, Human
uagaacacugacaugggaucaaugaggcaggcuaucuaauccaggcagccugcucuggaauccauguaaaaaccacuguuuug

SEQ ID NO: 4171253 - RNA, 64 nt, Human
uagaacaggaagugagaagcagcacagacaagacacugcuucuccagaccacugccucugucug

SEQ ID NO: 4171254 - RNA, 91 nt, Human
uagaacauguguuccggugucugggacaugcccuuacuccucuucagcuagggcucugugcaccccagcaccgugaaugcacaggacuuug

SEQ ID NO: 4171255 - RNA, 74 nt, Human
uagaacucugcuuggaauuucuuggacuuggucucauuuacuugguucaacuuuucuaaguagucagaguacua

SEQ ID NO: 4171256 - RNA, 71 nt, Human
uagaagaaaguagaauaacuacaacuaaguuuucaauaaauugguuugaguugucucuauaaucuuuucug

SEQ ID NO: 4171257 - RNA, 121 nt, Human
uagaagaaguuauuucccuuuauguuguauuccuaagucaugacaaauuuuuauuagcaauuuggagaauuagagaaugccuggcauuaacaaaguuuuggggaaaugggacuuuuuucua

SEQ ID NO: 4171258 - RNA, 73 nt, Human
uagaagacgaauggcuacauuugugcugguuugcuuauuucugggcucucaauguagugcccuuugucaucua

SEQ ID NO: 4171259 - RNA, 58 nt, Human
uagaagaggauaucgaagucauuuaagucaaaauuucaauugaugauguucucuuuug

SEQ ID NO: 4171260 - RNA, 89 nt, Human
uagaagaucauggugucagcaggauagguuucuuuggaggccucuccuuggcuugcagacggcugccuucuugcuguaucuuucuucua

SEQ ID NO: 4171261 - RNA, 62 nt, Human
uagaagccagaagaguaauccuaguuccucucucucacaaagaguugcucuguggucuuuua

SEQ ID NO: 4171262 - RNA, 101 nt, Human
uagaagccuuaggcucuuuaaggguaaggaacucagaucagccuccuaccagaccuaggaaucuccuccacagaguccuugccaaagggccucacugucua

SEQ ID NO: 4171263 - RNA, 111 nt, Human
uagaagcuuugauugcagguaaauuuaaggcaagauguuuuauaacccaccagcaaaccauauuagcaaugauuauaaagcauuuuugaaauuaugagauuaaagcucuua

SEQ ID NO: 4171264 - RNA, 77 nt, Human
uagaaggcagggugccgacuucagggaugaggccaaggugacauccuagcuggggaguuggcgcuaccugcugguua

SEQ ID NO: 4171265 - RNA, 62 nt, Human
uagaaggcccugguauucuugaggcucacuuugccuugggauuucucaugccaaugcuucua

SEQ ID NO: 4171266 - RNA, 57 nt, Human
uagaaguuuggcgggagagauaauuuuuacaaaauuuguaaauaccugccaauucua

SEQ ID NO: 4171267 - RNA, 94 nt, Human
uagaauaaagaucauucugaaggcuuagucucugaagauggcaagggggaaaacuuuaaagagggaaagacuucagauuuuaauuuaauuucug

SEQ ID NO: 4171268 - RNA, 68 nt, Human
uagaauaagcuuuugauuagaggaggagugugaagcacuucuucugagagaaaaagcucauuauuuua

SEQ ID NO: 4171269 - RNA, 87 nt, Human
uagaauaccgcuaauggucaucugucaaauugcaauaagagaguuuaauuuuauguucaaucagagcaggguuccuguugguuucua

SEQ ID NO: 4171270 - RNA, 82 nt, Human
uagaauggaauacuuagucuuucugaugaaauggaucuuacuuaauuucauugauuuuugaggacugguauucuccuuuuua

SEQ ID NO: 4171271 - RNA, 55 nt, Human
uagaauguggagguaacagacuccuaccggaucuguagaugcccaccagguuuua

SEQ ID NO: 4171272 - RNA, 90 nt, Human
uagaauucugccucacagucuaggugugugauuuaauuucuuccauuuuaagacuuugcuuuauuccuagcccuugugguagcuguucug

SEQ ID NO: 4171273 - RNA, 62 nt, Human
uagacaaggaggcaggaucuggggaguuuuacagaggcuccaggcaauguuucugaacucug

SEQ ID NO: 4171274 - RNA, 59 nt, Human
uagacaguggcagucguguucucuagaagagccuggagaucaggaagacugaacugcug

SEQ ID NO: 4171275 - RNA, 57 nt, Human
uagaccugaaugaucauuuucaaccagauggaggaaggugucauugaugggauucua

SEQ ID NO: 4171276 - RNA, 74 nt, Human
uagacgacaucuuuccuagauacccagaaaacgggagucgcugucaggcugggaguuucuagagaaagacucua

SEQ ID NO: 4171277 - RNA, 112 nt, Human
uagacuauuaaacaugcauguacacacacauacaugcacaccuaaauauauauguauauauguguuuguguguguguguguauauauguguauauauauauuuuauaguuug

SEQ ID NO: 4171278 - RNA, 79 nt, Human
uagacugaguuccuucacagcaguuauuuuacucaucuuugucucuccaguaccuaaaacuuugaaggugcucagugua

SEQ ID NO: 4171279 - RNA, 83 nt, Human
uagacuuugauuauaaauucacuccugguagaccugaacuacaguuauuagguacuucuacuaguuguggugagaucaagcua

SEQ ID NO: 4171280 - RNA, 56 nt, Human
uagagaaaaccacuggugagcuacauguagcuucucaaagcuacugguuaccucua

SEQ ID NO: 4171281 - RNA, 66 nt, Human
uagagaaauaagaggauauuuggccagaagaauguauuucucugcaguguguuuuccuuaacucug

SEQ ID NO: 4171282 - RNA, 68 nt, Human
uagagaagagaaugcacaaaggugucuauugcaguaaguuuuguucucaacauguuugugucuuccug

SEQ ID NO: 4171283 - RNA, 60 nt, Human
uagagaagauggucagaucuccacuacagaacucuccucuggcuucagccauuuucucug

SEQ ID NO: 4171284 - RNA, 59 nt, Human
uagagacaaagauuugcagauuaggcuagcaaauagaauaaaacuguaacuuuguccug

SEQ ID NO: 4171285 - RNA, 56 nt, Human
uagagacauccauauaguugcuucuaugauauggcaagcaacaauaaaauguccug

SEQ ID NO: 4171286 - RNA, 56 nt, Human
uagagagaugaggccuaaucagacacacuggagauuucagagccuuuaucucucua

SEQ ID NO: 4171287 - RNA, 70 nt, Human
uagagagugaggcuuuuggaugaacuguaagugacuucuauauagauucuugaaccagugccucucacua

SEQ ID NO: 4171288 - RNA, 125 nt, Human
uagagaucagggaaaaauuauagccuaugucuuaacucuuuaugguguuuaagagcuguuaugaggcuuucaguuacagcugcaccagagccugagaauaggcuucucucuuuccuccuucuuug

SEQ ID NO: 4171289 - RNA, 71 nt, Human
uagagcaagcccagaugugagaacugaggcuccgagagguucagugacuuaccuggagccauuaacaucug

SEQ ID NO: 4171290 - RNA, 107 nt, Human
uagagcaaugauuauggaaguuucauaaaugcauauaaauguugcugucauaagaccaugaaagacuauuguuugugucaaugacuucugcaacagaauuuucucug

SEQ ID NO: 4171291 - RNA, 83 nt, Human
uagagccaccguauaaagucauuucaaaaguugaagugggaauguauuuagauuuuugagauauuuuauuugguacagcuuua

SEQ ID NO: 4171292 - RNA, 55 nt, Human
uagagccagcaccuagcagacuaccuggaucugcugccauggucgcuggugucua

SEQ ID NO: 4171293 - RNA, 80 nt, Human
uagagcuagauucuuugcuagaucauugggaggucaggaggacccagcagugguaugggaggggauuugggauaauucua

SEQ ID NO: 4171294 - RNA, 64 nt, Human
uagagcuauuuaucagccagaaguagucaaauccuugacuuauucugguucuuggacuguuuua

SEQ ID NO: 4171295 - RNA, 73 nt, Human
uccccaugucuaaauaugagguuggaauaaauacauucuaaaaaccuuucccauacuaagagauuaugcggga

SEQ ID NO: 4171296 - RNA, 56 nt, Human
uccccauucagagugaugcagugagggccagaugucuuccugcugugugaagggga

SEQ ID NO: 4171297 - RNA, 58 nt, Human
uccccccagcccccacuuaccccaagggaaccugggagugaaaggagggcugcaggga

SEQ ID NO: 4171298 - RNA, 67 nt, Human
ucccccuccaugggggcuggccugugucaucaaaaaggaagcagcagccaucccccaaggaaaagga

SEQ ID NO: 4171299 - RNA, 80 nt, Human
ucccccucucuaauccuugcuaccugggugagagugcuuucugaaugcagugcacccaggcaaggauucugcaaggggga

SEQ ID NO: 4171300 - RNA, 68 nt, Human
ucccccuggccaguuugcucaggcaguccaucccgagacagcaagagccagcugggcaagccggggga

SEQ ID NO: 4171301 - RNA, 63 nt, Human
uccccgaagaggaaggggcagggggagccuauaucucucucccaccccuugacucuuuaagga

SEQ ID NO: 4171302 - RNA, 78 nt, Human
uccccguuaaugaacuggacgcccccuuccugcggggcuagguggcaagggcagccaguaacgucauugcccggagga

SEQ ID NO: 4171303 - RNA, 69 nt, Human
uccccguucacagccucugccccaggcacaaggaaaaguccccagugucugggcaggccugagcaggga

SEQ ID NO: 4171304 - RNA, 62 nt, Human
uccccuccaccagagcagcuccuuugcucagugaagaguaaagcagcguggguggggcagga

SEQ ID NO: 4171305 - RNA, 81 nt, Human
uccccuccuucucuagggguuucucuuucucucucaaaacaagaguuuagagaauuaacauuccauggcuagugaguggga

SEQ ID NO: 4171306 - RNA, 76 nt, Human
uccccucucuuauaauccugaagaaccaguauugcuaacccacuucaagaaccacuggcaggaugagugaugggga

SEQ ID NO: 4171307 - RNA, 63 nt, Human
uagaguuuguaauaaugaaggaaguaagugcugcugaugguuccacaucuauuauaggcuuua

SEQ ID NO: 4171308 - RNA, 61 nt, Human
uagaguuuguaguucuacauggcuccauauacauggagauuuuuagaauuacagauauuua

SEQ ID NO: 4171309 - RNA, 64 nt, Human
uagauacacauauauuauuuguggcucaauuuuuguuugggaauuuaacauauguguguaccug

SEQ ID NO: 4171310 - RNA, 60 nt, Human
uagauagauucuccuauagaguggcagggcucacgucaucauuaggagagaauuuauuua

SEQ ID NO: 4171311 - RNA, 87 nt, Human
uagauaggccagucuaagggugccugaguuagggcagaacuuuucucauauguucuuguaaagcucaggcacaaagaaaacuagcua

SEQ ID NO: 4171312 - RNA, 79 nt, Human
uagauaguaaggcacaauaucuguucagcaguggauucaaauggaaacuuccaccaaauaguauauaugcaucuguuug

SEQ ID NO: 4171313 - RNA, 96 nt, Human
uagauauaagauaaagaugaaaacaggacaauuuugagccaccugacugaggauuggcaguaggcagguugucuucuuaguuuuguuguguguuua

SEQ ID NO: 4171314 - RNA, 55 nt, Human
uagauccagcuguuauguuauggccuuggaggacauauucaccaguugugaucua

SEQ ID NO: 4171315 - RNA, 88 nt, Human
uagauccuggugcuauucuuucaggcauaucaaguaaaagacauuuaaaugguuuuuguccuuccugaaaguaguagguugagaucug

SEQ ID NO: 4171316 - RNA, 72 nt, Human
uagaugaucaggacuucacuucuuuugauuuauuuccugaggggagugucugcagugaugucucuucuucua

SEQ ID NO: 4171317 - RNA, 60 nt, Human
uagaugcaguauaaaucauuucuggaggugacauaguaccccaccguaguacuguauuug

SEQ ID NO: 4171318 - RNA, 75 nt, Human
uagaugccugugacagucucugucauauaaauaagaauaugcugcaauuuauaugaacuggacuuuaggaaucug

SEQ ID NO: 4171319 - RNA, 58 nt, Human
uagauguggugguuucuguugaauaacccuuaugguggucaauuuucuacaacauuug

SEQ ID NO: 4171320 - RNA, 61 nt, Human
uagauuaugaguagaaugcaaggccauaaauuguaucugcugcaggcuacuucugacucua

SEQ ID NO: 4171321 - RNA, 95 nt, Human
uagauuauucuuagcuugacaugucagcucuuuauugaaacaaaaauggaaaaaauccauagcuguccuucaaagaguuccaugaagaauaacug

SEQ ID NO: 4171322 - RNA, 98 nt, Human
uagauuauuucauugucauuaaaugaagggaaaguaggaggaucuaauucuaucccuagauuccuuaauaaguacuucauugucagugaaauaauuug

SEQ ID NO: 4171323 - RNA, 59 nt, Human
uagauuccauccagaguuugggaagcugaauucuuccuacaacugugugaaggaaucug

SEQ ID NO: 4171324 - RNA, 62 nt, Human
uagauucuacagcucagcuguccaacaggugccuauugaacaugugagauguggcuggucug

SEQ ID NO: 4171325 - RNA, 89 nt, Human
uagauucuuacugucugugacuacuacgugccaccaagaacuucccacuggugaugccaaaaacguggagccacagauggagcagucua

SEQ ID NO: 4171326 - RNA, 68 nt, Human
uagauugauugcaaagacaggcauacuauucaccaaucucuguaugcacacucuuugcaaugagacug

SEQ ID NO: 4171327 - RNA, 83 nt, Human
uagauuggauugguuuaaggucuacuucaucuugcaagcaucuuuguucccauggauagugaccuuguucuugauucagccug

SEQ ID NO: 4171328 - RNA, 78 nt, Human
uagauuggggcaaaaguaauugcgguucuugcaauuaaaaguaaugggaaaaacugcaauuacuuuugcgccaaccua

SEQ ID NO: 4171329 - RNA, 59 nt, Human
uagauugggucuguuauuaugggcuaguguauaguauaaguaauauacagacccaucug

SEQ ID NO: 4171330 - RNA, 82 nt, Human
uagauuuaacaucauauugguagagauguguaacuucuuacauggauuagacaucaagaagccaauguguacauauaaacua

SEQ ID NO: 4171331 - RNA, 80 nt, Human
uagauuuauuucaugaggagcccucauuuagguuucaaacaucuggagccuuagucuggcuucucuuuugaaaacaucug

SEQ ID NO: 4171332 - RNA, 71 nt, Human
uagauuucacacucagagucuguuugguaccugaaacaacagguagcuauccagacgcugaauggaaucug

SEQ ID NO: 4171333 - RNA, 104 nt, Human
uagauuuccucuccuugugauuuugauuauuucuuuuaugguuuuaaguaaagaguuguuauguuagaaggaauguuaaaaguaacaaguaacaaggaugucua

SEQ ID NO: 4171334 - RNA, 90 nt, Human
uagauuuggaaggugcugaaacuggucaauuaaucuggauacucagaugacuuuuagguucauuuugauuuuucaguccuucugacucug

SEQ ID NO: 4171335 - RNA, 56 nt, Human
uagauuuggacuuuauucacaaauaaaguacagugugaguuaaggauccaauucug

SEQ ID NO: 4171336 - RNA, 62 nt, Human
uagauuuguccagacuugauuacagcauuauuauguuuauugauaaaagcuggacacuucug

SEQ ID NO: 4171337 - RNA, 62 nt, Human
uagauuuuuaaaagguggcucuggaugcauaagaguagaagcagaggccaguuaggagucua

SEQ ID NO: 4171338 - RNA, 81 nt, Human
uagcaaaugccugguuaauuagaaaaucucauucagacuacauuguuuuugucagagaaugguuagccuguguuuaugcua

SEQ ID NO: 4171339 - RNA, 124 nt, Human
uagcaacauguauuucauaggaaaaagggaggaaggaaauuugauaagccauuguuacugucuuuuagcaguggggauuauauuuauauuuucuucuuaccuguccauauuuuucaaguugcua

SEQ ID NO: 4171340 - RNA, 61 nt, Human
uagcaagagagagugcgcucacagaagcauuaugcaaaaugucuuuugucucuuuuugcug

SEQ ID NO: 4171341 - RNA, 85 nt, Human
uagcaagccagaauuggaacccagagcucauaaaauuuguaggaauaagacauuuuaacaucuggguuuuuauuagguuaagcug

SEQ ID NO: 4171342 - RNA, 79 nt, Human
uagcaagccuuuacuaaugucuucuucagcugaauaauuguuuguuaucuaguuggaggagaugcuaaagaaaguguua

SEQ ID NO: 4171343 - RNA, 74 nt, Human
uagcaauauugaucuuggaacugauuuugguguuacaccgcccgagcggguuuaauuaggguuugaaaaugcug

SEQ ID NO: 4171344 - RNA, 79 nt, Human
uagcacacgaaugcacucacccaucacucaguucagugcaugauuaugugugaaugugugauugcuagauuggugguug

SEQ ID NO: 4171345 - RNA, 59 nt, Human
uagcacagucuucgccaggcugaggcugcuucccagcuccugugugucugacugggcua

SEQ ID NO: 4171346 - RNA, 96 nt, Human
uagcacguuuggaccucuuccugcacuuaaagucaugccuaccuucaugcgcuccaggugucccagguaaaaagagccauuccccaagcgaugcug

SEQ ID NO: 4171347 - RNA, 102 nt, Human
uagcacugaaaugaauucauugacguuuguagagcuuuguagaaacacuugcuugaccuaccacaaguguauuaagcaacguuauugguccacccugugcua

SEQ ID NO: 4171348 - RNA, 71 nt, Human
uagcagagcagggaucagagccugggcugucaggcccguuaacuggccauggucaccaauaugucgugcua

SEQ ID NO: 4171349 - RNA, 55 nt, Human
uagcagcacuauuuguuguagugcagagcuagaugcaauccacagaagucugcua

SEQ ID NO: 4171350 - RNA, 57 nt, Human
uagcagcauccuguggugaugguuuauggagaacaguauggccuggggcugcugcug

SEQ ID NO: 4171351 - RNA, 86 nt, Human
uagcaggacuaaaucaucugccagugccagaguacauaaaucuaucucaagcugugacuuuucacaggcugguccuuuuccugcug

SEQ ID NO: 4171352 - RNA, 82 nt, Human
uagcaggcaggaauagcuuucgacacagcucaguucucauaaaugugaggcagugugggccaagcuucccuuccuaccgcug

SEQ ID NO: 4171353 - RNA, 67 nt, Human
uagcagggagggaguaggagucauggagccuuuuuuuccccuguuuuccaacuucccaucccugcug

SEQ ID NO: 4171354 - RNA, 55 nt, Human
uagcaguagcauuuaacauauauugaguacucacucugugucaggugcuaugcua

SEQ ID NO: 4171355 - RNA, 74 nt, Human
uagcaguaugaucuccagggcacagagucccuuaggacaagagccacugaugcccugguagacacagacuguua

SEQ ID NO: 4171356 - RNA, 56 nt, Human
uagcagugauaguagaaagccaggaccccaaaucuuuggccagcugucuccugcua

SEQ ID NO: 4171357 - RNA, 76 nt, Human
uagcauaaggucucaaauuugcuggaccaguagaaauucuuuagucuuugcauuccaaaauuugagauugauguua

SEQ ID NO: 4171358 - RNA, 64 nt, Human
uagcaugcugguuacguguagcaugcugguuauguguagcaugcugguuauguguggcaugcug

SEQ ID NO: 4171359 - RNA, 65 nt, Human
uagcaugggaguugguggcagagcugggucuagaaacccaaguccugcugccacucuaccugcug

SEQ ID NO: 4171360 - RNA, 69 nt, Human
uagcauugcgguuuugcuauguuuguguuuugauaaauuaauguaaaaacaugcagcacaugaaugcua

SEQ ID NO: 4171361 - RNA, 65 nt, Human
uagcauuucccaaaugcauuugaccuucuaggaccuagucaaguguggggccuggggaaaagcug

SEQ ID NO: 4171362 - RNA, 72 nt, Human
uagccacacaggcgaugauaucugauaacaguagaguguuauagugucuauuugaauuauccuaaugggcua

SEQ ID NO: 4171363 - RNA, 75 nt, Human
uagccacauaagaccaaaguucuguagggaugaguuugagaacuguuccuuaccucaagcuuguggucauagcua

SEQ ID NO: 4171364 - RNA, 67 nt, Human
uagccaccucuuggcugguuugcagugcuguggauuuucuggacagccaugcaaaugagcuugguua

SEQ ID NO: 4171365 - RNA, 61 nt, Human
uagccaggcgaggucagugucggcaggcuaccuggucauuauugcugccucguccaggcug

SEQ ID NO: 4171366 - RNA, 61 nt, Human
uagccauuggcaggggaggcgcuugagcccuugagugggugugcucccuugcgagucgcug

SEQ ID NO: 4171367 - RNA, 58 nt, Human
uagcccccaaaagugcuuaugaucaaaauuagcuggacaagauauauuuuggggggua

SEQ ID NO: 4171368 - RNA, 57 nt, Human
uagccccugaaucuaaaagcaucucucucucuugcucaugggugcuccagguggcug

SEQ ID NO: 4171369 - RNA, 70 nt, Human
uagcccugagucucucaaccucggcacuauuggcauuuggagccugauaauucgugguuguggagggcug

SEQ ID NO: 4171370 - RNA, 112 nt, Human
uagccucaggcauguccuucaggagggauuccagaggcauuguuauagacgaugacagcucuguguguguuauugccacugaagaccuuccaugggacgcgauguggagcug

SEQ ID NO: 4171371 - RNA, 98 nt, Human
uccacuuaaucauaaucacuauacaccaaaauauuaaggcuggugguauuucaagugaccuuuauuuuguguguguuuagcuggagugaagaagaggg

SEQ ID NO: 4171372 - RNA, 67 nt, Human
uagcuauucacaaguugauggauauuugggucauuuccaguuuuuucaacuauuguggauaaaguug

SEQ ID NO: 4171373 - RNA, 71 nt, Human
uagcucuacuuauugugauuccugccucuuuccacaaguugggaugaugguggguuauuacacugaugcua

SEQ ID NO: 4171374 - RNA, 57 nt, Human
uagcugagugagcuuagguaaauuacuaauguucuucagcuuuaguuuacucaucua

SEQ ID NO: 4171375 - RNA, 80 nt, Human
uagcugcaugacauuuagcaaacugacuucucuggacucuauuccuuuaaaagugguguguuggaagaaaucauguguug

SEQ ID NO: 4171376 - RNA, 66 nt, Human
uagcuguuaauauacaaaugguggaaaguauuauugccuaucacaguuuugaauauaaugcagcua

SEQ ID NO: 4171377 - RNA, 57 nt, Human
uagcuuacagugacccugcagauuuuguauuauauaagacugccucacuuaagucug

SEQ ID NO: 4171378 - RNA, 64 nt, Human
uagcuucauguauugucucugcguuguucuauuuuaauaguugcauauggagacaauaaagcua

SEQ ID NO: 4171379 - RNA, 88 nt, Human
uagcuugccauuuuuuccaguguuauuuuagagugugauaaauguaaauauauauauauaaggagauacuuucuuaacauggcagcua

SEQ ID NO: 4171380 - RNA, 72 nt, Human
uagcuuggugcacaaguuauugcaguucauugaaaauaaugggaaaacugcaauuauuuguucaccaaccua

SEQ ID NO: 4171381 - RNA, 68 nt, Human
uagcuugucagugaauagcuguagaagccacauaauaaugaggggcauggcugacucacuguacgcua

SEQ ID NO: 4171382 - RNA, 66 nt, Human
uagcuuguugaccuacuguaacaugugaaauauaccguguuucacaucagagguagauuagugcug

SEQ ID NO: 4171383 - RNA, 74 nt, Human
uagcuuucccuccucaccaaccuugccuucuccucucccaagaaaagcaggguccaaggagauguagagagcua

SEQ ID NO: 4171384 - RNA, 55 nt, Human
uagcuuucucccugacgcuuuggacaagcuguccugauucagcaggagaaaucug

SEQ ID NO: 4171385 - RNA, 63 nt, Human
uagcuuugaagaaagaugacaccaccuuugaugagguagguuaaauuucuuuaucuaauguua

SEQ ID NO: 4171386 - RNA, 65 nt, Human
uagcuuuugggacaucuggcauacaguuauaauaacugccuuuaugccuuugucuucuaauucua

SEQ ID NO: 4171387 - RNA, 70 nt, Human
uaggaaacacauccugaaagaaacauuuccugauccaaccuagaucaggugccucuccucagggucccua

SEQ ID NO: 4171388 - RNA, 130 nt, Human
uaggaaagaaaaauauauacauuuccuucuucuuuuucacuuugauuacacagcagcuaaaaauacuggaggcuguuuccauuuaagugaauccagaauaaggauauuaaaagaguuugccugucuccug

SEQ ID NO: 4171389 - RNA, 63 nt, Human
uaggaaaggggauagaauuaugugaaugguuuaagcuaaucagaauuuguccccugaguucug

SEQ ID NO: 4171390 - RNA, 82 nt, Human
uaggaaauaaucgguuagagaugcaccuacacauuuauuaacuuaaagaugaauguaaguggauuucuuuaccuguuuugug

SEQ ID NO: 4171391 - RNA, 56 nt, Human
uaggaaaugccagccuuccuccaggugcccagcuccuuccagggcagcauuucuug

SEQ ID NO: 4171392 - RNA, 70 nt, Human
uaggaaguaaaauguugcuguaugaauaggaaggagggucuuccugucaaugagaauuaauguuuuccua

SEQ ID NO: 4171393 - RNA, 68 nt, Human
uaggaaguggaagaaucuggcucauucuuuuuccauaguaggagucagaacacuuucucuacugacua

SEQ ID NO: 4171394 - RNA, 85 nt, Human
uaggaauacaggcuuuaaauuuaaaaccaacgcuucaaagugcauugucauggagaaugggaugaauguggaggcugugguccua

SEQ ID NO: 4171395 - RNA, 58 nt, Human
uaggaauaguuuaauaguguuccaaaaaaaggaauguuaaacuauugagguauucuug

SEQ ID NO: 4171396 - RNA, 89 nt, Human
uaggaaucguuuuaaggccaaucugaguugggaauguauuuaguuuggauagaguacaauuauauuuagaugguuuggugccauuccua

SEQ ID NO: 4171397 - RNA, 62 nt, Human
uaggacauaaguauucuaacuucuagaaugauggagaaugagaauuggagacuuagguccua

SEQ ID NO: 4171398 - RNA, 71 nt, Human
uaggaccaacaccuucuccuugcaggccagacggcaguuuggcugucaaagacaggauguugucacuccua

SEQ ID NO: 4171399 - RNA, 99 nt, Human
uaggacgaaggaauaaagacaaagggucuaugugcugucucugaaggaugauucccagaaguugccacaugacccuucugcuuugagcccucuggccug

SEQ ID NO: 4171400 - RNA, 78 nt, Human
uaggagacacauugcaguuguuuagaauauguguaacuuccuauuuauauuuccauuaacagcaaauggcaguuccua

SEQ ID NO: 4171401 - RNA, 63 nt, Human
uaggagcaugugagauacuggaggccacagaagaaaagacuucuaguguuucaugugcuuuua

SEQ ID NO: 4171402 - RNA, 56 nt, Human
uaggaggaaagccaggauuugaacucaauucuguuguagagucugugcucuuccua

SEQ ID NO: 4171403 - RNA, 88 nt, Human
uaggaggaggccucccaaucuauugugucugugaggccugcccaauuccacagcagcccucagcaggaaagaucaacagguuccccua

SEQ ID NO: 4171404 - RNA, 60 nt, Human
uaggaggccauccagccugccuucaagccacugauggagagaggcugacuggcuguccug

SEQ ID NO: 4171405 - RNA, 81 nt, Human
uaggagggagguagcaugcuggaagggacccagaauuggagccugaacaccuugguuccugagcgagcuccaucaccccua

SEQ ID NO: 4171406 - RNA, 58 nt, Human
uaggauaggauggagacagaauuugguaacauaaagcagucuuuaauuauccuuccug

SEQ ID NO: 4171407 - RNA, 75 nt, Human
uaggaucuuacguaggucaagccuuauacagaaaccugggcagaucccagaggauauaugguuuguauguuccua

SEQ ID NO: 4171408 - RNA, 55 nt, Human
uaggaugggcuuccugcagcugacauguguacacacaacagugaggcccagccug

SEQ ID NO: 4171409 - RNA, 117 nt, Human
uaggauucuaugaucuacaaacagcaacuguugaccuauguuucuucaucugaagaaauccauaauuuuagauucagauauuuaggacaauaugcuagaauguucaugguaugccug

SEQ ID NO: 4171410 - RNA, 66 nt, Human
uaggauuugaaggaagccggguaucucauuaugucaacagaggacuuggcuucuuucagagaccua

SEQ ID NO: 4171411 - RNA, 120 nt, Human
uaggauuuugugguugaauuugaggauuuccagauuucuuugguuggguuugaggauuucuagaccuaauucuuuaauucaauugaaggauucucccagacaaucagcaaguauauccua

SEQ ID NO: 4171412 - RNA, 65 nt, Human
uaggcaaacugagcaucagaaaguuuaaguuauuugcccagacucacuugauguuguagugccua

SEQ ID NO: 4171413 - RNA, 77 nt, Human
uaggcaaauauugaauagcugcuuguuguauuugaugaauacagaauccaaaugaguacugcuaauuaaugcgccua

SEQ ID NO: 4171414 - RNA, 55 nt, Human
uaggcacaagaccaugcaaaggccccacaugguuauugaguagugguccugccug

SEQ ID NO: 4171415 - RNA, 62 nt, Human
uaggcacaggaggaaggggcucugucauaugacccuauuuucucacuucuuccuuuugucua

SEQ ID NO: 4171416 - RNA, 55 nt, Human
uaggcacuagacaugguuaccaaagaucacuuagugguuaccugaaaagugccug

SEQ ID NO: 4171417 - RNA, 57 nt, Human
uaggcacugguuguggauaguugccauggugacaaucaagauaauccagaugaccua

SEQ ID NO: 4171418 - RNA, 90 nt, Human
uaggcagauaacacaaauagguuaugugcuucaacugagccuacugcaguaggcagugguaggaacuuagaugaacacaugcccugccua

SEQ ID NO: 4171419 - RNA, 89 nt, Human
uaggcagauggcagggggcucaguccuucuuggcagcugcuuuccucauggcagccaggacguugcucagcuccuccugccuucucuug

SEQ ID NO: 4171420 - RNA, 59 nt, Human
uaggcauggcccugccaggaggaacaaggcacacaccguuguccuuuagggcuugucug

SEQ ID NO: 4171421 - RNA, 56 nt, Human
uaggccagauuacuagaguaggcuccugauuuuccugcuuuuacuccugccgccua

SEQ ID NO: 4171422 - RNA, 92 nt, Human
uaggccagggaaaacuagagauggcagguggaaugagaggucuucuggacuuguuuuggauguuuccacugcauguuuuuaguaccgcacua

SEQ ID NO: 4171423 - RNA, 72 nt, Human
uaggcccugucuuccugaggcucacuuugaauguuguggcaaaaccacugacagagcuuuuugaagagucua

SEQ ID NO: 4171424 - RNA, 75 nt, Human
uaggccuugguuuccuuaacagccuaaagggacagggagguggacccuuuguggcaggagcggagaccgggccug

SEQ ID NO: 4171425 - RNA, 81 nt, Human
uaggcgugaugugcugcuguaucugccuugcugccuucuccugaguggaagcugcagcuacaguguugguuauuacaccug

SEQ ID NO: 4171426 - RNA, 89 nt, Human
uaggcgugugacaccacacccgacuaauuuuuguauucccaguagagaugggguuucaccauguuggucaggauggucucaaacgccug

SEQ ID NO: 4171427 - RNA, 96 nt, Human
uaggcucaugggacccuggacacaaagaucaaauauuggugucauuaaauagcuacuugaauccaauaagugcuuuuguuuagcaacuaugucuua

SEQ ID NO: 4171428 - RNA, 80 nt, Human
uaggcuuauuguucauugcccccuguguaaaaagucucauuugagaaauuuauaguauagguaaugccaagaaagaccua

SEQ ID NO: 4171429 - RNA, 65 nt, Human
uaggcuucuugcuuccaaaugcauuguuauccaguaagauuaugcuuugccagagcaaaagucua

SEQ ID NO: 4171430 - RNA, 70 nt, Human
uaggcuuucugggcuauauggucucugcucaccucuaucaugguagcacagaggcagccacagacaccua

SEQ ID NO: 4171431 - RNA, 56 nt, Human
uaggcuuugguuucauuucucccacaggaaagggaaggacugaaaacacaaaccug

SEQ ID NO: 4171432 - RNA, 59 nt, Human
uagggacagagccaagugcuauguugacaagcauuaauaagaaauggcuccuguccuua

SEQ ID NO: 4171433 - RNA, 69 nt, Human
uagggaccaaguggcuuuaagaacuggauuaaaguugauccagugcauucagacacuuggcauucccug

SEQ ID NO: 4171434 - RNA, 60 nt, Human
uagggaccucauagaggcagaagcccaugggccuucugagcagaccuccuggggucacua

SEQ ID NO: 4171435 - RNA, 67 nt, Human
uagggacuaguuucaaggcuaaaaggugauuauaaucacccacacagcuguugaaaaugguguccua

SEQ ID NO: 4171436 - RNA, 126 nt, Human
uagggagcggcugugucauacauucguauaucuccuguaugggacuggcgaguaggaaaacuuucucuccucccauguaggagaugaugucuuuugaauuacuucuacuuuuacagugguuuccug

SEQ ID NO: 4171437 - RNA, 61 nt, Human
uagggaggcagcguagcaaggcuaguauuugcuauuuuaugcuggucacccugucuucuug

SEQ ID NO: 4171438 - RNA, 56 nt, Human
uagggaugagccaguggguaguaaguagagcaauucugccagacugauucaccuua

SEQ ID NO: 4171439 - RNA, 62 nt, Human
uagggaugaggauagauuuuucacugagccacuccuucucucauuuagucuccucaucccua

SEQ ID NO: 4171440 - RNA, 62 nt, Human
uagggauggcagcauguagcuuuuuauuaggcucaccugaaaauacacaguugcuuuucuua

SEQ ID NO: 4171441 - RNA, 59 nt, Human
uagggauguaaacauaguaauuacucaauuguaguagcucaagaauuauuacauccuug

SEQ ID NO: 4171442 - RNA, 80 nt, Human
uagggauuaaugauguuuuaauagguaaauauuguuuuauuaacagcaauuacauuuauugagcauucacuguuucucua

SEQ ID NO: 4171443 - RNA, 56 nt, Human
ucccccuggcucucccauagccuccaucaggagguuagauaagaagguugugggga

SEQ ID NO: 4171444 - RNA, 83 nt, Human
ucccccuuucuuuggccacuaucugucagaagcccuuuagggaaauuucuuggagugaaucacuagaugcagaggagugggga

SEQ ID NO: 4171445 - RNA, 78 nt, Human
uccccguccuguggacugugcugccacagugggcauucuccauccaccucacaguggcgugacagccauggaugggga

SEQ ID NO: 4171446 - RNA, 85 nt, Human
uccccgugugucacucacucagcugaugaagcacaaguggaaauuauuuauucuugcauugcugggaaacauugaugugugggga

SEQ ID NO: 4171447 - RNA, 63 nt, Human
aaacaagagucuugcuccaccuuugucuccgagcaccuuuaaacuggagcagggcccuuguuu

SEQ ID NO: 4171448 - RNA, 55 nt, Human
aaacaaguguaaacuagucugugucuuuaacaaaggcauacccuaacacguguuu

SEQ ID NO: 4171449 - RNA, 60 nt, Human
aaacaaucagagauugucucuguuuccuuaccaucggaaccaugaucugcucugguguuu

SEQ ID NO: 4171450 - RNA, 64 nt, Human
aaacaauguacauuuauaaugccucuuuaggagagaggaauuagauauuaguggugcguuguuu

SEQ ID NO: 4171451 - RNA, 109 nt, Human
aaacaaugugucuuuuagguaguaauuaagagaacaauuuggcuguauacuccaaaucccccaauuguccuaauuaauuagauuuaugcuuggaaagauacuaauguuu

SEQ ID NO: 4171452 - RNA, 59 nt, Human
aaacaccagcacuguuuacaaagaguugaccccaagaaauuuaaacaguguuaguguuu

SEQ ID NO: 4171453 - RNA, 85 nt, Human
aaacacuaaggcucauguaauuagagauaaccguaucugugaaacuaacuacagguccuaaguuauaugauacugaaagucguuu

SEQ ID NO: 4171454 - RNA, 70 nt, Human
aaacagacacuaaggggcuaguuuauaguaaagauauacuguguguguguauuagcuucuggugcuguuu

SEQ ID NO: 4171455 - RNA, 57 nt, Human
aaacauauucccuuuuaguuuagcugauuucuacaaugaaacuaaggggaaauguuu

SEQ ID NO: 4171456 - RNA, 57 nt, Human
aaacaucucaaagagguauuuguuaugugugagaacagaugccuuguaaugguguuu

SEQ ID NO: 4171457 - RNA, 85 nt, Human
aaacauuucagaaauuggacuuugugugaaggaaaauacauuaucuguguguuuagaugcaaagucucacagucagauauuguuu

SEQ ID NO: 4171458 - RNA, 55 nt, Human
aaaccaccuccccagcugcugugcuaaggcacaguaauagauuugagagugguuu

SEQ ID NO: 4171459 - RNA, 97 nt, Human
aaacccagaguuuucaauucaguagcucuggaauaggaacugauaauuagcguuuguaacaaaguuucuaggugcugcugaucaagaugauguauuu

SEQ ID NO: 4171460 - RNA, 84 nt, Human
aaacccuucucuguucagcugccucaggguauacaguuguccuugcucagauaucccaugagccagcugcagcagcucaaguuu

SEQ ID NO: 4171461 - RNA, 63 nt, Human
aaaccuggcuuuaggaccaaggggcuccucagcagacucuuuaagcuccuaacagccauguuu

SEQ ID NO: 4171462 - RNA, 79 nt, Human
aaaccuuaucagucuguuggaauaucgcugcaaaaccauguuuugaacggguguguucugucagacugauuggagguuu

SEQ ID NO: 4171463 - RNA, 66 nt, Human
aaaccuuuucuaauacuugcuuuggauguauguuucauauauauucuuaaguaguguagaggguuu

SEQ ID NO: 4171464 - RNA, 63 nt, Human
aaacuaacuaaaaaccuugcccugugaaaacaggcauauggcagagguuuuucaguaugguuu

SEQ ID NO: 4171465 - RNA, 75 nt, Human
aaacuacggcauugaaggcauuuuaucuacuucaauauuuucuguguuguguaaaugccacuuaauguaaaguuu

SEQ ID NO: 4171466 - RNA, 86 nt, Human
aaacuacuggccagggcugcaguccuaaggugcuagaggauccacuuccaagcucacuuagguggcuguuagcggggccccaguuu

SEQ ID NO: 4171467 - RNA, 130 nt, Human
aaacuagucagguguauaugaggcauguggaggaaaugaguguacacuguaauguacacauuauauucucuaugcugugcaucauuuccuccauaucgcacacauuauaauagaaaauaaucugaauguu

SEQ ID NO: 4171468 - RNA, 61 nt, Human
aaacucagaagguacagaagggaaguaucucccagccacccuguugcucucuccugaguuu

SEQ ID NO: 4171469 - RNA, 75 nt, Human
aaacuccacaaaaaucuaggaugggaagacuagagaaggagcugugagucuguauguccagauuuaguggauuuu

SEQ ID NO: 4171470 - RNA, 64 nt, Human
aaacuccagaggaucaguacuggcuggggaagaggacccaguguggccaggucuucugguuuuu

SEQ ID NO: 4171471 - RNA, 87 nt, Human
aaacuccaucauucugacucuccauuagucuuugguaacuggcucugcaucuaucagaaggcacauggagucucccugauuaaguuu

SEQ ID NO: 4171472 - RNA, 110 nt, Human
aaacuggcccaaaaggguuuaaaauugucagaaguugaucuugaucaguucaaauauuuuuugacaaagaaaaucaguucuggucaguucaaaucuauuuugaccaguuu

SEQ ID NO: 4171473 - RNA, 56 nt, Human
aaacuguuccuuuuucagcaacugcaauuuuguuguuguugcuuuaggaaaaguuu

SEQ ID NO: 4171474 - RNA, 74 nt, Human
aaacuuugauucucucuggaucccauggauaugggaacugugauguccaggagauccagagagaaucagaguuu

SEQ ID NO: 4171475 - RNA, 68 nt, Human
aaacuuugguauguagcaaaacugcuggguuuaauaaaacagauuacucagcucuacugccagaguuu

SEQ ID NO: 4171476 - RNA, 72 nt, Human
aaacuuuucuuggggaccugccauguuggaaucuccauaaauaagucagauagggcagccuaagaaagguuu

SEQ ID NO: 4171477 - RNA, 91 nt, Human
aaagaaaacuggcggugccugugugcucuucugugcauuaauaccucaugcauuccuggacaaacaucaaaagcacugcugguuugucuuu

SEQ ID NO: 4171478 - RNA, 81 nt, Human
aaagaaaauuuccagcaucagcauugucuuagggaacacuuagacucugugaugaugugaugguguuuaugaauuauuuuu

SEQ ID NO: 4171479 - RNA, 66 nt, Human
aaagaaguuucugcuuucgggguuaaacaucaggcuugcugcaacucugccaggcagaacggcuuu

SEQ ID NO: 4171480 - RNA, 56 nt, Human
aaagaaucuguugauuccccacugccaagcucuguaguaggguguacaaauucuuu

SEQ ID NO: 4171481 - RNA, 70 nt, Human
aaagaaugaaggacuuguuuaaaguuugugcugacuuucagaugaacuauacauaguucccccaauuuuu

SEQ ID NO: 4171482 - RNA, 84 nt, Human
aaagaaugacauugaaaagacauugccccgagguuugguagagcaaaagucuggaucauuuguacuguucaaugucaugccuuu

SEQ ID NO: 4171483 - RNA, 129 nt, Human
aaagaauuaaaugaacagaaagggaguauagcauaguaguuaagagugugagcucuguagcuggaaugcuuggguaugaaccucagcucuuuauacuagcugugugaccuuuugugucacaauuucuuu

SEQ ID NO: 4171484 - RNA, 105 nt, Human
aaagaauuuauauuaauuuauaaucauauggcuuaaaauuucagcauggcuaaauccauauuggguuagugagucagaguuuaucaaauggaaugugauuuuuuu

SEQ ID NO: 4171485 - RNA, 66 nt, Human
aaagacgaugcucaacuauaugaauuuugaaaaauuaugaaugucagaaugcagaguguggucuuu

SEQ ID NO: 4171486 - RNA, 67 nt, Human
aaagacugacagggggcagagguggcugaaccuuucggacuacccacugcaugcuuccuuuguuuuu

SEQ ID NO: 4171487 - RNA, 62 nt, Human
aaagacugucauugacagaaaaucucccccucagcuuuugaucaucugucuguguugucuuu

SEQ ID NO: 4171488 - RNA, 104 nt, Human
aaagacuguuccauugcaggggcuguggcacauggugugauccaggucuacaggggcacauggugagcggcaggccuauagggcaggaggauauagacagcuuu

SEQ ID NO: 4171489 - RNA, 75 nt, Human
aaagagaaaagacaugcaccuggaaaaaaauguuagccacuguuuaucuccagagcuguaugauuuuuuuacuuu

SEQ ID NO: 4171490 - RNA, 109 nt, Human
aaagagaaaggguaagagagcaaugaugacaaugaggaugacuaaaaguguguuuuuaguuugucaaccacugucacagauuuccuuucuugcuccuugugaacucuuu

SEQ ID NO: 4171491 - RNA, 56 nt, Human
aaagagaacuuuuacccaagaaaaugguaaugacuuuugggccuugaguccucuuu

SEQ ID NO: 4171492 - RNA, 85 nt, Human
aaagagacccucacugacaucucaguaggacaucuaacccugugaguguccacucuguugcugagaugaauagggcugucucuuu

SEQ ID NO: 4171493 - RNA, 56 nt, Human
aaagagcaagcugagauuugaauucagcucugucuaauucuaaagcucugcucuuu

SEQ ID NO: 4171494 - RNA, 79 nt, Human
aaagagccaaaacuguguccuuagcucucacuagguaaagcaaauaggggaggaaagagggcucagugauuuccuuuuu

SEQ ID NO: 4171495 - RNA, 130 nt, Human
aaagaggcauuuugcuaugaaaguguuaaauggugauauuucugcaagguuuuuacagugugcuuauuuuggaaaauugagaagaggcuuuguaggaaagaggcaugacaaaguaggaaaauggcuagau

SEQ ID NO: 4171496 - RNA, 94 nt, Human
aaagagguuuugaaguguuuugaggaugaaaucucccagggacauuuugugaauguuuacugaaaagauuucaauaccuuuucgguuuuucuuu

SEQ ID NO: 4171497 - RNA, 72 nt, Human
aaagaguaggaugaaggccacucacuuuagggagguuccugguuuggguaguuauuauuauuauuauuuuuu

SEQ ID NO: 4171498 - RNA, 58 nt, Human
aaagaguggcuucuuugacaugcuucuuuucuuugagccaucucaucagcagcucuuu

SEQ ID NO: 4171499 - RNA, 60 nt, Human
aaagaguuaagagucuuaagcuaaagcagcucuucugccaugugggacucugacuugguu

SEQ ID NO: 4171500 - RNA, 75 nt, Human
aaagauacacacaggggcucugagauugucuaagguuguaaagaaucagaauuagaacucaagcacccuaucuuu

SEQ ID NO: 4171501 - RNA, 98 nt, Human
aaagauagaaaauauuacuacugaaacucagaaauucaaacucacauuaauuuagugcaaaggcuugaucuggguucagugguauauuuuauuucuuu

SEQ ID NO: 4171502 - RNA, 82 nt, Human
aaagaucuggcuccuuaauuuaaaauaguucaggcaacaagauucuugcuguguuuuauguuagguuaacaugcugaacuuu

SEQ ID NO: 4171503 - RNA, 58 nt, Human
aaagaugugucaccccaugacugcuuugcauaacuaaggugucagugauacaugcuuu

SEQ ID NO: 4171504 - RNA, 85 nt, Human
aaagauuacaggaaaauagcugguccuuggcaguucucagaagguucuguuucucaccugggccaggauugugccugugguuuuu

SEQ ID NO: 4171505 - RNA, 68 nt, Human
aaagcaaauuuggaauugaggauuuacauagagucauuuguggggaacuucauuuucaucaaugcuuu

SEQ ID NO: 4171506 - RNA, 72 nt, Human
aaagcacucugugaggugcauucuauaguauauagccuaugcuacagauuuaucauguuauauagugacuuu

SEQ ID NO: 4171507 - RNA, 81 nt, Human
aaagcagacacccuguacaaauggacaucuuggcauuacagccaggaugcugugcuuuuguaggggggcaucuuuuguuuu

SEQ ID NO: 4171508 - RNA, 64 nt, Human
aaagcagccacagagagagcguuagauaaaaggaccaugauuuuuacucuguuugcgcugcuuu

SEQ ID NO: 4171509 - RNA, 87 nt, Human
aaagcauccaaucacacccuuccucaaccucucacaccaagggggagcaucuccuggaagccagaguugaggaggggagcaugcuuu

SEQ ID NO: 4171510 - RNA, 70 nt, Human
aaagcaucuucuuccaucaguucuggccucacaagacagagaggaaugagcagggguggaagguagcuuu

SEQ ID NO: 4171511 - RNA, 57 nt, Human
aaaauggaucccggggcuuuccaaggagccuggaauuucagcucacagaucuguuuu

SEQ ID NO: 4171512 - RNA, 62 nt, Human
aaaauggcaagcagaauaugguguccagcuguggauuugcuuacauauugugcuugcauuuu

SEQ ID NO: 4171513 - RNA, 73 nt, Human
aaaaugggaccauauuguauauacuguucuuaaccugcuggguuuuuugcuuaaugcauugugauucuguuuu

SEQ ID NO: 4171514 - RNA, 57 nt, Human
aaaauguuaagaaugcagacaaauggcacuuagugcccagugaguucuugacagauu

SEQ ID NO: 4171515 - RNA, 91 nt, Human
aaaauugcuugacuauuuugaaacauaaaguuaucuucaguccaacaggacugcaagguauauguuaucauaauuggaaauugguaauuuu

SEQ ID NO: 4171516 - RNA, 88 nt, Human
aaaauuuaguuuuauugaccagugcagccacugugcccacgaggggacuggugcacacagccugcugcacucaagaaacgaugauuuu

SEQ ID NO: 4171517 - RNA, 64 nt, Human
aaaauuuguagagcuuaggcauaggccagagcaacggcuaugcaagcaacauuuugcacauuuu

SEQ ID NO: 4171518 - RNA, 81 nt, Human
aaacaaaacacaacugaguuaaacaaugaagaaagcaagcuuuugaugacaaacuuuuggcugagaaguugugcuuuguuu

SEQ ID NO: 4171519 - RNA, 84 nt, Human
aaacaagagucggaagaguuauaaauaccuaauaggauuugucaguuauaauaaaacccaguauguuuauagcuccuuuuguuu

SEQ ID NO: 4171520 - RNA, 112 nt, Human
aaagggagcagggguacaaaauuagugcaccagguugaagucaccuagagcugacuuugagacuuuggcccuuaauuuacauuaauuuauaaaguaacucccugagcccuuu

SEQ ID NO: 4171521 - RNA, 90 nt, Human
aaagggaugaggauuucagauggcacacagagccugcugagcgcauagccaugcaccgcugugcugugccuuuuccucugacaucccuuu

SEQ ID NO: 4171522 - RNA, 56 nt, Human
aaagggcaguagugaucuuguuaggguuuggcaucugaaugaucugguugccuuuu

SEQ ID NO: 4171523 - RNA, 67 nt, Human
aaagggcccauuugguugaagaguugauguuuaaaaugacaagggcucacacaugacugggcucuuu

SEQ ID NO: 4171524 - RNA, 61 nt, Human
aaagggcugucaaauaagcaacggucaaaaggauaagcuguuucuucaguugucacccuuu

SEQ ID NO: 4171525 - RNA, 63 nt, Human
aaaggggaauggagaaaauggcaggaagcugaagacgugagccagccacaucuguaccccuuu

SEQ ID NO: 4171526 - RNA, 74 nt, Human
aaaggggccggggagcugugacacgcagcccagggcugucuuagucaaggcugucuccagcuuccaaccccuuu

SEQ ID NO: 4171527 - RNA, 60 nt, Human
aaagggucuguggcuugaacauguuggaaagucuugcuuuaaagcuccagcagauccuuu

SEQ ID NO: 4171528 - RNA, 85 nt, Human
aaagguaaugagaugggggcaagggagacaggaauucagguaagcaggcuuuacacuuuucugguuacucuugcuuauugccuuu

SEQ ID NO: 4171529 - RNA, 129 nt, Human
aaagguggcaaaaugggugcagggggagucaggcucaccauggccucccugcucuccggguccucugggacacucggcaugggccgaggugccuccucccccucacuguccagauguucuccuccgugu

SEQ ID NO: 4171530 - RNA, 72 nt, Human
aaaguaauuaggaaguaaguaucacaagucuguaauauauuuugacauugugauuggcuuucuaaugaauuu

SEQ ID NO: 4171531 - RNA, 74 nt, Human
aaaguacauagcauauuccaacucuugaacccuggauccuucuccccccacuggguugggugucucuguacuuu

SEQ ID NO: 4171532 - RNA, 75 nt, Human
aaaguacccugaccauaguuauuuuucccacaugcugagaaacugagaaacuaaccugguaggguuccaaacuuu

SEQ ID NO: 4171533 - RNA, 73 nt, Human
aaaguacuuugaggagucuaauauggauuuuaacuuagucaccacggugauccuguuagcaccuucaaacuuu

SEQ ID NO: 4171534 - RNA, 95 nt, Human
aaaguaggauguauucagggcuagucagaggaaguuucaccagugacuacuuaguuaacuccugcugaccaguaaaugaaugaggguccuauuuu

SEQ ID NO: 4171535 - RNA, 67 nt, Human
aaaguagucucuuucaucuuuuugucaucccuuccuaaguagagaagaaauuggaacagacagcuuu

SEQ ID NO: 4171536 - RNA, 73 nt, Human
aaaguaucuuacugcagccgaggauacauguagccaaaugggugagcaacugggaguugagugagguugcuuu

SEQ ID NO: 4171537 - RNA, 70 nt, Human
aaagucucaguuugaagugaugccagaccuggguuugaauccagcuuggcuacuuccagcugggugauuu

SEQ ID NO: 4171538 - RNA, 72 nt, Human
aaagugcacuagucaagugaacaauuuucuauauccauuuuguggcaaauuaucaugauuauuguguauuuu

SEQ ID NO: 4171539 - RNA, 85 nt, Human
aaagugcagauuccuuggcauugccccuggaauuuugauucagcagauuugagguggggccaaaugcuacaguagucugcauuuu

SEQ ID NO: 4171540 - RNA, 61 nt, Human
aaagugcugggauuacaagcgugagccgcugcgcacggccaugacguuucuuaaguacuuu

SEQ ID NO: 4171541 - RNA, 59 nt, Human
aaaguggccauccucugcaucgguaagcuuagggauccauggagagguuuggcuuuuuu

SEQ ID NO: 4171542 - RNA, 103 nt, Human
aaagugguuagugcaacugagaagcugaauuuuuauuguauuuagauuuauauuuaaaugcucacauaaagguagcagcuacaguauuggacggugcagcuuu

SEQ ID NO: 4171543 - RNA, 74 nt, Human
aaaguguacaauuuaguggugugugguucauucacaaagcuguacaaccaccaccaucuaguuccaaacauuuu

SEQ ID NO: 4171544 - RNA, 87 nt, Human
aaaguuccaaacaacugcauguguuucugcuggguuaccuugggaaaagaacuuuaguguacaucaucaguucugaaugguaacuuu

SEQ ID NO: 4171545 - RNA, 69 nt, Human
aaaguucuaccaaguuuagagucauguagggacaguuuccuaagugcaugauugaacuuggcaaauuuu

SEQ ID NO: 4171546 - RNA, 72 nt, Human
aaaguugaguaucuuaugugccuuugggugcugggacuuguagccauggcaaaggagauguuuucugacuuu

SEQ ID NO: 4171547 - RNA, 95 nt, Human
aaaguugcaugacauugugaauguacaaaaugccacugaauuuuacacuuuaaaaugauugaugaauuuuguuaugugaauguuauuacaacuuu

SEQ ID NO: 4171548 - RNA, 60 nt, Human
aaaguuuaguguccucuaccacaugcuuacuacaguggagagcuccagaagcuaaacuuu

SEQ ID NO: 4171549 - RNA, 129 nt, Human
aaauaaaccaaaaggaaacucuugagauuugcuucugggaagauggugacagaauuuccgauacuugaaaauauaaauauuugcuuuuaucuucuuauagaaauccuaagaguauuccauuucuagccu

SEQ ID NO: 4171550 - RNA, 97 nt, Human
aaauaagcaauaguaauuuuggauacagauauaagauugaggagguuaaacauaucucuuuaguccuaaauuugaauugaaaucuuuauuuuuauuu

SEQ ID NO: 4171551 - RNA, 82 nt, Human
aaauaaguagcagacugacuucuaguucuuaauaaccugguuguaaucuccuuugagaguagagucuucaucugucuuauuu

SEQ ID NO: 4171552 - RNA, 122 nt, Human
aaauaauccaggcagcuuuugaaacauacugaugcuugggcuucaccccagagauuauaauucgauugaucugaaauggggcugaagcacugguauguuuuagaaguuuccuacuuuuauuu

SEQ ID NO: 4171553 - RNA, 96 nt, Human
aaauacacauuaaguagcagguauucuggugugagggguacaauucuagacaguuucacuccagaaccugugcucuuuauguugguuuuuguauuu

SEQ ID NO: 4171554 - RNA, 87 nt, Human
aaauacauauauguaaguugcaaaugaaggacauggaagaugaaggaguccaugcauuagauucuucuuuccaauuacaugguauuu

SEQ ID NO: 4171555 - RNA, 89 nt, Human
aaauaccuuucuagcuccauauaaagcaggaugccacagccuacauguauuaaaucaugcauuguauugaguugaauugaaugguauuu

SEQ ID NO: 4171556 - RNA, 63 nt, Human
aaauacuucuagaaauacuaugcaaagauauuccugucuguguaaguacuuauggaaguauuu

SEQ ID NO: 4171557 - RNA, 69 nt, Human
aaauagacgugaauucccuggcuucccuuaacacuuagauuccuaaggucaggguauucacgucuguuu

SEQ ID NO: 4171558 - RNA, 58 nt, Human
aaauagcauuguauuuagcugagugacaaaugccgcuugguugaagaauaugcuguuu

SEQ ID NO: 4171559 - RNA, 61 nt, Human
aaauagcuugguuaaggguucuuagaguuuguuuuaucucuuggcucucuuaaagcuguuu

SEQ ID NO: 4171560 - RNA, 82 nt, Human
aaauaguaauuuagggaaagaugagaauaugauauaaauauuaauuacuauguaucuuuuguuuucccugcucaaccuguuu

SEQ ID NO: 4171561 - RNA, 75 nt, Human
aaauaguggacuuugccauucugagaugagaagaauacuucuauauuguagcugaugacaaaugugccauucuuu

SEQ ID NO: 4171562 - RNA, 61 nt, Human
aaauaguuuggggauuuuuugaguuagggauuacuccucaucacugaagccuaagauguuu

SEQ ID NO: 4171563 - RNA, 59 nt, Human
aaauauaggcagcuccuuguuacaaguaaaauuuagcugagaggcaggugcuaauauuu

SEQ ID NO: 4171564 - RNA, 113 nt, Human
aaauauauauauaauuuuuaguuuaucaaauccucaccucaucaugaaauuuuacuucauuguuaauauucaugcuugguguggggauuaugaauuaauguaaguaaguauuu

SEQ ID NO: 4171565 - RNA, 81 nt, Human
aaauaugugcauaugagauuagacuacaucuaauccauaaauuggagcagauguuuuguguauuucaucaugugcauguuu

SEQ ID NO: 4171566 - RNA, 77 nt, Human
aaauauguuucugggcuugauauuuaaaaugaucaucucugacuaugcuuguaaauauaaagcagcagaaauuauuu

SEQ ID NO: 4171567 - RNA, 82 nt, Human
aaauauuaaguccguuuuccacuggauuguuuggagacuauuaguauucaggcuugaauccauggaauagggacauguauuu

SEQ ID NO: 4171568 - RNA, 98 nt, Human
aaauauuauacugcagucacugcagacucucuuugauguauaaauaaucaaguuaaauuaugugcagcaaggagacuagugcucugccauucuuauuu

SEQ ID NO: 4171569 - RNA, 62 nt, Human
aaauauuguccugcauuauuacgugacaauguuuguguucaauauaaggcaggaggaaauuu

SEQ ID NO: 4171570 - RNA, 77 nt, Human
aaauauuuggaucuugcuaaagaccaacacauuuuuuuaaguguguauaauuuuagggcaauuugauccauauguuu

SEQ ID NO: 4171571 - RNA, 62 nt, Human
aaaucacagggucucuaaguauucucaugugucauugguuuguauagaggcuugauugauuu

SEQ ID NO: 4171572 - RNA, 68 nt, Human
aaaucacgugguccuggugcaagugcauuuccaguuugaaaaacuucagcaccagaccucagugauuu

SEQ ID NO: 4171573 - RNA, 103 nt, Human
aaaaguugccuuguuaaugcaguagagcagcucuggggugaagauccaagucuuacacccuucuccugaguguguuucuauugcuuuaauucaacagacuuuu

SEQ ID NO: 4171574 - RNA, 64 nt, Human
aaaaguugggaauggaugcuaagugcuaaccuuuuagcuacucggaaaccaugcucaaacuuuu

SEQ ID NO: 4171575 - RNA, 56 nt, Human
aaaauaaguugguccuguccuuguuugcucuuggcauagagaaggccacuuguuuu

SEQ ID NO: 4171576 - RNA, 65 nt, Human
aaaauaauggucuuuuuguuaugagagaggcuuagcuuuucucuuucaaaggaaaccaucauuuu

SEQ ID NO: 4171577 - RNA, 94 nt, Human
aaaauauagacagaguuccuuccucccuuucauaccccaacccuaacucuaacuaauagcugggauagggaggaaggaacuccuucuauauuuu

SEQ ID NO: 4171578 - RNA, 63 nt, Human
aaaauauuauugcuuaaggggagcuggggggauuuauucuuucucuuuguggcaauguauuuu

SEQ ID NO: 4171579 - RNA, 96 nt, Human
aaaaucaagaaugcucuguauagggcugcugcagaugacaggaagcuuaugcugccuagugcagauggcugcgucccuugcugaggucuugauuuu

SEQ ID NO: 4171580 - RNA, 130 nt, Human
aaaaugaacaggcaaacuauaggaacuucaggcaaagaggcuuucagugaacuuguggguaguaacuauugccuucuuuugcuaguuuuuugaaaagccacuuuaaaggaagugcugugccuggcuuuuu

SEQ ID NO: 4171581 - RNA, 91 nt, Human
aaaaugaaggcagggaacaaaggcaacauauacuuguuugacaauauuugaaagcaaugucaaguuguggugagauucuccugcccauuuu

SEQ ID NO: 4171582 - RNA, 130 nt, Human
aaaaugauguaauuagugcaacggugaugcugugacucagagggaggacugggcuggugaugagugaggugaugugugugacguugccagccaagcuucuccugguaucugucugccacuaacucuccuu

SEQ ID NO: 4171583 - RNA, 77 nt, Human
aaaaugcaaauuauugggccccaacuucugaucuacugaaucagaaacucugaguugagcccagaaauuuguguuuu

SEQ ID NO: 4171584 - RNA, 92 nt, Human
aaaaugcucagcaccaggucuggaauguagugaguuccugcuugguagugauugcugauauuccauuuuacugucaccgugcuggguauuuu

SEQ ID NO: 4171585 - RNA, 59 nt, Human
aaaaugugaucuacaaaugcaagccacauagaggauuguaaauuuuguagucacauuuu

SEQ ID NO: 4171586 - RNA, 92 nt, Human
aaaauguguugugugugugcucuggaggcuagauuucugggucaaucaaauacuugcaaacuaccuacagaugcaucacuacuaaauguuuu

SEQ ID NO: 4171587 - RNA, 93 nt, Human
aaaauguugaagucucucuggagaguagaagccugggagaaaacaaaaccaaacccauuuuccauugucacccagagauacugucaacauuuu

SEQ ID NO: 4171588 - RNA, 100 nt, Human
aaaauucuguaaaugagaaguggaaaaauuauggaguaguagagaauguuaaauaaccaucuauauuauacauccaggauugcuuuuaaaacaggauuuu

SEQ ID NO: 4171589 - RNA, 71 nt, Human
aaaauuugcaugggagguaguaaucaauaguuuuacuaaauucuuaaugugauuucugccccucaaauuuu

SEQ ID NO: 4171590 - RNA, 93 nt, Human
aaaauuuguagucugaaccuuuuuagaugcagaauaguuacaaaaguauuggcuuugauaucuaaagggauaaagacauuauuugcauauuuu

SEQ ID NO: 4171591 - RNA, 66 nt, Human
aaaggauccguuuuaacaaugggaguuuugccaguggaaaucccaaugggaugaaaccuguccuuu

SEQ ID NO: 4171592 - RNA, 58 nt, Human
aaaggauucucuugauuucaguggaaaaaaacucugcuuuuaaguuugagagaccuuu

SEQ ID NO: 4171593 - RNA, 58 nt, Human
aaaggcagaggauuuauuuuaaaggacuccuuugaaagggauauaucuuucugcuuuu

SEQ ID NO: 4171594 - RNA, 79 nt, Human
aaaggcagcaggugcauuuggugacucucacccuguauguuaauaugcgggggaguuaaauucaagugcacccgucuuu

SEQ ID NO: 4171595 - RNA, 55 nt, Human
aaaggcaugcugcugaaugauggguauggaacuuuuuaaaaaaguacaugcuuuu

SEQ ID NO: 4171596 - RNA, 92 nt, Human
aaaggcuaaagugggccgggaaucuuuuucauaagccucacgucucucaugagauuuggaaaaugauuccugugcuucccgcuuuugucuuu

SEQ ID NO: 4171597 - RNA, 72 nt, Human
aaaggcugccuggcauuacagcacuccugcucugcacagugguggaguguagcuaaaugcagcucagucuuu

SEQ ID NO: 4171598 - RNA, 92 nt, Human
aaagggaaguucuuauuuucuguaacuauuucuauagcugcugcuuuucugcuguugugauuauuuauagacagucaaaagagucucucuuu

SEQ ID NO: 4171599 - RNA, 74 nt, Human
aaagggacaucgaaccaguaggagguuaacccugugguaaacuggguucuuccucauugcuuugaaguuuuuuu

SEQ ID NO: 4171600 - RNA, 69 nt, Human
aaagggucagauucugcuagugaccaagcuacagcuugggugcaugguguggacagaauuagacacuuu

SEQ ID NO: 4171601 - RNA, 98 nt, Human
aaagguaauuaugugaagugauguauauguuagguaguugcuugugauaaucauugcacaauguauauguauaucaaaaccucacauuauacaccuuu

SEQ ID NO: 4171602 - RNA, 58 nt, Human
aaaggucuucagugcuuucacuagugaaugaacacucugaaugagcaucuggacuuuu

SEQ ID NO: 4171603 - RNA, 55 nt, Human
aaagguuuucugacccuuaguacuucagcagaaggaucuaggguggaguaccuuu

SEQ ID NO: 4171604 - RNA, 78 nt, Human
aaaguaauguauaaguggguuuguaaugugccuaaaauaauagguauuaucauuacagaucuuccuugguuuuacuuu

SEQ ID NO: 4171605 - RNA, 114 nt, Human
aaaguacgaugaaaagugcccaaauucugcuuuugauuaggauuccauaaguuuaaagaacuuuauggaaaauacaauuauaagcauaguaugguguuaauuaaaaaugacuuu

SEQ ID NO: 4171606 - RNA, 65 nt, Human
aaaguauguuguucucagcuacuugggacuccucucucaagagaagcugcaagagcaacaucuuu

SEQ ID NO: 4171607 - RNA, 73 nt, Human
aaagucuuacagacaagcugaaguacagguaccuacuuugaaaugucuucuguuuccugcugugaaagauuuu

SEQ ID NO: 4171608 - RNA, 55 nt, Human
aaagugcugugauuacaggcaugggccccagcacccggccagugcauugcauuuu

SEQ ID NO: 4171609 - RNA, 64 nt, Human
aaagugugacacuguguuaauuagagaaaguugcuguucccugagauuccuaguguccuacuuu

SEQ ID NO: 4171610 - RNA, 61 nt, Human
aaaguguugcuguggagccugguuuguuaaucuguacacaugaggucugcagcugcaguuu

SEQ ID NO: 4171611 - RNA, 85 nt, Human
aaaguuacaugugaauagaaaguauuauuugggggcaucucuaccacuuguuauacaaaaucuuacuuucuucuauguauauuuu

SEQ ID NO: 4171612 - RNA, 79 nt, Human
aaaguucaagaguucaguuuugaaauguuaauuccuuuuugggaaauugacauuuguagaauaaugguuuaggaauuuu

SEQ ID NO: 4171613 - RNA, 94 nt, Human
aaaguucaauuauuuagaaucuuaggucauuuucuagccugaaauaaaugaacauuucaguuagcugagacccaggauuuaccaauaggaguuu

SEQ ID NO: 4171614 - RNA, 105 nt, Human
aaaguucuccccuguugauguuuuagaacuaagaguuaucauuuagcuaucuucuucagcuaucauuuagcucuuaguucuagaguaucaacagaagagaacuuu

SEQ ID NO: 4171615 - RNA, 66 nt, Human
aaaguugagcacugcagaaaguucagucugcuuagagcuguguaagucauguagguguucaucuuu

SEQ ID NO: 4171616 - RNA, 86 nt, Human
aaaguuuauuucaaaucugccuccaaguccauguguucugaaaaggacagagggggccuuggagugcagccagauggaaggacuuu

SEQ ID NO: 4171617 - RNA, 63 nt, Human
aaaguuugagccucccaacacacauguucccaacugagguggaacaaagggaugcucaucuuu

SEQ ID NO: 4171618 - RNA, 69 nt, Human
aaauaaagaauauuuucaguacagaugguuggcaguugcugcugugugugugugaauguguguguguuu

SEQ ID NO: 4171619 - RNA, 107 nt, Human
aaauaauagacuucaugagaauucuagagauuggacuuccuagauuuggcagauacuauuucuaagaagcccucuaaaacuuuaggaaagugcaagcacuauuguuu

SEQ ID NO: 4171620 - RNA, 76 nt, Human
aaauacagaguuauggaccucagcucuagggauucugacucaauaguucuggcauaggguccaggacucugaauuu

SEQ ID NO: 4171621 - RNA, 57 nt, Human
aaauacaguggcagcagauaauggcaguaucucuguaacugcugguaaacuguauuu

SEQ ID NO: 4171622 - RNA, 62 nt, Human
aaauagcugaaaguuccuagauuuuugaugcucuuauucuagguuugauuuucaguauguuu

SEQ ID NO: 4171623 - RNA, 55 nt, Human
aaauagcuucuaagccuuuugauguccauuaagaggaaggaauggggagcuguuu

SEQ ID NO: 4171624 - RNA, 76 nt, Human
aaauauagaugccugggugauaucccaguuauacauuauuagugucucuggagagggagcccuggcaguuguguuu

SEQ ID NO: 4171625 - RNA, 66 nt, Human
aaauauaguaaaugcauaguucagccaagaaucaaagaugcagaaguacuaugcauuuauuuguuu

SEQ ID NO: 4171626 - RNA, 81 nt, Human
aaauauggcauuuuguaggcagggcaguuagaagcugacaugaacccagcaucuaccuccacccuauauauuaucauauuu

SEQ ID NO: 4171627 - RNA, 88 nt, Human
aaauaugucaucugcuuccugcugggauacugaguaugaagugcuccaggcaucccccaggacagagccccuguaucaugaucuguuu

SEQ ID NO: 4171628 - RNA, 102 nt, Human
aaauauguguacauuugcaauaauaggaaguuauagcuaugaucuuaauaagaacacuuuccaguuaagcaugcugcaacuucugcagagauggccauuuuu

SEQ ID NO: 4171629 - RNA, 104 nt, Human
aaaucaaauuguguauaauuuuagaagagauggaagugucacccacaaaauuacuaagggugaguuuucaugucauuuugauuuuauauaacuaauguugauuu

SEQ ID NO: 4171630 - RNA, 58 nt, Human
aaaucagaauuuauugaaucuuuuaugacacagugaaagaauuaaaggacucugguuu

SEQ ID NO: 4171631 - RNA, 57 nt, Human
aaaucaguuucugugaagaacacagguuaaugccuguaaagaucaagugacugauuu

SEQ ID NO: 4171632 - RNA, 60 nt, Human
aaaucauguaucuggcccugccugaaguuccaccccacucagguauaagaaaugugauuu

SEQ ID NO: 4171633 - RNA, 76 nt, Human
aaaucauuaugaacuaaaguguuuguaugcagauaagcuuaucuguacauucaugguuuaguugauuucuugauuu

SEQ ID NO: 4171634 - RNA, 76 nt, Human
aaaucucaguaaggcaaugccacuaagauggguuuuuaaauaaguguauuccaucucccugccucaacagagauuu

SEQ ID NO: 4171635 - RNA, 87 nt, Human
aaagcaugcuccccuccucaacucuggcuuccaggagaugcucccccuuggugugagagguugaggaagggugugauuggaugcuuu

SEQ ID NO: 4171636 - RNA, 65 nt, Human
aaagccaaagucauccaaauuuuuaugucauggcauaacauaagcucgagauggcuuuguguuuu

SEQ ID NO: 4171637 - RNA, 59 nt, Human
aaagccuauuaggagcugggcaagagauacucaugaaaaaguaguuucuaauggccuuu

SEQ ID NO: 4171638 - RNA, 103 nt, Human
aaagccuguguaaauagggaggcaguggcagggagccuggggcuggaagucaggaggcuugaauuccaguucuggcuuugccacucucuggcugugcagcuuu

SEQ ID NO: 4171639 - RNA, 84 nt, Human
aaagccuuucuggccgguauuugccucugggggcugcaucaucgucuacccagaguucuuaaauacugagcaacuuaagguuuu

SEQ ID NO: 4171640 - RNA, 128 nt, Human
aaagcuacuaaugaaucucucuugguaaauuauucacagacacauacauggggaagaugagcagaaaacacugcacuucacuaauacuguguggcaggauaauuuacuggaaaauucauuuguguuuu

SEQ ID NO: 4171641 - RNA, 86 nt, Human
aaagcuaugugauucaucaaguucaauauuuaggggccccggaaaggaauaugggucccuaaacucugaacugauucacauucuuu

SEQ ID NO: 4171642 - RNA, 63 nt, Human
aaagcugaugucccaguuugaagguaggaggaguucuuccuuccuuaggugaggcucagcuuu

SEQ ID NO: 4171643 - RNA, 121 nt, Human
aaagcugccaggugguucccagugccuggaaaaugaagaagcagaggcuccaugcugggucaugacuucuguuucagcuguucccugcuucugauuuucacgggggcugauugccugcuuu

SEQ ID NO: 4171644 - RNA, 64 nt, Human
aaagcugcuuuauaaucucggcagagcuguuuucacugcuuuuuugggaacguaauccagguuu

SEQ ID NO: 4171645 - RNA, 70 nt, Human
aaagcugugugccagacaugaugcuauggcccaaguuccccauggaauuuucuaggcauaaaacugcuuu

SEQ ID NO: 4171646 - RNA, 80 nt, Human
aaagcuuauuuccucagcuuuagacuaugaauagaauagcuuuaauuuauaguugauaaaagcagaaggaagaaaguuuu

SEQ ID NO: 4171647 - RNA, 72 nt, Human
aaaggaaauggucuuuguuaauuccagucagauaauggcauuguacagacaugggaaacaaccaauuuuuuu

SEQ ID NO: 4171648 - RNA, 83 nt, Human
aaaggaacagugcacucuuugcuggaucuuaagggguuuugcacauuucacuggccaagcuggauuuagcugcacauaacuuu

SEQ ID NO: 4171649 - RNA, 82 nt, Human
aaaggaaggacaaagaguuuugagacuguggauugcaacaaagaacuucaguuuuaucuauaauguuuuacuuccuuucuuu

SEQ ID NO: 4171650 - RNA, 77 nt, Human
aaaggaaggagacaggguugaaccacgcacuccagccugguugcacagugagacccugucucuaaaaaaauucuuuu

SEQ ID NO: 4171651 - RNA, 83 nt, Human
aaaggacagucagcaggguuugccauacuuaugcaucagcuaaaaguauaaaccuugguagcaucuugcuggcacuaucuuuu

SEQ ID NO: 4171652 - RNA, 65 nt, Human
aaaggacuagguguugccaaaaaguuaacauuuuuuaaagaaguuugguuaaacauuaguucuuu

SEQ ID NO: 4171653 - RNA, 74 nt, Human
aaaggagacagucuuaccuggacccuuuaaaggcuuccuugugccaaauaaaccaggaaauggcuugcuucuuu

SEQ ID NO: 4171654 - RNA, 66 nt, Human
aaaggagauggaaauuguucuaaugaugcuucuaauuuaagcaugugcaacuuuucugucuuuuuu

SEQ ID NO: 4171655 - RNA, 78 nt, Human
aaaggagucaccuugggaagguauuuagcugcugaagauuaucaugauuucucagcaccuuuuuaggacuucucuuuu

SEQ ID NO: 4171656 - RNA, 69 nt, Human
aaaggcaaauguauuugauguauuagccugggcucuccaaggugggguguuggauguuuauuugcuuuu

SEQ ID NO: 4171657 - RNA, 72 nt, Human
aaaggcacugaugcaaaaaucacucaggucuccucccugugacuuggugcacaccugggcaucacugucuuu

SEQ ID NO: 4171658 - RNA, 56 nt, Human
aaaggcagucugguuucaaagcagaugguuuuugcuacuucacuccaguugccuuu

SEQ ID NO: 4171659 - RNA, 73 nt, Human
aaaggcauugcugauccucagguugugccauacauaguccuuggugcuaucagagcucucagcacaugccuuu

SEQ ID NO: 4171660 - RNA, 60 nt, Human
aaaggcuaugauaguccaguggggaauucauaucuaacugggaacugagcaugguccuuu

SEQ ID NO: 4171661 - RNA, 76 nt, Human
aaaggcuuuauaaguuacagucagagguuaacaguaaucacauuuguuuccuccucuggcuuuaauaaaugcuuuu

SEQ ID NO: 4171662 - RNA, 86 nt, Human
aaaggcuuucugggaaaguaaauguaaaggaguugauaaaaauaaugucaaacaaucuuugcauucauuucauuccuguagcuuuu

SEQ ID NO: 4171663 - RNA, 68 nt, Human
aaagggagaaugaccaagguauauugaacuccuaugcacccuucaauacccuguuccauuuacccuuu

SEQ ID NO: 4171664 - RNA, 81 nt, Human
aaagggcaagaaaauucuuacuugccuacuauguccuaagauggcuucacagucuggcagguguugaaagcugagucuuuu

SEQ ID NO: 4171665 - RNA, 77 nt, Human
aaauuaaguauguuuaguaggaguuuaauacuuguugaagcuccaguuagugauauuucuucuacgcaucuugauuu

SEQ ID NO: 4171666 - RNA, 102 nt, Human
aaauuaaugaauaaguacaauucagcucuuaacacagcuuguauuagcuaagugcuagaaaauauaaacugaagauauggaauggcuuaaacguaauaguuu

SEQ ID NO: 4171667 - RNA, 59 nt, Human
aaauuaggaaguucagugucacuaacaacauacagacaugauacagagcuuccuaauuu

SEQ ID NO: 4171668 - RNA, 81 nt, Human
aaauucucuacuguuuuccuaaugagcaagaguguauaauuucuggcuacuucuuuuuaggagaauuaagcugagcaauuu

SEQ ID NO: 4171669 - RNA, 61 nt, Human
aaauugauguucccaguugaaaugacguacccagggucaugcagguggaauuggucaguuu

SEQ ID NO: 4171670 - RNA, 77 nt, Human
aaauugcagacuuuuaucaguuacggaugucacccauguuacggaugaagaaacuguggcugagaaauugacaacuu

SEQ ID NO: 4171671 - RNA, 56 nt, Human
aaauugcagguaggugggugauugacuuggccaaugaugucaccuucugucaguuu

SEQ ID NO: 4171672 - RNA, 84 nt, Human
aaauugcuauuuguucuuuuccaacuugugaaaagaugagacucacuucucugucuucacauggagaagcaacucaggucauuu

SEQ ID NO: 4171673 - RNA, 55 nt, Human
aaauuguccuuuuaagaaacagguuauaaagauagcuggcuuagguggacaguuu

SEQ ID NO: 4171674 - RNA, 78 nt, Human
aaauuguggauaguccucccucccaaaauuugaacuaauuaucauuucucaauuauguggaagaggauuaaacaauuu

SEQ ID NO: 4171675 - RNA, 79 nt, Human
aaauuuauauugcagggacucaauaagaauguuguuuauguuaacagaaaguuuucauugauucucugcaggcugauuu

SEQ ID NO: 4171676 - RNA, 74 nt, Human
aaauuuaugcaugugaaacuuagcaguuucuccauggacccauggaaugaguggcuaagauucaaacugaauuu

SEQ ID NO: 4171677 - RNA, 96 nt, Human
aaauuuauguaucacacaugguuaacaguuuugaguuuugcuucaaauaggucacccgaagagauggaagaauuguaaacuugauauuuuaaauuu

SEQ ID NO: 4171678 - RNA, 115 nt, Human
aaauuugaauuucagauaaauagugaauaauuuuuuaguauaagacagucccaaauauugcaugggacgaacuuauacugaaaaauuauuugucguuuaucugaaagucagauuu

SEQ ID NO: 4171679 - RNA, 64 nt, Human
aaauuuggcuucucaaaauaacugguuuuaacuuuguugaacuagaaaagggaggcucaaauuu

SEQ ID NO: 4171680 - RNA, 92 nt, Human
aaauuuguuugaacaguaugaagaugaugaaaaauagcauguaaaaauaagguguuguuuuaauuaaguuuaugcuuuauuuuaauagguuu

SEQ ID NO: 4171681 - RNA, 70 nt, Human
aaauuuuaaggcuggaacuuaauccaaugauguaugcuggaagaaauugaauucacggccugggagauuu

SEQ ID NO: 4171682 - RNA, 73 nt, Human
aaauuuuagaccaggcaaaacuaacauauggcaggaaaaaaagucagaaaagugauugccugggguaaaguuu

SEQ ID NO: 4171683 - RNA, 90 nt, Human
aaauuuuauuccaugucaauuuggccuuuguaugcaguauccuagauggauucuuucauauaaaggcucaguacugaacagaaaaaauuu

SEQ ID NO: 4171684 - RNA, 100 nt, Human
aaauuuucugcauaugaugcuuccuuuuucccuuaaggacaacuguaagaaauacaaaaucuuuggaggaaaauggaaagcuagcauauuuagaauauuu

SEQ ID NO: 4171685 - RNA, 84 nt, Human
aaauuuuguuuugcuuuucacauuuagcuguacaaucuauguggaauuuacucuguguaugaugugaguuaagggccaagauuu

SEQ ID NO: 4171686 - RNA, 55 nt, Human
aacaaacauuaccuggugcugguuuuaucaagguccaguuuggguucuguuuguu

SEQ ID NO: 4171687 - RNA, 70 nt, Human
aacaaagauuccugggcucccccuugaacuucugcaccagaacugccaagauggaguccgggaauguguu

SEQ ID NO: 4171688 - RNA, 66 nt, Human
aacaacacccauaugcacuguuuaggcucuugcaguacugccuaguauaugucuaugguuguaguu

SEQ ID NO: 4171689 - RNA, 71 nt, Human
aacaagauucucgggagauuuguauucacauuaaaauuucagacaugauguguuuaccugaggaucuuguu

SEQ ID NO: 4171690 - RNA, 67 nt, Human
aacaagugaucagacacugaagucaggaagccugagucauagacuucagacuuauggcacaauuguu

SEQ ID NO: 4171691 - RNA, 68 nt, Human
aacaauaggagugaugcaguaugauuccugaagcuaguuucuaaaaauguauccacuucuaccuuguu

SEQ ID NO: 4171692 - RNA, 69 nt, Human
aacaauauaguccaugagcaugcuuggcaaaauauaaagagcuuagcaaaagcauggaauuguauaguu

SEQ ID NO: 4171693 - RNA, 73 nt, Human
aacaauauugacacagggaaagcggauccauacuccauggguuuggaaagcuacucuguguucaauauguguu

SEQ ID NO: 4171694 - RNA, 61 nt, Human
aacaaugaccacacaauguacuaagucaacauggcuaagggugcacuauggguuauuuguu

SEQ ID NO: 4171695 - RNA, 129 nt, Human
aacacaccacucugcuucuucccacagaguucugagacagcuuuuacauaaugaucuugaacauauuguaaucuuguuuaugacagaaaugaaaagcugucaucacauuucuguuuuggagaguucauu

SEQ ID NO: 4171696 - RNA, 90 nt, Human
aacacauacucguguguaugaauauguauuuucauaugugugcacauaugugagcaaguuuauguguacauacauacaucuauuuguguu

SEQ ID NO: 4171697 - RNA, 59 nt, Human
aacacauaggcagagcaugacaacacagaguaaccugaguagagugcuaccuggguguu

SEQ ID NO: 4171698 - RNA, 64 nt, Human
aaagaccacuggggcaagucuucaaagggggagcuucucugcagaaaguggcucagugggauuu

SEQ ID NO: 4171699 - RNA, 94 nt, Human
aaagacugaugagaaaugauucagggaguuuucaggagcuauaccucaggggucucuuuuuagccucuucugaucaacauuuuugucaguguuu

SEQ ID NO: 4171700 - RNA, 82 nt, Human
aaagagauuuugagauguuucugggaaggaaaagucagaaucauaauuuaugcuuuucuagcuagaacauccgugucuuuuu

SEQ ID NO: 4171701 - RNA, 87 nt, Human
aaagagcccauacauccagguagccuucagauauggugucaaacagccccuuuuucugucacucccugaugaugaaugagguucuuu

SEQ ID NO: 4171702 - RNA, 57 nt, Human
aaagaggggacuguuaauuccauuuaucucuugaacaggaauugcuuuccugucuuu

SEQ ID NO: 4171703 - RNA, 62 nt, Human
aaagaguggcauccaauuuguugccauaugagguauggcagcaauuugugauguugaccuuu

SEQ ID NO: 4171704 - RNA, 55 nt, Human
aaagaguggguagcuucccugguucaaggccagccucuggcagcugccacuuuuu

SEQ ID NO: 4171705 - RNA, 68 nt, Human
aaagaucaugcuguuuugugaugcucagcauuuguaauuaaugcaccuaccauugacaguauaucuuu

SEQ ID NO: 4171706 - RNA, 129 nt, Human
aaagauccugccuuugcucugcgcaguuucaaaguguucacugugaacucauauucagacucuagcauuuucuucugaauauccucacuggugauaaaucuuuggccuuugaaaguggaugugauuuuu

SEQ ID NO: 4171707 - RNA, 110 nt, Human
aaagaugacucaauauggugguagaugggguaggagggaguugaagaguaugggcucuacaugcuuccaacugccccauccuaagcuccuacccuauuccuucuaucuuu

SEQ ID NO: 4171708 - RNA, 93 nt, Human
aaagauguaacuauuuucuuuguuggcaguacauuaagcaaaaguucauuaaaagugugugacuguuaagaaggaggauggaaggauuucuuu

SEQ ID NO: 4171709 - RNA, 92 nt, Human
aaagauucuauauguguaagguaauauuuuucucucuaagguauagugaaucuuauuugggacauauguugaaagacugcauaggaauuuuu

SEQ ID NO: 4171710 - RNA, 86 nt, Human
aaagauucuuuacaaguuuacagaaugauggacugagcuauagcuuccagaaaauauuuuuuaguuaacaagugcaggaaaucuuu

SEQ ID NO: 4171711 - RNA, 85 nt, Human
aaagcaacauagugugaaucagccugucaguuccauuccaaagcgacagcuugggaagaacagguuuauuuuccuauguuguuuu

SEQ ID NO: 4171712 - RNA, 129 nt, Human
aaagcacguagaccugugucaagagcauaauaaauucuuagaaaauguugguaguuguaauuuuaugauuagcuuuaaagcauauuucuaagguacuauguaaauauucauggcacuugucauuucuuu

SEQ ID NO: 4171713 - RNA, 59 nt, Human
aaagcagacaucuggagagaagaaacaauguuugcucuccagcagauguagucuguuuu

SEQ ID NO: 4171714 - RNA, 64 nt, Human
aaagcagaggaggaaaguuucaccagugcuuguucugagaaaccucuuagccucucuuugcuuu

SEQ ID NO: 4171715 - RNA, 107 nt, Human
aaagcaugaauagcaauaggaaaaggucauuggggacuaucuccgagucugacaguuacaaucuugagaugagcuuccuaaugaaagauuaaugcucaacauacuuu

SEQ ID NO: 4171716 - RNA, 57 nt, Human
aaagcaugugaauagaauauggcuacauuaaguggauucugugagagucacagcuuu

SEQ ID NO: 4171717 - RNA, 63 nt, Human
aaagcauuauucuguggaaaaagugagcauucuauuuuaacugaauucacaggaaaugucuuu

SEQ ID NO: 4171718 - RNA, 63 nt, Human
aaagccaggguguugugcaaaggucuguucuaugcccacuguggcacuaggcaccuuaccuuu

SEQ ID NO: 4171719 - RNA, 64 nt, Human
aaagccccucucggaaucuauccagccagaugguucucuuguguuaguccaguaggggggcuuu

SEQ ID NO: 4171720 - RNA, 56 nt, Human
aaagcgcagacacagagaguggagaguauacgauucucuuuccucuuuuguguuuu

SEQ ID NO: 4171721 - RNA, 83 nt, Human
aaagcuguauuuucuauauauaaauuuguagcugguagcagugaccuagacugcagguaaauuuguggaggauuccaaguuuu

SEQ ID NO: 4171722 - RNA, 59 nt, Human
aaagcuugacaaguaauacuuaaauuacuuuuguaaguagcaaguacuuguuaaguuuu

SEQ ID NO: 4171723 - RNA, 107 nt, Human
aaaggaaaucaauguuuugcucuugaggauuagcuuuuauugucuucguguuuugcgaaauguauaagcuggucuuuuggaagcaagaggaaauauguuggucuuuu

SEQ ID NO: 4171724 - RNA, 63 nt, Human
aaaggaaguaugagguaaagucuaucaaagaugaacaaagugguagauuucauacuucucuuu

SEQ ID NO: 4171725 - RNA, 55 nt, Human
aaaggaggaauggagagaugcuggguuaauuccagggaucagaauuuccuccuuu

SEQ ID NO: 4171726 - RNA, 76 nt, Human
aaaggauuuaaucagucucucugaaguauuaagauguauuaugucauaccuggcagagagaucccugagacccuuu

SEQ ID NO: 4171727 - RNA, 78 nt, Human
aaaggauuuugugugugugcuagauugucuucuaaaucacugauuuggaacaaauauuaguaaagcauuuaauucuuu

SEQ ID NO: 4171728 - RNA, 94 nt, Human
aaaggcaaaagauacgggaaaauguagaagugggcauuauagaagaauccaaaugugucuaaugucuucuucauacuaauuccuucuagccuuu

SEQ ID NO: 4171729 - RNA, 56 nt, Human
aaaggcaucuagccaaguugagaauaggcccuucauugacuugcuucuuugcuuuu

SEQ ID NO: 4171730 - RNA, 67 nt, Human
aaaggccaauguaucaagaagcaucaguaaagggacagucuguaauugaugacuugauuacacuuuu

SEQ ID NO: 4171731 - RNA, 78 nt, Human
aaaggccuccaccugcugggcugcuuugggccaggagggucucuguuucccacaggcugcccgcagcugggagccuuu

SEQ ID NO: 4171732 - RNA, 87 nt, Human
aaaggccuucagguguuagaagaaauuucaaacuauaaacucugccuuugggggaugacauuccuuugagcaucugaggaauacuuu

SEQ ID NO: 4171733 - RNA, 71 nt, Human
aaaggcucccucuucucgaguguugcucuacucaaccaucaauacucagcucaacacucagggaagucuuu

SEQ ID NO: 4171734 - RNA, 55 nt, Human
aaagggaggggcgauaagccggguccuugggagcguccuggucucccuucgcuuu

SEQ ID NO: 4171735 - RNA, 73 nt, Human
aaagggauguugcuaagauaugcuguggaucucauuuuuuuauauguacaucuugagcaaugaagcucccuuu

SEQ ID NO: 4171736 - RNA, 72 nt, Human
aaagggcccugaguugcagcccuggauccccauggaaccaaagggcccugggggcuggagcugggcuccuuu

SEQ ID NO: 4171737 - RNA, 59 nt, Human
aaagggcuuauggaaaaaagaugcucaugggugcuucuuggcucccuuguaggcccuuu

SEQ ID NO: 4171738 - RNA, 59 nt, Human
aacacugugcccacccuaguccuuuucuuaaauuugggcagagauccaggguauagguu

SEQ ID NO: 4171739 - RNA, 83 nt, Human
aacagagauuuguccagaugcacagauaauaauuaccuggaaugugauucaaaacuaggauugucugaauccaaagcucuguu

SEQ ID NO: 4171740 - RNA, 95 nt, Human
aacagaggcccagagagaauuaaaggagcuaugcuauagaaaguacuauagaaaguagguggcacagcccggauucuaugacuggccuucauguu

SEQ ID NO: 4171741 - RNA, 66 nt, Human
aacagaggccuuccucucaagcacauggaacgggguccauuuguggacuuggaggagagcaagguu

SEQ ID NO: 4171742 - RNA, 72 nt, Human
aacagauaaguauaucuauguauaccuacuaugcauaagccuuacaggugcuacauagaggugauaucuguu

SEQ ID NO: 4171743 - RNA, 76 nt, Human
aacagcagcagcacggauaguucagcuaaauacuucuguauuuuuagcugaaaaaauucaugcaaggcuuucuguu

SEQ ID NO: 4171744 - RNA, 56 nt, Human
aacagcaggcauuucuuagcucacauuuagugugacugggaagaucuuuuguuguu

SEQ ID NO: 4171745 - RNA, 90 nt, Human
aacagccacuucucucuuccuucgcccuugcuguuucagugggaggaauaugaauucugaaaggcuuggcggagggaggggguggcuguu

SEQ ID NO: 4171746 - RNA, 68 nt, Human
aacagccugagccauccauaccagcuuaccucuuuaugauaagcugcaauggauagcuuccugcuguu

SEQ ID NO: 4171747 - RNA, 77 nt, Human
aacagcgucuucugcaacugcaccugccucgcuugccucuggaaagggugggggcaggucagcagagccaugcuguu

SEQ ID NO: 4171748 - RNA, 55 nt, Human
aacagcuauuagaacuucauggagaauaauuuccuccacugaacuuuaagcuguu

SEQ ID NO: 4171749 - RNA, 83 nt, Human
aacaggagcaaagcuuuucagagaguugcacugucaaaagcacuggcagcuugaaugcagucuuugaacagauuguugcuguu

SEQ ID NO: 4171750 - RNA, 57 nt, Human
aacaggagucauugucauuauuguuacuuauuaguagugucauccucagcuucuguu

SEQ ID NO: 4171751 - RNA, 88 nt, Human
aacagggggcaucaggauuuucaucauuacagucauguuaugguauuguuuuccaaacaaaagacgaaugauaaucuaguucucuguu

SEQ ID NO: 4171752 - RNA, 119 nt, Human
aacaguaggaaagguaaacacagaagacagcuguuucacucgauuguggaaaaagcagagugcauguccugggugaaugcauuuguuccugugauuuauaguuucacucuuuccuuguu

SEQ ID NO: 4171753 - RNA, 85 nt, Human
aacaguagggagaauaugucuauagugccauggcaaacugucuugaagacaggaccagcaggccaggggcacugcucucuguguu

SEQ ID NO: 4171754 - RNA, 76 nt, Human
aacaguuaauuaaucagucucauuuagcagggagggaguuccuauuucuguugaauagcugauaaguuuaacuguu

SEQ ID NO: 4171755 - RNA, 113 nt, Human
aacaguuccuagauucuggcaguuggcauuggcaucuggcauuaacucucuccaccccgugcccauuuuauagaugcgaacaggccaacugaugcaggacugugguuucuguu

SEQ ID NO: 4171756 - RNA, 64 nt, Human
aacauaaucugccagcaagcuacccuggcauaaauucaauuacugcuacauugcugguuauguu

SEQ ID NO: 4171757 - RNA, 56 nt, Human
aacauagaauggcuccagagcuucuacuaaaaauaagacucagagcuauauauguu

SEQ ID NO: 4171758 - RNA, 61 nt, Human
aacaucagcacacaauagcaaggggcccauuccaugauuucuuugcucagaguaugauguu

SEQ ID NO: 4171759 - RNA, 55 nt, Human
aacaucauuauguccauuaaugaguuuucuuucaaguugagggcauucugguguu

SEQ ID NO: 4171760 - RNA, 100 nt, Human
aacaucugcuuuagaaaugcaccguuugguuuggauuuacagcuuuaguggguugaaaauuuauauuaccagaagguuuauaaaccccugugcagaaguu

SEQ ID NO: 4171761 - RNA, 71 nt, Human
aacaugagauacuugguuucuguuucugcauugguuugcuuaggagaguggauuccagcuguauccauguu

SEQ ID NO: 4171762 - RNA, 72 nt, Human
aacauggcugcucaguggagauaauugcuaguccuucuuauuaguaguuuccauuucugaguuugcuuuguu

SEQ ID NO: 4171763 - RNA, 97 nt, Human
aacauguguuaugaauuccucagcucugaaugaggcuuuaaggcuuuccuaaaguccaauuuuguucaggcuauguugaaauuuaccaucucauguu

SEQ ID NO: 4171764 - RNA, 62 nt, Human
aacauucaccucuaccuccuucugaaaucuuuuucugauagcuugaggcagagguaaauguu

SEQ ID NO: 4171765 - RNA, 71 nt, Human
aacauugagaugugccuaguucuguauuuacaguuuggucuggcuguuugaguucuagcgcauuuaauguu

SEQ ID NO: 4171766 - RNA, 56 nt, Human
aacauugauugcaucuguucacuauaauucucagugggagggauggaaaugauguu

SEQ ID NO: 4171767 - RNA, 59 nt, Human
aacauuuauucuaauucugggaaucacaaaauacucccaacggcauuagaguagagguu

SEQ ID NO: 4171768 - RNA, 57 nt, Human
aacauuugcugacuggaugcaguugguuggcaccaugcugugccauuagcaguuguu

SEQ ID NO: 4171769 - RNA, 67 nt, Human
aaccaacgagaaccaccaguguucucuacucaaagccuccuagaaaugucaaguguucuuguugguu

SEQ ID NO: 4171770 - RNA, 75 nt, Human
aaccacagaagcacuaggaggaaacguugcuauuuguauuagugacguggucacuggagugcaguuuccaugguu

SEQ ID NO: 4171771 - RNA, 68 nt, Human
aaccacauccaguuuccaaucacugcacggcuuuucagguuaaugguuuuuuggagacugcugggguu

SEQ ID NO: 4171772 - RNA, 59 nt, Human
aaccacauggcucaguggacauacuuauccauuaaguaugcuuauccugaccauugguu

SEQ ID NO: 4171773 - RNA, 62 nt, Human
aaccacuugaaacuuaguggcauaaaguaucauuaauuuuaugcccauggauucgguagguu

SEQ ID NO: 4171774 - RNA, 58 nt, Human
aaccagacucuccaaaggcaaaaaaugggcuuuuguuguccucuggaucgguuugguu

SEQ ID NO: 4171775 - RNA, 61 nt, Human
aaccauggauuucaguucaccuuucauuaucuaccgagaaguggucaucuaucccaugguu

SEQ ID NO: 4171776 - RNA, 81 nt, Human
aaccauuaacauaggaagcugguuuuuguuuguuuuacuguuguuuuaauacaguuuagaaaaucuguuucuucaaugguu

SEQ ID NO: 4171777 - RNA, 60 nt, Human
aaccauucacaguguagccaaauuucucuuauccauguuggcuccacuacuggguguguu

SEQ ID NO: 4171778 - RNA, 55 nt, Human
aacccagagcacagaugcaacgugcucaccaggagcaugaaugagcugugagguu

SEQ ID NO: 4171779 - RNA, 79 nt, Human
aacccaggcagcuuauucagauacagacucuugggccuuaggccuagaggugcugacucggaaagucuaugcuaggguu

SEQ ID NO: 4171780 - RNA, 75 nt, Human
aacccaugagucccaaaguauuagcauuucaacauguaagcaugucgguaagauaguugugcuuugcuuaggguu

SEQ ID NO: 4171781 - RNA, 57 nt, Human
aacccauuaauccuugcaagcaccucuguccauggugcugauuaugcagguuggguu

SEQ ID NO: 4171782 - RNA, 124 nt, Human
aacccuccuugggaagugaagcucaggcugugauuucaagccagggggcguuuuucuauaacuggaugaaaagcaccuccagagcuugaagcucacaguuugagagcaaucgucuaaggaaguu

SEQ ID NO: 4171783 - RNA, 59 nt, Human
aacccugccagaauugagcuugaauuccaagaucaacaagaucaagugcuggcaguguu

SEQ ID NO: 4171784 - RNA, 68 nt, Human
aaccguauuuccaaauaaggucacacucagagguucuggguggauauaaauuuuuggaggauacuguu

SEQ ID NO: 4171785 - RNA, 96 nt, Human
aaccuaccuggcuuuuuauaauuaugaguuauauuauugccuccucuuaaaggcccugugacuuauaacauagaauuugacagagugcuugugguu

SEQ ID NO: 4171786 - RNA, 65 nt, Human
aaccuccuucuucuguccugcucagaacaaugagaaaaagccaaggucaaaagcaaggccagguu

SEQ ID NO: 4171787 - RNA, 77 nt, Human
aaccucuaguauucaacagcaucaagacauaauaugauuaauauuauuaaauguuauuuggguuguguuuauggguu

SEQ ID NO: 4171788 - RNA, 86 nt, Human
aaccugcuacauugagguaguagauuuuuguccauugauacuuuaucuuuguagccuaacaucugccuucuuaaugugaucaaguu

SEQ ID NO: 4171789 - RNA, 70 nt, Human
aaccuggaggcuguguagucuuuuuggaucuuaaccgcuagcuaucccuggauucacagccacucagguu

SEQ ID NO: 4171790 - RNA, 107 nt, Human
aaccugugguucauuaaagaugaauauagauuucagaaaaccagguaaucuauguuguuuuuguucucuggaaacuaugauucaccuaugugacauaaacccagguu

SEQ ID NO: 4171791 - RNA, 84 nt, Human
aaccaguucucuguucuucuccacuguaugugcagaacuaaacacagcaccuggcauauagggagacagcacagaauagugguu

SEQ ID NO: 4171792 - RNA, 95 nt, Human
aaccauuugaaauuaaacuaacuaguuagaaaugcuuuucauaauucuuuugugcaggguccuaauuguuaaggaguagaauuuuaaguuugguu

SEQ ID NO: 4171793 - RNA, 101 nt, Human
aaccauuuugccaaaaaguuacacagauuucaguaucaucacucuauaagaaaacuagacugauagugucuaaaucugugcccaguuucuguacuuugguu

SEQ ID NO: 4171794 - RNA, 107 nt, Human
aaccccacucugcccaagccaccacugcagugguccagggagcggcccacacccugggccuuccaccuaggccucugcuuuguggggcacagggucagggugugguu

SEQ ID NO: 4171795 - RNA, 86 nt, Human
aaccccgagcagcuuaaaaaauaugcagcuaaugucauguaguuaaacugauguagcaugcauguuguuuugcaagcuaaccgguu

SEQ ID NO: 4171796 - RNA, 130 nt, Human
aacccuauucugcuugccaaaaauaauuacaucccauuuuuuucugccaaccauuuaaacucauuucauagaaaacggaaaaagaggguuggugcaaaugggauguuucccgcaagaaagaagaacgguu

SEQ ID NO: 4171797 - RNA, 72 nt, Human
aacccugacagaacuuuuucacaucuccuggauuucaaccagguaauuucugagauguucugcuccuuaguu

SEQ ID NO: 4171798 - RNA, 68 nt, Human
aacccuggagaaggcuuuggauguauugagguacuagaaugaaguucaaggcaguucuauguaggguu

SEQ ID NO: 4171799 - RNA, 87 nt, Human
aacccuucgagaugcacaaggauuuugauuguuugaaauguugguaacauuucaucuucccagagaccuuguucauuuaucaggguu

SEQ ID NO: 4171800 - RNA, 75 nt, Human
aaccgcauucuucucccuuaccuuccagacuuuuucuuuguucaguggugguggcuguaagggagagaagugguu

SEQ ID NO: 4171801 - RNA, 126 nt, Human
aaccggaggccugagauagugacacuggaaggugggcaggcugcuaaugaggauuccuggcugcgauucagccucagcacgcagcucugugugccuggcuguuguuaacugugcagugcucugguu

SEQ ID NO: 4171802 - RNA, 55 nt, Human
aaccuauucuguaagacaugacuuguaaacaaacucuaagccuugcagauggguu

SEQ ID NO: 4171803 - RNA, 69 nt, Human
aaccucaaguccaacacuaaaaagccucaaaaaguuaacauagggcuuugcugaaggccucuugggguu

SEQ ID NO: 4171804 - RNA, 65 nt, Human
aaccucauuuuacauaaggaagguuuaacucauaaggguuaaauaaacuuggucaagaucagguu

SEQ ID NO: 4171805 - RNA, 55 nt, Human
aaccuggguguacauuauggucaucuuuuaaauguuauauaaacacacuuagguu

SEQ ID NO: 4171806 - RNA, 64 nt, Human
aaccugugcagccaguggaacagcuccauuaucuuggccauuguugcucuuguugccacauguu

SEQ ID NO: 4171807 - RNA, 129 nt, Human
aaccuuaauuuauauagucuagcuuuguauuuucgaggcauuaugccaucguuaaauugcuaauacuuaccacauuguuuaaagcaggcaucauuccucaugugcgacgcagagacccagagauggguu

SEQ ID NO: 4171808 - RNA, 78 nt, Human
aaccuuauagaagaugucagaugauaucccugcuaaaauaaccccauagaagaugucaucugauauuacuuauagguu

SEQ ID NO: 4171809 - RNA, 130 nt, Human
aaccuucugaaaaugaaugccugggagcugugcuugacagugggaagcaugagaauuccagaaagcuuucaugucauauuuuuuuccucucaaauauugucaguaucuccaggcuucuguucucaagguu

SEQ ID NO: 4171810 - RNA, 68 nt, Human
aaccuuguuugucauuguuagaggcucugggaagggucucaaggaauauaaugagucgagucaagguu

SEQ ID NO: 4171811 - RNA, 59 nt, Human
aagccaggaagggagcuguccccagaaacugaauuugcugacaccuuaaucguggacuu

SEQ ID NO: 4171812 - RNA, 63 nt, Human
aagccagguguugggagaagagauaaagagcagcuucagucuuagaaccuaacaaccuugcuu

SEQ ID NO: 4171813 - RNA, 89 nt, Human
aagccauuuuuucugaccuaucuacauuuagaaaaacacacauuuggggaaagaauaaaucaguagauaugguauaggagcaguggcuu

SEQ ID NO: 4171814 - RNA, 60 nt, Human
aagcccacugaguuaccuuuacaccauucccugccaucuaaagcaauuacucaguggcuu

SEQ ID NO: 4171815 - RNA, 56 nt, Human
aagcccagaugagaucccuggauguggauaaagauccagguucucauagggggcuu

SEQ ID NO: 4171816 - RNA, 72 nt, Human
aagccccaagaacuuuauaacuguaaaugucaagaaaggucccuggcaauaguuguggguucuuuagggcuu

SEQ ID NO: 4171817 - RNA, 94 nt, Human
aagccccggcaucuucuugcugccgucccagacaacagaaguuaccagaugaacagacuuggaugggccacggggguggagagcuggaaagcuu

SEQ ID NO: 4171818 - RNA, 93 nt, Human
aagcccugaauaaauagucccugcuuauucucauuugguuggacuucauuuauuuccacauguaguaagcaggcaaugauaguuuucaugcuu

SEQ ID NO: 4171819 - RNA, 87 nt, Human
aagcccuguucuugcugacccagaauguuaaugaaauaaaggcaacucagaaacaguguucuaggguguggcuaggaacaaggguuu

SEQ ID NO: 4171820 - RNA, 106 nt, Human
aagccggagugcucguugucaacauauuaauuauguucucuguuuccacaggcuuuucaggaggauuuaaucaguuggcauuuaugagccuauuuugaaaaugcuu

SEQ ID NO: 4171821 - RNA, 72 nt, Human
aagccucccuggcugguguagagggaucagguccacaguggugcagauucaaccaccacccagggagugcuu

SEQ ID NO: 4171822 - RNA, 62 nt, Human
aagccucuuuccaauuucuuguucuuggcaauauuugaggagcauacaguugaaaguggcuu

SEQ ID NO: 4171823 - RNA, 83 nt, Human
aagccugacucuuguugagugagucuguggaccgggcacugugaugggcagugugcgugcacaacgucacuuaauccuugcuu

SEQ ID NO: 4171824 - RNA, 102 nt, Human
aagccugaguuuuuuuuaacuguggcuucaccccaguugucucugggguccucuaaccuggagauaacaauaaagaagcacaagguuggagagaauuuacuu

SEQ ID NO: 4171825 - RNA, 66 nt, Human
aagccuggcugccuauagucucccuuaaagguuaaggagugauauaugggugcuaaagaaaggcuu

SEQ ID NO: 4171826 - RNA, 88 nt, Human
aagccuuggaguuuggagaguuaauugacaguuacgaagauaauucacuucuuuguguuaacugccucuucaacuaaaauuuaggcuu

SEQ ID NO: 4171827 - RNA, 56 nt, Human
aagccuuuuccaccuaauagagauccaaguacaucacuaagaggaggacuagguuu

SEQ ID NO: 4171828 - RNA, 119 nt, Human
aagcgauugugaagagaacauagggauuuuaucgucauccuucuggaacuuauuugucuucaaaguguuuaguuucaaaggguccuuaacaugagauccaguucccugaaaaaguccuu

SEQ ID NO: 4171829 - RNA, 91 nt, Human
aagcgccauuuuuguuacaucaagagucuuacuaucaguauaaauuaugacugaugaugcugacugugaucaccuggcugagauaguguuu

SEQ ID NO: 4171830 - RNA, 73 nt, Human
aagcgguaauuguucuggacacgugacucucauuuaguaucugcugaagagcccuuguucauaauuauugcuu

SEQ ID NO: 4171831 - RNA, 79 nt, Human
aagcguauacauacauauguacacuuacguuacaaauaguuuuauauuauuucuguguguguguguguguacaugucuu

SEQ ID NO: 4171832 - RNA, 62 nt, Human
aagcgugcagaaauaugaugcauaaagggggcguucccugugacauuagaauuucauugcuu

SEQ ID NO: 4171833 - RNA, 83 nt, Human
aagcguuggaaucacagaagguggccauagcugaguuggcaugacuggucugcagcagaaguguuacuuucaugaaaacgcuu

SEQ ID NO: 4171834 - RNA, 83 nt, Human
aagcuauagauguuuauuaaaacuguuggcucugugguuuaaagcagaccuugggggauuguuuuaaugaauaggcaaggcuu

SEQ ID NO: 4171835 - RNA, 81 nt, Human
aagcuauaggaaagauuugucacaugaaugcuccaauaagagacuuuggguuauaugauguucaaacucuuccacuagcuu

SEQ ID NO: 4171836 - RNA, 122 nt, Human
aagcuauucuaauagcacuagucuaauagcauaaaauuugcuacuguuaaauaaaugcuuauccccugcauaauuuacagguagaauuuuaaguaauuggaucaaauagcuagaagaggcuu

SEQ ID NO: 4171837 - RNA, 126 nt, Human
aagcucaaggaaggaugaucccugccucaggaaguuuugaaucaacugcuauuuuuaacaaguauacaguagaacuugagaucaggucuucacucaguugguaggaaaaguuuuccgcugaagcuu

SEQ ID NO: 4171838 - RNA, 89 nt, Human
aagcuccuggagggcaagucuugcauccacugcuuugcuggcaacccgacugguaagcuucuggaaggcaaggcuugcauccagugcuu

SEQ ID NO: 4171839 - RNA, 66 nt, Human
aagcucuguccagccuaugauuucccacccugcggaagcacaugaagcucaggcuggaccuggcuu

SEQ ID NO: 4171840 - RNA, 82 nt, Human
aagcugaagaaauacuggguuagcuuucuauacauacagugacaaaguauguauagaaaguuaacccaguauuucuuuucuu

SEQ ID NO: 4171841 - RNA, 56 nt, Human
aagcugaagacacagcuccaguuucauccuagacuuuggaaaaugcucuuuaguuu

SEQ ID NO: 4171842 - RNA, 57 nt, Human
aagcugauauugcugcaucguguucaucuggauguauuagauguaaaauaguagcuu

SEQ ID NO: 4171843 - RNA, 69 nt, Human
aagcugcaugaaguugaguagaacaccagaaccucaucuacaaaauuacuguucaaauuuauguagcuu

SEQ ID NO: 4171844 - RNA, 55 nt, Human
aagcuggcuaaauaaaagguccuuuaguauccagagccccuuauuugcccagcuu

SEQ ID NO: 4171845 - RNA, 86 nt, Human
aagcugguucuuuuucuguuuuuaagauuguacugauuuccuuuuguuuucagcaguuuuauuaugauggaaauaaacauuaguuu

SEQ ID NO: 4171846 - RNA, 55 nt, Human
aagcugugcucuuaugauuugugcacuuuaugcaugucauauuucaauacaguuu

SEQ ID NO: 4171847 - RNA, 61 nt, Human
aagcuuaagucuccuuuuaugaugacgcagagaagaaaugguagaggugggauuuggguuu

SEQ ID NO: 4171848 - RNA, 69 nt, Human
aagcuuaucauaaaacaaauaguuaaagauggacuauaccauugagaauugggccuuuucugguagcuu

SEQ ID NO: 4171849 - RNA, 73 nt, Human
aagcuucaggcccacccauguccaacugccaucuacacacugccagcagcugugcagagggagccugaggcuu

SEQ ID NO: 4171850 - RNA, 61 nt, Human
aagcuucuuuacaggagagauuucaccaaaaucuguaaaaugaauucuuguucuggagcuu

SEQ ID NO: 4171851 - RNA, 74 nt, Human
aagcuuggcauucaacccagccuucugccaggaugguucugccuggcagcaaaaagccugguugaauuaagcuu

SEQ ID NO: 4171852 - RNA, 129 nt, Human
aaccuuacuuucauugacaucauaaaaucuaacacuuuuggcacgauuugcaauuuuacuuugcaguauaauugaauauauugcauuguauuguaaauguuugccacuaugagagcaggagagaagauu

SEQ ID NO: 4171853 - RNA, 130 nt, Human
aaccuucaacuauaaagaguuuguuuaacuagaggcaggaagagcugauuuucccuugaaaugcauggaaaauucauucauuuuuguuuguuuuaaacuuuuaaaaaucuggaguuauuaagggcuguuu

SEQ ID NO: 4171854 - RNA, 95 nt, Human
aaccuugagcucuauguauuaaaacuacauuugacauuuugucuuagucuaugaagauaaaguggagguaguauucauuccauuaguugaagguu

SEQ ID NO: 4171855 - RNA, 76 nt, Human
aaccuuuccuaugaggcacuucauuagcuggcuccauuuucuggguguuaugaagaugccugguacauggaagguu

SEQ ID NO: 4171856 - RNA, 66 nt, Human
aacgauauugacaagugagcugggcugcuuggcaccagguagucugaauuugacuugucaguuguu

SEQ ID NO: 4171857 - RNA, 64 nt, Human
aacggaggcuaacauuacggacaucugucagacuggcaucuggcccugccuaauguacuugguu

SEQ ID NO: 4171858 - RNA, 63 nt, Human
aacggcacaaggcaacuuuuggggaugaugggaauauuccacaucucaauugcggugguuguu

SEQ ID NO: 4171859 - RNA, 130 nt, Human
aacgugggacaggagcaagcauguaacagacaccaaugcacuuuguaaucuguucaauuacauuaauugauagauuacaaggugcauuggcgacacugaguaggcaugcucagcucuaccuagaaagguu

SEQ ID NO: 4171860 - RNA, 83 nt, Human
aacgugguguuuaaauuuguauuccuuuuccguaaaauacaaaugcugugggaaaauaauacauacuuauaggcaucuauguu

SEQ ID NO: 4171861 - RNA, 72 nt, Human
aacuaagucaacuucaaaugugacuuugcauuguaagauguaaugucagauucuggagaaaaauucuuaguu

SEQ ID NO: 4171862 - RNA, 123 nt, Human
aacuaaguuaggauuuuauuuuauuguggggaauuuaugugcaaauuauugugcaauuuaaugaaaauaagccaauguuuuauacagaaguacccagaaaauuaaauaacacuauacauuguu

SEQ ID NO: 4171863 - RNA, 57 nt, Human
aacuagaaaucacuacagguauugcuaaucaugguagugcuagaggaauucuugguu

SEQ ID NO: 4171864 - RNA, 78 nt, Human
aacuagaauuucccugcaagacuauuuaguuccacaaacuuuguugucauggaaaggaagagcuugagguuucaaguu

SEQ ID NO: 4171865 - RNA, 78 nt, Human
aacuagagauggcagaaccuggcugaagugggaaggcugaauuuuauuuaaccucuaauuuaguucuccucucaaguu

SEQ ID NO: 4171866 - RNA, 57 nt, Human
aacuaggaagcaagagaaacagggacgggauuuucuucuuucuguuugcuucugguu

SEQ ID NO: 4171867 - RNA, 55 nt, Human
aacuagggcagaugaacagggggcacaguccuaccuccagacaucuagcucaguu

SEQ ID NO: 4171868 - RNA, 109 nt, Human
aacuaguggcaauagaauugcagcaugauauuccauuagguaacuuauuuuuggcugcuuguuaagaaguguugccuaaugcaauguuguaaggacaaaaaucacaguu

SEQ ID NO: 4171869 - RNA, 76 nt, Human
aacuauagggguuaccuuuagcaucuccccucucugaucacacuauggagggaugccaaaagugccccccauaguu

SEQ ID NO: 4171870 - RNA, 62 nt, Human
aacuaugaauaccuauuugggguugaauuguguucccucaaucccaagaauaugcauaaguu

SEQ ID NO: 4171871 - RNA, 61 nt, Human
aacuauuagaggaaccaagguggagcuggccucuagggcucuucauaggucuucuggaguu

SEQ ID NO: 4171872 - RNA, 77 nt, Human
aacucaauuucccuacuuguaacuggaaacaagaauaacagcuguuucguagaguuguaguuaggguaaaaugaguu

SEQ ID NO: 4171873 - RNA, 78 nt, Human
aacucagaauaaagauccugcuuuugcuucugugaucauaaagcaagcacaaggcaauggcaggauuucaaccugguu

SEQ ID NO: 4171874 - RNA, 57 nt, Human
aacucagcucaggagcuggcuggggacagaguugcccagagagcagugaguggaguu

SEQ ID NO: 4171875 - RNA, 55 nt, Human
aacuccagugucagcugcaauguacauuagcaccagcaucuugagacugugaguu

SEQ ID NO: 4171876 - RNA, 81 nt, Human
aacucccauuccacaucugcccaaauccuucuuccucugggcaaccaccccgggggugggagguugggugggacggagguu

SEQ ID NO: 4171877 - RNA, 59 nt, Human
aacuccugaauucucacacagcucugugagguggauguuggcagaugagaccagggguu

SEQ ID NO: 4171878 - RNA, 126 nt, Human
aacucuaccagagucagauugggcagaaugaagggcaugauaugggugggagagaugauucuuccucuaaaaaucagguucccaaaauauaacaguuaacaaucuccuaauaauucugagugaguu

SEQ ID NO: 4171879 - RNA, 110 nt, Human
aacucucaguuaauggaagaagaacagugucaugaaucaaagauuauuuaaaaauugcuuauaaaaaugggacuuuggaaugcacucuuugacuuuuuuggcagaggauu

SEQ ID NO: 4171880 - RNA, 61 nt, Human
aacucugagacaggcuuuggugauacaucaaugaucagagaaaaaauccugcucucaaguu

SEQ ID NO: 4171881 - RNA, 68 nt, Human
aacucugcucuuauaguguuauagugugaaaccagcuauaggcacuauuuuacuaagugagcauggcu

SEQ ID NO: 4171882 - RNA, 85 nt, Human
aacucuuucccaagauuauauccagagagauuucucagaagacuugaagaggaaugucauagaauaaucaugcaugaaagcaguu

SEQ ID NO: 4171883 - RNA, 77 nt, Human
aagauaugucccauaaauuuucuagaacaucacauuaaagugauuuacagaaagguugugggauagaauuagaucuu

SEQ ID NO: 4171884 - RNA, 66 nt, Human
aagauccugccauugccccuggcuuccaggaacugaacuggauucugagcaucauggcagaaucuu

SEQ ID NO: 4171885 - RNA, 61 nt, Human
aagaucgaauaauugcauucuauaauagggaagucuguugucuuugugguugguuggucuu

SEQ ID NO: 4171886 - RNA, 101 nt, Human
aagaucuuagaucuucuaaguagaauuuuuuagguuguuguuuuauguuaaauaguugcaacuuuagaaaaaucuauaaaaugugaggaggaaaagguuuu

SEQ ID NO: 4171887 - RNA, 102 nt, Human
aagaucuuuaacuuaaccacauucucaaugucucuuucuaaaauguaagguaauauacacauacauuuggaggauuaggaugugggcaucuuuggagcucuu

SEQ ID NO: 4171888 - RNA, 93 nt, Human
aagaugaaaauacgguaaaauauguacacacacaagucccauuccccaagaauugauuaaguggaaugaguauuuguuuucccauuucaccuu

SEQ ID NO: 4171889 - RNA, 105 nt, Human
aagaugaacaaguggugcagaaggcucacucaguuaagaaugaagaccauaaaauauauuggcuacaaucuuuauguugagugguuuaucacagcuuagcaucuu

SEQ ID NO: 4171890 - RNA, 62 nt, Human
aagaugagcuccagggaacagcagcuaccuuggugaagccaugggucccuggggcaaauguu

SEQ ID NO: 4171891 - RNA, 55 nt, Human
aagaugcacaauguggcaauuaacaggauaguauuguuuccaaauugugcauuuu

SEQ ID NO: 4171892 - RNA, 57 nt, Human
aagaugcauauucccagaccucacgcccagagagucugggcaggaaucugcauucuu

SEQ ID NO: 4171893 - RNA, 56 nt, Human
aagaugccugccagugcaguucugucuuucucaugggacucuacacaggccaucuu

SEQ ID NO: 4171894 - RNA, 70 nt, Human
aagauggaaauucugaaauucccuucguuaagaacuuuuugcugauucaugauuugagaauuuuucucuu

SEQ ID NO: 4171895 - RNA, 56 nt, Human
aagauguuacucaaccaggauaaaucuuccagugucuauaccugugguagcaucuu

SEQ ID NO: 4171896 - RNA, 56 nt, Human
aagauguuauugucuuccuugcuuuguagaagcaaaggaaagaaacaauggcacuu

SEQ ID NO: 4171897 - RNA, 68 nt, Human
aagauguugcauuagaauaccuguucuccaacaauucguccuggauaaaggcaucugagucacaucuu

SEQ ID NO: 4171898 - RNA, 74 nt, Human
aagauucccacaguuucugauguguguguuuauagucuucaauguauguuaacauguuaggaacugaguaucuu

SEQ ID NO: 4171899 - RNA, 62 nt, Human
aagauuccucuuaaugaggcugacuuguauuuuuacaaagcaaaucaucuaagagagaucuu

SEQ ID NO: 4171900 - RNA, 55 nt, Human
aagauuuucccauugguucugcuacuaaauaggugaacacauuugggaaaaucuu

SEQ ID NO: 4171901 - RNA, 72 nt, Human
aagauuuuucuucagcagcccagaaaucuuuucucucugacagguuggaagcacugaagagacaaccaucuu

SEQ ID NO: 4171902 - RNA, 124 nt, Human
aagcaaagaaaaguaaaauuuuaaguaagcaguagagcagauguagcuuaaaaccuccaaauuauuucaggccucaagcugcuuuaaggcuguauuuuaagauucaguacuuuuuuauuuguuu

SEQ ID NO: 4171903 - RNA, 92 nt, Human
aagcaaagggagaaaauauuagcagugaucaaaauggaguucuaaauauauaggucuuuauuagguuauucucuguacuuuuccaaaugcuu

SEQ ID NO: 4171904 - RNA, 86 nt, Human
aagcaacccaauaucaguauccugcaguuucuaugggcccuuucugcagccuuuacucauggaagacaagggaucuggguuuguuu

SEQ ID NO: 4171905 - RNA, 112 nt, Human
aagcaauccucugggucuuuuguuaaaaugcagauucuguuucaguaugucugaagcaaggucuaaguaucuguauuuaugacaagcaagcuuccaggugauuacaaugcuu

SEQ ID NO: 4171906 - RNA, 60 nt, Human
aagcaauugugaaccaccugcaaugcgguccugugugugcaugugaauucauacuuguuu

SEQ ID NO: 4171907 - RNA, 130 nt, Human
aagcacaacuaaaucucagccauuuucaaguacagcuaggucuucagcacuuuaagaacugccucucagugcaaaguggaaaaugaaaaccagcuccugcauauugauuguagcugauuacaauuguguu

SEQ ID NO: 4171908 - RNA, 58 nt, Human
aagcacaccucccuggcaggagcaaauccccuuaugcuccugggggguaggugaguuu

SEQ ID NO: 4171909 - RNA, 86 nt, Human
aagcacagagagacagcugcucgcagagcuaugggcagaggauugguuuucaugguucucuaugaagcauugucucacugcugcuu

SEQ ID NO: 4171910 - RNA, 71 nt, Human
aagcaccuuaucccgggguauaggcaggggcaggggcauccuccacacgccuggccaccccagggcugcuu

SEQ ID NO: 4171911 - RNA, 71 nt, Human
aagcacuuucuuuuggucuccaagccaugugucaagucagugaacugcuggggaggccaaacucaguccuu

SEQ ID NO: 4171912 - RNA, 70 nt, Human
aagcagaccagauccuuuuuauggcauuuuaaguugguauuuacaguugcuacaaaggauaauucuguuu

SEQ ID NO: 4171913 - RNA, 95 nt, Human
aagcagagagaaaugcuuuucccuucuggguccaggaaggcagcuccauaacccguuucugacuccagagaggaauaagaauaaacucacugcuu

SEQ ID NO: 4171914 - RNA, 65 nt, Human
aagcagaggaccgacggagggauacuuucugcucuuuugugugccuccucuuucucucucugcuu

SEQ ID NO: 4171915 - RNA, 86 nt, Human
aagcuuuaggguacauguacacaacgugcagguuuguuacauauguauacaugugccauguuggugugcugcacccauuaacgcuu

SEQ ID NO: 4171916 - RNA, 76 nt, Human
aagcuuuuugagaaacugcuuugugauguguguauucaucucacagaguuaaaaguuucuuuugauugaucagcuu

SEQ ID NO: 4171917 - RNA, 59 nt, Human
aaggaaaucagggggcucuagagucuggcuaugugauuuucucaggccccaguuuucuu

SEQ ID NO: 4171918 - RNA, 55 nt, Human
aaggaagaggcagguuuugcugaccacauuuuggcaaaucuguuggcucuuucuu

SEQ ID NO: 4171919 - RNA, 65 nt, Human
aaggaagccccagacccagagucuagguagaaacaagggcacaggcgggguccuggggcuuucuu

SEQ ID NO: 4171920 - RNA, 79 nt, Human
aaggaagccccgcucugcugugucauuggaaugauucucuagaucuaauucuaaagacucauggaagugggaagucuuu

SEQ ID NO: 4171921 - RNA, 69 nt, Human
aaggaagucagcuggugccuaccuggagcgugcugucccuccagggaaggcugcuggcugugucuccuu

SEQ ID NO: 4171922 - RNA, 61 nt, Human
aaggaauaugguguuguccuauucuuguuagggaaggauuggaccacuacuguuuucucuu

SEQ ID NO: 4171923 - RNA, 82 nt, Human
aaggaauuaaugacacauauaaggaauugaucgacuaagguagaguugagaacaguuaacuucauaugaucauuaaucccuu

SEQ ID NO: 4171924 - RNA, 57 nt, Human
aaggacaggcuaaccugacauugaauuguaucuuuggaggccugcagcacuguccuu

SEQ ID NO: 4171925 - RNA, 68 nt, Human
aaggacuaguaaaguacucaaauagccccuauaaagaggcuucuuuguuucuuugaucucuggcccuu

SEQ ID NO: 4171926 - RNA, 68 nt, Human
aaggacucuugggaugacacuggaccuaccuggaugauccaggauaauuucuccaucucaagguccuu

SEQ ID NO: 4171927 - RNA, 84 nt, Human
aaggagaaagaaauggcuccucguaagaauaugauauuuuccccuuuccaagaaaauagauaaugccagggucacuaucuccuu

SEQ ID NO: 4171928 - RNA, 63 nt, Human
aaggagaaugagugcuagguaucaaaccauuuagauaaaaccaccuuagcauuuaucuuccuu

SEQ ID NO: 4171929 - RNA, 84 nt, Human
aaggagaggagaagggaacugugggagggugagagaaccagugcugacuggcuucucucgccuucccucgccuucccucaccuu

SEQ ID NO: 4171930 - RNA, 75 nt, Human
aaggagcauucuaugugaacguuauaguuugagcuuacaguaaacaggaagagcauucacaugguagugcuuguu

SEQ ID NO: 4171931 - RNA, 58 nt, Human
aaggaggagagugcauggaggaauguucucuuccccuucuccauggcucuucauccuu

SEQ ID NO: 4171932 - RNA, 129 nt, Human
aaggaggaugaaaaaucaggagcugucaacaaccgccugguaacccugggucggcaccauuuucuaguugcuugcaaucaaggauugugugauuccagagguuauuccuggccagcucccaucuuccuu

SEQ ID NO: 4171933 - RNA, 81 nt, Human
aaggaggggugacuguguaucuuauccuggcccuguuuggaaggaagagggcauaaaauagagcacgugucacugcucuuu

SEQ ID NO: 4171934 - RNA, 79 nt, Human
aaggaguaugccuuuugugcugaagauccagagcagggguugccaacuucucugaagagucagacauaacaaauuccuu

SEQ ID NO: 4171935 - RNA, 57 nt, Human
aaggagucugggccauucagagccagccucaggcagcuuugucccccaguauuccuu

SEQ ID NO: 4171936 - RNA, 90 nt, Human
aaggaguggguggaagagguccuggggcuggugagaugaaaaaugcauuguccuugggcugcaggcuucccuccagcauucugacuccuu

SEQ ID NO: 4171937 - RNA, 112 nt, Human
aaggauaugcuuauagguacaaaaugaacuguugacaguaguugcuucuggaaaaugagacaaaguggcuaaugaaaaauagauuauagguugacuuucuauuuuugucuuu

SEQ ID NO: 4171938 - RNA, 56 nt, Human
aaggcacagccacuugaucauccuggugacuccauuugaaauaaggaguuguccuu

SEQ ID NO: 4171939 - RNA, 57 nt, Human
aaggcacauuccugaaaacaauguggguuagaccaggcaguucauaggaugagucuu

SEQ ID NO: 4171940 - RNA, 61 nt, Human
aaggcaccugguaagugcucaguaaagggucaugguugcuguuguuauuaccagguguguu

SEQ ID NO: 4171941 - RNA, 64 nt, Human
aaggcagaaaguacagaugagacacuuuuugaaagaguucuucuuuuuguacucuuuuugcuuu

SEQ ID NO: 4171942 - RNA, 55 nt, Human
aaggcagccauagcaccauccagggauuucaucuugggggagaauugguugcuuu

SEQ ID NO: 4171943 - RNA, 61 nt, Human
aaggcaguacuuuauguccauaucaguuaaaucguuugaaaugaccaucaucugcugcuuu

SEQ ID NO: 4171944 - RNA, 86 nt, Human
aaggcauaaaggaagacuugucagggaugcugauaagagaauuuuugccuuauggguaggguuugauaagauuccuuccaugucuu

SEQ ID NO: 4171945 - RNA, 76 nt, Human
aaggcauaguucuuauccuucagcauucuggaauucccucgaugaccacagggcugcaggaugaggcucugcucuu

SEQ ID NO: 4171946 - RNA, 76 nt, Human
aaggcaucaucuggcuuuuagaaaaaccagguacaauagagaagaacuguuuuauuaucagaguuaggggugcuuu

SEQ ID NO: 4171947 - RNA, 75 nt, Human
aaggcauuacucccagcucuaaggcgacaucgcugucauuaaagaaaaccugugccugaguuggcugaguaccuu

SEQ ID NO: 4171948 - RNA, 62 nt, Human
aaggcauuuguuggauuucucaccaauuugaacaucucugguuuggaauacggugaauccuu

SEQ ID NO: 4171949 - RNA, 58 nt, Human
aaggccacuuuaccuuaaauccuguugauuuuaauuuuuuuuaguguuaaguggcuuu

SEQ ID NO: 4171950 - RNA, 78 nt, Human
aaggccaggauggagaguuguugguugaccacugcacuccugugaucaccgcaccccugcacucuccuccucggcuuu

SEQ ID NO: 4171951 - RNA, 78 nt, Human
aaggcccaauuauucucuagguugauauaaauuauuuguuauugggggacaaugguuuagcaacuuagggaaagcuuu

SEQ ID NO: 4171952 - RNA, 56 nt, Human
aaggcuagaaugaaaucugaguugauuacaggucaacaagauagagcucuugccuu

SEQ ID NO: 4171953 - RNA, 74 nt, Human
aaggcucuugaguggugauagugacaaugcugcaacuuaauaucuacauagugcuacaccauuuucaaggcguu

SEQ ID NO: 4171954 - RNA, 86 nt, Human
aaggcugauauguaauagaugauugggaaguaccuaaguaacacuccauauacaacuuaaucuuuauauaagaagcgugcagcuuu

SEQ ID NO: 4171955 - RNA, 58 nt, Human
aaggcuuguuaugauauaaaauacaaauauuuugggaaagaguaauauaauaagccuu

SEQ ID NO: 4171956 - RNA, 79 nt, Human
aaggcuuugcugaauucucauucccuggagaaauagccaagaguguugggcuuuuccaaagggacuucagcggaaacuu

SEQ ID NO: 4171957 - RNA, 103 nt, Human
aaggcuuuuuaaaggagggggccuuggagcugaacuuugaggccaguggcauucgaacacauccacgggucucccuuucggauuucagugcccucuuggccuu

SEQ ID NO: 4171958 - RNA, 60 nt, Human
aagggcuuuuaagauuuauccuccaugugaaauuuggggcuuuauauucuauaggccuuu

SEQ ID NO: 4171959 - RNA, 114 nt, Human
aagggggagaggacuuagaauguuaagaauauguauauauacacacauauauauauaauaagaauauauguauguguauguauguguauuuuugagacagggcuucucucuguu

SEQ ID NO: 4171960 - RNA, 63 nt, Human
aagggggagcuuuuauuucuuggucucuuccuccuuagacaaagucuugaugaucuccuccuu

SEQ ID NO: 4171961 - RNA, 85 nt, Human
aagggggauggaguaaaagaugaggcaguagaaaugccuuugaaugguuuucuguagcuaauucucuuuaaauuuuguccugcuu

SEQ ID NO: 4171962 - RNA, 72 nt, Human
aaggggugagcagaggcuucgcuuaacuuccuuaaggcucucaauggaagaaccgcaagugucuguccccuu

SEQ ID NO: 4171963 - RNA, 86 nt, Human
aagggucuuggugaccacuauaucaaggauuuuguuugcugagguaaagacaauuucucaauauagaaacuauucacuaagaacuu

SEQ ID NO: 4171964 - RNA, 57 nt, Human
aagggugggcaccgccaggucauccaugccagggaugcaccuguggccccaauccuu

SEQ ID NO: 4171965 - RNA, 119 nt, Human
aagggugggucugagauguuuggguggguuaagcggacauuuugacaacauggcuucuccuuuggcauguuuaauugcgauguuugacacacauccuugcaguuuaagaugacgcuuuu

SEQ ID NO: 4171966 - RNA, 87 nt, Human
aaggguuacugucaauuagugggggugugaauuggcauggugcuuuuggaaagcaauuugacaguacauaucaaccagcaaauccuu

SEQ ID NO: 4171967 - RNA, 81 nt, Human
aaggguuuuuguagauaaggauugauuuuuauuauaucuauuuuaguuguuaauaauuguuaaucguuguuucauuucuuu

SEQ ID NO: 4171968 - RNA, 60 nt, Human
aagguaagaaccagagucuuguauaugcccuuagucuuugaaguuucugguuuauaucuu

SEQ ID NO: 4171969 - RNA, 71 nt, Human
aaggucugcuagcuuguagugauuugugguaaaucacaauuuucaugauccauuuacaaaaugguaaucuu

SEQ ID NO: 4171970 - RNA, 79 nt, Human
aaggucuggaggcuucauccuacccagagugcauggggagcugaccagaguuuggagagggugaggcaauggagacuuu

SEQ ID NO: 4171971 - RNA, 126 nt, Human
aaggucuucagagaccaccugggucuaccccugcuggcaccgaugaaagacagugcuucauugugucuagcgcuggugcucaggcuagggauucaggcccuuuguuccaaauaucuguaugaccuu

SEQ ID NO: 4171972 - RNA, 90 nt, Human
aaggugaaaccugggggaauuccaggguuagcucauuugguagcucuggggagccagguuggcuucucugggauucuuuuguuucuccuu

SEQ ID NO: 4171973 - RNA, 61 nt, Human
aaggugacauucacaguuuccgaugguuaggacauggccaucucuuuuuggaggucagcuu

SEQ ID NO: 4171974 - RNA, 78 nt, Human
aaggugagugucuagggagcugcucaggcuccguggugaucccagagggcucggguccuucucuagagaucaggccuu

SEQ ID NO: 4171975 - RNA, 125 nt, Human
aaggugccagaugcaguggcucaugccuguaguccucaacuugggaggcugaggcaagaggaucgcuugagcccaggaguaugaggcugcaguaagccaugauugugccacugcacuccagccuu

SEQ ID NO: 4171976 - RNA, 74 nt, Human
aagguggagaaacugaaauauggcuuuucuuccucccccagguuccccugugccauucuuucuuucuucaucuu

SEQ ID NO: 4171977 - RNA, 66 nt, Human
aaggugguaauuuaauccuacacuguugggaauaccucagcagaauguuuccuggguugcuacuuu

SEQ ID NO: 4171978 - RNA, 77 nt, Human
aagguguguuacugugguuaccagaagcuucucucauuccaggaagaaucugcuuucugggcuauagaacgggcuuu

SEQ ID NO: 4171979 - RNA, 80 nt, Human
aagguguuauagcugaggaauaaaacugacauugaauaauagucauguuuacccauaucuccuuauuugcuuaaagccuu

SEQ ID NO: 4171980 - RNA, 92 nt, Human
aagguuaaggucaguagucauaagucauaagucaugauguuauguauccuuaauauaacaugauaaguaugauacuuugccuguguagucuu

SEQ ID NO: 4171981 - RNA, 62 nt, Human
aagguuaguaaguaucuuaugucccuggaacuacgcuaggcacauacauaccuuaccaccuu

SEQ ID NO: 4171982 - RNA, 67 nt, Human
aagguuagucaagggagacuugggguaagugccuguucaaggcccuccaccuggucucucuggccuu

SEQ ID NO: 4171983 - RNA, 68 nt, Human
aagguuaugggagagcugacacugagaccugaacuuccugaguaccuauucagugcuccuauguccuu

SEQ ID NO: 4171984 - RNA, 130 nt, Human
aagguuccagcccagcucuucccacucagugcccgcuucaggucuuccgagaggccugugcuccuggagacaggugggcacagagaggcccuggaaggaccuggacaaacucuguagggggcugaauucu

SEQ ID NO: 4171985 - RNA, 62 nt, Human
aagguugucagauuuaagagggauuaaauucucuacgaauucucuagaaaucgaauaaccuu

SEQ ID NO: 4171986 - RNA, 70 nt, Human
aagguuuggcuccguuguacaggcuggagugcagugaugcaaucucagcucauggcagccuugaacgcuu

SEQ ID NO: 4171987 - RNA, 92 nt, Human
aaguaaauagucagcagugcuuuuacaaauauauucacaugaaaauuuuuaugcugaaauuuauugguaaggaauugcuaaauguuguacuu

SEQ ID NO: 4171988 - RNA, 103 nt, Human
aaguaacuauugaauauucuguaaucuuagacauguauuuuucaagcuaacccuuugaagaaauguguucaagguaggaaaauauaaaauuuuuugguuauuu

SEQ ID NO: 4171989 - RNA, 78 nt, Human
aaguaaggcguuuugaugaucaugaccugaaucuuucccuaaagacuucagagucagggaucucagagggccuggcuu

SEQ ID NO: 4171990 - RNA, 130 nt, Human
aaguaauagaccuugggauuaucauagugaauugugcucugccccugacuguuuuaguaagauuaaaauuaauaacuucaucaaauaggcacauuucaugugugugaaaauuacucaauuucuuuuccuu

SEQ ID NO: 4171991 - RNA, 61 nt, Human
aaguaauuguaacuauugguugaauguagccucgguaauuaccaauguuuacagauuacuu

SEQ ID NO: 4171992 - RNA, 112 nt, Human
aaguacaaauuguuuuagacacggcaauuuuuguacuuauaguacuuauaauggccuaaaauacacauuuuaguguauaugugcugagaaacguguuuuuaaauguugacuu

SEQ ID NO: 4171993 - RNA, 60 nt, Human
aaguacauuauaugagcagaaugaaacauguuccaaaauauuuugcuuguaaguguaguu

SEQ ID NO: 4171994 - RNA, 64 nt, Human
aaguacuaaggcuauuaugaugcauuuagucauccagauaguugaucauauucagccuauacuu

SEQ ID NO: 4171995 - RNA, 68 nt, Human
aaguacuugauagauuaacuguggguuuuaauauauugcaaaaaaaauugacaguugucaggauacuu

SEQ ID NO: 4171996 - RNA, 112 nt, Human
aaguagaacgauuuuucuguauugcucgaaauaauuuagaauauagagccuaaaguuuacuaucuucucugacauuagauuaauuggaagcaagaacacagagauccuauuu

SEQ ID NO: 4171997 - RNA, 79 nt, Human
aaguagauuagccuuaauaauuuagaagugacaacuacucuugcuguuccuucugaaacagcauuaugggccuuuacuu

SEQ ID NO: 4171998 - RNA, 59 nt, Human
aaguagcaaucucauuaguuggaauacaaaguccaggauuucuaaggagauuguuauuu

SEQ ID NO: 4171999 - RNA, 65 nt, Human
aaguauacuuaggcauaaugguacaauguaagagcagacaaaaaacacagcgcccaaguguacuu

SEQ ID NO: 4172000 - RNA, 57 nt, Human
aaguauguugaguuuugcuuuaguauacuugaugcuaagccagcuguucagcuacuu

SEQ ID NO: 4172001 - RNA, 97 nt, Human
aaguauuauuuucaaggcccacaaguucuauugucacuuuauuaugaggaugccuggaaugguccagugacagauaggcacuguggcucgaaugcuu

SEQ ID NO: 4172002 - RNA, 104 nt, Human
aaguauuuagagucuuuaagugugcugaaauggugugcugugcaaugauauauguacacauucaauguauuacauauuauuuuaaagcuuuuaucuauuuauuu

SEQ ID NO: 4172003 - RNA, 77 nt, Human
aagggaaaauguguugaaauuuggagauaccacuacaaacugugaguaauagugucuaaaugcaauggauuuccuuu

SEQ ID NO: 4172004 - RNA, 100 nt, Human
aagggaaauaacuaaguaggugaguuuuaagcacaugguguauuuuauagguguuguaacacuuuucuauuaauaggcauauauaacuacuuuuucccuu

SEQ ID NO: 4172005 - RNA, 76 nt, Human
aagggaaguauaauacagagcaguaauagaggagaauuuaaaguuauaagaaaauucucucugucucucuuccuuu

SEQ ID NO: 4172006 - RNA, 55 nt, Human
aagggacuugucauuggauuuaggacccaccuggcuaauccaggauaagccccuu

SEQ ID NO: 4172007 - RNA, 75 nt, Human
aagggagaugcuguuuaaguggaauuuguuuuuagaaaacaggucagaaacaagagcuuacauggcugcucucuu

SEQ ID NO: 4172008 - RNA, 109 nt, Human
aagggagcuggaaaauggcaaagaugaacguucauaguuauuuguuucauacucuuuauauaacaggcuccuugugaauggauauuuccaauuuccacacaaggcccuu

SEQ ID NO: 4172009 - RNA, 107 nt, Human
aagggagguuuguaggaguccucggacgugggauauuggggguaucuagggcuuggaugguuuguggaauguccucagcauccucccgucccaacccaaccuuccuu

SEQ ID NO: 4172010 - RNA, 87 nt, Human
aagggaguaauugauagaacuuagcacuagacuuguugugggauuugagaccacuuacaauuuggaagcuugggcugauccuuccuu

SEQ ID NO: 4172011 - RNA, 68 nt, Human
aagggaguuggaggaaagaagguugauauaaagaguauuaaauuaaauuucuuucuuuuugcuuuguu

SEQ ID NO: 4172012 - RNA, 86 nt, Human
aagggaucagguuucugaaggccuugguacccagugggugccccacaccuacccugcaccuggcacuacaggcaccugucuuccuu

SEQ ID NO: 4172013 - RNA, 60 nt, Human
aagggauguguuuggaaagguagguuuggcacaaaccuugaauacuuaaauacaucgcuu

SEQ ID NO: 4172014 - RNA, 87 nt, Human
aagggccaaagcaugcuuucccugggugguuuuaugccugucaugaacaccguaagacagcuaaucccccuagauucuuuguacuuu

SEQ ID NO: 4172015 - RNA, 57 nt, Human
aagggccagggcucuagagauaagcagcccuuguuucgaaucccagcucuggcccuu

SEQ ID NO: 4172016 - RNA, 57 nt, Human
aagggcucccaacucaucuuuuaucaacuaguuugaugaugguaggguguggccuuu

SEQ ID NO: 4172017 - RNA, 98 nt, Human
aaggggaacaaaugagaucguguaggcgaugccacuuugcacauucugaagcacuaaaugaaugugcaauggugucaccacauggucuuuugccucuu

SEQ ID NO: 4172018 - RNA, 88 nt, Human
aaggggaguggguucuaaaaugaaagggaaauggcacuugacuucuuagauggcgggaacaugcuuucauuucagagaaacugcccuu

SEQ ID NO: 4172019 - RNA, 79 nt, Human
aaggggauagauauaagugacuuagaagaaaauauuggagacaauaguacagcauuuuuccugagucaccaauccucuu

SEQ ID NO: 4172020 - RNA, 111 nt, Human
aaggggcugaauuaauggauuggcaugaccaaagcagggaaaucuauuugcaugcaauauuaacugugcuaauaaacuccaggcugagcucagcaggccaggcagccucuu

SEQ ID NO: 4172021 - RNA, 60 nt, Human
aaggggcugagaaauguuguaauuauuaagaaauuugguauuagcaaucucagucuccuu

SEQ ID NO: 4172022 - RNA, 58 nt, Human
aagggggcacagucacuguaauaucaagcacugagcucugcaggaauuugcauuccuu

SEQ ID NO: 4172023 - RNA, 75 nt, Human
aagggggguggccaaggcagagaaagagcccgacaggccaggagccggcuuuucucccugcuuucuuccucccuu

SEQ ID NO: 4172024 - RNA, 69 nt, Human
aaggggucuauucaucaaggcaucacggcagugugcuuccugccuuuggccuugccgugaaagcccuuu

SEQ ID NO: 4172025 - RNA, 78 nt, Human
aaggggucuucuuuggucuccucucugccagucuccugaaagaggggagggguggaaggagugccuggaaggucucuu

SEQ ID NO: 4172026 - RNA, 103 nt, Human
aaggguacuuguuggggucaagucgcugcacgaucuccucgaugcucuugugcuucuggauuagauccacagcccgcuugggcccaauacuccagauacucuu

SEQ ID NO: 4172027 - RNA, 61 nt, Human
aaggguagaugggguaaaauaauuaagauuaagauucuuguauuuccaacccuuuauccuu

SEQ ID NO: 4172028 - RNA, 114 nt, Human
aauccuguuuuugguuugacacauuaugagcaguugucuuuccuuccucaaauagugggaaagcagacuugucuucuaaugucauuucagucucccuuuucccagaaauugauu

SEQ ID NO: 4172029 - RNA, 63 nt, Human
aaucgaguggugagaacacaacagaaguccaauuuagauucugaguguuguaaccauaugauu

SEQ ID NO: 4172030 - RNA, 62 nt, Human
aaucuaagcaauuguccugucucuacagacuuauaauuuuuaggauauggauaaugcagauu

SEQ ID NO: 4172031 - RNA, 77 nt, Human
aaucucugagucacaaggcagacagacacacaggagagaucaggguaaauguauuucucuuuaaagacucagagauu

SEQ ID NO: 4172032 - RNA, 90 nt, Human
aaucucuguacauguuaaucuuaaguuuagauuucucuauaucugguuuccuaagaggaggagagaaaacucauugaggugucagggguu

SEQ ID NO: 4172033 - RNA, 130 nt, Human
aaucugaguuuuuguggaacaggauuggggaacugggaagacaagaaagauagggaguuucuguuucuuuguuuuguuuucauguuauuuccagucuagaaauuacugcuuaucauaagaacuaaaauau

SEQ ID NO: 4172034 - RNA, 62 nt, Human
aaucuggaauaugcuacauuugaucaaugaagauugaagagugcauuagcauauuguagguu

SEQ ID NO: 4172035 - RNA, 65 nt, Human
aaucuggccuuaucacaaagcuagagagacccaaaauucucuuugggaaacuuaggggucagauu

SEQ ID NO: 4172036 - RNA, 59 nt, Human
aaucugguuugacaacuuuugucuuuuaaugggagaggacaauaacaguuggauugauu

SEQ ID NO: 4172037 - RNA, 87 nt, Human
aaucuguagucauaagcagugugggugaaauacaaaguguauauuuagacuuuaguguugcucauacauaugcauuguuuuuagauu

SEQ ID NO: 4172038 - RNA, 84 nt, Human
aaucuguuauaagcuccaggugauuugagguacccugaaauuugagaaccacuaccuuaagacauccguugcuuauaaugaauu

SEQ ID NO: 4172039 - RNA, 126 nt, Human
aaucuuaucuauugggagguagacuaaaguggagauaaggcuuuuguggguuuuuugucugugcuuagacaaaauuaugaagaggccuuguuuuguuucauuuugucauguucucaguguaacauu

SEQ ID NO: 4172040 - RNA, 129 nt, Human
aaucuucaguauguuggcuuuucaaaccugucucaugaagcaauggcagagaauuugucaccgacucuugguggucaaagccaguguucuuguugccauuugaagcugccaguguuuuaaacuaaauuu

SEQ ID NO: 4172041 - RNA, 67 nt, Human
aaucuugccuagcuuagggaaacugacagaguagauuucuuggcaguaucuuugugguuguuagauu

SEQ ID NO: 4172042 - RNA, 83 nt, Human
aaucuuugacuuuggcauuguuccaacaguauguaucaguaaaauuauauagcagaaacaccacaaugucaaggucagacauu

SEQ ID NO: 4172043 - RNA, 105 nt, Human
aaugaacauagcugcucugaaaguuuagugcugaacauuugggacuuguuuuagaucgaaaagaaucccauucuucagaugaaucgauaaaguguuauuuucauu

SEQ ID NO: 4172044 - RNA, 75 nt, Human
aaugaagacacaucuuucucauagguuuauuagacacugggguguauuacacugauagagguuguucucuucauu

SEQ ID NO: 4172045 - RNA, 65 nt, Human
aaugaagucuucaucugaugcucugaacagagaaacuuuagagguuuagagugaggacugacauu

SEQ ID NO: 4172046 - RNA, 60 nt, Human
aaugaaugugaaauuugaugagaaggauuggcuccugcugcaaauaaauuucuguucauu

SEQ ID NO: 4172047 - RNA, 130 nt, Human
aaugaauucagagaugaaacauuuauauauauacacauuuuuaccuauaguauuaaaaucacugaucaaucaucgggggaggcuauaggaagaaauuuguuuugcauauuucuucucauguuuuugcauu

SEQ ID NO: 4172048 - RNA, 91 nt, Human
aaugaauucucagacacaagaguaaagucaaauacuagaaaacgguuuuaaggugcuuuauuuagcucuuucugugugugcauuguuuauu

SEQ ID NO: 4172049 - RNA, 94 nt, Human
aaugaauucuggaaagagacucuccagaugggaagaaauggcuguaguaacaaucccaauucauccucuggggcuucauuuuuccuauggcauu

SEQ ID NO: 4172050 - RNA, 114 nt, Human
aaugacaagaauguaaacagugcuuagaaaguccccuucuucuggugccuguggaugagaaucacaguaaaagcauggaagaggcaggagaagacaaggcacuagcuggucauu

SEQ ID NO: 4172051 - RNA, 55 nt, Human
aaugacauguguaccuauuguugcuuguccuugaugaugaguacacuuguacauu

SEQ ID NO: 4172052 - RNA, 117 nt, Human
aaugacauucauuucauagaacuguuaagagcgugaaaugaguugaauuauugcucuuuauuuccaaagcccuuagcucaauuucuugcccacaguaucugcuauguaacuguuauu

SEQ ID NO: 4172053 - RNA, 70 nt, Human
aaugaccucauucacuccaaacccacggguacuuucugcuccaccucuuggcagugugugagcuguuauu

SEQ ID NO: 4172054 - RNA, 112 nt, Human
aaugacuucacaggugcccagcuccaccucacagacaccauuuuucucucugcagaggccugauacauucugugggucagacgcugggcagcaaagugccuguggggacauu

SEQ ID NO: 4172055 - RNA, 68 nt, Human
aaugagcggucaggagaaauaagcauuguuuguucaaugcaugauuuuuucuuacuuaggaguuuguu

SEQ ID NO: 4172056 - RNA, 74 nt, Human
aaugaguucauugguaggagucaagcuguagugccccguugaggcucauauuuuggcuccauggguggcucauu

SEQ ID NO: 4172057 - RNA, 62 nt, Human
aaugauauagacuagcagcagaauuuaucacuguugauaguauucugaugaaguuuaacauu

SEQ ID NO: 4172058 - RNA, 79 nt, Human
aaugauauuucacauuagugguucuauauacaaugguauguaaaauuauuaugguggagauuaaauuuucuguaucauu

SEQ ID NO: 4172059 - RNA, 64 nt, Human
aaugaucggcuaucacaaaaggagcaagugaaggcuccucuacugcuuuuggaaagugaucauu

SEQ ID NO: 4172060 - RNA, 115 nt, Human
aaugauugcucuaaaauagugguugucaaauuuuaacaugcauuagaguuacuaaccaucuguguaauucuaaugcauguuaaacuuugagaaccacuauuuuagagcaaucauu

SEQ ID NO: 4172061 - RNA, 83 nt, Human
aaugauuucugcuuaguagacuuccugucuuggcgguaucacucagagaggauuuuaauaaguguuguuuuucagagaucguu

SEQ ID NO: 4172062 - RNA, 92 nt, Human
aagucagcaaacaagcgaguaauggaaucaggauaugaacccagguauccugagguccuggccauaccugguuuccaucauguuccugacuu

SEQ ID NO: 4172063 - RNA, 60 nt, Human
aagucaggacagauuuucuggggguauccucugguugcucuuccagauacuuccugacuu

SEQ ID NO: 4172064 - RNA, 69 nt, Human
aagucaggagauguaaccuuagcugugcugguuaaaagccagcuuugagaguugcauuuuaccucccuu

SEQ ID NO: 4172065 - RNA, 84 nt, Human
aagucauuucuugagcugaaugcaaucaggagaaagugggccaaggagccagcucaaggugagucauuuggcucaagagaacuu

SEQ ID NO: 4172066 - RNA, 128 nt, Human
aaguccaaaaugaaacucuggaacuaaaaaucagggaggcagcagggcugguuccuucuggaggcuccaggggagaaucuguucuuugucucuuccauuuucuggagguuacuggcauuccuuggcuu

SEQ ID NO: 4172067 - RNA, 62 nt, Human
aaguccuagacuuggauaguuuuuucacauaaaugugguggucaguauucagucuaggacuu

SEQ ID NO: 4172068 - RNA, 63 nt, Human
aaguccuucaagucuggauguuggguaaucacguuuucuuccagaagccauuuguuaggacuu

SEQ ID NO: 4172069 - RNA, 71 nt, Human
aagucuaagauccacauaaugcuguucauuguuuggcaaaaacaaacaaguuagauuuugugucuugacuu

SEQ ID NO: 4172070 - RNA, 85 nt, Human
aagucuacacaauuacauuuaagaguucugaauuugagugucucaccucuuuaauauucaaagucuagauguaguguugaaacuu

SEQ ID NO: 4172071 - RNA, 62 nt, Human
aagucucauccguguagcuccacguguaauaaaugugagucgagugaacgaaugaaagauuu

SEQ ID NO: 4172072 - RNA, 81 nt, Human
aagucuguauuggaagauagggaauagaaagucugccauaauaggcuuccuaauacucccuacacuuagcgauacagacuu

SEQ ID NO: 4172073 - RNA, 56 nt, Human
aagucuucagguuuuucauaugagauccauuuuaauuucuaaagaaucugaagcuu

SEQ ID NO: 4172074 - RNA, 61 nt, Human
aagucuucucaaaacucaggguaucugcuaugcaugguagauuuaaguuuuugggacacuu

SEQ ID NO: 4172075 - RNA, 59 nt, Human
aagucuuucauaagucucuuauuaaggcauaaauacuuuggggcauuuauggaggacuu

SEQ ID NO: 4172076 - RNA, 70 nt, Human
aagucuuugcuacugugaauagugccacaauaaacauaugugugcaugugucuuuauaguagcaugauuu

SEQ ID NO: 4172077 - RNA, 70 nt, Human
aagucuuugcuacugugaauagugccacaauaaucauaugugugcaugugucuuuauaguagcaugauuu

SEQ ID NO: 4172078 - RNA, 70 nt, Human
aagucuuugcuauugugaguagugccacaauaaauauacgugugcaugugucuuuauagcagcaugauuu

SEQ ID NO: 4172079 - RNA, 64 nt, Human
aagucuuuguguucugauccaaaggccaagauaucuguggcuauggcaaagaacucagauucuu

SEQ ID NO: 4172080 - RNA, 98 nt, Human
aagugaaggaguuagaguagaaucaucaaauagacucuagaauuuauuucaaauagacuccagggucuauuuugguucuggugucccuugauucauuu

SEQ ID NO: 4172081 - RNA, 99 nt, Human
aagugaaucagcacuagcauuuucuugaugguugacucaauguauaauuaacaaauauacauagcagagucaauuaaucauagugccauuaugucacuu

SEQ ID NO: 4172082 - RNA, 58 nt, Human
aagugaguccuucuggcuggcaggauucuugugaucacugggcagguagggcuggcuu

SEQ ID NO: 4172083 - RNA, 57 nt, Human
aagugagugacagagccaggggcacugauuauagcccaugcuccuuaccacucacuu

SEQ ID NO: 4172084 - RNA, 59 nt, Human
aagugauacgccugccucggccucccaaaguacugggauuacaggcagauguuuuauuu

SEQ ID NO: 4172085 - RNA, 55 nt, Human
aagugauagagaggaaauaaaccugaguucaaaucuaguucuccucuguguccuu

SEQ ID NO: 4172086 - RNA, 86 nt, Human
aagugaugucauuccguucuggagauaaguaaagaggcaauucugugaguugcuccugaauuuguccuuuacagcaugacacauuu

SEQ ID NO: 4172087 - RNA, 85 nt, Human
aagugauugcauacuggcugcacuucaacacauccucugauaaaaaggagaggaaaaugaagucaugcuagauuccacaucacuu

SEQ ID NO: 4172088 - RNA, 68 nt, Human
aagugauuuagaggaauagaauuagaaugugggguuucuguauuccaguccuauccucuuuuccacuu

SEQ ID NO: 4172089 - RNA, 68 nt, Human
aagugcaauagcaaagaacaacaucugauguuuugcugccaucuuuguuauuccagguuaauguacuu

SEQ ID NO: 4172090 - RNA, 71 nt, Human
aagugcaauauugccauguucuugcugcucaaaauaauugggagcagcaaggagaugauaauauugcacuu

SEQ ID NO: 4172091 - RNA, 114 nt, Human
aagugcagacauuuaggugacaguaggaauggagucaggagcugagucuaacuuuucuggcucuaagaccaguuucuuuccauuguuaccucgauaccuuuaaaucauguacuu

SEQ ID NO: 4172092 - RNA, 129 nt, Human
aagugccagggguucaagucacccagccuggaggcaggaauccuggguucuauuuuuggcuucacagcuaauccgcugugugacagucguuaggagcucauucuccccucugggucucccugagcccuu

SEQ ID NO: 4172093 - RNA, 129 nt, Human
aagugcuaggauuacaggugugagccacugugcccagccucaugggcuuucuuauuuuuaauuuuccuccuguaagauucauuuauucugggcugggcgagguggcucaugucuguaauccuagcacuu

SEQ ID NO: 4172094 - RNA, 110 nt, Human
aaguggaaaauaaaacagcuuagaugagaaugauuuaaaauguacaggggaaaguguuaguagacacaauacuauuuuuaggucuuucuuaucuguuuuauauugcccuu

SEQ ID NO: 4172095 - RNA, 81 nt, Human
aaguggcacucuuugauucucauguuugagguucuaauugcuaccucaugcaggacuuacgagagaucagccaugcugcuu

SEQ ID NO: 4172096 - RNA, 60 nt, Human
aaguggcagaaaauaggugguggcugaauucccacugcaucuccaucugcucugccccuu

SEQ ID NO: 4172097 - RNA, 107 nt, Human
aaguggcugguuuaagcuuccucucuguagaauagccccaggguauguggacuucuuacacacuggcucagaguuccuagagaucaaaguggaagcugccaguccuu

SEQ ID NO: 4172098 - RNA, 88 nt, Human
aauauuaauugcuagucaccaagucuuuuugaaucuauaacuuggcuaaugcaguuacauauaagaagacagacugagaauuaauguu

SEQ ID NO: 4172099 - RNA, 78 nt, Human
aauauucaaauguacaguggaaaauggauucguuguguaaauuucacaauggucagcaugcuuuacuuauagaauauu

SEQ ID NO: 4172100 - RNA, 63 nt, Human
aauauuccagcagcuccuuagugguccuucauagguuccaacauauugaaugcugagaauuuu

SEQ ID NO: 4172101 - RNA, 97 nt, Human
aauauucuguuuugauuuguguggaaagcaaauaugaaauauugaaauaauauuucaaguucccaguuuuguggcacaaauagacauacagaauauu

SEQ ID NO: 4172102 - RNA, 61 nt, Human
aauauuucaucaugcagugcuauuuuuaaaaagugaggauggcauuuuccaaugauauguu

SEQ ID NO: 4172103 - RNA, 86 nt, Human
aauauuuucugugucauauuuucuccuuucaagauagcauuuccagggauguauuuacugagaaggaaacgaugucaggaaauauu

SEQ ID NO: 4172104 - RNA, 60 nt, Human
aaucaaggugccaggagggaauuuagguuaaaaaauccaaccuccuucuugucacaaguu

SEQ ID NO: 4172105 - RNA, 116 nt, Human
aaucacgugaucucugcuuguacacauugcaccguauauguuugcugugcccugacguccaagggacacguugcauauguggagagcaguggcaaggaaugauugauugcuugauu

SEQ ID NO: 4172106 - RNA, 70 nt, Human
aaucagagcauuguuucaguuaaaacauccuuccuucuaauguuauggcugagagcaauugacucugauu

SEQ ID NO: 4172107 - RNA, 60 nt, Human
aaucaguccuguggguuaaagaguugcuuauggaaggggccuuaaacacagagauagauu

SEQ ID NO: 4172108 - RNA, 69 nt, Human
aaucaucucagagagguauguuagucauaucuuucagaugugaacuuuaauacucuuuucuggauuguu

SEQ ID NO: 4172109 - RNA, 79 nt, Human
aaucaucuuagcgcuaaucaccgagcuucauugaguacuuuguaaugugccaagcugggagcugaaggcugauuugauu

SEQ ID NO: 4172110 - RNA, 81 nt, Human
aaucaugguuaaucugaaucaguaaacacuacauuuugaaguuuaacaaguagcagagugucugaucaguugacuagaauu

SEQ ID NO: 4172111 - RNA, 63 nt, Human
aaucauucucaugccaguuuccugugaaggacacgcaucuuggaauggcgugaagaggagauu

SEQ ID NO: 4172112 - RNA, 58 nt, Human
aauccaagcucucuaugccaugauucugcaaagagcauuguauauuggagguuggguu

SEQ ID NO: 4172113 - RNA, 77 nt, Human
aauccaauuguaaggucauccaguucuaaggucaaaguuguaagaucauagauuguucuuaacuuuauaaauggguu

SEQ ID NO: 4172114 - RNA, 55 nt, Human
aauccacuaaugaagaaugggcuauagcaaagaaucuguuuauuagaaguggauu

SEQ ID NO: 4172115 - RNA, 102 nt, Human
aauccagaagcagucacagcaaggucugucaauagugguaucuaggucaauguccacuguucuuguggcaugagcuuagcuguguuuuucugcuucuagauu

SEQ ID NO: 4172116 - RNA, 60 nt, Human
aauccaugcaugcaaggaaagggcacaaggacaaauccucugacuuugugugucuggauu

SEQ ID NO: 4172117 - RNA, 130 nt, Human
aauccccugagagcucagcuccucaccauggacuggaccuggaggauccucuucuugguggcagcagcuacagguaggaggcucccuagucccagugaugagaaagagauugaguccaguccagggagau

SEQ ID NO: 4172118 - RNA, 74 nt, Human
aaucccuggagggguuuccaaagauagaguaguauccggacauauuuuucuuucuuuuuaaauuccaggugauu

SEQ ID NO: 4172119 - RNA, 68 nt, Human
aaucccuggugugucuuuuugugugucccaauuuccccuucuuauaaggacaccagucacacuggauu

SEQ ID NO: 4172120 - RNA, 75 nt, Human
aauccucguaccagugcuaaauuaccuuugguaucccaaggaccagaggcuaaggguagcuuggggugagugguu

SEQ ID NO: 4172121 - RNA, 56 nt, Human
aauccugaccugggcaugcuugagaccagaagacacucaaugauuccaucaggauu

SEQ ID NO: 4172122 - RNA, 88 nt, Human
aauccuguguaugaucagcacaguagggugacgaggagguaaugccguuuaucucacccaacgugcaaugaguuucguaagcaguuuu

SEQ ID NO: 4172123 - RNA, 89 nt, Human
aauccugugucuuauguaugcuacuuuguggucaaguucauauccuuacaccugcuuaucaaauuagcauuuaugaaccaacuaggguu

SEQ ID NO: 4172124 - RNA, 55 nt, Human
aagucuuuuaccauguuucuauaggaaguauuuagaagcacagguaaagugauuu

SEQ ID NO: 4172125 - RNA, 55 nt, Human
aagucuuuuguucaggcuggcacugccaaagugggaaaucagccaaagaagacuu

SEQ ID NO: 4172126 - RNA, 56 nt, Human
aagugaagauuuuguagcuuucagcaaaaauaugcugccucuguuggucuucaguu

SEQ ID NO: 4172127 - RNA, 73 nt, Human
aagugaaggcuucaaaagguguaauugaaagagcauuuuuagcuuccuaauuacuuuauugaacuuuuuacuu

SEQ ID NO: 4172128 - RNA, 62 nt, Human
aagugacagugaacugggacucuaacaucauaccuagggucccaguccucucccugcuacuu

SEQ ID NO: 4172129 - RNA, 69 nt, Human
aagugcaccagagguuaagcgggagaucuggagccagcgauccuggauuuaacccuggcucugccacuu

SEQ ID NO: 4172130 - RNA, 79 nt, Human
aagugcagaaaaauuucaauuaacagagggcuuauuacuugggcacaaguuaauauaaguuuuacuguuacugccacuu

SEQ ID NO: 4172131 - RNA, 56 nt, Human
aagugcagagagaaauaaagcaagaaaaucuccgauggccuuucucucugcuauuu

SEQ ID NO: 4172132 - RNA, 78 nt, Human
aagugcauuggguuggugccugauuucaguggggagccuguaagggcuacccggaaaggcgauuaucccucugcaguu

SEQ ID NO: 4172133 - RNA, 81 nt, Human
aagugcgcucacagggcaucuaguucccucucuugaguuccuuuuaagcaagcaaggcaaccuauguccagagaagcaguu

SEQ ID NO: 4172134 - RNA, 81 nt, Human
aaguggaugacugagcccuaagggucaagcaggcccuugucuauaugcaacaaaugucucuuguccuuggguuuuuugcuu

SEQ ID NO: 4172135 - RNA, 63 nt, Human
aaguggcugcccccucccguggacacagcaggccugcugacguguucaccagggcagcagcuu

SEQ ID NO: 4172136 - RNA, 79 nt, Human
aagugggaauauuauuuaaaccauguacugcuuuauuuugcuggagcauuugauauguuuaaaaagugucagaccauuu

SEQ ID NO: 4172137 - RNA, 86 nt, Human
aagugguacacucaggccccacccuaccacagcacaggccuaccugugcugaggagaggggguggucuggcggcuggucacuauuu

SEQ ID NO: 4172138 - RNA, 78 nt, Human
aagugguacaguauuuauggcuugaguauuucauauuugugacucaguaauauucaagcucuaagacagguauggcuu

SEQ ID NO: 4172139 - RNA, 69 nt, Human
aagugguccagagauggacgagcagaugacuucagccuggaacaucaacgucuaucuguuggacuccuu

SEQ ID NO: 4172140 - RNA, 55 nt, Human
aaguggucuagucugaggauuauuuuucagucgaauagccucuaggagacuauuu

SEQ ID NO: 4172141 - RNA, 84 nt, Human
aaguguccauuacuauuguuugcucugacuaucuugcgcaaagaugccaaguaaggcuggagcaaaggccuuggugauacucuu

SEQ ID NO: 4172142 - RNA, 94 nt, Human
aagugucuuugucacagcuuguaucccaauggagcuauuaauuucauuugaaaucauguucucuuugugauauaagcagauuauaaagaaauuu

SEQ ID NO: 4172143 - RNA, 66 nt, Human
aagugugcuuuaaagacaguuaugcuggaaaaugcaucugucccauccuagcaauuguccauacuu

SEQ ID NO: 4172144 - RNA, 59 nt, Human
aaguguuaaagacuugaacacugggagaaacuuuucacuguuuuauguuuuuacuacuu

SEQ ID NO: 4172145 - RNA, 83 nt, Human
aaguguuauaaucugguuuuauuaagagcaggaaacccuucacaugcaugcuguucuuguuauugaccacgaauaaaacccuu

SEQ ID NO: 4172146 - RNA, 71 nt, Human
aaguguuaugagucaaggagcuacuggcauuuaaucuguagcagguaugcuguuagauuuaauaagcauuu

SEQ ID NO: 4172147 - RNA, 83 nt, Human
aaguguugacgguuagccuaaaacaugccucuaugagacacauccucuuucuugccagguucuuuuggccaaccucaugacuu

SEQ ID NO: 4172148 - RNA, 59 nt, Human
aaguguuuuggcuucuguacacauaaggaaagaaaaauugaguagaaguuagaacacuu

SEQ ID NO: 4172149 - RNA, 85 nt, Human
aaguuagccuguuaagcuuuaagugucagucagccaggauuuagcuuggcugguuggugguuguggcauuggcaccuguuaauuu

SEQ ID NO: 4172150 - RNA, 61 nt, Human
aaguuaugaaauuuggacagcuuggaaaugcugauuccaagcuguccaaauuucauaacuu

SEQ ID NO: 4172151 - RNA, 55 nt, Human
aaguucaaguguaaucuuuauuaaccuucacuuuauaaaggaagcauuuggacuu

SEQ ID NO: 4172152 - RNA, 55 nt, Human
aaguucacugugguuccuauggccuuuccugggguucucuaucauuagugaauuu

SEQ ID NO: 4172153 - RNA, 71 nt, Human
aaguucuaaaaugccuugauucaugauucugugauuucauauacaggacaauuuauaaugggcaagagcuu

SEQ ID NO: 4172154 - RNA, 111 nt, Human
aaguucugccaguguucgaacuuccuauaaauggaauuuggcaguauuuacccuuuugugccuauauacuacauaguuccauuuacaggaaguuaagccugggcagaacuu

SEQ ID NO: 4172155 - RNA, 63 nt, Human
aaguugauugcuucaaauuucugcuacuaacuucaagcuaugggaguuuggcaguagucacuu

SEQ ID NO: 4172156 - RNA, 97 nt, Human
aaguugcaagaauagggcaaaagaacgcacguuaaacuuuggcucagauucaccuauuguuaacaauuugcuucauuuguuuuaucauuuguuucuu

SEQ ID NO: 4172157 - RNA, 59 nt, Human
aaguugcauagcugcaaggacgacugggaaauauauuuauucugggcagccauguacuu

SEQ ID NO: 4172158 - RNA, 81 nt, Human
aaguugccuagacucagacagaaaaugugucuucccuauguuaugcaacagcugaauuuucugcucuggucuuaacaacuu

SEQ ID NO: 4172159 - RNA, 104 nt, Human
aaguugcuauaaaguauugacuauuagaaugucuugaacuuugguuacugugagccaagucggugcucaaaguauauuucauagucucaauuauauaguaauuu

SEQ ID NO: 4172160 - RNA, 55 nt, Human
aaguuggacagguggacuuuaacccauuuuggcuuaguccaaagccuguuuacuu

SEQ ID NO: 4172161 - RNA, 129 nt, Human
aaguuggggcagaauguccaaacacaguuuaguggaggugauucugugaggggcugaccuuaauaugguccaacauguagucucccuguauuaguuaucuacugcuguguaacaaaugacucccaacuu

SEQ ID NO: 4172162 - RNA, 74 nt, Human
aaguuggugaagcugugcauuugucuauugcaaucauuuugcaguacacacauauguauucguguuaugaauuu

SEQ ID NO: 4172163 - RNA, 59 nt, Human
aaguuuaggccaaauuagauuuauaauuaggaaacaaaugcugguuugguacuaaauuu

SEQ ID NO: 4172164 - RNA, 130 nt, Human
aaguuuccugagccgcucuccuuaggcauugggaauauuuugugaacccucaagcaaugcaguagcacugcauacuacucaacugugugaucgccaaaauucccacugugucuaaugcacuagguaugcu

SEQ ID NO: 4172165 - RNA, 89 nt, Human
aaguuugaccuuuaaauccggagggccucagguagauaucuaaagaaauuguuuuccugagggacuuuugagauuuaagacacaagcuu

SEQ ID NO: 4172166 - RNA, 61 nt, Human
aaguuuguucauucauucaucccuuuagcauuaugccagaggauggauagggaagagauuu

SEQ ID NO: 4172167 - RNA, 84 nt, Human
aaguuuuaugaaauuuaaacacagaucaaguacuaauaagaaaaucugguacucaaguugagaugugcuggauuuuggagacuu

SEQ ID NO: 4172168 - RNA, 79 nt, Human
aauaaagcugaaauaguacauuaggcauuuugagucauaaggaacagacaauggcuaaguaaccuguuaggcauuuauu

SEQ ID NO: 4172169 - RNA, 80 nt, Human
aauaacaaggagaugccagcaagguccagcauagggagguaacaaacuccagucuggagccuucugguuaaucaguuauu

SEQ ID NO: 4172170 - RNA, 101 nt, Human
aauaagauacaucuaucacaaugguauuagucaauuacaguggggcaagaguugucccaacuaccuuugacaaucaccagugagauauugaauauuuuauu

SEQ ID NO: 4172171 - RNA, 84 nt, Human
aauaagaucauugaaauauauucagagauuuagccugaaaauaacugagucuugaggucaucaucugaaacaaugugccuuauu

SEQ ID NO: 4172172 - RNA, 81 nt, Human
aaguugugcagaguugccuuuauuuauuuagcuuuguauuagcugcuuaagaaauguugguaaaacuuugaacauuuacuu

SEQ ID NO: 4172173 - RNA, 61 nt, Human
aaguuuaagagcauaggcuugaaaauaggacacuuagguuucagucucugcucugcugcuu

SEQ ID NO: 4172174 - RNA, 97 nt, Human
aaguuuaauuuugcuauaagacgccaguuuucgagucuauuuuauucggugcuuccagauaacaagauuuguaaaauuguaaaguaaguuauuucuu

SEQ ID NO: 4172175 - RNA, 58 nt, Human
aaguuuauguugguaagauaucccaguuguuaaugggauucaguggcaagauaaucuu

SEQ ID NO: 4172176 - RNA, 61 nt, Human
aaguuucucaauggcaacuggguucgcuuuuuuccaaacccagguguuuaaugggaaacuu

SEQ ID NO: 4172177 - RNA, 126 nt, Human
aaguuuugugauaaaaaggauggagcaacacaugugugcaugugggugcaugggugugugugucuguuguguauccuuauucacacacauuaugcucaucauccugaaaaauuauuaacaaagcuu

SEQ ID NO: 4172178 - RNA, 106 nt, Human
aaguuuuugcaugccuucauuucccuugguuaaauauguaggaguagaauagcuacucuuggguagguaccuagaauagguuuauaugaaagaguauguuugacuu

SEQ ID NO: 4172179 - RNA, 90 nt, Human
aauaaaaaaacagcaagucagugaguagaagauugauaccucugugauagugugucuguuucucucuauuuauuugucuuguauuuuauu

SEQ ID NO: 4172180 - RNA, 60 nt, Human
aauaaaucccauuuaugccuaguguuccauuacuggaaugcuaagcaugugggaguuauu

SEQ ID NO: 4172181 - RNA, 58 nt, Human
aauaaauguuaagauugucucagcuguaagccaugcaccaccagucuugacacuuguu

SEQ ID NO: 4172182 - RNA, 80 nt, Human
aauaaauuaguugaagauuuauaggagccuauuaacucuugugcaugaguuguagguuaauugaacuauaacaguauguu

SEQ ID NO: 4172183 - RNA, 66 nt, Human
aauaacaacuagcagguauuaauuuugugccaaggggcauagauuuugugaaugcuacuugucuuu

SEQ ID NO: 4172184 - RNA, 55 nt, Human
aauaacuucaguucuuacauuagggaguaaucgugauguuaagcaugagguuguu

SEQ ID NO: 4172185 - RNA, 75 nt, Human
aauaagccagagccagcaacucuagcccuguagagauuucuuuccaggaauagaucuguuuugccuggugauguu

SEQ ID NO: 4172186 - RNA, 102 nt, Human
aauaagucuguggauauuuaggagaccaggcacaagaagcaaauguuagcuaugcucaaaugcugccuuugugugcccuuuucccacugucuauaucuuauu

SEQ ID NO: 4172187 - RNA, 55 nt, Human
aaugcaaccugcugaucugacaauggguuguugguaagcgucuuuggguuguguu

SEQ ID NO: 4172188 - RNA, 68 nt, Human
aaugcaaggaccuuugagcgugccagcacucuuuauccucucugcuuggugcuguguuguccuguauu

SEQ ID NO: 4172189 - RNA, 61 nt, Human
aaugcacuggugaaagguggagaauaaauauauuuuccagauggauacuagaauuugcauu

SEQ ID NO: 4172190 - RNA, 77 nt, Human
aaugcagauaagaaucagguuugauaaaugagggaaaacaauuuuauaggauaaaccaaugauuuaaaaucuguauu

SEQ ID NO: 4172191 - RNA, 69 nt, Human
aaugcauaauaaggagcaaaauguauggaaucauccaaaugcuugcucuugauuauuuucuaccgcauu

SEQ ID NO: 4172192 - RNA, 59 nt, Human
aaugcauauguaggcaagcaguggcaguucugugacucuucucuaacuuacauaucauu

SEQ ID NO: 4172193 - RNA, 58 nt, Human
aaugcucaaugaaacguuuguguguguguauguguacacagauauuucauugaacauu

SEQ ID NO: 4172194 - RNA, 60 nt, Human
aaugcucuucuaagaugucuagcauaugcuagcauaaaggucaacguuuuagggggcauu

SEQ ID NO: 4172195 - RNA, 88 nt, Human
aaugcugaggaauuugguuuauguuuauguagguaacgaugagccugauaagugacacaaaucauguuuuucaauuaccuaucguauu

SEQ ID NO: 4172196 - RNA, 69 nt, Human
aaugcugaggauguucagagugcuugcuuaugaaacugcuugagagcuggauucuggauagguggcauu

SEQ ID NO: 4172197 - RNA, 102 nt, Human
aaugcuggacauuuaucuggagcugcaggggguaaagugucauccuugggaaauucaaagcuggccuguaccugcugagagcaccagggauauggucacauu

SEQ ID NO: 4172198 - RNA, 55 nt, Human
aaugcuguugaguuguuccuguuuuauucuucagugaaugacuguuuucagcauu

SEQ ID NO: 4172199 - RNA, 78 nt, Human
aaugcuugaugagcugcuauuagagguuccugaaaauaaauaccaggugacaguuugcacuguucaucaaagagcauu

SEQ ID NO: 4172200 - RNA, 66 nt, Human
aauggaaagucaccccacacucuugggacaguggguguuuuugucagagcaaagggugccuccguu

SEQ ID NO: 4172201 - RNA, 68 nt, Human
aauggagaaaccaaaucggacugugccucuacacuguacacuguagaaggcccauucauuuguucauu

SEQ ID NO: 4172202 - RNA, 60 nt, Human
aauggagaucugacuagggaaagaggcugcuuaaagcccuuuggcuuuuagauauccauu

SEQ ID NO: 4172203 - RNA, 79 nt, Human
aauggaggguguccuucuguggacucugaggaacguggccuugccaaaacuuagagcgcacacaaggagcccuacuguu

SEQ ID NO: 4172204 - RNA, 77 nt, Human
aauggaguuauugagacauagaguuaugaguguguuuaacuucacaagacuauuccuaaaauguccuaauuuccauu

SEQ ID NO: 4172205 - RNA, 75 nt, Human
aauggauaagagacuugugaaaccaguaacuucacuaacaccacaauuguuauuguauccagucuuauuaccauu

SEQ ID NO: 4172206 - RNA, 69 nt, Human
aauggauugcguaaaugaaaugcaaaaugauccacggugauggauugucugaauauguauguauccauu

SEQ ID NO: 4172207 - RNA, 71 nt, Human
aauggcagagggauugaacagcugagaauauuuuuguaacuuaagaaagcugcucauuacuuucuguuguu

SEQ ID NO: 4172208 - RNA, 67 nt, Human
aauggccaaaguagaaaauaauaggguucuuaagauuaauaucucacuauuguuaagacuggccauu

SEQ ID NO: 4172209 - RNA, 65 nt, Human
aaugggcuggaagacaggaaaugcuauuuuauuucucuuagcuccaugguucuuuauaguucauu

SEQ ID NO: 4172210 - RNA, 78 nt, Human
aaugguaggacaaaugcucaagacuaggcucaacugcugcccaagcucagcacuagccuguuuugcugugcugcuguu

SEQ ID NO: 4172211 - RNA, 130 nt, Human
aaugguaguauuuuuuuagauuuuuuaaagcaauuguguaaggcugauuaggaaggaggcucucuacagcacagcuuuccaauucaagcuuuuacguuuuuuaauguuucauuuuuauugacuuuuuuuu

SEQ ID NO: 4172212 - RNA, 89 nt, Human
aaugguaguuuaucuggaaaucaauuucuugguugauaguguuucauucagcacuucuaucauuuaguugucuucuuguuucuauuguu

SEQ ID NO: 4172213 - RNA, 61 nt, Human
aauggucauagcaggucuccuuuuagguucuguuaagcagaggccuggucuaugagauguu

SEQ ID NO: 4172214 - RNA, 68 nt, Human
aaugguccauuuuauucagagacuuugcaauaagcugagcauuguuaugaaaauaagauguuuccauu

SEQ ID NO: 4172215 - RNA, 60 nt, Human
aaugguguaucuauccuuguucugugucccaagcagagaacagguucaggguauaaaauu

SEQ ID NO: 4172216 - RNA, 76 nt, Human
aaugguuccuugaaaaccagcauguagccuguucauaaauuuuaugaugugugaagcacauguucaaggaaguauu

SEQ ID NO: 4172217 - RNA, 76 nt, Human
aauguaauauaacugccaguuaagguagacaguaguuguggucuuaguuacauuugauauggaguuguguaauauu

SEQ ID NO: 4172218 - RNA, 87 nt, Human
aauguaggugacaaugucuauuaaacugucauaaggauuuauaaauauaaacuauuguuauaauguuuaaagcauugguuuugcauu

SEQ ID NO: 4172219 - RNA, 82 nt, Human
aauguaucaugauuuugcacuauaggaaaaugugucuugcugagauguacaauauuucuaaguguauucuguccauugcauu

SEQ ID NO: 4172220 - RNA, 62 nt, Human
aauguauucugggaaaauguuaaauggaugcaacacuauaagauuuuccacagaaauauguu

SEQ ID NO: 4172221 - RNA, 61 nt, Human
aauguccuguuuugugguauacauuccaagagaaugcuaauuccaugagcacagggacauu

SEQ ID NO: 4172222 - RNA, 64 nt, Human
aaugucugccugaacuuuauauucugaggauuucuucuccucuguaaaucgcagguuagauguu

SEQ ID NO: 4172223 - RNA, 129 nt, Human
aaugucuguuucauuaucauuaucuguuugucagagucacaacuacauccacacuuuguuaugcccagaagcaucacuacugacagagauguguaagugacauuacagacaacacaggaaaauccaguu

SEQ ID NO: 4172224 - RNA, 62 nt, Human
aaugucuuuauuucagguuuacuuauggcugucuauacgguagaaccuaaaaaaaggauguu

SEQ ID NO: 4172225 - RNA, 58 nt, Human
aaugugaaacugcuguuuaugggggucaaguacgaccaaagaacagcaauuucauguu

SEQ ID NO: 4172226 - RNA, 84 nt, Human
aaugugacgucuuuagccagguacuuaauuauuuuuccacauuuuaaggguuaaagagcugagaccugguggaguuaaaacauu

SEQ ID NO: 4172227 - RNA, 84 nt, Human
aaugugccaaaaugacauuucuuguugauauaaaaauauuccgaaaggcuuuauguggggagaaauguugggaugagguauguu

SEQ ID NO: 4172228 - RNA, 75 nt, Human
aaugugccaagagggaagucaccuggaggugcuguguguuaucagaccucguuuuccuuuugucaugugcacauu

SEQ ID NO: 4172229 - RNA, 55 nt, Human
aauguggucucucuuaguagaaauccaugucguuucucuggaauuagaccauguu

SEQ ID NO: 4172230 - RNA, 56 nt, Human
aaugugucauuucccacaggugcuaagaacgcucaagccauggagagagaugcauu

SEQ ID NO: 4172231 - RNA, 70 nt, Human
aaugugugugugugugugugugugugugugcacacgcgugcagguguguauaaacauacauauauguauu

SEQ ID NO: 4172232 - RNA, 67 nt, Human
aauguguucuuauuccccauugcuucuucuaauacugaguugggaggagccaugaguuggauauguu

SEQ ID NO: 4172233 - RNA, 114 nt, Human
aauguuaaugaguuuuguuauaucgguuccaauauuucucauauauggaaaaugucauuuucccugggaauuaauauuuggagcugguguuuaagaaaaaccauguuugauguu

SEQ ID NO: 4172234 - RNA, 91 nt, Human
aauguucuuccaaaugaaguguuugcuuugccuugaaaagacaaauuaauauuuuacauggcaacaacucuuuauuccuuggugggauauu

SEQ ID NO: 4172235 - RNA, 57 nt, Human
aauguugacaguggugaucucauccacaccuuuggucuugauggccauuucaauguu

SEQ ID NO: 4172236 - RNA, 78 nt, Human
aauguuuaaggaacugguuugcuaacucauuucuuaaugacaagaauuaagccagcacagccucugguuucugacauu

SEQ ID NO: 4172237 - RNA, 72 nt, Human
aauguuuucagaacccacagugaaguuagagaaagagucagaacaaaaucucugucacugggagaagauauu

SEQ ID NO: 4172238 - RNA, 59 nt, Human
aauguuuuguagcccaugcuuauggugaagauccauuuucaagcauuagccaaagcauu

SEQ ID NO: 4172239 - RNA, 88 nt, Human
aauuaaaagacagcuuuuuaauuuuaaagacauuauuagacuguccaaacaugucugaauucuuagaauuaaagggaaguuugaaauu

SEQ ID NO: 4172240 - RNA, 129 nt, Human
aauuaagguuucccuauucauccaacaaacacuuauugagcuuuuucuucauacaagaaccuuuacaauucaaaucuuaggaagcaaagaguuuagugggugauucauauuauuaggggaaaaaacauu

SEQ ID NO: 4172241 - RNA, 85 nt, Human
aauuacagugacaccugaggguccagcccuguguaaaagauaugaauauuuacaaugcacucaccuuuagaaguggacuauaauu

SEQ ID NO: 4172242 - RNA, 72 nt, Human
aauuacaugaugcuaaauaacugguuugacuggcauuugucacccaaagaguuguuucagcuuugugcaguu

SEQ ID NO: 4172243 - RNA, 57 nt, Human
aauuaccuuuuccacuuaggcccuggucagcaggacuugaaugguaugagaguaauu

SEQ ID NO: 4172244 - RNA, 87 nt, Human
aauuacugcuaugaagcagccgcugaaacacuuuaauggccacaauuaaacagucccagaggcugaccuuuagacguggcagugguu

SEQ ID NO: 4172245 - RNA, 63 nt, Human
aauuagcacaggcaacuccacauaguuugcaaucagagaauuauauugugccaagugcuaauu

SEQ ID NO: 4172246 - RNA, 82 nt, Human
agcugugguugagguccccaguacccacuguggcagcguucucccuuguccagaaaccaaaugggauggggacucuccaguu

SEQ ID NO: 4172247 - RNA, 129 nt, Human
agcugugucccuuuagccucuuacaucaucaccagcaauaaagauuuuacugucaggacuuggcugacaaauuugcaggcucuuuauuacuggugaugauggacuauaagaagcagaaaaaacacagcu

SEQ ID NO: 4172248 - RNA, 56 nt, Human
agcuguguguuugucaugggcguagacagcucaggacagcacagaacagcacagcu

SEQ ID NO: 4172249 - RNA, 56 nt, Human
agcuguguuaggauguuaauaaguagaggaacaccaagcaguuuccuaacucagcu

SEQ ID NO: 4172250 - RNA, 61 nt, Human
agcuguguucugguugauucacccuucucagcacaguguguaguuaaucagaggacacguu

SEQ ID NO: 4172251 - RNA, 73 nt, Human
agcuguuaugaacuuuauuuaaauuuaaucugguagcaguguuuuuguuacuauuaguuugagcauaagagcu

SEQ ID NO: 4172252 - RNA, 60 nt, Human
agcuguugaaccuguaaguauagauguggacugugucagcauguaucuuucaggugugcu

SEQ ID NO: 4172253 - RNA, 85 nt, Human
agcuguuggcuuugccauuugcuaguccucugacuucuucuucaguauugacuuagaggcauuaaugaauaaacagggccaggcu

SEQ ID NO: 4172254 - RNA, 56 nt, Human
agcuguugucugcaggagaagcaaguauuucuccccuauucaaagcaacagcagcu

SEQ ID NO: 4172255 - RNA, 60 nt, Human
agcuguuuuacugguuguauaacuaaaaauaagauaauguuaugcuggguaaccacggcu

SEQ ID NO: 4172256 - RNA, 109 nt, Human
agcuuaccuuucacuuugacuaaaacaaacaagauugcuuucuuuagccaacuaguuagggaugacaguacagucuuagauuuuauuuuggucaacuuguggguaaucu

SEQ ID NO: 4172257 - RNA, 80 nt, Human
agcuuaggaaggacauggauuguuuuaaaagaugguggaaaaauugcucuguuaaauuguccagccacuuuuccuaaccu

SEQ ID NO: 4172258 - RNA, 57 nt, Human
agcuuagucacucuuaaauuuauuagaaucauacuaugacuugaggcugacugagcu

SEQ ID NO: 4172259 - RNA, 76 nt, Human
agcuuaguucuguguuucugcagcagaaauacugccugguaagugaguauucuguauggggaaacuagaggaggcu

SEQ ID NO: 4172260 - RNA, 101 nt, Human
agcuucaaguuuauuucucucuuauuccagaaggcuggcagauugagauuagaaucucucauccaauuuuaguuucugaggagcaacugauuugccaagcu

SEQ ID NO: 4172261 - RNA, 59 nt, Human
agcuucccaagguuggaagguuauguuuuuaaauuuuaaguuugaacuuucgggaggcu

SEQ ID NO: 4172262 - RNA, 68 nt, Human
agcuucgacugaggaugccacagugagacaccaucugggucuggaggguccacugugaggcagaggcu

SEQ ID NO: 4172263 - RNA, 105 nt, Human
agcuucguggagcuguggauacuaugggagauucauugcuuuaggcauuguagaaaugcacugcuuuaaggcugaguaacucauucuauagacucuaccacagcu

SEQ ID NO: 4172264 - RNA, 64 nt, Human
agcuucucauguuuauuuuuacauauuucaaaucccucauuaugucuuguaaacaagaggggcu

SEQ ID NO: 4172265 - RNA, 83 nt, Human
agcuucugacuucaaaugagaacuccaggcacuagcaggcauguuuagugcuuaauaaauuucagaaaagaagaauagaaguu

SEQ ID NO: 4172266 - RNA, 66 nt, Human
agcuucugaguucuugcuuaauaauauuaguaucaccuguugcuguucuacguuaacucaggagcu

SEQ ID NO: 4172267 - RNA, 62 nt, Human
agcuucuggcguuggaggucugaguucucgcgggccacgcguucgauauccgcccggaggcu

SEQ ID NO: 4172268 - RNA, 67 nt, Human
agcuucuuuaaaaugauauuuugaauucuuugucaggaaauucauagaucucaauuuugaggggguu

SEQ ID NO: 4172269 - RNA, 72 nt, Human
agcuugaguccucuuuggagaagcacguauuauuaauaacaauggcuuguguuuguucaggguuuuagagcu

SEQ ID NO: 4172270 - RNA, 79 nt, Human
agcuugcagagcagccagccccagccucugauguuauaaauguagaugugcugguggugggccaguucugucgugggcu

SEQ ID NO: 4172271 - RNA, 65 nt, Human
agcuuggaggagacaggacucagaaagcauggcagagcgucuuucgaucaagggucccuucagcu

SEQ ID NO: 4172272 - RNA, 81 nt, Human
agcuugggugugcauguauugauuuguaccauuugcuaauuuucuugguguaaauuuuccuacugucaaugauuucaagcu

SEQ ID NO: 4172273 - RNA, 65 nt, Human
agcuugguguugccugcuugagaaaguuccccuggucacccugucuaaagcagccacuacaagcu

SEQ ID NO: 4172274 - RNA, 57 nt, Human
agcuuguucuccuucccuguggcuuccuauuggauauagccaaaggagaacagugcu

SEQ ID NO: 4172275 - RNA, 85 nt, Human
agcuuguucuuacacuguauagucuuguggcaguuaucauagcuuauaguuacauuacuugugcaguuguuaguuugccugagcu

SEQ ID NO: 4172276 - RNA, 65 nt, Human
agcuuguuuaucaccuuggagauugguugcuaaaauguucaaguuuaaggcacugauaaguagcu

SEQ ID NO: 4172277 - RNA, 96 nt, Human
agcuuuaaugaccaauuuucacagaaagaagcuaguuuaauauucaucuucacugaauucaagcgaguuuuguuuuguucagguuuucauuuuguu

SEQ ID NO: 4172278 - RNA, 75 nt, Human
agcuuuacacuuucguuuguggauuagauucaagcacaguuuaucccuucaugcagaugagaaugucagacagcu

SEQ ID NO: 4172279 - RNA, 55 nt, Human
agcuuuagagagccaagacucacucauguggaacagagaucugcucccuggagcu

SEQ ID NO: 4172280 - RNA, 55 nt, Human
agcagccagaaauccagaggugaaugacauaaugggauagaauuucauggcugcu

SEQ ID NO: 4172281 - RNA, 64 nt, Human
agcagcucaucuagcuuugagguauagaucaagaaagucauccagagagguuaggugacaugcu

SEQ ID NO: 4172282 - RNA, 80 nt, Human
agcagcuuggaaagcacccaagauuuccuucuuuagagaaucagaaugaaggcagaacaggguuucuuucuauuguugcu

SEQ ID NO: 4172283 - RNA, 56 nt, Human
agcagcuuggggccgagauagaguuucaaagcguuauucaaugguuuuaaguuguu

SEQ ID NO: 4172284 - RNA, 56 nt, Human
agcaggaagggaaagguugacuccuggaaaggcucagggguuguccuccuuccucu

SEQ ID NO: 4172285 - RNA, 76 nt, Human
agcaggaaguagguagaaaugcauucacguucuagaauuuagcucugggaacucugucauuucccuacucacuguu

SEQ ID NO: 4172286 - RNA, 72 nt, Human
agcaggaauauaguauuucgagggcucauuguaaugcguaaugagaaacucuuugugugcagugugccugcu

SEQ ID NO: 4172287 - RNA, 86 nt, Human
agcaggacugguuucuucuggaggcuccagggagguuccauuucuuguaucuuccagcuucuagaggcugccaacaguccuuagcu

SEQ ID NO: 4172288 - RNA, 56 nt, Human
agcaggaguacaguauuuuuaaacaaaaggacaaccugaguccugugcuccuuguu

SEQ ID NO: 4172289 - RNA, 55 nt, Human
agcaggcaggcccagcggcuggguuucucuagcaccucggcauugucugccugcu

SEQ ID NO: 4172290 - RNA, 68 nt, Human
agcaggcaugauuagaucacuguuuuacagcuaaagaagcuggcugacagagauuuaaaaguggcucu

SEQ ID NO: 4172291 - RNA, 55 nt, Human
agcagggaagcucagaagaggccagugggcuucccgaguucugugcuuccuggcu

SEQ ID NO: 4172292 - RNA, 64 nt, Human
agcagggacaucuuugucuaguaccugaaucuucagcaucaguacguacagaugugcccuagcu

SEQ ID NO: 4172293 - RNA, 76 nt, Human
agcagggagccccaggagucaccugcccaaagucacccuggggugauuggcaagggcagggacugggcugcuugcu

SEQ ID NO: 4172294 - RNA, 57 nt, Human
agcagggcagugaucagaaagggaacucagauggccugucaggaaaauugcccugcu

SEQ ID NO: 4172295 - RNA, 56 nt, Human
agcagggcugcggccccaccacuuacucacuaugugauucggagccucaguuugcu

SEQ ID NO: 4172296 - RNA, 55 nt, Human
agcagggucccggcuuguguucaggauuuugaaacauuuguaaggugauuuuguu

SEQ ID NO: 4172297 - RNA, 75 nt, Human
agcaggucaacugagcaguagcgucuggagucagaggagcaggagcuccaggcauaaugcccagugguacuugcu

SEQ ID NO: 4172298 - RNA, 57 nt, Human
agcaggugccagguguacccgccugucuucagacacugguuaugccugguccaugcu

SEQ ID NO: 4172299 - RNA, 63 nt, Human
agcagguguuuguaucauaaggcaagaucaaguuacaucacccucaucuauacaaacucugcu

SEQ ID NO: 4172300 - RNA, 60 nt, Human
agcaguaagacuuuuuucuguggcucuaccccuuuccagagcagaagcuaggcuuacucu

SEQ ID NO: 4172301 - RNA, 78 nt, Human
agcagucagcccggccaggaacagaguauauucccugccgaugcacacuugugucuguccucgguugaugccucugcu

SEQ ID NO: 4172302 - RNA, 64 nt, Human
agcagucaggucugcacagugagagagugagcuccccgucuguggcugugcugggccagaggcu

SEQ ID NO: 4172303 - RNA, 57 nt, Human
agcagucaguccugaaugaaggugcauuuguguuuucuaauucuaacuggcagagcu

SEQ ID NO: 4172304 - RNA, 57 nt, Human
agcagugaugcaugacagccuagccccacugggaagcaugugauggcauaaccagcu

SEQ ID NO: 4172305 - RNA, 57 nt, Human
agcaguggcuaauaacagcuaaacaguccaucuagauuguugcuguaagccuuugcu

SEQ ID NO: 4172306 - RNA, 61 nt, Human
agcaguggcugacagacuuaccucuuugccuucuuaauggcuggugugucaaauuacuguu

SEQ ID NO: 4172307 - RNA, 56 nt, Human
agcagugguggaaugaggaauuguacccaaacaaucucaaccucagaacuacagcu

SEQ ID NO: 4172308 - RNA, 74 nt, Human
agcagugucccuaguccccggauccuguccagcugagcguagacggcaguagccagggacuggcagcacaggcu

SEQ ID NO: 4172309 - RNA, 63 nt, Human
agcaguguuuaggcauucaguaguccuugggagacacugaaauaaaguugcuaaaauucugcu

SEQ ID NO: 4172310 - RNA, 72 nt, Human
agcaguugggcucuuccuggcaaaagguauucuaaguguaggagggacuugaugucagggagauucucugcu

SEQ ID NO: 4172311 - RNA, 72 nt, Human
agcauaaggucaaggccaggagacuuggagucagacaguuuuggguucaaguccuccugcuaacacuauguu

SEQ ID NO: 4172312 - RNA, 68 nt, Human
agcauaaucucaugguggaagagugccuuagcuucuagagcuguguugucuaguaccgaggaugugcu

SEQ ID NO: 4172313 - RNA, 56 nt, Human
agcauagaguccugagggcaggggacacagccugcuccaucuagagcucugcagcu

SEQ ID NO: 4172314 - RNA, 55 nt, Human
agcauauguggggcgggacccccuggagggcaggguccagccccugcauguugcu

SEQ ID NO: 4172315 - RNA, 76 nt, Human
agcauauugugaaaauguugggaaauuuagguuauuuuaaugauggcugagaauuugugaacuuuucucauaugcu

SEQ ID NO: 4172316 - RNA, 128 nt, Human
agcaucaagaaucacauuauuucacagcugguuugcugaauagauuguaaacuuaguuaaugauauugcuccauuauggugccaauuuauuuagccaagaaagcaaaaauaccagugauuuuucagcu

SEQ ID NO: 4172317 - RNA, 91 nt, Human
agcauccaguccagagaggaggcugugugcgcuggggaaauggugacugacccacagauacugagcauccuuucuguggcagcuuggugcu

SEQ ID NO: 4172318 - RNA, 80 nt, Human
agcaucccucagacagaggccuggugcuguguccacacaaccucuccccuguggcaccuccuggcuucccugaggaggcu

SEQ ID NO: 4172319 - RNA, 76 nt, Human
agcaucugauucaguaggucuagaauaagacacaauaaguuacgugucuaacaaguuucuaggcaaugcugaugcu

SEQ ID NO: 4172320 - RNA, 63 nt, Human
agcaucuggaacagcaugugcagagacccagggccagggcugucacuggcauguuccggggcu

SEQ ID NO: 4172321 - RNA, 80 nt, Human
agcaugcaguaaagcccaugucucuggugugcagcaggcacaccuuggcacuccuuggguuaucuccuguugcugcugcu

SEQ ID NO: 4172322 - RNA, 60 nt, Human
agcaugcugguguucauggcaggauauuaggaugaggagccugcuggaacaucaguagcu

SEQ ID NO: 4172323 - RNA, 67 nt, Human
agcauggcaagggcccgagcuauaaggaggaucacccaccgagguggcuaaaggcucuaguccugcu

SEQ ID NO: 4172324 - RNA, 90 nt, Human
aggauugaaaauuaaugugucaaggaauucaugaaaagcuuaaaugagugguucuugggaauuuuuccaacacacaaaguauucuacccu

SEQ ID NO: 4172325 - RNA, 124 nt, Human
aggauugcaggggugguacaggcugcagauuuguugccauggugcucaacaggugaaagagaaagugacugcuuccuugggaaacaucauguaauacaccuguaucuuuuccccucucccuccu

SEQ ID NO: 4172326 - RNA, 64 nt, Human
aggauugcuguggcuuuauaguacaguuugaagucaaguacugugauagcugaaguuuuguucu

SEQ ID NO: 4172327 - RNA, 69 nt, Human
aggauuucagaagaagagacuccacagcuccacaggagcucuuuucuuuucuuugaauaauuguauccu

SEQ ID NO: 4172328 - RNA, 65 nt, Human
aggauuugaagguuuaacugagaggcacgccaauacguuuugaugcuuuauuggaaccucauccu

SEQ ID NO: 4172329 - RNA, 57 nt, Human
aggcaaaagaaugucauaaauguacuguaaucuguaugucugauguauuuuuugccu

SEQ ID NO: 4172330 - RNA, 74 nt, Human
aggcaaacaaauggguguggcugcgugccaauaaaacuuuauuuacaacaccaggcaguauccugaauuugucu

SEQ ID NO: 4172331 - RNA, 88 nt, Human
aggcaaaccuugccaauuuuuaguuugaucaauggcagccuuguauaugcaaguccaccagucagacuaggaaauaccaggguugccu

SEQ ID NO: 4172332 - RNA, 78 nt, Human
aggcaaagucuuuugauuugcaagaggcugcuuuugcugagagaagaaaaugcucuugaaaaucaaaagggaaggccu

SEQ ID NO: 4172333 - RNA, 81 nt, Human
aggcaacauauauuuuguuuuccugugaacggggcccaucuuuaaagggguaagccaggucacagggauaaaugguugccu

SEQ ID NO: 4172334 - RNA, 55 nt, Human
aggcaacugugacaccucccugggguccuuuuggugccagggauuuacagagccu

SEQ ID NO: 4172335 - RNA, 70 nt, Human
aggcaacuuuaaauggcuaugucuguguaaaguaucaugcauucugaccuggaaauuuauaguuaaaccu

SEQ ID NO: 4172336 - RNA, 59 nt, Human
aggcaagaagacgccaggacugaugucaccggcucuguaguucaaccgucuucuccccu

SEQ ID NO: 4172337 - RNA, 72 nt, Human
aggcaagauuaaaaccuuugccuggaagggagucggaagauucucuggguuccaguaaauggucucaugccu

SEQ ID NO: 4172338 - RNA, 67 nt, Human
aggcaagcaccgggggccuuuucaggagggugugucuaccugucaugaggcugucugcugcuggccu

SEQ ID NO: 4172339 - RNA, 60 nt, Human
aggcaagcugcagagaguccuuuacucccaggccucuucucccaccagcuaucagugucu

SEQ ID NO: 4172340 - RNA, 127 nt, Human
aggcaaggcucugaguugcagaggacagaggauuucuucccagccagcacagcccaugguaaaguggacuuuagcagcuggagaggagcaaaucaaucuuuacccacugggcacuaagagucugucu

SEQ ID NO: 4172341 - RNA, 64 nt, Human
aggcaaggugugguaugaagaugguagcucuuuaucgaguguuuauugugugccacacacuccu

SEQ ID NO: 4172342 - RNA, 67 nt, Human
aggcaaugcuaucaugucagagauaagagagggggccuuugucuuugagagcugcauggacuugccu

SEQ ID NO: 4172343 - RNA, 80 nt, Human
aggcaauggggagagguuguaaauauuaaacuguaauacccuugucccuguuaugcuuccaauauucucccuuuuugccu

SEQ ID NO: 4172344 - RNA, 66 nt, Human
aggcaauuuucugaugaugaagcacgugcuuauuagcauuuguauagcuuccucaguaaaaugucu

SEQ ID NO: 4172345 - RNA, 83 nt, Human
aggcacacggccaccucugcuguccacaggauguuagcacaacucacucccgugucccccaccagaggccuggucugucuccu

SEQ ID NO: 4172346 - RNA, 55 nt, Human
aggcacagagaaugcccuccauacauauuuauugaaugaagggauuaaugugucu

SEQ ID NO: 4172347 - RNA, 87 nt, Human
aggcacagagagauuauguaauugcucaagaucauccagccuagugagugguagagcuggaauuugcagcaaggucugucugacccu

SEQ ID NO: 4172348 - RNA, 82 nt, Human
aggcacagcugccgccccggacgucugaccaaacacaccagguuugugcgggacaugauccgggagguguguagcuucgucu

SEQ ID NO: 4172349 - RNA, 58 nt, Human
aggcacaggaggugguaagaagaaaugcaggucagauuuaacgacaugccuagugccu

SEQ ID NO: 4172350 - RNA, 72 nt, Human
aggcacaggguuacugucacuguugauugaccaaacuugcuuuuuuggcagcucagaaacuucauugugccu

SEQ ID NO: 4172351 - RNA, 57 nt, Human
aggcaccagguugugguuugucgauugaacccauaggcaggaugcaucuuggugucu

SEQ ID NO: 4172352 - RNA, 66 nt, Human
aggcacguuuuaugacagaagaagccuuaagacaccguggcuucaggagggugugggacagugccu

SEQ ID NO: 4172353 - RNA, 114 nt, Human
aggcacuauuccaaguauuuuacauauauugcuucauuaaguucucacaguaucaauauacaguugagaaaacugaagcagacagauauagguuaaaugacuuguccaaggucu

SEQ ID NO: 4172354 - RNA, 58 nt, Human
aggcacugaagaacucuuuuuggaaauccuauaagauauaacaguuuuucaaguguuu

SEQ ID NO: 4172355 - RNA, 81 nt, Human
aggcacuugugagaauuccugaucacagguccacucaugggcauguuugggguuggaauuuucacacuauuuauggggccu

SEQ ID NO: 4172356 - RNA, 60 nt, Human
aggcacuuuccuugaggaguuuuugcaagaguuaauugagauaauucauggaaggugcuu

SEQ ID NO: 4172357 - RNA, 95 nt, Human
aggcagagacagcaggcucccucugcuuuuaugugccggcgcugccagaggcagaaggcuggcuuucugagagcaggggcccgcacgcucugucu

SEQ ID NO: 4172358 - RNA, 62 nt, Human
aggcagaucacuugaggccaggaguucaagaccagccuggccaacauagugaaacccugucu

SEQ ID NO: 4172359 - RNA, 62 nt, Human
aggcagauuacuugaggccaggaguucaagaccagccuggccaauauagggaaaucuugucu

SEQ ID NO: 4172360 - RNA, 58 nt, Human
aggcagcagucaugaggaaagaagggcuuuugaccuucuugcacagugucugcugucu

SEQ ID NO: 4172361 - RNA, 61 nt, Human
aggcagcucuucacagggcggcaggagggagagugauacugagcaaagggggaagcugcuu

SEQ ID NO: 4172362 - RNA, 67 nt, Human
aggcagcugaguguuggcauguucagggaacuuuaaaauuaacugcauuucugacacacaguugcuu

SEQ ID NO: 4172363 - RNA, 64 nt, Human
aggcagcuuuucuuacugugcuugucuggguuaauuuaaaccacaccuguuaagaagagugccu

SEQ ID NO: 4172364 - RNA, 59 nt, Human
aggcaggacucugggucagaacucaaauccagaucaaucuggccugaaaguccaugcuu

SEQ ID NO: 4172365 - RNA, 97 nt, Human
aggcaggaggaucgcuugagcccaggaggcugaggcuguagugagcugugaucaugccacugcacuucagccugggcaauagggugagacccugucu

SEQ ID NO: 4172366 - RNA, 118 nt, Human
aggcaggcucuuaccaggacucaugagaaagccaagccaagcaccacuggcacucgaggguccuuccuugucccuuugggugauuggcacgguuguccacugagcccagagccucacu

SEQ ID NO: 4172367 - RNA, 55 nt, Human
aggcaggcugcuauggaguagaucccuuaucuccuaccuagaaggcaucuugccu

SEQ ID NO: 4172368 - RNA, 72 nt, Human
aggcaggggaaggccauggccauaggacuacagcacuuuccgggcgcuuuuggccaccccuuucucugcacu

SEQ ID NO: 4172369 - RNA, 74 nt, Human
aggcaggguuuauacuauacuaauaaugcuuuguuucucaagcuuuaugguaaguauagaugacuauucugucu

SEQ ID NO: 4172370 - RNA, 66 nt, Human
aggcaggugcaggagcugugcagggacagaaugcagaaugcucaccuguuguauuccucacuuccu

SEQ ID NO: 4172371 - RNA, 80 nt, Human
aggcaguaagaguggagucaaacaggaaugcgaugugcuucguguguccugcagacagacucaggcuucuuacacuggcu

SEQ ID NO: 4172372 - RNA, 87 nt, Human
aggcaguaagugguacaguguuuaagagauggcauuugcaguuggaaagccuaggauguaagucccagcucugccacuuacuagcuu

SEQ ID NO: 4172373 - RNA, 71 nt, Human
aggcaguguggcuggugcuaagucagguccuuucccguguccucaccugguuugucucaucaccaccgucu

SEQ ID NO: 4172374 - RNA, 73 nt, Human
aggcaguguuuaaugccuuuuccagcugcugguuugaggagacuggguagagaggacaaguaaacagaggccu

SEQ ID NO: 4172375 - RNA, 80 nt, Human
aggcaguucaaacagaggcgaggcagcugaaccuggugaggcugccaggaacagcgaguucugccucugaauuugcuccu

SEQ ID NO: 4172376 - RNA, 84 nt, Human
aggcaguuccagugagacgaguacccucugauaagaaauacucauagugguucuuggcaaugguauucauccauucagaagccu

SEQ ID NO: 4172377 - RNA, 104 nt, Human
aggcauaauugauuggacacuggugacuaauuuaacuuucagccccucuucccuuccuggaggcugaggggugggcuggaaguuauaacccucuaaucaugccu

SEQ ID NO: 4172378 - RNA, 73 nt, Human
aggcauagcuuuuugcaggcaccccucaguacagcaggcaguauugacaggugccugcagacauaagcugccu

SEQ ID NO: 4172379 - RNA, 67 nt, Human
aggcauauuacaauuauagaaggaucaugucucaaaugauccaggcaucugaauugagugaaugucu

SEQ ID NO: 4172380 - RNA, 74 nt, Human
aggcauccgaggcagcaugcauugaccacauggauacacuuugcuaugcuguccacucuugguguuuaaugccu

SEQ ID NO: 4172381 - RNA, 58 nt, Human
aggcauggauggauccagggcucaaaugauguuuugaagcuccacuuucucuccaccu

SEQ ID NO: 4172382 - RNA, 111 nt, Human
aggcauggcauccuggaaaguuugcuucuuuuaccgaaugugucaagauggaaagcauuaaugauacuuggucugaacacauuuuagguaaauaaauuccugauucagcuu

SEQ ID NO: 4172383 - RNA, 66 nt, Human
aggcauggcuucuggggacugcugauuuccuugacgauaaugccagucaggcccauagcagugccu

SEQ ID NO: 4172384 - RNA, 86 nt, Human
aggcauuuagucccuggauucucacuggacuccagugagauuuuuucucauuuugcugagucacuggguaaucuggauugaugccu

SEQ ID NO: 4172385 - RNA, 55 nt, Human
aggcauuuuguucaagaugacagcaugaugucaaaauaugaauccagaaaugccu

SEQ ID NO: 4172386 - RNA, 65 nt, Human
aggccaagcaggcaagguuguggggcaccuggaagguggguguccagcggccuggcugcugaccu

SEQ ID NO: 4172387 - RNA, 80 nt, Human
aggccaaguuauggcaguuacccuugaugauaccaacacauauucuugauaccaucuuuugaauuuuuauauauuggccu

SEQ ID NO: 4172388 - RNA, 66 nt, Human
aggccaauuaaggcugugguuguggauaaaguuauccugagaaggacagggccuaugauugagcuu

SEQ ID NO: 4172389 - RNA, 57 nt, Human
aggccacaagaaaaugcuucaugccaacagugaguaugagauguggaugugaugccu

SEQ ID NO: 4172390 - RNA, 75 nt, Human
aggccacuggugccagagaacagaauuaagggcagaaggaauucaaggacuguuuuuaaugguaccagacagcuu

SEQ ID NO: 4172391 - RNA, 94 nt, Human
aggccaugggucuguugcaccugcuagcuagcagcauuacaacaaauggaggcauuuguuuucugcagcagcauuaucaggggucccagggucu

SEQ ID NO: 4172392 - RNA, 56 nt, Human
aggcccaaaagaaaccacugggugacaaaugagaucagccucuuuuggacuagccu

SEQ ID NO: 4172393 - RNA, 55 nt, Human
aggcccagagagaugaagugaugggccaagggcucgcagcuggcucuguggguuu

SEQ ID NO: 4172394 - RNA, 83 nt, Human
aggcccauuuuaaauggaucuuuuuauaaugcagauaccucucaucuaucuguuuuguaaugauggauuuguuuugggggcuu

SEQ ID NO: 4172395 - RNA, 116 nt, Human
aggccccacuuaauguucuugucagucuuugucuagagagcaaauauuaauggcaaauacucuuuaucuguuauauguuuuuucuaaagucacaugaauagcaaauaggaaggccu

SEQ ID NO: 4172396 - RNA, 72 nt, Human
aggcccgugaauggacacuccauccuguuguuacuuggcaccagggagggugugcuucaagcaguggagccu

SEQ ID NO: 4172397 - RNA, 79 nt, Human
aggcccuaccuacaaauacagucacauucugaggucuugggggcuaggacuuccauggauggauugggugagggggccu

SEQ ID NO: 4172398 - RNA, 79 nt, Human
aggcccucacagucuauugugaguagcugacaguagcaugagcacuauaaguacuaaagcacagaugcugugagagccu

SEQ ID NO: 4172399 - RNA, 94 nt, Human
agcuguuaaacucgggaauggauuguguguuugaguggugcgaccacugauguauaaaaugcacaggagaaccaauucacugagguaggcaccu

SEQ ID NO: 4172400 - RNA, 79 nt, Human
agcuguuuauuacccagagugggcguggucgcaacagacaaucugucuggcaagcucguuugggucagaaagaauggcu

SEQ ID NO: 4172401 - RNA, 79 nt, Human
agcuuaagucuuagauuuacaguggccuucugaacucagaaaagcaaggcagucugucugaggaccuaagauuugugcu

SEQ ID NO: 4172402 - RNA, 81 nt, Human
agcuuagaaggaucagacaaguagcucuguuugucuaaauuccauaggauuuacagaugguuauugucauuucugguagcu

SEQ ID NO: 4172403 - RNA, 100 nt, Human
agcuuagauuaauacaucuuuugauauuucuuaucuauuucucagaaaauagagaaaaacuaagaguggguggugaagugucagagugaguggcagaguu

SEQ ID NO: 4172404 - RNA, 69 nt, Human
agcuucaaauggcaacaagaacacuggcuuugaccaccaagagucggugacaaauucucugccauugcu

SEQ ID NO: 4172405 - RNA, 60 nt, Human
agcuucaggaacaggcagccuguaacauucuacaaggcagacgcgugucuccaugaaguu

SEQ ID NO: 4172406 - RNA, 65 nt, Human
agcuucccacacucuaguuuccaccuuagaauuggcuuccauggaaacuagaguguggcaaagcu

SEQ ID NO: 4172407 - RNA, 70 nt, Human
agcuuccucugugacaaacaguccuggcaucauuucuggauggcugggcaguggucacagcagagauucu

SEQ ID NO: 4172408 - RNA, 66 nt, Human
agcuuccuuguaaaggcucucuugauaagaaaguccaguggaccuucugucagaaaagcugaggcu

SEQ ID NO: 4172409 - RNA, 82 nt, Human
agcuuccuuuauuuuaagacuuaauuucuggugaugucaugauucaaggcaucagaaauagucuuuaaaaugaaaagaagcu

SEQ ID NO: 4172410 - RNA, 55 nt, Human
agcuucuagcccauccagcagggguucuuucuccucauuaggauggucugaagcu

SEQ ID NO: 4172411 - RNA, 62 nt, Human
agcuucuccaugcagaaggcugaggugugcuccuguuccaggccuguguuguguggagggcu

SEQ ID NO: 4172412 - RNA, 58 nt, Human
agcuucuggaagccuggcagcagcacacuugaccucucucucugggcuucccgaggcu

SEQ ID NO: 4172413 - RNA, 56 nt, Human
agcuucuucugcugucucuguuugcuugaagaguaaccugagauugcaagggagcu

SEQ ID NO: 4172414 - RNA, 69 nt, Human
agcuugaaccuaaaacaauaauuuaaguggacauacuaaugugguuguaaguuuuagguguuucaagcu

SEQ ID NO: 4172415 - RNA, 60 nt, Human
agcuugaggcagcccuuaauugggacccauuucucuuucucccaagcugcuggcucagcu

SEQ ID NO: 4172416 - RNA, 59 nt, Human
agcuugauggauugcugaggcagagugcaccgagcaaggguucaguccuccauagagcu

SEQ ID NO: 4172417 - RNA, 55 nt, Human
agcuugauuucucugcagugugaacauuggcuguucagauugccuauaaucagcu

SEQ ID NO: 4172418 - RNA, 57 nt, Human
agcuugcuuuccccucagucagagcuuccaguugacaauggguggacaagauaggcu

SEQ ID NO: 4172419 - RNA, 58 nt, Human
agcuuggcuugugaccagggagugacgucuaggaagagaggucagcaggggccaagcu

SEQ ID NO: 4172420 - RNA, 84 nt, Human
agcuuggucaagauuacacacugguguuuugucaguacaauucagaaaauaaaauccagcaaauaaugugcucuucacaaagcu

SEQ ID NO: 4172421 - RNA, 74 nt, Human
agcuugucuuucaaaggaguuuguucacguauugagugcuccaacuuuuauagcuccuacaugagggauuggcu

SEQ ID NO: 4172422 - RNA, 86 nt, Human
agcuuguuccuguaauguagaguguguuuuauugggaguuugccauauaaauuuuuaaagagaugcugugcauaaagaaacaaguu

SEQ ID NO: 4172423 - RNA, 65 nt, Human
agcuuuacacuuggacccacacuugauaguacaccaggaaaggguucaugguguaggauguagcu

SEQ ID NO: 4172424 - RNA, 72 nt, Human
agcuuuauagaaaggaucagugggagacccuucuucuccacaauuucccaugauccuaaguuaauagagacu

SEQ ID NO: 4172425 - RNA, 90 nt, Human
agcuuuauucagucaauacagauggcaugugaagauguaauaugcuuuuuuacauuuucauauggguuauuuguaaauaacuauauugcu

SEQ ID NO: 4172426 - RNA, 57 nt, Human
agcuuucccuauuuuaagauuuuuugaggccccuuggaucucuggaaggagaaagcu

SEQ ID NO: 4172427 - RNA, 62 nt, Human
agccauucauugugcucucagauucuguaggucagaguccaagugggacagcaaggauggcu

SEQ ID NO: 4172428 - RNA, 71 nt, Human
agcccaacccuggguucccgcagcaccaccuucucucucagguugugagcuccaggaagccagggauggcu

SEQ ID NO: 4172429 - RNA, 74 nt, Human
agcccacacugggucuggccacaggaaguagaguacccugccuuuucuuccugaaagucaggcugcaaaggguu

SEQ ID NO: 4172430 - RNA, 67 nt, Human
agcccacagaugucuccuuucugcuucccccagaaggccagacaggaccacaucuccuccgugggcu

SEQ ID NO: 4172431 - RNA, 79 nt, Human
agcccacuguuacucugagaggauccugcccgggccuggaguucagggagggcuccucuaaggacaugacguuggagcu

SEQ ID NO: 4172432 - RNA, 79 nt, Human
agcccagcaucuaaacugugauaccguugauacauggcacuuccaugguauuagaggcaacacauuuggaaagcaagcu

SEQ ID NO: 4172433 - RNA, 73 nt, Human
agcccaggagccuuuggaggguuucaaacagagucuggagggugucugacugacuuuucaaaauguuccggcu

SEQ ID NO: 4172434 - RNA, 62 nt, Human
agcccaggucucaaaguacagggcugugagugaugacuguaccugugcuaucagcuuggguu

SEQ ID NO: 4172435 - RNA, 56 nt, Human
agcccagguuugaguuucugggaacaucccagagcccucugcaaugccucagggcu

SEQ ID NO: 4172436 - RNA, 79 nt, Human
agcccaucuucccuuuuuaugucuucagcacuuauugacaaaagcaaaguugagaauggcaaagagggauuguucugcu

SEQ ID NO: 4172437 - RNA, 77 nt, Human
agccccagcggggagcaccugcuucucuugggcaauuacccuugagaggccagaaggcgcaccccgcgcaaaggguu

SEQ ID NO: 4172438 - RNA, 57 nt, Human
agccccaggcccggacgccucuaggaucggacccgcgcgccccggaugcuuggggcu

SEQ ID NO: 4172439 - RNA, 72 nt, Human
agcccccaaaucucaaaggcuuagcaucucacauccaauguggaguugccagugguugggagggugggggcu

SEQ ID NO: 4172440 - RNA, 82 nt, Human
agccccugccccauuccugccaucugaggguccagccuggaagccaaggucugucuuuggauuguugcgggggguagggguu

SEQ ID NO: 4172441 - RNA, 61 nt, Human
agcccgagugguucacccucacagucucucuguuagagaagugaguugugacuaugggguu

SEQ ID NO: 4172442 - RNA, 75 nt, Human
agcccggcagauggagagcccgagacauccuguaucuccggauaaggcuaggggcccucuccccgcacccgggcu

SEQ ID NO: 4172443 - RNA, 85 nt, Human
agcccucaagucccuugaagagucuuucuuucccccuucuucuuagaagggcugaaacacacuuuaaguuaacuuaggaaugguu

SEQ ID NO: 4172444 - RNA, 66 nt, Human
agcccucaucacugagcccuguagauucaguuuccacuucacaggaaacacagggaucagaggguu

SEQ ID NO: 4172445 - RNA, 60 nt, Human
agcccucccagugccuccagagcagcaggggaauguggugggguggguaagggagaugcu

SEQ ID NO: 4172446 - RNA, 103 nt, Human
agcccuccgcaauuaucuuaagggguccagaauauuugggaaagaugucauauuacuaucuuucccaaauauucugggccccuuaaaauaauugcagagggcu

SEQ ID NO: 4172447 - RNA, 78 nt, Human
agcccucucuaaacaaaucauucugaccuugggccaaaccuaucacugugauucuguauggauuccaucugaggugcu

SEQ ID NO: 4172448 - RNA, 118 nt, Human
agcccucugggggcagugggcugggggugggagaggcagcucuucugaauggggugagcaggucuggcuucucggcuuugggcugcacucucccugcccagcccagccgccagcggcu

SEQ ID NO: 4172449 - RNA, 128 nt, Human
agcccugacaggugccuuaccauguacucuuuuguucauuuggaugcuggcagccgagugcuccaugugccuggcacuggagauuccugugagugugaaaaagacauggccccugcccuuauggggcu

SEQ ID NO: 4172450 - RNA, 99 nt, Human
agcccugagcccuuuugcuccugcuucugccuugagguccucagcucugcaugcacggucgguccuagggcccggggcagcccaggugagggggcggcu

SEQ ID NO: 4172451 - RNA, 120 nt, Human
agcccugccgugagcgaggcggcgcaggaggugcauuccagauguuacugaaaggcugugagguagcugacucagaugcagcuggauuugaguccuggcagcaccacuuacuggcuggcu

SEQ ID NO: 4172452 - RNA, 84 nt, Human
agcccugcuugucaaaaagacuuauucacuaguuuccaucaguuuaagcauuaagaauaaugucuuuggcuugaccagcaagcu

SEQ ID NO: 4172453 - RNA, 66 nt, Human
agcccuggggauucugacacggagugggcuggaagucuccauucaaaugucaaauccaccaguacu

SEQ ID NO: 4172454 - RNA, 60 nt, Human
agcccuggggugcagaaccauggaaaugauaauggaugcuauugguggugaccccaggcu

SEQ ID NO: 4172455 - RNA, 94 nt, Human
agccgcuccgagcgucgggccccgcgcccuggcccuccuggguguagucccgguccugccucugcggggcccgagcccgcccacggcgccggcu

SEQ ID NO: 4172456 - RNA, 59 nt, Human
agccgcucuuggcuuugcccagcaccgagaaggcagccugggcagauggcaguguggcu

SEQ ID NO: 4172457 - RNA, 55 nt, Human
agccgggggucaggccucccaggacugucaagcugggcugcuugagucccuggcu

SEQ ID NO: 4172458 - RNA, 119 nt, Human
agccgguccuggcuuagcacauggucuggcuauuguauuggcuuagcacaugguuuggcuauuguauuagcacaauacaauugucugguuauuguauuggcuuagcacaugaucugguu

SEQ ID NO: 4172459 - RNA, 82 nt, Human
agccguuuccagugaguuuggggaaaguucuugaaaguaacaauaaaguuauuuacaacucuucucuuccugggaaaaaguu

SEQ ID NO: 4172460 - RNA, 86 nt, Human
agccuaauuggguuuacuugugccuuggcuuaaggucuagaauauaauaaacuuaaaggucugaacacagugagguuaauuaugcu

SEQ ID NO: 4172461 - RNA, 62 nt, Human
agccuaggccucuggccaaagggcuuggaccaaaguaucugaguccaggaggaggccagguu

SEQ ID NO: 4172462 - RNA, 121 nt, Human
agccuauggaaaaauuggaaggauauuuauuaggaggugaggcucugugaguuacuccuauccuaacugaacacacacaucuuaauaaucuaucuucauucauccaaauuccucauaggcu

SEQ ID NO: 4172463 - RNA, 86 nt, Human
agccuauuuacuugaucuauacccaucaugauuuaaguaauggaaaacuguuuaaaugauuuugggugagcaaguuuaaagugguu

SEQ ID NO: 4172464 - RNA, 60 nt, Human
agccucaacagggugaagauguagguuugaugcaaugccuaucaaaauccuauugagguu

SEQ ID NO: 4172465 - RNA, 65 nt, Human
agccucacagaacaagccugguggagggguaagaaucucuuuuuagauuguuugugaaauucgcu

SEQ ID NO: 4172466 - RNA, 74 nt, Human
agccucaguuucuucauauuguaggauggggaugacuauaccugccuuacaguguugagggaauuaaaugagcu

SEQ ID NO: 4172467 - RNA, 71 nt, Human
agccucaugcccaaugucacaauuuuugaacagauggccuccuuccuuccuguuuacugacaugcaaggcu

SEQ ID NO: 4172468 - RNA, 109 nt, Human
agccuccagugagugcugcggugaccugauuuccaguugcugggugcuugcuuugggcaaguguaccuccacgauugaaaucuucccuccaccccgagcuccugaggcu

SEQ ID NO: 4172469 - RNA, 65 nt, Human
agccucccgaggaauuuuuauaagaucugaucuaaucaugaauuuguuuaaaaauccuucuggcu

SEQ ID NO: 4172470 - RNA, 65 nt, Human
agccucucccucauuggguuccauuucucagcugggaaaacugagaccgaaagggguaggggacu

SEQ ID NO: 4172471 - RNA, 61 nt, Human
agccucugcuggcccuggcacuugcucccagcuagguccugcccaguggccagcaaaggcu

SEQ ID NO: 4172472 - RNA, 58 nt, Human
agccugaaaagagaauccaagucuuggacugacacugguucaaguugggucucuggcu

SEQ ID NO: 4172473 - RNA, 83 nt, Human
agcauauuuuucaagucuuuugcuaagaguaaugccauggagcagccucccaucauucuuguuaauaggacugucuguguguu

SEQ ID NO: 4172474 - RNA, 129 nt, Human
agcaucagcauuguuggaaauguuagagaggaaaucuuaggccccaaccuggacuuaucaaaucagaaacuguggggugggucugauguaucuagccuuuaacaaaccuuucagaugauucugaugcuu

SEQ ID NO: 4172475 - RNA, 82 nt, Human
agcaucaguaacuccuauuugguagauggaagagaaguuaaaugcuuuaccuaaagucauacaaggugggagggcuacugcu

SEQ ID NO: 4172476 - RNA, 58 nt, Human
agcauccaggccagguugggcaggguuuaauaagcgcugggccuuucaccuggaugcu

SEQ ID NO: 4172477 - RNA, 68 nt, Human
agcaucugaggaggaaacauccaaagcuaguuaccugaagcucagcuuucucuucuuuagaaagugcu

SEQ ID NO: 4172478 - RNA, 74 nt, Human
agcaucugaugcaauguaagucuugguuauauacucugauauguuuccacagauauuuauuuagucagaaugcu

SEQ ID NO: 4172479 - RNA, 82 nt, Human
agcaucuuaaauguuuugcauuaguuuucuagaacagacucuuagaaguucuagaaauaaguugaagaccauuuugaugacu

SEQ ID NO: 4172480 - RNA, 67 nt, Human
agcaucuuaguuacuacugugggacuagcaucuuguugggcuaacagaaaagaacugaguuugugcu

SEQ ID NO: 4172481 - RNA, 61 nt, Human
agcaugacagcacugcugcuguuaaucuugauuaccuggcugagguaguguuugucaaguu

SEQ ID NO: 4172482 - RNA, 69 nt, Human
agcaugcuguagcugugacccaaguaccacuucugagaagugccacagggccacauguaaacagaugcu

SEQ ID NO: 4172483 - RNA, 80 nt, Human
agcauguaaaggucuaugacagaaagacaaguuuucuauuuacuagaaggcagguauugaugccacagccuuuggauguu

SEQ ID NO: 4172484 - RNA, 61 nt, Human
agcaugucuuucuugugucccaagagagaacuguuggauguggcagaggagaugacuggcu

SEQ ID NO: 4172485 - RNA, 65 nt, Human
agcaugugugccugagugauggacuugguauuuacaccagccacgcugauaagugcacauguguu

SEQ ID NO: 4172486 - RNA, 129 nt, Human
agcauuagaggaaucaaacaaacaaggucuauauuuuugcauaggguguuuuacguucaauacuacaauauuuauguuuggcacuauucacuccaugggaaaauauaggcugugugucuuuuauuugcu

SEQ ID NO: 4172487 - RNA, 94 nt, Human
agcauuaucuggaaaaggggaauggguagacuguugaauucaggcaccugaccucauguucacuucguaaaccccucccauuuccaauguugcu

SEQ ID NO: 4172488 - RNA, 57 nt, Human
agcauuauguccaugcuaaauugugcuguaaaugauaugguauggaacauaugugcu

SEQ ID NO: 4172489 - RNA, 130 nt, Human
agcauuuacuuagagaauugcaauccuuaaacuguucgguguggucucauagaccagcucaaagacaugacuugucuggcagaucaugcaaccucaguucucuaagcuuucauuucuuucauuguaaacu

SEQ ID NO: 4172490 - RNA, 85 nt, Human
agcggcuagcuggucaguuuuuaacuuagcuguaacgaaauaaggcccagagaaguuuaaucauuagaccauagagucagcugcu

SEQ ID NO: 4172491 - RNA, 71 nt, Human
agcgggagccugaacagcucauucagcacuaagaaaacugcauuugcagaauggcuuuuauggcucaggcu

SEQ ID NO: 4172492 - RNA, 63 nt, Human
agcggguccauauuccuguggcuccuucuccagauucuuugcccaccuggauaugacccagcu

SEQ ID NO: 4172493 - RNA, 69 nt, Human
agcggugaguagaauguuucuggauggucaaaggagaaagggauuuucucagcuacgcuuucaccagcu

SEQ ID NO: 4172494 - RNA, 62 nt, Human
agcggugggaauuucaagaccaaauguuaaaacuuaaaacagccuugccuguuccuacagcu

SEQ ID NO: 4172495 - RNA, 60 nt, Human
agcgucccugacuuucaccuggcaucagcaaaaugguaaauggagaaagcagggaauguu

SEQ ID NO: 4172496 - RNA, 116 nt, Human
agcgucucugccuuagaacauuccuuuucuucuuuaugcagccugaaaaaccaggaguuaaaaaugccuccauggagauugaaaaggguaauaauguugggaaacagaguuaugcu

SEQ ID NO: 4172497 - RNA, 83 nt, Human
agcgugcaggugccggcggccgccuuuuugggcuccgggacccccgggagugggagcggcagucggggacgccucaacucguu

SEQ ID NO: 4172498 - RNA, 72 nt, Human
agcguggggggagcacagcagagcauggcuuggguuuuuacuaccaguaauugcuugugcugucccuguccu

SEQ ID NO: 4172499 - RNA, 58 nt, Human
agcgugugugcgggucuucuuucaaaauaguggggcauuugaaacccgcgcugcagcu

SEQ ID NO: 4172500 - RNA, 68 nt, Human
agcguuguccuccagguuugugcacacugagccagugaggcgcuugcagggagucuggaggaagcguu

SEQ ID NO: 4172501 - RNA, 83 nt, Human
agcuaaaaaaccagcuggaaacaaauagagugaacaauauggauuauguauuuuuuuaguuuuuaguuuuuggucauguggcu

SEQ ID NO: 4172502 - RNA, 76 nt, Human
agcuaaaaggugugcccuguuaaaugcacaguaguaacuugacugcucuguguugucagaggcaccaccugaaguu

SEQ ID NO: 4172503 - RNA, 90 nt, Human
agcuaaacuacauuucgaagacaagucaggcggauuucuagauuaaauuccccuguccacugcugugugcuucaccgaaugugguaagcu

SEQ ID NO: 4172504 - RNA, 64 nt, Human
agcuaaagccaugcuuagugaaaaauguauacuucaaaugcauauuuuauaaagauggaaagcu

SEQ ID NO: 4172505 - RNA, 64 nt, Human
agcuaacauggaggaaaaaguuacuaagaugaaaaaaauuaggaacaaaccucagauguugguu

SEQ ID NO: 4172506 - RNA, 70 nt, Human
agcuaacuguaaugaauuguucaugacuugccaauugacaucaggaucagaaugauuuuugcagucugcu

SEQ ID NO: 4172507 - RNA, 55 nt, Human
agcuaaugggagacccuuucacugcauuaguuuugacagaggucuuuuaauagcu

SEQ ID NO: 4172508 - RNA, 65 nt, Human
agcuaccuggcuuaucacugucuugacuucgaucaccuggccaacguagugggugccagguugcu

SEQ ID NO: 4172509 - RNA, 64 nt, Human
agcuagagucaaggggcagauucagucuuuugugaaacuaguggaaggguuucuugacuuugcu

SEQ ID NO: 4172510 - RNA, 69 nt, Human
agcuagcauaugaggcagggccaccucccuuccagaccucgaggccuggagcuccugcccauccuggcu

SEQ ID NO: 4172511 - RNA, 74 nt, Human
agcuaggguggauauuuguaaaauucugugucuuggcucaaaauguuaagacugcuacaaaaaucuacuaagcu

SEQ ID NO: 4172512 - RNA, 83 nt, Human
agcuaguccccagaaugcaaaugcuucuacuuggaauguucuuugacucaacaaggcagcaucugcauauugggagaccugcu

SEQ ID NO: 4172513 - RNA, 112 nt, Human
agcuauaccucagaugcuguuggccuuggcagugagaagaguugauaaaagucaguaaguccauucuuccggaacuugccagggaagaccuagucuucaaccaaguuuggcu

SEQ ID NO: 4172514 - RNA, 61 nt, Human
agcuauagcuggaucuuaaguggcauucugagaaugaggaacucaauuuucugcuguagcu

SEQ ID NO: 4172515 - RNA, 76 nt, Human
agcuaugauauugauuuauaaggcccuucuuuuguuaucguaacaguggggucuuaauagaacauaggucaugguu

SEQ ID NO: 4172516 - RNA, 65 nt, Human
agcuaugucaaacacaacaccagugguuuuauuuacagccaggaaaccaguguguuucacgugcu

SEQ ID NO: 4172517 - RNA, 90 nt, Human
agcuauucuaacucucaaaagggcuggcuuucccauacauacaaagaagaaaaugcugugcuugcaugagugucugaaucaagaaaagcu

SEQ ID NO: 4172518 - RNA, 64 nt, Human
agcuauugggauuaucacauguagacuugugacuaaaguaaauaugcauguauccuuaucagcu

SEQ ID NO: 4172519 - RNA, 65 nt, Human
agcuauuuugcagggccagggcuauggaauuuuccccacuuccugucucugcccuacagaaagcu

SEQ ID NO: 4172520 - RNA, 61 nt, Human
agcucaaggguuaagaucaagcuuugucagaagacagagcuaaauuucaaucccaggugcu

SEQ ID NO: 4172521 - RNA, 83 nt, Human
agcucacagcugcaggcuguaauagguuuccagagaccacagcccuaugcuuuugaaaucuuccacagcccaagcuccaggcu

SEQ ID NO: 4172522 - RNA, 78 nt, Human
agcucacaucuauuucugcuaauaacaaucccacugcuaauuaugggaugugguaguuauagugauaagagaggagcu

SEQ ID NO: 4172523 - RNA, 130 nt, Human
agcucaguaacuggcuucucagaacuugucaauuauuuuccauauucugugcugcacaaguaugacuucauaaaggcaauuuaacaaauagaaaaucuggauuggcuagaacauuugucaauacuggauu

SEQ ID NO: 4172524 - RNA, 60 nt, Human
agcucaguggcucaguggguauucaucauucagcagaugcuuacuccgcagcauugugcu

SEQ ID NO: 4172525 - RNA, 130 nt, Human
agcucauuaguggccuaguugcucagcuggcucagguucuuguuucaaacagaccccugcacugcugggcgucuuucuggaaacaaacaacccuacuguagcuuugggguuccauggcuuuuuguguuuu

SEQ ID NO: 4172526 - RNA, 59 nt, Human
agcucauuauuauccuagccauguggaucccccauugagcaauuaggaaauaaagaguu

SEQ ID NO: 4172527 - RNA, 70 nt, Human
agcucauugaaguauuuaagcuccccuugauuagauguuauaaugaucagacagagaaguacaaugagcu

SEQ ID NO: 4172528 - RNA, 83 nt, Human
agcuccaaaauaaauugaauaauauuuuaaaaucaugucauuuccauuuuagagcagugguuuuagaguauauucagggagcu

SEQ ID NO: 4172529 - RNA, 55 nt, Human
agcuccaggccuugggccccgggcauggucccaggcccaucucuugcucuggguu

SEQ ID NO: 4172530 - RNA, 59 nt, Human
agcucccagccuccuccgucccacccucacccgggccugguggagaggcuggcgggacu

SEQ ID NO: 4172531 - RNA, 99 nt, Human
agcucccaucuggcuuuuuugagaggcucacucuuggaacccagcuacucugcuaugaggaagccaaacagcuacacagaaaggccagauguaggugcu

SEQ ID NO: 4172532 - RNA, 82 nt, Human
agcucccgccucuguugucugucuugcuguaucacccucgggccuuaucagcugaaaaacaggcagcaaaggaacggcagcu

SEQ ID NO: 4172533 - RNA, 80 nt, Human
agcuccuauccuggugccuccaacagcccauccuagagggaccuuuuaguauugggcucuggaggcugaaagaaguggcu

SEQ ID NO: 4172534 - RNA, 87 nt, Human
agcuccuggagggcaagucuugcauccacugcuuugcuggcaacccgacugguaagcuucuggaaggcaaggcuugcauccagugcu

SEQ ID NO: 4172535 - RNA, 67 nt, Human
agcuccuugccguccuuacuccagcggaugaauggguccgggaaagccgaaaugcggcaagugagcu

SEQ ID NO: 4172536 - RNA, 78 nt, Human
agcucguggucugcacaccgccaggcugacuccuguucccaggcagugggugugugugguguucgcagggcacuggcu

SEQ ID NO: 4172537 - RNA, 56 nt, Human
agcucuagggggcgccguucauauuguaguuuauguaaacaucacccccuggaguu

SEQ ID NO: 4172538 - RNA, 101 nt, Human
agcucucuccaauaucuuccugcuaacaaaucucugucucaaaguguuucaugggaaaaccaaccuaaggcaguggaugucaggaauggucagaggaagcu

SEQ ID NO: 4172539 - RNA, 56 nt, Human
agcucucuugacuucaguuuccucaucugaaaaaugaggagcugaauuagaggguu

SEQ ID NO: 4172540 - RNA, 59 nt, Human
agcucugcaggagcaaagccucugcucgucagagauagagcugcuuugccugcucuguu

SEQ ID NO: 4172541 - RNA, 90 nt, Human
agcucuggaugugucaucuuuccugccauugcccagugauagacuaugcaacauucucuggaauggcaaugggaagucccacccucagcu

SEQ ID NO: 4172542 - RNA, 65 nt, Human
agcucuggcuacagaauuggcccuguuuauggguuggagcagguuccaggcacuguggcugggcu

SEQ ID NO: 4172543 - RNA, 72 nt, Human
agcucuguccucacaggcaucucaucaggcuccugacccucagaguugcagcgucuaagugaguucagaccu

SEQ ID NO: 4172544 - RNA, 63 nt, Human
agcucuguguuugacaggcggucucccuuaugguuaguggaucccucuuuucuagcacuugcu

SEQ ID NO: 4172545 - RNA, 63 nt, Human
agcucuucagaucucagauggucugcucagcugagccgugcucucugaggugcuggcagaguu

SEQ ID NO: 4172546 - RNA, 80 nt, Human
agcucuuccucaagauaaagccaccagaagcuuccagcucaggaagaguucugcaauuguguuuauguaaaggaggaucu

SEQ ID NO: 4172547 - RNA, 55 nt, Human
aggaggguaagggggaauauagguacuugugcaucugugaccuuucuuuccuccu

SEQ ID NO: 4172548 - RNA, 59 nt, Human
aggagguaguucuacaacuuggagcaagacauccauggaaguuacgcuauuacucuccu

SEQ ID NO: 4172549 - RNA, 69 nt, Human
aggaggucauuuugccuauuagaaugccuggaauuaagaagcuuucuaugaagguaagauguacgucuu

SEQ ID NO: 4172550 - RNA, 58 nt, Human
aggaggugguggcagugacaauuccucacuggauuuggaauguguuugaucaccaacu

SEQ ID NO: 4172551 - RNA, 93 nt, Human
aggaguagaaacaccgccuaacucugaaagagaguacauacaguuuagaaagcaagauugacuaaaugugcuuauuuuuaaaaggucacuccu

SEQ ID NO: 4172552 - RNA, 65 nt, Human
aggagucucaaagucgaaugaaacuguguuauucagcucuguauuauucacucugaagccauccu

SEQ ID NO: 4172553 - RNA, 70 nt, Human
aggagucuggagguacauaaugagagggucugggacugguucagaagcucagugaugccuccaggggccu

SEQ ID NO: 4172554 - RNA, 72 nt, Human
aggagugauauaacuauauuauuagaaaaaaauguauggaguuagcugauaauggcuugugguguuauuccu

SEQ ID NO: 4172555 - RNA, 81 nt, Human
aggagugcucuugccacuggccacagggccuggauuuggggaggaagagcaggguccagggccaguggcugagcacggccu

SEQ ID NO: 4172556 - RNA, 78 nt, Human
aggaguggcagguuggguucuuauggaaguggguaaggaaucagaacuauggaaacucaacauuuguuccucauuccu

SEQ ID NO: 4172557 - RNA, 75 nt, Human
aggaguguuauucuucaggacaugaauuucauuuuuauguguucccacuuucaaguuuucagaauagccacucuu

SEQ ID NO: 4172558 - RNA, 73 nt, Human
aggauaaaggucaagcuggacucagguguauuuuccuuauguuauagcugucuaugaauuggcuucaaauccu

SEQ ID NO: 4172559 - RNA, 126 nt, Human
aggauaaauguaauuuuuaacuuuuuagaauauuuucuguucaggauggcugacuuugugauuuguccaaauuaggcaaaaagggcagcuagcuguagaaagagcuaaacaaguagaagaguuccu

SEQ ID NO: 4172560 - RNA, 58 nt, Human
aggauaacaguagccuuauguggucuccccaagacugauaccauguugcuguugaccu

SEQ ID NO: 4172561 - RNA, 71 nt, Human
aggauagggcuggcaaacacuuuuaaaugucacuaaguaauuucaggaaggagcuggccugccacuguccu

SEQ ID NO: 4172562 - RNA, 62 nt, Human
aggauagguuuccugaggauggagaugcagaaauaguugacuuugccuucacgaagcauccu

SEQ ID NO: 4172563 - RNA, 103 nt, Human
aggauagugacagcucugaggcuuuucucuaaauaguggucaguuuacaaagccuaugucagccacugagaccuuuuggaggagugucauccagcuuucuccu

SEQ ID NO: 4172564 - RNA, 62 nt, Human
aggauaguugcaucaugucaguuguaucauguuaggcacaacuauuaccauguuauugucuu

SEQ ID NO: 4172565 - RNA, 76 nt, Human
aggauaugaaguuuagaacuauaagagugaggaaucuucucuuucugacucuugcaguucuaaacuuuauacaccu

SEQ ID NO: 4172566 - RNA, 62 nt, Human
aggauauuguuguauuuagcacaucuguuuuucagaugcugaagcugaggcaacaaaaugcu

SEQ ID NO: 4172567 - RNA, 68 nt, Human
aggaucaaguugguugagcuuuuuacaagauuuuccuuauuuuaccuggcauuugccaaagugauccu

SEQ ID NO: 4172568 - RNA, 58 nt, Human
aggaucagugaauacucaggguccuaaaccagggaugcccugggcccuuccugguucu

SEQ ID NO: 4172569 - RNA, 80 nt, Human
aggauccaguggaguuuuuauacccaguaugucuaagaaucaugugggcuuggguacuggacuccacuccaggggguucu

SEQ ID NO: 4172570 - RNA, 130 nt, Human
aggaucccuugagggaagggcaagugcaccaggcccagcaucuccauggcuuuggaguaucacgcaggacccagcagccagaaugaggagcuugcuguuuaaaaugcagauucaccucugaagggauucu

SEQ ID NO: 4172571 - RNA, 84 nt, Human
aggaucucugacaacaccucuacucuccauggcugucaugacugaggccaacuagggagauggaaaguggugucuagagguccu

SEQ ID NO: 4172572 - RNA, 99 nt, Human
aggaugacaacaccauucuccaacuagagcuccccaguucucacucggcagugggagcacccugaggagcuuccuaguggaaagaggaaaaaucauuuu

SEQ ID NO: 4172573 - RNA, 74 nt, Human
aggaugacagggaaacauugaaguguccuuaguagaggagugacauuaucagguuuguuuucuagcuuaauucu

SEQ ID NO: 4172574 - RNA, 67 nt, Human
aggaugauugacugauggaggcucugguuggagaggccucagccaggucuaagcaucagccacaccu

SEQ ID NO: 4172575 - RNA, 70 nt, Human
aggaugcagcaagaaggcacugucugugaggaagugggcucucaccagacagcaaaucugcuugcaucuu

SEQ ID NO: 4172576 - RNA, 75 nt, Human
aggaugcauccugagagcagcugcuuuggaggaagguucucccugaccugcucguucuuccaugggauucaucuu

SEQ ID NO: 4172577 - RNA, 57 nt, Human
aggucccuaacagcuuuuuaaagucacggauagacuucggaauaugauaagggaccu

SEQ ID NO: 4172578 - RNA, 58 nt, Human
aggucccuagagugggaugacuugguacagcugccccaggucaauauucaggggaccu

SEQ ID NO: 4172579 - RNA, 86 nt, Human
agguccucagucacuguuuccuguacuggacagaaccacauuuacuaggcugugcaucaagagaaaacagugguguuggggcaccu

SEQ ID NO: 4172580 - RNA, 65 nt, Human
aggucgaguuucggggcuacuuugaaaaccacaugaaauuugguuuguaguacucugagugaccu

SEQ ID NO: 4172581 - RNA, 80 nt, Human
aggucguuuuccagagcugcagguaaaaugcuuccccacugcuucugaggcuuuuguuucagcucugcuacuaguggccu

SEQ ID NO: 4172582 - RNA, 70 nt, Human
aggucuacuucuguggcucuaagagacuugucucucauggcuucucucggagcuaccggaaguugggccu

SEQ ID NO: 4172583 - RNA, 65 nt, Human
aggucuaguugcuucuguuccauucuacauaguuuaaauguauccugacagaaauagcugugccu

SEQ ID NO: 4172584 - RNA, 63 nt, Human
aggucucaaaguacuuugguuauugugguacaucagaaugauagcuaguauuuacugagaucu

SEQ ID NO: 4172585 - RNA, 130 nt, Human
aggucucagaaauaaguggaauugauacauagauagacuguaugagauccucuagagaaacuggguaaugcagaggcauuuauugauguauacaaaauaauucacuugaauuuaacucugguaauagccu

SEQ ID NO: 4172586 - RNA, 88 nt, Human
aggucucaguuggcagugaggcaguggcugagaccaggggcucuucuguguagcccaggccuggcacugccuuucugccucgagaccu

SEQ ID NO: 4172587 - RNA, 66 nt, Human
aggucuccuccucucccaguucuagcguuuacucucuuaugugaagaacagaagggaggaaggccu

SEQ ID NO: 4172588 - RNA, 64 nt, Human
aggucuccuggaggcaaaugagcacauuuguuaaaauggaguauuacguuuguaccagaaaccu

SEQ ID NO: 4172589 - RNA, 75 nt, Human
aggucucuccguaggugccugcacgacccaaacacagcuguguuugucuuaauuaggcaucgagugguagcaccu

SEQ ID NO: 4172590 - RNA, 57 nt, Human
aggucucugcccacacaggcuuccaacuuccauggcauaucuccuggguaggggccu

SEQ ID NO: 4172591 - RNA, 70 nt, Human
aggucucuggcuguuucuccuuugucuauugcauuuuuccuggaguugacgagaugagaaauccugacuu

SEQ ID NO: 4172592 - RNA, 87 nt, Human
aggucugauugcuagggagagggaggcaucaugaauccagcccagcccugggcuuaggaaugucccuucccacagcugucacggccu

SEQ ID NO: 4172593 - RNA, 95 nt, Human
aggucugggaggauagugaggugaggcuguugagccccagcaagucucuuuuagggacucugcuugcccaauggaaaccuacugcccccaaacuu

SEQ ID NO: 4172594 - RNA, 61 nt, Human
aggucugggcaccacuggcugccuuccucuuuguucccugggcccugugaugucuugaccu

SEQ ID NO: 4172595 - RNA, 61 nt, Human
aggucuuaggaccucagcugugaguguggggaccugcacucugcucaaaguccugaggccu

SEQ ID NO: 4172596 - RNA, 89 nt, Human
aggucuugacagugagaguguuuggaaauagaaagggguucuuuugguggcauuuucucuuuuguuccuugacauuuuccuguggaucu

SEQ ID NO: 4172597 - RNA, 91 nt, Human
aggugaaacccagaccuccucuuccagccuggaccgugacugccacaccggcagcucugugcaggccuggggagagagaacuaauuuccuu

SEQ ID NO: 4172598 - RNA, 60 nt, Human
aggugaagaaguaaggucauuaauguaaucuuucauacuguaacacuugcuuuuugacuu

SEQ ID NO: 4172599 - RNA, 59 nt, Human
aggugaaguugaggaggcagaaagacauucuugucagucccuucucugugcuucugcuu

SEQ ID NO: 4172600 - RNA, 56 nt, Human
aggugacaggcugugauggccgggaguggacauuccuuguaagcaggcuugaaucu

SEQ ID NO: 4172601 - RNA, 57 nt, Human
aggugaggcugcugaauggcaugaggagaugcucaagccuuguggaggcucucauuu

SEQ ID NO: 4172602 - RNA, 58 nt, Human
aggugagggggcugaucauuuacugggcuaaggccuagcauugaucagccugcucccu

SEQ ID NO: 4172603 - RNA, 80 nt, Human
aggugauuagaucaugagagcaggcuccccccuugcuguucucgugauggugagugaguucucaugaaaucuaguuguuu

SEQ ID NO: 4172604 - RNA, 76 nt, Human
aggugauuucuguucuuggggaucugaaggcaaggucugaacuaagcaccugcccacuucccaugacaugacaccu

SEQ ID NO: 4172605 - RNA, 88 nt, Human
aggugcaguauuuucugugauucugagguuggcugaauagaaucguagcauguagcacaggaauccacagucuuguaccucuguaccu

SEQ ID NO: 4172606 - RNA, 116 nt, Human
aggugccggagagucaaggaggugggccucugacuucucuuuauuggcagucugugugggguggccaggacugaggggucagagggcccaauuccaagucaacuccuguaggcccu

SEQ ID NO: 4172607 - RNA, 88 nt, Human
aggugcgguauuuucugugauucugagguuggcugaauagaaucguagcauguagcacaggaauccacagucuuguaccucuguaccu

SEQ ID NO: 4172608 - RNA, 96 nt, Human
aggugcuagaauccaacuuaaucucugcuagccaagcuuuguguccacagagcugguucuguccagggaauucuuugaauucucccagaggcaccu

SEQ ID NO: 4172609 - RNA, 97 nt, Human
aggugcuaugaagaaugugaauugguagcuuucugucucuagauugaacaguggugaccauucauucauuuguucaacaaacaucuauuuagcaucu

SEQ ID NO: 4172610 - RNA, 86 nt, Human
aggugcuggccaggccagugggcagcagugucucccaucuugccuguggcacuggguauucacugccgccaccugcccccagcccu

SEQ ID NO: 4172611 - RNA, 55 nt, Human
agguggagacccagagaaggcggccaauugcucaaagcugcucugggucucaucu

SEQ ID NO: 4172612 - RNA, 57 nt, Human
agguggcagaggacuccuccugcaggacuuggcgggugggagggcuagggccauucu

SEQ ID NO: 4172613 - RNA, 57 nt, Human
agguggcucacaccuguaaucccagcacuuugagaggccuaggcagguggaucacuu

SEQ ID NO: 4172614 - RNA, 68 nt, Human
agguggcuccccuauucucaucugacgcuggucuggcaagcaaguguuuuuggguagggugaguccuu

SEQ ID NO: 4172615 - RNA, 56 nt, Human
agguggcuccucccauggcuggcaguugaugcuggcuguuggcgaggagcucagcu

SEQ ID NO: 4172616 - RNA, 81 nt, Human
aggugggaggggaaugaaaugaaacagaacauaucagaaugcauuacaugugguaaggguauuauuucauccauuuuaucu

SEQ ID NO: 4172617 - RNA, 59 nt, Human
aggugggcauagcuagaauauuugauaccaaauauugucuaaccaugcugugcuagccu

SEQ ID NO: 4172618 - RNA, 61 nt, Human
agguggggcugggaaagauucccacugggacacuagacagguauuuuuuucagcgacaccu

SEQ ID NO: 4172619 - RNA, 70 nt, Human
aggugggugaguucaggcccacacacaggcucagggccuguaaguaguuugccugagcuaccucuugccu

SEQ ID NO: 4172620 - RNA, 57 nt, Human
agguggucucucauuugucagcagccugacugggcuacaaaguaugagaagaccccu

SEQ ID NO: 4172621 - RNA, 86 nt, Human
agguggugcuuuucugucugcaaaccuaggggccagggcccaucggaaugcucugccuccccuaguguuacugcugacacccaucu

SEQ ID NO: 4172622 - RNA, 118 nt, Human
aguauccuugugaaaccuugaaaggauuuggacauuuacaauagugaaaugggauguuagguaucaaaggaucagucgcuguagcuguuaaaaucaggauuuagggauuuaugaugcu

SEQ ID NO: 4172623 - RNA, 79 nt, Human
aguaucucagucucauuuugcucuucaauccuuuggccauagaucagccaaagagauuucuguaaaauguaaaggugcu

SEQ ID NO: 4172624 - RNA, 59 nt, Human
aguaugagcugcuagaugauuuaugaccaaaggucaaaucagcaagcagcuucccagcu

SEQ ID NO: 4172625 - RNA, 77 nt, Human
aguaugucucuaaaucuuaacaggcugaucauauauccucuauaucuccaagagaggcuguagguuucaggcauacu

SEQ ID NO: 4172626 - RNA, 63 nt, Human
aguaugugagguugguuuccagggccuagugguagcacuacuuuggggauuauuuuuacuacu

SEQ ID NO: 4172627 - RNA, 70 nt, Human
aguauguuacagaaagcaaagaugaguauuguuucucaaagccuuugcuuuauguauuuauacacauacu

SEQ ID NO: 4172628 - RNA, 103 nt, Human
aguauguuuuauuucuucuaauuauucuagucacauagcauuuaaucacaugaucccacuuuugucugcuuuguguuugaauagauaauggaaugaucguacu

SEQ ID NO: 4172629 - RNA, 85 nt, Human
aguauuauuaugcucuguuucacauuugaaaauuacuacuucaucuugguagugaaaugauaguguaaauacagccaaugaugcu

SEQ ID NO: 4172630 - RNA, 62 nt, Human
aguauucuugaguggcaacuagguggugggccaacaacccuagaauguacuuaauagaugcu

SEQ ID NO: 4172631 - RNA, 70 nt, Human
aguauugagacuuccaguauaugagaguguucaguagagacaguaaaucagaauacuggaaguaucagcu

SEQ ID NO: 4172632 - RNA, 76 nt, Human
aguauugagggcagugaugucaaacagugaauaaaguuauauaucuauguggugaucuuauuuuaaccucaauauu

SEQ ID NO: 4172633 - RNA, 83 nt, Human
aguauuguguauccuuauguaggucuauuugcuaucaauuuuuuucugagcacaauuacuuacaucuuaguggugcaaguacu

SEQ ID NO: 4172634 - RNA, 125 nt, Human
aguauuguuucgaaaugcauuguaaacauguuagauuccugaugaauuuaaaauugugugaugcuucuaaucauugugaucgucauggaguaaguaacugcaauguuuauuuuaaacaacuugcu

SEQ ID NO: 4172635 - RNA, 70 nt, Human
aggaugcugccgaggaugaaugacagcugcaagaagcaguccccagcccucagguccucagcagccuccu

SEQ ID NO: 4172636 - RNA, 63 nt, Human
aggauggaaagggguguuugcugaugguaccuucuaagggaacagcugcccuuuucacauguu

SEQ ID NO: 4172637 - RNA, 60 nt, Human
aggauggaauuagguagcaaguugaaggcauaaaacccaguuuccuccuauuuccacccu

SEQ ID NO: 4172638 - RNA, 69 nt, Human
aggauggcagagauuagugcccuuaaggaucuaaugaauccagguuccggggauaguguuucccaucuu

SEQ ID NO: 4172639 - RNA, 59 nt, Human
aggauggcagcaaguucuugggaggucuaucaccuggagucuucuaauugcuguuuccu

SEQ ID NO: 4172640 - RNA, 57 nt, Human
aggauggggaauugaccgcggaucuucaugugaagagcaucgguggagcccccaccu

SEQ ID NO: 4172641 - RNA, 72 nt, Human
aggaugggucagcuagaguccauuuaggaaugaaauguggacuugacccaaaauagcugucaugcucagccu

SEQ ID NO: 4172642 - RNA, 78 nt, Human
aggaugguggacggugaccaagcaucaccgagcccuuacuaggucucggguaccaugcuaggcacuuccaccggugcu

SEQ ID NO: 4172643 - RNA, 78 nt, Human
aggauguccagaaggguccccuguucugacagacuccacaccugaggaagcagaacaggagggcagaucugacaucuu

SEQ ID NO: 4172644 - RNA, 56 nt, Human
aggauguccuggguguuaggagcauauaaugguuuuaaccuaauaugagggguccu

SEQ ID NO: 4172645 - RNA, 83 nt, Human
aggaugucgcaaagucuggguggccuucaguccaugaaagagaacacaucuguucuaucucaggcugaggucaucugcauccu

SEQ ID NO: 4172646 - RNA, 78 nt, Human
aggaugugaaguagagcauuugguuauaguaauuucuaaguuaggcaguucuaaguuuaaauucuauuuuugcaucuu

SEQ ID NO: 4172647 - RNA, 70 nt, Human
aggaugugagccagccuggccugcucaccauggugggccuaauaucuaguguuaggcguauuuagguccu

SEQ ID NO: 4172648 - RNA, 60 nt, Human
aggauguguguaggcugguuaauuucgaagaugaaaaccuuuuccucccugccacaucuu

SEQ ID NO: 4172649 - RNA, 84 nt, Human
aggauuaaugaagcucuuagcagcacucuuugcauggaguaaugcucaguaaaugguugcuguuauuuuguuguuauuaccccu

SEQ ID NO: 4172650 - RNA, 64 nt, Human
aggauuacauguuucuuugcugcaggacuucucagagccuuaguaauguguuaauaugaaucuu

SEQ ID NO: 4172651 - RNA, 56 nt, Human
aggauuagagacuucucuaccucaguuuuaacugagaguuuuauggcuuuaauucu

SEQ ID NO: 4172652 - RNA, 62 nt, Human
aggauuagaugacuaaugagcugugacauccucugugacacagacauuguacaucuuguuuu

SEQ ID NO: 4172653 - RNA, 67 nt, Human
aggauuauaguaaacauuuguugagcucuguguguugggcacuguuccaagugcuuuacuuaauccu

SEQ ID NO: 4172654 - RNA, 59 nt, Human
aggauucauggugcagacaaagacaggcccaggcuucaagcuucuguucaugcauaccu

SEQ ID NO: 4172655 - RNA, 67 nt, Human
aggauucucugcagacuggagagaagacaaagaauauuccaucuuccagaaucucagagggcuuccu

SEQ ID NO: 4172656 - RNA, 86 nt, Human
aggauugcuugcaccaaagagguugaggccgcagugagcugugaucaugccacugcacuucagccugggaaacagagcaagauccu

SEQ ID NO: 4172657 - RNA, 70 nt, Human
aggauugucaaguugcuuaugcuggagucagcugggcugguuggcuucuuauaaugcaauagacaauucu

SEQ ID NO: 4172658 - RNA, 106 nt, Human
aggauugucuuugcuguauguccauggagagaggagcaaaggggaacugggaggcgauugucucccauguuagguguuucuguuucccaugcauuugacuauuccu

SEQ ID NO: 4172659 - RNA, 79 nt, Human
aggauuuccuccccagccccgcaggcucaccuggucuuugucacaaguugucucagggcagcuggaggaggcaaacccu

SEQ ID NO: 4172660 - RNA, 69 nt, Human
aggauuuugaaccagacagacuucuuaugaaagccaacacucuuuugucuguucagguuucagagaacu

SEQ ID NO: 4172661 - RNA, 80 nt, Human
aggcaaaacucuuuuucugcacacgugucccauuccuccucccuguaguuuggagagggcauuuuagaaaaagagucccu

SEQ ID NO: 4172662 - RNA, 72 nt, Human
aggcaaaauaauggucauuggugguuauuggauaguaauucauuaaugcauaaucaccauuaauaauugucu

SEQ ID NO: 4172663 - RNA, 63 nt, Human
aggcaaacugaugaaagauuuugagugucagacacacuucuguaguagaaucuguuauugccu

SEQ ID NO: 4172664 - RNA, 59 nt, Human
aggcaacaugggaaaauuaaccuauuaguuccauuaguagaguugaugguuuauugccu

SEQ ID NO: 4172665 - RNA, 55 nt, Human
aggcaacaugggccaggcagaaauggaauucuuugcuuucaggucccuuuugucu

SEQ ID NO: 4172666 - RNA, 88 nt, Human
aggcaacaugguagaauccaaggcaugcaaugucuucagguaaucagaaugccugugcucccauagcuucugugauuuuuuuaugccu

SEQ ID NO: 4172667 - RNA, 56 nt, Human
aggcaagaaagguuaaauucaaagcuaccugcacaaauuucagacccauuuugccu

SEQ ID NO: 4172668 - RNA, 65 nt, Human
aggcaagacuugaacucaagcagccugguucuggagacggugcugagcugcuguucauccugcuu

SEQ ID NO: 4172669 - RNA, 111 nt, Human
aggcaagcuaggugccuagggcacaaaauuuaaggaggugcucacuuccagggcaugcguaugcaaguuagugccuccuuaaauuuugcucccuuggggccugcuuugccu

SEQ ID NO: 4172670 - RNA, 62 nt, Human
aggcaaggugacucuggguucaaggcucaccagcuggugacccugggcaagucaccuaaccu

SEQ ID NO: 4172671 - RNA, 67 nt, Human
aggcaauauguucuuggaaaugaagcuuaagucaggucuucaggugacauucagagaacauuugcuu

SEQ ID NO: 4172672 - RNA, 81 nt, Human
aggcacaaugaauuggaaugguguuagaaagauuuucucuagggaagacuacauuaugacagcauuuuccaaaguguguuu

SEQ ID NO: 4172673 - RNA, 64 nt, Human
aggcacacuuauaauaaguauccaccucccagagcuuugugugaauugcuugugaagugugucu

SEQ ID NO: 4172674 - RNA, 57 nt, Human
aggcacaggucaaaucugacucaggaagaaaacuucuuacuaugauuugagccuccu

SEQ ID NO: 4172675 - RNA, 67 nt, Human
aggcaccauuuucuaaaaauaugacuagggugugaccuaagguuuuauucugugaagaugaguaacu

SEQ ID NO: 4172676 - RNA, 66 nt, Human
aggcaccggcagauuuggcaucuggugagggccuguuucucauagauggcaccuucuguguguccu

SEQ ID NO: 4172677 - RNA, 67 nt, Human
aggcacgaaguguugugugucaagugcaagagcugaaguucugcauuauacacaaccuaaguguccu

SEQ ID NO: 4172678 - RNA, 75 nt, Human
aggcacgcggcuuuccaguucugggcuggcugcugcagcuccccugcagacacuggccuccugaggcugcuguuu

SEQ ID NO: 4172679 - RNA, 59 nt, Human
aggcacugacucaagggagccaagggccaagcauagaaggcuuccuggaggcagugucu

SEQ ID NO: 4172680 - RNA, 71 nt, Human
aggcacugcuauuauuagacaauguguccuuccuucuaaggaaacccacgcugguggauaagcagugaccu

SEQ ID NO: 4172681 - RNA, 67 nt, Human
aggcacugcuucuaaguaggaaucacacugcaguggguuagugacacccugcucagaaauggugccu

SEQ ID NO: 4172682 - RNA, 69 nt, Human
aggcacugugcuucuuauauguuuucuuauuuaauucccaaguccuacaagggaagcacauuauugccu

SEQ ID NO: 4172683 - RNA, 55 nt, Human
aggcacuuguaauugcagucauacagauauuuguaugauuaucaacuuaaugccu

SEQ ID NO: 4172684 - RNA, 114 nt, Human
aggcagacagaaggggaagccacuagcuucggguccuccucacugguuccuuuccuuggagcagggaaacucacaggugcaggggcacuggaaguggcuaucugccuuccgccu

SEQ ID NO: 4172685 - RNA, 64 nt, Human
aggcagagaaaaaccagauaugccuggagauacagguaaggagucuguguucucucagcugucu

SEQ ID NO: 4172686 - RNA, 83 nt, Human
aggcagagaaagucuggcucuggaaggcaaagggcaguuguguucccuuugauguucagagcauggguuugguugaucugccu

SEQ ID NO: 4172687 - RNA, 65 nt, Human
aggcagagcuacaagaagacagugccacauuauuuucauuggaaucuauguacgcaucuaugccu

SEQ ID NO: 4172688 - RNA, 58 nt, Human
aggcagaggaaaaguaaauucuaggaucacaacucaugaguuaauuugaccccugccu

SEQ ID NO: 4172689 - RNA, 56 nt, Human
aggcagaggaaggguggauuugcucucugcuugagcuggaacauccaucuucuccu

SEQ ID NO: 4172690 - RNA, 72 nt, Human
aggcagagggacagugaggaauuugcccagggaggaccaagagaacugguuccucaugaguaccccuuaacu

SEQ ID NO: 4172691 - RNA, 62 nt, Human
aggcagagguagcuggaaccaggaacaaaggacugagucugggguuggguuaacuacugcuu

SEQ ID NO: 4172692 - RNA, 86 nt, Human
aggcagcccucauccuggacacccauuccuuggcuguacccaacagaccacugcuuucagggagccgugccagugaguagcugccu

SEQ ID NO: 4172693 - RNA, 58 nt, Human
aggcagcugaggucuggcgcccccuggcccccaguggaagcaaggauaaagcugcucu

SEQ ID NO: 4172694 - RNA, 55 nt, Human
aggcagcugucuccauggagguuucuuugucuccaaguucuaggaacugcugccu

SEQ ID NO: 4172695 - RNA, 59 nt, Human
aggcagcuuuuacuuaucuaugcugcccacgcuuaacauggaaaacugaaagcugaccu

SEQ ID NO: 4172696 - RNA, 129 nt, Human
aggcaggcagaacacagggaggagucugauguuggaagguucuggucaugguuuugcuacuaauuuaucacauaaccuugaauaaaccucuuuaucucuuagacccucuguuuucuucucuguuaaacu

SEQ ID NO: 4172697 - RNA, 59 nt, Human
aggcagguagaaggaucuuuaugcaguagcacuauaagauugccccauuuacacugccu

SEQ ID NO: 4172698 - RNA, 74 nt, Human
aggcagucacaaagugguuuuaagagguuccuuauaaggcacauuaaaaguagccaacacccuuuccauugcuu

SEQ ID NO: 4172699 - RNA, 96 nt, Human
aggccagacugcuacccuuagggaaguggucugggaacuugggauuuccgagugucccuaccauuuccuaacugguaagggugguuuacugggccu

SEQ ID NO: 4172700 - RNA, 65 nt, Human
aggccagaugucgggcuagaaguacaaucccauaucuuaugaauuuguagccuuuuaucuauccu

SEQ ID NO: 4172701 - RNA, 87 nt, Human
aggccagugacucugcccucugaccuaggacaaggaccugccuccguccucugagaacaccuggcguccaagggaacacguggaccu

SEQ ID NO: 4172702 - RNA, 64 nt, Human
aggccaguuuuuggagggaaacaucaauacuguugccauucaguucucuaugccaugcuggccu

SEQ ID NO: 4172703 - RNA, 61 nt, Human
aggccauaucuacucacuguccauuucaucugugggacacuugacgugagggacauagcuu

SEQ ID NO: 4172704 - RNA, 55 nt, Human
aggccaugggauuuccaauuggcugucaaaaaggaaaguucugagucccuggccu

SEQ ID NO: 4172705 - RNA, 91 nt, Human
aggccauuuaaauaucacuucuuuugugauucuucaguuacuucaggccaucuggauguauacaugcaggucacaggggaugcuauggcuu

SEQ ID NO: 4172706 - RNA, 86 nt, Human
aggccauuuucacuucuuuugugauucuucaguuacuucaggccauguaggcguauaggugcaggucacaagggaugugauggcuu

SEQ ID NO: 4172707 - RNA, 72 nt, Human
aggcccacuaagcugugugguucacucagcaucacguggcuaauaugauaugaagccacacuagcuuguccu

SEQ ID NO: 4172708 - RNA, 74 nt, Human
aggcccagagggcaaguguaguccaguagaaaaccuccaucuuggcuccuggagauaauuugcauugugggucu

SEQ ID NO: 4172709 - RNA, 77 nt, Human
aggcccagcagccucugguccucccucagcuccccucugcccuuguggcugggagugggagcaggggcucugggccu

SEQ ID NO: 4172710 - RNA, 102 nt, Human
aggcccagccuucucacccacccagccccacacggucuagcucugccugaaguaggugcuuggcucgugcacacagauggacggguggaugcggcugggccu

SEQ ID NO: 4172711 - RNA, 93 nt, Human
aggcccaggugaggagaaauggugggcugagucucaucggaaagcacuguuuccugggacucagucccauucagagucugucucccuggaccu

SEQ ID NO: 4172712 - RNA, 76 nt, Human
aggcccaucucagucagguugaauuuggcugaccaagucaggaaaucagaggaccuuacugagaaccugggggucu

SEQ ID NO: 4172713 - RNA, 86 nt, Human
aggcccccagcagauggagaauggagucaggaccagaauccaggccuucugacuccuuaccauaugcuuuccagggagacuggccu

SEQ ID NO: 4172714 - RNA, 66 nt, Human
aggcccuguccauggugcugaaggacacauuggggaaguucugaaguucacagcacugcagggccu

SEQ ID NO: 4172715 - RNA, 92 nt, Human
aggcccuuucugagccucaguaucuccacauguaaagugcaaaugauaaccaucucuacuuugugaugaugugcugaggcuucccugggcuu

SEQ ID NO: 4172716 - RNA, 105 nt, Human
aggccgaguguaaggagcagucauggucuuucauuccuggcccacccagcaggauguauacaggcauaagagauacaugaaagacugucucucaacacuuagcuu

SEQ ID NO: 4172717 - RNA, 100 nt, Human
aggccucgagggagggaugucucaggccccauuccucuugggacagcugaguggucucugagggugggagcugguuugaggcuucuuccgcagcuggcuu

SEQ ID NO: 4172718 - RNA, 105 nt, Human
aggccucuccaucuugcucuucccaucuuggccuuacuugaugauguauaaaguccucuaaauggucuuaugacuuaagugggcccaggggaggggagaggaccu

SEQ ID NO: 4172719 - RNA, 92 nt, Human
aggccugaaaaaguaaaauucaaucuucacugguaaugaaauauuaaauuaguguggacacaguggagagacuuuuacucuuuugcuggccu

SEQ ID NO: 4172720 - RNA, 59 nt, Human
aggccugaaggaagaugagcugauggcauucccagcuuauuaccacuccuugggggccu

SEQ ID NO: 4172721 - RNA, 55 nt, Human
aggccugacuugaauuuagggcugcaaucagaugcacugagaucaauguuggccu

SEQ ID NO: 4172722 - RNA, 59 nt, Human
aggccugaggggcugcgugauguccuggaggggccuccugcagagccgcccucaggucu

SEQ ID NO: 4172723 - RNA, 55 nt, Human
aggccugccuggagccuggcuggcuccugagugagcuaggacuauaggcagcccu

SEQ ID NO: 4172724 - RNA, 66 nt, Human
aggccugcuguguagccuguugucugacuuccucgugcuuuguucucccaggcacgcugcaggccu

SEQ ID NO: 4172725 - RNA, 62 nt, Human
aggccuugggauguggcugcagcugggucagucagccaggcugaagcccacucccugggucu

SEQ ID NO: 4172726 - RNA, 55 nt, Human
aggcgcagacauacagggucugucacucacccgugcucagguggcugcugcgccu

SEQ ID NO: 4172727 - RNA, 99 nt, Human
aggcgcuccuuggucaaaugaggaggcaggugcucagggcucuucaggauuuaaaggugagccagacauggcuccugcuccugcacucaaggagccccu

SEQ ID NO: 4172728 - RNA, 66 nt, Human
aggcgggugguucacuugaggucaggaguucuacacuacccuggccaacauagugaaaccucgucu

SEQ ID NO: 4172729 - RNA, 56 nt, Human
aggcgguccacugucccagugggaccugacguggcccagaguggacgguggccccu

SEQ ID NO: 4172730 - RNA, 75 nt, Human
aggcgguggacggcgugaguccugcucugggcagggugaggggccagccugccugcagggcugcugucccugucu

SEQ ID NO: 4172731 - RNA, 104 nt, Human
aggcuaaagaggggagccccagaaagcuuugcuggaaggaagagaaagacaaaagccuugccuuuucucucgguagaagcugucggucauggcucuucuagccu

SEQ ID NO: 4172732 - RNA, 67 nt, Human
aggcuaagaggccuucagauacuggaacuuacaccagcagccccccaguuucuuaggccuuuggccu

SEQ ID NO: 4172733 - RNA, 80 nt, Human
aggcuagagaugaaggcuuucuccccucugguugguguucuagcuggccuggggagagggccacauuugaacucuagucu

SEQ ID NO: 4172734 - RNA, 61 nt, Human
aggcuagcuuuggcucaguaaauuugcuguguaaugauuuucuaaugaguuaggcuggcuu

SEQ ID NO: 4172735 - RNA, 56 nt, Human
aggcuaggcugaugccucuuccuuugcuaugugagaccugaaggcaaagucugccu

SEQ ID NO: 4172736 - RNA, 55 nt, Human
aggcucaagagagcuggaugucaagauagauucuucacacaugcuccuggagccu

SEQ ID NO: 4172737 - RNA, 64 nt, Human
aggcucacccagggucaagagacuccagcagccuggcugcugcaaggcuugaaccuguugacuu

SEQ ID NO: 4172738 - RNA, 61 nt, Human
aggcucagaaggacucacuagugaauacuguaguagugaacacuguauauucuucuugucu

SEQ ID NO: 4172739 - RNA, 58 nt, Human
aggcucagagagcuguguccauauaacacuaagaaauggaauccaaguucccuggccu

SEQ ID NO: 4172740 - RNA, 59 nt, Human
aggcucaguucacgucaacuuucuuguuaggaaaagcacacuguugacuaauugagcuu

SEQ ID NO: 4172741 - RNA, 62 nt, Human
aggcucauucuugccucugagcucucacacuggcuauuugcucaccaggcaggacuugacuu

SEQ ID NO: 4172742 - RNA, 56 nt, Human
aggcuccaggcccuucaccagcugcagccacucuugcugaugguagucuggggucu

SEQ ID NO: 4172743 - RNA, 79 nt, Human
aggcucuaagugguccugaguagcuuuagaaucugaauaaaucacacauacuagggauccaucgagaccacuagaaacu

SEQ ID NO: 4172744 - RNA, 75 nt, Human
aggcucuagucaagaaugaauucgagugaaggaaagcugugugacaccuggccuuccucuauguucauggagcuu

SEQ ID NO: 4172745 - RNA, 84 nt, Human
aggcucugagagacgagacagaaguuucaaguaagaagugauuauucgcuguacuauuugagacuacugaaacgcucaucgccu

SEQ ID NO: 4172746 - RNA, 68 nt, Human
aggcucugaucagguggcuguggggcccuaauccagaaugagcacaguuauuuugaucaauggagucu

SEQ ID NO: 4172747 - RNA, 59 nt, Human
aggcucugcagaccccagcugucaaauccaaauggagcuggguuuacugcugcaggcuu

SEQ ID NO: 4172748 - RNA, 67 nt, Human
aggcucuggguguuaaugucaguguuaugcagaaaauuacccuagacauagauagcucccagcaucu

SEQ ID NO: 4172749 - RNA, 62 nt, Human
aggcugaggugcuuggggacagaucgggccaccuugcccagcaguacccaagcccuuggccu

SEQ ID NO: 4172750 - RNA, 58 nt, Human
aggcugcagugcagguaggauugucaugcugauuaaaaccuggacacacuugcagcuu

SEQ ID NO: 4172751 - RNA, 64 nt, Human
aggcugcuucagcugcagggagccagugaaaucgacaauuggagcccacagcuguaagggcucu

SEQ ID NO: 4172752 - RNA, 80 nt, Human
aggcugcuucuuguccuuggcauagugauguauaaaacaaacaaccccaucacaauuuugccagacaaaaguaacugccu

SEQ ID NO: 4172753 - RNA, 79 nt, Human
aggcuggagugaaguggcgcgaucucggcucacugcaagcuccaccugccggguucacgccauucucucgacucagccu

SEQ ID NO: 4172754 - RNA, 79 nt, Human
aggcuggagugcaauggcgugaucucagcucacugcaagcuccgccuccugaguucaugccauucuccuaccucagccu

SEQ ID NO: 4172755 - RNA, 79 nt, Human
aggcuggagugcaauggcgugaucucagcuuaccgcaaccuccgccuccuggguucaugccauucuccugccccagccu

SEQ ID NO: 4172756 - RNA, 73 nt, Human
aggcuggagugcaauggcuugaucuuggcucacugcauccuccgccugccagguucaagcgauucuccugccu

SEQ ID NO: 4172757 - RNA, 79 nt, Human
aggcuggagugcaguggcgugaucucagcucacugcaagcucugccucuuggguccaugccauucuccugcuucagccu

SEQ ID NO: 4172758 - RNA, 63 nt, Human
aggcuggagugcuggagugcuggagugcaguggugccaucucagcucacuauagccuccgccu

SEQ ID NO: 4172759 - RNA, 56 nt, Human
aggcuggcggugacugcucugaucacuacgugcugugaagggcacggugccagccu

SEQ ID NO: 4172760 - RNA, 74 nt, Human
aggcugggcauuuacauaaucuuauuuaccuucacuacagcccucaaagguagauauugugaauguuccaguuu

SEQ ID NO: 4172761 - RNA, 83 nt, Human
aggcuggggacccagggaagagccgaugcugcagcucagcgucugucugcaggccgagcuccuucucggggaguucucagucu

SEQ ID NO: 4172762 - RNA, 59 nt, Human
agucugagccugggcguuucucuagugugacaccacugaggauuagcccaggcuagauu

SEQ ID NO: 4172763 - RNA, 67 nt, Human
agucugcagcugauagucagauaucagagacaaaaaucucugaaauaaaugcacuguuaggcuuacu

SEQ ID NO: 4172764 - RNA, 125 nt, Human
agucugcaguguuuggaugggcaggugaacuacugauuuucaaccaaaaauuguuuuucucauuguucuuuggaguguuaucaguaauuacuaauuuugaaucuauaccaagcaaaccccagauu

SEQ ID NO: 4172765 - RNA, 81 nt, Human
agucuggagacuguggugaagagccuguuucuuggagucagacugcuuggcuucaagucuagguucuaccacuaacuagcu

SEQ ID NO: 4172766 - RNA, 81 nt, Human
agucugggaggcuaaccuggcagcuuccuuugcaucugucuuuugugcagauugcacgggggcuguugugucucuuuugcu

SEQ ID NO: 4172767 - RNA, 75 nt, Human
agucugggaucaaaauuuuauuucucaaggacuucagagauuccuaagaauauuaaaauuugagaauugcagauu

SEQ ID NO: 4172768 - RNA, 84 nt, Human
agucugguggaaaauagaaugaggcugagaauucugucuuuugacauauucuccaguagucauucuaucaagucaaacuaaccu

SEQ ID NO: 4172769 - RNA, 89 nt, Human
agucuguuuugagaugcaagcaagucuauuuuacaguuuaaaaagagagagagaaaggaagaaagaaaaugcuagccuuaacacaggcu

SEQ ID NO: 4172770 - RNA, 65 nt, Human
agucuuaacuaugcaaguacuauguauuccaauacacauagacacaucaaguauaguuaaggacu

SEQ ID NO: 4172771 - RNA, 83 nt, Human
agucuucaucugucuagcucaccaacuucaauugauggguaacagaaggucacaccugguuggucagcucaauggagaggguu

SEQ ID NO: 4172772 - RNA, 77 nt, Human
agucuuccuugcccaccauccaauaaaauggacaaauguucaccauuuugcugcauugauugguggcgagucagguu

SEQ ID NO: 4172773 - RNA, 63 nt, Human
agucuuggcagcagcugccuuucagacccaucugguuugaauuggcaaaacugcagcugugcu

SEQ ID NO: 4172774 - RNA, 64 nt, Human
aggcccugaaacccugucauggucuuugucuccagcuuccaaagcccugaagguuucaggcccu

SEQ ID NO: 4172775 - RNA, 58 nt, Human
aggcccugaucuccuggauucuucuauuaauauaaaaggaucucugagaucauggcuu

SEQ ID NO: 4172776 - RNA, 128 nt, Human
agguaaucucauuccacuagaguuuuucaaaccagugauagacuagacacagagcacaugcccuguaagauguguguggugcuguuuugucuuuggauuguauuacugugccuugaaugacauuaguu

SEQ ID NO: 4172777 - RNA, 87 nt, Human
agguaaugaguuuguaugacaggguucuagcgcuucaugggggaagaaagcuacaagucuugucauucauuucauaaguuuuuaccu

SEQ ID NO: 4172778 - RNA, 65 nt, Human
agguaauguugauguagggauuccuguaaaauaaagaauuuucagggguaauauuugcaguacuu

SEQ ID NO: 4172779 - RNA, 67 nt, Human
agguaauuucuccaaacaugcuacuuacucaacaaaaaguagucuaggugucuuagagaaggugcuu

SEQ ID NO: 4172780 - RNA, 71 nt, Human
agguacagaggucaagaucugaagugaggaauccaauuuccuucuuuggcuuacgucuggccuguguucuu

SEQ ID NO: 4172781 - RNA, 63 nt, Human
agguaccaugcugaaugaaagaaauuaguuucaaaagcuaugauuucauuuagaugacauccu

SEQ ID NO: 4172782 - RNA, 83 nt, Human
agguacuaugaguaagaauauuuuuuuaaagugugcugugaauucugaagaagacaugagagaaaaguauucugaggguuccu

SEQ ID NO: 4172783 - RNA, 76 nt, Human
agguagaaacaaaggaauaagagucaaaaugguuuaauucagggccauguuguaucucuuaucggccuucugcacu

SEQ ID NO: 4172784 - RNA, 59 nt, Human
agguagaggccuccaggcagcaacugagguuauccauugggcagccaggugcucuaccu

SEQ ID NO: 4172785 - RNA, 61 nt, Human
agguagauaugcugcugcuguagugaaguuuuaaauggacaagcagcccagugcucugccu

SEQ ID NO: 4172786 - RNA, 65 nt, Human
agguagcagaacuauucauucucauuagcgucauagauguuuucauggagaugguggcguugccu

SEQ ID NO: 4172787 - RNA, 82 nt, Human
agguagccugauacagaaguuuuccacuuauuuagccaauuugacuuaggugcuaaucuuucuuauguuaaaagugcuaucu

SEQ ID NO: 4172788 - RNA, 120 nt, Human
agguaggaaacaaacuugcaaaaaacgaugacuugaaauaagaguguagaccuuuauucuuggccccauagauuagcccuauaguuuuacaagauauuuugggcaggauauuuucuaucu

SEQ ID NO: 4172789 - RNA, 58 nt, Human
agguaggaauaaccuuuguaauucaugauuacauaauuacaaugagacguucuuaucu

SEQ ID NO: 4172790 - RNA, 63 nt, Human
agguagugccuccccuaaguccaggcagccucacccauggcaggacagaggagaaggcacccu

SEQ ID NO: 4172791 - RNA, 60 nt, Human
agguaguguagcugagugggaucccaucuaagacccaucugacuccaaaagccacgaccu

SEQ ID NO: 4172792 - RNA, 129 nt, Human
agguauaucacuaacgauacuuuaaaauuucaauuuaugauuagccuauuguuggaaucaugauugcaauaaugagaaugagaauaaaauaguuaaugagugagaaaaaaaggagagagaaaauguacu

SEQ ID NO: 4172793 - RNA, 60 nt, Human
agguaucauccagcuaaguuacauaugguuuccauauuagcuuguuuggcaggaugaccu

SEQ ID NO: 4172794 - RNA, 79 nt, Human
agguauuaaguggcagagcugugucuugaaaacagagguucugauucuaaguagaagccuguccuacuaauucaugccu

SEQ ID NO: 4172795 - RNA, 71 nt, Human
agguauuagaagagucaugggacccuugcaguuuuuguaggacuaacgcucucugugacauuucugagccu

SEQ ID NO: 4172796 - RNA, 80 nt, Human
agguauuuguuacagcagcaccccacuucucaguaccaauuucugucuuaguccauuugggcugcuauaacaagauaccu

SEQ ID NO: 4172797 - RNA, 64 nt, Human
aggucaacagagacagagacacugagugaugucccuagccccgguguuuccuccucuguuuccu

SEQ ID NO: 4172798 - RNA, 97 nt, Human
aggucaaggaggucugcugggugaggaagcuuucugguuacuucccaaggggcuaggccaggcucuuccauuuggguccaguuucuaccuccuuccu

SEQ ID NO: 4172799 - RNA, 56 nt, Human
aggucaagggcaagagugaggucaggggccuguccccaccaugugcccauuggcuu

SEQ ID NO: 4172800 - RNA, 61 nt, Human
aggucaagguucacaggggaucaagaaauauuauucuuguauaaucuguuuacuuugaccu

SEQ ID NO: 4172801 - RNA, 90 nt, Human
aggucacacagcuaaaugcgaacacacuugggaguucugagagcuuucugcuucagcucuuggguuguuuuauuuuccuauugugcaucu

SEQ ID NO: 4172802 - RNA, 83 nt, Human
aggucacagcucagguggcugagcugaccuuugaacccaaaucagccuggcucacagcucaucacuaccugaugcugccuccu

SEQ ID NO: 4172803 - RNA, 69 nt, Human
aggucacugguccuucucugccugcagugugguggugccuacguagagcagaagcaggaagggaagccu

SEQ ID NO: 4172804 - RNA, 66 nt, Human
aggucagcauaguucacacacaguccugauagcuaacagucggcugugcccauauucugcugaccu

SEQ ID NO: 4172805 - RNA, 75 nt, Human
aggucagccaggaagcggugagggcugcccuggucccugcgcgucacggcugucuucucucuucucucucuaucu

SEQ ID NO: 4172806 - RNA, 67 nt, Human
aggucagugaccuuaguaaaaggaauuauaugacuuuuguuuccuuuauacaagaaaccgcuggccu

SEQ ID NO: 4172807 - RNA, 64 nt, Human
aggucaguguucuuauuuaauuagguauucuugaugccuauuuguuggaaaagaacauuugucu

SEQ ID NO: 4172808 - RNA, 101 nt, Human
aggucauagagcuggaaauuggcagagcugggacuggaagccaggccaggcaccuggcuccugaguuucagcucuaagccuaggccauccuacgcugaccu

SEQ ID NO: 4172809 - RNA, 67 nt, Human
aggucaucagaccugccagacuaggucauuucaugaaauacauauaacuuacauggcucugaggccu

SEQ ID NO: 4172810 - RNA, 62 nt, Human
aggucaucuuggcccaguggcuuguuuuaaaggaggaggaaacugagggccagagaggaccu

SEQ ID NO: 4172811 - RNA, 70 nt, Human
aggucauuccuugucuucuugcaaacuuauuuucuuugacucaguguucccaaugagcgaggaaugaccu

SEQ ID NO: 4172812 - RNA, 60 nt, Human
agguccacaguucagcugcccaagaggagcucaauccugccagcagcaacaugugagccu

SEQ ID NO: 4172813 - RNA, 57 nt, Human
aggucccugaagaugccugaggagaugguguccaauauucuauaacuucagggauuu

SEQ ID NO: 4172814 - RNA, 64 nt, Human
aggucccugggagacagaguauuggaaucuaacauucaagucgugcuugucugccuagaggcuu

SEQ ID NO: 4172815 - RNA, 110 nt, Human
agguccguaauuuaaccaacaugcaccagaaugaucauuuggauuaauugggcaucucuucuaauuggccagugcuugugauuuucuguuuguugaguacuuaggauccu

SEQ ID NO: 4172816 - RNA, 56 nt, Human
agguccugacgugcuccagggcugacucggccuccucccuccagcaaccaggacuu

SEQ ID NO: 4172817 - RNA, 82 nt, Human
agguccugcaguuuuguggagagcaaauaauuggaauccaucugaccuacaggaggaucauuugcccaagcuuuagagacuu

SEQ ID NO: 4172818 - RNA, 68 nt, Human
agguccugggaagaugcucaugacuccuccccucuccucacugagucugaccucuaucucccaggccu

SEQ ID NO: 4172819 - RNA, 70 nt, Human
agguccugucaaaguugucccccacuggaacuaaauaacucuaccuccaacagcuguuagauaugggcuu

SEQ ID NO: 4172820 - RNA, 68 nt, Human
agguccuguuauccucagcucaccucuagaugcgaaacuagaggccgaaugcugagcugggagggccu

SEQ ID NO: 4172821 - RNA, 100 nt, Human
agguccuugugcaaguaucagugauugcuguauacaaaauagcugccuccuccccuuugcugcuuuguauuucucuguagcacugaucaguaacuggccu

SEQ ID NO: 4172822 - RNA, 62 nt, Human
aggucuacaugcuuaauauaucaaacaaauuauagcuuuaggugauugagcaugacagaccu

SEQ ID NO: 4172823 - RNA, 67 nt, Human
aggucuccaagaaggguggccaggauggcauugacaucucuucacagguggccuuggugagagaccu

SEQ ID NO: 4172824 - RNA, 76 nt, Human
aggucucucauuugugugagugauuugacaaccugauccuugguguuagcucaaucuucacagaggagguagacuu

SEQ ID NO: 4172825 - RNA, 69 nt, Human
aggucuggaaucagaccuaaucccagccucucugcuaguuugcugggauuaggucugauuccagaacuu

SEQ ID NO: 4172826 - RNA, 70 nt, Human
aggucuggggcaguuacuggggccuagaugccacuccuccugggucccaggagcuaacugccuuuguucu

SEQ ID NO: 4172827 - RNA, 84 nt, Human
aggucuucugggcucacagagcagcagaugagaaggcccuaaaggcagggauggugccuggugccuggagaaucccagaggccu

SEQ ID NO: 4172828 - RNA, 60 nt, Human
aggucuugaaagaaaaagggauuugcugugaccucugcagcagcuuccugcucuucgccu

SEQ ID NO: 4172829 - RNA, 56 nt, Human
aggucuuuaguggcagagucuaggucuuuuccuuacucuguaauucugaagcaccu

SEQ ID NO: 4172830 - RNA, 82 nt, Human
aggugaacaguuuaucaaguuuuuacaguauguacuuuaaauauuuuggaugugaagauuugacauaaaauugauuccacuu

SEQ ID NO: 4172831 - RNA, 64 nt, Human
aggugacccugagaagagcuuaugagugacagcccuguguuaugaagucuucucagggcaaccu

SEQ ID NO: 4172832 - RNA, 73 nt, Human
aggugagagguuauaaaucagggucauuuaagcucuguuguaccaacaaaugaaccugaaaucucagucacuu

SEQ ID NO: 4172833 - RNA, 92 nt, Human
aggugagcagaaacaucuugggaagagggaaccacgacuguaucuuccucagcagacaugauggugcaggguaccccuuccccugcccaccu

SEQ ID NO: 4172834 - RNA, 66 nt, Human
aggugaggagagggugauuuaagugggauacauuacagaaaaucuauaaagucaccccugcucccu

SEQ ID NO: 4172835 - RNA, 58 nt, Human
aggugaggagcuucucuuugcugguagagcacugcccaaaugaagaaccuucucaccu

SEQ ID NO: 4172836 - RNA, 61 nt, Human
aggugaucgcuuuacuuguccagaggccugaccaagguaggccucucugaagaggucaucu

SEQ ID NO: 4172837 - RNA, 56 nt, Human
aggugaucugccaccuuggccucccaaaguguugggauuacaggugucagucaccu

SEQ ID NO: 4172838 - RNA, 71 nt, Human
aggugauggaaugaacauaauguuaaaagugcccacaguuuuuggugcugcacacuguucuucacacauuu

SEQ ID NO: 4172839 - RNA, 58 nt, Human
aggugcauuaauggaagagcaucaucccagauucuugcacuucuccauagaugcaucu

SEQ ID NO: 4172840 - RNA, 61 nt, Human
aggugccaaaauauuagugcuuaaguacacugauggugugcuaaaggcagaauauucaccu

SEQ ID NO: 4172841 - RNA, 102 nt, Human
aggugcccuccuucacguguaacaaagugcguuuagaguuguaaaccacaggguuacaacugcacaucugaaucacugcauauuuguaaguagagacuaccu

SEQ ID NO: 4172842 - RNA, 57 nt, Human
aggugcucagaaacgaggugcagcccaaaaagauggccccuccuuuccugagcagcu

SEQ ID NO: 4172843 - RNA, 86 nt, Human
aggugcugaggaccccaaacacagagggcccccuggccacagucugugugagcuggcuggguccaugguccucgggucccucuccu

SEQ ID NO: 4172844 - RNA, 93 nt, Human
agguggaacauauauggcuggcauuuauaucccaguuuaugauuuauaaagcaagaacaaaauuaugaagggaauauaagugcugccccaccu

SEQ ID NO: 4172845 - RNA, 128 nt, Human
agguggacucuaggggacgcucacuuggaacuugcaucacccggaacugugucugccacugugacuucagagcagcacagaccugagguggauccagcaaugcccacaacuguccaacaauuucacuu

SEQ ID NO: 4172846 - RNA, 81 nt, Human
agggucauggaguaaguaaauguuggagcucaaauuugaaaucaggcaguucaaauguauacuuuaccaccucuagaucuu

SEQ ID NO: 4172847 - RNA, 67 nt, Human
aggguccuaagccucagauaagaccccagccccagcugacaccuuaauuuuagccuuacaggacccu

SEQ ID NO: 4172848 - RNA, 59 nt, Human
agggucgggggagaagaggccugggcaggacaggccaccugggaucucauccuggcccu

SEQ ID NO: 4172849 - RNA, 89 nt, Human
auagaaggccuuguuguguguaacuugaagaaauauaggcaaguucagagucucauuugucuucacauucacguaacauagguuucugu

SEQ ID NO: 4172850 - RNA, 103 nt, Human
auagaauaaagagauaauuuuauagcaaagaggagaccuaggcagcuuuuccuagcuguuuaugugccucuucuuuuuaauauugaagcucuuaaauuuuuau

SEQ ID NO: 4172851 - RNA, 99 nt, Human
auagaauuaaauauuugaacagggcuugugacaacuuuaauuuaguugaaaggaacugaaaacuuaauguguguacaggauuuugugggagcguucugu

SEQ ID NO: 4172852 - RNA, 75 nt, Human
auagaauuguuuggcgaugagaagagugcucuguucagaaauccuacguugcauuuauuaucugccaggcacugu

SEQ ID NO: 4172853 - RNA, 61 nt, Human
auagaccuucuacacaggacaauaaauucauaaagcuuuucucuugaugauaggaggcuau

SEQ ID NO: 4172854 - RNA, 61 nt, Human
auagacuguggaagacacagaagcuccaagacauggggcuucucaguaguacacacacuau

SEQ ID NO: 4172855 - RNA, 58 nt, Human
auagagcagaaugguuaaaguggaauuucagucuacacagagcuguuguugacucugu

SEQ ID NO: 4172856 - RNA, 65 nt, Human
auagagcagauagugaaacagaauaguguauuuaucuauaugugucuuucugugcaucuuucuau

SEQ ID NO: 4172857 - RNA, 82 nt, Human
auagagccuuuggguucaaucucggucugguaugagccagcuggguguucuugggccuaauuuguaaaauaaaggcaucuau

SEQ ID NO: 4172858 - RNA, 63 nt, Human
auagagugauguaagguaugugaagugccuggccacaguuuacccucaacaaauucacucuau

SEQ ID NO: 4172859 - RNA, 70 nt, Human
auagagugggaggaagaauauggucuacauuuccuuggaacuuuagauacauuuuucuuuccuguuuuau

SEQ ID NO: 4172860 - RNA, 74 nt, Human
auagauaaauagaugcacaaagcagagggaaucaaguagaauaacaugguuuauuuguguguguauuguucugu

SEQ ID NO: 4172861 - RNA, 74 nt, Human
auagauacacauguacauacauagauauacacacauguauguguguauauguguguguguguguguguauauau

SEQ ID NO: 4172862 - RNA, 112 nt, Human
auagauacuuggacaugcugaccucaaaaucuaccucgcuuuuuugcuggggaggugaaccuucugccagagacuggcugagagaucuuggguuaaugcucugagucucugu

SEQ ID NO: 4172863 - RNA, 78 nt, Human
auagaugggauugugaauugagaguacuucucucaucuucagagagagguccaugucucaauucuuaacacuauuugu

SEQ ID NO: 4172864 - RNA, 95 nt, Human
auagauucagccuuucccagccacagguguagcccucaaccuccccuugcccucccuggguagaggcuccuagccuguggcuggugcuguucugu

SEQ ID NO: 4172865 - RNA, 87 nt, Human
auagauuuuaucuucuuuugcuuguguuuacucuucauucuccaguuugaauugugauaacucaggcagagaauaauugaaauuugu

SEQ ID NO: 4172866 - RNA, 68 nt, Human
auagcaaaaggcaccagagugaaagagaaaccacuaagacaauuuuuuguucuugggcauuuugcugu

SEQ ID NO: 4172867 - RNA, 76 nt, Human
auagcaaucaguguauuugaaaguccauguaagccuuuccccuuaucccugacccugaaauaacugaaauugcugu

SEQ ID NO: 4172868 - RNA, 86 nt, Human
auagcacaaagucuugcccuuuugugaaucuggaaauacugaauagcacccuguacuuuggccaaaaggguaauacuucuugcugu

SEQ ID NO: 4172869 - RNA, 61 nt, Human
auagcaggaccaggcguucugggcugucuuccucaaaggcagucuggaucugugcugcugu

SEQ ID NO: 4172870 - RNA, 61 nt, Human
auagccuggagaagauguguauuguacacaggaauaugaaugcacugcucuccuaggaagu

SEQ ID NO: 4172871 - RNA, 95 nt, Human
auagcugcugucacgcucccugugucuucuugccuuuguguccauccaacuggacagggaacuccaugaggccagagagugucucccagcauuau

SEQ ID NO: 4172872 - RNA, 78 nt, Human
auagcuuuaaauauuaucauucaagacccuucucauuagaauuguuaggcacuugaauugaugauguuagaaggcugu

SEQ ID NO: 4172873 - RNA, 72 nt, Human
auaggacuccuugugccauaaccacccugacuggggaucuagauccauaagguggggauggggcaggccugu

SEQ ID NO: 4172874 - RNA, 61 nt, Human
auaggacuuuguaucaggaugaguugaaaucugaguuuaccauucuguguaaauguccugu

SEQ ID NO: 4172875 - RNA, 93 nt, Human
auaggcaaauuaauucaaguguccaaauuauacaguauuuuucauggguauuauauaaaauucuggaagcuuuuaguguucaguucugcuugu

SEQ ID NO: 4172876 - RNA, 92 nt, Human
auaggcagcugggcgagagggaauguagcagagcuaaaauugcccuagacuagugaugcaaagauuuaucuuucuccaaauccacugcuuau

SEQ ID NO: 4172877 - RNA, 59 nt, Human
auaggccuguuucuuguccagcucuauguagagaaggacuacggaaaacagaugcuugu

SEQ ID NO: 4172878 - RNA, 67 nt, Human
auaggcgucuccuucaauaaucugggccucugaucuccggcaggccuguaaugaagggacaguuugu

SEQ ID NO: 4172879 - RNA, 78 nt, Human
auagggaguaacugggagacaagagagggcugacaggauggaacugucgcugucaccaguuuccuuuuugcucucugu

SEQ ID NO: 4172880 - RNA, 76 nt, Human
auagggaucuauuguuuuauuaaaugagcccuggggaacauuuuuaaaggguucaaaagugagaggggauuccugu

SEQ ID NO: 4172881 - RNA, 129 nt, Human
auagggccugguacuuagcaggugcucauuaaauguauguugaacaaaugaaugaauaucuaccuaacaguguuuauuauugcaaguauauaaaguaaugauguugcuugucauaugguaauucccugu

SEQ ID NO: 4172882 - RNA, 70 nt, Human
auagggucacucugagaaguccuguauuucuauuuaaauaaaauuuaauaugauauguuucaggcccugu

SEQ ID NO: 4172883 - RNA, 129 nt, Human
auagggugcaucuaggggguaaugggauuguuugauauagaggcaggaaauaguucagucaaacuguaggaaaacuacagugauaauuucauguuuagacauuccaaggccccuuuuguuacagcaugu

SEQ ID NO: 4172884 - RNA, 80 nt, Human
auaggguggcaugaaacuuccaaagcugaccuccauaaaaauuuaacuaguaaaaauggaguaguuuuacaucccccuau

SEQ ID NO: 4172885 - RNA, 61 nt, Human
auaggucugaaaguguauccugcuugauuuucuguucaaguggauuggagaacagauuuau

SEQ ID NO: 4172886 - RNA, 88 nt, Human
auaggugcuggcagcuggaaguugggcuggccucacaaaaauaguaagagguuauggacagggcaccacugacaucugcuucaauugu

SEQ ID NO: 4172887 - RNA, 108 nt, Human
auaguaaaaguuaaagaggaaauuugcugaucaucuagcuaauguuuacuauagaccauuaaacuagguaauccaggcaauaaaacuucacuuuaggcuuuaaacuau

SEQ ID NO: 4172888 - RNA, 87 nt, Human
auaguaacacacuugugcugacagauggaagaaugugcauggcaacugcgccugaagcacuuccaucugucaccaggucucugcugu

SEQ ID NO: 4172889 - RNA, 85 nt, Human
auaguaccuauuauugcuaugagaauuaaaugagcuaacauaugugaagugcuuaaaacacucucuggcacauaauaaggucuau

SEQ ID NO: 4172890 - RNA, 55 nt, Human
auaguagugccuaacacugaguuccugcccuucuuaguguuuagaauacuauuau

SEQ ID NO: 4172891 - RNA, 68 nt, Human
auaguauccuguggggaaaagccuaucuuuugagccagaaagacuggcuuaaaucccaguauuauugu

SEQ ID NO: 4172892 - RNA, 83 nt, Human
auaguaugauagggaugauuucagugucugccaaaagggaauugguuaaguaaacugagguacauccaaaugaugcauacugu

SEQ ID NO: 4172893 - RNA, 87 nt, Human
auagucacaggcuucugccgucuugaugcucagccaugcucagcgggugguuuucaucaagaugguugcucaggcuccggucacugu

SEQ ID NO: 4172894 - RNA, 73 nt, Human
auagucucuccuauucaaugggaggaauauugagcucacauuguauaaagaccauugagauaggagagauugu

SEQ ID NO: 4172895 - RNA, 62 nt, Human
auagugagguuaaaaauuccugcaaugcuaaaacagacuuuugcagcauauugaucuccugu

SEQ ID NO: 4172896 - RNA, 70 nt, Human
auagugguauuuccaggcuuaugguagauggcauagcugguaugguagagagccuggaaaaauugauagu

SEQ ID NO: 4172897 - RNA, 79 nt, Human
auagugucuucuaucauacuugaauacauuaauccaaauaaaugugauuaauguauucaaauaugauaggaggcacugu

SEQ ID NO: 4172898 - RNA, 66 nt, Human
auaguuacagauccuucguuaguugaauuuggaguaacuccaagcuacugaagguuuggguucuau

SEQ ID NO: 4172899 - RNA, 61 nt, Human
auaguuaguauguguagucuagcuuuuaauuaacuaaaagcagggccagaauacuugcugu

SEQ ID NO: 4172900 - RNA, 129 nt, Human
auaguucaucauuaauguuuguaaaaauuaauggugucauuuauguuugggaauaaaaaacuagaaauauaacuuuauuugauagagauaaaugauagacauaaaguuuacauaaagcaagagaauaau

SEQ ID NO: 4172901 - RNA, 80 nt, Human
auaguuuagcauacaucuucaggaucuaagaccuaaaaagaucaaucuugcccaaggccugaaaauguaugcaaaacugu

SEQ ID NO: 4172902 - RNA, 67 nt, Human
auaguuucacaggaaagaauuuugccuccgaaacucuaguuuagugcuuuccuucuugugacauugu

SEQ ID NO: 4172903 - RNA, 76 nt, Human
aggcccugggcagggagaccaggcucugaccccccaguuacauccuuggaaugagcucuggcuuccgcccucuccu

SEQ ID NO: 4172904 - RNA, 77 nt, Human
aggccgcgauuagaguaaugccagggccgggacaauguguucugugcccauaaucugguauuuaccuggugugaccu

SEQ ID NO: 4172905 - RNA, 64 nt, Human
aggccguggccgggcccggcugcuuagguaggccuucuccucuuccagugcccgacgcaggucu

SEQ ID NO: 4172906 - RNA, 82 nt, Human
aggccuagaugaucucugauauuucucuuaacacuagaaguuauuuuaauaaagggaaugacagauuuucagaucaaggucu

SEQ ID NO: 4172907 - RNA, 68 nt, Human
aggccucagcuaaagagaagggugucgcuggagcaaguuuccgugcccuucagcuuugcugaaagccu

SEQ ID NO: 4172908 - RNA, 61 nt, Human
aggccucagugaucaucaucagaccauccuucuuauugaacagaugaggaaacugaggccu

SEQ ID NO: 4172909 - RNA, 58 nt, Human
aggccucauuuucacuuuaugccuggaucuauggcagccauuugggaucaugagguuu

SEQ ID NO: 4172910 - RNA, 114 nt, Human
aggccuccugggggcugacagcagcugccuucaggcucucagggugggguccuucaaggagcaacugagcagcugcugugcuccaucuuucucuugcccauccugggagagccu

SEQ ID NO: 4172911 - RNA, 59 nt, Human
aggccucggcccacugcugcgguggccccaaaacaccgcguggccuguggcugaggccu

SEQ ID NO: 4172912 - RNA, 58 nt, Human
aggccucuguagggcccugaagggagggaccagcccuuuagggucuccugccaggucu

SEQ ID NO: 4172913 - RNA, 61 nt, Human
aggccucuucagggagcauggagagcuguguucugccucccugcgcauuagaugagcgccu

SEQ ID NO: 4172914 - RNA, 61 nt, Human
aggccugagaaggauaggaagcgauucccugggucuugguguugcuaaccuuuuuaggcuu

SEQ ID NO: 4172915 - RNA, 56 nt, Human
aggccugccuggaucacacagaaagcgacaggcagcuccugugagagguagagccu

SEQ ID NO: 4172916 - RNA, 63 nt, Human
aggccugggucucgugccuaccccugaaucuaguguggcugaggcuagccagacccagauccu

SEQ ID NO: 4172917 - RNA, 55 nt, Human
aggccuggguguucaccagaagcuaacuuagcugcggggugggaagccagggccu

SEQ ID NO: 4172918 - RNA, 58 nt, Human
aggccuggugaaugaaguaucugaaccuccagguagauuuuuaguaagcacggagccu

SEQ ID NO: 4172919 - RNA, 80 nt, Human
aggccuguaccuugccuuguuucucuucuguaggaaacaaguccugaauuaggaagcuuggggcagggcuacuaggaccu

SEQ ID NO: 4172920 - RNA, 65 nt, Human
aggccuguguguaggccaggggaguguauugaaacuucaggccauuuucaagccugcaccagcuu

SEQ ID NO: 4172921 - RNA, 80 nt, Human
aggccuuaagugagcacuuuaaaauauucccaagguuucccaugcaggguauaguuaaagagcauuccacuugagauccu

SEQ ID NO: 4172922 - RNA, 68 nt, Human
aauucugacacuuguuauaaugguaaggaugacuuuauucaggacuauugcaauacgugucagcaauu

SEQ ID NO: 4172923 - RNA, 65 nt, Human
aauucugagacuacuauauucagauccuugucuugagacauugagaaauacaguguuauagaauu

SEQ ID NO: 4172924 - RNA, 127 nt, Human
aauucugcaagucuugauacuaacucugaggaacugcaugaagguggugcuucugcuccucugcucauacagagcaagcagaacaagccacuguuucuguggugugauuucaggagaaugcucuguu

SEQ ID NO: 4172925 - RNA, 102 nt, Human
aauucugcauccagauuguugggucugccucaagugagccuuuuguggaaggucaccagagagcaggacuucacugagcugacccagcagguuauaagaauu

SEQ ID NO: 4172926 - RNA, 77 nt, Human
aauucugugcagcaacaagauagaauggcacaggucuacucaggugacagccaaccuuucuuuuguaguaaggaauu

SEQ ID NO: 4172927 - RNA, 64 nt, Human
aauugaaagcuguccacuaggcugugucaucuugggauagcuugcuagacagcuuuguccaguu

SEQ ID NO: 4172928 - RNA, 97 nt, Human
aauugaaaugauuuuccuuguggaagcaagcuccucuguucuuuuuuauauuauggaacuacaccuggaauugguuucaagggaaagugaaucaguu

SEQ ID NO: 4172929 - RNA, 130 nt, Human
aauugacaucuauuuauacucucguugucaauggugugaugguaaacauuuaacaacuaguucucuugaaauaaaagcccuauuuuuuuauguuugccaauuuccaugguguaaaugcucauaguugauu

SEQ ID NO: 4172930 - RNA, 59 nt, Human
aauugagcaucauguuugaaugagccuacaauguucugcuuugcauacagaugccaauu

SEQ ID NO: 4172931 - RNA, 79 nt, Human
aauugauacuagagaacaaaugcauucuguuuucacuaggaccaguggcuuuaucuagcagaagcauucuguaucaauu

SEQ ID NO: 4172932 - RNA, 70 nt, Human
aauugcaagaauuguauacccucauugagcucauuugguuuaagugcagagugcuacgauucuugucguu

SEQ ID NO: 4172933 - RNA, 73 nt, Human
aauugcaaugcuuauuauuaauagaauguucaaauuacgguacugucauuuuaugaaguaauaaguagcgguu

SEQ ID NO: 4172934 - RNA, 82 nt, Human
aauugcagcauucucugguugggagguuggcuuucagcuaaaaacguuaaguuggaaacuauccucacaacuagaagcaguu

SEQ ID NO: 4172935 - RNA, 99 nt, Human
aauugcuaugcuggaagacagguaucauuauccacauuguaaaaauaaauuacaccaaauaugugagguaucuaggucuucgucaguuauacaguaguu

SEQ ID NO: 4172936 - RNA, 75 nt, Human
aauuggacuugacacgugaguugguguuucugguugacaauacaagaggaacacaagcuaugauccacaccaauu

SEQ ID NO: 4172937 - RNA, 88 nt, Human
aauugggaaugguccccucagaaagugacaggggggugaaacagacuuuugcaucccuuaaaccacuuuuuugggggcuuucuuuguu

SEQ ID NO: 4172938 - RNA, 78 nt, Human
aauugguuguuuucagcaguuuaugacuuguuauuuaacauuuaacagaauggcuauuuauuuuggaaacaaccaauu

SEQ ID NO: 4172939 - RNA, 67 nt, Human
aauuguaagcuccaugaggacagggucuacauuuuguuuguuuuguuucucagagucuauuacaguu

SEQ ID NO: 4172940 - RNA, 101 nt, Human
aauuguccuaagagcauacagauggagaaacaugcauucaagaaaaucuacuagauauuaguaaaauagugagaauuuuugcaguuuagccauggacaauu

SEQ ID NO: 4172941 - RNA, 79 nt, Human
aauuguuaccaaagcagguaaugaauggaaagauacuguguuuucuuaaugcccuucucuaucugcucuaguagcaguu

SEQ ID NO: 4172942 - RNA, 89 nt, Human
aauuuaaagugaagagcauuuuacuuucccucucagaacucuuagaaaaccucugaaggaguaaagggaaagaaugaucaguuuaaguu

SEQ ID NO: 4172943 - RNA, 56 nt, Human
aauuuaaucaaguucugcucugguccuuuguggccaggcaaucaauggguuaaguu

SEQ ID NO: 4172944 - RNA, 58 nt, Human
aauuuacacuucauuuggagggcugagauuuggaucagugcccagugaaggucaaauu

SEQ ID NO: 4172945 - RNA, 78 nt, Human
aauuuauguuuuucuauagcuuucuugggaguaaugauauuuucauuucacugacuccuguugugaaaaacaagaauu

SEQ ID NO: 4172946 - RNA, 57 nt, Human
aauuucauguauuuaucauguaaaugugccuuauuugcaaaagaaaagcaugggauu

SEQ ID NO: 4172947 - RNA, 81 nt, Human
aauuuccauuuuauuagugacauuuagacuuaauacugucacuuaaacauuuuuugagugcucacugcgaagguggaauuu

SEQ ID NO: 4172948 - RNA, 82 nt, Human
aauuucccaauauguuuaucuagugaagugaagaagagucuuuguacacugucuacuaugaaugaaagcaaauugggaaguu

SEQ ID NO: 4172949 - RNA, 75 nt, Human
aauuucguauauaguauguccuccagaauucuuaccaaugcuaggacauuagggaauacugcugugugcuaaauu

SEQ ID NO: 4172950 - RNA, 60 nt, Human
aauuucuauucaaauaugagcucuauuuugaauaaaaggggcuacauugugagagaaguu

SEQ ID NO: 4172951 - RNA, 65 nt, Human
aauuucucccacagacuguaaauguuaacacuuuaauagaugauuuacagcugugugagcaaguu

SEQ ID NO: 4172952 - RNA, 80 nt, Human
aauuucugacugacagagcucaucccagaggcgagaacauccuuucuguaacugccauguagccugucuccaaagagguu

SEQ ID NO: 4172953 - RNA, 64 nt, Human
aauuugaaacauagucaccacugaugaguggacaaccugcuauuucuuugacugguuucaaauu

SEQ ID NO: 4172954 - RNA, 86 nt, Human
aauuugacauauugacacauuuccuuagcgcugagcucgucagaugaguuuagauggcauuaagguagguauguuauuguuugauu

SEQ ID NO: 4172955 - RNA, 68 nt, Human
acaaauacuguucacaaagacaauuucaaacauuucuuugaauuaugauugaaaugaggaguauuugu

SEQ ID NO: 4172956 - RNA, 69 nt, Human
acaaaugcaguuucauuuguagaauauaccucagacauaaguguauuuugaaaauagacuguacuuugu

SEQ ID NO: 4172957 - RNA, 60 nt, Human
acaaaugucaggugguggauggcuugaguuccaagcuaaugaacuuagaccugacacugu

SEQ ID NO: 4172958 - RNA, 62 nt, Human
acaaauugugagcaaguaucccaagaugggugcagagcccaacuuccuucuaguucauaugu

SEQ ID NO: 4172959 - RNA, 85 nt, Human
acaaauuucuuugggggaagaggauagacagugguccuaaccauaggcaagaaacuucaauuuucucuuucaauauaaacuuugu

SEQ ID NO: 4172960 - RNA, 85 nt, Human
acaaccaagcauauacaaacucauauacauacuuaaauugguacggugguguaugugugcgugcguguguguguguauguguugu

SEQ ID NO: 4172961 - RNA, 70 nt, Human
acaaccacuucagcuugcuaaaagggcaucuccucucuauacagugauggugcccuuagguucugguugu

SEQ ID NO: 4172962 - RNA, 64 nt, Human
acaacucucaguuaaauaaagagcaagauuagaagagcuaauuuacuguuugcuugagaguagu

SEQ ID NO: 4172963 - RNA, 58 nt, Human
acaacugaacacgucucuccucugguuauacaacuugggagaagaaugugucaauugu

SEQ ID NO: 4172964 - RNA, 74 nt, Human
acaacuggugugauggcccagcugucuguugugugugacaguguguggcuauggcugggucaccaucagggugu

SEQ ID NO: 4172965 - RNA, 59 nt, Human
acaacuucaauugggauucuccccugauucuaccuuggagaaccuuucuugaguguugu

SEQ ID NO: 4172966 - RNA, 90 nt, Human
acaacuucauguagaggaaacugaaguucuggagggguaccaggguacucaucucuuuagugucagucucucucauggacugugaguugu

SEQ ID NO: 4172967 - RNA, 58 nt, Human
acaacuuuaauuugggugucagaguccuuuguggacuuuauaagcccuuuaaaguugu

SEQ ID NO: 4172968 - RNA, 130 nt, Human
acaagacuugacugaccugacccucggggauccauccacguggcccacccaaguaaugcaccuuuuagaauauuugcugaaauaacugccaccugguggcaucuucugggucaaugucacuguccauggu

SEQ ID NO: 4172969 - RNA, 78 nt, Human
acaagcaaguaucccccuguaucuggaagaauauuaagucuaaguauucuacaugauagaagggagaacugacaaugu

SEQ ID NO: 4172970 - RNA, 64 nt, Human
acaagcauucaacucucagucagucucuugggcugaggcagaacagagccugaaucucucuugu

SEQ ID NO: 4172971 - RNA, 89 nt, Human
acaaggcagaggagaugaguucuguaaaugcuccugggcucucagcuguguccuaagguuucgauagagcucuucuucuuuuaacuugu

SEQ ID NO: 4172972 - RNA, 62 nt, Human
acaaggccugacugcuugucuaaaccaaucauauagguuuauuacagcgaucagaguaaugu

SEQ ID NO: 4172973 - RNA, 88 nt, Human
acaaggcuguagauggaacucaucaacaucgugacagagaaggucaauaaucugauugaugaguuauccauuugacucucggucuugu

SEQ ID NO: 4172974 - RNA, 109 nt, Human
acaagggaaugagccuuggaaucagaaagauuugggucuacucucugcuauggcauuaacauuuugggaaagacccugagucuuauugagacuuaguauauucaucugu

SEQ ID NO: 4172975 - RNA, 76 nt, Human
acaagguuaaaucgucuuaagcacacugagaacuguguuagcagugggccucaguuuccuuaggaugucucuuugu

SEQ ID NO: 4172976 - RNA, 103 nt, Human
acaagucuuaaaucagguugugguuugauuugauccggagagaugagaaauucaacucuugugaaaggguuacugucaggccacaaaaagcuguaggauuugu

SEQ ID NO: 4172977 - RNA, 119 nt, Human
acaagugagaagggaaagggaccuugugcuagaaccaguacagaauucagagccauuucucuuggcugauuauuugguguuggauaguggacaaaguguuugguccucucugaugaggu

SEQ ID NO: 4172978 - RNA, 65 nt, Human
acaagugcauggaaucagcuguggguauuauugcaaagacggaaaucugauucuauuugcucugu

SEQ ID NO: 4172979 - RNA, 69 nt, Human
acaaguuaauauauagaauuuugaaccauaccuggcaaugguaagcauuauguauguguuagcugcugu

SEQ ID NO: 4172980 - RNA, 83 nt, Human
acaauaguagcauugauucagcauucauuaugcgccaguugcuggacugugcuaguugcugcugaccguaugugcuuuauugu

SEQ ID NO: 4172981 - RNA, 79 nt, Human
acaaucggcagauauucuagaaccuaguagaaucucaggccugauaggaucuguccugguucuggaauguuuaaguugu

SEQ ID NO: 4172982 - RNA, 74 nt, Human
acaaucucauuggcccugaauuaaucaaauacccaucaaugaacaaauggaucguggucagggaaugagguugu

SEQ ID NO: 4172983 - RNA, 129 nt, Human
acaaucuggaauggcuguggugaucuaaccuuuggaggaaaaacggguguugagauauguguaaucauaugugauauguguaaucauaucugauaccuaccucuggggguuugcaagucuuuggauagu

SEQ ID NO: 4172984 - RNA, 63 nt, Human
acaaucuuauuaguaguauagauccaggugccuucuggggacugucaucucuaaaaagauugu

SEQ ID NO: 4172985 - RNA, 98 nt, Human
acaaugauaaagcugugagaaugauuuucuuagaugauguuuugaaccuaaaaaguucaagguaaguaugagaaagcaguacauuuugcuuguguugu

SEQ ID NO: 4172986 - RNA, 58 nt, Human
acaaugcaauaggagcuagaaacaaaaaugauuucaagcaggaagccugauguauugu

SEQ ID NO: 4172987 - RNA, 92 nt, Human
acaaugggaauuggagcucugaggaauucugcagugagaaggucaguuuagcuuuguucaacgcagcauuucucaaguuuaguugccauugu

SEQ ID NO: 4172988 - RNA, 67 nt, Human
acaauggguguuggagggaagacaaaauucuuaaucucaucuuuccugcagacauuuacaccuuugu

SEQ ID NO: 4172989 - RNA, 62 nt, Human
acaaugucuggacagagauucucaaucugagacugaguuauuauuggacagaugcuuauugu

SEQ ID NO: 4172990 - RNA, 57 nt, Human
acaauguuuugaaacaucuaggacaauguuagaccaguuguagguguuuaacauugu

SEQ ID NO: 4172991 - RNA, 66 nt, Human
acaauucaaaugcauaguucacagcccaacucaaugccuugugaauucucuguccauuuggguugu

SEQ ID NO: 4172992 - RNA, 84 nt, Human
acaauuugcuuucuuuuucuaaguuuuagguuuuucuuucucucuuaggaaguuuagugaaacucuagggguuaggcagguugu

SEQ ID NO: 4172993 - RNA, 114 nt, Human
acacaaaagcuuuaugagaaguuucuuuaagucucugcauuagaaucuauugucaccuugguaggaauuagaaucugaauguagagcugaaaagaaccuuaaugaaagcugugu

SEQ ID NO: 4172994 - RNA, 56 nt, Human
acacaaacagucuauagcaccagaaaauucuaguuguugcuguugagugugugugu

SEQ ID NO: 4172995 - RNA, 65 nt, Human
acacaaacaucaauccuguuuuccaaauuacuuuugauauucuuggagcuuuagggaguuugugu

SEQ ID NO: 4172996 - RNA, 82 nt, Human
acacaaauguguucaccucuggucacugguucagguucugggcagucugucccuuuggcuggagguagaagaacacuuuggu

SEQ ID NO: 4172997 - RNA, 68 nt, Human
acacaaucugacugguguccuuauaagaaaaggaaauuuggacacaaagagagauaccagggaugugu

SEQ ID NO: 4172998 - RNA, 81 nt, Human
acacaauggaucauuuaucucagacuucagauugggugauugucaacaggacccucgagguuuucugagguaccccugugu

SEQ ID NO: 4172999 - RNA, 82 nt, Human
acacaccugugcuccugucugucuuuggucccuuucagaguugagagaucaggagaaaagauagccagguucagaagugugu

SEQ ID NO: 4173000 - RNA, 61 nt, Human
acacagagcuggaacugcuucaaugcuauaaaccacgcucuagcauuaacuagcucugugu

SEQ ID NO: 4173001 - RNA, 82 nt, Human
acacagauaaugcucauauagguaaauuuuuaaggacacaaaaacuaucaaauaacuccugauuauauguguaugucugugu

SEQ ID NO: 4173002 - RNA, 70 nt, Human
acacagaucaggcguuucucuccaggcuccaacacacaugcucagccuggaucaauaagccugacugugu

SEQ ID NO: 4173003 - RNA, 87 nt, Human
acacagcaucugugauuaaauacuaguuauuaaagcuuuugaaauaucauccaauugcuuuaguuaccauagugcaccaugcugugu

SEQ ID NO: 4173004 - RNA, 77 nt, Human
acacagcccaggacagagugaacagugggaugugcagggcucgacuggccaagcugaacuguuuucuuggguugugu

SEQ ID NO: 4173005 - RNA, 65 nt, Human
acacagcugugcaguuuuuucaagcucugcucagguguaagaauggaggaaguggacaguugugu

SEQ ID NO: 4173006 - RNA, 57 nt, Human
acacagcuguuugggcauggccagagcgccacucucaaguuauguaacagcuguugu

SEQ ID NO: 4173007 - RNA, 73 nt, Human
acacagguaaugguuuuggaagacuucaugucugauuaaauuuuaaauuacuuuuagaacaucugccuugugu

SEQ ID NO: 4173008 - RNA, 75 nt, Human
acacauaaauauuaguguguaggcuggaaaaaagcuugaaguauuuuuccuuuucaugcacaagucuuuauuugu

SEQ ID NO: 4173009 - RNA, 62 nt, Human
acacauauacauguguuaauauauguaaguauauacauauguuuaaauguauguguaugugu

SEQ ID NO: 4173010 - RNA, 74 nt, Human
acacauauauaagagcauucuggcuuuuuacagcagacuuuaaaauuugaaggccagacuugaguguauguugu

SEQ ID NO: 4173011 - RNA, 69 nt, Human
acacaugcacauuauucaaagcccauugagguauguuucaccuuggaguugcuuauaaucugugugugu

SEQ ID NO: 4173012 - RNA, 61 nt, Human
acacaugcauaccuauguguauauaugauauguguguguguguguaugugugugcaugugu

SEQ ID NO: 4173013 - RNA, 55 nt, Human
acacaugcucauaaauaaauagucuaaaaagccuuuuuuaugugugugugugugu

SEQ ID NO: 4173014 - RNA, 57 nt, Human
acacauuugcuaaaaugagcucugguagauaucaguuugcgcacaggcacaaugugu

SEQ ID NO: 4173015 - RNA, 82 nt, Human
acacauuugggucugcuauuguuguuguuuuaauugaauuuuuccagccuuauugagacaaaauugacagacaaaauugugu

SEQ ID NO: 4173016 - RNA, 59 nt, Human
acaccagccucgcccguguguucuguaacccagacucauuugguugugagggcuguugu

SEQ ID NO: 4173017 - RNA, 55 nt, Human
acaccagggauaugaggaaggaggcggcugaggccccagacucagacccuggugu

SEQ ID NO: 4173018 - RNA, 93 nt, Human
acaccauauguucaugcagcaguuuuuuucugguuuccaagcaccauuagcuggaggagagagggacugucugcacuuagauauuccuugugu

SEQ ID NO: 4173019 - RNA, 55 nt, Human
acaccaugaugagugauguagcucuccugcugccagcuuaccuaucaucggcugu

SEQ ID NO: 4173020 - RNA, 74 nt, Human
acaccaugcaauaaauaacauggaagacauaaaauggcaccaggaauggcuauguuuucuauuuguugcugugu

SEQ ID NO: 4173021 - RNA, 78 nt, Human
acaccauucccgcagauuugcucuuugcaggacccucucuuugguguuuccaaaggcaaaacuguggugucgaggugu

SEQ ID NO: 4173022 - RNA, 59 nt, Human
acacccuuucucuggcuuuggguguugucuucccaguuuccugaagagaaagaaugugu

SEQ ID NO: 4173023 - RNA, 79 nt, Human
acaccuaagaaacauuugagugguaauuacagaaaauaugcuuuuuucuaagugaacauucaaguuucuguuuaugugu

SEQ ID NO: 4173024 - RNA, 56 nt, Human
aauuucaggcauuagccagacaguaagaacaccucuguccuggugacccugaaauu

SEQ ID NO: 4173025 - RNA, 61 nt, Human
aauuuccugggauaaaaagccaauaauugcgcuagaaagcaaagagguuuucccagaaauu

SEQ ID NO: 4173026 - RNA, 93 nt, Human
aauuucucucaguauguagagcaaguucaguuuugaguugggaaugaauuccagucaccuagacagaacuuacuucugaucauauaggaaauu

SEQ ID NO: 4173027 - RNA, 58 nt, Human
aauuucucuuagcaagacauuacacugcaugguggauggccuucuugcucaggaaguu

SEQ ID NO: 4173028 - RNA, 82 nt, Human
aauuucugaguuacacaagcaagggucugcaauguuuuuccauaaaccucucauaccaggcuugaugauuugcuuagaaauu

SEQ ID NO: 4173029 - RNA, 57 nt, Human
aauuucuggaugaaccuggcuuuggaagguacugugcuguagguuuuuccaggaguu

SEQ ID NO: 4173030 - RNA, 116 nt, Human
aauuugaaaauguugcagauggccuuuuaucaggagcuauggacugucaaaauaaauagauauaauuaugaaccauuguuguugaaugggccaucuuaaauaauagcagucaaguu

SEQ ID NO: 4173031 - RNA, 55 nt, Human
aauuugacccaucuuggaauuuuggccccuugguccuguuucccugggacagauu

SEQ ID NO: 4173032 - RNA, 93 nt, Human
aauuugauagucuuugauagcaauaugacauugcuacauccaagugugggagucaguacacuuauauugcgcauaucuuggacauuuuagguu

SEQ ID NO: 4173033 - RNA, 60 nt, Human
aauuugcccagaauauuaauguaaaacaucauguuucaguguaaucuuauugggcagauu

SEQ ID NO: 4173034 - RNA, 121 nt, Human
aauuuggguaaauuuaagguauugaaaaccaggcaaguaguguuugucauaaauucuguccuaucugaacaugauucuugauaggcauugugcuuuguuuuauggcuuuuuaaccuaaauu

SEQ ID NO: 4173035 - RNA, 56 nt, Human
aauuugguggcacgugucagugcaucuuucuguucugcacaaugcaccaucaaguu

SEQ ID NO: 4173036 - RNA, 98 nt, Human
aauuuguguccuuuuacaaaaugccugucaaauacugauucccuuccacaauggggcuugaaugcagcugacagucguuuuguuucacgacauugauu

SEQ ID NO: 4173037 - RNA, 66 nt, Human
aauuuguucuagccuccuguuuugacaaguauuccuucauaacaaccuggaaggccagaccaaauu

SEQ ID NO: 4173038 - RNA, 125 nt, Human
aauuuuagacuuguaucucuuuguaaggacccuuggaaauuaacagggauuguccauacucugagaggaaguggcuucucugucuaguuucuaccacuuauaauuauguuggucuuuuuaaaauu

SEQ ID NO: 4173039 - RNA, 72 nt, Human
aauuuuaucucuaagcaggcuuucucacugugugggcaucccaacugcuaaguuuguuuaauagaucaaauu

SEQ ID NO: 4173040 - RNA, 86 nt, Human
aauuuucagccuucaaagcuacuguggcucuuaaauggcugacuuaaacugcuggauaccacagagacucugcaggacugaaaauu

SEQ ID NO: 4173041 - RNA, 109 nt, Human
aauuuucucuguugccuuguagugauuauguguguaaacuuuucaugucagauggauauguagucaacaccugguucuauuacagacuagcaguuaaauagagaaaguu

SEQ ID NO: 4173042 - RNA, 59 nt, Human
aauuuuuaaggucuguauaauauuccauugaguggauguaugcaguuuacuuagguauu

SEQ ID NO: 4173043 - RNA, 88 nt, Human
aauuuuuucagcaggagcaggggaguggaugauggauuuuuauugaaccaucuuuguccucucccuuaaucccgcucaugaagaaauu

SEQ ID NO: 4173044 - RNA, 82 nt, Human
aauuuuuuucagcuuuauuuugcucugucuuuaaauuauaaauugagguauuacacugugacaagaaagagcuggugaaauu

SEQ ID NO: 4173045 - RNA, 107 nt, Human
acaaaaaacaaaaaggugccaauccauguauuuuaacaaucagaggaagaagcuuacuuuucccaagugaagugaagccaguggauggcccuuucuugugcguuugu

SEQ ID NO: 4173046 - RNA, 67 nt, Human
acaaaacuagagcagcggggcuggguuaggucaucacuuaccccacuccucuguuuuaacuguuugu

SEQ ID NO: 4173047 - RNA, 61 nt, Human
acaaaauagauauaauguguugaauguugacuacauucuggccacuuuauuucuguuuugu

SEQ ID NO: 4173048 - RNA, 72 nt, Human
acaaacacagucccugcaccccauuuuacauuuacauucuccgugugugugugugugugugugugugugugu

SEQ ID NO: 4173049 - RNA, 82 nt, Human
acaaacccaggccccugagccagcuggcaugugcuaaaggcucuucuaguaucacacccuggcuuucucuuccugggugugu

SEQ ID NO: 4173050 - RNA, 58 nt, Human
acaaagagggaccagugacuugacauauauaacugucacucgauggcacuucuguugu

SEQ ID NO: 4173051 - RNA, 61 nt, Human
acaaagauaaucacagaauacccaaguuaucucaggucuucggguauagugguuacuuugu

SEQ ID NO: 4173052 - RNA, 68 nt, Human
acaaagaugaaauagcuuuucauaauucucagaggcuuugaguaggaaaggaaauguuuugucucugu

SEQ ID NO: 4173053 - RNA, 80 nt, Human
acaaagcugguaauuaagugcacaguuuggaggcugguugccuguguuccagucccaucucugucgcuuacuagcugugu

SEQ ID NO: 4173054 - RNA, 60 nt, Human
acaaagcuuuguucuucacagagugcuuuuuaaguaugugaagauuugcgaaggauuugu

SEQ ID NO: 4173055 - RNA, 56 nt, Human
acaaaggugagcagaagacacauuuccuuuggugucagaaguggcuucaucuuugu

SEQ ID NO: 4173056 - RNA, 75 nt, Human
acaaagugaacagaggaagaguggggguuaaauuagauuuuacuaggcagcugcccucuccuuccuacuuaaugu

SEQ ID NO: 4173057 - RNA, 114 nt, Human
acaaaguucccucaguguguggguuuuucugugagcgguaaaggucuugggggaggcugugguguccaggucucaguacuugcacagaagaacuugcuauacugcagauuuugu

SEQ ID NO: 4173058 - RNA, 79 nt, Human
acaaaguugguuaguggaauucuucugccuauauaauaacaucacaguauuucagaguuguuuucuguccucucuuugu

SEQ ID NO: 4173059 - RNA, 60 nt, Human
acaaaugaaucauacauaaugugugugaaagcauauguguauguauguauucaauuuugu

SEQ ID NO: 4173060 - RNA, 76 nt, Human
acaaauggagauugauaaccucuagcuuggaaaugugugauuuuuugucuguuauugagguggagucucacucugu

SEQ ID NO: 4173061 - RNA, 62 nt, Human
acaacaaagacacuugaaaugaugacaacccaguguccuuuuuucaauguguucuuuguagu

SEQ ID NO: 4173062 - RNA, 130 nt, Human
acaacaaggcagccaaaguucccaggaaggccccaggaacaguagaaguagccagaagaggugccagcagguggcuuuaaugagucuuucugcugucuggagucuucgaaagcauuuguguuuugugugu

SEQ ID NO: 4173063 - RNA, 101 nt, Human
acaacauggaugaaccuugaagacauaugcuaagugaaauaagucagauacagaaggacaaauacugugugauuccacucauaugagguuccuagaguugu

SEQ ID NO: 4173064 - RNA, 62 nt, Human
acaaccuggaguugaaggaaggugggccagcuucggugcccaccccacagcuccuggugugu

SEQ ID NO: 4173065 - RNA, 60 nt, Human
acaaccuucucugucuuggcaauaauuucuaaacacaagagguagcacagagcaggaugu

SEQ ID NO: 4173066 - RNA, 61 nt, Human
acaacuccagggggucaauauuuacauuacagucugugugaauggcaucuccuggaguugu

SEQ ID NO: 4173067 - RNA, 79 nt, Human
acaacuguagacugcaugauaauaauagcagaucugauugcauggaucucugugaagguaugugugugucugcagaugu

SEQ ID NO: 4173068 - RNA, 64 nt, Human
acaagaagaggaagucuccauggagaguucucccgagucucaccauggaucuuccauuucuugu

SEQ ID NO: 4173069 - RNA, 69 nt, Human
acaagauacucagcuacaagacuggcaaagaaaugcagaagacuuaaaggcugaauguaggauucuugu

SEQ ID NO: 4173070 - RNA, 77 nt, Human
acaagauagcacaacuuuguagcaauuccacgagauucagauuucaaagaguuugagcuagaaaguauuuauuaugu

SEQ ID NO: 4173071 - RNA, 56 nt, Human
acaagauagguugagucuagccucauaugcuagauuaagaacguggaccaucuugu

SEQ ID NO: 4173072 - RNA, 57 nt, Human
acaagauccagcuucuacacagagcucacaagcuagugagcugucugcugcuuuugu

SEQ ID NO: 4173073 - RNA, 76 nt, Human
acaagauucucaugugauucccgugcauguuaaagcuugacaaguucugugccaugggaacaguuguuaauccugu

SEQ ID NO: 4173074 - RNA, 67 nt, Human
acaagauugauaagucugcccucguggaauacugauuucuggaaggagaugcaggcauuaaucaugu

SEQ ID NO: 4173075 - RNA, 74 nt, Human
acaagcagcuggaagaguaagaugaaaagagaaaaacagaucuucaugcaguauuugucucuuaccacugcugu

SEQ ID NO: 4173076 - RNA, 59 nt, Human
acaagcccucaagacacuggaggcuggaaucccccugccagugccuuuuguggguuugu

SEQ ID NO: 4173077 - RNA, 74 nt, Human
acaagcuccuucuauagcccuucgggggucuacuugucauuaagugcucucuccccagugcuacuggaguuugu

SEQ ID NO: 4173078 - RNA, 56 nt, Human
acaagcuggaguuccucagaguggcaaaaauguaccugaaccaagcccagcucugu

SEQ ID NO: 4173079 - RNA, 55 nt, Human
acaaggcccagugucuggagagggagaaagcccccuccuucaggcagggccuagu

SEQ ID NO: 4173080 - RNA, 70 nt, Human
acaaggcuuucagcuaacuugauugcaucagcucuuuacaucucuguaauuugguugaugaaagcauugu

SEQ ID NO: 4173081 - RNA, 73 nt, Human
acaagggcagagaccuugcaagucuuauacaucccuuaaauguaugagauauucccagcgucuacaaccuugu

SEQ ID NO: 4173082 - RNA, 76 nt, Human
acaaguaaacuuccugaaggauauuuggcuacagaagcucagaaagcuaugagcugaaugucuggauacuacuugu

SEQ ID NO: 4173083 - RNA, 76 nt, Human
acaaguaagaagggagcugagcugugagcagcauucuggggugcuguuggugcuagucucucugaauccugcuagu

SEQ ID NO: 4173084 - RNA, 72 nt, Human
acaagugcuuagcagaagcuucagcuucagaugagagucugaacaaaaaauggugcuucuccugugcagugu

SEQ ID NO: 4173085 - RNA, 110 nt, Human
acaaguuuuugcugugcuuuccuagcacuuccauauguacguagcaggaggaggcugaaugccaucugcucugucugccauguugcuguaaaucacagugaguuuuuugu

SEQ ID NO: 4173086 - RNA, 103 nt, Human
acaauaaaacacgaaguucagauggucauucacuagggugugugauauuuuggaguauagaccuuaagugauuaugacauaucaaaauaauguggucuuaugu

SEQ ID NO: 4173087 - RNA, 90 nt, Human
acaauaaaagauuuuguuaagugguauaaaaauuugugaauguugaaauucaacaugcuucauauuauaaccaaccugcaagaauauugu

SEQ ID NO: 4173088 - RNA, 88 nt, Human
acaauacagcauuuugcuuguucaagauuucuguguaaaaauuuacacguuuucuagagaauaugcagaaagugaaaacuguaaaugu

SEQ ID NO: 4173089 - RNA, 78 nt, Human
acaauaguguucuagaggauucuaaaggaagcugccccagcagcccugagagaaccaucuauacuuuggauauguugu

SEQ ID NO: 4173090 - RNA, 67 nt, Human
acaauauacacauccuaaugggagguaaacgugguauaauauccgauauuacgauguguuauauugu

SEQ ID NO: 4173091 - RNA, 80 nt, Human
acaauaugagggacacaucucaggggacacucucgagugaggcauuagggugugggugcugagaugucucuuuucauugu

SEQ ID NO: 4173092 - RNA, 84 nt, Human
acaauauuucaagucauuugacuguguguuaccagggagggacaacaccuugaacauaucauaggaugucauugaauauauugu

SEQ ID NO: 4173093 - RNA, 62 nt, Human
acacuguaaacaucucaagcacuuggauagucucuucaaauguuuuauucuguaugcagugu

SEQ ID NO: 4173094 - RNA, 69 nt, Human
acacugugucuagcauuuuacaggggagcaauaauguuuguucauaaaaggauagcagauggauggugu

SEQ ID NO: 4173095 - RNA, 97 nt, Human
acacuuagucuucagucacuugguuugauucaagaacaaagaguuagaaacucuucaccuuuugaaugcaaggaaguaggcugaccccucaaagugu

SEQ ID NO: 4173096 - RNA, 87 nt, Human
acacuuccuaguuaauauuucacagcagcucauuuaacgaugucucucagagguugagcagcuucuauggaauaaucagggaagugu

SEQ ID NO: 4173097 - RNA, 68 nt, Human
acacuucuaaucagaaggucuggucuugagcuaagauaugaauuuuaacuagcuuucuggagaagugu

SEQ ID NO: 4173098 - RNA, 57 nt, Human
acacuuuacagcuuccuuugcagaaugucgggggagucaauuuuagcugugaggugu

SEQ ID NO: 4173099 - RNA, 55 nt, Human
acacuuucuguguaucuuccauuguucuaggcacugugggcaccacagagagugu

SEQ ID NO: 4173100 - RNA, 56 nt, Human
acacuuuguugaugaaauaguuuuguuacuuacaguccugugaauucagcaaaggu

SEQ ID NO: 4173101 - RNA, 72 nt, Human
acacuuuuuaucuuuuuucuagauguacuaauuggagaucuagaguggaauguagaaaaaagauguuggugu

SEQ ID NO: 4173102 - RNA, 86 nt, Human
acagaaaaaucauuuaaccucuauuuuuauaaaagugaacaaugccauuuuguauagucuguggaugucguagaugguaguuaugu

SEQ ID NO: 4173103 - RNA, 109 nt, Human
acagaaaauaaggggggcagggcaucuauacugacaggauauguggguuggugaauugaacaaauaaucacaauucagaugucuuagguuugcauccugaauuuucugu

SEQ ID NO: 4173104 - RNA, 65 nt, Human
acagaaaauucauggugaggccaaagccaugacaacaccuguguugccucacauugauuuucugu

SEQ ID NO: 4173105 - RNA, 104 nt, Human
acagaaaauuccauuuguaguagugagucuuuauaaauagcuuuauaauuguuuccaguuuauauuuguaaaaagccuccacuagaauaaagagaauuauuugu

SEQ ID NO: 4173106 - RNA, 75 nt, Human
acagaaacccccagagacuugcuucuaagaccaacacugggcucuauuuuaguagcaggaaucugaagguacugu

SEQ ID NO: 4173107 - RNA, 122 nt, Human
acagaaagcagaaguggggcaaugggaugugcggccccuguggcaggaggaggagcacacgaacccugacccugcuucuuggugcaggccacuccaggccuugcuucuguaagagacucugu

SEQ ID NO: 4173108 - RNA, 62 nt, Human
acagaacuuccagggaacauacgccuucccuuucaaacauauguuccgaggggaauguuugu

SEQ ID NO: 4173109 - RNA, 63 nt, Human
acagaacuuccugcuggaguggcucaaagcucaagggauucgguacuucagcaggguuccugu

SEQ ID NO: 4173110 - RNA, 80 nt, Human
acagaagcuggaaaugugaauuaagguuagcuuuugaaguaucuucaauaccaugauaauuaauucaugcccuuuucugu

SEQ ID NO: 4173111 - RNA, 72 nt, Human
acagaaggagcucaaauuuacucuugguugcacccugacacugugauuucuggguuccagccuuuauucugu

SEQ ID NO: 4173112 - RNA, 76 nt, Human
acagaagggugccuggaagccacucacagaaccucguaucugccaucugcugaagcuucugcaccugcuucacugu

SEQ ID NO: 4173113 - RNA, 130 nt, Human
acagaaguaauuacaccaugacaccugcuccugcaagucaggcuggggucuggcaggcucugugcggggcugcugauguggagcccacccucggcugagcugguggagcugcgguggaaagggcugcugu

SEQ ID NO: 4173114 - RNA, 58 nt, Human
acagaaguccccaugaagaagcuaucauuaucaucagcaucuucgugggguuuucugu

SEQ ID NO: 4173115 - RNA, 69 nt, Human
acagaaguuugacauguuuagcucuuccaaauauagaguuaaucuagcagcuaaauuggaaauuucugu

SEQ ID NO: 4173116 - RNA, 106 nt, Human
acagaauccgggaaguggggugagccggacuggggacgcagggaaaggcugguguccagcuagcaauccguugaucccuugccucucggccccaaaucugcucugu

SEQ ID NO: 4173117 - RNA, 77 nt, Human
acagaaugaguggcuuuggagaaguagggagcaggucacgaggggcacccagcucaucaggagccgcccauggaugu

SEQ ID NO: 4173118 - RNA, 66 nt, Human
acagaauggaacaggacaggcugggcuagacucgagcacgcaguggccccugugccaccacacugu

SEQ ID NO: 4173119 - RNA, 63 nt, Human
acagaauguccuuuuucuuaggaaauauacaaggaaguaucuggaggcaaaggggcgugaugu

SEQ ID NO: 4173120 - RNA, 69 nt, Human
acagacacuuacagaauucccuccuuuugcuuucugcagcaggaaaaucaauucuguguaguguccugu

SEQ ID NO: 4173121 - RNA, 64 nt, Human
acagacagacagagaacuauucaaaacuccaaacuuccaauauugaacaucucuggauguuugu

SEQ ID NO: 4173122 - RNA, 55 nt, Human
acagacaugcuguuuggguggucagaauauuuugcauccaagcauaaauguuagu

SEQ ID NO: 4173123 - RNA, 61 nt, Human
acagaccugggcacagaaaggaccaguucagggagggcguccuuucuccacccagguuugu

SEQ ID NO: 4173124 - RNA, 81 nt, Human
acagacuggcugugggaugagagccucagaagccaccacucuccccuguggaaaugaagguuccauuccaugugcagcugu

SEQ ID NO: 4173125 - RNA, 61 nt, Human
acagacuuaccuaaggucacacagcuaagaagucgugaagcugggaucgaaucaagucugu

SEQ ID NO: 4173126 - RNA, 60 nt, Human
acagagaugggaacauucagguuaguuugacauaucuuugaauguuuuuauuaucuuugu

SEQ ID NO: 4173127 - RNA, 57 nt, Human
acagagcuaauguugcauaggcucaaaagaagguaaggccugagauaaaagcuuugu

SEQ ID NO: 4173128 - RNA, 92 nt, Human
acagagcugacauuuguucauuuguauugauuuuauuuacauuuuucaaaaggaaauagaugcagaugguauagaaaguuucagugaaaugu

SEQ ID NO: 4173129 - RNA, 64 nt, Human
acagaggaccagaaaucaacacagaauguuuauggggcagugaggaagcugucuggaccucugu

SEQ ID NO: 4173130 - RNA, 91 nt, Human
acagaggccucagcccuucucacacaguucucugaagcuugaauauccccucagaccugagcugaauugaagcaaggagcucggccuuugu

SEQ ID NO: 4173131 - RNA, 59 nt, Human
acagaggccucggccugcccagggguggacaaaaacccugcagccaguguggccacugu

SEQ ID NO: 4173132 - RNA, 55 nt, Human
acagagguuauugcucuccaaguucaauguuguggaccugaaccagugccucugu

SEQ ID NO: 4173133 - RNA, 65 nt, Human
acagaguccaggggccuggugugugcuguguuuuacagaugacacauuaaccuuugaaauucugu

SEQ ID NO: 4173134 - RNA, 58 nt, Human
acagaguuaauggauaggcagguaaaauauauguugaaugccauucauguaagucugu

SEQ ID NO: 4173135 - RNA, 115 nt, Human
acagaguucugcaucaauucuauuucuacuuuucauuuuuguagaugcaagcacagaaaagccuuguuugaagacuacugggagugaaagaaguuuaauuacggcaguuuuaugu

SEQ ID NO: 4173136 - RNA, 83 nt, Human
acagaguuuuauucauugccauaauagagccauguaggaaaugcacugacugcauguuauuguggcaagaauauccuaaaugu

SEQ ID NO: 4173137 - RNA, 83 nt, Human
acagaucagccuguauuuccaaauuaaaauguacaaugaaguagcucauuuagacauuugauuugggggaagguugaaauugu

SEQ ID NO: 4173138 - RNA, 60 nt, Human
acagaugaaucugugauugcugguaaacccguccugguguagcacagucaaggucacugu

SEQ ID NO: 4173139 - RNA, 61 nt, Human
acagaugaauuuugggggcacuauucauucagcaguaagugucuuacaugaauugauuugu

SEQ ID NO: 4173140 - RNA, 61 nt, Human
acagaugaggcuggcgagggcaggggugacauccuaccuccgcucucagccucucaucugu

SEQ ID NO: 4173141 - RNA, 70 nt, Human
acagaugcaaggaaaugauugcuuuuuagguuucugaguccggugaguugauugcuucuuugcuaucugu

SEQ ID NO: 4173142 - RNA, 77 nt, Human
acagaugcucuccgucucaucauaguugacaugaacuauaguucugcuggcuguauaugugagaguggaguuuuugu

SEQ ID NO: 4173143 - RNA, 90 nt, Human
acagaugguuugugguagagcccagaucugaaccuugccuguugggccccaagggacccaaaguucaggcucuaucccagaccgcucugu

SEQ ID NO: 4173144 - RNA, 61 nt, Human
acagauugggaacugucuccuuuaugggaaagcucuuuauauuugggacaccccaguuugu

SEQ ID NO: 4173145 - RNA, 83 nt, Human
acagcaaacaguuuauugaaagcauggauuuggauuuggacugaucuaacuuugaauccaaguuucgcuuuuuguuugcuugu

SEQ ID NO: 4173146 - RNA, 72 nt, Human
acagcacauuaugcuacuaccaaauguguucagauagcugcuauucauuuauuaguuaguucgauguucugu

SEQ ID NO: 4173147 - RNA, 64 nt, Human
acagcagccagccacugugagcaucuugccugcgcucugcuccgugguguguugccccugcugu

SEQ ID NO: 4173148 - RNA, 60 nt, Human
acagcaggugcugccugucacccuggagcaccaggcaggguuccaaagcacccuugcugu

SEQ ID NO: 4173149 - RNA, 77 nt, Human
acagcaguaguuaccugggguacaugguuaauuugauuuagcagauucuuuggcuaaacccuaguaaauuaaaaugu

SEQ ID NO: 4173150 - RNA, 88 nt, Human
acagcagucaagggaaaauaguugaugaccaacugaagcaaucagagcucaccaucuuggucuucagcuguuuucccuggacugaggu

SEQ ID NO: 4173151 - RNA, 87 nt, Human
acagcaucuccuggggcugggcccugcucugggagcagccuuccccuucuucucucucaggggccuggaguccugggauggugcugu

SEQ ID NO: 4173152 - RNA, 82 nt, Human
acagcauugacaacuaacuuuuugauucuuggggaacauauugcuguucuguuuccaucucaugaggaauuugucaaguugu

SEQ ID NO: 4173153 - RNA, 62 nt, Human
acagcauugcugagggagggguuuuccagggcagguucaagacccuucucugcagccccugu

SEQ ID NO: 4173154 - RNA, 83 nt, Human
acagccaccaucaccccccuucuacaggcaggaaguagggucccugagagacccagcaguuugcuuagagugauaggaucugu

SEQ ID NO: 4173155 - RNA, 128 nt, Human
acagccaggaaaugaaugagagaagggaucauuuaugcaguuuguguucugcuacccaguagcagucugaacacuugcuguuaauaaguguagcccuccugccugaucauauauugcuuccuuucugu

SEQ ID NO: 4173156 - RNA, 57 nt, Human
acagcgugagcuucaugaagguagaggaggauucuaucuguauuuguucacugcugu

SEQ ID NO: 4173157 - RNA, 72 nt, Human
acagcucaggccauuccuaccaagggaagaaaggcuggccucuguaaccccuguaggaaaggccugcuuugu

SEQ ID NO: 4173158 - RNA, 62 nt, Human
acagcuccuggggcuuuaauggauaauccauauuaauaaauauguaggggccuagggggugu

SEQ ID NO: 4173159 - RNA, 85 nt, Human
acagcugugccuuugccguggggccugcugugguuugcucuuggggaguggacccggaacagaggccccugcaggccucagaagu

SEQ ID NO: 4173160 - RNA, 69 nt, Human
acagcuguguuuuauaaucagcgcuaccgaauauuuccuucaugcuguugauuaaggagacauagcugu

SEQ ID NO: 4173161 - RNA, 66 nt, Human
acagcuucuggaaggcucuggaaaagguaaauaauggaccuuuccuagagucucuagaagaaaugu

SEQ ID NO: 4173162 - RNA, 78 nt, Human
acaggaaaggacacagacuuagauuuaaauuacauguaagauucugugguuuuagucuauucucuguccuuuccuugu

SEQ ID NO: 4173163 - RNA, 71 nt, Human
acaggaaugggccauaauccuugguugacaauaaauggacaaagcagcugggugcgguggcucaugccugu

SEQ ID NO: 4173164 - RNA, 65 nt, Human
acaggaauuugcuggaacacagaucauucaacuuccuugguugaaaucguucaguaauuuucugu

SEQ ID NO: 4173165 - RNA, 101 nt, Human
acaggacagaaagauaauucucuuaugaaaagacaguuaauuugcauuuuaugugaauauuuuaaguguuguuuucaagagauagguuucuucugucuugu

SEQ ID NO: 4173166 - RNA, 56 nt, Human
acaggacaggcccuguggggucugaggguuccucagcuuuccagacgccugccugu

SEQ ID NO: 4173167 - RNA, 66 nt, Human
acaggacagguaggauucgcaggggcuugaaagucccauaacucaagugcauuucaccuguacugu

SEQ ID NO: 4173168 - RNA, 65 nt, Human
acaggacuaacuggaggcggggucaaagcuguaauaccacacuccuacuuccaguuuaguauugu

SEQ ID NO: 4173169 - RNA, 76 nt, Human
acaggacuuaaaaguaacaauaagguucuauuuuccauuuggagaguaggcucccgguuguuuauuuuaugacugu

SEQ ID NO: 4173170 - RNA, 57 nt, Human
acaggagauguaccuguuuuugagaggauauaauaaucacucaaacuacucuucugu

SEQ ID NO: 4173171 - RNA, 82 nt, Human
acaggagcaacagacuaagacauuccuccacacaauaacagacccaggcagugcagagccaugugugucuuaucuguccugu

SEQ ID NO: 4173172 - RNA, 56 nt, Human
acaggaguuucugacagagacaggucaaugcgcuugucuccuagcugucuccaugu

SEQ ID NO: 4173173 - RNA, 85 nt, Human
acaggauacauucagugagcaugccuucucaguucuguuuccucccaggagacacacacaggagguggcaaagcugaacaccugu

SEQ ID NO: 4173174 - RNA, 103 nt, Human
acaggauuguugggaauauuaagggaaauguuaggcaugcuugacccuagauggggacucaagacaucacugugcauuuugcuuuuucuuccacagcuccugu

SEQ ID NO: 4173175 - RNA, 61 nt, Human
acaggauuuucagggaaggugauacauuuugcuuuguacuucauuccugaggaauucaugu

SEQ ID NO: 4173176 - RNA, 67 nt, Human
acaggcaagaugugaaacacggaacuguauaaucaaugugccugaguccccucauucacucuccugu

SEQ ID NO: 4173177 - RNA, 64 nt, Human
acaggcagagaguggcggacucagaaucuuaacucugaucuccagcuuucacgcuccugccugu

SEQ ID NO: 4173178 - RNA, 70 nt, Human
acaggcagcuacugugugucagccacugugccagcccuggaaauacaggaaugccacacagccugcuugu

SEQ ID NO: 4173179 - RNA, 57 nt, Human
acaggcauugcaagcagcaguucacuaaccaaaacaaauugcagccuguagucuugu

SEQ ID NO: 4173180 - RNA, 74 nt, Human
acaggccuauguuccauugcagggauuaagaaauacgaacuugaacacaaaauguagugaagcagagggcuugu

SEQ ID NO: 4173181 - RNA, 90 nt, Human
acaggcugcaugggggucuggcuugcaaaggagcucgcauauaaagugaaagcugcucaggagagccaggucuccccacaggcguccugu

SEQ ID NO: 4173182 - RNA, 82 nt, Human
acagggaacacagcaggcccauacuggaaggugcuggggaggcccgggaccccuguauaguauggcaggcugguguaacugu

SEQ ID NO: 4173183 - RNA, 56 nt, Human
acagggagauaucuucaauauccaaagaccgugaaggguaggaaauaucucccugu

SEQ ID NO: 4173184 - RNA, 78 nt, Human
acagggauuugagagugacaauuuuaugaauagguccuuaauaccugcuucuguauugaaauuguuauuuuccacugu

SEQ ID NO: 4173185 - RNA, 83 nt, Human
acagggcucuccacccugagucacugucugucugcccugauuaccccagggccagguaccagacaacucaggacagcccuugu

SEQ ID NO: 4173186 - RNA, 55 nt, Human
acagggcuucuauaccaauucauuguaaauaagagaagugagagagaagcucugu

SEQ ID NO: 4173187 - RNA, 69 nt, Human
acagggcuugcuuuauggauuuguguccuguguaguuacacaagacucacacacagaagagggcucugu

SEQ ID NO: 4173188 - RNA, 64 nt, Human
acaggggcuguuugccucaggcccuuggcuccuuuccccaagggccugugcugucagcccuagu

SEQ ID NO: 4173189 - RNA, 63 nt, Human
acagggucaagcugcguuaccuucgacaaagaugucacuagucugaagcagccuugauucugu

SEQ ID NO: 4173190 - RNA, 124 nt, Human
acagguaaaaucagaagcagguguacaguggggcuccagggccccccaguugcacggacuccuucugaagccugggagggcucuggcaaugugcccacuggucauauauuuuuguacaauuugu

SEQ ID NO: 4173191 - RNA, 60 nt, Human
acagguacauguuccagauacguaacuugaaacuuaaagaugccuugggacagugccugu

SEQ ID NO: 4173192 - RNA, 57 nt, Human
acagguaggcagccggucucuggccuccgcccggcuguacacaaacugccugccugu

SEQ ID NO: 4173193 - RNA, 68 nt, Human
acagguguaagcugcagaacuggaacuugaggucucauagucuucaggcccuuugcugcugccccugu

SEQ ID NO: 4173194 - RNA, 56 nt, Human
acagguguagguacauuugcauacauugauuuguugcaguuguugcuacuaccugu

SEQ ID NO: 4173195 - RNA, 63 nt, Human
acagguucacuaggaacccauuauuuacuaggcaaaaguaaagcuaaccuuagugaacacugu

SEQ ID NO: 4173196 - RNA, 105 nt, Human
acagguugguugggcaauacuucaagauuccauagggcauucaugccuucuuccuggaaguauguguguuucaguggaaauguugauauaauuaauugacacugu

SEQ ID NO: 4173197 - RNA, 58 nt, Human
acaguaaauauuaagccugaguccuucuaauucauaccaggcuugucauucuugcugu

SEQ ID NO: 4173198 - RNA, 73 nt, Human
acaguaauuuauugaacaccuucacugugcccagcauugugcugugagccauugggugauuaaaagaugcugu

SEQ ID NO: 4173199 - RNA, 97 nt, Human
acaguacuguguuaacugaaccaaguacagaugggaauagaguggaucuuucauuugcaugguucugagcaugguucaaauaugcacaaguuucugu

SEQ ID NO: 4173200 - RNA, 69 nt, Human
acaguacuuaacuuauaggagagaaacaguguuuuaccauaaaaugugcuucuguuguaaguuugcugu

SEQ ID NO: 4173201 - RNA, 61 nt, Human
acaguacuucacauuugcaagucuuggggaaucuuuugaagacuuggaguugaaggguugu

SEQ ID NO: 4173202 - RNA, 70 nt, Human
acaguaggaauagauguagauacaugagcauacuucacucugcuacuauaauuauugcuauuccuacugu

SEQ ID NO: 4173203 - RNA, 55 nt, Human
acaguagguaucucauaagguuguuggaacaacuaaaugcauugguaucuauugu

SEQ ID NO: 4173204 - RNA, 77 nt, Human
acaguaguagacuuugggguuauaaucauauugaugacaacugccauuuauuaaaauuccaagguaugccaagcugu

SEQ ID NO: 4173205 - RNA, 76 nt, Human
acaguauuaagaaacugcagagccaugguucaacccaagcugggucugacaccagaaucugagcucuuuccacugu

SEQ ID NO: 4173206 - RNA, 73 nt, Human
acaguauuuccuaggugcucgagugcuuuaaaauaagaacuucugaaguuugggugcaucuaggaagugcugu

SEQ ID NO: 4173207 - RNA, 67 nt, Human
acagucagauuuuuaagaccuuuaacagagugccuugccuauagaaaguucuugauaaguccacugu

SEQ ID NO: 4173208 - RNA, 66 nt, Human
acaguccauaagguugaaaacuguacacuuuugugaguuacacaaguucuuuaaccuaugaccugu

SEQ ID NO: 4173209 - RNA, 56 nt, Human
acagucccugugcaggcugcgggcaucuucaugcugcuggccuguccacgggcugu

SEQ ID NO: 4173210 - RNA, 56 nt, Human
acaguccuuguguggaacauuaugaaaucauaaacggcaguguucacaaugacugu

SEQ ID NO: 4173211 - RNA, 73 nt, Human
acagucgcaauuuguaaacacagaaaagaggaaugaaaugaaaggccgugucugugcuacaaaucgcgucugu

SEQ ID NO: 4173212 - RNA, 128 nt, Human
acagucggugacaaugugcacaucugguauuuccugugugagagcaaaacugcaggacucagugagugguuucugugguuugcacuuguguaucuggguguaugggaguguguagcccugcugacugu

SEQ ID NO: 4173213 - RNA, 57 nt, Human
acagucuacucaggaaguccccgagaucaaagcaaggggcuuuuuauuuagcacugu

SEQ ID NO: 4173214 - RNA, 72 nt, Human
acagugaacaucugggaucauugcuguguauuccccgcaacagagagcugcagaauggcccaggugcgcugu

SEQ ID NO: 4173215 - RNA, 55 nt, Human
acagugauuucucuccguuauuucagagaacacugaaauaccagaaaaucagugu

SEQ ID NO: 4173216 - RNA, 57 nt, Human
acagugcacauccugagugauuuuccaaauuacugaaucauuuacuuguuccacugu

SEQ ID NO: 4173217 - RNA, 76 nt, Human
acagugcauuguguauuucuguaguacuguuuugcauuuuccauagagacagaaaacuuugcaagucaaucacugu

SEQ ID NO: 4173218 - RNA, 59 nt, Human
acagugcuaucaauagcuagaaguuaaauuaaauccuucauugcuagugagcuuacugu

SEQ ID NO: 4173219 - RNA, 118 nt, Human
acagugcucuggcccaggcuuuguccaugcucugguggaugaauguccucguacaaugagucacccuuuaucugacaggucauuuucuauagagaaagccaauuaaaacagagacugu

SEQ ID NO: 4173220 - RNA, 65 nt, Human
acaguggaaucucaagcuggaagaaaccuuagaggucaccuaaucuuugcaugaguucccucugu

SEQ ID NO: 4173221 - RNA, 63 nt, Human
acaguggucuggaggcccagcaacucucuaauaggucagggccacaacaccagaguccacugu

SEQ ID NO: 4173222 - RNA, 74 nt, Human
acaguguaaauaacucuccagaauuauuacuauuauuuuuaauaaagguaauauuugggggaaaauuauauggu

SEQ ID NO: 4173223 - RNA, 55 nt, Human
acaguguccuaaauucccacagauggcauuuacacugugugaacacggacucugu

SEQ ID NO: 4173224 - RNA, 55 nt, Human
acaguguccuuguggucccuguugaguuggaauuaggggagucuagggaggcugu

SEQ ID NO: 4173225 - RNA, 55 nt, Human
acaguguucaaaccacuaggcugcagacuguauuuuauuugguuugggcacaugu

SEQ ID NO: 4173226 - RNA, 82 nt, Human
acaguguuuguacagccagcuaugcagcugaaggcugccauguaguagcugcuacacuguuuggcuccuguacuuauacugu

SEQ ID NO: 4173227 - RNA, 58 nt, Human
acaguguuuuaugagaauuguuggucaugcccagcuacacaauccucaugcauauugu

SEQ ID NO: 4173228 - RNA, 130 nt, Human
acaguguuuugcccaccccaaccaauguccuugucacuucucagggccucccucuguuucugucuucuggcugagacagaugggcuccugaagagcacacaagagguggaaggggccugugcucugcacu

SEQ ID NO: 4173229 - RNA, 104 nt, Human
acaguuacuaacaugacaacagauuugguuucaggugccuuuguauacacucacacucacaagaggcacuccagccacuggucuucuuugcaauacaagacugu

SEQ ID NO: 4173230 - RNA, 67 nt, Human
acaguuagccuggcacugccccauccaugcaguccaugggcaggaugacuuugcgugccggaagugu

SEQ ID NO: 4173231 - RNA, 59 nt, Human
acaguuagggacuauaaucauuuggaagcuucuuuacucauguuuagugccuagucugu

SEQ ID NO: 4173232 - RNA, 70 nt, Human
acaguuaucuuugaaauagagaaaguaagagcugcaguguagauucucaaauuauuuuaaggacaacugu

SEQ ID NO: 4173233 - RNA, 76 nt, Human
acaguuauuugcaggaugggcauugguuggauuuuucuugaauuaaugaaaucuguauugcucauacuugaauugu

SEQ ID NO: 4173234 - RNA, 74 nt, Human
acaccuaaucuauuggguaaauaauguguguuucagaaaaucuacugugaauuuacauaauagacuuuaggugu

SEQ ID NO: 4173235 - RNA, 102 nt, Human
acaccucaguuccuucuacaugagucaugggcuugagguuacccagaaauggacugugaaccuauaaaccccagcaugcaugugguauugcgucgagcaugu

SEQ ID NO: 4173236 - RNA, 106 nt, Human
acaccuccuucaucugugcuuagccgcagcgucugcccucgcuucuuccuaggggucugaggaccucugaggugaggaggagcuuuuugaggaacaugggaggugu

SEQ ID NO: 4173237 - RNA, 85 nt, Human
acaccuguauguugaggcaccucccagcaccaucagggagcaucuuauguuucuuuugcugagaggggcacaagcccacaggugu

SEQ ID NO: 4173238 - RNA, 85 nt, Human
acaccuucagcugcgaggagagcuguagugagaccuuugugucuaaugacugccgucucucuucaauuucauguaaugagugugu

SEQ ID NO: 4173239 - RNA, 55 nt, Human
acaccuucauucaaaugggcuugcagauuggcuuagccugugagaggacaggugu

SEQ ID NO: 4173240 - RNA, 71 nt, Human
acacgaggaucugauggacagggcuggaggugcagcuccugugccucucuguaagggucccucccucgugu

SEQ ID NO: 4173241 - RNA, 67 nt, Human
acacguaaaucucucaguggccagagagccacugaguggcucucugaccacugagggauuuacaugu

SEQ ID NO: 4173242 - RNA, 58 nt, Human
acacguacaauggauccaacacagugcacagcaaauaguugaauauccauguaugugu

SEQ ID NO: 4173243 - RNA, 83 nt, Human
acacguguaccuguguggaaaccgcaugacgaggcuaacaggcucacacaccuuccauguggucuccacacaagcaacacugu

SEQ ID NO: 4173244 - RNA, 63 nt, Human
acacuacaguagugaaacuccuacaugugguugcacagggagugcaauucauauuguagaugu

SEQ ID NO: 4173245 - RNA, 74 nt, Human
acacuagcgauucuagccaaccaucugagaucacgccacuggguccagggagagggcaggauggaugagagugu

SEQ ID NO: 4173246 - RNA, 81 nt, Human
acacuauacuuccauugcugguggccuugagaauagaaacauuuggcucagcaagaaucugggaguaaaauucuuuggugu

SEQ ID NO: 4173247 - RNA, 79 nt, Human
acacuauguccuuuacaucugacuucuuucacuuaguguggugauuuugaguucaugauguagaaugugucaguagugu

SEQ ID NO: 4173248 - RNA, 56 nt, Human
acacucacucacucucucuggaauguccauuuauacagagcugaaggguguagugu

SEQ ID NO: 4173249 - RNA, 58 nt, Human
acacucuacagagcaaucuaccugcaggaagcagguggaauagaagcuuuguaggugu

SEQ ID NO: 4173250 - RNA, 63 nt, Human
acacugacugggcaguauagucaacgguuguuuagugacugccuucuauaugcuuagucuugu

SEQ ID NO: 4173251 - RNA, 60 nt, Human
acacuggucaagagcuagcagagcuagggucuggcuucauuucuguccuugauuagcugu

SEQ ID NO: 4173252 - RNA, 65 nt, Human
acacugugaguaacugagauccaaucccauugggauaugcuuccaaguuauuccacccaaagugu

SEQ ID NO: 4173253 - RNA, 81 nt, Human
acacuguucuaguuaaaguauguauuagccaaaaucauaaacuaaguaugcuucaccauaaauuaacuggguguuuagugu

SEQ ID NO: 4173254 - RNA, 62 nt, Human
acacuugaggaauguggugauucucagaacagaaagggagagaaguacauaucugugagugu

SEQ ID NO: 4173255 - RNA, 60 nt, Human
acacuuuaagcauuucacacuguuuaugaaggcccuaccuuccagguggaauuaaugugu

SEQ ID NO: 4173256 - RNA, 55 nt, Human
acacuuuagaaaaaagaauggugcauguaauuaccaauccuucacucuggagugu

SEQ ID NO: 4173257 - RNA, 79 nt, Human
acacuuuauucauuaugaccaaaucuagugcaucaaagaauacagauggccuagggauuggucauaagaagcaaccugu

SEQ ID NO: 4173258 - RNA, 58 nt, Human
acacuuuguccuuuuucauuguauuuagauaauuaaucaaugagacagagcagagugu

SEQ ID NO: 4173259 - RNA, 63 nt, Human
acagaaaaggacggggacgcaagucagcaagccaccaggcaugugacuucaccugucuacugu

SEQ ID NO: 4173260 - RNA, 73 nt, Human
acagaaaaggaugcugcugcauagcuucuccaauguaccagucauugaggccagcgcgcagcacuuuuaaugu

SEQ ID NO: 4173261 - RNA, 113 nt, Human
acagaaacauauuucuuacaguucuagaagcugggaaguccgagaccaaggugccagcaaaugugguaucuggugaggguuccccugcuucauagauggugccuuguuacugu

SEQ ID NO: 4173262 - RNA, 73 nt, Human
acagaaaccagugucagaaggucuagcacaaggcuggccacucaggccugcagcccuuccugcauguuuuugu

SEQ ID NO: 4173263 - RNA, 62 nt, Human
acagaaaccuggggguuguacauaacgcaggccccagcuauguuuuaccccaggguuugugu

SEQ ID NO: 4173264 - RNA, 60 nt, Human
acagaaauccaauuuaaacacuuauugcuuuuuugagccagaauuaaauuggauuugugu

SEQ ID NO: 4173265 - RNA, 62 nt, Human
acagaacaagaccugcuuauugguggauaagacaaccucuaguaaggcagcucuuuucaugu

SEQ ID NO: 4173266 - RNA, 59 nt, Human
acagaacagaugugggcuacugugggaucucuguggauccccagauucaugucugcugu

SEQ ID NO: 4173267 - RNA, 74 nt, Human
acagaagaaguucaaggugaagucuggggcuauacauuucaaggucauuuauguuucacugugaguuuuucugu

SEQ ID NO: 4173268 - RNA, 71 nt, Human
acagaagcauggcaggugugggguuuuauggggagcacuuccguauccucuuccugcugugcuugagcugu

SEQ ID NO: 4173269 - RNA, 100 nt, Human
acagaagucaugaugauggggcccaugacuggcaaccugcugggagagguggccugcagugugucuggaguacaugggggaccccgggagcaucuucugu

SEQ ID NO: 4173270 - RNA, 61 nt, Human
acagaaucgaccuuugcaugcaaugcaauuuguacagaauugcuuugcagguggauuuagu

SEQ ID NO: 4173271 - RNA, 99 nt, Human
acagacacacccuaaaacucuccagucuuuccacuguaguuaugaugaaguuaaaacuccuuaauuucuccagacagcugugcaaaaucuggugucugu

SEQ ID NO: 4173272 - RNA, 64 nt, Human
acagaccuggguuggacacuuugggcagguuauuuauccucucugugccaguuuccaugucugu

SEQ ID NO: 4173273 - RNA, 84 nt, Human
acagagaaggcuguucuagucuguaagucacccauuaccauaaacucugguuuugagcuacuugcagcagcagcuauuggcugu

SEQ ID NO: 4173274 - RNA, 84 nt, Human
acagagacagacuaugagccaggcuggauagaaacugugcugcaugcauuggugucuuccucuuggcuugagcuuguccauugu

SEQ ID NO: 4173275 - RNA, 62 nt, Human
acagagaccagcaucuucugccuguagucagcauuucagaaagacaauuguugguuaucugu

SEQ ID NO: 4173276 - RNA, 65 nt, Human
acagagagggagugauaaauccuaugggcaaggacauacacucauaugucacucaccuccuuugu

SEQ ID NO: 4173277 - RNA, 57 nt, Human
acagagcaacuuuauuucaugguccuucaugugaccacuccauaugguugauucugu

SEQ ID NO: 4173278 - RNA, 64 nt, Human
acagagcagcuggcucugggaaaaacuggaaaaccaaguuuguguuccccagccggcucccugu

SEQ ID NO: 4173279 - RNA, 57 nt, Human
acagagcagguccagaagugccaggacagguugucaggcuuggaccuucugcucugu

SEQ ID NO: 4173280 - RNA, 60 nt, Human
acagaggaaggcugagcugcccuucacacacgugggcuugccuggagccauuccaucugu

SEQ ID NO: 4173281 - RNA, 113 nt, Human
acagaggacauuaaaagccaugcuaagaaguuuggcauuuauucuaaggucaaagggaagccaauugaaauuuaguaugaagccauuuuaagcacggguguaguguuuuuugu

SEQ ID NO: 4173282 - RNA, 63 nt, Human
acagaggagaugaggagcagaggacugggggugaagaguucugugcucaaguucugccucugu

SEQ ID NO: 4173283 - RNA, 59 nt, Human
acagagggccagccgacuuccagccuccucaacgauguugcuuaaggcuggcuuugugu

SEQ ID NO: 4173284 - RNA, 86 nt, Human
acagagguucauagauacugcuccucaagggaaccugaguggcuauggccaccaggacagcccugaggggguucaguacccuuugu

SEQ ID NO: 4173285 - RNA, 94 nt, Human
acagaguaacucaucccguugaaacuuaguugaaauuuacacucuauccaaaguggauuuuucugagaugucaggaaugugagauuuauucugu

SEQ ID NO: 4173286 - RNA, 62 nt, Human
acagaguacauucagagacuaugcccacuuggcaugguuagagcauagaaugauacuagggu

SEQ ID NO: 4173287 - RNA, 57 nt, Human
acagagucauaagcggagcucgccauugccuaggggagcagagugcuuugacuuugu

SEQ ID NO: 4173288 - RNA, 85 nt, Human
acagaguguagcuacacaguuaaaggcccaauaucuggauaaggucagccuuagauuuagacccugccugacaguuacucucugu

SEQ ID NO: 4173289 - RNA, 72 nt, Human
acagaguuagaaaugucacagaucugauuugacaaacugucugaucuuggcugcauuucuauuccuuucugu

SEQ ID NO: 4173290 - RNA, 75 nt, Human
acagauacauaaacacuucuagggcacacagauuuucauguauguguguacuaugguguuaaugcagaauucugu

SEQ ID NO: 4173291 - RNA, 57 nt, Human
acagauacucagcucuaugcuuuaggcaaaaaauuaguacuggcagcuguagucugu

SEQ ID NO: 4173292 - RNA, 75 nt, Human
acagauagaaaggcucacgcaguuagugaugcuggagaaggaguauucaauugcaaggugggcaagguuaugugu

SEQ ID NO: 4173293 - RNA, 91 nt, Human
acagauaggaaacuaacucccuuuucccguaaucuauuugaggaagaugguuccgagcugggaaggggcugcagguggguuaccugucugu

SEQ ID NO: 4173294 - RNA, 80 nt, Human
acagauauucagaaguaacugugaaguaauuguggaugggauccaugucuacuugguauguuugucuccugagcaucugu

SEQ ID NO: 4173295 - RNA, 76 nt, Human
acagaugcauugcaucgaguagcuucucuggucacuggugaccacgcaucaacggagcugguuauguaacaucugu

SEQ ID NO: 4173296 - RNA, 55 nt, Human
acagauggcaccuuuuugcuguguugucacacaauagaaagaaagggcuagcugu

SEQ ID NO: 4173297 - RNA, 60 nt, Human
acagauggugagccgcugaugucugcacacggcugagccaggcagcucacuacuuucugu

SEQ ID NO: 4173298 - RNA, 64 nt, Human
acagauguugcuugucauucucuuguuguuaagcaggcaccagauuggaucaagcagcaguugu

SEQ ID NO: 4173299 - RNA, 78 nt, Human
acagauuuggcugguuccauagugagaggaggagagugucaggcuucugagaccugccucugcacuaggccgcccugu

SEQ ID NO: 4173300 - RNA, 58 nt, Human
acagcaaacaggccaguuaaaugaagugaauuccauucacuggcagccugccugcugu

SEQ ID NO: 4173301 - RNA, 130 nt, Human
acagcaacauggcaaaaguugaaaggaaacuguuuggccugggugauuuuuugucuuucaggcagaguaaugaguaaauacaaaaucaccucuggugagacacaguccacugguguuuaugucaugucau

SEQ ID NO: 4173302 - RNA, 96 nt, Human
acagcacucaacagggcagccuaggaugcguuuugugugcaaagauguauagauucacuuguacaacacauauucuacagugccuuugggaguugu

SEQ ID NO: 4173303 - RNA, 59 nt, Human
acagcagagaagacacaggcuucaucaucaagcagaacuggaccuguccuucucgcugu

SEQ ID NO: 4173304 - RNA, 64 nt, Human
acagcagcuggguucccaccauccccccacagugccuagcacggggcugggagacaccugcugu

SEQ ID NO: 4173305 - RNA, 68 nt, Human
acaguucuaugucagugugcucugugguacuauauuuacauacaaguacacuacacauaacacacugu

SEQ ID NO: 4173306 - RNA, 83 nt, Human
acaguugagaagaugagguugacauuuugugcuaaguaugagacauaauagcugaaugugaccuuaaagauuuucagaucugu

SEQ ID NO: 4173307 - RNA, 57 nt, Human
acaguugcagcacuacagauuauuucagcugaauaaaucugugcucccugcauuugu

SEQ ID NO: 4173308 - RNA, 67 nt, Human
acaguugccuguuuccuugugugucucucccacucaaaugugagauauuccaggacaggugugcugu

SEQ ID NO: 4173309 - RNA, 59 nt, Human
acaguugguuuugaggcuguacuggauacucagcagcucccuccucagccacccacugu

SEQ ID NO: 4173310 - RNA, 71 nt, Human
acaguuuggcgugauugauagucuuggcucaggagagucccagaauugaacuaacaaccacacuaaauugu

SEQ ID NO: 4173311 - RNA, 78 nt, Human
acaguuuuuccccuucggagaccuuugaaguuuguuuauucuuacaaagcucuggaaggcucgucugaaagaagcugu

SEQ ID NO: 4173312 - RNA, 60 nt, Human
acauaaauauuuuaugcucuuucauguuuuacuauaaggaagaggcaucacuauuugugu

SEQ ID NO: 4173313 - RNA, 62 nt, Human
acauaaccuagaggaagaugggucagagaaugcuucucagagcugagucuucaagguugugu

SEQ ID NO: 4173314 - RNA, 76 nt, Human
acauaagccagauucucaacuuacguaauucuaugggaauucacagaguuauauugguugagaauuuggcuuaagu

SEQ ID NO: 4173315 - RNA, 63 nt, Human
acauacagaccugcagggcagccucgcacuggaauagugguagcccugacuucuucugagugu

SEQ ID NO: 4173316 - RNA, 62 nt, Human
acauaccuucucuuggagaacucacuuaagcuguuaagugaguucuccaagagaagguaagu

SEQ ID NO: 4173317 - RNA, 62 nt, Human
acauacuuugggauaagaguggauauaauuaaugcuuuguucugauucauuccagagugugu

SEQ ID NO: 4173318 - RNA, 78 nt, Human
acauagaacuggugaagugaagggcagaagaaaggaaucauaggguuaguauuuguccuucauuauauuuguuuuugu

SEQ ID NO: 4173319 - RNA, 57 nt, Human
acauagaagugaugcuuauccacuaacaguccuguuuuggcagugucaugucuaugu

SEQ ID NO: 4173320 - RNA, 93 nt, Human
acauaggcaaucaaugcugcuaguuccuuuuucuucuccucuccccagaggucaaguugccuuaaugaauugcaguacugacuugcuccuugu

SEQ ID NO: 4173321 - RNA, 65 nt, Human
acauauaauggguguggcagaaggcuugguauuuauggcauuucugucauuuagcauugucaugu

SEQ ID NO: 4173322 - RNA, 78 nt, Human
acauauacuaugacacaggccauuauauauguauguguguauaugugugugugugucuguguacaugcaccaauaugu

SEQ ID NO: 4173323 - RNA, 91 nt, Human
acauauagacuuuuugcacuguggaaguagauuugagaagguaaagucauuuauuaacucaacaaauauuuacugagugccuauuaugugu

SEQ ID NO: 4173324 - RNA, 68 nt, Human
acauauagauuaaugcauaaagggauacguagauagaucuauuugcucuagcugcagugaauauaugu

SEQ ID NO: 4173325 - RNA, 86 nt, Human
acauaucauuauacauuugucaaaacacagagaacaccaggaaugaacucuaauguaaacuggauuugagggugguaaugaugugu

SEQ ID NO: 4173326 - RNA, 75 nt, Human
acauaugcaguacagauaauucuacaaaaucauagucguuaguugaucccauguagugugugugugugugugugu

SEQ ID NO: 4173327 - RNA, 82 nt, Human
acauauggguuguuuucaguuuagaagaaucaugaacaacacugugaugaauuuuuuggacuguguuuuggugaauauaugu

SEQ ID NO: 4173328 - RNA, 70 nt, Human
acauauuccuguuuuuaacacuuuggcagcaaauaagacaagauuacuaaauguguuauaggaguuaugu

SEQ ID NO: 4173329 - RNA, 57 nt, Human
acauauucuucaucagagaugcacuagaaaacacugucuagugcguaaagaaggugu

SEQ ID NO: 4173330 - RNA, 60 nt, Human
acaucaguccuuagucuggauggcuucuuggagccacagcaaccucaaaggagcuaaugu

SEQ ID NO: 4173331 - RNA, 72 nt, Human
acaucaucuggugcuaacaaauguggaacacuucacugaguacucugaacauuuuuugcagccuaugauugu

SEQ ID NO: 4173332 - RNA, 93 nt, Human
acaucauuguacagaggaauguucuggaacaccgcuuuguaagauaguucaaggugaugugcaaagcaauauacaguuuguacacaugguugu

SEQ ID NO: 4173333 - RNA, 92 nt, Human
acauccaaaguauguagcaguggguuggguaccagugccagagcaggcuccuggaggccgcuggcugggccgggccuugugccuuuagaugu

SEQ ID NO: 4173334 - RNA, 69 nt, Human
acaucccaacauugccacaugccacguuuuaaauuuaaacaaauaacaguauaacaguguugggugugu

SEQ ID NO: 4173335 - RNA, 76 nt, Human
acauccuucagcugcccuguuaccaaggugcacagccuugaacaaguaggaaguggcagggaggguugaggaaugu

SEQ ID NO: 4173336 - RNA, 61 nt, Human
acaucuccaggaaccaucaugguaacuaaauuaauuguuuaccguauucuuucuggaaugu

SEQ ID NO: 4173337 - RNA, 63 nt, Human
acaucugacucaguuuucugccacaaucuagagagaaaguuuggcuaaacuugggucagaugu

SEQ ID NO: 4173338 - RNA, 126 nt, Human
acaucuggcugaagggugaaaaugaacacaaucacccagguguuuggccugcaugaugacagauaucaaacacuuagaaccaucugggugauuggcauauuuucuuuuucacuuuuauccagaugu

SEQ ID NO: 4173339 - RNA, 80 nt, Human
acaucuugauauuuuuccuuuuuucaccuggccuuucagagcugaaaggucauugaaaaggaggaaguacuuuuaagugu

SEQ ID NO: 4173340 - RNA, 65 nt, Human
acaugacucaucaggaaguucagcucuaguuacaauuuauagcaagcuaccuagauagucuaugu

SEQ ID NO: 4173341 - RNA, 63 nt, Human
acaugagggacguaauucuaaagaguacuggccuugcaauaacucuuuagauuuaucuuaugu

SEQ ID NO: 4173342 - RNA, 71 nt, Human
acaugccauuuacuuggaggagagaggcuugugaaacagcacuaagguuucagucagguugaugaguaggu

SEQ ID NO: 4173343 - RNA, 59 nt, Human
acaugcccaccuucaucagauggaaaccacacacuuguuuauucugcagggggccgugu

SEQ ID NO: 4173344 - RNA, 75 nt, Human
acaugcuauucuagccaaagaagguauauuuguauagauauaaaaucucuacagauuuuuggcugggauauuugu

SEQ ID NO: 4173345 - RNA, 62 nt, Human
acauggaagcaaaguucuauuuuaaacuugauaagcuggagaugucugcuaugcuuccaagu

SEQ ID NO: 4173346 - RNA, 94 nt, Human
acauggagacagggacuuggcccaccugccugcugguggucaccugucuugcuggugcucagaaggagggggcaagcccuggagcuuucccugu

SEQ ID NO: 4173347 - RNA, 61 nt, Human
acauggcacaacccugucucuacuaaaaauacaaaaauuagcagggcgugguggcacaugu

SEQ ID NO: 4173348 - RNA, 64 nt, Human
acauggcaggggcugguagauuucagaugaauuccucccauguaugugccauccccagucaagu

SEQ ID NO: 4173349 - RNA, 55 nt, Human
acauggccacagggucacacgcuguuaggggcagagccaaaugcugugguuaugu

SEQ ID NO: 4173350 - RNA, 59 nt, Human
acauggcgggaguuucagauaccauacaagucacuggucucucuggaacaacuucaugu

SEQ ID NO: 4173351 - RNA, 66 nt, Human
acaugggugaaucuuaaagacauuacgcuaagugaaagaagccagucuccagagguuacauccugu

SEQ ID NO: 4173352 - RNA, 87 nt, Human
acauguauuuuggaaggugcauuuugggcaaaugaucaacauuuguuucuuuggcuaugauuuacuguuuaauuccaaaaguagugu

SEQ ID NO: 4173353 - RNA, 58 nt, Human
acaugugcucuugcuguacagcccuggcuaauuaguugacagcauuacuaauacaugu

SEQ ID NO: 4173354 - RNA, 116 nt, Human
acauguggucagaggaggaugcaugacuugggaggaugucugcccugugaccugagggaagacuaagaauucagggcaugucugauggcccaagucaucccgcucugaaggugugu

SEQ ID NO: 4173355 - RNA, 85 nt, Human
acauguguuuuccuacuuaugacggucacaacuuaauuaaauaaacuggaagcuuagguauagcaugaauagggcauauauaugu

SEQ ID NO: 4173356 - RNA, 57 nt, Human
acauguuaaacaucauggaaugaagucauaaaacucagacuguggauuuugacaugu

SEQ ID NO: 4173357 - RNA, 130 nt, Human
acauguugguuaggggcacucccucucuccuuccuuccaguggcacuggagacuagagcagcucccugaacaggcucuggcaucaggcugccuuggauuugaaugcaguucuaaugccuccuagcugugu

SEQ ID NO: 4173358 - RNA, 65 nt, Human
acauuaaagaguaagguuaguuuaccaccccaaggugagcuucaaugugccuauaccuuuaaugu

SEQ ID NO: 4173359 - RNA, 113 nt, Human
acauuacaagguaugaagcguucgagauagguagaauagagcagguuauauuagagaagucucuucuaaaauuguguuggcuagccugggauuugaacuuauaccguguaugu

SEQ ID NO: 4173360 - RNA, 67 nt, Human
acauuacaaugaugggauucagccaugucaauucaugugguuguaguucauucauucucacugaugu

SEQ ID NO: 4173361 - RNA, 129 nt, Human
acauuagccucaucugaggaacuuaaaaaacacugaugcccaggccccaccucagugauucugauuugauuccucuggguggagccuggucaucuguguuugaagaaucuucccaagugaggcuagucu

SEQ ID NO: 4173362 - RNA, 110 nt, Human
acauuagcuucuggaauccuugcauuauacagauagaguucucgugggacuaccacaagcagcaggaaucuguucuguauaagaauuauagauuuugaauuagaaaaugu

SEQ ID NO: 4173363 - RNA, 64 nt, Human
acauuauacagguagggucuauguuagauaaaacuguuucuaaaaucuaacucuaccuguuugu

SEQ ID NO: 4173364 - RNA, 72 nt, Human
acauuaucccuggcacaacugccucuuagcuagaucuugaaagugccuggggcaaugaccagaggagaaugu

SEQ ID NO: 4173365 - RNA, 65 nt, Human
acauuauccugcuuuuaagccucaaauuauggccaacccagccauuagugaaggaaggaugaugu

SEQ ID NO: 4173366 - RNA, 68 nt, Human
acauuaugcuaagugcaacaagccagucacaaagagacuaauacugugugauugcacuuauaugaggu

SEQ ID NO: 4173367 - RNA, 80 nt, Human
acauuauugaacagcccagguuuaccuuuucauccuauguauugagugggguuaaacuucugagcugugacaguugaugu

SEQ ID NO: 4173368 - RNA, 90 nt, Human
acauuauuuaacuuuucuugcaaagugcuuuucuaucucuuuugguaaguguaauuucuauuaugagaggagaaaagucagggcuaaugu

SEQ ID NO: 4173369 - RNA, 107 nt, Human
acauuccaacuucccaucauggugaacaaggauucccaaagaagaaauguccaaguaauuuuuaccucguuguguccuuguuccuuaggaaaaauauggcccagugu

SEQ ID NO: 4173370 - RNA, 56 nt, Human
acauucuacaggacuggcaaucccuccuaaaggagaggaaaacccuguagugaugu

SEQ ID NO: 4173371 - RNA, 56 nt, Human
acauucuauuguagcacccuguaauuuuccuuuacagcaugaucacaauggaaagu

SEQ ID NO: 4173372 - RNA, 89 nt, Human
acauucuccaugaguuuguguucaugucuggccagcggggcugaccuucugcagcccugagcuagugugggcaggggcuuggagaaagu

SEQ ID NO: 4173373 - RNA, 55 nt, Human
acauucuguaucaucugucucacauuuuaccauuuggagcaggugugcagaaugu

SEQ ID NO: 4173374 - RNA, 76 nt, Human
acaaucagcauguauugcugagaauucucccaaacaauuacguuugaagagcuuuucuguaauaacaucugaaugu

SEQ ID NO: 4173375 - RNA, 81 nt, Human
acaaucgaaaccugcuaagugucuguguuucugcaauccugcagggguuguugaaagacauuauuuauauauuuccuuugu

SEQ ID NO: 4173376 - RNA, 65 nt, Human
acaaugaacacacaaggaauucucguccagacaaagaugaauggauucaucuguuuguucgcugu

SEQ ID NO: 4173377 - RNA, 65 nt, Human
acaaugaauuuaauaccuuauuucacguucaaggaaaccagggguagggcaguuaaguacaaugu

SEQ ID NO: 4173378 - RNA, 59 nt, Human
acaaugaugguauugaugagcuaauuugaauugagugcaaucauugccauuaccauugu

SEQ ID NO: 4173379 - RNA, 72 nt, Human
acaauguaguugucaugagacaauagacuauuugacuuagcaagucuucaguuauauugccaaguauauugu

SEQ ID NO: 4173380 - RNA, 67 nt, Human
acaauucuggguauuuauauaggguaauuaaaacuuaaaggcuuuuuguauguauacugagaaucgu

SEQ ID NO: 4173381 - RNA, 70 nt, Human
acaauugcaaacuagcaucaacuaguacaucaucucuuugaagacugcuggucuauguuauguaucaugu

SEQ ID NO: 4173382 - RNA, 61 nt, Human
acaauuguggcaauuuguauguuuuaacuugaacuuauuguaccaauugccuucuaguugu

SEQ ID NO: 4173383 - RNA, 57 nt, Human
acacaaaaucaaaguccuaggcugaugugacagcucucaaauggcuuuguucugugu

SEQ ID NO: 4173384 - RNA, 71 nt, Human
acacaaugugauagcuaugguggggcagaaaacaauuucugauauaacacucuagcuauaacaacuggugu

SEQ ID NO: 4173385 - RNA, 74 nt, Human
acacacacacauuuaaaaaggaacauauggucuuuuaagugaaccuuuaaagugugagagaagggcaugugugu

SEQ ID NO: 4173386 - RNA, 76 nt, Human
acacacacauguauagacacucauacaguuacuucugaacuuggcugugcugcauuuguuuguugcaugugucugu

SEQ ID NO: 4173387 - RNA, 75 nt, Human
acacacagauuuuacauggugggucaaggauucaauuaaugucauuuggcuucaaaaucuaguggucuguguugu

SEQ ID NO: 4173388 - RNA, 74 nt, Human
acacagacaucauccucagcuucccacgugugcaacccagcaucaguggagcuaagcaugagauaaaauugugu

SEQ ID NO: 4173389 - RNA, 120 nt, Human
acacagaucauuggaccucaccccagaguucugauucaggagguguugccagugccgccgguccagggaccacacugugggaaccacugaaucagggagccuggucccaguuauaugugu

SEQ ID NO: 4173390 - RNA, 81 nt, Human
acacagcaaugccuaggguggauuugugcagagugauuagagccuuagucuggaauaaaacuacuuacaacgugaaugugu

SEQ ID NO: 4173391 - RNA, 56 nt, Human
acacagccgugaaucugcuucucuugcuacuaacagaacaguggaaauggcugugu

SEQ ID NO: 4173392 - RNA, 63 nt, Human
acacagccucuuaagagaaucagaauuuguuucuuccuuugucugucucauaaaggggugugu

SEQ ID NO: 4173393 - RNA, 69 nt, Human
acacaguaaauauugucuccucugugaucauaauagugaugaaaaugauggugacagugaugcugaugu

SEQ ID NO: 4173394 - RNA, 58 nt, Human
acacaguaggccaccaugucauggccagcaugggcgaugugaugguggguugcucugu

SEQ ID NO: 4173395 - RNA, 80 nt, Human
acacagucgugauuagaauuuaacugaugguuuuguauuauaacuucuaagaccugccagaaugcuaguccugagagugu

SEQ ID NO: 4173396 - RNA, 77 nt, Human
acacagugggccuagcaagccugcuacuagagacagccaugggcugguuuagcuguaagguucccucucauuugugu

SEQ ID NO: 4173397 - RNA, 55 nt, Human
acacaguucaggaucaaauagcaccacuuacuggguuuuuaacucuugacugugu

SEQ ID NO: 4173398 - RNA, 100 nt, Human
acacauauguguguguauauguguauauauacacauauguguguauauguguauauauacacauauguguguauauguguauauauacacauaugugugu

SEQ ID NO: 4173399 - RNA, 61 nt, Human
acacaucaccuguccacgcagucugccuaaauccuggccaggaaaaacguggugggagugu

SEQ ID NO: 4173400 - RNA, 64 nt, Human
acacaucuacugauauuccaggaaaauaacucucuuauuuccuggaauacacaguuuggugugu

SEQ ID NO: 4173401 - RNA, 72 nt, Human
acacaugacccacaggaauauaaguuugaguuugccauauuugggaauuuuuguguuucugagucaauaugu

SEQ ID NO: 4173402 - RNA, 77 nt, Human
acacauguacacacaaucucuggucaguauuccuauuaggaaaugugccacaugauauugucucuauguaagugugu

SEQ ID NO: 4173403 - RNA, 60 nt, Human
acacaugugcaugugcacacaugcgugcacaaacaugcagugacacacaugcacaugggu

SEQ ID NO: 4173404 - RNA, 59 nt, Human
acacauuauaggcaaucaaaagugauaauagaaagauuuguugaaugcuuauuaugugu

SEQ ID NO: 4173405 - RNA, 70 nt, Human
acaccaagucuguuucccacauuucuggagaccaaggaauucaagaucaagguggcagcagauuuggugu

SEQ ID NO: 4173406 - RNA, 82 nt, Human
acaccaccacacagcugcucuucuguugaaguuguugcugcauuaaugagcuuccagacaaaggcaugacuguguggugugu

SEQ ID NO: 4173407 - RNA, 115 nt, Human
acaccacguuaagaaccauggcuacuuauaccauuaagccucacuuaguuccuaagcagagcuucauauucaauaaucuguggauggauugaggcagugggagugccgugggugu

SEQ ID NO: 4173408 - RNA, 129 nt, Human
acaccagugucauuagcguaaggacacagaggcaggagcaaaguucacagaagauuccaauuccacccagguaugaauaggaaauuaucuguggaauggucugcuuccccuuaguuacacaugugguuu

SEQ ID NO: 4173409 - RNA, 67 nt, Human
acaccauucauguuuuugaacuaugcauuugauaacaaagguauguuucaucaggcauggagugugu

SEQ ID NO: 4173410 - RNA, 67 nt, Human
acacccaacacuguuauacuguuauuuguuuaaauuuaaaacguggcauguggcaauguugggaugu

SEQ ID NO: 4173411 - RNA, 78 nt, Human
acacccacucaaugucugucuaucuauuuaaauagggcuucuucccccaguggauagaaggaagaauugaucacgugu

SEQ ID NO: 4173412 - RNA, 69 nt, Human
acacccacuggcccauaaaggccugggagccacgccagcacccaaggccuucaagccagcucagggugu

SEQ ID NO: 4173413 - RNA, 96 nt, Human
acacccucaggcagccuccaucauuugauacagcugucuguucaagucugccaacaggacaguuaaaaauagauggccagucuccuuuaagggugu

SEQ ID NO: 4173414 - RNA, 59 nt, Human
acaccuccugcccagguaaggaaccugucugucccugccuuugcaauugaggaggaugu

SEQ ID NO: 4173415 - RNA, 80 nt, Human
acaccuucugcucuccccagaagacuuggaguugcuaucauauuucuguggcagcucccagagcuuccaagcugaggugu

SEQ ID NO: 4173416 - RNA, 71 nt, Human
acaccuugccacauuuguuacauucguaagguuuuucuccaguaugaauuguccgauguugugcaaggugu

SEQ ID NO: 4173417 - RNA, 125 nt, Human
acacggccgcuuuggggccccgagucuuugucugccugggacuggauguguuugugucggugugacuaaugggauuuauggaugucagugccagggugacugaugaagggcuuggcagcacgugu

SEQ ID NO: 4173418 - RNA, 64 nt, Human
acacuaagaucuaggcacuagcuugaccuuccagaguguuucacaagcuuccaggaucuggugu

SEQ ID NO: 4173419 - RNA, 81 nt, Human
acacuaccuagugacaacauugaguuaugugcagcuuaguuaugugugauaugugugauucuguguugcugaugguggugu

SEQ ID NO: 4173420 - RNA, 78 nt, Human
acacucuugcaccaagaugcaacacauuugaugagcgaucucauuucugcaucaugauguuugcaaggagaagagugu

SEQ ID NO: 4173421 - RNA, 104 nt, Human
acacugaaaugcaaucguuuguuaaaaggcuguucucuucuguugucaauaaauuuccuuuugcugacaguuacugcuguaacagaugucuguauguugguugu

SEQ ID NO: 4173422 - RNA, 58 nt, Human
acacugagcugagcauucuuguuccagaggaaucgucugggagagccuagcucugugu

SEQ ID NO: 4173423 - RNA, 59 nt, Human
acacugcagcccuauuguuugcauaguagcuaaaauuaugcagauguuugguucauugu

SEQ ID NO: 4173424 - RNA, 84 nt, Human
acacugcggaaccgcuccugaccagcugugucccacaucugcagcgacaggcacuggucaggcuguccagcccuucccuggugu

SEQ ID NO: 4173425 - RNA, 61 nt, Human
acacuggagauggaccucacaaaugcaagauaugugggaaagccuuuguuuaucccagugu

SEQ ID NO: 4173426 - RNA, 63 nt, Human
acacuggagcuucuagcccacggauuuuuuugugauauggcuaaagaaaguuucuuccagugu

SEQ ID NO: 4173427 - RNA, 104 nt, Human
acacuggauuuaaacugccugugaagcucuuuucaccauuaaaguguaggaaaauagacuuuuuaggggaaagagagauguucauuggaguuuggguuuuuugu

SEQ ID NO: 4173428 - RNA, 61 nt, Human
acacuguagacuguugaaguacagcuguguauccagcauuacuuuucaguguguauagugu

SEQ ID NO: 4173429 - RNA, 60 nt, Human
acacuguugcuuacaguuuuggacccuggcacuuccuggggccuaaguaacaacaguugu

SEQ ID NO: 4173430 - RNA, 92 nt, Human
acacuuacuauaucaaagcacagggcugugcugugcauuuuagcaucugccaggagaauuacaauguaaggcaugguucuuguugucagugu

SEQ ID NO: 4173431 - RNA, 69 nt, Human
acacuuauuucuugucuaaccagugcugaguccuaagucugacacagaauggaugcgcagaaauugugu

SEQ ID NO: 4173432 - RNA, 88 nt, Human
acacuucuugauuucaugcaguuaagauucacauugcacuccagcauguugcaguuaauggcuacuguaugaaauuucaagaucaugu

SEQ ID NO: 4173433 - RNA, 60 nt, Human
acacuuuuguguauauccaguucuauccucauugaacuuuagaauauagcucagaagugu

SEQ ID NO: 4173434 - RNA, 79 nt, Human
acagaaaagaauucucuuccauugaaacagagacuggauaaucacauuuugggggguuguuuggagggaauuuuacugu

SEQ ID NO: 4173435 - RNA, 116 nt, Human
acagaaaaugguauuaaagcacagagauaauuuuaaguuuuaaaaucuuaaauuggauuacaaauaaacuaccaauuuaguagagaaauuaagaaagcucuguugccauuuucugu

SEQ ID NO: 4173436 - RNA, 68 nt, Human
acagaaagauaggcacaaggucacgguugcugaaggaaagagcuauuaccaaaaccuauacuuucugu

SEQ ID NO: 4173437 - RNA, 91 nt, Human
acagaaagccaagaaaagugagcuucagaaaugaacacugucuggaaccaggcuaagauguggucugagcauuuuuaccagguuuuauugu

SEQ ID NO: 4173438 - RNA, 59 nt, Human
acagaaauucaaacuggaauuuagguagcugaaacuggacuugaaguuggaguuucugu

SEQ ID NO: 4173439 - RNA, 69 nt, Human
acagaacagaugaugugcacagauagagauauaaauaguaauuuuugucugggcaugcauuuucacugu

SEQ ID NO: 4173440 - RNA, 57 nt, Human
acagaagaguaaaggauuuuugcucugacaguuggaagaaaguguuuucuuuucugu

SEQ ID NO: 4173441 - RNA, 91 nt, Human
acagaagcacacucucuuccucucccacgcuggcagcggaaagggccgauugaagugaguggcucaguuucugcccagcugggacuucugu

SEQ ID NO: 4173442 - RNA, 58 nt, Human
acagaagugaguggcaagaacuuaacuaaagaguuacaaugccaucccuuauauuugu

SEQ ID NO: 4173443 - RNA, 63 nt, Human
aauuuggggaucaauagaaugccucaugagucccagaacauguaggcaugggaugcccagauu

SEQ ID NO: 4173444 - RNA, 67 nt, Human
aauuuguacacaggucauucagggaugauucaaagaacaaaguaagcccuugacugugugacaaauu

SEQ ID NO: 4173445 - RNA, 123 nt, Human
aauuuuaacuccuuuaugugcgucuuuagagcugaguaguguuuaucuuggggaaaggauaagguccuucuucaauagcaagcgcauaaauagacugauaaggggacgugcagaguugaaauu

SEQ ID NO: 4173446 - RNA, 59 nt, Human
aauuuuauuagaaggcaaggggcuaauggcagccaaucaguguuaaugcugauaaaauu

SEQ ID NO: 4173447 - RNA, 93 nt, Human
aauuuucaguuuuuaaucuaaucugccuuccuaaucuuccuggugauuggaaacagguuaggaaugggagguaauggaauaaacaugaggauu

SEQ ID NO: 4173448 - RNA, 59 nt, Human
aauuuugagacaaaguuguuggauguucaucuguaugaacacugaaaugucuuaagauu

SEQ ID NO: 4173449 - RNA, 89 nt, Human
aauuuugcuuacucuguuaaaugggaaucacaaugccauccgugcauaagaaggcaccccacagaccucuauuuacagaaagcagaauu

SEQ ID NO: 4173450 - RNA, 69 nt, Human
aauuuuguccagauacucaucucuccaccacguagccaacuacaacaggagacaaugagugacagaguu

SEQ ID NO: 4173451 - RNA, 62 nt, Human
aauuuuguucagaguauuaauugauuuauuuguaaaucagcuuaugccuuuugaggaaaguu

SEQ ID NO: 4173452 - RNA, 65 nt, Human
aauuuuuagucagacauugagcaucuaauaugugcacagcauuguucaaaguuugccuaaagauu

SEQ ID NO: 4173453 - RNA, 73 nt, Human
aauuuuucaucaaggucaccuucauaacaacugugacagauucaguguuuguuagguuccuuuguggagaauu

SEQ ID NO: 4173454 - RNA, 103 nt, Human
aauuuuuuauauacuucugaacaaacugaauggguuuucugucaaacuuugugcauuuuuuuaagaguacaagagcccuuucagauugacgaggaaaaaaauu

SEQ ID NO: 4173455 - RNA, 56 nt, Human
acaaaaacuggauggaauagagugcauuuuugcuuuguuucaugcuauuuucuugu

SEQ ID NO: 4173456 - RNA, 129 nt, Human
acaaaacuccagugucuuaauguccuggcgugccaucuccuggucaacugguagagcagcaauccuuuccuauaagccaguggcccucuggagaagggcacacugaacacaauaagcaugacuuuuagu

SEQ ID NO: 4173457 - RNA, 61 nt, Human
acaaaauagaguucuccccugggaggaugaugccuccagggcaauaggaacacuuuuuugu

SEQ ID NO: 4173458 - RNA, 68 nt, Human
acaaacaauugcuaaugcuucuguugagugcucaccaugcgccagccaugagucuaagcaguuuaugu

SEQ ID NO: 4173459 - RNA, 58 nt, Human
acaaacacaguuucugcauugguaguguaaagcauaccuuguuaggaacguguuuugu

SEQ ID NO: 4173460 - RNA, 60 nt, Human
acaaacaggagagagauggauugagaaagcauucaguaacuuacuuauucaccuguuugu

SEQ ID NO: 4173461 - RNA, 86 nt, Human
acaaacaucauggggugaccaugagcauuuaauggaauacuauacauauaaagcucuuggaacacuaccuggucuaugaugcaugu

SEQ ID NO: 4173462 - RNA, 78 nt, Human
acaaaccucuaagguggccauaggaccagccugggcuccaacacccagcccaugcacaccuggccauugcagguuugu

SEQ ID NO: 4173463 - RNA, 82 nt, Human
acaaacucaaagcauuuuagauaaagcaucagucuaauauauuauagauugauggaguauaauaaaaugacauauagucugu

SEQ ID NO: 4173464 - RNA, 61 nt, Human
acaaacucagcaucaguguccagaacaaccgaaguguucggcauauuaauggugggugugu

SEQ ID NO: 4173465 - RNA, 82 nt, Human
acaaagauggcaaugacaucucccugcucuaaacagcugacacagcagcauuaguuggguugguggucacggccucuauugu

SEQ ID NO: 4173466 - RNA, 82 nt, Human
acaaaggauuuuaugcccaggugccauucccagcaaaucugauuaaacugcucugggaugaggccuaggcacgggccuuugu

SEQ ID NO: 4173467 - RNA, 67 nt, Human
acaaaggcagucuaguccccaggcaagaagggguuuuguuuugggaaagggcuguuauucucuuugu

SEQ ID NO: 4173468 - RNA, 76 nt, Human
acaaagggagacaggaagucugaaggagggagaacaaaguugcuucuucuucucucugcuuccuguuucuuuuugu

SEQ ID NO: 4173469 - RNA, 56 nt, Human
acaaagguaguauauauauuguuuaauugccaagcaaaguuauauguuaucuuugu

SEQ ID NO: 4173470 - RNA, 65 nt, Human
acaaagugcagagagcaauacucuacuucgacaaaagugguuagggcugcuuucuauauuucugu

SEQ ID NO: 4173471 - RNA, 57 nt, Human
acaaagugcugacauuacaggcaugagccaccgugccuggcuauuuuuuugcuuugu

SEQ ID NO: 4173472 - RNA, 113 nt, Human
acaaagugugcccuguguauuaauaucagccaacagugcuucauucacacauugcaugacuauugaugucuuaaucuguggagguacugagccaguguggggcauaugauugu

SEQ ID NO: 4173473 - RNA, 108 nt, Human
acaaauauuuauugagccuacugugagccaggccugcaugcacaaaggucggugagaauauucuaguacagggcuuggcucauaaguggaugcucaacagauauuugu

SEQ ID NO: 4173474 - RNA, 84 nt, Human
acaaauauuugcauuacguuuuuuaugugucagggcugugcuuauaguguguacacuguguuuacauagagaauauaauuuugu

SEQ ID NO: 4173475 - RNA, 87 nt, Human
acaaaugcuauaugugaaugaggcagcaagaggccauggacacgcauauugccuggaucuccucuauucauauaugugccccauugu

SEQ ID NO: 4173476 - RNA, 71 nt, Human
acaaauuaaugacuuguccuuaaaauaucaauuuugugauucauguuuuggcaggugguuagauguuuugu

SEQ ID NO: 4173477 - RNA, 65 nt, Human
acaacauggcaguuauuuguccccagagcaagcaacaccggagggcaaggaagaagccaugaugu

SEQ ID NO: 4173478 - RNA, 55 nt, Human
acaaccacccaaaccuuucucucugcccaagccagagccacuuuugggugauugu

SEQ ID NO: 4173479 - RNA, 55 nt, Human
acaaccgcggggcccagcgguuccugugggugcugacaggagccuggcggugagu

SEQ ID NO: 4173480 - RNA, 128 nt, Human
acaacuaaauuccccaguuagaaacuaguucuuuucccuccuucaucucgugggaauguauaacuauaugugcaggugcaggaagggggcugagaguuccuucucuaaaagacuccugggguaguugu

SEQ ID NO: 4173481 - RNA, 109 nt, Human
acaacuggcaaagcuugauguucagguuugaaaaaagcaguauguaauaagcuuucauuauuuacagccugcuuuuuucaaaaaaggauuuaaggagaugagaaguugu

SEQ ID NO: 4173482 - RNA, 63 nt, Human
acaacugucaguaaagaauauuuugaagauauugucaaauccuucuugugagugacaaguugu

SEQ ID NO: 4173483 - RNA, 92 nt, Human
acaacuugcuaaaguagguauuauuauuuuucccgguuuuauugauaaauaaauugaggcacagagaaguaaaguaucaugccuaauguugu

SEQ ID NO: 4173484 - RNA, 64 nt, Human
acaagaaauggaagauccauggugagacucgggagaacucuccauggagacuuccucuucuugu

SEQ ID NO: 4173485 - RNA, 60 nt, Human
acaagaagcaaggucagggcccaggccccaugcaggcuucgggccggccuugcuccuugu

SEQ ID NO: 4173486 - RNA, 60 nt, Human
acaagacugaguggcuuaagaaaagcuauuuuuaggcucggcacaguggcucacuccugu

SEQ ID NO: 4173487 - RNA, 92 nt, Human
acaagagcaucucagcuaucuuuucuauguauguuaucaucccccaaaugccacugugaggcaugcaugcaaggugguguauacugcauugu

SEQ ID NO: 4173488 - RNA, 75 nt, Human
acaagaguuccuauacugggucaguccuuugcauacaauuaagggggucuauaaacuuauaugggaaaaacuugu

SEQ ID NO: 4173489 - RNA, 57 nt, Human
acaagcgagcggcuucuggccggucuugcuaaggggucugcaaagcuguucucuugu

SEQ ID NO: 4173490 - RNA, 85 nt, Human
acaagcuagauaagauaguccagcacaaucugauaaagaaaaccaugggcagaguguguauaucuggauaucuauuaaguagugu

SEQ ID NO: 4173491 - RNA, 69 nt, Human
acaagcuugggcucuucucaggagcuaucuccuucaggaagccuuccaugagagggcccugugccaugu

SEQ ID NO: 4173492 - RNA, 79 nt, Human
acaaggaguaacuggaaaguauucuuucacugguggugauaaagaacaccaaggcagaacuuccccagacucucccugu

SEQ ID NO: 4173493 - RNA, 63 nt, Human
acaaggcacuuuaugaagaggaaaagagcugaacaaaagguguucucuucaggagguccaugu

SEQ ID NO: 4173494 - RNA, 55 nt, Human
acaagguuuauuaauaaguugguaguaguacugacuuguuagauauaaaguuugu

SEQ ID NO: 4173495 - RNA, 105 nt, Human
acaaguaagaaucauagggaugacguuuguuauauuuccuuucaucaugccugagagcauagugggaggaaguggugauauuuuuauccucuggguuguugaugu

SEQ ID NO: 4173496 - RNA, 57 nt, Human
acaaguauuggugaggauguaggauguagagaaaucagaguucccaccauugcuugu

SEQ ID NO: 4173497 - RNA, 87 nt, Human
acaagucaagagucacuccauaaaucccagggccacccacuuucuuaacucccaugggaauuucucguggaugacaaauuugcuugu

SEQ ID NO: 4173498 - RNA, 59 nt, Human
acaagugacucauacucugguugccuuaauacccagagucauccaggagagaugcuugu

SEQ ID NO: 4173499 - RNA, 76 nt, Human
acaagugagggaucuuugggauuucacugggccucaacuuaucacucagugacaguuucaggcauuuuucaaaagu

SEQ ID NO: 4173500 - RNA, 55 nt, Human
acaaguguauugugcuucacagccuaaguguuucuagggcucagaguacacgugu

SEQ ID NO: 4173501 - RNA, 55 nt, Human
acaagugugugcaguuuguaaaaacucaaugagcuguacauuuguguacacuugu

SEQ ID NO: 4173502 - RNA, 115 nt, Human
acaaguguuugcucugucuguaccacuccccaggcacuucaucauuaggguggucaucugauuacucuauuggcuguggguuccuggaaagcagguuaucgagcaccaucacugu

SEQ ID NO: 4173503 - RNA, 75 nt, Human
acaaguucaaaacguuuucaaaagugaaaaagcuuacaccaaguuugucaaguuugcaaauacguuugaaaaggu

SEQ ID NO: 4173504 - RNA, 67 nt, Human
acaauaacuuuuuccugauauaauuaaaguuuguccauugauuucaguucacagggaagguuauugu

SEQ ID NO: 4173505 - RNA, 82 nt, Human
acaauaagagaugaguggaccaaagauaggaggcaguagauagaguggauuuuguucccuaacuucacuucauugaaguugu

SEQ ID NO: 4173506 - RNA, 89 nt, Human
acaauaauacaauuucaucuugugcuucaauguuucauguccugggggcaaguuagguuggugcuacuggaaagagguuaaauuauugu

SEQ ID NO: 4173507 - RNA, 83 nt, Human
acaauacugugauucuaaagcuuugagcagcagccuagggaauuucaccuauucuguagagguauuaggggagcagagguugu

SEQ ID NO: 4173508 - RNA, 81 nt, Human
acaauagaaauaaugggagaaugaugugagguaauguuacauguaaaauguuauacacaauucuuuuacuacguuuacugu

SEQ ID NO: 4173509 - RNA, 86 nt, Human
acaauagguauggacaaucugagccauggcuggggucccugagcccagugggccucaugauggcucaggaaguaggugcugaaugu

SEQ ID NO: 4173510 - RNA, 62 nt, Human
acaauagugguagugcuggucauagugaugaagaagaaacaagagcagcagcuaccacuugu

SEQ ID NO: 4173511 - RNA, 60 nt, Human
acaaucacuugagugaacuugagagugaauccucuccauguuaagccuugaggugauugu

SEQ ID NO: 4173512 - RNA, 58 nt, Human
acagcaggcaggcugccagugaauggaauucacuucauuuaacuggccuguuugcugu

SEQ ID NO: 4173513 - RNA, 106 nt, Human
acagcagugcagguuguccacugcaauacuccagggguugcuauuuacaucauagccgaugugaaugacuuucuggaguuuuguagugcacagccuuccuggcugu

SEQ ID NO: 4173514 - RNA, 56 nt, Human
acagccaacgucuuucuuacuuccugaucggacaggaaguagguuucaguugcugu

SEQ ID NO: 4173515 - RNA, 57 nt, Human
acagccagagcuucggcugaauccuaagccugcugcagggaccccgaggcucucugu

SEQ ID NO: 4173516 - RNA, 94 nt, Human
acagcccugugagauagguaucacucucccuggguuacagaugaggagacugaagcucagagaaguugugccuggccaaggucacacggguugu

SEQ ID NO: 4173517 - RNA, 60 nt, Human
acagccugacuuuuguugucacacggguacuaagccauauugagaggaagugcaggcugu

SEQ ID NO: 4173518 - RNA, 69 nt, Human
acagcgaugcccuucucuuugcuggauacuggcuuucccagcaucccuggcagcuaaggguggucaugu

SEQ ID NO: 4173519 - RNA, 82 nt, Human
acagucugggcauauuagaaauguuuacucacccccuuccauuccuggaagcagggagaaauuuuucuucagucuucacugu

SEQ ID NO: 4173520 - RNA, 89 nt, Human
acagucuugcucuaucacccaggcuggagugcaguggugcagucucagcucacuguaaccuccaccuccuggguucaagcgauucucgu

SEQ ID NO: 4173521 - RNA, 55 nt, Human
acagugauacccuagggacagaagagucgcugucccagucaaggcugucaucugu

SEQ ID NO: 4173522 - RNA, 90 nt, Human
acagugcacugcccaaagugaaacuuaguuucuggcuauuuacugccaaguauaaagucccaggaacuaagaauccuuuagcauuucugu

SEQ ID NO: 4173523 - RNA, 57 nt, Human
acagugcuaaugaugccaagaucaaggguuuaauccccuuggccuacuuagcuuugu

SEQ ID NO: 4173524 - RNA, 63 nt, Human
acaguggaagcaugaugcuaucaucuagugacacucaucuugcaguaucauauuuuuacuagu

SEQ ID NO: 4173525 - RNA, 75 nt, Human
acaguggaagguggcccugagcaugacaaucucugagaccagcguuggaaugaguaguggccacugugacccugu

SEQ ID NO: 4173526 - RNA, 96 nt, Human
acagugggagccucaugggauaagagaugggguccuugcagcugucuguacgugcaucuguaacugcuaucaucuccacugaaaggcccagacugu

SEQ ID NO: 4173527 - RNA, 57 nt, Human
acaguggguccucagaguuuguagucagaaacacgcacacacugaguuuuccacugu

SEQ ID NO: 4173528 - RNA, 77 nt, Human
acaguguuacaugagguuaauuaagcauccuggaauucagcaggaagccuguuagagacuugauggagaacacaugu

SEQ ID NO: 4173529 - RNA, 57 nt, Human
acaguuacuguaugucaaagacucuaaugacacauaguaggauuccacagugacugu

SEQ ID NO: 4173530 - RNA, 82 nt, Human
acaguuagaaugcaaacuucuuguuacuugucauuuucugaaauccuagaccaguuguuuuggaaguuugcagaauagcugu

SEQ ID NO: 4173531 - RNA, 87 nt, Human
acaguuagagggcaggaaggggcaccaggacaugacucccagcucgcagcuguaaguccacuggccugcccuuugccaucuaauugu

SEQ ID NO: 4173532 - RNA, 73 nt, Human
acaguucuggcugaggcagagccugggguaucauaucugaguccccgcuccguuugucuccaugucagccugu

SEQ ID NO: 4173533 - RNA, 60 nt, Human
acaguugagaugcaacuuugggcguucagccauuucucugccaaggacaucuaugacugu

SEQ ID NO: 4173534 - RNA, 84 nt, Human
acaguuuuagaccacuuaccccaugugaaacguuauuguaagcacugacagucagcauauauggaguaaggaucuacaaggugu

SEQ ID NO: 4173535 - RNA, 80 nt, Human
acauaaagccacaguuucacagucaauuuggagucaggcacagagcaugagcuuugaaauuggaaaugauguauuuaugu

SEQ ID NO: 4173536 - RNA, 67 nt, Human
acauaacauaguugacauuuuuucugcugcgugcauauagccaggaguggauuugcuguguuacugu

SEQ ID NO: 4173537 - RNA, 55 nt, Human
acauaagagcaggugaggcacucugucaucgguggaugcuucauuucuuuuaugu

SEQ ID NO: 4173538 - RNA, 81 nt, Human
acauaaguagagucuuagaggauauguccuuugugaauggcuuauuucauguaguguaaugucuucaagauucauucaugu

SEQ ID NO: 4173539 - RNA, 56 nt, Human
acauacaguuuucccuagaugugcuauguuggaaguagcccagggaggcugugugu

SEQ ID NO: 4173540 - RNA, 83 nt, Human
acauagaaggucuaaaaugauauuuauugaauagaugaguggaagcagugcacuguucuccaaaugucuggacucuuucaugu

SEQ ID NO: 4173541 - RNA, 68 nt, Human
acauagagauagugcuuuucauucuauccauuuucuccuccaagagagugagaggacauuuuucaugu

SEQ ID NO: 4173542 - RNA, 68 nt, Human
accaugagcuuugguguaagaucuagguucaaauccuagcucugucacauacacugcaugcucuuggu

SEQ ID NO: 4173543 - RNA, 63 nt, Human
accaugaguuauuugacaggccauccuagaauggacgauguccugucugcagauaucucaggu

SEQ ID NO: 4173544 - RNA, 58 nt, Human
accaugauacuuugcuccuuuacuuaguaauagcuaaguuuggggaaaauguuaaggu

SEQ ID NO: 4173545 - RNA, 60 nt, Human
accaugguucccgggggagugccugaagggaggaccugaagagauucccugggagauggu

SEQ ID NO: 4173546 - RNA, 59 nt, Human
accaugucauuuauuggccaaaccagaacaauuuggagagcuauuaauaaugauguggu

SEQ ID NO: 4173547 - RNA, 116 nt, Human
accauuaauuaaucuaugauuuaagacugaagaucugccugucucuugagucuuauuuuugaggccacaguacuuugcagaccauuuuucuagaaauauagacucugauuucaggu

SEQ ID NO: 4173548 - RNA, 56 nt, Human
accauuacaugauccuuacccagugcuggauucugagugggagaucaauaaguggu

SEQ ID NO: 4173549 - RNA, 56 nt, Human
acccaaagauuagccaaacauuagggaacauauccugcuguggcaaagcuuugugu

SEQ ID NO: 4173550 - RNA, 125 nt, Human
acccaacaccagggcagcuagaaguuuauaaaugaagacucuaugguuccuuuguuugaaaauauguaaguuguuguuggaauaaagcagcuuuaguucuuuauuggaaauauucuguguugggu

SEQ ID NO: 4173551 - RNA, 79 nt, Human
acccaaccuggcucuucuuguuguuaggguccugucguagucugauagggcugccaucacagaagagcuuagacugggu

SEQ ID NO: 4173552 - RNA, 73 nt, Human
acccaacucagacuggauuaaauaaaaggggauuuucuugcuuauuuaacucuagauucagugguaaaugggu

SEQ ID NO: 4173553 - RNA, 81 nt, Human
acccaagacagcagguugcuguuauuuuuguagaucucucugauuuucaaaguugcaugacagcuuaucuuauccuugggu

SEQ ID NO: 4173554 - RNA, 79 nt, Human
acccacagagguaccuguaccauaugagaagaugcuacaagaccagucagcuuugauaguacaggggcuuccagaaggu

SEQ ID NO: 4173555 - RNA, 88 nt, Human
acccacaguggggcagcucugcccaucagaggcucuucuuagcucagagcuggguaccaccucccgguggcagcucucccacuggggu

SEQ ID NO: 4173556 - RNA, 57 nt, Human
acccacugucaucucugaccacaguaccacaugcaaggugaccagaagacagugggu

SEQ ID NO: 4173557 - RNA, 57 nt, Human
acccacugucuucuggucaccuugcaugugguacuguggucagagaugacagugggu

SEQ ID NO: 4173558 - RNA, 63 nt, Human
acccacugugcccuguguguccccugggcucccccgugcaggaggaggugggacacagugagu

SEQ ID NO: 4173559 - RNA, 55 nt, Human
acccagaauucagucuuaggccacaaugauaaagggcuuauuucugguuuugggu

SEQ ID NO: 4173560 - RNA, 64 nt, Human
acccagagaacugaggcaugaauaacucuagccauggaacaguuaugcuugcagauuuaagggu

SEQ ID NO: 4173561 - RNA, 60 nt, Human
acccagaucccaggggcuacuucaggcccuucuacuaagcuccugacccuggcucugggu

SEQ ID NO: 4173562 - RNA, 84 nt, Human
acccagcccagguaccaguccuccuaacugagguucagggccugggaccaagcccuguccuggaugggagcacugggggcgggu

SEQ ID NO: 4173563 - RNA, 77 nt, Human
acccagcuaucauucaucucuucauuaguuccugucccaugcuuguggcacagggucaugcagagcaggugcugggu

SEQ ID NO: 4173564 - RNA, 58 nt, Human
acccaggauagagugcugcagugugaucucggcucacugcaaccucugccuccugggu

SEQ ID NO: 4173565 - RNA, 58 nt, Human
acccaggcuagagugcagugguauguucucggcucacugcaaccuccgcuucccaggu

SEQ ID NO: 4173566 - RNA, 58 nt, Human
acccaggcuggagugcagugaugcaaucucggcucacugcaaccuccaccuccugggu

SEQ ID NO: 4173567 - RNA, 58 nt, Human
acccaggcuggagugcagugaugcaaucuuggaucacugcacacuccaccucccgggu

SEQ ID NO: 4173568 - RNA, 58 nt, Human
acccaggcuggagugcaguggcacgaucucggcucacugcaaccucugccucccgggu

SEQ ID NO: 4173569 - RNA, 58 nt, Human
acccaggcuggagugcaguggcacgaucuuggcucacugcaaccucugccccuugggu

SEQ ID NO: 4173570 - RNA, 58 nt, Human
acccaggcuggagugcaguggcgcgaucucagcucacugcaaccucugcauccugggu

SEQ ID NO: 4173571 - RNA, 58 nt, Human
acccaggcuggagugcaguggcgcgaucucggcucacugcaagcuccgccucccgggu

SEQ ID NO: 4173572 - RNA, 58 nt, Human
acccaggcuggagugcaguggggugaucucagcucacugcaacugccaccucccgggu

SEQ ID NO: 4173573 - RNA, 58 nt, Human
acccaggcuggagugcaguggugcaaucugggcucacugcaaccuccaccucccaggu

SEQ ID NO: 4173574 - RNA, 58 nt, Human
acccaggcuggcgugcaguggcgugaucucggcucacugcagccugugccucccgggu

SEQ ID NO: 4173575 - RNA, 58 nt, Human
acccagucuggagugcagugacaccaucucggcucacuguaaccuccgccuuaugggu

SEQ ID NO: 4173576 - RNA, 61 nt, Human
acccagugccucacccagggauggcggagacuucugucuggcucugcagcaaggccugggu

SEQ ID NO: 4173577 - RNA, 76 nt, Human
acccauauauacuuggagacuaucauuguucuaaugggaaagaucaauggacgcuuagccagcauauguaaugggu

SEQ ID NO: 4173578 - RNA, 75 nt, Human
acccaucugcuaccuuugucggugacugacuuggaacuuuuccauccagcucugaagaaaggugucuaggagggu

SEQ ID NO: 4173579 - RNA, 71 nt, Human
acccauucccaucauggccugagcuaguguuucagguuuacuuuagaaugcucuuggccaaguggaagggu

SEQ ID NO: 4173580 - RNA, 90 nt, Human
accccaccagccagcuucccugaccagagugagggcuuaguuccagggccgcccuccuaccugggcagaaggaaggcccauggcaggggu

SEQ ID NO: 4173581 - RNA, 78 nt, Human
accccagcccugccagucaucacgucuugggcuucccuggggccaggcaggggaagcugcguggucuagggcuugggu

SEQ ID NO: 4173582 - RNA, 68 nt, Human
accccaggccccugcaggccacucuuguagaccacagagcucaguguccccuccaagggccuggcggu

SEQ ID NO: 4173583 - RNA, 63 nt, Human
accccaggcuaguaugauaucaguggaguauagagaagcugacuaaagacauacucuggaggu

SEQ ID NO: 4173584 - RNA, 60 nt, Human
accccaugcauacacaggucaggcaggugcaggcaucaccuggucgcagugcgugugggu

SEQ ID NO: 4173585 - RNA, 58 nt, Human
acccccugccugcagcaggggcaccaucacuaaagaaggcgccugcaggcacgggggu

SEQ ID NO: 4173586 - RNA, 130 nt, Human
accccgaacuccuuggcgaccacugaguccccauagcaacagcggugacuucacucugggcucggcuuacaaccccggugaggucaccggccguugccaggggaacgggagggcgcaaggaguccggggu

SEQ ID NO: 4173587 - RNA, 102 nt, Human
accccgccgcccugacagagcuugggagaggguccccaggacuuggcguacccguccguccuggggcugcugcuguccucagagccuggggagguaccgggu

SEQ ID NO: 4173588 - RNA, 59 nt, Human
acccgcccccugccagggcaaccagugaacucaguguccauggggaaggggaagugggu

SEQ ID NO: 4173589 - RNA, 66 nt, Human
acccgggagcuggaucgcgcgcccggagcuccggucuccgaguccgaguugugcagcucucggcgu

SEQ ID NO: 4173590 - RNA, 65 nt, Human
acccguaaauggcagcccacgauggcaauggacgacuuucuuaauugcccgugaugcuugcgggu

SEQ ID NO: 4173591 - RNA, 61 nt, Human
acccucaauguaauuuaauguuggaaaucaguacuguauguccuggauugaauugagaggu

SEQ ID NO: 4173592 - RNA, 60 nt, Human
acccucaucccacuagggaacacugcgccucacgagagccagcagagugggguggagggu

SEQ ID NO: 4173593 - RNA, 55 nt, Human
acccucugaguuuuuccccuagcuccugggacuaugggugggagagucugagggu

SEQ ID NO: 4173594 - RNA, 63 nt, Human
acccucuggcucauuuccuaguuuaggucaacucuuagguggcaaugcuuaagcucugagggu

SEQ ID NO: 4173595 - RNA, 58 nt, Human
acccucuugagauuagucaguagcuaggacuaucccaguaacugucucugagaguggu

SEQ ID NO: 4173596 - RNA, 107 nt, Human
acccugagauugacauauggggagucugggcuagacuccucgagggugagaaacuaugugaagcaaggucuggccaauagacagccccaaaugccagaauugggagu

SEQ ID NO: 4173597 - RNA, 82 nt, Human
acccugcacccugauccugccccuggaguguuccaaguggauggaacagcuuuaucucagggaucagcaugguuggaagggu

SEQ ID NO: 4173598 - RNA, 87 nt, Human
acccugggcagggugacaugcauggugcugguggguggagccagccacaucugcauuuaauguauaauacuucaccggguguagggu

SEQ ID NO: 4173599 - RNA, 55 nt, Human
acccuggggucacccuucucuguauagucuugauaggaaaggaaguccccagggu

SEQ ID NO: 4173600 - RNA, 56 nt, Human
acccugucuucccugggcaucacagcggugugucagggauuuaaagacacaagggu

SEQ ID NO: 4173601 - RNA, 91 nt, Human
acccuuuaccugcucccucacuuuuucuuccuauggagaccccucuuuuuccuccacaggccuuaggagagaugggggaagggguaggggu

SEQ ID NO: 4173602 - RNA, 59 nt, Human
acccuuuccaggacagccugugaaugugaaauuacccauucacaggcugugggaauggu

SEQ ID NO: 4173603 - RNA, 101 nt, Human
accgaguuuaauuaaauaucaugaguaauaaaagagagguccaggggugauugcugagaacacuuauggauuauucugaauuugaaaauuugacucucggu

SEQ ID NO: 4173604 - RNA, 81 nt, Human
accgcugagauugggaggagcauguggggcuggaaaagauaaaugcccuugguguccuuuucucuuuucacucucaguggu

SEQ ID NO: 4173605 - RNA, 102 nt, Human
accgggauaacagugaauucugagcuccuggauugcuccuagggugcuggauggggauucugggacagucaggaguuuagggagugaugcugaaguuuuggu

SEQ ID NO: 4173606 - RNA, 61 nt, Human
accgggcucagccagcccauucuuccuuuacugggagaagccgagucagcugagccauggu

SEQ ID NO: 4173607 - RNA, 79 nt, Human
accgugcaugggguaucagagaaauugauguguucaguugaaaguaguuucucuuugacaccaaaaucauaagcacggu

SEQ ID NO: 4173608 - RNA, 69 nt, Human
accuaaacuaguaaaaguuuaguugaaaguuuuauaaguaauuuucagccaacguuuugcacuguaggu

SEQ ID NO: 4173609 - RNA, 73 nt, Human
accuaaagcaacaggcaguuugcucaugugcgccagaagaagcgcacaaguggcugugugugugugugugugu

SEQ ID NO: 4173610 - RNA, 88 nt, Human
accuaaagggaacuauuagucagagaagacaucauugugaagucuguguuuccacugaaguuuucuccugagaaacaguccagaaggu

SEQ ID NO: 4173611 - RNA, 58 nt, Human
accuaaaucuaccucauguuuuggucaaagcagaggccaaagcaucccggauucaggu

SEQ ID NO: 4173612 - RNA, 94 nt, Human
accuaaaugugaaacauaagauuaucuaaaaguccuagaagauaacauaggagaaaaucuagaugaccuuguguuaggcaaugacuuuuuaggu

SEQ ID NO: 4173613 - RNA, 86 nt, Human
accuaagacagucuaucuagaagccugagccaagauagucuagcuacuugaauuauauuucuagagaaaggauuguugaauaaggu

SEQ ID NO: 4173614 - RNA, 59 nt, Human
acauguuuggcucuaugcuauacacuggagcucagagaucagaguagagacagacaugu

SEQ ID NO: 4173615 - RNA, 108 nt, Human
acauuacuaaguaaaacaaccuaaaguuacugaucauuuuucuguuuugggaggaaaaugaauacuuuuuuugucgguuuaucuuugcuauuuuuuuaaccuaagugu

SEQ ID NO: 4173616 - RNA, 128 nt, Human
acauuagaaucagcuggggagcuuuuaacaauuaccagugcccagaucucuccccagaacaaacgagaaucucuaggggugaggccaggcaucaguauuuuuaaaagcuucccgggggacucugaugu

SEQ ID NO: 4173617 - RNA, 71 nt, Human
acauuagcauauuaaauagucauugaagucauucaauaaauuguugaaaugcacuacagaagugcugaugu

SEQ ID NO: 4173618 - RNA, 99 nt, Human
acauuauacauauaaugagucagaaaugaucguuauucauuuacaggcucuccaguuagagugaaauacugucguuuuuaggucauuguauaaugaugu

SEQ ID NO: 4173619 - RNA, 101 nt, Human
acauuaucaguuugaacucagcauuuagaauuugaagugucacuggggaaauuauuuacuaacacuuagcaguuuuaauugcauguuaaaauuugugaggu

SEQ ID NO: 4173620 - RNA, 129 nt, Human
acauuaucuuuuaguuaauaagucaacuauccugaaugcuuggagucauaaaaugucuaagccauagugcauugggaauuuuaaacugcagcuuuacaugaccuguaugaaugacuaaaauauugaugu

SEQ ID NO: 4173621 - RNA, 63 nt, Human
acauuaugaugcaacuuggcaacuguaauaaacagagagugccauccugugucaugcucaugu

SEQ ID NO: 4173622 - RNA, 79 nt, Human
acauucauuuccucugggcuauuuucauuuauuuggcaaagaaugccaaauagaagguacucagagaaaaauuagaugu

SEQ ID NO: 4173623 - RNA, 62 nt, Human
acauuccaggcaaagggacuagcaggagcaaaggccccuagcuggggguuugcuuggcaugu

SEQ ID NO: 4173624 - RNA, 60 nt, Human
acauucuagauauguuauauuucuuguaacucgaaaggaaaugaugaauggucagagugu

SEQ ID NO: 4173625 - RNA, 77 nt, Human
acauugagcaucauggugaggggugaagggcagccaguuacggccuggcagcuugacuccacugcugagugcaaugu

SEQ ID NO: 4173626 - RNA, 81 nt, Human
acauugaugaaaagguaucauuucccuuacuguugugaaaaaccggggacaucuuacaauagguucuuuuucaucagcugu

SEQ ID NO: 4173627 - RNA, 70 nt, Human
acauugccaagugcagcggaugcuguccaauucugauaugauuggaacucucugcagcacuugacaaugu

SEQ ID NO: 4173628 - RNA, 86 nt, Human
acauugcuauuuuagacaccauuccaguacuguaacugacgaguuagaguacaguacucuaaugaaaagugcuuugauauuagugu

SEQ ID NO: 4173629 - RNA, 94 nt, Human
acauuguaaggugaccauaauagauuaugagucccaagcagauccuggcuuuaaugcucaauuaauuuauaagugguacuuguugccucagugu

SEQ ID NO: 4173630 - RNA, 64 nt, Human
acauuguaguuguucugcagcauccauuccacuccucucccgcuguauaacaacuaugcaaugu

SEQ ID NO: 4173631 - RNA, 68 nt, Human
acauugucgucaauggacacauagauucgggcaaguccaccucuacuggccaucugaucuacaaaugu

SEQ ID NO: 4173632 - RNA, 72 nt, Human
acauuuacagugcuagacaaucaccaauagaaaauaaauugaggauuccaacuguguuuagauugugauugu

SEQ ID NO: 4173633 - RNA, 78 nt, Human
acauuuacaguuaccaagagggcuuauggaucauagagauuuccagauaggcuuccgagucuugguaucuuagaaugu

SEQ ID NO: 4173634 - RNA, 88 nt, Human
acauuuacauaauuaugaacacaugccuuaagaauaagugguacgccauauauuugugugugcaugugugauauauguauguguaugu

SEQ ID NO: 4173635 - RNA, 80 nt, Human
acauuuauuucuuauucuugucuuauugugcuaccuaggacucccaguacauguagaauaggagugaugagagaggaugu

SEQ ID NO: 4173636 - RNA, 84 nt, Human
acauuucccgcuguagccucaggaaucaagaaaggggcugugucagagcuccugggaagagaccugagcauaugugggagaugu

SEQ ID NO: 4173637 - RNA, 60 nt, Human
acauuucucuugaugucucuauuaaugcaaaauauugagcaagagaccgcaggagaaggu

SEQ ID NO: 4173638 - RNA, 64 nt, Human
acauuucuuccuaauuaucccuauugugggugaugaaauugacagggaugguaggggagaaagu

SEQ ID NO: 4173639 - RNA, 94 nt, Human
acauuugccagcacuguuauaugcuugagcaguggguaugcaguggagaaccagacagacccucuccucauggacaugagccaacuggcagggu

SEQ ID NO: 4173640 - RNA, 68 nt, Human
acauuuggcauaggcagaggcccagacagggagaccacgcugggaccacgccuccuauccaacagugu

SEQ ID NO: 4173641 - RNA, 67 nt, Human
acauuuuagaaguucaugugggauuuuuuuuaguuuauguagaauuccuuuggaucuucuggagugu

SEQ ID NO: 4173642 - RNA, 80 nt, Human
acauuuucuggauauaugucuucgucaccuaucucacagguuuguugugaggcguaaaugaagauaguaugugaauaugu

SEQ ID NO: 4173643 - RNA, 62 nt, Human
acauuuugcccuuauuugcugagccccaauucccacagggcaacaugaugagggucaagugu

SEQ ID NO: 4173644 - RNA, 119 nt, Human
acauuuuggauuauauucccaaaccuguucuagccauguuauuuauuauccucgguugugaaguggcugacaacauuggaauuauaacuggagaacagugggagaguaauugagaaagu

SEQ ID NO: 4173645 - RNA, 59 nt, Human
acauuuuguaguauuuuguuugagauaguucagaagacaguugauauacuauaaaaugu

SEQ ID NO: 4173646 - RNA, 72 nt, Human
acauuuuuauccugagugccaguguuauuuauaagcuucccaaauaaauagaucacuagagguuaaagaugu

SEQ ID NO: 4173647 - RNA, 73 nt, Human
acauuuuucccuuagaagauggaggguggggucucugggaguuguccuuucuuuucuaugggcccagaaaugu

SEQ ID NO: 4173648 - RNA, 92 nt, Human
acauuuuucuaagagagguugucaccuauacugagcuuaauagaaauuguuaaucuuauauguaaagguaauaauuugucauaaauaauugu

SEQ ID NO: 4173649 - RNA, 73 nt, Human
acauuuuugagaaucuucuaggucccagucucucuguccagcacuagagcacagggaauagacagauaaaugu

SEQ ID NO: 4173650 - RNA, 61 nt, Human
accaaagcucugguuaaaaggccuggguugcgugcccacuucugaagcuaagggcuaaggu

SEQ ID NO: 4173651 - RNA, 57 nt, Human
accaaaggcauugggggucaaacacguuacugugauugcugaauugaauccuuuggu

SEQ ID NO: 4173652 - RNA, 66 nt, Human
accaaaguguuuucaguaaggauucucuuguuuugaucuugagagaauacaaagaagauauguggu

SEQ ID NO: 4173653 - RNA, 88 nt, Human
accaaauauuuauauuucucuucccuacuagacacccaguaggauuauacuucuuguguuggggaggagccauguaacuaguucuggu

SEQ ID NO: 4173654 - RNA, 68 nt, Human
accaaaugaauugcuucugguauguuacugaguucaugcucacuggguucagagggaguuucuuuggu

SEQ ID NO: 4173655 - RNA, 71 nt, Human
accaagagacugguuucuauuacaagcuaucuucuuuuuggauaagaucuuuagugaagcuaaaucugggu

SEQ ID NO: 4173656 - RNA, 66 nt, Human
accaaggacuggcugccuccaaagugugcacugcuguguuaugcugccuggugagucaucccuggu

SEQ ID NO: 4173657 - RNA, 130 nt, Human
accaaggcagggaucuuaguuuuguucccugaucaugagcauccagaacagugccugggacauacuaggggcucaauauauaguucuggguugacuacaucagaguaaaauggaugggaucugccuuugu

SEQ ID NO: 4173658 - RNA, 55 nt, Human
accaauagcugcugagcuggaguuugccccugcacuccaaaaccugcggcuuggu

SEQ ID NO: 4173659 - RNA, 80 nt, Human
accaaugguacaaaauguauaaagucaaacugggcauucaagaagcuucucaggaaagacuuuuuaccuugaaucauggu

SEQ ID NO: 4173660 - RNA, 64 nt, Human
accacaccccuguaguuuuucuccuugaugggauggguuugaggagagcagcaguuggugaggu

SEQ ID NO: 4173661 - RNA, 68 nt, Human
accacacgcaagacuuuuagaggcuuuuguauccccugaaagcucucuucccgugaguguugcauggu

SEQ ID NO: 4173662 - RNA, 76 nt, Human
accacacuggaaaguuggauuucauccucaugggacucuucagacgauccaaacauccagcucuacuuaguguggu

SEQ ID NO: 4173663 - RNA, 83 nt, Human
accacagcaggucgccgaagauagcuccuggccagacacuccacugcugggggcuugguggccaugaacaugacuuugauggu

SEQ ID NO: 4173664 - RNA, 124 nt, Human
accacagggcuaggggugaggguugagguuaguaggucagcuucacccaucaacuguggaggcuuuuuggguccaggcuguaucucacucacacuuucaugcccagggcuggccuuggccuggu

SEQ ID NO: 4173665 - RNA, 86 nt, Human
accaccauuguuccugugauucucugaguuggccuaaugcuuugaacgugagaauggcucagauaauucaaggggcucuggguggu

SEQ ID NO: 4173666 - RNA, 86 nt, Human
accacccaucacacuggacauuggauacuccuauuuauucaagaggcuugugaaguaucugugugccagugggggauggugugugu

SEQ ID NO: 4173667 - RNA, 82 nt, Human
accacgcagacagauuucuuuaugaaguacagaaaggcaugaaauaacgagauuuuugucucugaaguagaucucugugggu

SEQ ID NO: 4173668 - RNA, 65 nt, Human
accacgccuggcuaguuuuuguguuuuuaguagagaugggguuucacaauguuggccagguuggu

SEQ ID NO: 4173669 - RNA, 81 nt, Human
accacgggacccuccauuaaaacagaccuauaaggccuggaaugaacaaaugggucuucacugaggagaggcuugcauggu

SEQ ID NO: 4173670 - RNA, 60 nt, Human
accacguggcaggcaucgccauaaacccuucgguaguggcagaggcucugugauguuggu

SEQ ID NO: 4173671 - RNA, 76 nt, Human
accacuacucuacuuucuaugucugugaauuugccucuucuggacauuucauauaaauggaaucagaauagguggu

SEQ ID NO: 4173672 - RNA, 80 nt, Human
accacugccuggggucagccagccagcaagaggucaagccacugccugggcucugguuuccuggcuggggcgguacuggu

SEQ ID NO: 4173673 - RNA, 60 nt, Human
accacugcugcugccucccuugcugggcucugccaguguuaguggcugcagcuggugugu

SEQ ID NO: 4173674 - RNA, 66 nt, Human
accacuggucucacccagcccuuccucuucuugcaaaugaagaaagggagcguggaucaauuuggu

SEQ ID NO: 4173675 - RNA, 58 nt, Human
accacugucuacacauugacucccucucugcuagaggguaaugaugggaugauauggu

SEQ ID NO: 4173676 - RNA, 57 nt, Human
accacuuaucaucacuaucucaggaucucucagcaagagguaguguggugcaguggu

SEQ ID NO: 4173677 - RNA, 58 nt, Human
accagagucaauuauuuugccaguagaagaaucaaaaggcaguuuaauugauuucagu

SEQ ID NO: 4173678 - RNA, 55 nt, Human
accagauccaagccacccucucaccagccuuauugggagcagcuuccuaucuggu

SEQ ID NO: 4173679 - RNA, 70 nt, Human
accagcauccuuccuauuaacagccacaaaaugaacuuaucugugcaauagagaguggggcaggaugggu

SEQ ID NO: 4173680 - RNA, 78 nt, Human
accagccucagccugcgucauggugacacacaucugcugacuggacgcaucggugcaucgugcuguaggcugacuggu

SEQ ID NO: 4173681 - RNA, 73 nt, Human
accagccuggcagguagcauugaggagucaaauaguuguuucccaguauuaccuucaggaagaaugcaagggu

SEQ ID NO: 4173682 - RNA, 72 nt, Human
acauagcaagugcucaauaaauagaagcuguuaggauuguguuaacugacauuuacugagcacuuacuaugu

SEQ ID NO: 4173683 - RNA, 70 nt, Human
acauagcacuggaaaccuccuuuuuucaagaaaugacacuauuagaaaggcugggauuuagcgcuggugu

SEQ ID NO: 4173684 - RNA, 58 nt, Human
acauaggcagacagcuauuuaaguggcuuauuaccaccauauuagcuuuuuccuaugu

SEQ ID NO: 4173685 - RNA, 67 nt, Human
acauaggugcugagagauuuaaagggccauaaaacacaucugguccgauaucuucuuauacaaaugu

SEQ ID NO: 4173686 - RNA, 66 nt, Human
acauaguagaauccaaaccaacaguucaaguaaacagaaugaggggauccuggacuuccacugugu

SEQ ID NO: 4173687 - RNA, 67 nt, Human
acauagugccuaccuaccuuacggacguaagagauuuagcaacugccugguacuuuaggcacuuugu

SEQ ID NO: 4173688 - RNA, 85 nt, Human
acauauaaagcuaauuuuagagcgauagaucacaaaguaagauuuucuagcuuuguauuaucagcauuggcuuggcuuucugagu

SEQ ID NO: 4173689 - RNA, 56 nt, Human
acauauaugcgugggcucaugggaaauauauauugugugucagcacgugugugugu

SEQ ID NO: 4173690 - RNA, 74 nt, Human
acauaucuacucugaaucgauguuauacaugccaaguauguaaaguaaucugucgaucaguacuacuagaaugu

SEQ ID NO: 4173691 - RNA, 77 nt, Human
acauaugacuauguaauuuauguuauccauaacuccguauguuauggauagugaaguuuacacacauuggcauaugu

SEQ ID NO: 4173692 - RNA, 67 nt, Human
acauaugucuauuucauguaaaauaauguuagggagauagcaauagcagauggaguagauaaugugu

SEQ ID NO: 4173693 - RNA, 91 nt, Human
acauauucacuagaagcuaagucuucacauggguacugcugaucucuuccccauagaucauuguuucuaaugugacuucuuuugacugugu

SEQ ID NO: 4173694 - RNA, 96 nt, Human
acauauuuugggauuuuccagauguauuucuguuauugauuucuauuuaauuccuuaaagguuagagcacauacuuugcaugauuccaauuauugu

SEQ ID NO: 4173695 - RNA, 72 nt, Human
acaucaaaauguguagucuugaucuaaugacuuagaucuaaugauuuugauuaagauuacauauuuaagugu

SEQ ID NO: 4173696 - RNA, 57 nt, Human
acaucacagagcccagauaaagucgagagagucuuuguaaaccuugguuccugaugu

SEQ ID NO: 4173697 - RNA, 73 nt, Human
acaucacuagugugccuuguauuuguguggauuuuuguccugcaaauaggaaaagggcauaaccuuuaaaugu

SEQ ID NO: 4173698 - RNA, 89 nt, Human
acaucacugagcuuuaguuuucucaucuaucucaccuaggaaauggguguaaucauugagaagauuugaagagagacugcaugugaagu

SEQ ID NO: 4173699 - RNA, 58 nt, Human
acaucagcugcaguuucacaagcacccgugaggugccaggugcuaagcugugcucugu

SEQ ID NO: 4173700 - RNA, 68 nt, Human
acauccaagccaggaagcaagugauuuucuuggcaauaagucaagaacuggcuccuggcuacuagugu

SEQ ID NO: 4173701 - RNA, 60 nt, Human
acauccacuauccuugcuuguuacuuccacuagaaagaaguuucugagggcuggggaugu

SEQ ID NO: 4173702 - RNA, 58 nt, Human
acauccaggugauguaggggauuuaguuuugaaagucuaauacaugaaaccuagaugu

SEQ ID NO: 4173703 - RNA, 57 nt, Human
acaucguguaucacugaaccuuagccaaguguggugggauuggcugaugucggaugu

SEQ ID NO: 4173704 - RNA, 84 nt, Human
acaucguguguugugacauucuuggaugcauggaugggauauugaaacacauguuugcaucuuggaugacauaacugugugugu

SEQ ID NO: 4173705 - RNA, 80 nt, Human
acaucuauguagauacacacauauaguggugaagccaucuucaaauagagacccgugugugugugugugugugugugugu

SEQ ID NO: 4173706 - RNA, 112 nt, Human
acaucuauuuuuauaacuuugaaaacuuuaauuagcuuaucccauuucugaaacguauuagauguuucauaaguggaguaaguuuaaagauaauuaaagguuaguuagaugu

SEQ ID NO: 4173707 - RNA, 55 nt, Human
acaucucacuucuuugaaggcuugagaucucagguccaaaggagacugagugugu

SEQ ID NO: 4173708 - RNA, 64 nt, Human
acaucugacaugaucuucaguaaaaaguaacauaagucaucacugaaggacucucaugagaugu

SEQ ID NO: 4173709 - RNA, 61 nt, Human
acaucuuugcccauccacuuccaccauguucuaugaagauuuugcaagugugggaagaugu

SEQ ID NO: 4173710 - RNA, 57 nt, Human
acaugaacacugcuugccacauucccuggaggaagccaaggaugagcugugucaugu

SEQ ID NO: 4173711 - RNA, 105 nt, Human
acaugaaugguuauagugacuuuauucguuaacuguuaaaaacuggacacaacacaaauguccguuaacuagugaaugaauaaacaaaguacuuccauucaaugu

SEQ ID NO: 4173712 - RNA, 80 nt, Human
acaugaauuaaggauaacuggucuauccaagagauuuaguuuugggugauacaaugcagauuguuauucccaguucaugu

SEQ ID NO: 4173713 - RNA, 75 nt, Human
acaugacccacccuuuuccauuaaggccuuuagaauccugaucuacagcuggccuuggaaaacugggaguuaugu

SEQ ID NO: 4173714 - RNA, 89 nt, Human
acaugaccugggaguuuguuagaaauguagauucucagacccacuggauuagaaucuucauuuugacaagauucccaggggauucaugu

SEQ ID NO: 4173715 - RNA, 59 nt, Human
acaugcacauuucaagggaauaaacagacuucuucugagccagaguggagugugccugu

SEQ ID NO: 4173716 - RNA, 100 nt, Human
acaugcauacuuagaguuguuguauaaugauggaacuuuagcaauucacucacaauuugaaguacccguuuuuauugcauuuaauuauauauacgcaugu

SEQ ID NO: 4173717 - RNA, 60 nt, Human
acaugcucuccuaaggcccugugcuccuguuuggagccacaaaagcuuuuggaggguugu

SEQ ID NO: 4173718 - RNA, 122 nt, Human
acaugcugcauccagggagggauugugucagauaaucuggagagcauugaacaaaacucuuuacuuuugaaaugcaucaucauuuagaugaugauaccaaauugccuccuuuuuuaugcugu

SEQ ID NO: 4173719 - RNA, 66 nt, Human
acaugcugggcaauguuguuuuccugaaugucuaucaaaguagaugagcaaugcccaguugcaugu

SEQ ID NO: 4173720 - RNA, 69 nt, Human
acaugcuucagagacauccuacucaaggguggaggagccauuguuuggaggcugcucucaggggcaugu

SEQ ID NO: 4173721 - RNA, 64 nt, Human
acauggagaaaccccgucucuacuaaaaauacaaaauuagccagacgcgguggugcaugccugu

SEQ ID NO: 4173722 - RNA, 85 nt, Human
acauggauauggcauccuucuuaaauuggcugcacagauacaaugguauucucugugcagauuuaagacagccaaaaauuuaggu

SEQ ID NO: 4173723 - RNA, 87 nt, Human
acauggauuucucccauuacuaagccuggucuaagagccucauaucaacucugugagcuuaggacagggcuaugggaugaauucugu

SEQ ID NO: 4173724 - RNA, 59 nt, Human
acaugggagugugguuagagaccugggcacuuugcccagcucuguaacccauucccugu

SEQ ID NO: 4173725 - RNA, 71 nt, Human
acaugggcaccuuaaaaugaggcagauacuaugucccccgguauugaacagucucacaagguggcuuacgu

SEQ ID NO: 4173726 - RNA, 59 nt, Human
acaugggcaucuaugaggcucuucugcuccaacgaaggugugaguuuuuggaccugugu

SEQ ID NO: 4173727 - RNA, 61 nt, Human
acauguaaguaaagcugugaaggaggagauuaucuuugccuuccaguuuuaauuaaauugu

SEQ ID NO: 4173728 - RNA, 76 nt, Human
acauguacaaggcaguacaaugaugacacauuuucuguuugcugagugugaguaauaaacugucuugcucugcugu

SEQ ID NO: 4173729 - RNA, 63 nt, Human
acaugucagcucuguuccaucauuacaugccaucaugcagugcaacagaagcaggcuggcugu

SEQ ID NO: 4173730 - RNA, 55 nt, Human
acaugucagggacucugggaggaaggaaacucaggccugggguacacuggcaugu

SEQ ID NO: 4173731 - RNA, 88 nt, Human
acaugucugagaccuggaggcaaagcuggcuuuuacaggggcuggcuuggcuccuggggaggugagcuugugugcccuucugacaugu

SEQ ID NO: 4173732 - RNA, 60 nt, Human
acauguucuaauauugugacauagcguagaauuaagcuggcuuacuaaguagaaacaugu

SEQ ID NO: 4173733 - RNA, 76 nt, Human
acauguuuacucugaucuagaauuucugcacaaaucaauugagugugagcaugaggucuggcaaucagaaaccugu

SEQ ID NO: 4173734 - RNA, 91 nt, Human
acauuaaagguuaaaggauguuugaaaggaaguuaauacuuuuaaaacauugggagaauggccaucuuuucagagaucugaccaaaaaugu

SEQ ID NO: 4173735 - RNA, 78 nt, Human
acauuacuuaccuuggguucuaugccaacguccucaagcauuuuaagaaaauggcuuagagcuuaagucguacaaugu

SEQ ID NO: 4173736 - RNA, 61 nt, Human
acauuagaaccaagguacagucuauugcuaggugucugcagcagcugccugguuuuuuggu

SEQ ID NO: 4173737 - RNA, 130 nt, Human
acauuagaaucaccuggagagcuuuuaaaaauucuaaugcccuggccccagcccagaccaauuauauuaaaaucucuggggugggacccaggcaugaguauuuuuaaagcucuccagguaguuccaacgu

SEQ ID NO: 4173738 - RNA, 63 nt, Human
acauuauagcuuugaguuuggaaauguguagggugaaaucucaaauuuucuuggcuguagugu

SEQ ID NO: 4173739 - RNA, 80 nt, Human
acauucaaguucauguguagucagugccgaaauggagacaugaggucuuaaacugggaugcaugaaauccuugaaauugu

SEQ ID NO: 4173740 - RNA, 56 nt, Human
acauucauugagcaacaacaauuauggauuaucuauuugugcagcucagagagugu

SEQ ID NO: 4173741 - RNA, 57 nt, Human
acauuccugacagcaaguacuguacuuucaguagaguacagugagguguuaggaugu

SEQ ID NO: 4173742 - RNA, 76 nt, Human
acauucugguaaggcuauugaugugaaaaaauaacaccauuugugagacaacaguagccuuuacaaggcauugugu

SEQ ID NO: 4173743 - RNA, 57 nt, Human
acauucuuccagcuggcuguugucgggucuggugagauggagagucuggaagagugu

SEQ ID NO: 4173744 - RNA, 64 nt, Human
acauucuucuugugaauuuacuacauggguauuuucuacacuugauuuccaauaaggagaaugu

SEQ ID NO: 4173745 - RNA, 55 nt, Human
acauugaacauggcaggacauuguuuuuauggcauauguaccuguauuucauugu

SEQ ID NO: 4173746 - RNA, 105 nt, Human
acauugagcaagauucacaauaggagcaugcaaauauuaugcgcuacucauaucaguggugcauaauauuugcaugcuucuauugugaaugucgacuauuaaugu

SEQ ID NO: 4173747 - RNA, 77 nt, Human
acauugcuugggcuuguucccagagacucagugaaaugccccugauaugucuccaggagcaagucacccaggugugu

SEQ ID NO: 4173748 - RNA, 111 nt, Human
acauugguugugauccuguaaaaagccgcaagcaguggcucuuucaguacaaggaaacccuugggacagaaaaguuuacuuuugcucaggcuuuauggugacagccagcgu

SEQ ID NO: 4173749 - RNA, 69 nt, Human
acauuuagaugguguuauaguacuuuuugucauaaugguggaugaauuguagcaccauuagguaagugu

SEQ ID NO: 4173750 - RNA, 60 nt, Human
acauuuauuuuggcacggcacaauucuauucucuugugacuaugucaguaugguaagugu

SEQ ID NO: 4173751 - RNA, 55 nt, Human
acauuucuaagaaggcugcacaucacagucuaugugaugguggcccuggagaugu

SEQ ID NO: 4173752 - RNA, 57 nt, Human
acauuugaaauucugaacagaucccuaaggggaauacuguuuaacauuuuauggugu

SEQ ID NO: 4173753 - RNA, 75 nt, Human
accuaccugagaccucuugguaucgcuaggcagaagcaaaccgccuguacuuguauuaaagguccgggucuuggu

SEQ ID NO: 4173754 - RNA, 72 nt, Human
accuacuacacagugaucaguuacugucuguauucauauuuuacagauauguaaacugacacuuggggaggu

SEQ ID NO: 4173755 - RNA, 61 nt, Human
accuaggaacucaauggcagauauucugagaauggggaugucugucauggaauuucaaggu

SEQ ID NO: 4173756 - RNA, 81 nt, Human
accuauguuguauagugccuggcauaaaccagguagccaauaaaaagcuauugauuaaaugcaggacuuauaagguaaggu

SEQ ID NO: 4173757 - RNA, 58 nt, Human
accuauucuaaccuugacuucugaccugucgcugaggaaaagcaagcuuugagugggu

SEQ ID NO: 4173758 - RNA, 67 nt, Human
accucacaagauacucaguggauaugcaucccuuaaacuggagaagcacacuguguuuuguucuggu

SEQ ID NO: 4173759 - RNA, 124 nt, Human
accucagaaacacucauuggcuccagaaaguuuuugauucuaagagagauucaggguauccuaagcaucauuuuuuacuucucucucaaagggaaucaagacuguuuuaagaaaugaugauggu

SEQ ID NO: 4173760 - RNA, 79 nt, Human
accucagaguuggaaucacauuuuuaagcugcauauuccaguuuuaaacacaucagauugguuccuugcuuugaaaggu

SEQ ID NO: 4173761 - RNA, 61 nt, Human
accucagccugugcacccagccgcucugacugguggccagaaccugcaguaggccagaggu

SEQ ID NO: 4173762 - RNA, 104 nt, Human
accucagucugaacccauauaaaucuuggacagacuaaaauugcacagugggaucauuucauucacaugaguuugccaauauguggguauuaacaggcaaaggu

SEQ ID NO: 4173763 - RNA, 57 nt, Human
accucagugcuugccagguguguuacaagccacuuuggaauaaucaagcucugaagu

SEQ ID NO: 4173764 - RNA, 79 nt, Human
accucauucauggcucuuuguggccaccuaaucuugggauuaugccagugacaugaccacaaagcagcaugacugacgu

SEQ ID NO: 4173765 - RNA, 66 nt, Human
accucauucauucauucagcagguacuuacugagaagcagaugagcugagacugacaugaagaggu

SEQ ID NO: 4173766 - RNA, 64 nt, Human
accuccaggagaauaauggcagauuauaggcucaucuccguggcugccuuuucucucugagggu

SEQ ID NO: 4173767 - RNA, 113 nt, Human
accuccauguuucccucuguggauggaguguaguucauuccguccuauuccuuguagagggauugugaaguagggcugagugauuacacuuggugcagaugagaugaaggggu

SEQ ID NO: 4173768 - RNA, 64 nt, Human
accuccucugccuuguuuccucuuuccagagccacuagggaggacgguccagggcaaaggcugu

SEQ ID NO: 4173769 - RNA, 75 nt, Human
accuccuucaaucuuccugacaacccuauggguaaauauuauuguuguaauucccauuuagcggaugagggaagu

SEQ ID NO: 4173770 - RNA, 74 nt, Human
accuccuuucugguaacacuuggcugcaaccuggaauaggcaaaaaguuuuauucccagcaagguaauggaggu

SEQ ID NO: 4173771 - RNA, 94 nt, Human
accucgcagaugacuugagagugaauguccccgcgggucagcaccacauuggcugugcuguggaugcuguaggacacgcucucucuugcggggu

SEQ ID NO: 4173772 - RNA, 72 nt, Human
accucuaagcugauuccacuuuuuccacagagcugcuccagggcgguguggguggaggggggaucaggaggu

SEQ ID NO: 4173773 - RNA, 129 nt, Human
accucuagauguuaauuccuucaucuuauaaccaaaucuauaaagcugccugugucuauuccuuuuuucccuuccauuacaaaggaaagaaguauuagaacauaggcaucuuugaugaggggcauuauu

SEQ ID NO: 4173774 - RNA, 95 nt, Human
accucuaggccaguuucccaggcuguggggcccuauaggcaauuucccauagggucucagagccugagaaccugugcaucuuacugccugguggu

SEQ ID NO: 4173775 - RNA, 56 nt, Human
accucugcaguagggcugugccauguggccacagcuccagauuaauuguaggaggu

SEQ ID NO: 4173776 - RNA, 64 nt, Human
accugaaauaauaauacugugcaauggauaguauauauuuaaggcccacagugguuaaucaggu

SEQ ID NO: 4173777 - RNA, 61 nt, Human
accugaagagaaauuucccuguauaaugaaaacauuuguacagaaaaaauucuugguaggu

SEQ ID NO: 4173778 - RNA, 130 nt, Human
accugaggacuccacagaggacacagugcuuggaaccugcaucucccuuccuaugcccugcucugccugcccagggccuugggauucuuggaugcuccaagcccacuucagauccugugcaagccucugu

SEQ ID NO: 4173779 - RNA, 68 nt, Human
accugagggcccaaacuugguagaguuuacuuaacaaacacugcgcuuccaaggccaggcccugaggu

SEQ ID NO: 4173780 - RNA, 77 nt, Human
accugaugggucucucccuacugcaaugaugcuucagggcaugucucucacugcuggggagugauugaccaucaggu

SEQ ID NO: 4173781 - RNA, 110 nt, Human
accuggaaacuuguuagaaacacaauuuccugggucucacuccagagcuccugauuuaaaaauucugcagguagagcucaggaaucuauguuuucacaaguccucuaggu

SEQ ID NO: 4173782 - RNA, 82 nt, Human
accuggaaagcuacaucaccuucacgaaccauucagggguccugaccccagucauccugcaggugaaagagcugaucagugu

SEQ ID NO: 4173783 - RNA, 84 nt, Human
accuggaagcugguuagaaaacagagcucaggugccaccccagaucuacugaguccgaaucuguauuuuaaccaggucccaggu

SEQ ID NO: 4173784 - RNA, 123 nt, Human
accuggaccuugucccuccagugaaggcugcccggaugccucagagagcacagccuucuuagcuucauucuuccggagugcuuuuccuuauuuggugcuuucuagggaguaggcaggucaggu

SEQ ID NO: 4173785 - RNA, 56 nt, Human
accuggagcuuccaacucaacuuuaauuaaaggcccuuugcguggaagcuccaggu

SEQ ID NO: 4173786 - RNA, 98 nt, Human
accuggauggucuggcuggggagggcgucaaggccaaguaccucaugccgcccuuugucacgaugaccuccccgucccacuucaccgccaucccgggu

SEQ ID NO: 4173787 - RNA, 68 nt, Human
accugggagaaauggugaaucuggauggaugaaguauguuuauuuauccaagcacaauuucuaaaggu

SEQ ID NO: 4173788 - RNA, 68 nt, Human
accuggggcagaguaggauuuuggccucuacugaucuuguuuauaauccaacucugcucccuuuuggu

SEQ ID NO: 4173789 - RNA, 67 nt, Human
accuguaacauauagcauguucuugauaaauauuuauuaaaugaaugaaacuauguguuguuuaggu

SEQ ID NO: 4173790 - RNA, 64 nt, Human
accugucauguagaguuucagcuuucuuacccuggguacagagucucaaaccuacaaagugggu

SEQ ID NO: 4173791 - RNA, 77 nt, Human
accugugacucuccacuaguaugaaaugggcugccucgaaugagccugacauauucuacaguguuaguguuagaggu

SEQ ID NO: 4173792 - RNA, 96 nt, Human
accuguuucacuaguauucagaguauuccaugagguuagcaugaaaugaccauguccauuuacaccagggaaauucaggguggcugugggacaggu

SEQ ID NO: 4173793 - RNA, 72 nt, Human
accuuagaaugugaccuuacuuggugauaggguguuuacggagguaaucaagcucaaguaagguuauaaggu

SEQ ID NO: 4173794 - RNA, 66 nt, Human
accuuaguguuugacguuuuuguuggaaaguaaggagcaggcagauuguuaauguugcacuaaggu

SEQ ID NO: 4173795 - RNA, 84 nt, Human
accuuaguuggagauggggucucuauggggauaaucaagucaaaauaaaguuauuagccuaggcccuaauccaacaugacuggu

SEQ ID NO: 4173796 - RNA, 77 nt, Human
accuucaagaaacugugcuacagaguuaguuauuuuaguaauccuuuaaauucuguuacaguaaucuuguugagggu

SEQ ID NO: 4173797 - RNA, 72 nt, Human
accuugcgucaauuagcugguacugacaggacugggaaggucguugcaggccccaucugggcauagcaaggu

SEQ ID NO: 4173798 - RNA, 70 nt, Human
accuugggcaaccugcuccugcuagaaaaagccuaaaugcaugaagcaggacuguaggcuugccccaggu

SEQ ID NO: 4173799 - RNA, 76 nt, Human
accuugugggaguggugagaggccacgguuuuccuugggggcauuuccccaaagauguggcugccaccuaccaggu

SEQ ID NO: 4173800 - RNA, 71 nt, Human
accuuguuagacuauggaccuuaugcagcuuucagugucuguaugcgcuguguguguauucuacgcaaggu

SEQ ID NO: 4173801 - RNA, 130 nt, Human
accuuuaguuuucagaccuaaaaaugcauuuggcuguuuuugauuuuuuuuggaaggggaugagguuccuugccaaauuaacauacagaaauuaaagcacauauaaccaugauguuacaaaacuugaggu

SEQ ID NO: 4173802 - RNA, 94 nt, Human
accuuucaggccaccgaaggauucaggccgaggagcugcauagugaccgagggugaugaagcugguuuuggcuuggggauggcuggccagaggu

SEQ ID NO: 4173803 - RNA, 112 nt, Human
accuuuccccuuucugcucucagccuggccuggcacugggcuccuggccagguaucacccccuggcacagggcagggccagguggggcagaggauaguaagguggcaggggu

SEQ ID NO: 4173804 - RNA, 69 nt, Human
accuuuuaaugcuguuagugaaaugguuuauaccuacgaagagaccacauuucugaauagcauaaaggu

SEQ ID NO: 4173805 - RNA, 68 nt, Human
accuuuucaaguccuuuggaaggccuggggagugauaaaucuguagugcucaggagggcuuaaaaggu

SEQ ID NO: 4173806 - RNA, 72 nt, Human
accuuuuuccaaagcuucuuacuguggagucagaauccucccugacgugauaagaauuuugugagaaguggu

SEQ ID NO: 4173807 - RNA, 74 nt, Human
acgaaaggguguuucuaaaggucacaggagcccuugcugggucgccugugggcccuggacagagacccuugagu

SEQ ID NO: 4173808 - RNA, 108 nt, Human
acgaagguggaucuuacuuguaucaaagcagcugaucucagagccuccagcccgugguuucaggucaguuagcuguuuuuaugaugcccuagugggauaugccucugu

SEQ ID NO: 4173809 - RNA, 65 nt, Human
acgagauuagguaauuacagcaaauguggucauuagccucaucugcucuuauuaucuuauuaugu

SEQ ID NO: 4173810 - RNA, 66 nt, Human
acgaggugucccgcaguccccaagcagaucuggagaaccuuggaggaaaggcagggagaccggugu

SEQ ID NO: 4173811 - RNA, 113 nt, Human
acgauacacuguguucucugcucaaagcuauuuauucuugagagugagaagaaacguugcauguuucuuuugugccaaguaaugaauaaucaacaguagacacugaguguugu

SEQ ID NO: 4173812 - RNA, 101 nt, Human
acgaucguauuguagucucucaaagugcucuagaaauugucagugguuuacaugaaguggccaugggugucuggagcacccugaaacugcaccaaaguugu

SEQ ID NO: 4173813 - RNA, 110 nt, Human
acgcaaggaaaugauucgauauagggugggaggcuggcagggugggguccugcugaauccuagaaggcuccuaucgcuuucagcaaucaacuuuucucauuuguuugugu

SEQ ID NO: 4173814 - RNA, 75 nt, Human
acgcagcucuugcagccuuaccaaggcauuuggauuuuauuaugaaugugaaaggaagcugccaggggugggcgu

SEQ ID NO: 4173815 - RNA, 61 nt, Human
acgcggccuuuccggacaccgacugagcugggcuugccuagcugggugcccgaagccacgu

SEQ ID NO: 4173816 - RNA, 61 nt, Human
acgcgguuaggcaucagguauauaaacauuuaauguuuucaugguuaugugucuaaugugu

SEQ ID NO: 4173817 - RNA, 62 nt, Human
acgcugaaucuccacuccuuguuugcaggaggaaacugaggcccaggagccuggagaugugu

SEQ ID NO: 4173818 - RNA, 68 nt, Human
acgcuugccguauccuucuccagucguauuuuuauccaaaagaaggaccuggaggaggaugagagcgu

SEQ ID NO: 4173819 - RNA, 56 nt, Human
acccaacuccaggguuuaucugugcuuagucaaucagaaguuugaccuuggugggu

SEQ ID NO: 4173820 - RNA, 64 nt, Human
acccacagaaccugugacaacaaccaugcauguuuguuguuuuaagucacuaaguuuugggggu

SEQ ID NO: 4173821 - RNA, 57 nt, Human
acccacagccgcugugcgucccucucuccgggugucagugcgcgcggcggguggggu

SEQ ID NO: 4173822 - RNA, 73 nt, Human
acccaccgcacuauucaacguuucucgacccuaguggaguacccgguccccuggagauguugugcaggagggu

SEQ ID NO: 4173823 - RNA, 110 nt, Human
acccaccuucccacagcugcggcaguggugcuuccggcggaugacggugaagggugcuuugcacgccgugcagaagccacaggccucgucuggcacccacuccggggggu

SEQ ID NO: 4173824 - RNA, 58 nt, Human
acccacgaaaucuaggagaguaacaaaaugguuguucuaagcaacuaaguuuuggggu

SEQ ID NO: 4173825 - RNA, 68 nt, Human
acccacuuuauguaauuguagcaaaaugaugcagccuuuguguaacaucguguuucauugcucugggu

SEQ ID NO: 4173826 - RNA, 78 nt, Human
acccagaauggucuuugagagaaguugauugaaugaaaaguguacaugaaucaguucuuuaaaggaugaugucugggu

SEQ ID NO: 4173827 - RNA, 58 nt, Human
acccaggaaguggagguugcagugagcugggauugcaccacugcacuccagccugggu

SEQ ID NO: 4173828 - RNA, 59 nt, Human
acccaggaggcagagguugcagugagccaagauugcaccacugcaacgccagccugggu

SEQ ID NO: 4173829 - RNA, 58 nt, Human
acccaggcgggagugcagugggguaaccuuggcucacuacaaccuccgccuccugggu

SEQ ID NO: 4173830 - RNA, 58 nt, Human
acccaggcuggagugcagugacaugaucucagcucacugcaaccuccgccucccgggu

SEQ ID NO: 4173831 - RNA, 58 nt, Human
acccaggcuggagugcagugauacaaacuccacuugcugcaaacuccgccuccugggu

SEQ ID NO: 4173832 - RNA, 58 nt, Human
acccaggcuggagugcagugaugugaucucggcucacugcaaccuccgccucccgggu

SEQ ID NO: 4173833 - RNA, 58 nt, Human
acccaggcuggagugcaguggcaccaucuugguucacugcaaccuccgccucccaggu

SEQ ID NO: 4173834 - RNA, 58 nt, Human
acccaggcuggagugcaguggggccaucuuggcucacugcaagcuccacccuccgggu

SEQ ID NO: 4173835 - RNA, 58 nt, Human
acccaggcuggagugcaguggggcgaucucggcucacugcuagcuccgccucccgggu

SEQ ID NO: 4173836 - RNA, 58 nt, Human
acccaggcuggagugcaguggggcgaucuuggcucacugcaaccuccaccucccgggu

SEQ ID NO: 4173837 - RNA, 58 nt, Human
acccaggcuggagugcaguggugugaucucagcucacugcaaccuccaccacgugggu

SEQ ID NO: 4173838 - RNA, 58 nt, Human
acccaggcuggcgugcaguggcgugaucucggcucacugcaagcuccgccuccugggu

SEQ ID NO: 4173839 - RNA, 60 nt, Human
acccagggcuuaaggcggugcauugcuucugcagggacaccaugcugcaggcccugaggu

SEQ ID NO: 4173840 - RNA, 69 nt, Human
acccagucagcugacccagugaggaggcaaagcccaggcugccuucuucucccuggcucaggagugggu

SEQ ID NO: 4173841 - RNA, 58 nt, Human
acccaugagauucugaauuuggccuggguuggccagguuuuggaauuuuuugaaaggu

SEQ ID NO: 4173842 - RNA, 75 nt, Human
acccaugcacauucugggcgccuauggcugcagcaugucccucacccuguugccagguagucccagggcaugagu

SEQ ID NO: 4173843 - RNA, 56 nt, Human
acccaugggccaguugggguggucugcaugugaggcaucccaagcagcucaugggu

SEQ ID NO: 4173844 - RNA, 58 nt, Human
acccauuccuuuacuucaucuggcauggauuuaaccaaugaauaaaaggguugugggu

SEQ ID NO: 4173845 - RNA, 84 nt, Human
accccaagaauauuaggauuuuaucuugccaaugaagcuguuuaacaaugcuauuuggaaaugauaaaguacuguuccuggggu

SEQ ID NO: 4173846 - RNA, 61 nt, Human
accccacuucccccaugcaaacacaccucugcuuguucaggccugggacaguuuuaggggu

SEQ ID NO: 4173847 - RNA, 65 nt, Human
accccagcccugcuucugggaggcucuccugagccucaguccccucagggguguggcugcugggu

SEQ ID NO: 4173848 - RNA, 60 nt, Human
accccaggcccagggaagaggcugggcuaggagacggucucgucuggggaggccuggggu

SEQ ID NO: 4173849 - RNA, 55 nt, Human
accccagggcucuaggaaaaaagaagugauucagauuccauagcacccugugggu

SEQ ID NO: 4173850 - RNA, 94 nt, Human
accccaugacauugauuagcacaucuucuuggccugcaacucauucauaugugcauauuuugucggcccaaugagaguguuagcagaaaggggu

SEQ ID NO: 4173851 - RNA, 56 nt, Human
acccccgucugggccacuccugcguggcaggcacacagguggcuccugcugggggu

SEQ ID NO: 4173852 - RNA, 77 nt, Human
acccccuaaagcugaaacagugcuucacucagccaacguuaagggcuugaugcauucugguuccagucuggggaggu

SEQ ID NO: 4173853 - RNA, 67 nt, Human
accccuaugagcugccuuggggaaggauggcaggaaggccucugaguucugcccaaggucugggggu

SEQ ID NO: 4173854 - RNA, 68 nt, Human
accccucuggugccauucuguggccuagacuugcuuggcugggccaagaaguuguguaugugaggggu

SEQ ID NO: 4173855 - RNA, 74 nt, Human
accccuuuggcuggcuggcugugcaaaggcaggccccacaggggaguaauguauuugugacagccaguuggggu

SEQ ID NO: 4173856 - RNA, 116 nt, Human
acccgugugacaccaauuccaucuuccaggacaccaggguaguauucugugcaaugaaaguaauuuacuaaaugguccucuggugucguggaagagugaauucauuuugcacaggu

SEQ ID NO: 4173857 - RNA, 98 nt, Human
acccuaguuccugugaguguggcuuuauuuggaaauagggucuuuauacguauaauuaaguugagaaucuccagaugaaguccuccuggauuuagggu

SEQ ID NO: 4173858 - RNA, 77 nt, Human
acccuauauguuagguuuuaucugaaggaaaucuacacauucaguuuucuccagacacaaaaucuaagaguuggggu

SEQ ID NO: 4173859 - RNA, 75 nt, Human
acccuaucgaugauaguaauuauugcugauaauauuaaugguaguuuuacuaaugauuauugucauugugagggu

SEQ ID NO: 4173860 - RNA, 89 nt, Human
acccucacagccucucuggccgagagucccugggcgcucacuugccgggaugcacaggcacgccucuggccaggccgggcugcgggggu

SEQ ID NO: 4173861 - RNA, 66 nt, Human
acccucagccugccccccagccucagucuccccaagccugcaguggggccggugaggccgaggcgu

SEQ ID NO: 4173862 - RNA, 55 nt, Human
acccucagcuggagauugaauuaauauuauaauaacaucguucuccaacuggggu

SEQ ID NO: 4173863 - RNA, 64 nt, Human
acccucauuucuguuacuuuuauguuuuuaaugauagaaguaugaagaauacauagaugauggu

SEQ ID NO: 4173864 - RNA, 57 nt, Human
acccucucuagacauuugugaugagaaaugacauuuugacauuugucaagagaaggu

SEQ ID NO: 4173865 - RNA, 62 nt, Human
acccugagguguuuaguaggggcggagcagcagcaugagcugggccgugaccaccugggggu

SEQ ID NO: 4173866 - RNA, 88 nt, Human
acccugcagcagggcagcacaucugauuauaugacucugacgaaaugucagagaaaugaaaacaaauggcugagcagucccugggggu

SEQ ID NO: 4173867 - RNA, 69 nt, Human
acccugcagcccugggcaccugugaggggccagcugugggcagacccugggccacagaggagguagggu

SEQ ID NO: 4173868 - RNA, 61 nt, Human
acccugggaccuggagguggaucaccugcggucaggcccuggaggaccuccagucaagggu

SEQ ID NO: 4173869 - RNA, 76 nt, Human
acccugugcuccaggagguugcugcuuccuuucucauuuugaaggaugaacaaguggccucuggucaccuaagggu

SEQ ID NO: 4173870 - RNA, 89 nt, Human
acccuuacugagugugaccucaucuuaacuggaacccaucugcaaagauccuauuuccaaagaaguucacauuuacgauuacugggggu

SEQ ID NO: 4173871 - RNA, 79 nt, Human
acccuuagaaaccaucagauaauucauacuggagagaaacccuacaaaugugaagaaugugguaaagcuuuuaaguggu

SEQ ID NO: 4173872 - RNA, 68 nt, Human
acccuucggacuuuggaaagugggaagcucauugcaguuuugggcuggccuucugcagaguucugggu

SEQ ID NO: 4173873 - RNA, 85 nt, Human
acccuuuugcuccuauuguucauccaauccugagccuacccauaggguggauuucagcaagggugggugggaggaggaggagggu

SEQ ID NO: 4173874 - RNA, 79 nt, Human
accgaagcuagaagaagaaaagugaacauagauuaguuuguuucugcugacaagccaguuuguaguucucucuuuaggu

SEQ ID NO: 4173875 - RNA, 62 nt, Human
accgacacucuccagguuagagcacuuauccaguggaugguucagcuuucuggaggauaggu

SEQ ID NO: 4173876 - RNA, 79 nt, Human
accggcugucucagcuagaggugaaacaugccaauaagauacaauguaggcaauggguggcccuagaaugacugcuggu

SEQ ID NO: 4173877 - RNA, 57 nt, Human
accgggagaauuuagcaaggccugauuguucagauucuuuucuguguuccucccugu

SEQ ID NO: 4173878 - RNA, 81 nt, Human
accgggagacgaggcacaggccuggugcugcugacaggugucagcuucagcugcauuaggaucugagucuaugauucuggu

SEQ ID NO: 4173879 - RNA, 114 nt, Human
accgggcccgcgcggcggccgccgucccggccaagccggggccccgaagccagagccggagccgggcgggccgcggggucauggcugggccgcggggcgcgcugcuggccuggu

SEQ ID NO: 4173880 - RNA, 74 nt, Human
accggguuuggagaggaaacacagagcagugucuauuuagaucuucagcgagguuuccuuucuuucuccacggu

SEQ ID NO: 4173881 - RNA, 69 nt, Human
accgguuggccccuucggcuccaccuggcucaacagacagccaguggcaugcggcagggaccaaugggu

SEQ ID NO: 4173882 - RNA, 65 nt, Human
accgucuuucaucuuucaugcaggguaaaagaagacaccuuggcuacagcaagaggaaagaaggu

SEQ ID NO: 4173883 - RNA, 55 nt, Human
accgugucugacacuuugggcgagggcaccacgcugaagguguucaugaugcggu

SEQ ID NO: 4173884 - RNA, 62 nt, Human
accuaacucugacauuaucucuugucaacuguuuuccuaguagacaggagaguuagguaggu

SEQ ID NO: 4173885 - RNA, 94 nt, Human
accuaaggcuaugaugugguugucucucacuagcugggggaacacaaggcauucugcuuccagagcaugaagggcaaugaccagagucauaggu

SEQ ID NO: 4173886 - RNA, 68 nt, Human
accuacagcauggggaucacuguaggcaacuagaaauggaggugucuugugguacccauggcuaccgu

SEQ ID NO: 4173887 - RNA, 94 nt, Human
accuacccagauaauccaguauaaugcccccugugggguauaauccggggggauaaucccuuggggggacauuauucugcuaucacaggagggu

SEQ ID NO: 4173888 - RNA, 55 nt, Human
accuagaacugcaggcuauuuuugcugguuucaaaagugaccuguagcuccaggu

SEQ ID NO: 4173889 - RNA, 55 nt, Human
accuagaguagucaaauucauagaaacagaaaguggaacagugauugcuuggggu

SEQ ID NO: 4173890 - RNA, 56 nt, Human
accuagcaugguucuaauauuuaggaacauaacugucucuacaaauuauguuaggu

SEQ ID NO: 4173891 - RNA, 79 nt, Human
accuagcuuucuaugcaucugaacaauagagagguccccauuugccacguucucuaagucuguacagaucaaccuaggu

SEQ ID NO: 4173892 - RNA, 79 nt, Human
acauuugaugaugguacuguauuugaauaagaaaacacuaaauauuuuaaucaagucaaccaucaugugcaacagaagu

SEQ ID NO: 4173893 - RNA, 60 nt, Human
acauuuuaaaaacaguaccuggaggugacuaagugacuacugcacugugauuuaaaaugu

SEQ ID NO: 4173894 - RNA, 91 nt, Human
acauuuuaauuugugggacuauaaugcagguuaauauagcaucuguauggcaucuuuugcauauguagcucccaucccguuuucaaagugu

SEQ ID NO: 4173895 - RNA, 97 nt, Human
acauuuuugugucuauauaucuguauuacauuucuguacacuucugagcuauauucuaaaguucaaugaggauagaacuggauauacacaaaagugu

SEQ ID NO: 4173896 - RNA, 63 nt, Human
accaaaaugcuaaaugcagcaaguagucucuggucuccaucuuauuugauuuggcacuuuggu

SEQ ID NO: 4173897 - RNA, 77 nt, Human
accaaacuagccugucccauuuucuacuauggaauggugucccauuuucuacuauggaauggaauaguuaggugggu

SEQ ID NO: 4173898 - RNA, 125 nt, Human
accaaagcaggaggccaacaaacgacgggaucagggcaugggcgcccgguggggccuggccauggggcuggcucugcgucuguucgugggguccuggcacaucccguccaucuccuucuugcggu

SEQ ID NO: 4173899 - RNA, 57 nt, Human
accaaaugcuuggcugcugugauaacugcuggagccacagaucuucaagacauuggu

SEQ ID NO: 4173900 - RNA, 111 nt, Human
accaaccgcauggccuuggugugccuagauuuccucuuuuguaaagugaggcugaagugucucccuuuggaugguaggcgaggaccaagaggcccagcgccuggcgguggu

SEQ ID NO: 4173901 - RNA, 112 nt, Human
accaauccuuacgcguuuuaaauccuaaaauuuuucuuuagguuuagguaaauaguuaaaaaauuauaacaucuaagggagagaaaguguuauuguauggaacagaguuggu

SEQ ID NO: 4173902 - RNA, 130 nt, Human
accaauucaaauuauccagaagcccgaagguuauaaugauguucauguauagagagcuuuuauucaacaauucaaaguucugugcaggaagucauuaugauaaaagcuuucuuaccaaauuaugaagugu

SEQ ID NO: 4173903 - RNA, 129 nt, Human
accaauugaacuauaacuucuuuuaaagaucuugugccaagcugagcaauuuagaguggcaaaacucaacaaauaaguggcacuuaaagucuuagcuuacagcuaagguccagugaaacuuuauuuggu

SEQ ID NO: 4173904 - RNA, 79 nt, Human
accacacucaaauguguacaugacagauagaaagauuauaguauuuuuuaauguuugagucaguauauuuauugguggu

SEQ ID NO: 4173905 - RNA, 77 nt, Human
accacaguauauaaagucaaggcauuuuaugaucuuccuggauguaauuauuuuccaugacuuuguguaaucauggu

SEQ ID NO: 4173906 - RNA, 55 nt, Human
accacagucucgaagcacugcaggaaagguccacugcagugucccuaacaguggu

SEQ ID NO: 4173907 - RNA, 62 nt, Human
accacagucucuccacacugcagggcgccaagcuugccuuuagcccaagggagggacuuggu

SEQ ID NO: 4173908 - RNA, 55 nt, Human
accacauugcuccacaggguuaacagacaacuguuaaaucaaagaauaauguggu

SEQ ID NO: 4173909 - RNA, 62 nt, Human
accacccucagcagagcugaaaacuggggcaauuccccagaacucagugugugggagguggu

SEQ ID NO: 4173910 - RNA, 64 nt, Human
accaccucacuaguuaaagaagucagcgacuggucacuucagauaacuggugucaccaaggggu

SEQ ID NO: 4173911 - RNA, 70 nt, Human
accacuacagaugugacugggcaaguuacuucaccucucugagucucaguuuccauaucugcaagcuggu

SEQ ID NO: 4173912 - RNA, 60 nt, Human
accacugaaacagguauugcuggugauuuuuguucaccuuggauacauuuuucacauggu

SEQ ID NO: 4173913 - RNA, 85 nt, Human
accacugaaaugagcaauguggaccagcucagggugggcacugcaguacuuuucaugggcugaguccuuuugagguuuccuuggu

SEQ ID NO: 4173914 - RNA, 55 nt, Human
accacugaggccggagcacugaagaguccagcucuuuuucaccucugucagcggu

SEQ ID NO: 4173915 - RNA, 58 nt, Human
accacuuuacagaaauggaaaggucaccaacaaccuucauguuguuaaguauaguggu

SEQ ID NO: 4173916 - RNA, 65 nt, Human
accagaccgggcuaauuuuuguaucuuuaguaaagagaggguuucaccauguuggccaggcuggu

SEQ ID NO: 4173917 - RNA, 101 nt, Human
accagagaaguaggcagaugccagaucaugcagggccuuguggaaucuaagugagaaaugaugugaccuggccuagcaugaagcgucugucuucuauuggu

SEQ ID NO: 4173918 - RNA, 74 nt, Human
accagagacucacagcuggagugaggauggagucucuugcuucagacagauucuuuuuccuccucugugcuggu

SEQ ID NO: 4173919 - RNA, 57 nt, Human
accagagauggggcuucucugugggaugaccugauggauucaguucuuucuuuaggu

SEQ ID NO: 4173920 - RNA, 56 nt, Human
accagaggaugaucuggccucucucgguuuccugccagggaggccucaccuguggu

SEQ ID NO: 4173921 - RNA, 79 nt, Human
accagaggcaguagaaauuugagagauauuuaggauguggaaauaucaagaauugcugaugaaucugauuggcuuuggu

SEQ ID NO: 4173922 - RNA, 58 nt, Human
accagagggagacuuccucuucuacuucagaaaugaauggggaguauaauuuucuggu

SEQ ID NO: 4173923 - RNA, 74 nt, Human
accagaugauguaccacuuucucaguucugaguuugcugagugacuggauagagagucgguacaacagcaaggu

SEQ ID NO: 4173924 - RNA, 67 nt, Human
accagauugagauuguguuuucaaaaaauacagcuucacuggaaagaaaucacuguccaaucuuggu

SEQ ID NO: 4173925 - RNA, 82 nt, Human
accagauuucucuagggaaauaaacugaguggugaccaaaauuuaauauauuacuaggcaguuuuucucuguguuuacuggu

SEQ ID NO: 4173926 - RNA, 67 nt, Human
accagcaaagucucaggcagaggaaggcuaugcuugauagcaacaccaucuggugagaaaagcuggu

SEQ ID NO: 4173927 - RNA, 83 nt, Human
accagcaaggugaaagcaguaucccuuggggccugaggcaggacuacaggcuccacggcaggaugcugucugucuugcuuggu

SEQ ID NO: 4173928 - RNA, 57 nt, Human
accagcagagcuggaagugugcucuuggcuuucagagauaucuccagugaugcucgu

SEQ ID NO: 4173929 - RNA, 88 nt, Human
accagcaguucaaugcuuuuagcuucagcuugcccagaaacaaaccuugagggcaaguuguuuaggagguguuguagauguugcuggu

SEQ ID NO: 4173930 - RNA, 56 nt, Human
accaggaaaucacucugauuuugguucaugccagcuccugagcaugguuuccaggu

SEQ ID NO: 4173931 - RNA, 60 nt, Human
accaggagucuagccuagucaaaaccauuuugauuaagucucuggugcugguuuccuggu

SEQ ID NO: 4173932 - RNA, 59 nt, Human
accaggauaauagguugggaugggacacacuuccaguccaaucuugcuguccacuuggu

SEQ ID NO: 4173933 - RNA, 103 nt, Human
accaggccagaaagugcagugacccuggagagcugggaagcaggcuagaugagcucuacaguuuguccagguuacugcuuggcaaaauuuucaaggccauggu

SEQ ID NO: 4173934 - RNA, 61 nt, Human
accaggugcggccagcuucauucguuaccuugguuagcaguguugccguuggcugcugggu

SEQ ID NO: 4173935 - RNA, 58 nt, Human
accagguggcuaugaggaugcagucaugauaaauguaauugcucauauggcaccuggu

SEQ ID NO: 4173936 - RNA, 59 nt, Human
accaguaugugccuucagugucucuuucuugauaucugcaugagggcauuugucugugu

SEQ ID NO: 4173937 - RNA, 56 nt, Human
accagucuggcuaauuuuuuguagagaugggaucucacuuuguugcccagacuugu

SEQ ID NO: 4173938 - RNA, 81 nt, Human
accagugcccagcaucauuaaggcagaauuaaggcgucucccacuguggacccuguuagucuuuauaguggggcacuuugu

SEQ ID NO: 4173939 - RNA, 91 nt, Human
accauacguguuccaucaacaucuuuuuuccucccuguggcagagagauuggcuuuacaaauagggagggagugaugaaagauauuuuggu

SEQ ID NO: 4173940 - RNA, 56 nt, Human
accauacuuagauggaugccccugcucggcugcagagcagucugccucuguguggu

SEQ ID NO: 4173941 - RNA, 119 nt, Human
accauauaucuauuuguuuguuuccugccuuaggugccaagagggcauuaacucugucuuguucacugcugaacacuuaagucccuggcacuuaaaguuguuggcaaucguuaauuggu

SEQ ID NO: 4173942 - RNA, 83 nt, Human
accauauugaacacuguguccuauuuccuugacauucuagugaaugaaaaaugagagaacacaguuaaugauuugauuauggu

SEQ ID NO: 4173943 - RNA, 96 nt, Human
accaucauaguaaugggcaauaucagguccgcguaagucauggcagcagagcaagacuagguaggauuuagguacauuauauaauacuaaaaaggu

SEQ ID NO: 4173944 - RNA, 128 nt, Human
accaucuguugggcacaucacagcguuaucucauuuaauucccucugcugguaaaggagacacugauuuuacagaguagggaauugaaguucugagagugcauguaaauugcucaagaucucacuggu

SEQ ID NO: 4173945 - RNA, 72 nt, Human
accaucuuuugucuuauccaaucucucagguauccuuguuugguuuuggggaagacaauugcaaaagguggu

SEQ ID NO: 4173946 - RNA, 86 nt, Human
accaugaccaagaguccaggucaagaaugccagugugcuucucucaacaaaacauagcuugauucugggcuuuuaggcuuuuaggu

SEQ ID NO: 4173947 - RNA, 64 nt, Human
accaugcaagcuugaccugugcgcugcucauaucuagagcucagcuucagcaaggcuugcuggu

SEQ ID NO: 4173948 - RNA, 123 nt, Human
accaugcccagugaugaggccugaagguuagggaucaggaacaagagcuugaggaucccugcaagaggugaagcuaugcauuuugguuccaucccuggcugaaugcuugaucagcugcaaagu

SEQ ID NO: 4173949 - RNA, 86 nt, Human
accaugccuucccucagucccucucaucuucacuuagauuccaucccauagugagucagugacaugaacuuguggggagacauggu

SEQ ID NO: 4173950 - RNA, 60 nt, Human
accauguaaaaaauuaggucaucuugggggaacucaaaugaucacuuuguucugcuuggu

SEQ ID NO: 4173951 - RNA, 93 nt, Human
accauuugacaucauggauauguuaauuugcuuaucuguaguaauuauuucacuauguauacguauauugaaauaucaugagccagccauggu

SEQ ID NO: 4173952 - RNA, 58 nt, Human
acccaaaaggcgaagguugcagugagcugagaucaugccacugcacuucagccugggu

SEQ ID NO: 4173953 - RNA, 62 nt, Human
acccaacacucaccuccggauuaaugagcugauauuugcuaaguaacuugugauugcugggu

SEQ ID NO: 4173954 - RNA, 76 nt, Human
acccaagauaggucgguuucucuuuggagguaaaauuaaaagauuccagagcauuuggaagccacguguccuaggu

SEQ ID NO: 4173955 - RNA, 55 nt, Human
acccaagcuucucacagugauagcauuugcauauuacacagugaaagcauggagu

SEQ ID NO: 4173956 - RNA, 105 nt, Human
acccaagugagaccacaauauccugacuuccagucuagagcuaucuguaaugcaauaaaucucuucacaggagcauauacacugggaacgggaacucucacaggu

SEQ ID NO: 4173957 - RNA, 127 nt, Human
acccaauucaccgggaaaccuccagguuaagcucugguccauaaggagaucucccagaaugccaaagggugaugaucaucucuuuguggccaggagaggaaaauggcccuuccccacugccuugggu

SEQ ID NO: 4173958 - RNA, 67 nt, Human
acccaauuucucgguuuugauauugugcuaucgcuaugcagaauguuaccacgggagaaaacugggu

SEQ ID NO: 4173959 - RNA, 79 nt, Human
accagcgcccaggggugcgggugagcaccuccuggugacacccagccgccggugccagccgcaccccaggagagcuggu

SEQ ID NO: 4173960 - RNA, 110 nt, Human
accaggaaaaauucugcaucuuuaggcagucauugaacaaguagcuuuguguuauuuccuuugaauuguccaugaagccugauguauuauuaaugaauuaauuucuuggu

SEQ ID NO: 4173961 - RNA, 60 nt, Human
accaggcuccccuuggauccugagggguuucuuuggggaucucacucaggagcuuuuggu

SEQ ID NO: 4173962 - RNA, 63 nt, Human
accaggcucugccaguguuuacugagcaccuacugugcccuggacacugugcggggacuaggu

SEQ ID NO: 4173963 - RNA, 63 nt, Human
accagggauuucugggggccaggggugcuggaaggcaccaggcugaaccagaggggaccuggu

SEQ ID NO: 4173964 - RNA, 68 nt, Human
accagggcuccaggggaccaucaguuuuauaagcaggugagagcugugggauuugggugugccugugu

SEQ ID NO: 4173965 - RNA, 62 nt, Human
accaggggugucaacagcauuucccaacaucagagauggcuucuuugugacagcucuuaggu

SEQ ID NO: 4173966 - RNA, 106 nt, Human
accagucuucccugggcagagguagagaaggagcuccuuggggucugucugcuucucauacagacuuccaagcagucuuucauuccugugucuaggggugccuggu

SEQ ID NO: 4173967 - RNA, 95 nt, Human
accaguggaaugagcagccuggucagagcagucaggaucaggguccuggguuccugauuaucaccuggacuccugcugacucucuuuucucuggu

SEQ ID NO: 4173968 - RNA, 98 nt, Human
accauacgaauguucccauuucuugcauccuugcugacucuuucuuucuguguuguagucauccuggugggugugaaguggggguacuucauuguggu

SEQ ID NO: 4173969 - RNA, 62 nt, Human
accauagcagaaggaaaggggcccccucccgcuccagccccuucagccucaacuacuauggu

SEQ ID NO: 4173970 - RNA, 57 nt, Human
accaucuccugugccuccagcuucgcuuuugggguugguggcuuguaggagggaggu

SEQ ID NO: 4173971 - RNA, 129 nt, Human
accaucuccuuguagaaaaacgucucugacagguguucuuccaggccggagucuugauuggccauaaucuaaaauccaugcuuggaaagugaaugccuuuucagcagcugucugccuaacagagaugau

SEQ ID NO: 4173972 - RNA, 57 nt, Human
accaucuugcuuuuaguagucaaugcaguuugcaaacuagaaaucagcaagauaggu

SEQ ID NO: 4173973 - RNA, 64 nt, Human
accaugaacaugaagcagaagaaugaagaugaugugcuagucaguucuaagugcuuuacauggu

SEQ ID NO: 4173974 - RNA, 68 nt, Human
accaugcccagccaguuuaugguaauuugcugcaaccacaggcaauuaauauacacuguuagcauggu

SEQ ID NO: 4173975 - RNA, 59 nt, Human
accaugcuggagucccuagcugucagucaccaaaacagacagccaugauaccagcuggu

SEQ ID NO: 4173976 - RNA, 73 nt, Human
accaugcugggccuugggugcacucaucaaaaaacggaccacaggcaugaugcucacaggugcccggcauggu

SEQ ID NO: 4173977 - RNA, 58 nt, Human
accauggggguagucaacagggucggccugugcuggcaguggcacugcccccauaggu

SEQ ID NO: 4173978 - RNA, 62 nt, Human
accaugggucagccaccucagccccuuuaguauaggggcccuaaaggucucuugcccauugu

SEQ ID NO: 4173979 - RNA, 81 nt, Human
accauuagccuguaucugcuagaauuauccccaguaugguuagaaggagauaauauuagaagauacaaauugccaaauggu

SEQ ID NO: 4173980 - RNA, 98 nt, Human
acccaaaucucaucuugaauuguaacucccacaauuccuauaauucccauaugucaugggaggaacuggugggaggugauugaaucauggggaugggu

SEQ ID NO: 4173981 - RNA, 61 nt, Human
acccaagaugugggcacugcuuuguagucaagggcuauuugagcagcagaugcacuuaggu

SEQ ID NO: 4173982 - RNA, 102 nt, Human
acccaagccucagaccuugucgucacuuagaggaagugccagggacgcaugcuucugguugguauuugugugagcugauaggcuuugaugaugggcuugggu

SEQ ID NO: 4173983 - RNA, 129 nt, Human
acccacaauuuaugcauaagugcaugccuucacaaccacauuucugugagucaauauugcaggggccuuggacagucuuacucaagaaauaguuauuuuguaaaaugcaaauuguaaaagucugugugu

SEQ ID NO: 4173984 - RNA, 61 nt, Human
acccacaucaaaugcuaauucugaugugcauccccaucagauuuggaaagcugaguggcgu

SEQ ID NO: 4173985 - RNA, 61 nt, Human
acccacccccaagaggggccuucagcuuuggggcucagaggcacgaccucuuggggagggu

SEQ ID NO: 4173986 - RNA, 67 nt, Human
acccaccuucccucgagagcaaaccccucugcagucaggaggcagcucugugucugggaagcagggu

SEQ ID NO: 4173987 - RNA, 58 nt, Human
acccacuccccacgugcugucagaacucaucacagaguuggacugggaaguggugggu

SEQ ID NO: 4173988 - RNA, 113 nt, Human
acccacucugacaucgagguuaaaugcaacuuuagggccagcaaguacaagccuuauucugccacuuacuagcugcagggccugggguggcacuuggccucccaagggaaggu

SEQ ID NO: 4173989 - RNA, 62 nt, Human
acccacuucuuaccucucuuaaaauccagcaggaaccagcgauaacagaaguagaagugggu

SEQ ID NO: 4173990 - RNA, 106 nt, Human
acccagaaguuuauuuaagcugcacauuucuaggaaauuaaaugcaauaacaccuaauuuaucugauauuauuggagaugugcucucuuauguggauuuuccaggu

SEQ ID NO: 4173991 - RNA, 63 nt, Human
acccagaauagcacaugcuguauauuuuuucagaaaugacagaaauauucguggugcuugggu

SEQ ID NO: 4173992 - RNA, 60 nt, Human
acccagagccagggucaggagcuuaguagaagggccugaaguagccccugggaucugggu

SEQ ID NO: 4173993 - RNA, 59 nt, Human
acccaggaggcugagguugcagugagccgagauugcgccacugcacuccagcucugggu

SEQ ID NO: 4173994 - RNA, 58 nt, Human
acccaggagguggagguugcagugagcugagaucgcgcuacugcacuccaccuugggu

SEQ ID NO: 4173995 - RNA, 88 nt, Human
acccaggccacagcucagcccucccccuccugguugcuucaaacacuaaccccugugaagcagaggggucuugagcugugaugagggu

SEQ ID NO: 4173996 - RNA, 58 nt, Human
acccaggcuggaaugcaguggcgcuaucuuggcucacugcaaccuccaccucccgggu

SEQ ID NO: 4173997 - RNA, 58 nt, Human
acccaggcuggaaugcaguggugcuaucuuggcucacugcaaccuccaccucccgggu

SEQ ID NO: 4173998 - RNA, 58 nt, Human
acccaggcuggagugcaguggcucgaucuuggcucacugcaaccucugccucccgggu

SEQ ID NO: 4173999 - RNA, 58 nt, Human
acccaggcuggagugcaguggggcgaucucugcucacugcaagcuccgccucccgggu

SEQ ID NO: 4174000 - RNA, 58 nt, Human
acccaggcuggagugcaguggggcgaucuuggcucacugcaagcucugccucccgggu

SEQ ID NO: 4174001 - RNA, 58 nt, Human
acccaggguagagugcaguggcgaaaucuuggcucacugcaaccucugccucccgggu

SEQ ID NO: 4174002 - RNA, 58 nt, Human
acccagguggcagaagcugcagugagcugagaucacaccacuguacuccagccugggu

SEQ ID NO: 4174003 - RNA, 95 nt, Human
acccagugauauaggaagcccagaaugauucagcgacaguucagcuucaggggaacugugacugugucuucugggcaaguguucuuuccuugggu

SEQ ID NO: 4174004 - RNA, 82 nt, Human
acccaguucccauucuuacacaauauuuuaauauuauuguguccagugagguucaaauuaaguguuuaaugguagcugaggu

SEQ ID NO: 4174005 - RNA, 57 nt, Human
acccauaggcuguacaacaucaggcauaaacccuaagguaaaauauggucuuugggu

SEQ ID NO: 4174006 - RNA, 63 nt, Human
acccauuacccaugaaagccauuugagguuuguuagcaaauaguggccugauuaugaaugggu

SEQ ID NO: 4174007 - RNA, 76 nt, Human
acccauucccaaaaaacaguuucauagaguuuagcaauauauuugcaggaaacuaguuuuaauugucugauagggu

SEQ ID NO: 4174008 - RNA, 85 nt, Human
accccacuuacuuucuauauagcuuauuuauccacugaacauuagaguucuuaggacuaguauagcaugagguaauugugguggu

SEQ ID NO: 4174009 - RNA, 56 nt, Human
accccagcacauaguagguauucacuaaauguuaguggguguuguagugugggggu

SEQ ID NO: 4174010 - RNA, 88 nt, Human
accccagcaggacuucauuguagcuugacuaauuauauuugcaaugaguauauuuccagaugagguuacauuuugagguacugggggu

SEQ ID NO: 4174011 - RNA, 65 nt, Human
accccagcuccaggcauugcaucugaauucaaagaagauacaguguauguauuuguagguggggu

SEQ ID NO: 4174012 - RNA, 64 nt, Human
acccccuaccuaggaacguauucaccaacacagauggucacagugucguccuuggguguuaagu

SEQ ID NO: 4174013 - RNA, 66 nt, Human
accccgccaacugguacccacaggucaggaugaggggggcaugugggaagaggccagcuggcaggu

SEQ ID NO: 4174014 - RNA, 71 nt, Human
accccguagaauaugucaugucuuagagaaugagcucacagugauucauuccuaacaugguucuuaggggu

SEQ ID NO: 4174015 - RNA, 55 nt, Human
accccuaaacccaggaguggucgguucuuaaaggacugugacuggguguaugggu

SEQ ID NO: 4174016 - RNA, 83 nt, Human
accccucacccccagggcccagcagcauuucaguggauuaaaggauccugcuucacccaacuuugggauugggggucaggcgu

SEQ ID NO: 4174017 - RNA, 57 nt, Human
accccucagcuccuuugaccuuaggauccacuuauuuugucaauaaaaguuaggggu

SEQ ID NO: 4174018 - RNA, 60 nt, Human
accccugccauugccugcccccuagcagauauuugauggccagugugcaguugcaggggu

SEQ ID NO: 4174019 - RNA, 70 nt, Human
accccuucagccucaagauccuucaucuccgauacacaccagagaugggggaucuugaggcugaagaggu

SEQ ID NO: 4174020 - RNA, 66 nt, Human
accccuugacuguaauggaguagggggaaucccauuuugcccuacgccucauacagaccagagggu

SEQ ID NO: 4174021 - RNA, 64 nt, Human
accccuuuccugccucaggaaguagcauggccuccaaacuccacuugcuggguaggaaaagagu

SEQ ID NO: 4174022 - RNA, 63 nt, Human
acccgaggacgccaccugggcccuagucccacuuggacacuggcucugggugugaccuugggu

SEQ ID NO: 4174023 - RNA, 121 nt, Human
acccgcggucuuggccauaggcgaugccacuuccgacagcccagcagggucuggcccugggucccagaggcgcagccccugcgggguuuggauggguuccugcggccuccgauccgcuggu

SEQ ID NO: 4174024 - RNA, 69 nt, Human
acccggccuguuuugacauucuuaaugaucuuaauaauuuggcaucugaaagucugaaacagugucagu

SEQ ID NO: 4174025 - RNA, 55 nt, Human
acccuagcccucugcaugcccugcccugccagcagccaugcugaccugcuguggu

SEQ ID NO: 4174026 - RNA, 65 nt, Human
acccucauuguggggaauguaacacuauugcugcuauaugcauaaauggcuuucauuccuagggu

SEQ ID NO: 4174027 - RNA, 69 nt, Human
acccucucuccauuccuuugaaggaagucacugugcacagacuauuccaaaggaauggggagcuauggu

SEQ ID NO: 4174028 - RNA, 58 nt, Human
acccugaacuggggcucaggagauugagguuuuugucccagcucugccuccaguuggu

SEQ ID NO: 4174029 - RNA, 78 nt, Human
acccugaugagaauggugauucugcagaaaacugcacugcccguggcuguaucugggagguaaccaugcugauggggu

SEQ ID NO: 4174030 - RNA, 80 nt, Human
accuaugugguaggcagaauucugauaugacaccuaaugcccccuggccauguagaauuccuucuacuuugagugugggu

SEQ ID NO: 4174031 - RNA, 82 nt, Human
accucaagacuuucaaguaugcaugcaugcauucauucuucaacuaggguauuugacaagcauuuuugaguaucugugaugu

SEQ ID NO: 4174032 - RNA, 73 nt, Human
accucagaaugugacuguauuuggauauaagaucuuuaaggaggcaauuaaauuuagaugaggucccugaggu

SEQ ID NO: 4174033 - RNA, 83 nt, Human
accucagaguaaacagagaucuugaggucagcagauuguauguaaauuugaugaguuuguaagucuucguaaggcuuuggggu

SEQ ID NO: 4174034 - RNA, 96 nt, Human
accucaggggaaucauguaacuucugugaaucugacuuuucucaucacaggaugcugucaggauuaaugggaguaugcugugauauccucuguggu

SEQ ID NO: 4174035 - RNA, 58 nt, Human
accucagguggcuuggagggggacggagcagaccaucuuccucugggucaccuagggu

SEQ ID NO: 4174036 - RNA, 95 nt, Human
accucaguguuuuggcuuaugggacuguaagcucuggaaugucccuguguuaguuuccuagggcuucaguaccaaaguuugaagacauugguggu

SEQ ID NO: 4174037 - RNA, 62 nt, Human
accuccggcauuacucagaccagccaucuaagcccauguugcuuuggaugugugccugaggu

SEQ ID NO: 4174038 - RNA, 62 nt, Human
accuccucuugccaagacauacugcaucacuauuucuguucucuguggcagcaugaugaggu

SEQ ID NO: 4174039 - RNA, 95 nt, Human
accuccugagaucauuauccaaucuacuaugggggauaccauuccccucacccauaugucucccacgguacaggauaaacaagaauccaacaggu

SEQ ID NO: 4174040 - RNA, 82 nt, Human
accucggccucccaaagugcugagauuacaggugugagccaccgcaccuggccaauuuuuguauuuuuaguagggacggggu

SEQ ID NO: 4174041 - RNA, 66 nt, Human
accucuacuggccuugcccagcgccuagguauguacccacagcuggcgcugcauggccagccaggu

SEQ ID NO: 4174042 - RNA, 61 nt, Human
accucucaggguuuccuaaugcaaauccuugaacccugcagaagugagcauccagagaggu

SEQ ID NO: 4174043 - RNA, 74 nt, Human
accucucucugccucagugauuucuuuaguguuacucaaaauauacauagagcaaggaguggcaggauagaggu

SEQ ID NO: 4174044 - RNA, 84 nt, Human
accucucugugcuucaguuucccaucuggaaaauggguaauguaaugcucaccugggagggcugugguagguuuacagggaggu

SEQ ID NO: 4174045 - RNA, 92 nt, Human
accucugaagugccacaagauaaaguaucauaaaugcagaggaaugauuccauugcuuugugcauauuuaaaaggauauggcgcugagaggu

SEQ ID NO: 4174046 - RNA, 65 nt, Human
accucugagggccaaucgcggggcuggaggaguuuccaauggugcucagugugguccucagaugu

SEQ ID NO: 4174047 - RNA, 92 nt, Human
accucugauuuuuuuugcuuccaggucuuuggccuuggcacucuuugucauauuagaguuccugggucuaggccugggcaggauucauaggu

SEQ ID NO: 4174048 - RNA, 63 nt, Human
accucugggaaaaguauggaaaauaagaaucagaguuuuagaaacauacggaauuuuagaggu

SEQ ID NO: 4174049 - RNA, 79 nt, Human
accugaaaccuucacaucuacucuacaggccccccaggcuagagggcuguuguugcagggagggugggagguaguaggu

SEQ ID NO: 4174050 - RNA, 80 nt, Human
accugaaguggaauugcuggauaauaucagauagaguuucuuuuuaaggugaugaaaauguucagcaauuaaauaauggu

SEQ ID NO: 4174051 - RNA, 61 nt, Human
accugagacuugggaugggaauauauguuucaaugcauucaaaacucuugagucucuaggu

SEQ ID NO: 4174052 - RNA, 90 nt, Human
accugagaguuuguuggaaaugagaaccaacaccuggcuccaccucagagucacuggaucagaaucugauuuuuaacaagaacuccaggu

SEQ ID NO: 4174053 - RNA, 58 nt, Human
accugaggagcucagccucccaugaccaacccuguguugggcugugccuccucguggu

SEQ ID NO: 4174054 - RNA, 77 nt, Human
accugauggucaaucacuccccagcagugagagacaugcccugaagcaucauugcaguagggagagacccaucaggu

SEQ ID NO: 4174055 - RNA, 95 nt, Human
accugccugugcuauauaacgagaaacugcauuuauuuauuuccuuuuucuggaguuagaugcuugucaguuucugucgauaacaguugcagagu

SEQ ID NO: 4174056 - RNA, 57 nt, Human
accugcuauaaaaugggcauagaaagcaaacauuccaaugcuuaauuccuaguaggu

SEQ ID NO: 4174057 - RNA, 75 nt, Human
accugcuccauuguuccuuuacuguguucuuuauaauugacuucucaguaagaguugacaauggccauagcaggu

SEQ ID NO: 4174058 - RNA, 55 nt, Human
accugcugugauucuaauuggcugagaggaaacaauaaaccaaucacauguaggu

SEQ ID NO: 4174059 - RNA, 84 nt, Human
accuggaagcugguuagaaaacagagcucaggugccaccccagaucuacugagucagaaucugcauuuuaaccaggucccaggu

SEQ ID NO: 4174060 - RNA, 69 nt, Human
accuggaauaggcagcaggaugcuccucuugagguuucagagggagcacagccuugccaguaccucggu

SEQ ID NO: 4174061 - RNA, 67 nt, Human
accuggaauauggugccuccaauaccuauggaucccaagcagguauuuacccacuuuuguuuuaggu

SEQ ID NO: 4174062 - RNA, 102 nt, Human
accuggaggccucauuacagcacaaaaacauucccagaguuucuuauccaguagauccaagguggggcccugagaaugugugugucuaauggguuuccaggu

SEQ ID NO: 4174063 - RNA, 61 nt, Human
accuggauucuuacuucuaagcaagcugcccucuaggcagucauuuauacgggaaccaggu

SEQ ID NO: 4174064 - RNA, 85 nt, Human
accuggcaaucuguuagaaaugcagacacucaguccccaccccacaccuacugaaucugaaucugcauguugacaagauccaggu

SEQ ID NO: 4174065 - RNA, 58 nt, Human
accuggcaggcggagguugcagugagccgagcucacaccaguacacuccagccugggu

SEQ ID NO: 4174066 - RNA, 72 nt, Human
accuggcaggucucgcugacgugucuagccccauucaggacaccuuuucagccugaccaguugcuccaaggu

SEQ ID NO: 4174067 - RNA, 58 nt, Human
accuggcagguggagguugcagugagccgagaucacgccacugcacccuagccugggu

SEQ ID NO: 4174068 - RNA, 58 nt, Human
accuggcugagaacgugcagcuggcagaaacaggcccauuugucacaauucaucaggu

SEQ ID NO: 4174069 - RNA, 82 nt, Human
accuggcuugccuacaucauaauuucauuguguacaucaaguaagacuuuauguacuaaagaaauuugcaggccauacaggu

SEQ ID NO: 4174070 - RNA, 65 nt, Human
accugggaggcggagcuugcagugagccgagaucgcccacugcacuccagcacuccagccuaggu

SEQ ID NO: 4174071 - RNA, 58 nt, Human
accugggaggcggagguuguagugagccgagaucgcaccacugcacuccagccccggu

SEQ ID NO: 4174072 - RNA, 84 nt, Human
accuggggagucugugcagcaugccucuggguggcugcucuggcagagcagcaccaaccagggccuguuuauauuuccccaagu

SEQ ID NO: 4174073 - RNA, 72 nt, Human
accuggggucaaugugguggcagaugucagugccagauggcaugacaccuaauaaccaacauguuuccuugu

SEQ ID NO: 4174074 - RNA, 64 nt, Human
accuggugggaauguguuagcuuuuacuucuuaaugccugcuuugucaucaguauccacuaggu

SEQ ID NO: 4174075 - RNA, 58 nt, Human
accugucugggcuacauuugcauaagcucacaaaaugcaggggaggcuuaaagcaggu

SEQ ID NO: 4174076 - RNA, 71 nt, Human
accugucuucagagugaaagucugugauucacggggucaguggucucaucuucauaucugaaagacagugu

SEQ ID NO: 4174077 - RNA, 81 nt, Human
accuguuauuuguggugcugauuuguugcugagauuuagauuuucauguguguuacucaagagauagcuuuaaaugcaggu

SEQ ID NO: 4174078 - RNA, 99 nt, Human
accuguuccucuucugauggccaucauuugguuugacccaaaagccuugugucuggggcugaggguuaagaucagacagcuguucacuggagagcgugu

SEQ ID NO: 4174079 - RNA, 59 nt, Human
accuguuuagaaagcuuaugaggaagaucuguuccuccuuugaguugcuguagacaggu

SEQ ID NO: 4174080 - RNA, 81 nt, Human
accuuacggcagcaaucagucaauggacuagucccugcuccuuagucaugacaggcaggguuucuccauucugcccaaggu

SEQ ID NO: 4174081 - RNA, 61 nt, Human
accuuacucuuuagucuuccuuguugguucacaguagggaauacauugggguaaauuaggu

SEQ ID NO: 4174082 - RNA, 128 nt, Human
accuucauuuccaacaagcuuugggagccugugugucugcucacagcuaggaggaaagcagaggaaggccaguucuccuuacuuuuugccuguuguggcccagcuaacccaauaaaugaaauucaggu

SEQ ID NO: 4174083 - RNA, 80 nt, Human
accuucuaugguuuuauauuucugguagccuucaggaucuugguguuuauuccugauuguuuugugugacaccuaguggu

SEQ ID NO: 4174084 - RNA, 76 nt, Human
accuucuuuugggauuauuggaauguuauauuugcagagcaagucagacacguuuuccauuaguacuaaaaguugu

SEQ ID NO: 4174085 - RNA, 78 nt, Human
accuugacaguguauuaaggaucuugaccuagcagaguauccuggacuauucagguguccauuaauccaaucacaggu

SEQ ID NO: 4174086 - RNA, 78 nt, Human
accuugcaaugacaguuggaaugacauuagacucucaaaugagagacuaagaaguuuuaacuuugucuaguagauggu

SEQ ID NO: 4174087 - RNA, 64 nt, Human
accuugcuuagcgacuccccuuccucuaccuucaaauagagggaggcaaccugcaaagcugggu

SEQ ID NO: 4174088 - RNA, 100 nt, Human
accuuggagaggagcagccccagggaggauggccucgguggcugccguggaucugaagcagcagcagcaggaggcuguccaccaccaugcuccccacagu

SEQ ID NO: 4174089 - RNA, 58 nt, Human
accuugucuguuuuccaguauguaggauccccuagcacagagauggcacagagaaggu

SEQ ID NO: 4174090 - RNA, 114 nt, Human
accuuguguauuagcuuucuagggcugcuguagaaaacugucacaaacacggugaguaaaacacagaaacuuauugucuuacaguaauagaggcuagaagucugagaucaaggu

SEQ ID NO: 4174091 - RNA, 77 nt, Human
accuuuaaggagcuacucaccgucagacucacccaaguauaggguuggccccugagagcgaguaccuccuuaaaugu

SEQ ID NO: 4174092 - RNA, 55 nt, Human
accuuucccauccucucccugggcuucaguuugccccugaagacaauggagaggu

SEQ ID NO: 4174093 - RNA, 57 nt, Human
accuuugguaaguuuccaaaacauaaacucauguaaguaaaugggaacuuuagaggu

SEQ ID NO: 4174094 - RNA, 57 nt, Human
accuuuuauguaaauauauguugacuugcugguuuguguaugcauugcauguaaggu

SEQ ID NO: 4174095 - RNA, 85 nt, Human
acgacuccccuuuucuucuccaccguugaccuuuagguuccuggaaaacuuugguggugagggugugaaaugagggggugcacgu

SEQ ID NO: 4174096 - RNA, 84 nt, Human
acgacuuguacacugugaugccaucuuuccaccuauaaaauggaaacaauccuauagacuugaugguauuaagugagcaguugu

SEQ ID NO: 4174097 - RNA, 64 nt, Human
acgagccuggcucccucugcagcuccucugggguguccuggacgguggcugggggcaaggccgu

SEQ ID NO: 4174098 - RNA, 82 nt, Human
acgaucuuggccacgugcugggagcugcccucucugagcccuuccuugcccagaggggcccgguucuccgucuuggccucgu

SEQ ID NO: 4174099 - RNA, 67 nt, Human
acgcuugguaugugagggccaaccccaauagucaccaaaguaaggggagccacauucuuccaggugu

SEQ ID NO: 4174100 - RNA, 130 nt, Human
acggaaaugugauugaauacauuauaaagugauaauacagaauuugcccuuuucauauuguaagcaagaugaguuuauggaaggauuucuugucuaucacuuuagguaaagaaaaacaucuuuuuucugu

SEQ ID NO: 4174101 - RNA, 63 nt, Human
acggaggccacguucucagccaccgugccacucugcaugucagcuggcugggcgugccuccgu

SEQ ID NO: 4174102 - RNA, 64 nt, Human
acggaggggagaaagcuggcauauugaucccccacuccuugguugucagcucccuguccugugu

SEQ ID NO: 4174103 - RNA, 83 nt, Human
acggcuucaacugcgcagaggccaucaacuuugccacuccacgauggauugauuaugguaaaguggcuucacaguguagcugu

SEQ ID NO: 4174104 - RNA, 71 nt, Human
acggggcugguuccuguguacuguggcuuagcuggcugggaugagaagcagcuuacagguguccaccuugu

SEQ ID NO: 4174105 - RNA, 79 nt, Human
acggggucacuuugagaaacugcacacgaugugccugaugcacgguaggugcucaguacgugggcaguuccuuccccgu

SEQ ID NO: 4174106 - RNA, 58 nt, Human
acgguccuuggggaccaaauugaaagcuuuagggcuuugacuuuguccucaggaaagu

SEQ ID NO: 4174107 - RNA, 70 nt, Human
acggugccuagcacagugcucuggacagaguggaaacgcuaccugcauagucauugagcgagggcaucgu

SEQ ID NO: 4174108 - RNA, 66 nt, Human
acggugugaucucaaagcauggagcagaaugagucuccacuuuguccgcuaugggaucuucacugu

SEQ ID NO: 4174109 - RNA, 88 nt, Human
acguccagggaagagcuguggauaguccuggauuguccugcguuuggcagcggagguggaccaggcuguuccagucuaacccugaugu

SEQ ID NO: 4174110 - RNA, 55 nt, Human
acguccgcaggagagcacgugcacaccacggggagcgugugccucugcaggacgu

SEQ ID NO: 4174111 - RNA, 70 nt, Human
acgugaaaucuugagaaacaucuaaucuuuguguugaaagacaguaauauuuuacauguuucuugcaugu

SEQ ID NO: 4174112 - RNA, 130 nt, Human
acgugcaagauccaggcucugcgugauaagcuguggaucuuccugguucagucuuucuaugcuguucgucacacagaaagcuggaagcugaugagcacagaugaucaacagaaaauccaagcagguacgu

SEQ ID NO: 4174113 - RNA, 73 nt, Human
acgugcauauguauacacacauacacuuauuuuacaacaaucaggucauauuguguauacuguuguagcaugu

SEQ ID NO: 4174114 - RNA, 79 nt, Human
acgugcccauuagguucauuuagugaaggagauaccaaaggaaauggccuucucuucucuagugagcaacuggccacgu

SEQ ID NO: 4174115 - RNA, 58 nt, Human
acgugcugggucugcggggccguggcccgguggccaggcgagcucuucuccagcacgu

SEQ ID NO: 4174116 - RNA, 66 nt, Human
acguuuucagccuuaauguagauaguuuuucuaagccgucucgagaaacacaugggguauaaacgu

SEQ ID NO: 4174117 - RNA, 55 nt, Human
acuaaaacuagccccuccucccagcccuaccuggggagggguugcauguuugagu

SEQ ID NO: 4174118 - RNA, 102 nt, Human
acuaaagguuauacccucuuuuauuaauucagcuucaaauuuggugaaguacagcuaaauuucaagaggcauuucacauuaauuugaugcucagccuuuagu

SEQ ID NO: 4174119 - RNA, 99 nt, Human
acuaaauggugaaaggcucauacagaaaauacaggcuuccacaggaguuaauacgaagucuauuuucuauagaugaauuaacugccuaccauaaauggu

SEQ ID NO: 4174120 - RNA, 74 nt, Human
acgugugcacaaugaccuaggcaagucagaggcuguccaggaacccuucucuauuugccuaggcuugugccugu

SEQ ID NO: 4174121 - RNA, 84 nt, Human
acgugugugugccugucaacaagugguuauugggauggacgacuggucagucaugugacugcuuuuggguggugugcuuuacgu

SEQ ID NO: 4174122 - RNA, 56 nt, Human
acguguucaauuuccaucugacuccacucucuauuucagauugagguucugcacgu

SEQ ID NO: 4174123 - RNA, 103 nt, Human
acguucuaaaaucuccuucaggugacagauuugcugcgcaugguguguuuaacugaggauucagcguaccuagcagaguuucuggaggaaauuuugagauugu

SEQ ID NO: 4174124 - RNA, 69 nt, Human
acguugcuggaacucagugaaucauuaaaaaucaaguaaugauuuuucugaauuccauuuuuguggugu

SEQ ID NO: 4174125 - RNA, 73 nt, Human
acguugguggauaugauguuauuauaaauacuacucuaugucaaaggcuguuauaacaucgguugacuaaugu

SEQ ID NO: 4174126 - RNA, 61 nt, Human
acguuuugaguagauagccauauuugauaagcagguuggaugcuucuguugcuuaggaggu

SEQ ID NO: 4174127 - RNA, 59 nt, Human
acuaaaacugcggcauuuagggcagcacacuaaacugcacuaaacucugcagauuuagu

SEQ ID NO: 4174128 - RNA, 121 nt, Human
acuaaaaggucuauucucccaucaaugcauaagggauuuacaaguuuaacucucauugcuguuaauaggaauucuaugugugauccaaggguguauucauggagaaaaugcaucuauuagu

SEQ ID NO: 4174129 - RNA, 73 nt, Human
acuaaagggcaguucagccacaggcucuggauucaaauccagcaccuucucauguuagcugugugacuuuagu

SEQ ID NO: 4174130 - RNA, 81 nt, Human
acuaaauaguaagucagaaggcuuuccuguaggaagacacaacuacgguuuguuucacugaaagccuuacuacucaacagu

SEQ ID NO: 4174131 - RNA, 69 nt, Human
acuaaaugcaauauguguuucuguuuaggauccugcaccugaaagagaggcauuguugggacauuuggu

SEQ ID NO: 4174132 - RNA, 78 nt, Human
acuaagaaucuccaaggaagccccaagggaucugggaucuagacuuuagaaaaggggcccuccuuggaugaugcuggu

SEQ ID NO: 4174133 - RNA, 79 nt, Human
acuaauauuaaagacagcagauggauggcucaagaguuccuaccuuuugucuuaucucuuugucugauuuugguugggu

SEQ ID NO: 4174134 - RNA, 65 nt, Human
acuaauuccacaauuuuacaaguuaaaaauauucuuaguuuuagcuugaaaguuuuggagguugu

SEQ ID NO: 4174135 - RNA, 67 nt, Human
acuacaagugugcaccaccauguccagcuuaggugucaguuugauaugagucaguagcauaaguagu

SEQ ID NO: 4174136 - RNA, 120 nt, Human
acuaccaggagagauugggguagggcaggcugagaaauauacuacuccugugugcucgggaagaaaauauauugucucugccuugucuggacucucaguuuaccuucucuccucuguggu

SEQ ID NO: 4174137 - RNA, 57 nt, Human
acuacccagaugcuauagugaaauguguguguucauauaaacucaggaucugggagu

SEQ ID NO: 4174138 - RNA, 58 nt, Human
acuaccuuauacaaaauguagguuucauacaaacacaugcauucuuguguaagguagu

SEQ ID NO: 4174139 - RNA, 93 nt, Human
acuacuauaaaauauuauuagauucuuaauuguaaucgcaguaagccuugcaaccucuuauaguuacagaauugggguaauguggauauuagu

SEQ ID NO: 4174140 - RNA, 83 nt, Human
acuacuauaauuuauaacuuuggauaugacaagagauguuuuuuagcaaaguuugcgacucuugaguuaagaaguuuagaagu

SEQ ID NO: 4174141 - RNA, 56 nt, Human
acuacugagaaauguaggggcaggggccagagccucugcccacaucacucaggagu

SEQ ID NO: 4174142 - RNA, 63 nt, Human
acuacuguuaggauucaugagguaucacaggaaaacugccuagcucagaagccuaugcauagu

SEQ ID NO: 4174143 - RNA, 64 nt, Human
acuagaaagcaaaagccauuucagacugcaguuuuugguugaaaauggaaaaugcuguuuuggu

SEQ ID NO: 4174144 - RNA, 56 nt, Human
acuagaaagcacuaagcuaggcugccaggccggggcuguguggagguguuucuagu

SEQ ID NO: 4174145 - RNA, 87 nt, Human
acuagaagugagguggaugaacauuaagagagacuucuuccuuccccucuguuaccaaaaucuuguauauccauuucaaggaucagu

SEQ ID NO: 4174146 - RNA, 67 nt, Human
acuagaaguuuggguccauuaagaaaagcauuuuaucauuuguucacugauguaccucaagccuagu

SEQ ID NO: 4174147 - RNA, 69 nt, Human
acuagagggaggaguucugucaccaaggaagcucccaggcauuccuucaaacgccuccugcacucuggu

SEQ ID NO: 4174148 - RNA, 58 nt, Human
acuagcagaaacugaucauggcuggacuccacuggccaggauagccaguucugguagu

SEQ ID NO: 4174149 - RNA, 59 nt, Human
acuagggaguuuauguuguauuccaaaagcauguggagcuacaagggagacuuuuuugu

SEQ ID NO: 4174150 - RNA, 59 nt, Human
acuaggucaacauucuaauuagcguccagauggaaggugccuguuauuguuggcuuagu

SEQ ID NO: 4174151 - RNA, 82 nt, Human
acuagucuuuugaaaaauccacuuugcuuguauucugaauaacuaguuggagugcagcaagaccggauaugucgagacaagu

SEQ ID NO: 4174152 - RNA, 128 nt, Human
acuagugguacauuugauugaaucagaaaaauaaacaaaucuuuccugugggagaaaacaaagucucucagggaaugugauacaggaagagugauuugguuuguggucaugguugaagugccacaggu

SEQ ID NO: 4174153 - RNA, 64 nt, Human
acuagugugacacccuguuaagaucccuuuaccagcuaacacuuaauauagguucacaacuagu

SEQ ID NO: 4174154 - RNA, 84 nt, Human
acuaguuauuuuuuaaagcauguugcuuaacaggcacacacauugugaacauuuuuuuuaaguugcauacuuuaagggauuagu

SEQ ID NO: 4174155 - RNA, 57 nt, Human
acuaguuuucaggcaugucuggaucucuggguucaaacaaugucaucaggacuuggu

SEQ ID NO: 4174156 - RNA, 122 nt, Human
acuauagcccccaugccuggaacagugcuugccaccaaguaacaaccccauaaagacuugcucagucuuuaagggauguucugcuuuuagggaacucugauucaggugaacagguaucuagu

SEQ ID NO: 4174157 - RNA, 62 nt, Human
acuaucaagugcuuaaaaggguggucuauuaggaaguugauaaccagggagagcaugguagu

SEQ ID NO: 4174158 - RNA, 99 nt, Human
acuaucaauuaauauagcauacuugaaugauuuuaaacagauguccagcaaaucaggugugagaaggguucaggaauauguuaggauuaauucuuaagu

SEQ ID NO: 4174159 - RNA, 57 nt, Human
acuaucuccugaugaaaauugacucuggaguugggugucaauuucagguagcauagu

SEQ ID NO: 4174160 - RNA, 71 nt, Human
acuaucuuauaggugugccccaaauuuauacccaaaauuaguauaaauuugggguauaccuaugagauagu

SEQ ID NO: 4174161 - RNA, 91 nt, Human
acuauguccuguuacauuuuguuccacgguccagaauacguuccaaugaacacauuuuggcuagguggagaagugguagcaaugaaguagu

SEQ ID NO: 4174162 - RNA, 77 nt, Human
acuauguuucccuguuuuauauccuaacaagaaauguuacuuguucuugauuccgauaaagaugggagaaacacggu

SEQ ID NO: 4174163 - RNA, 88 nt, Human
acuauuagguugguacaaaaguaauugcaguuucugccauuacuuucaauggcauaaaccgcaguuaccuuugcaccacucuaauagu

SEQ ID NO: 4174164 - RNA, 127 nt, Human
acuauugcuucaguacauuauuuuugcuuaaauuaggucucauuaguuucuguuuguugcaaccaagaaugcugacagaacucaaacaugagaaggagcagaaaguaaugcaaugaaagcuaaaagu

SEQ ID NO: 4174165 - RNA, 77 nt, Human
acucaaauucaaggaauuuacaacuaugagggggaaaauaaggucuccuuacaaugcaguuuacuuaggauuugagu

SEQ ID NO: 4174166 - RNA, 60 nt, Human
acucaacugccauacagcuccaugguucagagcacuguuuuaggaguugguggccugagu

SEQ ID NO: 4174167 - RNA, 60 nt, Human
acucaaugggaagaagggccucuccaguguucccauugcugcaggcccccuuccuggagu

SEQ ID NO: 4174168 - RNA, 60 nt, Human
acucaauuaccucucucucuucucucugugccgacauggggcccaaagagaggucugagu

SEQ ID NO: 4174169 - RNA, 65 nt, Human
acucacaauuuuucagugacuauugcagacuuggcugagauaagcuucuuugaaaaauugucagu

SEQ ID NO: 4174170 - RNA, 56 nt, Human
acucacagacugcagguuuauugggugcuaagugugcccugcuguagucuguuagu

SEQ ID NO: 4174171 - RNA, 71 nt, Human
acucacucuuaaucagacucccucaggagcagagauuacucuugacaccuaagucuguuaacacagugagu

SEQ ID NO: 4174172 - RNA, 79 nt, Human
acucacuuauuccucuguaacugugcuuggcccuagaaggcaauuauuaaguauuuguugaaugagugaauaaaugagu

SEQ ID NO: 4174173 - RNA, 79 nt, Human
acucaggagaaagccaauuagagugaacaugugucacuccuuugacccacccaacaccuuugaaugucuucucucuagu

SEQ ID NO: 4174174 - RNA, 57 nt, Human
acucagggcagaaaguuucuggagacuucccucccuucagcagcaucugccuagagu

SEQ ID NO: 4174175 - RNA, 68 nt, Human
acucagucuugccuuguaggucugcuuauaauuagaaagaggcauaccuacauuauagggauaugggu

SEQ ID NO: 4174176 - RNA, 77 nt, Human
acucaguuuacacagcucugaauuuuaacuacacaaagauaagcaaauauuuugggauaaauucaugagcacugagu

SEQ ID NO: 4174177 - RNA, 71 nt, Human
acucauaacccucugaagaggcauuauuuuucauuuuacagaugcagaaacugcagcucagagaagugagu

SEQ ID NO: 4174178 - RNA, 58 nt, Human
acucauagaaauuauacuaagaacuaaaguugccuguucuuguauuggaucugugugu

SEQ ID NO: 4174179 - RNA, 55 nt, Human
acucauauacuguuguuuuuaagucuuuuaaauuuagauuuguaaguaugugggu

SEQ ID NO: 4174180 - RNA, 66 nt, Human
acucauaugguguauacccugaaggacguuacuauuacauguauggguuaaacaugcuauaugagu

SEQ ID NO: 4174181 - RNA, 55 nt, Human
acucauguuuucucuagcuggaagcccuccuggcugcccuggcccuaaccugagu

SEQ ID NO: 4174182 - RNA, 59 nt, Human
acucauuuccugcuugauuuugugauuuagccaucaaugucagcugguaggaaaugugu

SEQ ID NO: 4174183 - RNA, 68 nt, Human
acuccaaggaaacaugaaaugcauuggggacacaucccuucaaggcagauucauguuuccugaaaagu

SEQ ID NO: 4174184 - RNA, 130 nt, Human
acuccaaucugacuaauauuugcuuugcuugugcuacacuuucaaagcuaauuucuuuagcauuuaaacuuaucccuuggguuucagcugguaaaggaguagcgaguacauuuacauuuuauuacagauu

SEQ ID NO: 4174185 - RNA, 69 nt, Human
acuccagcaaccugacaagacuaugaguaguucuccuucauccuauuuaugugguacagguugugaagu

SEQ ID NO: 4174186 - RNA, 73 nt, Human
acuccagcagucacugguugagguucacuggcaaacucacugccugguguugccaaucugugccuccuggagu

SEQ ID NO: 4174187 - RNA, 74 nt, Human
acuccauaacagcuggcaccaaauauaguaaauugugaaauaaugagcuuguauauugcuagcaauuacagagu

SEQ ID NO: 4174188 - RNA, 66 nt, Human
acuccaucacucaucacucauuggacaacagaggcuucuugauguuugcugaagugaugguggggu

SEQ ID NO: 4174189 - RNA, 62 nt, Human
acuccauuccuguaggugaccacugcuggcuucugggaaagaguggagcuggaaaguggggu

SEQ ID NO: 4174190 - RNA, 60 nt, Human
acucccagguggagguccugagccacgcgaucuccuucuaaagccuccaccauggagggu

SEQ ID NO: 4174191 - RNA, 67 nt, Human
acuccccacagcccuggacugguuggucuccucagaagccugggucuccaguucagggcagggcagu

SEQ ID NO: 4174192 - RNA, 56 nt, Human
acucccuugguggagaaugcaaccuucuugcuucaguuucaagucccucugggagu

SEQ ID NO: 4174193 - RNA, 72 nt, Human
acuccuaggcuuuuguuuugagcaauuggauggguaucauauaauagcaucuucugagacaaagacuggagu

SEQ ID NO: 4174194 - RNA, 81 nt, Human
acuccugagggcuucauugaaggagggacuugcuugggggaaacuggaagcaauuuccuguucagugagacccauggaugu

SEQ ID NO: 4174195 - RNA, 78 nt, Human
acuccugagguucuggagcugacucacaccagcuagcaagagacagcuguggucagaauucaguuccaucuugugagu

SEQ ID NO: 4174196 - RNA, 112 nt, Human
acuccugguuaauucuaagcuauuaccuucuuaggccauugauuuuuauaaguuuuaacuuggauuuuuaauauuaucaguagguaaaggucauacuguauaagacuaaagu

SEQ ID NO: 4174197 - RNA, 61 nt, Human
acuccuuuggcagcauguugagaccuaaggaccucccucagaauaauguuucuaaaggugu

SEQ ID NO: 4174198 - RNA, 72 nt, Human
accucuaagcugauuccacuuuuuccacagagcugcuccagggcggugugguuggaggggggaucaggaggu

SEQ ID NO: 4174199 - RNA, 91 nt, Human
accucuacaguauuuaaggcauacauauuguuauagguagcuuuuguuuugcaucugaccucaaaauguguauuucaauauaaauaggggu

SEQ ID NO: 4174200 - RNA, 105 nt, Human
accucuaccccucucuuucucuguuacacacacacuguuaauguaggaguaugugugcaagcauguguaugcucaaaggcuaucaauagugugaaaauagaaggu

SEQ ID NO: 4174201 - RNA, 66 nt, Human
accucuacuguaggugggucacuaguacagguggaucacuaguacagguggaucacuaguauaggu

SEQ ID NO: 4174202 - RNA, 82 nt, Human
accucuagcccugcacagccggaccccugcugugggcagaacucccaggcuggguugcaggcugugccuuaggcuucaaggu

SEQ ID NO: 4174203 - RNA, 62 nt, Human
accucucagagcucgugggaccuuggagaccacucuaaggacuucagcuuugauuuuugggu

SEQ ID NO: 4174204 - RNA, 95 nt, Human
accucucugggcugcugugaggaugagaugagauaacacacaggaagguguucucgcuacaugaguguucccagucauucuuagggccaagaggu

SEQ ID NO: 4174205 - RNA, 93 nt, Human
accucucuuuccauaaauguauaaugcgccucagaaaacagagagccccaacucuacuuuggcuucugugggcguuuaccaaggaaaauuggu

SEQ ID NO: 4174206 - RNA, 62 nt, Human
accucugaagggccaagcaaugcuaggagucguggaugcauuguuucauguaucuucagggu

SEQ ID NO: 4174207 - RNA, 72 nt, Human
accucugucuaagguauagucuggaaaagggcauuuuccaagcuguguuuugagauauuauuaacaguaggu

SEQ ID NO: 4174208 - RNA, 58 nt, Human
accucugugugaugcgcaaaguacaccuguuucuauuguaccugccucucgcgguggu

SEQ ID NO: 4174209 - RNA, 73 nt, Human
accucuuuuugucucaccccuuugaggaacuuuguuaucuauacguuugaguucuaaggugaguagagagggu

SEQ ID NO: 4174210 - RNA, 61 nt, Human
accugaaccaggaugggaguagcgggaguugugagaggagcuugcauucuggaucuauggu

SEQ ID NO: 4174211 - RNA, 110 nt, Human
accugaagagcuuguuaaaacacagauugguaggccucacucucagagcuucugauucaguagguuugggagggugaggcccgcaaauuugcauuaucaaguucucaggu

SEQ ID NO: 4174212 - RNA, 67 nt, Human
accugauaccuauagugaugcuaggcuuuucugacugaaggagcuucagcgugugcuaagggcaggu

SEQ ID NO: 4174213 - RNA, 69 nt, Human
accugcaggagcagaagccuaaacccagccuucacuccacugcuggccaggaggcugcuucugacacgu

SEQ ID NO: 4174214 - RNA, 59 nt, Human
accugcaggggugcucucugggacaucucauuaaccgugucaucaaagcccccucaggu

SEQ ID NO: 4174215 - RNA, 66 nt, Human
accugcccauuuucaagucuaauaaaaauguccugacauuugcaugaccuuugcaaguggguuggu

SEQ ID NO: 4174216 - RNA, 63 nt, Human
accugcccuggaggaagauauucagccccauucccccaagcccugaguuuuccaggggcaggu

SEQ ID NO: 4174217 - RNA, 69 nt, Human
accugcuccaagagagaaguguaguuacucugauaguucacuagaccacauuuuucuaggaggcaaggu

SEQ ID NO: 4174218 - RNA, 59 nt, Human
accugcugguuuaagcuuuccucucagcugaggauuccuagagcugcagaccaggaggu

SEQ ID NO: 4174219 - RNA, 61 nt, Human
accugcuguuucuuugaugauggaaugaaugccucuuauucuaucuaaagugaacaaaggu

SEQ ID NO: 4174220 - RNA, 90 nt, Human
accuggaauguaaguagggaugcuucaguuacuucuccccaccccagaaugaaguugaccuucaagcaccauauuuaucccuuuccuggu

SEQ ID NO: 4174221 - RNA, 68 nt, Human
accuggaggggagguguccccaaaucucauuaccuccuuugcucucucucucuuucuccccuccaggu

SEQ ID NO: 4174222 - RNA, 74 nt, Human
accuggagugauggaaagugcuuggccaaaguuuacaaagcccuguagccaauaacugguuccaaauuucaggu

SEQ ID NO: 4174223 - RNA, 71 nt, Human
accuggcuggcugugccccugccguccugcauuguaaauuggcuuuagguugcauguuucuccagcuuggu

SEQ ID NO: 4174224 - RNA, 57 nt, Human
accugggaacgcuuuguggaggaccuggucacugguuuuccgaaggccagcccaggu

SEQ ID NO: 4174225 - RNA, 112 nt, Human
accugggaagcuugucaagaugcauguucccaagcucccaggcucccacucccagagauucuaauacuguaauggagcugaggacacuacauuuuuaacaggcugaccaggu

SEQ ID NO: 4174226 - RNA, 130 nt, Human
accugggacuuguggccuuaggaaagcgaaaauccacaaggugucuucagggugagacagaggcaggcaccuuuucaacccuccuguuacugccugcaggacaccucgcuaauuaagcugccuucccugu

SEQ ID NO: 4174227 - RNA, 129 nt, Human
accuggggugccgguguguuuuacaaggcuggcuuucauggcgcaguugaguucccacuugcagaacauacucacccuguggcuauaaggcaaagcgcuggggcuuguaggcacuggaccccaagcagu

SEQ ID NO: 4174228 - RNA, 67 nt, Human
accuggguuggagcuaucauuaguggcagaauaaaguuccuuccagguuuuggcuccauuccaaggu

SEQ ID NO: 4174229 - RNA, 80 nt, Human
accugugcuucagaaauuuucucaguaguuccggacaaguuguucaauuuggacagauggcaaguuuauggaguucaggu

SEQ ID NO: 4174230 - RNA, 61 nt, Human
accuguugcugaaucaccugggcguucguggggguaaaaugcagauucuuagccagcaggu

SEQ ID NO: 4174231 - RNA, 55 nt, Human
accuguuuacccugggcuccccugacuugcuccggggggaaaguggugagcgggu

SEQ ID NO: 4174232 - RNA, 83 nt, Human
accuuaaguugcucuaggugaggucuuuaggcuaucuggucccauaauaacuagcaaagacacaacaccagggauaacaaggu

SEQ ID NO: 4174233 - RNA, 68 nt, Human
accuuacccagucuggauguaggaccuuacuaguguucuucaaagugacaacuaaacugggguuaggu

SEQ ID NO: 4174234 - RNA, 67 nt, Human
accuuaugagguagguauuauacuuacauacauuuuguggguguagaaaacuugagcucagagaggu

SEQ ID NO: 4174235 - RNA, 78 nt, Human
accuucaaucaaacagagagaaucucaguucagccagguaacugauggaaagagaaacucuugcuaauuggugggggu

SEQ ID NO: 4174236 - RNA, 123 nt, Human
accuucaucuaguaucugcucuuuauaaucuaaaacaguaucuacgggaacuauuucaagguuugaauucauaguucauggagaugccaagcauuguuaaagaaauuauuuuauuuugagagu

SEQ ID NO: 4174237 - RNA, 67 nt, Human
accuuccucuaagacauuuagcucagaauaaagcacacauucaucuuagcuguaguagagagagggu

SEQ ID NO: 4174238 - RNA, 75 nt, Human
accuucuggaauucuguaggauagacuuugucaaagugaguguauaagucagaauccugcugagaaacagauggu

SEQ ID NO: 4174239 - RNA, 83 nt, Human
accuugagcaaaguuaccuuaccucucuguacuucaguuuccucaagugaagcacagagagguaaaguaacuuugcucaaggu

SEQ ID NO: 4174240 - RNA, 100 nt, Human
accuugcaaaguuauuccuugggaauuauugaaugucucuuugccagaaccguaggcuaaagcaaccauuccauaacaaucaacgagggggcagcuaggu

SEQ ID NO: 4174241 - RNA, 84 nt, Human
accuugcacaugcaugucuaugggcagguaacuguaugcaauauauagacuaacauauucaugauauaugcaugaacaaaaggu

SEQ ID NO: 4174242 - RNA, 58 nt, Human
accuuggcauggccuuuguccacaucucaggcaguggacaucuuagucaugucaaugu

SEQ ID NO: 4174243 - RNA, 76 nt, Human
accuuguuuccccgugaggcuccgaucgcugggccagguccuccagcuccuccugagugucugggagggacgaagu

SEQ ID NO: 4174244 - RNA, 65 nt, Human
accuuuacucugaguuccuacuugcuccugagaagcagaaccaggauuuuagaaacucaguaggu

SEQ ID NO: 4174245 - RNA, 59 nt, Human
accuuucucccuggugccaugugagccacuuacccaucaguagugucaaggaggagggu

SEQ ID NO: 4174246 - RNA, 68 nt, Human
accuuugcugauuuguuucuauuccauuuguccauggcauugugggaaaagagauagauggccuuggu

SEQ ID NO: 4174247 - RNA, 68 nt, Human
accuuuuggccaucuucucgcagagugcucccugcuaacggggacagguaaagaugguggcaggaggu

SEQ ID NO: 4174248 - RNA, 70 nt, Human
acgcaagucuucucauuucacaugcuuucacaaaugcagaguaagaagaaaagagaugggggaagugugu

SEQ ID NO: 4174249 - RNA, 87 nt, Human
acgcaggaaccuggaguaguagcauuaacuaaggcccaaagauggagugcuuauaauguuacugacaacaacaaacaaagccugugu

SEQ ID NO: 4174250 - RNA, 81 nt, Human
acgcauaugagaugcucagcuaauaaaaucaguaugagaaaauauuuauacauuuuaauaugcuuaguguguuauuuuugu

SEQ ID NO: 4174251 - RNA, 68 nt, Human
acgccgggaugcgccuggcugcagccggcgaggcuauugucuccccgcccugaagccagccccggcgu

SEQ ID NO: 4174252 - RNA, 66 nt, Human
acgcugagguacgcuggcucccuggcaccuagauccagcggcuguaggggccagugaccuucgugu

SEQ ID NO: 4174253 - RNA, 62 nt, Human
acgcugucuacagaugaaauaagcagccaccagcugcucccaggcauucucuguugauaugu

SEQ ID NO: 4174254 - RNA, 106 nt, Human
acggacggacagacagauggacaacagcuggaggcuuggcccggccauagggcucucugcgggacagucccagcugcuagugucgcuguugcugcuacugacccgu

SEQ ID NO: 4174255 - RNA, 68 nt, Human
acggagacauguggaggaggcgaggguaacauuuuucugugcacugccuuucuuggcaugaccuuugu

SEQ ID NO: 4174256 - RNA, 76 nt, Human
acggaggcccugacacacaccgaagacucauuuacagugagagugaagcuuuccuguggucaggaaauacuucugu

SEQ ID NO: 4174257 - RNA, 58 nt, Human
acggaggucaacuuggucaccaagcguggcuuggugcccacucuggacccagcucugu

SEQ ID NO: 4174258 - RNA, 128 nt, Human
acggauuguggcucaccuaagcagggaagccgauuuggaacuuaaacaagcucccaaguugugaucagucgagcuuggcaagcacuguuugagagaguagguguccugcaagcaggagccgguuuugu

SEQ ID NO: 4174259 - RNA, 57 nt, Human
acggcaggcucagagcuggaauuagaacacuggcaaccaaacucuagagccuguugu

SEQ ID NO: 4174260 - RNA, 75 nt, Human
acggcuuucucugaguuucuccagugcuaguugucauguaaagugacaagguucuuguggaggaauuaaggcugu

SEQ ID NO: 4174261 - RNA, 55 nt, Human
acgggcagacagagcuacucgcuuccuaauuuggaugagacuuuuguuugcuggu

SEQ ID NO: 4174262 - RNA, 57 nt, Human
acggucacugcagaugaguccuaagggcugcuucuugggcucaguggcaggaagagu

SEQ ID NO: 4174263 - RNA, 91 nt, Human
acgguguagacauuucccccaguaugagcacagugccuggaccugaaugaucaucuuggcaguucuugugcuuuuacuuuguaaacauugu

SEQ ID NO: 4174264 - RNA, 88 nt, Human
acgguuauugcuuucagaacagggauugggccuguaaucuuuaguaagagagaaagacagaguaggcccaaucccuguugugagcugu

SEQ ID NO: 4174265 - RNA, 99 nt, Human
acguaauaucauacauguucacaucgauggauuuugcuuagguuuucuucuccuugccugugugcaugcauguguuuguguguguguguguguguuugu

SEQ ID NO: 4174266 - RNA, 67 nt, Human
acuguguacaagucacuuaaaauaacucuuuuuuccucuggguaauguuacugauuugauauacagu

SEQ ID NO: 4174267 - RNA, 79 nt, Human
acugugugcccugacgccagggacugugcacuuucccccuacaccccccacaccaucuggcagagucagugcacacagu

SEQ ID NO: 4174268 - RNA, 81 nt, Human
acugugugcugcucaagggacaggacagugcaugggcacugugcuggauuuugguuccuuguaaaaagcaauggcuauagu

SEQ ID NO: 4174269 - RNA, 68 nt, Human
acuguguguguguguuuuuuuaaugugaguuuuauauuuaucugaggaaagcagacaauagacacagu

SEQ ID NO: 4174270 - RNA, 70 nt, Human
acuguuccuucagugcuguuguaagcucauugugaagucagagcuuuggaaauguguacugaugggcagu

SEQ ID NO: 4174271 - RNA, 76 nt, Human
acuguucuaggugcuagggacaaagcagugaauauaaaaaggcaaaguguucaaagcauuagcaucuauggggagu

SEQ ID NO: 4174272 - RNA, 80 nt, Human
acuguugagugugaguacuaugcaaaggugagagccauuuguuucuaucuuuggugcuuggugcucccacccaccucagu

SEQ ID NO: 4174273 - RNA, 69 nt, Human
acuguugcaucuuuggguacaaacuugccuuuccaaugggauagguuaauuucugcugaaagagacagu

SEQ ID NO: 4174274 - RNA, 78 nt, Human
acuguuugcuucugccagaaguucugagaguauccuacaccuggacuacuuuucauguuacuuuuggggccugagagu

SEQ ID NO: 4174275 - RNA, 64 nt, Human
acuguuugcuuuuugcacccuuugccguuacaaaaauauaauggaugugcagagguaggagagu

SEQ ID NO: 4174276 - RNA, 58 nt, Human
acuguuuucuaaagaacagaugcuucauaugaaucugugacaagcuggggaaaacagu

SEQ ID NO: 4174277 - RNA, 63 nt, Human
acuuaaaaugccauugcucuaaaaauugauaauggaaagaauaguggcaaaagcauuuugggu

SEQ ID NO: 4174278 - RNA, 65 nt, Human
acuuaacaguggucugugguaucugaggaaacuuuagaugaacagaaagccacuguuuuaugagu

SEQ ID NO: 4174279 - RNA, 105 nt, Human
acuuaauacuggaaggaaucucaagugucauuuuguccaucuucucauuguauggaugaggaaaugaggccuauggcaauuaagugauuuguuccagcuuuuggu

SEQ ID NO: 4174280 - RNA, 70 nt, Human
acuuaauggaugugcuaauuggaucaaagacuuauuucuuuuucagauuucaaaaguagauccaucaggu

SEQ ID NO: 4174281 - RNA, 72 nt, Human
acuuaccccacaucacguagcugguggaggagaaaaagacccugugaaggcuguuggauggggaagguaagu

SEQ ID NO: 4174282 - RNA, 79 nt, Human
acuuacccuaucuggcaucauuguuuucauacauaaaauggaguuuauaaugucugugccaaaauugauucagggaagu

SEQ ID NO: 4174283 - RNA, 61 nt, Human
acuuacuagguuucucccuugugcuaggauuuuugcucaagccugggagacacuaaguugu

SEQ ID NO: 4174284 - RNA, 67 nt, Human
acuuacuauagguagguggaaaaguaauggcaaaaaccuauuauguugcaccaaccuaauaauaagu

SEQ ID NO: 4174285 - RNA, 59 nt, Human
acuuagauacuucuuuuaagggggucccuucacucuuuuugaacaggaguaucuauagu

SEQ ID NO: 4174286 - RNA, 129 nt, Human
acuuagaugcuaaccuagcuucaauaccuucuagcuugggauguccagucacugucaauguuccuuuugcaaaguggggaggaguugcuggagguaacugggaagguggaaggagaggaagaggagcgu

SEQ ID NO: 4174287 - RNA, 59 nt, Human
acuuagcagcuuaaguaauuagaauuuauuauuucuuuggauucuguggguugcugggu

SEQ ID NO: 4174288 - RNA, 66 nt, Human
acuuaguaaaugugcuaaaaugugucgggcuacauagaagcuugacacccagcucauuaacuaagu

SEQ ID NO: 4174289 - RNA, 88 nt, Human
acuuauagaaguuacauugcugaaaagcuggccuuuguaaagcucgcucuuggcaaauugcuagcuuucucugcgugugucuauacgu

SEQ ID NO: 4174290 - RNA, 65 nt, Human
acuuauggcgggaugcugcuuaucuuaguuuauuucagacaguuggcaaggucuggccagcgagu

SEQ ID NO: 4174291 - RNA, 70 nt, Human
acuuauguuaggcuugaaucaaugauuaaauauuuauuugagggucaauguucaaguaugacaauguagu

SEQ ID NO: 4174292 - RNA, 129 nt, Human
acuuauucacggugcguacagguaguaaauguaggagucagaacauauauuuugugaugucugaucccagcgucauguuauuagaugugguucugcuuucuaacucacaaucuacuagugugaacagau

SEQ ID NO: 4174293 - RNA, 61 nt, Human
acuuauuuccaguccagaaauuuaagauuugugggugauggauguagggguggaaauaagu

SEQ ID NO: 4174294 - RNA, 74 nt, Human
acuuauuuuccucagcacuuugaagauacuuuucuacugucuucuggacuuuauggugcugauaagaaagaagu

SEQ ID NO: 4174295 - RNA, 57 nt, Human
acuuccauuaugugcuucugugucugaaaaggaugcacaaguuauauguauggaagu

SEQ ID NO: 4174296 - RNA, 58 nt, Human
acuucccaggcgcugugugcugcaaagguugcagcugaccagcaaguccugggcaggu

SEQ ID NO: 4174297 - RNA, 85 nt, Human
acuuccccauaugacaaugugggccuaaggguucaaaaggugaaaugauuugccccaaggucuuacaguuuguucuuggcaaagu

SEQ ID NO: 4174298 - RNA, 116 nt, Human
acuucccugcccccagcauggcagcaagugccugcucagaccuagcaggccuggaacaaagaugucuuuguggcugcggagucagagcaggccucccguccucaaggcaggagagu

SEQ ID NO: 4174299 - RNA, 96 nt, Human
acuuccggcauucauuuacuuucaacagcuaagcauguuggagauaccuccuaggagcuacagagcugacuugcgggguagagggaggcuggaggu

SEQ ID NO: 4174300 - RNA, 94 nt, Human
acuuccuuucgauugugcauacacacaucaaauguuuaaaacuagcuaagaauauuggacaaauguauguguuaugauucagucugcaggaggu

SEQ ID NO: 4174301 - RNA, 60 nt, Human
acuucucuauuuugugcucuguugaaugacuuggggugaacagaugggacguggaggagu

SEQ ID NO: 4174302 - RNA, 61 nt, Human
acuucugaggagcaccgaggcuugguggaaauaucucuugcaugcuuuuuagaguccuggu

SEQ ID NO: 4174303 - RNA, 65 nt, Human
acuucugcucugucaagaaaagaugcccucccccgcugggaggucagugcuggcgugagagaagu

SEQ ID NO: 4174304 - RNA, 79 nt, Human
acuugaaaucuuccaauggucacaucaaucugaaaucacugauucauucuaaauggugugccauauggagcuuuccugu

SEQ ID NO: 4174305 - RNA, 85 nt, Human
acuugaauuugguaguagccaacuuuucuuagacuuugaacuguaaaugucuuuaaacuugaguuguuaccuuggaaauuuaggu

SEQ ID NO: 4174306 - RNA, 65 nt, Human
acuugacugggagaaaccaauuuccugggggaagucucaauaaaauuguuuuccuaucaucaggu

SEQ ID NO: 4174307 - RNA, 64 nt, Human
acuugcaaagugagggaguguuaucuuaccuagacccaagauuaauuucucagacuuuggaagu

SEQ ID NO: 4174308 - RNA, 63 nt, Human
acuugcucugggggaagccagcuguucuguuguaagaacacucgagcagcccuacagaggggu

SEQ ID NO: 4174309 - RNA, 65 nt, Human
acuuggauuauaguuuuugucuuuuuaaucaaauuauagaaaaaugacauaaagcuaugcuaggu

SEQ ID NO: 4174310 - RNA, 103 nt, Human
acuuggcuacauccucccaauacuauucggaccaucucuggguacggauacagagaagucucaagaauauauuacuaagggcaaaaaucaggguguggaaggu

SEQ ID NO: 4174311 - RNA, 70 nt, Human
acuuggcuccuauaggaaacauacgugacuaggccaggggcuggcaaauguuuucuguaaagggccaggu

SEQ ID NO: 4174312 - RNA, 82 nt, Human
acuuggcuuggauuuaagauaagauacucuaugguaauuuugaacauacuguagaaauuccauuuacuuugacuccccaagu

SEQ ID NO: 4174313 - RNA, 55 nt, Human
acuugggggcccacucucugccgcggaaaggggagaagugugggcuccuccgagu

SEQ ID NO: 4174314 - RNA, 82 nt, Human
acuuggguugacucauaccugccugacccaaagcacauccuucugggcugaaagggcacugguagguuuggacagcucaggu

SEQ ID NO: 4174315 - RNA, 129 nt, Human
acuugguaaccagcaugaucuucuaacgcuaguuuuacccuugucagcacuuugccgaaaaccucaaauaaagacuuuuuuaaaaaugugcgauggaaaacuaaaguuauaaauuauaucauaaccauu

SEQ ID NO: 4174316 - RNA, 81 nt, Human
acuuggugcaaacugguacucagcuggcacucacauuuuccaguauguagauguaagcuuggaucaggcauguacauaagu

SEQ ID NO: 4174317 - RNA, 88 nt, Human
acuugguuuaugagcaucagaaaaacauaauguuauuauggcagaagcaaagugauaaauguuuuucauugccaacauggacuucagu

SEQ ID NO: 4174318 - RNA, 58 nt, Human
acuuguaccagcucauuucagaaccuacucuauugggucaagauagugugguacuggu

SEQ ID NO: 4174319 - RNA, 61 nt, Human
acuugugucauuuuuuugcauuccagauuggcgagauuguaaugaugaaagaugacagagu

SEQ ID NO: 4174320 - RNA, 70 nt, Human
acuuguguuccagauuuagccaaccgaagauggcaguuucuauaagucuuuggcauuuaggagcaggagu

SEQ ID NO: 4174321 - RNA, 130 nt, Human
acuuguuguuuuauugugucuuugcuggcuccaggagagcugcuucaaaaugggcuccuuugucuuuucuugaaugggucugguaggaggaguggcuggagcccaacaggcaccaaugacugcagcaggu

SEQ ID NO: 4174322 - RNA, 64 nt, Human
acuuuaaacugucauuuuauauaguuauuagaaugcuagugguauguaauguaauaguuuuagu

SEQ ID NO: 4174323 - RNA, 110 nt, Human
acuuuaauuucaucuguuuuugguuucagaaggggagaaaggucaaagcuucuuuguuuuaagugagcuggucacuccuucugaaguguaaaaugauaggggucaggagu

SEQ ID NO: 4174324 - RNA, 77 nt, Human
acuuuacaaugcacauauugcauaaauauauguugauaaauaaacuugcuagcugguguaugcauugcauguaaagu

SEQ ID NO: 4174325 - RNA, 63 nt, Human
acuuuaccagagaggcaaaacuccuuccauuuguaaaagcauaaauguaguugccucugaagu

SEQ ID NO: 4174326 - RNA, 55 nt, Human
acuuuacccgcacucagacacaggcgaccuugaagcaguucucgguguguagagu

SEQ ID NO: 4174327 - RNA, 61 nt, Human
acuuuacucuuuaauuggggagauacugggugguaggguuucuuuggugggagauugaggu

SEQ ID NO: 4174328 - RNA, 95 nt, Human
acuuuaucgaaccaaguaaacaucagcaaauacuacuaguuuuuaaccauuaguuuuaaaagugauauuuggagcaauauuugguaugauacagu

SEQ ID NO: 4174329 - RNA, 63 nt, Human
acuuucauggaucucuguucaguuguuacaagguacucaacuuuuggauagaugccauagagu

SEQ ID NO: 4174330 - RNA, 58 nt, Human
acuuucaugguaguuguauucuuggagaauucgcuguaaauuaaaacuacaugaaagu

SEQ ID NO: 4174331 - RNA, 130 nt, Human
acuuuccuucuacuuagauuuuuaaauaaucaauucagggaaauagcagggcugaaauuucagcagaugguucagcucuaaaauuucauuugagucucagauuuuuagauuccuuggcagaauaaaaagu

SEQ ID NO: 4174332 - RNA, 112 nt, Human
acuuucgaaagcauuuuaaggcuauugucucuucauguguuuaauuuuuacauaaaauaaugauaauaaaaaaugaauaugauggaggauucucuguaaagugcaagacagu

SEQ ID NO: 4174333 - RNA, 84 nt, Human
acuuucuuugacuaauuuuucgugaaguuuacagggcaaaaauugucaccccaaaagcuggagaguuaggugaauacagaaagu

SEQ ID NO: 4174334 - RNA, 58 nt, Human
acugugguggcucuggaaccugacaacccauguccaaauccaggcuccuccacuuagu

SEQ ID NO: 4174335 - RNA, 67 nt, Human
acuguguaaaguucuacuagaaucaacauagaauucuugagauucuuuccagaacuuugaaugcagu

SEQ ID NO: 4174336 - RNA, 65 nt, Human
acuguguauucaagccgaagucaacugccuuuccuucccagguguugauuuagugagugagcagu

SEQ ID NO: 4174337 - RNA, 97 nt, Human
acuguguuaguuugcuagggcugcugaaacgauaccacaagcugaguggcuuagccagcagaaacauauugucucacaguuuuggaggcuggaaggu

SEQ ID NO: 4174338 - RNA, 66 nt, Human
acuguuacagagcaggaaauuguaauauuuuagggaaaggugagagauuuucugacuccugauggu

SEQ ID NO: 4174339 - RNA, 60 nt, Human
acuguuaucuguagauauuuguauauagcuuauggauacaauuauucugcagauauuugu

SEQ ID NO: 4174340 - RNA, 77 nt, Human
acuguuccuccauguaugucaggguuguccagagaaacagaaccaauaagauaaauagagauauauaggaggaaagu

SEQ ID NO: 4174341 - RNA, 63 nt, Human
acuguuccuguuuucuugagcacgcugccagcagagaaggccugagacaaugggguuggcagu

SEQ ID NO: 4174342 - RNA, 122 nt, Human
acuguucuagaaaaugacuuauuauuaagugugguuguuuuaggauucuuuucuauguguucaagugacagaaauucaauucuaauuagcuuauuaucuuaauaguucagacccagaguggu

SEQ ID NO: 4174343 - RNA, 56 nt, Human
acuguucuucauuuagcaaagacugaccuggcacucauugcuggacccagggcagu

SEQ ID NO: 4174344 - RNA, 124 nt, Human
acuguugaauuuguccuuuuuauucguuuuuauucugugcuuucaaaagaaggguuuuucucaaaggcuaauucaagaaggagcagagaagcagagacugagggauagucucaacauguucagu

SEQ ID NO: 4174345 - RNA, 109 nt, Human
acuguuggucuucuguuuagccauuauucucaguucugugcaggagugagcugaaacaaaguuguauagcccagagagugagaagcugcauuucaugucucccaacagu

SEQ ID NO: 4174346 - RNA, 67 nt, Human
acuguuuaacuuucaugcaaaaacuucccaguguuugggaaaucugucuuuguuugaauaguuuagu

SEQ ID NO: 4174347 - RNA, 88 nt, Human
acuguuuuggaaaugcaaauuccaaagcacaucagaacuaugucaucauggcauuuugccugcuguuuugggucauuuacauaacagu

SEQ ID NO: 4174348 - RNA, 75 nt, Human
acuuaaauucagauccugacauuuuagguauuuuugaaacaacaacuaugcuuaauaggaguugaacauuggagu

SEQ ID NO: 4174349 - RNA, 91 nt, Human
acuuaacauuucaagguacuuacugggcauuguguauuaucuaaguuaaaaauuuacaaagccugguagauaucugggaguuauguugagu

SEQ ID NO: 4174350 - RNA, 58 nt, Human
acuuaagaguaugaggagagcccugguuuaugucagcuccagucauagccucuugagu

SEQ ID NO: 4174351 - RNA, 72 nt, Human
acuuaauaauguugacgauagucuuaaucacuugguugagauaguguuugucagauuuauccauuauaaagu

SEQ ID NO: 4174352 - RNA, 87 nt, Human
acuuaaucuguguuauaaacuguuauagcagaaaggacuuugguggauuuuagaggcccagcuguauauuacaguuuuagagagagu

SEQ ID NO: 4174353 - RNA, 60 nt, Human
acuuacacuucugaaagccuagguccgacuauagggcugauaccgggagagaagugaagu

SEQ ID NO: 4174354 - RNA, 55 nt, Human
acuuacccaccccuggguugaggguaugguaucauuucccagcuggugggucagu

SEQ ID NO: 4174355 - RNA, 71 nt, Human
acuuagaaauuaccuugcacugagucugaaaaauacaaauuuuucuauaaaaagugcuaggauaacugggu

SEQ ID NO: 4174356 - RNA, 67 nt, Human
acuuagauggcucuguaacugcuuuaaucaaaguauauagcuguugcauaaaagaguauaucuuagu

SEQ ID NO: 4174357 - RNA, 102 nt, Human
acuuagcuaugcaauuuguuacuucuuggggaaaguuuugcauuacauaaauuuguguuucagaaccuucuuucauucugggugcaagcugaauagccaagu

SEQ ID NO: 4174358 - RNA, 81 nt, Human
acuuagcugaguugacccaucaggccacaugagguccuuguggcuggagaccuguguggccaggcuggagucuugcuaggu

SEQ ID NO: 4174359 - RNA, 76 nt, Human
acuuagcuuuguacuuguucuguuuccuugaggcuagacacagugccauccaggacuuauuacaguauaacugggu

SEQ ID NO: 4174360 - RNA, 55 nt, Human
acuuagcuuuguuuaacacagggaguucccuuaacuugcuguccucagaguaagu

SEQ ID NO: 4174361 - RNA, 61 nt, Human
acuuaggagaauaucugguuauguguauacacacacauacacacauacuuucuccuugugu

SEQ ID NO: 4174362 - RNA, 71 nt, Human
acuuagguuccagaagaggaguuaagacucauaaaccacugggcucuguggcucauaucuguaaucucagu

SEQ ID NO: 4174363 - RNA, 111 nt, Human
acuuagucuguuuucaaacuggcagcaaaaaaguaauauuuaucuacuuggccauccggagaaguguuauggauuugcaauuuugcacuuuaguggggucauagaacaggu

SEQ ID NO: 4174364 - RNA, 69 nt, Human
acuuaucuccugaaaaauucacacugccgugaacacgauccagccuugcagugugucucggagguaagu

SEQ ID NO: 4174365 - RNA, 90 nt, Human
acuuauuaaauuacauauuccuggucccuaccacagaccuacuuaauaauguccaggugaggaauccaggaauuuuuaguuugaucaagu

SEQ ID NO: 4174366 - RNA, 80 nt, Human
acuuauucacaugaaaacaaauuuuuagauuuuuacguuugaaucugucuggucagaguucuguuuucuuguugguaagu

SEQ ID NO: 4174367 - RNA, 75 nt, Human
acuucacauauaaauacaauauguguuaaaggacuaaauuucuagugucacaguuuguacuuuauaguuugaagu

SEQ ID NO: 4174368 - RNA, 55 nt, Human
acuucagaaugcggagcaggcuuuccaacagucugccuuccccauaaucugaugu

SEQ ID NO: 4174369 - RNA, 121 nt, Human
acuucagcuuccucuggccccggucuucacagcugcuggcuguggcugcaagguuaagaugacguuagcuuucuaaggcuagagagacugugccuaggacgcgccaugggaauguaauggu

SEQ ID NO: 4174370 - RNA, 57 nt, Human
acuucaguagcucagagcugccugguaccacagaacuggccauggguugccugaggu

SEQ ID NO: 4174371 - RNA, 83 nt, Human
acuucauauuuuuacacguguguguaucuguauuuguguauauauauggauauauguauauacacgugugugugugugugugu

SEQ ID NO: 4174372 - RNA, 67 nt, Human
acuuccugggaccgagggaagagcugcuucugcuucaguaacagccucugauggcucccaaggaggu

SEQ ID NO: 4174373 - RNA, 70 nt, Human
acuuccuguacuuccagccaagugagacaaaugaaaccucuucauccugugcaguugaagugcaggaagu

SEQ ID NO: 4174374 - RNA, 82 nt, Human
acuuccuuuucaaccauacagccaccgcuggggccaaccacucccuacguuuguauaaugcuguaugguuuucaaagcaagu

SEQ ID NO: 4174375 - RNA, 70 nt, Human
acuucuacacagugcggguuaacaaugaucuuaaugcacuuucaucuguaaacuccuuggugugugaagu

SEQ ID NO: 4174376 - RNA, 79 nt, Human
acuucucagcucuaguggcaucuccuaauuguguagaaaauaaaaguauuuacacaaaauguuaguagaugcugggugu

SEQ ID NO: 4174377 - RNA, 76 nt, Human
acuucucucuacuuagucuucuuuguacaagaugcagauaaccauacugucuaauaagauugaugggagaggaagu

SEQ ID NO: 4174378 - RNA, 65 nt, Human
acuucugagcauuauuuaaugaugggcuuuugauuugagcucacaucauaguaagcucauugagu

SEQ ID NO: 4174379 - RNA, 69 nt, Human
acuucugauaccuugcaggauccuuauuauuauuagacuuagagauuccuaaaguaagauaucagcugu

SEQ ID NO: 4174380 - RNA, 66 nt, Human
acuucuggcuuuucucuuggauggucuucaugaagaucuuaaucgaguccaugaaaagccauaugu

SEQ ID NO: 4174381 - RNA, 87 nt, Human
acuucuguuggagagcaaaguaaucaaauuaagcuaauugcuuguacaaaguuaauggcuuguguuauucacauuuuccaaaucagu

SEQ ID NO: 4174382 - RNA, 69 nt, Human
acuucuuauuugauaucuucacuugaaggucuaauagguauuucaaguuuaguguguucaaauagaagu

SEQ ID NO: 4174383 - RNA, 68 nt, Human
acuucuuucuucuuaaauaguaguagaugguggauaagcuauguguaucuguuagagagcaaugaagu

SEQ ID NO: 4174384 - RNA, 59 nt, Human
acuucuuuucaaaucaugcaaaguuauacgacuuaacugauugcucugguugaggaagu

SEQ ID NO: 4174385 - RNA, 76 nt, Human
acuugaaaaaauaccugagccugucuucuuaaggaauuacuaaauauagaguuuggaagucaggcuuuucucaagu

SEQ ID NO: 4174386 - RNA, 72 nt, Human
acuugaaccccggaggcggagguugcagugagccgagaucgugccauugcacuccagccugggggacagagu

SEQ ID NO: 4174387 - RNA, 74 nt, Human
acuugaaucucucagccucacucccuucaaagccaaguacugaagagacuguaaaggcgugaguaggggcgggu

SEQ ID NO: 4174388 - RNA, 88 nt, Human
acuugacucuacuugaauccaaaugggagaugaaucauugcagauuuccaucuuuuucuccaugugaggauucaagagagggcagcgu

SEQ ID NO: 4174389 - RNA, 96 nt, Human
acuugaguacuuacagcauaucagcaucaaaacacaggcuguuuccaugucauaaaaaugauuugugcuuuugagcugagaugagugaagucaagu

SEQ ID NO: 4174390 - RNA, 96 nt, Human
acuugaguuaugguauuuuguguggagcuccaaguagcccgaaucuaaagucuagagcauccaugcauggauuugacauguguacuguauuugagu

SEQ ID NO: 4174391 - RNA, 58 nt, Human
acuugaguuccaugagccaauaaauccuuauuuugucuuaaacuugugggacuucagu

SEQ ID NO: 4174392 - RNA, 129 nt, Human
acuugauauuaaaggaaaaugagcaaagugaaauaguccuuaguaagcugugaaugaugcaaauucucucagaucucccuggggacuaaucuucucuuuuaauagcacuguuuaacucaaauuccaggu

SEQ ID NO: 4174393 - RNA, 59 nt, Human
acuugcaagucugggaaauggccacuuugucaggugccaaauauucucuacgugcuagu

SEQ ID NO: 4174394 - RNA, 73 nt, Human
acuugcacugguccacucccauggguggucuuaucugccaagauguggccggcuagggagagcccuuggaagu

SEQ ID NO: 4174395 - RNA, 62 nt, Human
acuugccuccauauuuuauugccagcucuuaccuagcuaugauaaucgugagggaggcaagu

SEQ ID NO: 4174396 - RNA, 65 nt, Human
acuugcucaaggucacacaggggugauugauggggucacccagacugucugacucuugugugggu

SEQ ID NO: 4174397 - RNA, 55 nt, Human
acuugcucuccugaccuccacugauguugcuucacagcaaggaagucgaguaggu

SEQ ID NO: 4174398 - RNA, 66 nt, Human
acuugcuggaaaguagcagagucaggacucaaacuuagguucuggcucggauuugucuagcacagu

SEQ ID NO: 4174399 - RNA, 72 nt, Human
acuuggaaagagaaaguuaaagacugaggcaaaggauauuagccugcuucaaguugaaauauucuuacaagu

SEQ ID NO: 4174400 - RNA, 77 nt, Human
acuuggcagguucggguccagguuuuggucagccuugcaaaugaccaggcacucagagacugggacuuguuuugagu

SEQ ID NO: 4174401 - RNA, 63 nt, Human
acuugggcaguauguuuauuagaacugcaggaguuuguagucucagggagcugcuucucaggu

SEQ ID NO: 4174402 - RNA, 57 nt, Human
acuugggguaugggcuugccuuagcaccagauccugcucuagcccccacucccaagu

SEQ ID NO: 4174403 - RNA, 79 nt, Human
acuuucuuuguuucuguuuaaauuguguauacuuaucauaaacaauucaagcaagagagacaaaugcaaaggagaaggu

SEQ ID NO: 4174404 - RNA, 57 nt, Human
acuuugaaggggaacauuuuaaaggaucuuuaggaauacauuuuguucccccaaagu

SEQ ID NO: 4174405 - RNA, 60 nt, Human
acuuugcaaauaaacucucuaaugcucaaguauguauaaggugguauuuaauugcagagu

SEQ ID NO: 4174406 - RNA, 60 nt, Human
acuuugcagguacaugagcaucuuuugugucaaagucuaccucugagguaucuguaaagu

SEQ ID NO: 4174407 - RNA, 58 nt, Human
acuuugcuggggugacccgaggggugcagccauguggcucuguugcucgcaguuuugu

SEQ ID NO: 4174408 - RNA, 80 nt, Human
acuuugggucucugucaaauucauaacacuuauuucuugguggaauacaguuaaugaguuggacaguucaggaaagaagu

SEQ ID NO: 4174409 - RNA, 72 nt, Human
acuuuguaaccauuuaggggggaaaauaucuaugaagugauacuauguucuuccuaaauagugcuucaaggu

SEQ ID NO: 4174410 - RNA, 56 nt, Human
acuuugucucuaagaagggaauuauugccagugauuucauuuguuauagacaaagu

SEQ ID NO: 4174411 - RNA, 67 nt, Human
acuuuuaaaaauagcauauugcuuucuuucguucccacaaaggaggaaaagaaaaugcugugaaagu

SEQ ID NO: 4174412 - RNA, 79 nt, Human
acuuuuaaaaaugcagauuccuagguucuacugucugcugugucagguuagggccagggaagcuguauuuuuaacaugu

SEQ ID NO: 4174413 - RNA, 68 nt, Human
acuuuuagugaaugguacaugucuuagucuucgugggcuuacaugacagaauaccauugacuaggugu

SEQ ID NO: 4174414 - RNA, 71 nt, Human
acuuuucauguauuucccaaagcuuuuaacaguaaacaugauuggguugggggaaaugccuggauucaagu

SEQ ID NO: 4174415 - RNA, 67 nt, Human
acuuuucuuaucagaaaggccacguccaaacccacuguucacgcgauggucaucugcugaggaaagu

SEQ ID NO: 4174416 - RNA, 90 nt, Human
acuuuugaguacguuuuguaagagacuuucaggaguugauacaagaagggaaaaugagcuccugggcaccucuuucacauguagugaagu

SEQ ID NO: 4174417 - RNA, 89 nt, Human
acuuuuguaagauuuccuucaguagagcuauuggaaacacagcugcuaaauaaacuaaugcuuuauuuuaggaauauuuuaacuagggu

SEQ ID NO: 4174418 - RNA, 85 nt, Human
acuuuuguugucaaugcccuuaugccagaggcaauuuggacuaagaaauaauugucaaaaaauggcagggcuuuacuacaaaugu

SEQ ID NO: 4174419 - RNA, 92 nt, Human
acuuuuuauugauaaauuuuuacauguuuaugugguacauggaguaguuguuacauuacacauuacagaauauguaaugaucaacugagagu

SEQ ID NO: 4174420 - RNA, 108 nt, Human
acuuuuugagcuacuuuguuuuaggaguauuuaaauuaauguaaaaguguagggaaaugucuuagcucagaaaauuuaaacuuacuagauauuaagugcuuaaaaggu

SEQ ID NO: 4174421 - RNA, 89 nt, Human
acuuuuugucauaauaauuauauaugcauagugauuuagaacagaauacguuuauuuagugcucuauguauauauuuaguguagaaggu

SEQ ID NO: 4174422 - RNA, 130 nt, Human
agaaaaaaagaacgguuuaacuagaaagaaagggugucuccuggaagaauaccacacuuuggcacuggaguaggagcaauuuauaggcagccacaucuuaaacuuuucaaagcagccccucuucuguucu

SEQ ID NO: 4174423 - RNA, 128 nt, Human
agaaaaagaagcacccagaugggugauggugauagggcuugugguggacacaggguugugguaagauuccucagugcuucggcgagcaccuaagacuauuacccuggaacugacugcuuucuagagcu

SEQ ID NO: 4174424 - RNA, 122 nt, Human
agaaaacaaaucaaagugaugguuauuuucuuuuccaagcugucuuggcccacauuguuaccauggugacucagugacugccaugacauuugguacagaaugagcauuuguuuauguuuuuu

SEQ ID NO: 4174425 - RNA, 56 nt, Human
agaaaacacugcaaagcugauugguaaauugauuuugccauuugcugugguuuucu

SEQ ID NO: 4174426 - RNA, 55 nt, Human
agaaaacacugcccccucucuccuuuugagcgaggucagagacgugguguuuuuu

SEQ ID NO: 4174427 - RNA, 107 nt, Human
agaaaacauccuuagcuugcagacugagcagguggugggccagauuuggccucugggccuuuauuugccaaccccugaauuaacauuuguaagcuggaagguuuuuu

SEQ ID NO: 4174428 - RNA, 88 nt, Human
agaaaaccugauuucccuuuucucagaaccagggaaggcccauugcucaggccucacuucuucaagagaaugggagacgugugcaucu

SEQ ID NO: 4174429 - RNA, 83 nt, Human
agaaaacugugcaaucuuggcagauggguggggacugugagguggugccucugggccucaccugcugcucagcgccacuuucu

SEQ ID NO: 4174430 - RNA, 58 nt, Human
agaaaacuuuauuguuaggggcuaaauuugaauuuagcuaauacgauuuaaguguucu

SEQ ID NO: 4174431 - RNA, 75 nt, Human
agaaaagccguguuaaucauuuuugauuuugccuuuaugaggguaaaaucaugacagauugacauggacaauucu

SEQ ID NO: 4174432 - RNA, 59 nt, Human
agaaaagucugcuuucuauuaucaucuugucuuggugagauuaguuugcaaauuuuucu

SEQ ID NO: 4174433 - RNA, 100 nt, Human
agaaaaugguaaaguguucugagccuuucuaagaaacauugcucacauaugcagguuguugcaucuugauagugucugaguaaaauuacaaccauuuucu

SEQ ID NO: 4174434 - RNA, 81 nt, Human
agaaaauuauucuuaggcuuugaaaucuaaucaaggaacagacaaccuuuguucauugggauuucagaacugcuauuuucu

SEQ ID NO: 4174435 - RNA, 69 nt, Human
agaaaauucaggggcucacaagauuaaugagauuuuuggccuaauagucugaggcacccugaauauucu

SEQ ID NO: 4174436 - RNA, 70 nt, Human
agaaaauuccaagaguuuaaaucaauggccagagauuacauuaucucuuuguugaggagcugaauuuucu

SEQ ID NO: 4174437 - RNA, 55 nt, Human
agaaaccagggcuuaccagugccuaagaucacagagcugguaagaggaagguucu

SEQ ID NO: 4174438 - RNA, 119 nt, Human
agaaacuagaggugaaaguuuuagucaggaauuaauguagucucugagguaaacaacuauuaaauuuauuuguuuacuuuuaauuaccugucuccugagagcagacaccugucuuuucu

SEQ ID NO: 4174439 - RNA, 84 nt, Human
agaaacugagcgguggggaggcuuuuggagcuccugcuaauguuagcagacuguagggcugaggcuaccacuggucugauuucu

SEQ ID NO: 4174440 - RNA, 130 nt, Human
agaaacuuaauugacaacuuaggggaaguacucauucacaauuuguauuuugcauccacuguuuuuugccuguggggcuuucuguagaacagauuguguaucucuuacuguaguaaauuucaacauuccu

SEQ ID NO: 4174441 - RNA, 79 nt, Human
agaaacuuacauucacuuuuuccugguccauuuugguuccuaagaauagauaggccauuaagaaggauauuagguuucu

SEQ ID NO: 4174442 - RNA, 65 nt, Human
agaaagacuuggcuuaugauuugcguauguguuaccuaauuugcauaucauuuauaagucuuucu

SEQ ID NO: 4174443 - RNA, 71 nt, Human
agaaagaucugacuuagacacagaauaagcugcuugugcuggguguguuugugagcugggugagguuuucu

SEQ ID NO: 4174444 - RNA, 65 nt, Human
agaaagauuugguaucagaagaccuaaguucauucuugcacuucaauagauaccacaucugaucu

SEQ ID NO: 4174445 - RNA, 56 nt, Human
agaaagcacagcggguccauuuuaaggauuuuuccaaauauaccagcuggcucucu

SEQ ID NO: 4174446 - RNA, 72 nt, Human
agaaagcagcagccgacauggauugcacucuugcucugugccuugcaugcguuaguuggcguguugcuugcu

SEQ ID NO: 4174447 - RNA, 85 nt, Human
agaaagcaggucuuuaaaugcaaugugcuuuaccagggaccaugguuuccuugcaguagccacauugcauuaacuccugauuucu

SEQ ID NO: 4174448 - RNA, 67 nt, Human
agaaagcuuauuuguaugcauguuguuucacaaacugcagggugcagaacaaauuaagacacuuucu

SEQ ID NO: 4174449 - RNA, 80 nt, Human
agaaagcuuguuaaacauguagaaucucagauccccaccccagaucugcugaaucagaaucugcauuuuaacaagccucu

SEQ ID NO: 4174450 - RNA, 71 nt, Human
agaaagggaauggaguggaaaaguacugcagaaaccuuuccuuucuucacacuuuggaauuccaccuuucu

SEQ ID NO: 4174451 - RNA, 65 nt, Human
agaaagggccaucccagaacagaaagggaugucuuuaauccuuucucuuggaaaaggccaauucu

SEQ ID NO: 4174452 - RNA, 75 nt, Human
agaaagguuagggauaucacauauccuaagcuagccccuuagguacuggaauaaugugauauuccuguccuuucu

SEQ ID NO: 4174453 - RNA, 76 nt, Human
agaaagguuuuguucaucgauuuucuuaaauggaaaaguuuuaaaggaugaggguaagugaacggcgagcuuuucu

SEQ ID NO: 4174454 - RNA, 80 nt, Human
agaaagguuuuuugaauaauucagaaacagcaaagcaaguggugguuugucuguacugccguuauucagagagaacaucu

SEQ ID NO: 4174455 - RNA, 70 nt, Human
agaaaguaaguagaaaccugcaaggacucagccuaggcugggaacuggggcauuguuucuguuguauucu

SEQ ID NO: 4174456 - RNA, 73 nt, Human
agaaagucaacccuagaagcccagcaaacugugaucauaucauuuauaucacgauaaaugggcugguuuuucu

SEQ ID NO: 4174457 - RNA, 55 nt, Human
agaaagugugucauacuaagugcuguucuaagccacuaaguagacugcccuuucu

SEQ ID NO: 4174458 - RNA, 78 nt, Human
agaaauaauuguagauaaacacugagagaaaggccucuuugggaugucuuucaucuuauuugucuacauccgauggcu

SEQ ID NO: 4174459 - RNA, 78 nt, Human
agaaauagaauguaagagucuaagauuguagaguuauuggcuuaauguuauuuaaaucaaacuuuugcuucuguuucu

SEQ ID NO: 4174460 - RNA, 55 nt, Human
agaaauagcagagucaggcggggccgguuggacacccccugaucuguuuauuuuu

SEQ ID NO: 4174461 - RNA, 62 nt, Human
agaaaucacaggaggcagaaggcuuccaucucaguuucagccucagccucagcaggauuucu

SEQ ID NO: 4174462 - RNA, 55 nt, Human
agaaauguaauugcaacugucuguucaaauacuggguaacagcaauugcauuuuu

SEQ ID NO: 4174463 - RNA, 61 nt, Human
agaaaugugagccccuuaucaagcagauugcugcccuugucaaguaaggcugacauuugcu

SEQ ID NO: 4174464 - RNA, 115 nt, Human
agaaauuuucacucgguuuuuuguuuuacuuaaugaggaaacauuguagaagcagucauuauguagacugggcuuguguuuuuccucagagacagaaaguacucaaguaauuuuu

SEQ ID NO: 4174465 - RNA, 77 nt, Human
agaacaaagcccugcccaagagcucguuuccugggaccugccaacuuccaugaauaagcgggcaaggcuuuaauucu

SEQ ID NO: 4174466 - RNA, 74 nt, Human
agaacaagugucacaggcccagcucuucaccagaagcuuugaugauggccugggcuuugaauacgugauguucu

SEQ ID NO: 4174467 - RNA, 98 nt, Human
agaacaggaugagcauaugaccugggcauuuuggaugauuaagauagcccaucuuacauguugauaaucuuugaaugccagauugugcuccuugcucu

SEQ ID NO: 4174468 - RNA, 90 nt, Human
agaacagugccuggcauauaguaggugcucuguguuugauaaauuuauucaacauuuauugagcaccuacuggaugccagaugcgguucu

SEQ ID NO: 4174469 - RNA, 94 nt, Human
agaaccaacauagaacuaguaaaagcaacaguauagccuggacaguucaagggauaugcugacgcuuauauugcuaagaaauuuaccauggucu

SEQ ID NO: 4174470 - RNA, 59 nt, Human
acucgaagagauuaagugauuuaaaggucaagaccacauaaaucucuguauucuucagu

SEQ ID NO: 4174471 - RNA, 68 nt, Human
acucgcagccucagccugcuucccccaaccuggcccaguuuggagggaacccaggcugcucugcaggu

SEQ ID NO: 4174472 - RNA, 66 nt, Human
acucgcuguaauguuuagaagcagacagcuuaucuaagccuucugagucucagcaugcuugugggu

SEQ ID NO: 4174473 - RNA, 66 nt, Human
acucgcuuguugggggcaggauggguuuccuuccuccgcuuuuuccuccuggccuucucgggcagu

SEQ ID NO: 4174474 - RNA, 80 nt, Human
acucuaagcaucaccccuacauuucccuugcucucuuaccaaguaagcuagggugggcugggggaguugcuuuuuggagu

SEQ ID NO: 4174475 - RNA, 76 nt, Human
acucuaauaugacucuuuuucuggugaacucuucaguccaauagaacuaucagauuuagaggagucauaaaagagu

SEQ ID NO: 4174476 - RNA, 84 nt, Human
acucuacuuucuuguuucuuaagauugcuuucucuaaauugcgcuuccaugagagcuguguuaagaacaggccacaagcagagu

SEQ ID NO: 4174477 - RNA, 57 nt, Human
acucucaauuaucuggacugaaggcacuguucucacuauggccagaugaaugggagu

SEQ ID NO: 4174478 - RNA, 61 nt, Human
acucucagggcuccagggaaagaggacacaguauaaugugccccuggggccacuagggagu

SEQ ID NO: 4174479 - RNA, 87 nt, Human
acucucaguugcugugucacuuagcaauuugauuaaaagaugugcccaucuuucuuaccuguuaagucaggaaguaguaccuagagu

SEQ ID NO: 4174480 - RNA, 62 nt, Human
acucucccagcuauauguggugaaaaggaauugcuuaacuauguaaacuggcgugggagagu

SEQ ID NO: 4174481 - RNA, 92 nt, Human
acucucucacgcucacaugcaccuucaguuuuucccuugcuguccccccauaugggaggaagagaagaugucuccagaagugugagcagagu

SEQ ID NO: 4174482 - RNA, 82 nt, Human
acucucuuccccuugagaugagcuaauuuuuuucauuuucugaaggcaucuauacauuauguucauuucgcuggaggggagu

SEQ ID NO: 4174483 - RNA, 63 nt, Human
acucugagcgccuccgcaucugccagauguuuguugggaugcggagccccaagcuugaagagu

SEQ ID NO: 4174484 - RNA, 71 nt, Human
acucugaugccugggcaaggaugacuggaagacuuagacuaccuccccaugcugcuuggcacccucagagu

SEQ ID NO: 4174485 - RNA, 71 nt, Human
acucuggaaagaguuuugguauauuugaaugcaauugcuccagauguucuacauaacucuuuaaucacagu

SEQ ID NO: 4174486 - RNA, 56 nt, Human
acucuggagauggaugucaggagucauucagguucugacauuuucuaguccaaagu

SEQ ID NO: 4174487 - RNA, 75 nt, Human
acucuggcaucauucaucauggagucuagccauacaaucaggaaagcuuuccuccagugggggugagccuagagu

SEQ ID NO: 4174488 - RNA, 60 nt, Human
acucuggguucuuucacuugacauuaugauuuuagauucagugauguugaaccuagcagu

SEQ ID NO: 4174489 - RNA, 78 nt, Human
acucuguaaacuuacagagugguuguccaacucuguaaacuuacagagugguuguccaacucuguaaacuuacagagu

SEQ ID NO: 4174490 - RNA, 129 nt, Human
acucuguccuuucucccaggagcagcuggccggagaguaacacgacuccagccggacauggucaugacuauuucagccugcaaggucaugacucucuggcccaccuaggacuccuaggggaaaggaagu

SEQ ID NO: 4174491 - RNA, 69 nt, Human
acucuuauguacacccuaauuauaauugcauacaaugucugcauguggauauguuagggugaugggagu

SEQ ID NO: 4174492 - RNA, 93 nt, Human
acucuucacaguaccugcugcacuucaccacuguccugguuugccugguagaaaagagacagggugggugauuagguugacaaagucgagggu

SEQ ID NO: 4174493 - RNA, 72 nt, Human
acucuucuuaccacugugucaguuugguuagacaaggcugcugauuaaguuugucaacaggcaaagaggagu

SEQ ID NO: 4174494 - RNA, 77 nt, Human
acucuuuacuguuuggugcucuauugacuaaauuuuuccaauaaagugaugauaaugauaccaaacauguagauagu

SEQ ID NO: 4174495 - RNA, 105 nt, Human
acucuuugacaauuucucuagcagauguuuuuaaucuuggauugagggcucaaguguuaccuggauccaugaaaaggcuacuuugggaguaaugacaggaagggu

SEQ ID NO: 4174496 - RNA, 64 nt, Human
acucuuugucuguugccgcuuacucuaaagauggucuuucuuaaacaacagaacaccaaggagu

SEQ ID NO: 4174497 - RNA, 85 nt, Human
acucuuuuaagcuacauuguacuagaaauuguauucagaauguuuuccgugaacagauuuuuaaugcaaaggguuuuaagagggu

SEQ ID NO: 4174498 - RNA, 78 nt, Human
acugaaaccgugagaguaccaccucaacaucugcauauaauuaugccugauaucaguuggaacucugcacuuuucagu

SEQ ID NO: 4174499 - RNA, 55 nt, Human
acugaacagaccauuuuguccuucauuucugagaaguaaaaugucuguggucagu

SEQ ID NO: 4174500 - RNA, 62 nt, Human
acugaacgccgccgucaggagagcugaggggacccgacggcccuggcggaggcgggagaggu

SEQ ID NO: 4174501 - RNA, 58 nt, Human
acugaacguggcaguggaaggcuggguggagacuucucccccagcuccugccaucagu

SEQ ID NO: 4174502 - RNA, 61 nt, Human
acugaacucucucaagugacagaauuacucuuuggauauuugucacuagaaaggguaaagu

SEQ ID NO: 4174503 - RNA, 69 nt, Human
acugaacugaugccaagagugcucccaggagacagaccuucaaaggcagcaucuugauauugguuuggu

SEQ ID NO: 4174504 - RNA, 68 nt, Human
acugaacuuuuucuaaauugcugaaaaaguuguuaaauugcagcugguucagaaauuagauggucagu

SEQ ID NO: 4174505 - RNA, 58 nt, Human
acugaaguccacacauguaggauugaugauauuuacaauccuguggcacuguuucagu

SEQ ID NO: 4174506 - RNA, 112 nt, Human
acugaaguugcugguaaacacucaugccaccccuuucuucaguauucauugauuugaccaauauggaagcuggcaguaaaggguuuggcauuaacugugcaguggcuucggu

SEQ ID NO: 4174507 - RNA, 76 nt, Human
acugaaucagcuuugcuacucuggaacaggcugcaacagaauuugugcaggacucaaggguagcaggugaugcagu

SEQ ID NO: 4174508 - RNA, 56 nt, Human
acugaauguauguguauaugugugcgcauucacauguaugcagcaaaacaauuagu

SEQ ID NO: 4174509 - RNA, 58 nt, Human
acugacccggaaagaaaaugaagauguccucuaggccaggcuuuaccucuggguaggu

SEQ ID NO: 4174510 - RNA, 79 nt, Human
acugacccuucaaauauccucaaaugacuuucauuuacuuguuuuuguuacuuuuaagagaugucugaaaagggcuggu

SEQ ID NO: 4174511 - RNA, 98 nt, Human
acugaccuauugcuuuggaacuacucuuuuagccccacagagacugugaaacaguguuuugguggucuauaggaaagguucaacuuggcaaauguagu

SEQ ID NO: 4174512 - RNA, 92 nt, Human
acugagaucuaaagauguauuuucaagagcaguaguauggcuuaccaagcuaagcugaaauuccuccugaaauucuauuuguggauuuuagu

SEQ ID NO: 4174513 - RNA, 82 nt, Human
acugagaugcuagcaugcagguuagagcauccacacagauacuaaacacuuuugggauguuggcuggauuuuagauuuuagu

SEQ ID NO: 4174514 - RNA, 95 nt, Human
acugagauuuuacuuuggugcuuaagcuucugcuuuaugugcuuuaaaccagcuggugcaugccagguuugaguaucuugauaggaacacucagu

SEQ ID NO: 4174515 - RNA, 69 nt, Human
acugagcaauuuuguguguguguagauuccccucagauuucagagaggaacagauauuugauuuucagu

SEQ ID NO: 4174516 - RNA, 80 nt, Human
acugaggaggaacucagaaagaagguggccuuagugggucugugcuugucauuacugguuucucguuuuauucauucagu

SEQ ID NO: 4174517 - RNA, 64 nt, Human
acugaggguagaggucaguguugaaaauuuugauuuuaaacaucugaauccugcuucccacagu

SEQ ID NO: 4174518 - RNA, 59 nt, Human
acugaggucuaucaugagccaggcugggugcuggggacacauagugaauagaccucagu

SEQ ID NO: 4174519 - RNA, 94 nt, Human
acugaguaacagauguguaucaugaucagcaacuaaucacgucacaucucucaacauuugucagugaauggucacugagcaucuguuacucggu

SEQ ID NO: 4174520 - RNA, 67 nt, Human
acugaguaagaagcuguuuggauuuuucauggucaucaaauccccagacaguuccuugagguucagu

SEQ ID NO: 4174521 - RNA, 63 nt, Human
acugagugaauucaaguaaagggccuguaagagugccuggcacuugcuaagaauucacuaagu

SEQ ID NO: 4174522 - RNA, 81 nt, Human
acugagugggacuuagcaguauaaauccagguaguuccuaucucucaacugucuuauuuauauuucugucauuaacucagu

SEQ ID NO: 4174523 - RNA, 55 nt, Human
acugaguuauagagguuuauaucuuugaaaaaugagauaacuacauuggcucagu

SEQ ID NO: 4174524 - RNA, 80 nt, Human
acugauagcugacuccagacauagcucucuuuaaacauaacagccaaagggcauguuuguuugagccagucucuucaugu

SEQ ID NO: 4174525 - RNA, 67 nt, Human
acugauaugauuccuuacacuauaguuuugauuugugcagaaugucguguaaacggacucaugcagu

SEQ ID NO: 4174526 - RNA, 76 nt, Human
acugauauuuccagugcacugaauagaaaagcugcaaucacaguuguauucugccaagagcaauggaacuguuagu

SEQ ID NO: 4174527 - RNA, 69 nt, Human
acugaugccccuggaccugugacucugaauuuucuuggaggacaccccggguaccaggucugcauuugu

SEQ ID NO: 4174528 - RNA, 62 nt, Human
acugauuacacgaguucugacuccuacuaccugcuugucugucaguaaccuccuggaucagu

SEQ ID NO: 4174529 - RNA, 66 nt, Human
acugauugaaaggugacauuguuagagauuauaaauaauucaacaaauggcaucuaucugauuagu

SEQ ID NO: 4174530 - RNA, 56 nt, Human
acugauugcauucauaggguuuuuccccaguaugaauucuuugaugugcaauaagu

SEQ ID NO: 4174531 - RNA, 104 nt, Human
acugauuuauguugugaggaggaagaauuagacaugcuuugcuuuuauguugacaguauauaaacugguauucaaauguuugguuaaauucacaugugaacagu

SEQ ID NO: 4174532 - RNA, 101 nt, Human
acugauuuucaaguggguuuauguuuccugagcuuacaccaguggucacguaagaggcauucugguggcugaggaaaaguaggcugagagugaauguuagu

SEQ ID NO: 4174533 - RNA, 105 nt, Human
acugcaaaauacuucagggcucaaaaccaccucuucacccuccuuuugcaggugagcaugagccuggauugaagugggugguaaugaacucuugaaggaagcagu

SEQ ID NO: 4174534 - RNA, 64 nt, Human
acugcaacuuucaguuaaugacuccauaggaucugcuuaaacuggguuagacugaauuuucagu

SEQ ID NO: 4174535 - RNA, 91 nt, Human
acugcaagguuaaguacuauuagucucuuucauuuguaaggacaaaggaagauuaaagagauuaaaguaacuugccuuuuauccagcuagu

SEQ ID NO: 4174536 - RNA, 63 nt, Human
acugcagaguuaucaacagaucuguuuucuccauggaaaacaggaguuuugguaggcugaagu

SEQ ID NO: 4174537 - RNA, 55 nt, Human
acugcagcaaagcccgugucuuugcaggaguaggagacacagggguugcuggggu

SEQ ID NO: 4174538 - RNA, 74 nt, Human
acugcaggaacugaggugagaggaggccaugugacaauaaagaucauuauguacucacugccugaguccugagu

SEQ ID NO: 4174539 - RNA, 61 nt, Human
acugcaucagcccaggucacguaaucaagucuuccuugacagcagcucuggguugaguagu

SEQ ID NO: 4174540 - RNA, 76 nt, Human
agaaccuagaaaaugguuuugucucaucaauguaauguccuccuccacacaaugauugaaaccauauuaggucucu

SEQ ID NO: 4174541 - RNA, 71 nt, Human
agaacuacacaauggaggaaaacauuucacuguagauguauauaggaaugugcuccaauugucuacuuucu

SEQ ID NO: 4174542 - RNA, 64 nt, Human
agaacuaggcauucccguggcaucaugugcccaaugcacagugccacaggaauggccaaugucu

SEQ ID NO: 4174543 - RNA, 88 nt, Human
agaacucagggacgguauggaacuggcuuuacagauuugccucuuguugcuugcuauuaaaguuaguuucuuauaugucucugacucu

SEQ ID NO: 4174544 - RNA, 58 nt, Human
agaacucugaacacugucuggagcucacacaaguuccuggaauaaugcuuuaaguucu

SEQ ID NO: 4174545 - RNA, 59 nt, Human
agaacuggauuuaggaacagagaaacugcaaccaaugcuucucuggauaggccaguccu

SEQ ID NO: 4174546 - RNA, 60 nt, Human
agaacuuguuuuguguaucucuagcuaaauauugccauuauugcacacagauaaguaucu

SEQ ID NO: 4174547 - RNA, 81 nt, Human
agaagaacauugaaaccuguuucucucugaguuacuuguaagcauuaagaaaaaagagagcugacagaaacauuuucuuuu

SEQ ID NO: 4174548 - RNA, 71 nt, Human
agaagaauaauuuguggcaugugaaaaugacaagaaagucaaaugucaguguccauaaauaaaguuuuauu

SEQ ID NO: 4174549 - RNA, 83 nt, Human
agaagacucccagcccauggagagggucugaccugcacagccccagugccgagacccugcaccucucgugggcugagucuuuu

SEQ ID NO: 4174550 - RNA, 109 nt, Human
agaagacucucuaaauauuuuuuccugccuuuucaucugagcuggaguucacccugucuucauuuucccucagcaggaauguggcaggcaagugaguggaguaacuucu

SEQ ID NO: 4174551 - RNA, 130 nt, Human
agaagacuucagccgcugcucccgaagccacuaagggcagggaggccaaagugugggcggcucugcucagaccauucgcgcuuuaggcccaccgcucugcgcucuugguaaggcggaggaggcagcuucu

SEQ ID NO: 4174552 - RNA, 79 nt, Human
agaagagaaaauuaagugucugggaagccuccagauuagcaauaaagauguggcuucuuagaauuugacuuacucuacu

SEQ ID NO: 4174553 - RNA, 129 nt, Human
agaagagggaaaaagcagggugcuggcggaaagccagguuucaacuaaaucaagaagguggugagaacaaccuaugaagauguugaggcugggaauuucucuacacaugaagauggguuccagaggucu

SEQ ID NO: 4174554 - RNA, 75 nt, Human
agaagauaggcaguagcaggaucugccauaauucuaaaagugugcaugggagaaucuugcucugcuaccucuuuu

SEQ ID NO: 4174555 - RNA, 57 nt, Human
agaagauauaaaaauacgcagcuuaacuauaucuuccugcguguguauuuauuuucu

SEQ ID NO: 4174556 - RNA, 76 nt, Human
agaagauuaggguaucacaucacagguugagcuagauaaacuagaguaucuucaauucaugaaguccaugucuucu

SEQ ID NO: 4174557 - RNA, 71 nt, Human
agaagcagacagaccauggcuauucagaaaccucccugcagagucaaguagcccugguccugaguguuucu

SEQ ID NO: 4174558 - RNA, 61 nt, Human
agaagcagcaguaagacugagacaagggaaaucucuucaagucaguuaaguugcugaaucu

SEQ ID NO: 4174559 - RNA, 72 nt, Human
agaagcagugccauuuugugauaguuuuugaugcuccaaaucugaauuaauacacagaauggcauucauuuu

SEQ ID NO: 4174560 - RNA, 80 nt, Human
agaagcaugccuacuagaacacgucucggaaugagagauguuuaauucugucaccucccagaaaguuuugcaggguuucu

SEQ ID NO: 4174561 - RNA, 56 nt, Human
agaagccauaguaucucaggguagaaaaacccaauagguagaaaacauggccuucu

SEQ ID NO: 4174562 - RNA, 74 nt, Human
agaagccaugucucagguggccacaagaggagauggugaaucccaggccauuaccgcugagacccagggcuucu

SEQ ID NO: 4174563 - RNA, 58 nt, Human
agaagccauguuuaguaggaugaaagucaugacagcaucuccucuaccauggauuucu

SEQ ID NO: 4174564 - RNA, 95 nt, Human
agaagccucuuuuucauguccagggacagcgggacucugacagcugagagcuggugggcggcugucucaguucccuucucuggacaagagcuucu

SEQ ID NO: 4174565 - RNA, 87 nt, Human
agaagccugcucuguccuugugcagcugcggcaggcaggagcuggaacauaugccugucugaaagaggacgagcugggaaggcuucu

SEQ ID NO: 4174566 - RNA, 87 nt, Human
agaagcucggcagugacuugcucaaaucagauuuuagacacgauuuaaagcauguuucaguaagguuaauauaguguccgaguuucu

SEQ ID NO: 4174567 - RNA, 57 nt, Human
agaagcuggggucacuuauccuugggaaggaacaggauugagacagagaccaguucu

SEQ ID NO: 4174568 - RNA, 78 nt, Human
agaaggaagucagaggaaugggccaggcugguagguguaaucauggaagucugugcaaguucucuuuacauuccuucu

SEQ ID NO: 4174569 - RNA, 59 nt, Human
agaaggaaucuccauuuagucugugaaccacagcaacagacagcugggaguguccuucu

SEQ ID NO: 4174570 - RNA, 55 nt, Human
agaaggaggaauggguagaaaggcaaaaaguucaaacucagcucuuccucccucu

SEQ ID NO: 4174571 - RNA, 78 nt, Human
agaaggauuccagaggaugaguggagaguaccguguuucuaagacaccuguuucuucucaucccugaaaucagugucu

SEQ ID NO: 4174572 - RNA, 57 nt, Human
agaaggcaaagagaugacaggggccagaucaugauggauguuaugacuuugccuuuu

SEQ ID NO: 4174573 - RNA, 68 nt, Human
agaaggcauugccuggauucucuucugaugaaauuucauuagcaaguuuuccagcuaauuggcagucu

SEQ ID NO: 4174574 - RNA, 55 nt, Human
agaagggaaaugcuaacagaugggcaagcuuuuuguucaugguguauuucuuucu

SEQ ID NO: 4174575 - RNA, 90 nt, Human
agaagggaagcuguuaggggaaaugagggggcaacauuccuggcuuuuucugcaggacuagaaaugucgucuccacauuugcucccuucu

SEQ ID NO: 4174576 - RNA, 60 nt, Human
agaagggaggugggaggugcggaggggaugguccugucuguggcuuccuauuucuuggcu

SEQ ID NO: 4174577 - RNA, 59 nt, Human
agaaggugggugaagcuugcucaguauccugcuuaaugcuaucaguuucuucccccucu

SEQ ID NO: 4174578 - RNA, 58 nt, Human
agaagguuguuaaaggggauucaaaucaauuacuuugaaacuaugaagacaaccaucu

SEQ ID NO: 4174579 - RNA, 102 nt, Human
agaaguaauagagaagaaguuaaguaaauaucuguagucuuuacagaggaacgucaauaacaacugcugagguauuugaucuuacauuuauuuucuaauucu

SEQ ID NO: 4174580 - RNA, 124 nt, Human
agaaguacagaaucaggcauuagauucucauaggagugcuaccccuauugugaacugugcaugcgagggauguagguugcaaguuccuuaugagaaucuaaugccugaugaucugucacugucu

SEQ ID NO: 4174581 - RNA, 66 nt, Human
agaagucaaguggucuaugaaaucacagguaauaaugaaaaaaaugccucaugaccauuggcuucu

SEQ ID NO: 4174582 - RNA, 79 nt, Human
agaagucguccaguaggagguucugagguucuggguuucgaucaaacgcauccuuuaucuuuccuaggaauacacuucu

SEQ ID NO: 4174583 - RNA, 106 nt, Human
agaagugagggcaagggcuguggaucagaggacuucccacucaucuggccacuggacucugcccugaggaggugaagucuccaucauuccccucuccuucccuucu

SEQ ID NO: 4174584 - RNA, 72 nt, Human
agaagugcaauaaaguaguagaauugcaauaaagagaugugcaaauaaauauuuacacuuuguagcauuuuu

SEQ ID NO: 4174585 - RNA, 58 nt, Human
agaaguggcagaacuggaauucgaauccaggcaguuuguguccagagcuggugcuucu

SEQ ID NO: 4174586 - RNA, 58 nt, Human
agaaguuauggugcccagccucugugugcaagacagagacaccgcgcaucauggcucu

SEQ ID NO: 4174587 - RNA, 65 nt, Human
agaaguugggguuaucacaccaggaaucugggaagagacuccuuggugcuggagcucagacuucu

SEQ ID NO: 4174588 - RNA, 61 nt, Human
agaaguuuaaccaggugcuacucauagaaaaucaguuauuuguauuauugguuaaauuucu

SEQ ID NO: 4174589 - RNA, 65 nt, Human
agaaguuuucauuaccuauacagagugauuuuugauuuuuacauauguauuuaaugaaggcuuuu

SEQ ID NO: 4174590 - RNA, 74 nt, Human
agaauaaaggauaauccauuagacuggaugcauuuaguuucaugaacaacuuauggcauuguccuuauuguucu

SEQ ID NO: 4174591 - RNA, 83 nt, Human
agaauaacaagaaagccaugaauguuauagaggaauccagaaagccucuccuuuagcuucuguggcacauucauguuuauucu

SEQ ID NO: 4174592 - RNA, 78 nt, Human
agaauacaagggaggucuagaucagguuggagggacaccagugccuugaaucucugcucuagaacuuucuucuagucu

SEQ ID NO: 4174593 - RNA, 65 nt, Human
agaauacucuuuaaggaaaguguugaucugaaauaggaucagcaaucaaauugcagagugugacu

SEQ ID NO: 4174594 - RNA, 86 nt, Human
agaauagcacaucugcagggaugugaggggugagccgaagauucacuuauggaguuacucgucaucuuccucagggucgcugaucu

SEQ ID NO: 4174595 - RNA, 78 nt, Human
agaauaggggcaacagaaaucugucucuuugucuagacaacaacugcacagacagauuuugucugauguaucuauuuu

SEQ ID NO: 4174596 - RNA, 62 nt, Human
agaauaguggcaaugacugcacauaaaguauauuguagacguagucaaugucacugaauucu

SEQ ID NO: 4174597 - RNA, 73 nt, Human
agaauaucuagauaccaagaagcacauucugaugaguugucagguucuuuguagcuuccuuggucucugcucu

SEQ ID NO: 4174598 - RNA, 87 nt, Human
agaauaugagggaagaggccugacauuuucuugagaacugaaaccuuucuuuuaagauggcuugccuuuaucaccauccgaaauucu

SEQ ID NO: 4174599 - RNA, 67 nt, Human
agaauauggaaacaauaauuggaauugucuuuucaaaggccuuucaacuuguuugcuuccauagucu

SEQ ID NO: 4174600 - RNA, 57 nt, Human
agaaucaggagagagagaagcaagcuauuuuaugcagccacuaguuuuccuguuuuu

SEQ ID NO: 4174601 - RNA, 60 nt, Human
agaaucaggcagagggagaagccaagcugugaugccagccuggcagccucagccaauucu

SEQ ID NO: 4174602 - RNA, 55 nt, Human
agaaucagugcuggcuauuagcuacaaagguaccagcuaauaccucacugaaucu

SEQ ID NO: 4174603 - RNA, 128 nt, Human
agaaucccauuaaauuugaauuucagauaagcaauaaauaauuuuuaguauaaguaggucucaugcauuauuugggauguacuaaaaacuuuugcuguuuaucugaaauugaaauuuaacugacaucu

SEQ ID NO: 4174604 - RNA, 67 nt, Human
agaaucuauggaggguaggccaggguaugggcauauuuccaaaacucugcaguuaguuucuaguucu

SEQ ID NO: 4174605 - RNA, 99 nt, Human
agaaucuauucaagggguucacagucuuugacaagcccuuucaagcagcaggaugcaguggaaggggcagagacugaagaguccaaugaccuggguucu

SEQ ID NO: 4174606 - RNA, 92 nt, Human
agaaucugcuacauuaauaacuucauguaacauuuaacauguaauuaaacaacauauuauggauuuacugaguuauugaguuaggagauuuu

SEQ ID NO: 4174607 - RNA, 83 nt, Human
agaaugcagaguguugcacauuuccuagaauuucaauagauugaaaaaacuauaaaaggugauguagcuaauuuugucauucu

SEQ ID NO: 4174608 - RNA, 110 nt, Human
agaauggaagaaaacaagcacuuuucccuuagaucauuugaauugagguaggaauuuaaccuuuuuguccuuacuugcaugaugugggaguagcuuguuucuuucuuucu

SEQ ID NO: 4174609 - RNA, 66 nt, Human
acguagagcuacagccugaugaacauuccuuauacaaaggaauguacaucucaguguaguacucgu

SEQ ID NO: 4174610 - RNA, 66 nt, Human
acguaguuacauacaaaggcuggguuaucugaaccuucagaaacccuagcaugugugugugugugu

SEQ ID NO: 4174611 - RNA, 68 nt, Human
acguaucuucagaaacuaguaacagcuaucuucuauauauggcuagaauacuguuuuagaacuuaugu

SEQ ID NO: 4174612 - RNA, 74 nt, Human
acguaugggaaggacauucugggcucaggaacauccaguacaaaggcccugaggugggaguuuuucucauaugu

SEQ ID NO: 4174613 - RNA, 66 nt, Human
acguccacacagcacuggcugcugcagugccaccgcccagcagccucuugugccuguggugguugu

SEQ ID NO: 4174614 - RNA, 57 nt, Human
acguccauuauugccagccauacugaaucccuuugauuccguggaugcaauaugcgu

SEQ ID NO: 4174615 - RNA, 79 nt, Human
acguccuccagggcagugacuacagcggccgccaccccagggcugcugagcaucagggcugcccuuggacccuggacgu

SEQ ID NO: 4174616 - RNA, 61 nt, Human
acgucuugacguggagagagcuggguuugcaaguguccaguccuucuccauuaaggcucgu

SEQ ID NO: 4174617 - RNA, 63 nt, Human
acgugcgccaauaaaugcacuggaaagcaauucacuuugauucaacauuuauugagcguccgu

SEQ ID NO: 4174618 - RNA, 56 nt, Human
acguguaacuucaaaugggaagaucccuuguccuuccugagaauagaguugcaugu

SEQ ID NO: 4174619 - RNA, 78 nt, Human
acgugugugcauuugugcaugcacaugugugugccuauucauuugcauguguuuugcaugcaucaugugcacgcaugu

SEQ ID NO: 4174620 - RNA, 88 nt, Human
acguguuuucauuugauucuaugagguaagcuauuaucccccauuuaauagaagucaauuuugccuucauggagugucugaaaacugu

SEQ ID NO: 4174621 - RNA, 76 nt, Human
acguuagggacaagugugucugugaguuccuaguuugcauaaccuggccuuguagaauugaaauggucucaaaugu

SEQ ID NO: 4174622 - RNA, 77 nt, Human
acguuucucaacuaucaagccucagaaucuucuccauucagcuagugaauaaggaaagagggaggguggaggauugu

SEQ ID NO: 4174623 - RNA, 130 nt, Human
acuaaaaagcauauagaagaaaauaaaaauuacucauaauaucuauacucagaguuaauaucuguugguauuuggguauguaucaucugggugggaguguggguaauuucccuucuuugugcuuugauau

SEQ ID NO: 4174624 - RNA, 73 nt, Human
acuaaaaggagguugaagcugucaggguuuuaugugacuuugaugacagguauuuuuaaggcuuccuuucugu

SEQ ID NO: 4174625 - RNA, 84 nt, Human
acuaaaggauuuucaguugugccggccccucugucuacuagauccccaggcagaacagcugcaaaacuuaaucuagcuuuuggu

SEQ ID NO: 4174626 - RNA, 120 nt, Human
acuaaauuugauuugcuucauuagaagaauugauauuucauucuacaugugcucagagugucuagaacuugugaaauaucaauguuauuucuuaguaauaagcagugauuuguaguuagu

SEQ ID NO: 4174627 - RNA, 66 nt, Human
acuaaccagcaguacucuaaugcacagcuccagugccacggcugaaguuugaaaugauugguuggu

SEQ ID NO: 4174628 - RNA, 61 nt, Human
acuaagaaguagcauuaucauuuuaccgaaaaaaggugcaggagauaauggugcuuagagu

SEQ ID NO: 4174629 - RNA, 65 nt, Human
acuaagggcugcuguagaagcagagcccacugcccuggccaugcucuucuauguagucucaaagu

SEQ ID NO: 4174630 - RNA, 89 nt, Human
acuaauaaccuguaugauuucuaguaugucuuuggaagguuuguaaacuuuccaaaguuaguuauuagaaaggagauaacauuguuagu

SEQ ID NO: 4174631 - RNA, 124 nt, Human
acuaaucuuagauuuuacaauaaugauguuauuuaugggagcaauuggggagguuacaauccacgugaccucugguuacaugacuccugauacauaaucuuaaccuuguggcuaauuuguuagu

SEQ ID NO: 4174632 - RNA, 70 nt, Human
acuaauggauuaacgucccugucgugugacauuuucugguaugacagcugaagauguugaaccguauggu

SEQ ID NO: 4174633 - RNA, 60 nt, Human
acuacacugcccuggggaucaagguagaggaacuaagggagugccuuagggcaguguggu

SEQ ID NO: 4174634 - RNA, 115 nt, Human
acuaccuaagaucucugcuaguaaauggcugaaugaucuggacuacaauucuuuggacucuuccuucucaggagauccuguagucucacagccccauagcugugaucuagguagu

SEQ ID NO: 4174635 - RNA, 55 nt, Human
acuaccuuaucugucucggacuaugaagucuuuggaagcuuucagagaagguagu

SEQ ID NO: 4174636 - RNA, 55 nt, Human
acuacugcacaccagcaaaagaaaaucccuaggaaguuaucuguguugcaguggu

SEQ ID NO: 4174637 - RNA, 55 nt, Human
acuacuuggccaaccuaggaugugccuaaggcaaaugcucuccuuggucaggagu

SEQ ID NO: 4174638 - RNA, 75 nt, Human
acuacuuuuaaaauaucagcacuuuugugguauaauagagccuauuaacaacaguuggcugacauuagagguagu

SEQ ID NO: 4174639 - RNA, 124 nt, Human
acuagaaagauaacagagccacuaucaaagagccucaaacuucaauuucagucucagagaguucucaacaggaugcucuggcuagaaauuauuaguucuuugcaagggcucggaguccacuagu

SEQ ID NO: 4174640 - RNA, 73 nt, Human
acuagaaaucuuuucaucucauuugaagccaugauuauaauugacuucacaggaggacugaaagauauuuggu

SEQ ID NO: 4174641 - RNA, 66 nt, Human
acuagaaucugauuacccuaugaauaauuuauuacuuguuuugguagacuguaaucaguuuguggu

SEQ ID NO: 4174642 - RNA, 70 nt, Human
acuagaauggaaagacuggagagugauuuuguaauuuuaaaacauuagauuuguuuuucuagccucuagu

SEQ ID NO: 4174643 - RNA, 63 nt, Human
acuagacccucugguuugcccuugggugcugcaguacuugucuagucuaccagagacuccagu

SEQ ID NO: 4174644 - RNA, 89 nt, Human
acuagccuggagauuuagauuccauuuaauucugcuggauugccauuucugcugucagucuacaaucuuaaaugaacuaguuccuuagu

SEQ ID NO: 4174645 - RNA, 88 nt, Human
acuagcugacuaucaggacauaugaguggcaaauaaaucaagaugugauucacauuauuuauggcccucaccugauauagggcuuagu

SEQ ID NO: 4174646 - RNA, 128 nt, Human
acuaggcaauuguuguuauuucccuguacacuauuaaaccugcucauuagggaugggugcauuggguaacccagggugacggcuagguuuaauagugugauuuauuaaacauuucauauuuaccuagu

SEQ ID NO: 4174647 - RNA, 85 nt, Human
acuaggcaugagaguagguauccacauugaggaggggaacucaguaaaagggugcuuuacucuaaaauuucuacuaugucucagu

SEQ ID NO: 4174648 - RNA, 106 nt, Human
acuagggcaaguaauuucagcucacauguccugggaaaauaacuggacuuggaucuaguuccugcccugaccauguggccuugaaaaccacucaccugcucugagu

SEQ ID NO: 4174649 - RNA, 75 nt, Human
acuaguagacuaauggacaccaucaugcuccuucuuauuuuuaaggaagcagcauaauugcuauuuuauccuagu

SEQ ID NO: 4174650 - RNA, 86 nt, Human
acuagugaauuuucugcugauucuuaaaugugguugugauacaacuaaaugaugacaguuagauauaaccccaggaaauguauggu

SEQ ID NO: 4174651 - RNA, 83 nt, Human
acuaguuaggaguuggguuaggugugaaguguguuauaauuguuauuucacucaguauaccauagguuucaaauuccucuagu

SEQ ID NO: 4174652 - RNA, 85 nt, Human
acuaucuccucaaaggucaaagacaguaacuuuuauuauuaagcuuuguagaagcuaauucaugucuuauggccagagugauggu

SEQ ID NO: 4174653 - RNA, 86 nt, Human
acuaugaaaucgacguguaaugagucacuuaccuuaaagagcuagaaaugcuuuuaagccaaagggaccauuacugauuaaauggu

SEQ ID NO: 4174654 - RNA, 56 nt, Human
acuaugaaucagagaaaauaagugaccugccuaaggucauccaguugguuuauggu

SEQ ID NO: 4174655 - RNA, 65 nt, Human
acuaugugguucagagaacccgucuagucugcccaacugcaacagagcauucugcacuacaaggu

SEQ ID NO: 4174656 - RNA, 110 nt, Human
acuauguuugccaggcuggucuugaacuccugaccucaugauccacccaccucggccucccaaagugcugggauuagaggcaugagucacugagcccggccugacauagu

SEQ ID NO: 4174657 - RNA, 65 nt, Human
acuauucagaaucaccagccuucaaguuacuauucagaaugugaaaagcguguguucuagguggu

SEQ ID NO: 4174658 - RNA, 130 nt, Human
acuauuuagcuuguguuccauuaagacuaccgagucaacuuugaucucaguuccucagagguagugcucauucuccaccuuggaacugaaguguuuuuguugugauggugaugguggcaguugaauuuuu

SEQ ID NO: 4174659 - RNA, 64 nt, Human
acuauuuuccauuacuuagaaaggaacugagaucaaaucaguuuuaaaucugugaugaaauggu

SEQ ID NO: 4174660 - RNA, 63 nt, Human
acuauuuuuaaguuccccuguagccuccagugcaccaaaugcagggcagaacauauagauagu

SEQ ID NO: 4174661 - RNA, 62 nt, Human
acucaaaggaugcugccgauuccaucagucaggugcaguuggcauuccugcauccuaugugu

SEQ ID NO: 4174662 - RNA, 63 nt, Human
acucaaauugucuuuugaaaguugauaaacuucagaucacaugucaagaagauaauuugcagu

SEQ ID NO: 4174663 - RNA, 73 nt, Human
acucaacaaauaaguggcacuuaaagucuuagcuuacagcuaagguccagugaaacuuuauuugguuuggagu

SEQ ID NO: 4174664 - RNA, 90 nt, Human
acucaagaaugcuuuucauccagccucaucaggagcugcugagaauggucccugagaagugaaacuuagauggggguggguaggcagagu

SEQ ID NO: 4174665 - RNA, 77 nt, Human
acucaagcaacacaguuuuccaaaauagagcauagucccugccauuagacuuauucuagaaagacuaugguuugggu

SEQ ID NO: 4174666 - RNA, 65 nt, Human
acucaaggcaaguuaacaaaucuguuugaacagcuguuggaacuagagcuuccagcuucuugagu

SEQ ID NO: 4174667 - RNA, 81 nt, Human
acucaaggcagagauauucuugaucucugugggaauaaucacaauuuaaccaaaguagcaaagaguaauuuuguuuugugu

SEQ ID NO: 4174668 - RNA, 76 nt, Human
acucaauagcgagguccauuuucacauaugauucugaugacauuaccuaaguggaaaaggauccucuuccuauagu

SEQ ID NO: 4174669 - RNA, 65 nt, Human
acucacagcaugagcuuggcagaguuccccauacccucuuucugucauuuggcuaccugugaagu

SEQ ID NO: 4174670 - RNA, 99 nt, Human
acucacaugguuagcuuguccacucuccugggagcaccauacuuguuucuucaagaacuaaagaaaagggaagugcugccccagaggcugacugugagu

SEQ ID NO: 4174671 - RNA, 87 nt, Human
acucacccuauucccuaccucaaguuggaaauaaaauguucaucuucagaugacaugugugacaacagaggugaguauauguugagu

SEQ ID NO: 4174672 - RNA, 72 nt, Human
acucagcacagugcauggccaauaaaaagcacucagucagcuguuguuaccauuguuaucauugugcugugu

SEQ ID NO: 4174673 - RNA, 67 nt, Human
acucagggcguccuuccccagcugagcccgaggggcagcggccggugaggaaggggagcucgggggu

SEQ ID NO: 4174674 - RNA, 71 nt, Human
acucagguuuacuuuaucauagaugauuaauagguguuacguguuaaauucgaugauggauaaacuguugu

SEQ ID NO: 4174675 - RNA, 77 nt, Human
acucaucucauagugcagugcuguaaucuacugacauuaccaaguuucuugacuacaguuuuucacugaagaugugu

SEQ ID NO: 4174676 - RNA, 58 nt, Human
acuugguugcuucugaaaugacacuuuaauuaauugaagaauguuagaggcaucaagu

SEQ ID NO: 4174677 - RNA, 76 nt, Human
acuuguagacuaacagaagaauuuauaagauaauucuauucuagguaggaaaaguaugaguucaguuaucuuaagu

SEQ ID NO: 4174678 - RNA, 120 nt, Human
acuuguagauggguucucuggagagauauggaagagccugggaauuuagcggcucaaaucagcuggcaacuggaguucauuuaggugauucacauacaauuuccggcuuuccuugcaggu

SEQ ID NO: 4174679 - RNA, 55 nt, Human
acuugucacaaaaucaccagugacuuuucaucacggucacaggcaggugauaggu

SEQ ID NO: 4174680 - RNA, 63 nt, Human
acuugugauucaauuaucugaugcuuuccauugugcaaaagagagcuuguaauugagucaggu

SEQ ID NO: 4174681 - RNA, 76 nt, Human
acuugugccaggugucauggauaauggguagcagagucaggaucuaaacccagagucauggcacuuagccaccagu

SEQ ID NO: 4174682 - RNA, 57 nt, Human
acuuguggccagguuuaucggcugucauccucaaaguuaagcaaucuggcggcaagu

SEQ ID NO: 4174683 - RNA, 64 nt, Human
acuuguguaacuugagcaaacacaagagaaauaagagguuucuguguguucagauacagcaagu

SEQ ID NO: 4174684 - RNA, 55 nt, Human
acuuguugaggaauguuuuccacagugcaguguuuuacauucccaucagcaaugu

SEQ ID NO: 4174685 - RNA, 87 nt, Human
acuuuaaauguauuagguugaugcgaaaguaauugcgguuuuugcaauuacguggcaauaauuuuuucaccaaccuaauaacugagu

SEQ ID NO: 4174686 - RNA, 102 nt, Human
acuuuaagaauauuugccagaagugacucugcauuuuauggaucuaaguaaaucuuaagugaccuuggaauuuaguagucuucccuagcaaaguaagaaggu

SEQ ID NO: 4174687 - RNA, 73 nt, Human
acuuuaauuaagagaugcuuuucuaaauaauuaguauauauuuuuguuugguuguagcauuucuuuuugaagu

SEQ ID NO: 4174688 - RNA, 98 nt, Human
acuuuagucugaaacauuuacugcuacuauuacauuuugcaauuacagugaagugaggcagaaaauagcaguucaaaaauguauucaaguaaugaagu

SEQ ID NO: 4174689 - RNA, 58 nt, Human
acuuuauacacugaguuuagaaccucuaugugagauguuauucuucaguguguugggu

SEQ ID NO: 4174690 - RNA, 64 nt, Human
acuuuaugugcuugcucuuuccuugauaacaugaacauuguuauagagugcaguauguagaagu

SEQ ID NO: 4174691 - RNA, 92 nt, Human
acuuuccaggugucacacagugaguggcauaaucagaguacaauuugagucaugcccauacaucacauugccagugauuacccaaggaaagu

SEQ ID NO: 4174692 - RNA, 78 nt, Human
acuuuccuggcagugugacccuggacagaugcuuaacuucucugugccugucagguuucccaucugcaaaaugagggu

SEQ ID NO: 4174693 - RNA, 66 nt, Human
acuuucgggcaucuuuucccuucuacuaaucaugaaaacaagaggggcaaaugugagccuggaagu

SEQ ID NO: 4174694 - RNA, 56 nt, Human
acuuucuauuguuuagauucugaaauagaguuuauagaaucugagaaauggauagu

SEQ ID NO: 4174695 - RNA, 57 nt, Human
acuuugaucuaaguuucuuugauuuaacacugcaauuaagaagauuugguucaaagu

SEQ ID NO: 4174696 - RNA, 98 nt, Human
acuuugauugauucugaaaauacacauacuaggggaaagcugacauuucacuuucaaaccuacuuguauguuuguuuugauauggagcccugcagagu

SEQ ID NO: 4174697 - RNA, 56 nt, Human
acuuugcagagccagaagagaagaauuagauuuauuccuccuuucguucugaaagu

SEQ ID NO: 4174698 - RNA, 57 nt, Human
acuuugccccaggucucaugacuagcaaaccccagagcuaagaucugaggcuaaagu

SEQ ID NO: 4174699 - RNA, 82 nt, Human
acuuuggcuguuguacagauuagcaaugagagucugaauauagaagauaaaucugauucauucaugugcaccagccccaagu

SEQ ID NO: 4174700 - RNA, 66 nt, Human
acuuuguauaaaguccuugaaccggauguauguccuccauguacauuucauuauggggcacagagu

SEQ ID NO: 4174701 - RNA, 65 nt, Human
acuuugugcccaacagaaagaagaaauaacaucuauuggcucuuucacauuguggggggcauggu

SEQ ID NO: 4174702 - RNA, 58 nt, Human
acuuuguguuacccagcaaggacuaaccaagguuuccuucugaaaaaugcacacgagu

SEQ ID NO: 4174703 - RNA, 55 nt, Human
acuuuguuuggcuauuagagucaagauauucuucucuagugugcucagucaaagu

SEQ ID NO: 4174704 - RNA, 72 nt, Human
acuuuuaaaacuucucauuuuuauggugaaaaagucauaaauuuauucugaauuugugaaguuugaaagagu

SEQ ID NO: 4174705 - RNA, 60 nt, Human
acuuuuaaaugaguuucaguuguagaguuagaaugcaacugauucuugaaguugacaagu

SEQ ID NO: 4174706 - RNA, 70 nt, Human
acuuuuaccuuuggaagggacccuuagugaaggucuugucuuuucaucuguagcaucuuccaauaaaagu

SEQ ID NO: 4174707 - RNA, 104 nt, Human
acuuuuacuuuacugccuagcauauuaguuuucaguaaauauuagugaucugcauuuuacacauggguccuaugugcuuacugaagauggcuguaucuuaaagu

SEQ ID NO: 4174708 - RNA, 103 nt, Human
acuuuuauauaccaucgaauguuauuacacuugugaaauucuccugucuaaccugaauuuacauuccauggugguuacaugguauauguauuauuauuaaagu

SEQ ID NO: 4174709 - RNA, 72 nt, Human
acuuuucaauuguuuaaaaugaacgaugaagcacaaaauccagccucauuaugcaaagaacacuugagaagu

SEQ ID NO: 4174710 - RNA, 92 nt, Human
acugcuacauggggagacauauauacauauauguaggaguacaccuaugugugcauguguguguauuuauaaaucucucuccauguagcagu

SEQ ID NO: 4174711 - RNA, 55 nt, Human
acugcucaugaggaccuuucauuugucuuuuaaagauguguggguuuagaguagu

SEQ ID NO: 4174712 - RNA, 77 nt, Human
acugcuccccuccccacuguguugcagucuagugcuucaggaguugacuguaaguccacggauggacuuugagcagu

SEQ ID NO: 4174713 - RNA, 56 nt, Human
acugcucuguuguuuguuucccuuugcuucccugcugcaagcagacagcagacagu

SEQ ID NO: 4174714 - RNA, 100 nt, Human
acugcugccuugucggaaggaaaggugcuguuuggucucuucgcuggcauccccaucuuuaggaauuccagcccaaacaagccgccuuccaauuagcagu

SEQ ID NO: 4174715 - RNA, 91 nt, Human
acugcugguuggaucaggguuucugcugccaccugggcacaugcagcccacccuaucuggcagcagacaucugaggucuaaccucagcagu

SEQ ID NO: 4174716 - RNA, 92 nt, Human
acugcuguauuuaucuauuguauuguugauggacaauuaggauuaguucuucuuucuuggucuuaacaaacaguguggauauaaacacaugu

SEQ ID NO: 4174717 - RNA, 106 nt, Human
acugcuuaacuuguauuagggagucugaagauggaggaacuuagaauuugaucaaguaaucuaagugcggccguuuaagcacucucaaguugaauauuggaguagu

SEQ ID NO: 4174718 - RNA, 116 nt, Human
acugcuucuugcuucaggguuugcugugggcaguacauaagcuacuugacccaauacucaugugaaaguuuauucugcuuggcccucccaguugccuugcagacauccaggagagu

SEQ ID NO: 4174719 - RNA, 104 nt, Human
acugcuuuauacugcuuugcugccauuauauuuuacugcaugggaggaccacaaucuauuuuauuuauuagugaagacauagucaguuuccaguuauaagcagu

SEQ ID NO: 4174720 - RNA, 57 nt, Human
acugcuuugucuuauauugaugaaauuuucagaugucaaaaagcugggacaagcagu

SEQ ID NO: 4174721 - RNA, 56 nt, Human
acuggaaaaccacugaaaugagcccaugaggcacauguguuuucaguauuuucagu

SEQ ID NO: 4174722 - RNA, 77 nt, Human
acuggaacagcuauacugacagaguuguaaauauuucccuuugaaaucacaacaguccaguauagacugucucuagu

SEQ ID NO: 4174723 - RNA, 89 nt, Human
acuggagagagguaggguuggguacuggggcaaguuuagccaagggaacuauacaaaccugcccagacucagauccuagcucugccagu

SEQ ID NO: 4174724 - RNA, 100 nt, Human
acuggagguauugguuggugcaaaaguaauugugguucuugccauuacuuucaauggcaaaaaaacacaauuucuucugcgccaaccuaauaacuguagu

SEQ ID NO: 4174725 - RNA, 90 nt, Human
acuggagucacacacagcucugguccuuuagagagguauagaaaugagcacagcuucucuagcaaaaccagcuaguagugagguuccugu

SEQ ID NO: 4174726 - RNA, 76 nt, Human
acuggauuuaugaacauauuucucaagaaugucaagaaagaauuguacaaucugaugauguauggugaguuucagu

SEQ ID NO: 4174727 - RNA, 101 nt, Human
acuggcaaugaacucuaguggcuucauggcaagucuuaguaucuuugaagagugauagacuauuaggacuuuguugaacccuguaagguaacauuacuagu

SEQ ID NO: 4174728 - RNA, 60 nt, Human
acuggcagagacccugauggccaaggaguccacccagggccaccggaguuauuugcuggu

SEQ ID NO: 4174729 - RNA, 78 nt, Human
acuggcagguaaaggaggaauaaagagguggugaagacauauuuuuauccugcuuuguuccucuugagcacuacuagu

SEQ ID NO: 4174730 - RNA, 75 nt, Human
acuggcugauggaaggacaggcgccgugaugguuaaguguguccauguuggcuaccugauuucuuuucagccagu

SEQ ID NO: 4174731 - RNA, 87 nt, Human
acugggaagcacauuuuauugucuguauugccuauaguucaccuuuauauaauagacagaaagauaauagaauaacuccuucuuggu

SEQ ID NO: 4174732 - RNA, 82 nt, Human
acugggagggagcugcugacacuuuauuaagcuguuguuuugcuuaaauugcaguuaucuaaagugacacuuccccuccagu

SEQ ID NO: 4174733 - RNA, 99 nt, Human
acugggcggcccacccacuguccgugcaguggaggguguggcugugccugguucacccgcaggugggcccuucauugauggagagcaggugccccgagu

SEQ ID NO: 4174734 - RNA, 58 nt, Human
acugggggaggaggugguuugcugacgaucaguagcauuuccgcccucuucugccugu

SEQ ID NO: 4174735 - RNA, 80 nt, Human
acuggguucuagagggaccagaacauacuguguucccucgcaguuccccacaguauguucuggucccucuggaacccugu

SEQ ID NO: 4174736 - RNA, 66 nt, Human
acuggguuuaggccgggcaggcccaggccugguuucgggccuggcgccgggcugccugucuuuggu

SEQ ID NO: 4174737 - RNA, 82 nt, Human
acugguagugggagaaggugugcagggccaaaguuugaccaauguccagcauccugcuugcugucugugaaucacugccagu

SEQ ID NO: 4174738 - RNA, 58 nt, Human
acuggucuugggaagcaggcaguuuaaugaacaacucuuuugauuucacaaggccagu

SEQ ID NO: 4174739 - RNA, 59 nt, Human
acugguguaugugcucaauaagcauuugaauaguaaaugaaugaaccacauauaacagu

SEQ ID NO: 4174740 - RNA, 68 nt, Human
acuggugucaggaaaaucucaguguuaaucaacuguagaacuacuggguucuuccuggcacagucagu

SEQ ID NO: 4174741 - RNA, 118 nt, Human
acuguaaccaaaagaguaugucccauguuugcaaaaugaggugaagagucuauuuugacucaucgggugguuuuguauugcaaugggaauuauaucucucuguuauaugaguuacggu

SEQ ID NO: 4174742 - RNA, 76 nt, Human
acuguaacuggaugguuauauguaagguaccucuaagcuguagcaccuuaggauuucccauauagcuccauacagu

SEQ ID NO: 4174743 - RNA, 60 nt, Human
acuguacuguguauuguagaauguuuaguagcaucccuggccacuacccacuaguacagu

SEQ ID NO: 4174744 - RNA, 66 nt, Human
acuguagguuccuggagggcagggucaugugucacucaucucuguguccucaggaccuggcacagu

SEQ ID NO: 4174745 - RNA, 69 nt, Human
acuguaugccuucugugcuccaggcaauaugcucggguuuuggagacacagagcaacaaaauauacagu

SEQ ID NO: 4174746 - RNA, 112 nt, Human
acuguauuucucuuuugguaaucuguacuucuaauuugaauuugaauauuguacaagucaaauauacuaagagguaaagauugcagauaaaagagcaaauuuucccagcagu

SEQ ID NO: 4174747 - RNA, 64 nt, Human
acugucacccgggcuggagugcaauggcucgaucucggcucacugcaaccuccaccuccccagu

SEQ ID NO: 4174748 - RNA, 57 nt, Human
acuguccgggacaggcccauccagagacagggaggggaugugugggugucggggagu

SEQ ID NO: 4174749 - RNA, 65 nt, Human
acuguccuucagcuuuaucugaacacccccauaacaaugugugacuaaguggaguugaggacagu

SEQ ID NO: 4174750 - RNA, 63 nt, Human
acugugacgugccuuauggagagaauaugcguguuaguaagcuuuguucaggcaaguuacagu

SEQ ID NO: 4174751 - RNA, 59 nt, Human
acuguggcagggguuuucugacuugagucuccaacucugguccugccuccugcaauggu

SEQ ID NO: 4174752 - RNA, 77 nt, Human
acugugguagguccuggggauacagaagugaaucagaaaugguccuucaguuaaagaucucacagccuugcugcagu

SEQ ID NO: 4174753 - RNA, 57 nt, Human
acugugucuaucuaggcuguaaguccccagggcucagcacagggcuggcaucccagu

SEQ ID NO: 4174754 - RNA, 87 nt, Human
acugugugggcugagagcaguguuuuuaaccagucuuacuauccugaggggagugguuuaaccugucucuuauuaacucauagcagu

SEQ ID NO: 4174755 - RNA, 67 nt, Human
acugugugugggaguuagagugugguaaucaaucaguaaguccucaccuggcacauucuaccacagu

SEQ ID NO: 4174756 - RNA, 61 nt, Human
acuguuacaaaguguuaugauaaacauuucuguguauuugugcacuucuguguguuacagu

SEQ ID NO: 4174757 - RNA, 55 nt, Human
acuguuauaguucacuuuucccuuguuuaugaggacuaguguuaucuguagcagu

SEQ ID NO: 4174758 - RNA, 65 nt, Human
acuguuggcuuggcucuaggugccaugucuaucuuuaguaccuagcacagugccaggcacacagu

SEQ ID NO: 4174759 - RNA, 63 nt, Human
acuguugguugugaagguuaagugcaaaguucuuuaagcaggguauuacacacaaugagcagu

SEQ ID NO: 4174760 - RNA, 96 nt, Human
acuguuuccgagaaugagacugucaaguggcaggaauuaagaguuggauuugcagcuccucuagaucugccacuugaauuccauuuuggggggagu

SEQ ID NO: 4174761 - RNA, 67 nt, Human
acuguuugcugauagauauuuaaagguuauuuuuuauuaaugaugggaauaguucuguggcagcagu

SEQ ID NO: 4174762 - RNA, 81 nt, Human
acuguuuuuguuggauguaugcuuuuaugacaauuuccacauaaacuuccaguuacagguauuuuauugagcagagacagu

SEQ ID NO: 4174763 - RNA, 59 nt, Human
acuuaaggaaaauggacaucaaacaguuaauuuguuuaggugccuguuuucuugaaagu

SEQ ID NO: 4174764 - RNA, 67 nt, Human
acuuaagugaguuauuugaaaugccucuagacaacugugaccagaaggcuaaaguaacuuaguaggu

SEQ ID NO: 4174765 - RNA, 84 nt, Human
acuuaauacaagaaacuacaugaaugcauaauuaagauauucauuagucugucuuguaucugauguggauuuuuugcauuaagu

SEQ ID NO: 4174766 - RNA, 112 nt, Human
acuuaauuuuauuaauucaagaaaguuugcucuguuuuccguaugugccagaaaugaucaugguucauugagaagacugaagggaacuuugcugaauaaaccuuuauuaagu

SEQ ID NO: 4174767 - RNA, 94 nt, Human
acuuacaauaggauuaaguuuggauaaacucacuguaaguugaaagugaauuuucaacuuacaauagguuuauggggacaacacugucauaagu

SEQ ID NO: 4174768 - RNA, 65 nt, Human
acuuaccuggaacuuggucauuuuuccccuccuccuucugggaaaaggcagaguuccggggaagu

SEQ ID NO: 4174769 - RNA, 66 nt, Human
acuuagagugcuuuauuagauguagcuuggagauuauagggugccacuaaagaaccacucccaagu

SEQ ID NO: 4174770 - RNA, 71 nt, Human
acuuagaugagcaguagguucauggcugauauuuuaguccuguauauuagaaugaggcuguuucucuaagu

SEQ ID NO: 4174771 - RNA, 91 nt, Human
acuuagugaacuuagugcacuuagugcucuaaguuuaccaaguuuaccauuuauuguacuuaguguacuuagugcucuaaguuuaccaagu

SEQ ID NO: 4174772 - RNA, 72 nt, Human
acuucaagaguuaugaaagcaaggcauuuucaaaaaucaaaagaaaaugaggcuauuucauagauuuuaagu

SEQ ID NO: 4174773 - RNA, 77 nt, Human
acuucaagauuuuccucgcucugcucugcaggucucuccuuuuucuggggguuaagugaggacaaguucuuugaggu

SEQ ID NO: 4174774 - RNA, 64 nt, Human
agagugguucuugaucuguagaguugaugugagucuuacaugagaaagaaccugcaaaagcucu

SEQ ID NO: 4174775 - RNA, 67 nt, Human
agaguuagagccauagagcacggguuaugucuccccuacuucuguaaccccuuuagucucuaacuuu

SEQ ID NO: 4174776 - RNA, 55 nt, Human
agaguuaucacuccaugcagcucucuccucucugaugcuguacccugaaaacucu

SEQ ID NO: 4174777 - RNA, 61 nt, Human
agaguugaaagugccaaguccuagugguuuugagaagccucuggucugcucuuucugcucu

SEQ ID NO: 4174778 - RNA, 78 nt, Human
agaguugaaaugauccugaguuccugccucuaaaugacaaauguauuuauaugaaagugaccaguggacaucaacucu

SEQ ID NO: 4174779 - RNA, 58 nt, Human
agaguuggggcaccaccguguuccuuguaguacaaagcaccugugauuuccuagcucu

SEQ ID NO: 4174780 - RNA, 79 nt, Human
agaguuuaaagcauacauauuuucucaagggauguuaggaagauucaagaaaugaucuaugugaacugcuuuaagcucu

SEQ ID NO: 4174781 - RNA, 57 nt, Human
agaguuuauggauuagaguuugauucuuuuaugaggcucagcaucugauucauaucu

SEQ ID NO: 4174782 - RNA, 71 nt, Human
agaguuucagaccuagacaucaaggcaucaagaggccaugaggcuucuguuuucauuugucuugagacucu

SEQ ID NO: 4174783 - RNA, 56 nt, Human
agaguuuuaugccauaaaacuggauacguuuauucuguaagaugggauaagacuuu

SEQ ID NO: 4174784 - RNA, 55 nt, Human
agauaaaaguauguguacacuugaaauuucuacaaagugcauauacugccuaucu

SEQ ID NO: 4174785 - RNA, 76 nt, Human
agauaaaaugguucaaaggcuauuuucaccaccuacuagacaaggugguuauuaacggccuuuguuccuuuugucu

SEQ ID NO: 4174786 - RNA, 97 nt, Human
agauaaaggauagaguccagagaauuuuagacaaaaaucacucuguuaauucuauuaugguaauauuuaagucugaauuccugguuugacuuuugcu

SEQ ID NO: 4174787 - RNA, 59 nt, Human
agauaacauuuauugaauguaacuagugugcuuggcauguuacagaaaugauguuauuu

SEQ ID NO: 4174788 - RNA, 71 nt, Human
agauaacugugugucaugcauuacuuccacccacaucccaauggcuaaaaugcaugugcauggcucuaucu

SEQ ID NO: 4174789 - RNA, 56 nt, Human
agauaaguaguaaguauguaugccuugaagccaucaggcugugacuuacacuaucu

SEQ ID NO: 4174790 - RNA, 95 nt, Human
agauaaucuccuugucagggauucauugaagcccuugacaagccuuccuuguaguuaggcuuuuauccauuucaguuuucuugauuagguuaucu

SEQ ID NO: 4174791 - RNA, 63 nt, Human
agauacaaaagauaagauuuagcaguuuauucuuugguagguuguaagaggucuuuuguuucu

SEQ ID NO: 4174792 - RNA, 66 nt, Human
agauacauggaacgucaaaccugggcccuucucccaaugccccuggaauugauuacucuauggucu

SEQ ID NO: 4174793 - RNA, 78 nt, Human
agauagccauaugucuacugcuuucuguaaggacagucacguuugcacagagacaggcagacagucuugauggcaucu

SEQ ID NO: 4174794 - RNA, 112 nt, Human
agauagggagagagauugaucacaaaguuguaauucaaucuguagauugugauguuuaugauaucaucaguaucaugagauuaaauuacaaguugcaaucuaucuuccuucu

SEQ ID NO: 4174795 - RNA, 69 nt, Human
agauauaaauuucaugguccaacuaguaagcacccuauuuugcuuuuaaggaaugugcaguuuauauuu

SEQ ID NO: 4174796 - RNA, 58 nt, Human
agauauagcugagggguauuauaauuuagcagaaauuuaaucuuccuacagcugaucu

SEQ ID NO: 4174797 - RNA, 58 nt, Human
agauauaguuguugagaagaacugggaugccccccagauuuucuuaaauuuuauuucu

SEQ ID NO: 4174798 - RNA, 58 nt, Human
agauaucaccaguuuuacauacacuuguguguguguguguguguguguguguguauuu

SEQ ID NO: 4174799 - RNA, 95 nt, Human
agauaugaaguuucguuaauaguauuuuuccaaaguuaauuuccuaguauuaggggaaaaugagugaagaguauauuuagugaaaucucuguacu

SEQ ID NO: 4174800 - RNA, 80 nt, Human
agauaugaugauaaaguauuuggcacuugggucaacaaucuaguuuauucaguaguucagcaaauauuuuaaauauaucu

SEQ ID NO: 4174801 - RNA, 84 nt, Human
agauaugggccuagaggucgauaucugggccuggaguggagauaugggccaggaguggagauaugggccuagaggucgauaucu

SEQ ID NO: 4174802 - RNA, 56 nt, Human
agauauguuacugcaucaugggguuaaacaauuuccagaaaacaguaagaaugucu

SEQ ID NO: 4174803 - RNA, 55 nt, Human
agauauuucacugaaucuaucucucuaagguugagaguaggcaaaggaaagaucu

SEQ ID NO: 4174804 - RNA, 88 nt, Human
agaucaaugacuauuuuauuugcucaacccugccuccaguccauggcuguggccuccaucaugaaguagcuggaaugauuaaugaucu

SEQ ID NO: 4174805 - RNA, 102 nt, Human
agaucacaauguauucaguuuggcaggagagcagggcacuugugggaaggagucagagguguccuugcaguuugaagaaagaaguuugagaaauugugaucu

SEQ ID NO: 4174806 - RNA, 71 nt, Human
agaucacuugaccuguaauaugucaugccugugguggaauauaaggcucugugaccuuaggcaaguuguuu

SEQ ID NO: 4174807 - RNA, 84 nt, Human
agaucagagcuguuaagagggagugacaggugguguaugcauccccaggcccugacucacuaaauucuaaauggcacuuacucu

SEQ ID NO: 4174808 - RNA, 90 nt, Human
agaucagcaacgccaggcugacucccccggccuuaucuucuuggccugcccauuggcccaggugggggacucaacugcgcugcugcuucu

SEQ ID NO: 4174809 - RNA, 95 nt, Human
agaucauaggggcaaaaugggagugcaggaguaggagagggcuuucugggaaagauacuuauuuuaauuuugcaugcauugaguuuuugagguuu

SEQ ID NO: 4174810 - RNA, 81 nt, Human
agaucauuuauuaugucaauuuauugacuuugguguuccuagaauaugaaaguaguauaaaauucaugugagggaagaucu

SEQ ID NO: 4174811 - RNA, 97 nt, Human
agauccaccaccacuuauugaaaagcccguccuuucuccacuguucugcaauaucaacuuugucauaauaaaccaggaugggucuguuucuggauuu

SEQ ID NO: 4174812 - RNA, 74 nt, Human
agauccaucaucauauuuucuauauggcauauagucaaaugcauuaucacuccuggaagauguguggugggucu

SEQ ID NO: 4174813 - RNA, 63 nt, Human
agaucccaggauacuggccuauaaugcugagaaaggaaauagugucagagaaucuugguuuuu

SEQ ID NO: 4174814 - RNA, 73 nt, Human
agaucccaucgugaaugugauuuaacugugaugauuaauuuaacuugcaguuuucuuguuauauuugggagcu

SEQ ID NO: 4174815 - RNA, 98 nt, Human
agauccuucacugcacuccuaagagcugagccucguauucaaaucugaaugaaucagguucugauucagucucuucaggagaauugucugagagaucu

SEQ ID NO: 4174816 - RNA, 81 nt, Human
agaucgaucagcaaauagaugggccuccccguauucugaauuacaguguguguuugggcgguuuauugacaguugauaacu

SEQ ID NO: 4174817 - RNA, 99 nt, Human
agaucuucaaaaacacuuccaugaacuuucuuuacaguuuugugcuauucucuuucuaaauuugccaauuguaugugguaagguugauggugaggauuu

SEQ ID NO: 4174818 - RNA, 69 nt, Human
agaugaauuguuauggcuacgagaggcauaaagacuuacagaaaauuguccuguagauagcauucguuu

SEQ ID NO: 4174819 - RNA, 76 nt, Human
agaugagaaaaucguuagcauuuugcuauugcaguauuuugacaccagcagcagcaacaauagcggucacucguuu

SEQ ID NO: 4174820 - RNA, 70 nt, Human
agaugagucaacaaauacuuaaagcagagagcuuaguuccuguuccuauggauauuuguuuuucucauuu

SEQ ID NO: 4174821 - RNA, 63 nt, Human
agaugauauacuacauggcuucaaagaaguuuccuaucuauuggcuucaaagugugaucaucu

SEQ ID NO: 4174822 - RNA, 62 nt, Human
agaugauuaugauagcacuguucuaggcacuuuauaugaagaagguacuauuauugucaucu

SEQ ID NO: 4174823 - RNA, 76 nt, Human
agaugcaacacucuuuccuuguuauuauuuguccugauauguaggcaauuaucaaauuaggcaaguuuguuguucu

SEQ ID NO: 4174824 - RNA, 77 nt, Human
agaugcagaaaaacuaagugauuucucuaagaugacauggccacccggagauucuauccucaguguuucugacaucu

SEQ ID NO: 4174825 - RNA, 78 nt, Human
agaugccaucaagacugucugccugucucugugcaaacgugacuguccuuacagaaagcaguagacauauggcuaucu

SEQ ID NO: 4174826 - RNA, 83 nt, Human
agaugccuucuuuccagcaggaauuacucugacagcggggcuggugucaucaagaguaauuucugcugaaaagguuccaaucu

SEQ ID NO: 4174827 - RNA, 58 nt, Human
agaugcuaagaucauaguuuaaaauccauagcuuugggcugccucuuucuuagugucu

SEQ ID NO: 4174828 - RNA, 57 nt, Human
agaugcucacccugggcugaugagucacucuggcuuccaguccaggcugcagcaucu

SEQ ID NO: 4174829 - RNA, 92 nt, Human
agaugcuugggcaguaaucagauggcagucaaccaggugaggagguaacagaucuucaaugaaauuccaucagaaaaauugcuugaucauuu

SEQ ID NO: 4174830 - RNA, 70 nt, Human
agauggaagagaguuguuucugugcagugacaugcuagauucacaugacagacagcuucucauuuuauuu

SEQ ID NO: 4174831 - RNA, 79 nt, Human
agauggaggacuguagguaaaagcaucuaguguaugauggccauagcagauguucgauagcuuaauuacuccucccucu

SEQ ID NO: 4174832 - RNA, 68 nt, Human
agauggaugaguguugacagccaagccuaugcccaauacaaaggcuccuucacagcacucgcccaucu

SEQ ID NO: 4174833 - RNA, 87 nt, Human
agauggauuaauuuaguggaguauuccagucugauggguacuuucucaauccguuuauuuugaagauuccacugauuucugaccucu

SEQ ID NO: 4174834 - RNA, 75 nt, Human
agauggcacgaggggcuggguagggcaacccccuucauaaaguggagguugacauucaguuccuugccaccauuu

SEQ ID NO: 4174835 - RNA, 77 nt, Human
agauggccaccaagugcaaauucugaauucuuauauuuuuauaagaggaguagaugugguugguaaaagguuaugcu

SEQ ID NO: 4174836 - RNA, 83 nt, Human
agauggcccagaaaugccacugacaagcaugaaauacauuaaaccaaugcaucuuuucauagcagucccuuucugggucguuu

SEQ ID NO: 4174837 - RNA, 92 nt, Human
agauggccuuucuaacuugguuaaguguucauuccauuugaaucugauaggaaugaaacucuaacuuaacaaguuuuggagaaauaacaucu

SEQ ID NO: 4174838 - RNA, 62 nt, Human
agaugggguuccucaguuuagauuuuguguauaugacacuaucuaaaaggagcucuuuaucu

SEQ ID NO: 4174839 - RNA, 60 nt, Human
agaugggguuucacuguguuggucaggccggucucaaacuccugaccucgugauccaucu

SEQ ID NO: 4174840 - RNA, 69 nt, Human
agaugguaagggauuugaacauagguuaauccauugcuguuaggaucaagaccagaucccuuaccagcu

SEQ ID NO: 4174841 - RNA, 64 nt, Human
agaugguagguaacacauggaacauuuacauguuuauguaaaugaaguaugcuuuacuuuaucu

SEQ ID NO: 4174842 - RNA, 78 nt, Human
agauggugcugacugaggauggcuuggcaggguuacucccugggcuuuaccuggucccugaguaguuaugcagcaucu

SEQ ID NO: 4174843 - RNA, 56 nt, Human
agauguaaacucucaugucauuggccaccuaaagccaaacacagaguauuggaucu

SEQ ID NO: 4174844 - RNA, 63 nt, Human
acuuugaaagccuuggccccggcuuaucauuuuuuccauucuuaggccaaggcuauuuguagu

SEQ ID NO: 4174845 - RNA, 84 nt, Human
acuuugaaauggaagugaaaauucuaccuuguaagauaaaagagauuaggaugaggagauguuuucuaauucuauauuuuuagu

SEQ ID NO: 4174846 - RNA, 58 nt, Human
acuuugaacuggggaaguguucaaagacuagcaaugguuugggcaucauucacaaagu

SEQ ID NO: 4174847 - RNA, 127 nt, Human
acuuugcaucuagaaucaccuggagagcugaugaagaaugcggagucccaggcuccuggaggugggaggggccugggccuuuguguuuugaccaagugccccaggugauucuguuaaagaucagagu

SEQ ID NO: 4174848 - RNA, 57 nt, Human
acuuugcccuacagcagcucugccuccccauguaugcugcugagguggaggcaaagu

SEQ ID NO: 4174849 - RNA, 56 nt, Human
acuuugccuacaagcccauggucaguuaauagaagaccugggcuugaaagcaaggu

SEQ ID NO: 4174850 - RNA, 75 nt, Human
acuuugcuuccaaauguucauuugacaaguagugaugcauugaauauccuuguacaugugagcaugcaguaaagu

SEQ ID NO: 4174851 - RNA, 82 nt, Human
acuuuggaauugaugccuggggccugucaccagaaauuaauuggugccagugggucucaggauauuuaaaaguuccccaagu

SEQ ID NO: 4174852 - RNA, 69 nt, Human
acuuugggggaagaauuaaaacaagaauggcauuucuuuuucuucauguaacuuuucuucuccauaggu

SEQ ID NO: 4174853 - RNA, 80 nt, Human
acuuuguaaaugauuagaauaugucagucauaaucaugccaagagauuauggauuuaugcauauuuuguuuugcuguagu

SEQ ID NO: 4174854 - RNA, 84 nt, Human
acuuuuaaauuauaaaauucucuacugugcuaaauuucggagggaaaugaagcagcaaaagagaauaguuuguggucaaagagu

SEQ ID NO: 4174855 - RNA, 87 nt, Human
acuuuuaugcuggccauguugccucugagacuauuauaagcuuucauauaguaaggaaaauggcagaaugguuauugaauagacagu

SEQ ID NO: 4174856 - RNA, 104 nt, Human
acuuuucagguacuccauauuaaaugaucaaaaagagagaaauauauugcagcaguucucaacagcaagaugguuuugucuuuaugauucuguagccugauugu

SEQ ID NO: 4174857 - RNA, 115 nt, Human
acuuuucauuaacuuaaaagacgaacacagguggcagaguauggugauuauaugcugucccucauaagcucacauucaaaucugccuucuaucuuuugucuguguuaaugauugu

SEQ ID NO: 4174858 - RNA, 87 nt, Human
acuuuugcaauuuuuuuucaaaguuuuggggucuugcaaacacauugcuacagcuccugccagggccuuggaagaaaccuuagaagu

SEQ ID NO: 4174859 - RNA, 55 nt, Human
acuuuugccuuaaacagauggggucugucggaucccauaauuuuguuucagaagu

SEQ ID NO: 4174860 - RNA, 119 nt, Human
acuuuuuaaaaauuacucuauauaaggauauugguuaauuuugguugguguauuuuuauaauauacacagccauuaugaauuagguuuauuuucaguaguaguuauugauguggaaagu

SEQ ID NO: 4174861 - RNA, 67 nt, Human
acuuuuuauaugaaggauagugcguuugaacuggagcaguacacaagcuuucauguauucagagagu

SEQ ID NO: 4174862 - RNA, 71 nt, Human
acuuuuucucauacaucucauaagagcagugguguugcugaggccugauugagauaguauauggaaagagu

SEQ ID NO: 4174863 - RNA, 63 nt, Human
acuuuuucugcaguguuaacaaugucaucuucauuggugguaucguguuggcacucaguaagu

SEQ ID NO: 4174864 - RNA, 55 nt, Human
acuuuuuuucauguuaagagcaagaaggcuuuuguucuuggagcaggcagagagu

SEQ ID NO: 4174865 - RNA, 79 nt, Human
agaaaaacauaauuucuguaucagcaccaugcgcuaaccaauugcgccacuggagcuccacuggaaaaauguaauuucu

SEQ ID NO: 4174866 - RNA, 78 nt, Human
agaaaacaggcaaggaggcacugagggagaaagacacagacuuuaucgcucuguggcucauuguuacuggaauauucu

SEQ ID NO: 4174867 - RNA, 117 nt, Human
agaaaacuaucaauaguugagagagcuaaaguggaagucguguuuuaaggauucauagaguagagguguggagaaacaggcuuccauuagagcaaaacaagugauuuaaauguuucu

SEQ ID NO: 4174868 - RNA, 59 nt, Human
agaaaaggaaccaguaguaagcuuuaugagauagcuuaacaaagcucuguuccuuuucu

SEQ ID NO: 4174869 - RNA, 63 nt, Human
agaaaaggcagauuuugaggcuaccccagaaauccugcagcaggcccaggaauuugcauuucu

SEQ ID NO: 4174870 - RNA, 130 nt, Human
agaaaaguauuagaugaugcugacaacugcugaguuuccaaaucuugcagauauuuggguaguauaaaucuggagaaguuuguacauucaaaugucccaucuucaggcaggcauuguacaauauuuuugu

SEQ ID NO: 4174871 - RNA, 60 nt, Human
agaaaaguuuaaaucuuggcacucucuucucuuugagaaugcagagauuuuuacuugucu

SEQ ID NO: 4174872 - RNA, 91 nt, Human
agaaaauaguagauugaucucauauaaaggccauuuggauguagacugggcuccagaugugauacgaucaggguuucugcuuaggguuucu

SEQ ID NO: 4174873 - RNA, 86 nt, Human
agaaaaucaagaugagcugugauuaauaaguagggccugauuauuggaacuuggcauuggauauaauuaaguugaucagaauuucu

SEQ ID NO: 4174874 - RNA, 63 nt, Human
agaaaaucauguuggcacaauaaaaccacucuugguguuuguuuuuccaauauguaugccucu

SEQ ID NO: 4174875 - RNA, 130 nt, Human
agaaaaugaaauuuuccugguaaagauggaggaaaaagaaaugcuggcuuguugagaaaaugaagcuuccaagaguagcaaauucuuuuaucuccuuguucaugcuuuuccuuuguucaguaaaauauuu

SEQ ID NO: 4174876 - RNA, 92 nt, Human
agaaaaugugacagaguucucagaccucuggauagaugugaggagcauuuuucaguuuagacuaaagguagagguuucucuaguccaaaucu

SEQ ID NO: 4174877 - RNA, 100 nt, Human
agaaaauuguuuuguuaagaggaaggcaguuaauuuggcuagaauccaaaaacucauucagcauggcuguuuucccuuauuucaaaugaaaaacuuuucu

SEQ ID NO: 4174878 - RNA, 114 nt, Human
agaaacaaacaaaaagaaaugaagaaagguagagagaaggaggaagauaggcugguacgucaauauuucacuauucucuguaacuacuuuucuugaaaaucuuucuaaguaucu

SEQ ID NO: 4174879 - RNA, 89 nt, Human
agaaacagaagaguggguuugcauggaagacagugaguucaguuuggaauucauugagcacuuacuauguauaguccaagaacugcucu

SEQ ID NO: 4174880 - RNA, 58 nt, Human
agaaacagcauuagcaucaauugugagcuagcuuuucaucgggugcaagcugcuuucu

SEQ ID NO: 4174881 - RNA, 80 nt, Human
agaaaccaaagacauuauuauuggugaguuaaggaaagguaacuuuggaaguuaucauauaauucuggccuaugguuucu

SEQ ID NO: 4174882 - RNA, 67 nt, Human
agaaaccaaggucauugcaccucccuguaggggccccuacaaggaggcuaaugaugacacagguucu

SEQ ID NO: 4174883 - RNA, 64 nt, Human
agaaaccaggcccauuuucagccagucugaggaggaaagaggucccugaagaggccugggguuu

SEQ ID NO: 4174884 - RNA, 119 nt, Human
agaaaccuuagccagcuaacucacuacugggguggcauagggugauggcuuaggguguucuaacaggcauuuucacugaugucauccuacagagcaguauagaaaggacuaauguuucu

SEQ ID NO: 4174885 - RNA, 64 nt, Human
agaaacuacuuggaggaaagauaacagggauguaaucuuggaguuuuuccucguaagaggaucu

SEQ ID NO: 4174886 - RNA, 75 nt, Human
agaaacucagaggggacuggugugguacaaagggcaugaguucagagccauaaaaccggguucccucacuuuucu

SEQ ID NO: 4174887 - RNA, 91 nt, Human
agaaacucaguuugauaguaauguguuuaaaugucaaguaauucuuauugccuauggccugguuauauugcuaucauuuguacauuuaucu

SEQ ID NO: 4174888 - RNA, 57 nt, Human
agaaacugaaguaggaauucuaugcugcaaucuugaggcagaauugcugcuucuucu

SEQ ID NO: 4174889 - RNA, 103 nt, Human
agaaacugggaagugucaucuaguccacuguccugccuccagagagaaauuuaucuucaucaugugagacaggugguucauuagauaaaacacucuagcuucu

SEQ ID NO: 4174890 - RNA, 64 nt, Human
agaaagaacagacuuuuagguuuuuaacucccaaucguagaaucugaaaguggcugugaguucu

SEQ ID NO: 4174891 - RNA, 70 nt, Human
agaaagaggagcaggagucucuugaauuuggucuuauaaaauucaauuaacuuucaugcuuacucucucu

SEQ ID NO: 4174892 - RNA, 72 nt, Human
agaaagaggcacuggguuuucuucaucauucaaucaaucucuagaggcagcuuucagugucucucaaauucu

SEQ ID NO: 4174893 - RNA, 98 nt, Human
agaaagaguuucgcucuuguugacuaggcuggagugcaaugaugggaucucggcucacugcaaccucugccugccagauucaagugauucuccuuucu

SEQ ID NO: 4174894 - RNA, 77 nt, Human
agaaagcaggaaguuucuggugaggacgaggugagagaucuuacagcuuuuggcuagccaagaaacaaaaugcuucu

SEQ ID NO: 4174895 - RNA, 79 nt, Human
agaaagccuuccagcuugggaguuugguuuuauccaacaaagauacaaucaaccacuugcgagcucccgaaauauuucu

SEQ ID NO: 4174896 - RNA, 117 nt, Human
agaaagcucaauaucauauucauuguauagaggauuucagagcagauauugaaggguggguuuggaacagacccuucaugcucuaacuccucaggccuguaagacugugggcguucu

SEQ ID NO: 4174897 - RNA, 66 nt, Human
agaaaggagagaaugagagugucgagugggccuugaccucauucacaaagcugguuccuucugucu

SEQ ID NO: 4174898 - RNA, 57 nt, Human
agaaaggaggaagaaugaccucaugcugaaaaggaaccuucaaucuuucuucuuuuu

SEQ ID NO: 4174899 - RNA, 102 nt, Human
agaaaggaucauuugaucucucucaggaauagaguggcagcaguuuaugcucuauucucugaagugcugccuuuaauuuaugauagaauuagaaugcuuucu

SEQ ID NO: 4174900 - RNA, 57 nt, Human
agaaaggugaaauggcuuauucacauuuucauaguaggcuaggaaucaagccuuucu

SEQ ID NO: 4174901 - RNA, 55 nt, Human
agaaagguggaugcucuggaauuaccucugugcuuucagagcaguuggcuugucu

SEQ ID NO: 4174902 - RNA, 58 nt, Human
agaaagucauauuacccuggggccagaacucaaucaguggaaucaggugugacuuuuu

SEQ ID NO: 4174903 - RNA, 63 nt, Human
agaaagucuguccuuauuccucauucucccccaaaaaccccagugaggaggcuucagcuuucu

SEQ ID NO: 4174904 - RNA, 55 nt, Human
agaaagugauauaguuggaauccuacaguacaugggcuuuucagauucacuuucu

SEQ ID NO: 4174905 - RNA, 63 nt, Human
agaaagugguggggaguucuaacugugaauaacgcuugaagaucuaaacccuacuuucuuucu

SEQ ID NO: 4174906 - RNA, 74 nt, Human
agaaauacaauguuuguuagagcucuagagaugcuucugauucuucuggaugcauaacaugacauuucucaucu

SEQ ID NO: 4174907 - RNA, 67 nt, Human
agaaauacuuacacagagccucagacaaaccuguaaugacagaugaauuugucuguuaaguguuucu

SEQ ID NO: 4174908 - RNA, 114 nt, Human
agaaauagcuauaaaaacaaagguuuuggcaggcuuauggggagacagagucagaguucagggccuuucaaagauauguggucugauaaccucccaaaccuuugagcuuguucu

SEQ ID NO: 4174909 - RNA, 109 nt, Human
agaaauauagagcuuuucaguucucaugagcaaggugguuuuuauuacucccuuagauagcuuucacuauguucggagaacucugauuauuugaacaguuuuuuuuuuu

SEQ ID NO: 4174910 - RNA, 80 nt, Human
acuucagagaaagagggaauucuuauaucugucucuuccuaauuccauugacauggauugaacccuuccuucucucaagu

SEQ ID NO: 4174911 - RNA, 79 nt, Human
acuucagugucuucuaguuuucauauguuccuuugaaugaaugaagcaagacaucugaauauuagagagaaccuggagu

SEQ ID NO: 4174912 - RNA, 74 nt, Human
acuucaguuuucuaaugcuucugauuugggaacacugggaacuuguuuucaaguuacauuagaaaucaugcagu

SEQ ID NO: 4174913 - RNA, 56 nt, Human
acuucauguugcucuuggcuaucgcuggggaaaggcuugagccaggcauaugaagu

SEQ ID NO: 4174914 - RNA, 61 nt, Human
acuuccagcugauuggcauccaggaugggcaccuaucacugcuccaggacagcauggaggu

SEQ ID NO: 4174915 - RNA, 59 nt, Human
acuuccagugucugcugcuagcauauccagcaggugaacuagauacaacaacuggaagu

SEQ ID NO: 4174916 - RNA, 56 nt, Human
acuucccaagcugcagagcuggaccaugaugaaucugagcuacagcauggcgaggu

SEQ ID NO: 4174917 - RNA, 73 nt, Human
acuuccugaauggggcuaauuacuagaaagaguggccucuggugaguugauuguguccggucucucaggaagu

SEQ ID NO: 4174918 - RNA, 70 nt, Human
acuuccugcguguuugcacccugucuguuugaacguuuauauuuagaauucucaaacaugcccagggagu

SEQ ID NO: 4174919 - RNA, 127 nt, Human
acuuccuuagggccuaauguuccuuaucugaacaaugguaaauguaacagcauucuauuuguagaaauggcgaagugagugugauauguuugucauuguuaggaaaagucaucaguaccuaggaagu

SEQ ID NO: 4174920 - RNA, 102 nt, Human
acuucgcaccugaaucccacaugcugaccuuugguagccaccuuugauguauucuguagaggugagccaucaaggggcaguguggcagagcagagcagaagu

SEQ ID NO: 4174921 - RNA, 55 nt, Human
acuucguccuggaaaguuaaucacauuuucagugauuaacuuguagauaugaagu

SEQ ID NO: 4174922 - RNA, 95 nt, Human
acuucgugauuccagggccuagagcuuucugcugguguugaucuuuaaugacaaaugcagccuggacagaagcuuuugguuauggagcacugagu

SEQ ID NO: 4174923 - RNA, 57 nt, Human
acuucuaugcacagagcuuggaaacagacacauguuccaagggcuuuggcgugaagu

SEQ ID NO: 4174924 - RNA, 58 nt, Human
acuucucuuccccggaacucuagcaacucaacuggaaacaugcaccagggaagagagu

SEQ ID NO: 4174925 - RNA, 59 nt, Human
acuucugagaaauuuaaggacaguaacauaaugucuuuaaaaccagugucucaagaagu

SEQ ID NO: 4174926 - RNA, 80 nt, Human
acuucugagucuucaggggagguugaaucgucuccagcccagcacgagaccccagcucagccuccagaacaucaugaagu

SEQ ID NO: 4174927 - RNA, 71 nt, Human
acuucugauggugagauccuuuuccuuaagaaaugauauucuccaaguugauguuucuuaaaucaagaagu

SEQ ID NO: 4174928 - RNA, 81 nt, Human
acuucuuucaaugugaaaccauguaaagauggagucagcagguaguugagacauacauggcuuauauauugaauaguaagu

SEQ ID NO: 4174929 - RNA, 69 nt, Human
acuucuuugcagcuaggacucuguacaugaucuagcuucugcuuggcacaguccuagcugcaaagaagu

SEQ ID NO: 4174930 - RNA, 69 nt, Human
acuucuuugcagcuaggacugugccaagcagaagcuagaucauguacagaguccuagcugcaaagaagu

SEQ ID NO: 4174931 - RNA, 79 nt, Human
acuucuuuuaggauuguuuuccuucuucauuguguuacagcugcuucaguacaaaaggaagagggaucuuagagguugu

SEQ ID NO: 4174932 - RNA, 56 nt, Human
acuugaaaagcucagcaguaguggugaaaaaaugauaaugagcuggcauuucaggu

SEQ ID NO: 4174933 - RNA, 60 nt, Human
acuugaauaggaaagccacaaaccacuaaucaggguaucucagguuugaccuauucaagu

SEQ ID NO: 4174934 - RNA, 60 nt, Human
acuugauggaguuucacuguauuauguucaugaugggccccagugaacuccauaucaggu

SEQ ID NO: 4174935 - RNA, 73 nt, Human
acuugccuagguguauauuaaauggauucaauacagaaaauaguuauuuaauauauuaugugccugguauggu

SEQ ID NO: 4174936 - RNA, 100 nt, Human
acuugcuucgaauaccaccucuucacaaagcucucuuuauguguuuuguggcacuggggagugguuuugggaaguggguaaugaauguauucacguaugu

SEQ ID NO: 4174937 - RNA, 65 nt, Human
acuuggaaauuaacuugguacauauccuuuccacucugggaaguguucaaguugauuaucucugu

SEQ ID NO: 4174938 - RNA, 87 nt, Human
acuuggaaugccagaaaagaguuccaagucauuuuaugcaaugagaauguauggaagauuuuugagcucauucucuacuuccucagu

SEQ ID NO: 4174939 - RNA, 68 nt, Human
acuuggccagugugaccaucuguuagcucgcagccaugguagcuugauuccuggucaaacuuccaagu

SEQ ID NO: 4174940 - RNA, 61 nt, Human
acuuggcugcuuuugugcacauuucaaauguuuuugaucaaaugcguaugcaguccaaugu

SEQ ID NO: 4174941 - RNA, 129 nt, Human
acuuggucaugggucugugaucuccauucucacuguugacugggcugccugguucuucuaccagaugucugguggagggcaggagcucaggaaauaagugugagugggaugcacauguaacugaagagu

SEQ ID NO: 4174942 - RNA, 55 nt, Human
acuugguuucaaaugagugguaagauuuuacuuaccuuaaacuuuacagccaagu

SEQ ID NO: 4174943 - RNA, 79 nt, Human
acuugguuuuucaucuguacaacaaagggaugagacacauaucugucucauuuuucagguacaguuuuaaaaaucaagu

SEQ ID NO: 4174944 - RNA, 58 nt, Human
acuuguauggagacuuggaaccugauucuuuuuuggaaugaccaaaucucuuauaagu

SEQ ID NO: 4174945 - RNA, 67 nt, Human
acuugucacauucaugcagaaucaaaaugaugcuucuuugguccucucucugugugugugugugugu

SEQ ID NO: 4174946 - RNA, 66 nt, Human
acuugucgacaggggcaguagucucguagaguguuucacuuuccagauuuguccaguuauucaggu

SEQ ID NO: 4174947 - RNA, 123 nt, Human
acuugucguuuccuauguuuucuagcuugauugcuuaugguauauauucaguaaauguuugcuuaaugaacagauacacauaggcauauuuuggaaaaggacuuagaggaaccuagaccaagu

SEQ ID NO: 4174948 - RNA, 74 nt, Human
acuuguuucaugagggcugaugcuuacuuauuuuuccaaugagggaaaaauaauuuuagcccuuauaaucuggu

SEQ ID NO: 4174949 - RNA, 78 nt, Human
acuuuaauagaauuacgaucauuucuaaaauaaaguaauugugaucacuauaugcuaaggaggucguagucuaaaggu

SEQ ID NO: 4174950 - RNA, 56 nt, Human
acuuuacuucucaaaauaaagcaggcuugccuagaucugcuugaguaaaguaaagu

SEQ ID NO: 4174951 - RNA, 77 nt, Human
acuuuauaaggaauugugaaugccugucagucuuuucuccuauugcaagaaggcugaccaguuuacacuuuauuagu

SEQ ID NO: 4174952 - RNA, 67 nt, Human
acuuuauguuuguguauaauacacauaucagaaauucaagacguguguguguuuauaaaucuaaagu

SEQ ID NO: 4174953 - RNA, 76 nt, Human
acuuuauucauaaucaccaaaaacuggaagcaacccaaauguccuucaguuggugaauagaaaaacaaacugaggu

SEQ ID NO: 4174954 - RNA, 59 nt, Human
acuuucacaguccugacugagcggccuuggauaagcccucaguuuccacacuguaaagu

SEQ ID NO: 4174955 - RNA, 77 nt, Human
acuuucagcucucuaugcaacaccccuauggauggacauccaauguucaaagccaaugguuguggggaccuggcagu

SEQ ID NO: 4174956 - RNA, 90 nt, Human
acuuucggagacugaggcgggcgaucaccugaggucaggaguucaagaucagccuggccaacaugguaaaaccccgucucuacuaaaagu

SEQ ID NO: 4174957 - RNA, 113 nt, Human
acuuucucauuaccagccauggccaagcaugccuguggccaggcaaugcuuguuuugcauucaggggccacuagagcaagagcuuuuaagcuauggcaaaguaaaagaaaagu

SEQ ID NO: 4174958 - RNA, 57 nt, Human
acuuugagaaaagcauguuuucuguguuaaccuaggaauguauguuuaucucacagu

SEQ ID NO: 4174959 - RNA, 86 nt, Human
acuuugaggauauuaugcuaaguggaauaagccagucacaaaaagauaaauacugcaugauuccacuuauaugaaguaacgagagu

SEQ ID NO: 4174960 - RNA, 112 nt, Human
acuuugaggcuuucucuuuauauuuuauuugauugugaaacauucugcuugcuaaaaugguggcuuagaacuugauagacaguacaaaucagugaagaggaauucucugagu

SEQ ID NO: 4174961 - RNA, 126 nt, Human
acuuugcaaauaagaaacucuguagucaaaaucuuggcaagaaaauacuauuuaauuucuaaagugaaauuugggagcugucaucaguguugucaugccaugauuuuguuagcuacuugagugagu

SEQ ID NO: 4174962 - RNA, 130 nt, Human
acuuuggaaccaccuggagauguuuuaaaaaucucugugcucaggcugaaccccaggccaauuaagucagaaacuuugagggugggcccugggcaucugugcuuuuaaaagcuccccagaugauuccaau

SEQ ID NO: 4174963 - RNA, 66 nt, Human
acuuuggaggguguuguagaugaaaacacaaguuuccuaagcuuuuuacacauaccucuuuaaagu

SEQ ID NO: 4174964 - RNA, 61 nt, Human
acuuuggaggucauagccaagaggccugcaggcuucugggucauucuggcuugccuagagu

SEQ ID NO: 4174965 - RNA, 88 nt, Human
acuuuggcccugcgugggucagcauguggucugagguaacccucaaaugccuccaccacacaucuguccaccugcacggguucaaggu

SEQ ID NO: 4174966 - RNA, 62 nt, Human
acuuuguaacagcugcuuaauagagcggggaaauguuucuguuuuaagcccuguuaggaggu

SEQ ID NO: 4174967 - RNA, 60 nt, Human
acuuugucugcauggaauaauauacucaucuguucagugaguuacauguauagauaaagu

SEQ ID NO: 4174968 - RNA, 127 nt, Human
acuuuuaaauuaaugauguucuuauauguauuauuuuaacuuuuguguuaugugugagugcguguuugccccuacacauuuucaacacugucaagguuaaaaucaaguguugugguuguauaaaggu

SEQ ID NO: 4174969 - RNA, 82 nt, Human
acuuuuagcuucacuugaaggguaucugugaaccagauacacauuuucacaguuacuccuucagaugaaauuuggcuuuggu

SEQ ID NO: 4174970 - RNA, 97 nt, Human
acuuuuucagccucagcuuagucaauuauaaauaggcgauaauaauaucuaccacugccaguuuucugaggauuaaguaugggaaaaauguaaaagu

SEQ ID NO: 4174971 - RNA, 64 nt, Human
acuuuuuuucuccugccucaguucagcucagugauaaauaaggaacugagguuagauaacaggu

SEQ ID NO: 4174972 - RNA, 93 nt, Human
agaaaaacaggccaaagagagucagucugagcaccaggauuuaaaccuagagagccugacucaagagccugacucaucuuucaccaguuuucu

SEQ ID NO: 4174973 - RNA, 92 nt, Human
agaaaagcuugguauugagaggugcauaggaaaccagguuaagauuuaucucuuagggaaugugaaaacaccucucagguuucaguuuuucu

SEQ ID NO: 4174974 - RNA, 57 nt, Human
agaaaaggaucaguuauuuucuuuucuucaauaggaaagaaucaagugauccugucu

SEQ ID NO: 4174975 - RNA, 70 nt, Human
agaaaaggucagaaacacucuucuucugucucccuagagcagaaaugugugaaguguguuuccuuuuucu

SEQ ID NO: 4174976 - RNA, 129 nt, Human
agaaaauaacuuucuguuguuuaaaccacucagucuuagguauuuuguuaugucagcuugucuuagucaguuggggugcuauaaaaaugaucuuacacuggguggcuuaaacaauacaaauguauuucu

SEQ ID NO: 4174977 - RNA, 67 nt, Human
agaccugggacaugcuuggaaucuagaagcuaaucuuuccuaaguuccguuuucgugucagaguucu

SEQ ID NO: 4174978 - RNA, 70 nt, Human
agaccuuucauaaacaguagaagacuagagcucucucccucugucucucucucuguguguguguaucucu

SEQ ID NO: 4174979 - RNA, 122 nt, Human
agacgcaguccuuggcacaugguaagcacuaaauaaagggcagcuauuaucgucaucucaugcaacaacugagaugggcguggcaguccagcuguuugcuuauguugagaggaagaaugucu

SEQ ID NO: 4174980 - RNA, 55 nt, Human
agacgggaacagaggaggcaaagcccaacccagcccugucuccuccccgccgucu

SEQ ID NO: 4174981 - RNA, 125 nt, Human
agacgugacuugaaaugauuucauuugucagcggcuguguaguuugcauuguaaugaagaaagcaaacuuuaccacuucaaauacaaguagauuauguuucguuugaccguuuuuaguacugucu

SEQ ID NO: 4174982 - RNA, 86 nt, Human
agacuauacauugaggauaugcuaaagaauaucagguaacugucuaaaaagauauauaugcaauuuuuuagugcaaugaguauucu

SEQ ID NO: 4174983 - RNA, 125 nt, Human
agacucaccuggggaauuaaaaaaaaaauacauugaugccugggccccaccccagagauucugauagaauuggucuggaguggacccagagcacuaauauuuucaaauguuccucagcugagucu

SEQ ID NO: 4174984 - RNA, 68 nt, Human
agacucagagccccucccaggagccggguggugaggucagccuggcucaaggcgaggacuccaaguuu

SEQ ID NO: 4174985 - RNA, 63 nt, Human
agacucugauucccucaugucauagccagcauggcagggaaggaauguagggauucagcgucu

SEQ ID NO: 4174986 - RNA, 84 nt, Human
agacugaaacauuugauugaugaauuaaauguuagucuuaaaauucaaauugaaacauuugauugaugaaucaaauguuagucu

SEQ ID NO: 4174987 - RNA, 60 nt, Human
agacugaaguaagaaugcagcugagaguaguaauacuuaacguuguuucuucuucgaucu

SEQ ID NO: 4174988 - RNA, 58 nt, Human
agacugcaccuuccaugccugucucuuucauuagagaucagacucugcauugcagucu

SEQ ID NO: 4174989 - RNA, 56 nt, Human
agacugcggcaguuggugggagcuuucaaaggcgcucuugaaaauuguagcaguuu

SEQ ID NO: 4174990 - RNA, 67 nt, Human
agacugcuaagcccagguauagucuggggaaucagaugaccucaacuccuggcuguuaggcacaucu

SEQ ID NO: 4174991 - RNA, 70 nt, Human
agacuggacaagaaagguaggauucaggugcugaaguggcaucaucugauuucucucucucucucuuucu

SEQ ID NO: 4174992 - RNA, 63 nt, Human
agacuggaguucucacacuugccaguugugagauaaagggcaagugguagaacaucugagucu

SEQ ID NO: 4174993 - RNA, 57 nt, Human
agacugggacuggugggaaugugccagcaaugugugcaugaagccgguucccuguuu

SEQ ID NO: 4174994 - RNA, 71 nt, Human
agacuguauuccaaagguuaaugcccauuaauccgaagggaguggugaguaaauuccuuauauaucagucu

SEQ ID NO: 4174995 - RNA, 101 nt, Human
agacuugaggucccuuuagauacaguaaccacauucuauaguuggaugucugugaacuuacauauggagaaagguuaaugaucaaguggucuaaauagucu

SEQ ID NO: 4174996 - RNA, 83 nt, Human
agacuuuugaagaggccagaucaucauagaugggagaaauaaaucucaacacaggcuaaugaauuuggucuacucaucugucu

SEQ ID NO: 4174997 - RNA, 122 nt, Human
agagaaaaaagggaaucucaagccucuguugcaguacuucuuggaaacuggauuaggcacacuguugcuaaucuaguuuccagcaaguacugugacagagguuugagauuccuacuuucccu

SEQ ID NO: 4174998 - RNA, 65 nt, Human
agagaaaacaaauguuucugagagaauucacacuucauuucucucugagguccugugauuucucu

SEQ ID NO: 4174999 - RNA, 89 nt, Human
agagaaaaucuugucuuguauuugaacaaaaugcucucuuaccuuagaguugguauauauuugucuaauugcaaggcaagucaagcucu

SEQ ID NO: 4175000 - RNA, 87 nt, Human
agagaaacgucauuuagagcaggauuuaaggaagcuugaagauaauuucuucaucuguuucucuguaguucugugaguuguuucucu

SEQ ID NO: 4175001 - RNA, 82 nt, Human
agagaaagacugcaagucugggaaaggagaaaguuuauuuuccucucugcuaccucugacuccaguuuugcuuccuauuucu

SEQ ID NO: 4175002 - RNA, 79 nt, Human
agagaaagggcauuuaauauagccuuuauuagucacuuuauuagucacugguaccugucuugaauuuuccaaaggcucu

SEQ ID NO: 4175003 - RNA, 65 nt, Human
agagaacaggcucuggagucagacaacuguguucucaucaacagacucugaugagcccguuuucu

SEQ ID NO: 4175004 - RNA, 89 nt, Human
agagaacuacagagugaaugcagaaaauauugaauuugccaaugggcuuguugcuagguuauuagcauuuacuguuguaguuugacucu

SEQ ID NO: 4175005 - RNA, 91 nt, Human
agagaagaaagacuagaauauugaaaguucuugacauugcauuaaaugagcaauaguugaaggaacuaauguuuuaaagucuccauuguuu

SEQ ID NO: 4175006 - RNA, 72 nt, Human
agagaagaguauuguguguccuguuuauaugaugaaaauaaauuuuucuagggcugccauuugcuuuucucu

SEQ ID NO: 4175007 - RNA, 94 nt, Human
agagaagcaccagcccugggauucucagguguuuccacuuugucaucagcaacaaacaaauuaccauggaauuugggcugagcuggguuuuucu

SEQ ID NO: 4175008 - RNA, 75 nt, Human
agagaagccagcauuugccuacccagagagucagccuccugagucuccacacuggcagaugccuuuggauuuucu

SEQ ID NO: 4175009 - RNA, 73 nt, Human
agagaagcccagugugccagcccugcagaugugagaauggccacacuaagguuggagucacaguguucucucu

SEQ ID NO: 4175010 - RNA, 88 nt, Human
agagaaggaagcaugcaaaauguauuuuauuagcuccucccacacugcgauuuaguggaugaaauacguuaggcgaaucacuucaucu

SEQ ID NO: 4175011 - RNA, 64 nt, Human
agagaaguacuacaguuucucauuaaauguaauaacauucaugacaggauaguagugcagcucu

SEQ ID NO: 4175012 - RNA, 116 nt, Human
agagaagucauaaggggcaugaaccuuugugauguacccugcagugucuuagccugacuuuccuaugacaguaacagucuauuucucagaggucucucagcugcuuugacuuuucu

SEQ ID NO: 4175013 - RNA, 58 nt, Human
agagaauagccuuugagccacugggaaagaaauugcugagaaucacagguuauaaucu

SEQ ID NO: 4175014 - RNA, 77 nt, Human
agagaauauauuggaaggaaauuggggcaguuguucugagugauggaauaucaggugacauuuuccuuccaaucuuu

SEQ ID NO: 4175015 - RNA, 89 nt, Human
agagaauguaaaugaguguggaccagcuaucaaugccagggcagcuccagcugugauggcgggugguuggcacuuauuaacagcacucu

SEQ ID NO: 4175016 - RNA, 105 nt, Human
agagacaaucaaaagugacaaccagcaggacuuagugaaccuuauauuugcacaucacgaaaaguuuuuguugguuuuguuuugcuuguuuguuggauugucuuu

SEQ ID NO: 4175017 - RNA, 56 nt, Human
agagacccauugccggaaucaccuauuuugugguccuguccucagucugggucucu

SEQ ID NO: 4175018 - RNA, 59 nt, Human
agagaccugaaagugugggcgaccuggagcuaccaggccccucagucaucacggucccu

SEQ ID NO: 4175019 - RNA, 64 nt, Human
agagaccuuccugacuccagagcucaaaugcccaaugcaaucccaaggcucuggcagggacucu

SEQ ID NO: 4175020 - RNA, 55 nt, Human
agagacggaaauguguagccugaggucaaaaccucaccuaguacaaucuguuucu

SEQ ID NO: 4175021 - RNA, 128 nt, Human
agagacgggauuucaccauauuggccaggcuggucucaaacucccgaccuugugauccucccgccuuggccucccaaagugcugggauuacaggugugagccaccaugcccggccuguucccauuucu

SEQ ID NO: 4175022 - RNA, 86 nt, Human
agagacuucuggaggaggcugcaacagggaaccagcugaaguccucagcugaaucucaggcauccuuucccuccuagaagcucucu

SEQ ID NO: 4175023 - RNA, 92 nt, Human
agagagaacaugcaaugugauuccauuuauaugaaguucagaaauaagcaaaacuaaucaauguggauggaagucagauagcaguuguuucu

SEQ ID NO: 4175024 - RNA, 59 nt, Human
agagagaaggugguggugaugugucugaaugcggagauugaauaaccaccuuuuucuuu

SEQ ID NO: 4175025 - RNA, 67 nt, Human
agagagacaagccaacagcacagcuggacgccccacucgcaauuuguucagcucaguuugauucucu

SEQ ID NO: 4175026 - RNA, 66 nt, Human
agagagacagugagaaugaguugaaaaagcacaugauuuuuuuaagucccaguccugucacuuucu

SEQ ID NO: 4175027 - RNA, 70 nt, Human
agagagagaagugguuuuccagaguggcaagaggacacggucccagugcccuggugaagugcucuccucu

SEQ ID NO: 4175028 - RNA, 81 nt, Human
agagagagagagaaauauauuuaaauccagguugaaauuuguggaaaaguuaugaucuguauuaaauucuuucacugcucu

SEQ ID NO: 4175029 - RNA, 90 nt, Human
agagagagcuggagaaacaaaacacauuagcccuguggaaaaucacaugauuucuaagaaaguaaugguuaugauucuuaggcuuucucu

SEQ ID NO: 4175030 - RNA, 85 nt, Human
agagagaggugggcagugaauauuggugggaaaagacauaguaacaagaauuucaaggcaauguucacgccaaaacuuaacugcu

SEQ ID NO: 4175031 - RNA, 129 nt, Human
agagaggaaaugagguaacacugcaagguggcuuauaggauuggaaagaaugugaguuuuaaaaaucagaaagaccaggcuuacauacuuacuagaucuaugaccuuguccaacuuauuuauuugcucu

SEQ ID NO: 4175032 - RNA, 99 nt, Human
agagaggcuucugucucauuccuccguggcuguggacgcagccccuccaaaccaaggugggcuggcgaccugcagcgacgugcgacacccagcuucccu

SEQ ID NO: 4175033 - RNA, 68 nt, Human
agagaggugaagagggcaaaaacuucccaaagugugaacauuucaggauuauacucucuucccuuucu

SEQ ID NO: 4175034 - RNA, 105 nt, Human
agagaggugcuuucuucuucucucacccugggugagaggcaaacaggugcuugcuuguucucuuacccagggucuagaggaagcaauuuauuuauuuaucuguuu

SEQ ID NO: 4175035 - RNA, 71 nt, Human
agagaguauauuuggggagaacuuugcauaugcucaccugagucauugcagaguggauucuguauaccuuu

SEQ ID NO: 4175036 - RNA, 94 nt, Human
agagagucgcuugaacccgggaggcugagaggucgcagugggccaagauugcaucacugcgcuucagccugggugacagagcaagacuucaucu

SEQ ID NO: 4175037 - RNA, 85 nt, Human
agagagugguaucuauggaaauuaauucaacugucuuuaaaaaggucauagaucaaagauuaacauuucuaagaugccauuugcu

SEQ ID NO: 4175038 - RNA, 65 nt, Human
agagaucaguguauucauagggaauauucaaaaucuacagauuguuucuagaaucauugaugucu

SEQ ID NO: 4175039 - RNA, 88 nt, Human
agagauggaggggaggggacacuggggacucuggccuuuugacaggacaugugucaaaaugccgagugcccaggucgaucagauuucu

SEQ ID NO: 4175040 - RNA, 67 nt, Human
agagaugucuagugaaugacacuuaagaagaugaucucauuuuauauguaucaaucacggcaucuuu

SEQ ID NO: 4175041 - RNA, 71 nt, Human
agagauguuuagauguuuguccaaggucacacagcuaguaccugcuggagcagaaauuugaagccaugucu

SEQ ID NO: 4175042 - RNA, 68 nt, Human
agagauguuuccucugagagcaggauauauguuucuuccuaucauaaacucugccucagaagagcucu

SEQ ID NO: 4175043 - RNA, 68 nt, Human
agaaaucaaggcuacauucagguucaacugccaaggcaagcacagaccagauuguagucugggucucu

SEQ ID NO: 4175044 - RNA, 76 nt, Human
agaaaucccaucuuuucagaagccauucuggauuuaaaagaauccagaauggcuucugaaaaggauugaaauuucu

SEQ ID NO: 4175045 - RNA, 59 nt, Human
agaaaucuauguuuugguuagauguauuuuuucaucuuuuauagaauauaggucauucu

SEQ ID NO: 4175046 - RNA, 62 nt, Human
agaaaucucaguaucucagggauucuugguaagacagaaguaacugaugugcucagauuucu

SEQ ID NO: 4175047 - RNA, 110 nt, Human
agaaaugaauuaaugaaaaauacuggagugauaaguuuuauauuaugaucccaagagauguuaugauacaagcaaaacuaaucaauguagauuauucaguuauuauuucu

SEQ ID NO: 4175048 - RNA, 116 nt, Human
agaaaugccgaugugcuucuaaguaacuagcuuguacaaauguuuaaacacuuuaaauuucacaagagcuuacacuuuggcaagcuauuaaaaggggaaauaucuguaguguuucu

SEQ ID NO: 4175049 - RNA, 108 nt, Human
agaaaugccuaugccagucuuuugggcauuuuuaguauugguuuuuguccacuuaggugugacaagcauuguauauugguuuuuguccacuuaggaccauuaguuucu

SEQ ID NO: 4175050 - RNA, 86 nt, Human
agaaaugcucauagacuugggcucuuuguucuagcacuuacuuauagugcugccuuaaaaaauucuaaacaucuugagcauuaucu

SEQ ID NO: 4175051 - RNA, 74 nt, Human
agaaaugcuuauggguuccauaauaccgcuuggcauugcacacuaagcaauauuguucuugcucaaguucuucu

SEQ ID NO: 4175052 - RNA, 79 nt, Human
agaaauuaaguuacuuucugaucaguguguccaggcuuucaugcugcuuucugacaucaucagugagugaauaguuuuu

SEQ ID NO: 4175053 - RNA, 98 nt, Human
agaaauuacagggucagaagguuugaaaguucaacaggaaaaaaggucccauuaccuuuuuaagaagcuuccaggccuagcacugacauuuguuuucu

SEQ ID NO: 4175054 - RNA, 63 nt, Human
agaaauuacccagagcugagucugauauaugcuguuaguauacuucaauucagccugauuucu

SEQ ID NO: 4175055 - RNA, 57 nt, Human
agaaauuaugcaguaguuuuauaggcugaccuguguaaacuccuugucauaauuuuu

SEQ ID NO: 4175056 - RNA, 98 nt, Human
agaaauugaagaaauaagagcuuuccuugggaggauccaagagucugcauuugaaaacaguguuaucucagggacggcaucucauuucuuuaaccucu

SEQ ID NO: 4175057 - RNA, 76 nt, Human
agaaauuuauuagugccuacuaugugccggacaucauucuguguggagauauacuguaggccacuauaagaaaucu

SEQ ID NO: 4175058 - RNA, 85 nt, Human
agaacaacacugaaggggaauuaucacaguuucuggugacuaaaaucacucaguuuuugcugucugguucaucccugagguuucu

SEQ ID NO: 4175059 - RNA, 74 nt, Human
agaacagauaucacaggcccagcucuucaccagaagcuuugaugauggccugggcuuugaauacaugauguucu

SEQ ID NO: 4175060 - RNA, 62 nt, Human
agaacauucacagacucaccauuauuguacaaugauaauguaguguauagugugugaagucu

SEQ ID NO: 4175061 - RNA, 100 nt, Human
agaaccaaauacagaaggagaaagcuuguguuucugucgccuuucuuucaaugaaauaaaaguucaagagaguacagauuuccccucuguucacaguucu

SEQ ID NO: 4175062 - RNA, 56 nt, Human
agaacccagaccuggaagcuagaccccagacauaggucauccaccucucgggcucu

SEQ ID NO: 4175063 - RNA, 128 nt, Human
agaaccucagggaguugauaguuggagccagguuauuuuaucucugagagguugucaaauuggaacauuauuuaauauaucagagauagagguaaagagaaccuccauaaacguuuucauuguggucu

SEQ ID NO: 4175064 - RNA, 104 nt, Human
agaaccuccccuuuccgugcuggcucugggccaagcagggaggcaaagaucugagagucacccuguucuuuguccagaaggacagcacagagaauggcacuucu

SEQ ID NO: 4175065 - RNA, 67 nt, Human
agaaccuggcaccuguguuuucuggaugcugaccaggugcgucugauggaaccagguuccagggacu

SEQ ID NO: 4175066 - RNA, 65 nt, Human
agaacuaaauucagagacaugaagugacauucccaaugucacucagcaaguauuuggaagauucu

SEQ ID NO: 4175067 - RNA, 64 nt, Human
agaacucuccaggggcugucuuggaaucuugggauaaagacccccaccggccccugaguggucu

SEQ ID NO: 4175068 - RNA, 103 nt, Human
agaacugccaacgcgggcuccuuggcaaccagagcucaccaucugcccaggcaaccagggagggcacagagggcagugagccucugccaggauggacaguucu

SEQ ID NO: 4175069 - RNA, 92 nt, Human
agaacuguacauuggcuacaauugagaggcagagaggcuuucugggucauauuuauaucuccugccucacaguugaaguuuuaggcaauucu

SEQ ID NO: 4175070 - RNA, 59 nt, Human
agaacuguccccagagagcacuaaucaaucagugugaccuccaaaggggacccaguccu

SEQ ID NO: 4175071 - RNA, 78 nt, Human
agaagaaacagcaucccacauaauugcuuuuggcagccuauuagucagcaaaaaauuuaugugaggaaagguucuuuu

SEQ ID NO: 4175072 - RNA, 70 nt, Human
agaagaaaggaagcugccacccucuugccauacacucugggggccucuguucugcauuccuccuucuucu

SEQ ID NO: 4175073 - RNA, 74 nt, Human
agaagaaauagaaaagaaaaugaggcagugccacucuaguuggugauacaugacauuucuuucuguucucuuuu

SEQ ID NO: 4175074 - RNA, 63 nt, Human
agaagaaaugugaaggccacugugcacaugaaacagcacagaguggacccagcuauuucuuuu

SEQ ID NO: 4175075 - RNA, 70 nt, Human
agaagaauauauaaugauuuugucagcuaaaaguugggcugagagagacaucacucauuuauguuugccu

SEQ ID NO: 4175076 - RNA, 70 nt, Human
agaagacaacagcauauggacugucauuuagauuaaaagauaucuauuguuagccuggugcuuuguuucu

SEQ ID NO: 4175077 - RNA, 96 nt, Human
agaagacauuuuuuuaguaaguaaaaucagguugaggcuuggaugacaggcaagagucauccaggaaaagauuuggaaaaaugcuggaaaacuuuu

SEQ ID NO: 4175078 - RNA, 56 nt, Human
agaagagaguccuaccccauacacauauguaguuggaaaagggaggacuuuuuuuu

SEQ ID NO: 4175079 - RNA, 57 nt, Human
agaagaggccugggagagcucacagugggcagggcugggggcuccuugggccucucu

SEQ ID NO: 4175080 - RNA, 73 nt, Human
agaagagugggaauguucuaagaauucuuuuuggcuuaaucuuuguugaauugaaaauauguauaacucuucu

SEQ ID NO: 4175081 - RNA, 78 nt, Human
agaagauaauuaaauuauguccaaagaauuaauauugcuuacuuuagagauauaaguuaguggucauguuuaucuuuu

SEQ ID NO: 4175082 - RNA, 68 nt, Human
agaagaucaugcauauuuguaguaguucaauaagaauugagcuaaagcuuguguuuauacuaucuucu

SEQ ID NO: 4175083 - RNA, 80 nt, Human
agaagcagcuguggaaaaguaacuaaauuacguggggaggcugcaggaagauaggcauuauuuuaccacggucuguuucu

SEQ ID NO: 4175084 - RNA, 99 nt, Human
agaagccaaugucggaaaaugaauccuguagauucuaauuccugcacugugugaggacuacuggugaauuauuuuccgccacaauuugcauuuucuucu

SEQ ID NO: 4175085 - RNA, 58 nt, Human
agaagccacugcucccagugagcaguagggccuggacuucauuuagagcagggcuucu

SEQ ID NO: 4175086 - RNA, 56 nt, Human
agaagccauugaagcagaccucuagcugccagucaggucugcucugaaggcugccu

SEQ ID NO: 4175087 - RNA, 114 nt, Human
agaagccugaguguggaggaugacuagcccagagucccaauuccagcccuguucaucacuagcugguugugaaacuuggguaaguuuuuaaauuuuucggaaccucaguuuucu

SEQ ID NO: 4175088 - RNA, 75 nt, Human
agaagcugcuguguucucuugacccacccuuacccccugacuggccuguagcugggaggaggacuagcagcuucu

SEQ ID NO: 4175089 - RNA, 65 nt, Human
agaagcuuacuguaauuaaaagacuuugaacucagacacccagaguuuugaauucagaagcuucu

SEQ ID NO: 4175090 - RNA, 64 nt, Human
agaagcuucuccuccuaacaggcaagcaugacacacucugccaaaccaggaagggcaaguuucu

SEQ ID NO: 4175091 - RNA, 88 nt, Human
agaagcuuuaggugcuuagcuuuuuacauuuaaguuuaugauugauuuuuaguuaauuauggugugugguuaagggaucaaagcuuuu

SEQ ID NO: 4175092 - RNA, 130 nt, Human
agaaggaaauacaaccuucauucuaagagguucuccgaggucaugcgggcagcuucucccaggcuguuugugaaauauggggggaagaugcucucggaggacccaagcaaagaagccuauuuauccuugu

SEQ ID NO: 4175093 - RNA, 80 nt, Human
agaaggaagcagggguagagauugcugguguaagggacuuuuucuucccuucugucuucucucccacuguuuugucuucu

SEQ ID NO: 4175094 - RNA, 65 nt, Human
agaaggaagccguuucucuccaggacaugcagugucugcuggaguuuuggaaaaaugcuuucucu

SEQ ID NO: 4175095 - RNA, 91 nt, Human
agaaggagaagacuucaaaucucuugaaagcaauggguuuuuccuucaccuagggauauuuugacuuuuaacagugagucuaucuucuucu

SEQ ID NO: 4175096 - RNA, 65 nt, Human
agaaggagaguaguuaggacuggggcacguauaggucucaaugacuccuauuuacauuuuuagcu

SEQ ID NO: 4175097 - RNA, 79 nt, Human
agaaggcaguggagcucagauuccaauguuggccuauuugacugcaggccaaguugcuaaaggaguucuuuguccuucu

SEQ ID NO: 4175098 - RNA, 67 nt, Human
agaaggccaggaaauuaucccuaugacgaacugaugauguccaauaggagacuguucuuggcuuccu

SEQ ID NO: 4175099 - RNA, 55 nt, Human
agaaggccccaugaacacugcaaagacaguuugcuuguuguaaauggagguuucu

SEQ ID NO: 4175100 - RNA, 59 nt, Human
agaaggcccuguguggucugagccuggccuaccuguucaaccuaauugcacggccuucu

SEQ ID NO: 4175101 - RNA, 58 nt, Human
agaaggcugagacugggaugaaacuuaucacaaaaguaaaggaaccacuuagccuucu

SEQ ID NO: 4175102 - RNA, 55 nt, Human
agaaggcuuuccagaaagucuugaaacuugauuucagcccaggaaugagccuucu

SEQ ID NO: 4175103 - RNA, 63 nt, Human
agaagggccugggagucguauucucugcaucgccucagcacaggggaucuuccaggcucuccu

SEQ ID NO: 4175104 - RNA, 96 nt, Human
agaaggggcuggcugccaaugugauaauugagaaacaccuggugaaaaugucucucuauuaauugacaauggcuuucuccucccuaguccucaucu

SEQ ID NO: 4175105 - RNA, 59 nt, Human
agaaggguguauacauuuccuggaugugauccuuacauauagaaguaugugacccuuuu

SEQ ID NO: 4175106 - RNA, 83 nt, Human
agaaggugccugggcuuuaggguugaaugcaucuggguuugaagccuggagcccccacguuuccuggguccaggugaucuucu

SEQ ID NO: 4175107 - RNA, 85 nt, Human
agaagguuuacucugaguccaggaagcaucauggucuauuuaugauaauagaaauuuguaggcaucuggcuucaggugaaccucu

SEQ ID NO: 4175108 - RNA, 59 nt, Human
agaaguacauggaggauagcugcucuguuuugucaggaagugcuaagccaugugcuuuu

SEQ ID NO: 4175109 - RNA, 56 nt, Human
agaagucagccucauugaagccacuguaacagauggcagauacaggcaugacuucu

SEQ ID NO: 4175110 - RNA, 81 nt, Human
agaagugagauggugcugccagagugccgacccccgaauccucaggggcccuggccucuccuggcagcauccacccauucu

SEQ ID NO: 4175111 - RNA, 55 nt, Human
agauguccugaaaagcccugagacccuucacgugcagaggcugagagggcaaucu

SEQ ID NO: 4175112 - RNA, 79 nt, Human
agaugucuuucugagaugaauuaacugacuuagacauacagaaguagagucaccuugaaaugucuugaaaagaaauucu

SEQ ID NO: 4175113 - RNA, 72 nt, Human
agaugugcaguccuggcauauagguccucacugaaaguaguggaggaacaugaccaggaccuggaaacauuu

SEQ ID NO: 4175114 - RNA, 77 nt, Human
agauguguauugaugagcauuacucucuaacugcucgugucaaagcacuuggggaggcucaucaaucuugugcguuu

SEQ ID NO: 4175115 - RNA, 81 nt, Human
agauguuuccuaacuggccuuuauggauaaguuugcuaaccuguacucuagaucacgugaaguccauaauaguuuauauuu

SEQ ID NO: 4175116 - RNA, 84 nt, Human
agauuagcuuagugcuacuucauggguucucugggauaggugugaaauaaaaacagugggaaagugaagagcauuaaauagucu

SEQ ID NO: 4175117 - RNA, 57 nt, Human
agauuaggcuacaccuggaaaagccuuccaagaaggccuccuggucuaggcuagacu

SEQ ID NO: 4175118 - RNA, 81 nt, Human
agauuauaccaacagcuacaggacgggcaucugcagucaagcaugcagaaaaggcagugcccaguguuguagaaauaaucu

SEQ ID NO: 4175119 - RNA, 64 nt, Human
agauuccagggggacauuggaggcaaaugauauaugccccaaagaaaacaguaccucaggagcu

SEQ ID NO: 4175120 - RNA, 77 nt, Human
agauucuacaaaggcaggauugacuuaguuaaaggauacaaaccgauaacccucacugaguuuuuacugcaggauuu

SEQ ID NO: 4175121 - RNA, 82 nt, Human
agauucuagaccagugguuuccaaacuuguuccacauuaguaucaccuggacaucuuuagaaacuacugcugucuggcuucu

SEQ ID NO: 4175122 - RNA, 75 nt, Human
agauucucugucaccagugcucccagaggccagcugggcccggccaggucugggagagcugcugucagagcgucu

SEQ ID NO: 4175123 - RNA, 95 nt, Human
agauugaccugucaggggguuugacagcaguaggaguuuccagggugggaagacucaagaaggagacuccacugugauccugugugguucaaucu

SEQ ID NO: 4175124 - RNA, 78 nt, Human
agauugaggcacagggcagagccaggauuucaaccauuacagucuaauuccagaguuugugcccuugagccuuaugcu

SEQ ID NO: 4175125 - RNA, 82 nt, Human
agauugaggucagcuagaggaugugacauucgaguugggucacaaaggauguacaggaguuuuucaaggcugaccacagucu

SEQ ID NO: 4175126 - RNA, 81 nt, Human
agauugagguccagccagguuuuacaauccagccagaaugacauguugagagagguggagauggccucaggcccucagucu

SEQ ID NO: 4175127 - RNA, 88 nt, Human
agauugcuucuugauuuauucuacccagaauguacaccuagaucugcuacuaagcuuuuggauaggauagaacagaauuugguacucu

SEQ ID NO: 4175128 - RNA, 69 nt, Human
agauugggauuagagaucuguaugcagguauaauuuccaucccuguccuuuagucuuuauucuuaauuu

SEQ ID NO: 4175129 - RNA, 56 nt, Human
agauugggguccagacuccugagugcuccccaucagggcucguguuucccaacucu

SEQ ID NO: 4175130 - RNA, 60 nt, Human
agauugguguugcagaaccaugaauguuuaacaauuugucaguucaguauacacuauucu

SEQ ID NO: 4175131 - RNA, 84 nt, Human
agauuguuaaggaagucuaggaucuauguguaauuuuacuacuuaaauuuuauacauguguuuugagaugaguuuuaauaaacu

SEQ ID NO: 4175132 - RNA, 114 nt, Human
agauuguuuagugccauggaaagguuucuuaaauacuauugaccaggucucugcaaucauagacaugaauguuuauaguaccuugagauauaacucaucccagccuauaaauuu

SEQ ID NO: 4175133 - RNA, 69 nt, Human
agauuuaaugauggcuucuaacaggcuucucucauucuuguugaacugguuacaagccuuguuaaaucu

SEQ ID NO: 4175134 - RNA, 86 nt, Human
agauuuacccuuucugggaggcaguuucucaggaguacaucuguaaaaggaggcugccucuuuugagaggguacugacaagaaucu

SEQ ID NO: 4175135 - RNA, 57 nt, Human
agauuucaggcuaucuaugcagacuuaguugagggucugauaguuaaucugaauacu

SEQ ID NO: 4175136 - RNA, 130 nt, Human
agauuucuuaaauuuuuaaauauauaguagauauaauuuuaagugguaaauuaguucuuugauaggcaugauaacauaguuuucuacuuauucuuguguugugugcucauauauuuuuuaugagaaaucu

SEQ ID NO: 4175137 - RNA, 72 nt, Human
agauuugaaaauaguacaaucuacagacauaguguuagcuguuuuuucuaguuuugugucuuuugcaaaucu

SEQ ID NO: 4175138 - RNA, 83 nt, Human
agauuugucaucuacagugcgauuuuuaggccucuugacuuuuuguugagcccuaggcuuuugugacugccugugacagcucu

SEQ ID NO: 4175139 - RNA, 55 nt, Human
agauuuucaaggaaaucagaaccaaauuaagaguucuuaauuuccuugugaguuu

SEQ ID NO: 4175140 - RNA, 78 nt, Human
agauuuucauaugcuugacucuuucacaucgccuuccucagagaaaugugaugagaacugugcauaaugugaagaucu

SEQ ID NO: 4175141 - RNA, 113 nt, Human
agcaaacaccagcuccuaugggccagcccugugcuuggcuaagcuggggaggccuggggaggaauccaggccuggacggguggccuggguggccauaaggacuagugugugcu

SEQ ID NO: 4175142 - RNA, 65 nt, Human
agcaaaggcacuagcuaggucauggaggacugugaacacguccaggaggcugaaguguuuuugcu

SEQ ID NO: 4175143 - RNA, 61 nt, Human
agcaaaguggcuuuccaaaccauagucuacuuuuucuaguuuuuguaugagucauuuuguu

SEQ ID NO: 4175144 - RNA, 104 nt, Human
agcaaaguggggacacguagcuuccccuugcaguuauaaguaaaugugaauucuguucugugacuucaagguucagcaccuucuguccucaaaacuucuuugcu

SEQ ID NO: 4175145 - RNA, 73 nt, Human
agcaaauuauccagcaccaaugucagagguguagcucucccuucuggauauucaguuggauaaacucauugcu

SEQ ID NO: 4175146 - RNA, 55 nt, Human
agcaacagcaacgacauuucucuaaaagguagcagagaucucugaagcugcugcu

SEQ ID NO: 4175147 - RNA, 63 nt, Human
agcaacagcagguuugcacuccuaacauagcaaccccauggagggugcagguaacgcugugcu

SEQ ID NO: 4175148 - RNA, 63 nt, Human
agcaaccguggcucuugggaccaguugacucauguucaaguacaccuuuggaguccacgugcu

SEQ ID NO: 4175149 - RNA, 101 nt, Human
agcaaccuacccaaacccugcacccccuucaaggcuccaccacauuuaagugggaauugaggugauugugagggaaucagggcagaggaugggauggugcu

SEQ ID NO: 4175150 - RNA, 68 nt, Human
agcaaccugccagucacucaguggccuccaaccagagaaaacaaccugccaaguuggcagccguugcu

SEQ ID NO: 4175151 - RNA, 82 nt, Human
agcaacuaaaugaauguuccucagacuuccccaaaauuuuugauucugggauagaagcaggaauaaucuuuuguuagaagcu

SEQ ID NO: 4175152 - RNA, 55 nt, Human
agcaacugcucugggcaacagccucccucaauaggcaaggcccccagaguaagcu

SEQ ID NO: 4175153 - RNA, 56 nt, Human
agcaacuguaauauuggaagaucaguccuucuguauuauauuguauaauaguugcu

SEQ ID NO: 4175154 - RNA, 75 nt, Human
agcaacuguucccaagauaagauuaugauuuacaccaguacuucuuaaaaugugggucugcggaaugguguugcu

SEQ ID NO: 4175155 - RNA, 78 nt, Human
agcaagaccaggguuuuguguuugugaaccuaucuaauauugcugggguuugaaaacugaacccugaguuuuauugcu

SEQ ID NO: 4175156 - RNA, 73 nt, Human
agcaagagcggaaaggcccugggaugcucagcagugguuguggucccuaguguccugagggcugugacuugcu

SEQ ID NO: 4175157 - RNA, 64 nt, Human
agcaagauugaggcuuccucagcuuuuggaucgacaaucgacagcugagaggcuauuuuuugcu

SEQ ID NO: 4175158 - RNA, 55 nt, Human
agcaagcugucaagagagcugacaggugagauaauuguuagcucucuggcuugcu

SEQ ID NO: 4175159 - RNA, 72 nt, Human
agcaaggaaaaaggccuuuagagcuuaaauuacaaccacaucuaaugaacucagagguguuuuucacuuacu

SEQ ID NO: 4175160 - RNA, 76 nt, Human
agcaaggaggcacagccagcugccuuucacaucuggcucuaaaugagccacggcacuggcucuguccacauuugcu

SEQ ID NO: 4175161 - RNA, 58 nt, Human
agcaaggauuauccugggaagggagcuuaacuaccucuaaauccaggaugcuuuuucu

SEQ ID NO: 4175162 - RNA, 55 nt, Human
agcaagggaagucgacagaauagcaccucaaaugauguggacucaguuucuugcu

SEQ ID NO: 4175163 - RNA, 68 nt, Human
agcaaggggucuggcuuucugaacaucagugaauggaaguguuuacuuuaguaaauccagcccuugcu

SEQ ID NO: 4175164 - RNA, 70 nt, Human
agcaagggugagagacagaauuugagcucaauuuauugaaugccaaagugcugcucuuuaccacugugcu

SEQ ID NO: 4175165 - RNA, 97 nt, Human
agcaagguauuuagaacaaaggaggugauaggcccucuuuuucgugcugagcuaaccacauguggaguauuguagcuuccaguucaagugccuagcu

SEQ ID NO: 4175166 - RNA, 67 nt, Human
agcaagugggugggacuaucuuuugagccucuguaauaggccaaguacuguaucacuuacuccugcu

SEQ ID NO: 4175167 - RNA, 72 nt, Human
agcaauagauuccagugugcuuccuugcuacacauaauuuugggaugacaauggggcacauggaaaguagcu

SEQ ID NO: 4175168 - RNA, 57 nt, Human
agcaaugcuaccgggugauucguagaaaauugggauucaugccuucuagcauuugcu

SEQ ID NO: 4175169 - RNA, 71 nt, Human
agcaauggaacucauguucugguggaaaacagaugcaaaucagauaauuucaacagaauaugaucagaguu

SEQ ID NO: 4175170 - RNA, 79 nt, Human
agcaauggaauugucuuggccagugagaagggccuuuuccuucacgauggcugagacgguauuuuaguuuucuauugcu

SEQ ID NO: 4175171 - RNA, 73 nt, Human
agcaauguuugacaguuuucuggguaaggucuugcucacaccuugcuaaauuuauuuucgaacauuucaugcu

SEQ ID NO: 4175172 - RNA, 100 nt, Human
agcaauucuccugucucagccuuccaaguagcagggauuacaggugugugccaccaugcacggcuaauuuuuguauuuuuaguagagacgggguuuugcu

SEQ ID NO: 4175173 - RNA, 72 nt, Human
agcaauuuaggaacuucugucucaguguucaguuuuuacuuaguaccuugacacuacucuuaguuccuggcu

SEQ ID NO: 4175174 - RNA, 123 nt, Human
agcacaacuaacucauuguaucaguuaccuguugucacgauaacacugcuaacaaacacucacagaagcccagugguauacacggguaacuguuuauugcucaugugcuuggaguuguuggcu

SEQ ID NO: 4175175 - RNA, 78 nt, Human
agcacaaugaucaaugcaugugacaaagaguaugaaucacuaggaauugcccuugucagugcauuagcuugaugugcu

SEQ ID NO: 4175176 - RNA, 82 nt, Human
agcacacacagggcacuucuaagcauggggcucugugcaccugccuggguugcaugccagaagccagcccugucucagugcu

SEQ ID NO: 4175177 - RNA, 64 nt, Human
agcacacauaacacucuucucuagugagcagucucuggugcugacugaguauauguuuggugcu

SEQ ID NO: 4175178 - RNA, 75 nt, Human
agcacagcauucacagaaagacaucaaucugcacuuuuuguaaaagaagcacaauguccuucuugagggcuuguu

SEQ ID NO: 4175179 - RNA, 104 nt, Human
agcacagcgugccuuuccucccagcuuccucagaggccacaggcauuuuuggcucagcgaggucccuggggaacuaggcugugcggagggaggagugugcagcu

SEQ ID NO: 4175180 - RNA, 60 nt, Human
agagauuacagcaggguccagcguuugcuuggagaaaacucuugaucuuguguagucucu

SEQ ID NO: 4175181 - RNA, 88 nt, Human
agagauuagaaggcaauuuucacauaaaagcuccaaagaaacauguuguuauucuguggaaguuauuugauuguuccucauagucuuu

SEQ ID NO: 4175182 - RNA, 71 nt, Human
agagauuaguugagauagucaaaguucuuucuguuccaggaagugcuuucauauagucuuaaugaugcuuu

SEQ ID NO: 4175183 - RNA, 127 nt, Human
agagauugaaagguuggaggaggaguguucagguuguuaauucgcuugguuacuccacuguacaagauucaaugaauugauugcaucauucacgcuggacauccuucuccaugcaauugccaucucu

SEQ ID NO: 4175184 - RNA, 77 nt, Human
agagauugaucuguguaauuuuuugugccaacuugucagguuuugguaccagggguuauuucugcauauucauuucu

SEQ ID NO: 4175185 - RNA, 81 nt, Human
agagauuugggcuauuuugaauaaugcugcugugcacacuuguguacacauuuuuauguuaacauauguuuucacuucucu

SEQ ID NO: 4175186 - RNA, 60 nt, Human
agagcaagugauaugcuucccaggucaaaggaaacuaaaacugaaggauauuauaguucu

SEQ ID NO: 4175187 - RNA, 82 nt, Human
agagcagaaugucauuucaaaaaccacaucuaauauucuucuguggauguacaguuacuuugaaaauugauauuucugcuuu

SEQ ID NO: 4175188 - RNA, 59 nt, Human
agagcagagaaggcagcucugauaaugagaugacaaaacagagggcuuuucucuguucu

SEQ ID NO: 4175189 - RNA, 69 nt, Human
agagcagagcuucucagcuucagaacuguuggccagauaauucuuuguuguaagaggcucuucuguucu

SEQ ID NO: 4175190 - RNA, 55 nt, Human
agagcagaggcauggccguggggaggaggguccauggaacccgggcgucugcucu

SEQ ID NO: 4175191 - RNA, 58 nt, Human
agagcagagggcucugggacaagaauguuucucucuucucccucccuuuuccugcucu

SEQ ID NO: 4175192 - RNA, 65 nt, Human
agagcaggcacuggguaauuaguagcucuaccucuuagcaagguaugagcucccacuuuuggucu

SEQ ID NO: 4175193 - RNA, 86 nt, Human
agagcauggcuuucuccuugcugucuuuuucccuuccuaacaucacuauaaugucugugaggugagcaggcaugcagaagcccucu

SEQ ID NO: 4175194 - RNA, 79 nt, Human
agagccagaggaagaagcaaaccagcuaaucuccugggguggccugcauccccuuuaugcugguuucuuccugggcuuu

SEQ ID NO: 4175195 - RNA, 77 nt, Human
agagccagcagcagcauugagcgcuuguagggcaccaccuuugugcuaggcacgugcucagagcuuugauggccucu

SEQ ID NO: 4175196 - RNA, 56 nt, Human
agagccaggcggcugggcaccuucccccaccuuggugugucgaagcuccugucucu

SEQ ID NO: 4175197 - RNA, 76 nt, Human
agagccaguccucugggucaggacacaaaaguuccugggaggggauuuaugucugauacccagaaugccugccucu

SEQ ID NO: 4175198 - RNA, 60 nt, Human
agagccaguggacuucaguaugggucgcuuucauuggcagacccucaauccacuuguuuu

SEQ ID NO: 4175199 - RNA, 71 nt, Human
agagcccugacugaugcagugggucaccuccuaagguuuuacuagcagagggcugaugccauugcagcucu

SEQ ID NO: 4175200 - RNA, 69 nt, Human
agagccuccaguuuuuuucugaacuuugaaagucaguaccaaagagucagaacugaauggaaggacacu

SEQ ID NO: 4175201 - RNA, 60 nt, Human
agagccucucugaugugacagcuacaggaaguccggugcugugcuggcggcagaggcccu

SEQ ID NO: 4175202 - RNA, 55 nt, Human
agagccugaaauacaggucacugaguagccuuucuguggccuacauuuagguuuu

SEQ ID NO: 4175203 - RNA, 81 nt, Human
agagccugacugccaggcaggcagggguaucuuuggggcucugggagccccagccucuggauucugcccucagugagcuuu

SEQ ID NO: 4175204 - RNA, 57 nt, Human
agagccugagccugaucuugaaauccagucagcugcauugggaagggcaugggcucu

SEQ ID NO: 4175205 - RNA, 64 nt, Human
agagccuguaacaucuuucuuaggguaacuaugaacuccugguucagauuuuggcaaggcaucu

SEQ ID NO: 4175206 - RNA, 76 nt, Human
agagccuucaguucccuuucucaucucuucauguagggcuuaugaggguguuggggagaugggaaaugaaggcucu

SEQ ID NO: 4175207 - RNA, 74 nt, Human
agagcguaauacaaucuagcaguucauugugcuauggggcuuuugucauuuugcagugugcuguuggcagcucu

SEQ ID NO: 4175208 - RNA, 58 nt, Human
agagcuacugauaagcacaguagucugaagaagacuucucaguuuuauuaguaguuuu

SEQ ID NO: 4175209 - RNA, 90 nt, Human
agagcuauuucagggaugugaugagcugagccagcugcuggagagggacuccaugggaaaaugggcucggccgucagcuucaugagcucu

SEQ ID NO: 4175210 - RNA, 59 nt, Human
agagcucaagacgcucacaguaaggucuccaugaccugcugugacaucccuugugcccu

SEQ ID NO: 4175211 - RNA, 69 nt, Human
agagcucaaugaaagaaauaguuauguuaaaaauaaaugacauguauucuggaucugucaucgaguuuu

SEQ ID NO: 4175212 - RNA, 88 nt, Human
agagcucaggcagauaggaacaaguuuccuugcugugguucguguuuuugacagugggaacauuuguucuaguccagccguucacucu

SEQ ID NO: 4175213 - RNA, 85 nt, Human
agagcucaggugguaaugcgagugaugcagaguggcugcaaauacagaugaagcuuuguuugcucacccgccgcucaccuccucu

SEQ ID NO: 4175214 - RNA, 112 nt, Human
agagcucuuauaaaauugccaaaauaacugauuugaucugguuaacagagaccuaauccacaguguuuccuuuuggcuaggugugaaaaaguuuggcacuaugaaugguuuu

SEQ ID NO: 4175215 - RNA, 77 nt, Human
agagcugauaaguggcagagccaggguugggacacagguguguucaaagcccuuucugcuuuuacauuccagacucu

SEQ ID NO: 4175216 - RNA, 56 nt, Human
agagcugcuugcccagaagcagagcacauccguucuggagcucagcaugcaguucu

SEQ ID NO: 4175217 - RNA, 57 nt, Human
agagcuggcacugacccucacccucaauuauucgugugggcaguucaaugccacucu

SEQ ID NO: 4175218 - RNA, 56 nt, Human
agagcuguuagaagggauuagaucauuucaguuugcacagucccaucuucagcucu

SEQ ID NO: 4175219 - RNA, 70 nt, Human
agagcuuguuagaaaugcagcuucuugggccagcuccacagaaucagaaucugcauuuuuaauaacaucu

SEQ ID NO: 4175220 - RNA, 76 nt, Human
agaggaaucaucacacugucuuucagaaugguugaacuaguuuacauucccaccaacaguguaaagguguuccuuu

SEQ ID NO: 4175221 - RNA, 57 nt, Human
agaggacacagaugaacauuuauugagugcccucuuuagaaaucagcuggugccucu

SEQ ID NO: 4175222 - RNA, 86 nt, Human
agaggacucauuaagcaggagaaauguggcugcuaccauggacaccaugggugggagggcugcguuccucuugcuuccaaucuucu

SEQ ID NO: 4175223 - RNA, 72 nt, Human
agaggagaaauuuggggaccugaaagagaaacugcucucagucauaucuccuuaauuuucugucaacccuuu

SEQ ID NO: 4175224 - RNA, 122 nt, Human
agaggagaagaauggggcacaaggcgguuaaguaacuugcuuagagucacacagcugguggcagagcugagcagucugacucaagcuagugcuccugaccacugcauagugacccuuccucu

SEQ ID NO: 4175225 - RNA, 62 nt, Human
agaggagcuuuuggaaaaggccacucucccugggggcucgcucaucauccacaagcuucucu

SEQ ID NO: 4175226 - RNA, 91 nt, Human
agaggagggucuccucgaggggucucugccucuacccaggacucuuucaugaccaggaggcugaggccccucacaggcggcuucuuacucu

SEQ ID NO: 4175227 - RNA, 57 nt, Human
agaggaguuugggccagaaucugaggagggcuuggcugcugucccagacucugcucu

SEQ ID NO: 4175228 - RNA, 70 nt, Human
agaggauuacuucugcuugcccagugacuacagaccagcucuggcaugggcaaaccagggaaacuccucu

SEQ ID NO: 4175229 - RNA, 56 nt, Human
agaggcacaaacuggaaaggacaaagucuguugguccuugguuuuuugugcccucu

SEQ ID NO: 4175230 - RNA, 55 nt, Human
agaggcagaaguguucaaacccacguugugagucugguuugagagccugcauucu

SEQ ID NO: 4175231 - RNA, 75 nt, Human
agaggcagggaaggaaaggucucaugccuuucagguugacacuaagaaagaggcuuccauuccuuucccuguucu

SEQ ID NO: 4175232 - RNA, 62 nt, Human
agaggcaucacuaacuggaccuucuucagggagaggaaauagguauucagagagaugcuuuu

SEQ ID NO: 4175233 - RNA, 59 nt, Human
agaggccacggaagggagcugugugcucagaccuuguacaucaaccuccugugggcucu

SEQ ID NO: 4175234 - RNA, 56 nt, Human
agaggccagcccaggccaccgagccugcauccuaccucgugccugggucucccucu

SEQ ID NO: 4175235 - RNA, 57 nt, Human
agaggcccuggccugacucaauguugcccuggcaacaguagggccuggagggccucu

SEQ ID NO: 4175236 - RNA, 59 nt, Human
agaggccucccucccagcugguugugcacgccccauucaguuggcugggauggccgucu

SEQ ID NO: 4175237 - RNA, 71 nt, Human
agaggccugguuuguguuuccuggaaagggagugucguuacagcucuccuggggagcacacacacgccucu

SEQ ID NO: 4175238 - RNA, 86 nt, Human
agaggcuaauuugcccaagguuuuguagcuaggaaacagcagaauugggauuuucacugcuuuuuuggcuauguacauuguccuuu

SEQ ID NO: 4175239 - RNA, 75 nt, Human
agaggcuagagagcugcuuccagaguugagugguauagaaggcucacagacuugagaagcaccuuacuuuccucu

SEQ ID NO: 4175240 - RNA, 84 nt, Human
agaggcucugaagccaguguuugaagaauuuguuccugaaguaccuccuggggguaggcuagaggcuucuggcuucaggguccu

SEQ ID NO: 4175241 - RNA, 55 nt, Human
agaggcuuuguucccauuaaugguguguaacgcaugaagguagcacaaagccucu

SEQ ID NO: 4175242 - RNA, 73 nt, Human
agagggauggaauguauauugcaagcuugacuuuucuaauaaucuuugcucugcucuaacauuccugacuucu

SEQ ID NO: 4175243 - RNA, 99 nt, Human
agagggaugugggaauuagagaaguuuuacuuaagaauccuugaugaugcaguaaaaauuauauuuuuuaaguaugaacucuugaguacacaucuuuuu

SEQ ID NO: 4175244 - RNA, 55 nt, Human
agaggggaaucuggaucagugaauuugaaaaccuugaauuucuagauuauccucu

SEQ ID NO: 4175245 - RNA, 109 nt, Human
agaggggagauuagaggggaagacgggaccaguguucucaaguucuuucauuggggcagugucgaggucugguccagacucauucccucugguccagaucauuuucucu

SEQ ID NO: 4175246 - RNA, 73 nt, Human
agaggggccgaggggggguuauggagauggggacuaagauuuuccugcauuccacucuucucuggacuuaucu

SEQ ID NO: 4175247 - RNA, 56 nt, Human
agagggggaaaauagagguguucugacuagacuuaggauuccuggccucugccucu

SEQ ID NO: 4175248 - RNA, 59 nt, Human
agaggggguguuccagaagcauccucuccuccagcgauguggaucugggcuccuccucu

SEQ ID NO: 4175249 - RNA, 59 nt, Human
agaggggguugucuuccaagggucucuguuauuaaaagaccugaagaguuucucuuucu

SEQ ID NO: 4175250 - RNA, 65 nt, Human
agaggguaacaagaggccuggaugcaugaaauaagacuauuugggccaucaucuugugacuuucu

SEQ ID NO: 4175251 - RNA, 112 nt, Human
agaggguaccaguagaaaauuuuagcauuaucugucuuaucauugguauaauuggaugcugacacguggcauugacuuaaggccgaaaugcauuuuucuauuguuaccuucu

SEQ ID NO: 4175252 - RNA, 94 nt, Human
agaaaauaucagugagcuauuucugagauuuugccuaagcuuuguguguacaauauauagauauuagcaaaauuuuauucuuuugaugcuuucu

SEQ ID NO: 4175253 - RNA, 125 nt, Human
agaaaauaucaugcgagugugaaacaagggaguugaaaggugcuuucacucauuucacauuaugaauucuauccagugaaagcacucacuucugcucuuuucuuuuaacaucaucuugacuuucu

SEQ ID NO: 4175254 - RNA, 110 nt, Human
agaaaaucuuaaaccaaucuuaaaccaacuuaaacccacucauguagauuagcauagauuagcgugaucugcucagguaguuuaggcuuggggaaaaaguuagauauucu

SEQ ID NO: 4175255 - RNA, 83 nt, Human
agaaacauaagauucucagagagcuuagugugcugcauguuaaguugcagacagacaugcuaguuuucuuugaaucaguaucu

SEQ ID NO: 4175256 - RNA, 63 nt, Human
agaaacaucgcuuaguccucauuuacucacugggaaccucggaggauuucagcugauguuuuu

SEQ ID NO: 4175257 - RNA, 72 nt, Human
agaaacuccuaauucugcuuuaacagaugauggugugaauguguuuagauuaucauuuuuagagggauuucu

SEQ ID NO: 4175258 - RNA, 74 nt, Human
agaaagacgugaugaagaaguauccuaauauccaugcucuaaauccugggagcuuuucuuuccacaucuucucu

SEQ ID NO: 4175259 - RNA, 76 nt, Human
agaaagagcggcuggcagcuucaucccagauuuauagauuguggagcuggaggugucagaaaaaaaguuacuuuuu

SEQ ID NO: 4175260 - RNA, 64 nt, Human
agaaagaugggauuaguccugaucaucuguuagagaaugaucugagagcagaucaccaucuucu

SEQ ID NO: 4175261 - RNA, 74 nt, Human
agaaagcugcugcaauaacccaugagauagaagcugguggcuuugaucucagugguaguuguuguggagcuucu

SEQ ID NO: 4175262 - RNA, 63 nt, Human
agaaaggcaauauuaacuacacccauaguauauuggauguguaagcugaaauguugccuuccu

SEQ ID NO: 4175263 - RNA, 74 nt, Human
agaaagggucagguaaacacagggggauaggguaggccgauucuaagcaucucauucuugccuguccauuuucu

SEQ ID NO: 4175264 - RNA, 69 nt, Human
agaaagggugaauuagauaacuauggauuaggaaaaaaauccagacucuuuaaguucauuuuccuuuuu

SEQ ID NO: 4175265 - RNA, 62 nt, Human
agaaauaggagcuuaagcacuucuuuguacauugggaagaguguuauuugcucuguauuucu

SEQ ID NO: 4175266 - RNA, 72 nt, Human
agaaaucaucaacauacugcucaggcauuuaauuuuggugcuuugaauacugauguguguuugguguguucu

SEQ ID NO: 4175267 - RNA, 65 nt, Human
agaaaucccauuuuauaccauaagagcaagcauauuagguugcacucaaauaagaugggguaucu

SEQ ID NO: 4175268 - RNA, 66 nt, Human
agaaaucugaaauagugugaaguaggcuguacugcauugucugccacugucucuauucugguuucu

SEQ ID NO: 4175269 - RNA, 107 nt, Human
agaaaugcugaccugguaucuccucgauugcaguuccuucauggacaaauguugaaucuguuuuaagccauuagaagauguaauagagaguuaucuaaacuauuucu

SEQ ID NO: 4175270 - RNA, 74 nt, Human
agaaaugugaaacgcaaugggaucaucuggaaauaugaaacugaacuaugaugaaaaccuuuuuucucauuucu

SEQ ID NO: 4175271 - RNA, 72 nt, Human
agaaauguuugucggaugacuggagagacagguacacaaaaucaaccugugcuccaucauccauaaucuucu

SEQ ID NO: 4175272 - RNA, 79 nt, Human
agaaauuacagaaagcaauauugagugaaguacuguuauuaaccagaugaaacuuaaaguaguuuuacugugguauucu

SEQ ID NO: 4175273 - RNA, 84 nt, Human
agaaauuaguggguugccugcuguccuguguguuuacauaacagggcaccugagguaggaagggcccuuucaggacugauuucu

SEQ ID NO: 4175274 - RNA, 57 nt, Human
agaaauucaucucugcuagguuucauguucagcaucucuaaguguuggugaauuucu

SEQ ID NO: 4175275 - RNA, 58 nt, Human
agaaauuuguuugugcgaccacugccacuaucacucaggaacaaacaggcagauuucu

SEQ ID NO: 4175276 - RNA, 72 nt, Human
agaaauuuuugagggcaguauuagguugauugggcugauucccacagcuuugcuuuccuuaauauucuuucu

SEQ ID NO: 4175277 - RNA, 87 nt, Human
agaacaagacuuugauggagguugcacucuaguggaauauauuaugacucauaaaugaagugcacaccuuaguacaaaguaaauucu

SEQ ID NO: 4175278 - RNA, 72 nt, Human
agaacacuucuguugauaauaagcuuaaaagauauuuacuuuauuuugcuuacauguucauagaggaugucu

SEQ ID NO: 4175279 - RNA, 89 nt, Human
agaacagccuuuucuggccaccaagcgcugagcauucaugaccuuagccuugggacaggccaaaagggggauaaagguaacacuguuuu

SEQ ID NO: 4175280 - RNA, 57 nt, Human
agaacaggcuuccaggagggacgaaaaggguauuuucggccuuucagaguguguuuu

SEQ ID NO: 4175281 - RNA, 57 nt, Human
agaacaucugaagauacaaaguauuuaauaaccaggugauguguucauagguguucu

SEQ ID NO: 4175282 - RNA, 80 nt, Human
agaacaucuuauccauuuccucuuaauccaguuuauauucauccugagcccaucagagcaggagauggaaugagaguuuu

SEQ ID NO: 4175283 - RNA, 62 nt, Human
agaacauguagagcugucuuuuuuuccaaaugcaucccuuggauuacagagcuacauauucu

SEQ ID NO: 4175284 - RNA, 65 nt, Human
agaacauuccuggaagagugcuuaaguuguaggcaggcuuaccaaaggauauuccaggauguucu

SEQ ID NO: 4175285 - RNA, 69 nt, Human
agaacauuuggcaugagaauuuggucuugacuucacaauauggccaauauuagaucagaccaagugucu

SEQ ID NO: 4175286 - RNA, 74 nt, Human
agaaccaaagaaacccaagcucagggcaucagccccacccaaucucugcccgagccucgguuucuuuucuuucu

SEQ ID NO: 4175287 - RNA, 79 nt, Human
agaaccacaguggagcugaguguccuaggcaugggcuuagcccagcgacugugaccucagcuaaccaauccaguuaacu

SEQ ID NO: 4175288 - RNA, 91 nt, Human
agaaccaucacugagugacagcaguacuucucagagguauuugcagcuugaugcaaaguagucucuaaugaguaggcauucaggugguucu

SEQ ID NO: 4175289 - RNA, 62 nt, Human
agaacccuggaggaggcauaguaagcaaggcagagacugugagaguuuuucuaggagguucu

SEQ ID NO: 4175290 - RNA, 107 nt, Human
agaaccucucagaaucuguuuggagacauuuuaaagagccaugcugaaguuuuuccuggcacugccuaugcaaauguacucuaaggguaggaaggaauggagguuuu

SEQ ID NO: 4175291 - RNA, 82 nt, Human
agaacguaucaacuugcuguaagaggcaaaccugugcaaauuaaguuugucgaaauuaucagcaaacaguugguuucugucu

SEQ ID NO: 4175292 - RNA, 77 nt, Human
agaacuacccacauuucuggacugaaaaggaagugcuaguacccauuuuugacugaggccagagguagggcuguucu

SEQ ID NO: 4175293 - RNA, 56 nt, Human
agaacuagcuucugagcuggguauuaaggauagaaggauccaggucauguaguucu

SEQ ID NO: 4175294 - RNA, 71 nt, Human
agaacuaguuugaaccaggcuaauccaguuccaauugguugaaacuggauuaacuggcucaaaucaauuuu

SEQ ID NO: 4175295 - RNA, 62 nt, Human
agaacuccagggcauugucuccuggggcuaugguuguccucagaagaacaaaccuggagucu

SEQ ID NO: 4175296 - RNA, 60 nt, Human
gaaagugcaugugcccaccauuaguuuagcagauggaaauguauuugggcaugcccuuuc

SEQ ID NO: 4175297 - RNA, 89 nt, Human
gaaagugccaugcagaaauauccuggcgggggaacugcccacacagcugugccaguuauucacccucgccagauucuucaugcucuuuc

SEQ ID NO: 4175298 - RNA, 57 nt, Human
gaaagugccucaguccucuuauacucuguuuucuugcaaagguacugugggacuuuc

SEQ ID NO: 4175299 - RNA, 59 nt, Human
gagcagggcuuguccuccucaucagaccugacccugauagcaagggcuguuuucugcuu

SEQ ID NO: 4175300 - RNA, 65 nt, Human
gagcagggggagacauguguguguuuuaauuuuuaagacauuucauacuauuuuuccaacugcuc

SEQ ID NO: 4175301 - RNA, 68 nt, Human
gagcagggugccucauacaucauaaaaggcuacauggugcgucuuccaggagggugggcaaacugcuu

SEQ ID NO: 4175302 - RNA, 84 nt, Human
gagcagucagauggauggagaugcuuucucugagauggagacgcugagagcaaagcaugucuagggggccgugaugaagugcuc

SEQ ID NO: 4175303 - RNA, 99 nt, Human
gagcagugauccuauuugaaugcaauagcauuuuuaagggaaucagguccagccaauuucugauucuguaaggcuaaauucuauuaggcauuaaaacuc

SEQ ID NO: 4175304 - RNA, 56 nt, Human
gagcagugcuaggaguguugagccuuuaaaguucauugaaauguuucuagcugcuu

SEQ ID NO: 4175305 - RNA, 58 nt, Human
gagcaguggucacagggagggacauuaagagugugugccauucuagguggcagugcuc

SEQ ID NO: 4175306 - RNA, 87 nt, Human
gagcaguuauuguuguacccauuuugucaguagggaaucuaagguucagagagaccaaguggcguguccaaaauaaugauucugcuu

SEQ ID NO: 4175307 - RNA, 91 nt, Human
gagcauaguacacaguggaaauaacguggacuuuaggauaguauuauuauagaaauccaguuugucauuucccagcugugugaccuuguuc

SEQ ID NO: 4175308 - RNA, 78 nt, Human
gagcauauucuuuugaaacuauuuuaauguuaggcuuaagagagaauauauugaaguaguuccauuugugaguagcuc

SEQ ID NO: 4175309 - RNA, 79 nt, Human
gagcauauuuauaauaguuacuuugaagucugucuggugauuccagaaccuguuuagagucauuuuauauugacugcuu

SEQ ID NO: 4175310 - RNA, 60 nt, Human
gagcaucaaagugaucccagugaugucauguagauaggcacagagaaaauguuggugcuu

SEQ ID NO: 4175311 - RNA, 59 nt, Human
gagcauccccaaccccccaguuuacauaaaacccuuaaaaccugggguugccugugcuc

SEQ ID NO: 4175312 - RNA, 58 nt, Human
gagcaucugaugagauuggauuugucaauaagggcaguagccaggcccacggguguuu

SEQ ID NO: 4175313 - RNA, 105 nt, Human
gagcaugcuugucauugcagcaugauuacauguggagucugauugcagagggguuuugcuuuugguccacauuugauuuucauguaaguaaacuagguuaugcuu

SEQ ID NO: 4175314 - RNA, 62 nt, Human
gagcauggauagaaggugggauagagaauugggaucacuuuugcaauccaucuaccauguuu

SEQ ID NO: 4175315 - RNA, 65 nt, Human
gagcauggcauuaacaagauggaaggcuaacuuaauggaaguuccauugauaaaaugccauccuc

SEQ ID NO: 4175316 - RNA, 65 nt, Human
gagcauggguaccccuucugugcagaaggagacaccacagugucuugcagcagaagcccaugcuc

SEQ ID NO: 4175317 - RNA, 117 nt, Human
gagcauggguaucaucacuguugaauugugagguagccuuuggagggcccugguacaagcucccaguggugccuggcucuaucagugguggacauuacagaugaaugcccugggcuc

SEQ ID NO: 4175318 - RNA, 68 nt, Human
gagcaugguuccauagguuggucuuguuucaaucaagaaaauccucauagcagccuggaauccauuuc

SEQ ID NO: 4175319 - RNA, 57 nt, Human
gagcaugucgcuggcuuucccgggccuugguuuccaggcuggucgcgugcaugucuc

SEQ ID NO: 4175320 - RNA, 61 nt, Human
gagcaugugggggcaguggaguuagcuaggccugaaagccugcagcugccacgcccugcuc

SEQ ID NO: 4175321 - RNA, 60 nt, Human
gagcaugugugugcaccucugugcauguuuuugcguguguauuauugcauacacauauuc

SEQ ID NO: 4175322 - RNA, 63 nt, Human
gagcauugccacauggugcauuuccuagguaggcaugucuaaaaucauuaaguggccuagcuc

SEQ ID NO: 4175323 - RNA, 83 nt, Human
gagcauugccuggggacauggagcuccauggaggcugagcuccaggcucccugggugcuccugcucccagcccaggugauuuc

SEQ ID NO: 4175324 - RNA, 75 nt, Human
gagcauuuuggauugggcauuucccacugguugaugcacacagccaugugugguacagucccguuuaagauccuu

SEQ ID NO: 4175325 - RNA, 68 nt, Human
gagccaacgggcauccgaugugcacuggugcagcacccacugaggcacaggcagugcccccgcggcuc

SEQ ID NO: 4175326 - RNA, 56 nt, Human
gagccacagaaggaaauuggggauaggaaaggucuaaaauuuuguuagugugguuc

SEQ ID NO: 4175327 - RNA, 130 nt, Human
gagccacccacauuccuccaaucuuuuuauuguaaauuucuauccacuuuucacuaagaugaauuuguuuacaguuuauuuuugauaagucuugcaauacuuuuuggggaguguuaggggaaagaaacuc

SEQ ID NO: 4175328 - RNA, 67 nt, Human
gagccaccugcccuggccacugugcccaggucauccuucauugcuuggugagcacacccagggucuc

SEQ ID NO: 4175329 - RNA, 79 nt, Human
gagccacugcuuuaacagguaaaguaaaugugcuaaccaggcacacgcacaugccugauugacaagcauaugucggcuc

SEQ ID NO: 4175330 - RNA, 64 nt, Human
gagccacugugugcacugaaggcuucuccaauagcccuccaugagacacaguguaauaaagcuu

SEQ ID NO: 4175331 - RNA, 67 nt, Human
gagccagagauucacguuccaggagcccugacugucucaucucagggaauugaaucuccuugugcuc

SEQ ID NO: 4175332 - RNA, 74 nt, Human
gagccagccagccagggugcuggggcucagcucuugagaaaaauguugauguaaaagccuugguggccugguuc

SEQ ID NO: 4175333 - RNA, 91 nt, Human
gagccagccccagcccgccuggccgcucgagucacccuuaccccucccgaggaguggcgaggggagguccuggcggcgccggcggcggcuu

SEQ ID NO: 4175334 - RNA, 61 nt, Human
gagccagcugagcugcacugucugucugucaugcuuagagagugacgaccucggugggcuu

SEQ ID NO: 4175335 - RNA, 66 nt, Human
gagccagggcugugagcugagcgccacuagaucaagaaaugucagcuuuucucucagcuuuuccuc

SEQ ID NO: 4175336 - RNA, 58 nt, Human
gagccagggucucucgcucuguugcgcaggcuggagugcaauggcaugaucguggcuc

SEQ ID NO: 4175337 - RNA, 67 nt, Human
gagccagucaguggggccugggccuccugggaggaaggaagaggccugagucccaccuggcugucuc

SEQ ID NO: 4175338 - RNA, 64 nt, Human
gagccaguuggcuaugaggaggagggaagcgcauucaccuuuugucuucuuuauguuauggcuu

SEQ ID NO: 4175339 - RNA, 72 nt, Human
gagccauaugaaauugccauuuuuaaaggucaaaaaugauagacuauuggcaauuggcaauuucguaugcuu

SEQ ID NO: 4175340 - RNA, 57 nt, Human
gagccaucuuuucccccggcagcccagcagcucaccacuggggaggaggauguguuc

SEQ ID NO: 4175341 - RNA, 62 nt, Human
gagccauguaccuacaacagcaaaggcucagacaagccuucuccugccuuggguucaugguc

SEQ ID NO: 4175342 - RNA, 104 nt, Human
gagccauguguuguagguggccaugcuuggagcuggggaaacugagggaggcuuggagaggagcuguccuucagccucccagcucaaaguggcugccagggcuc

SEQ ID NO: 4175343 - RNA, 107 nt, Human
gagccauuccagagauagaauacggcacuauaaccuguuagaauagauaucaaaugucaaggauaacugggcuuucggguuuggaugccuccucucaggaauugcuu

SEQ ID NO: 4175344 - RNA, 74 nt, Human
gagccauuucccccugauuugugucugacaggggagcacugaggcugagauaucagggaggaagacaaaggcuc

SEQ ID NO: 4175345 - RNA, 55 nt, Human
gagcccaauuauuuuuaaggaugacgacagugcaugcuguuaagauaauggguuc

SEQ ID NO: 4175346 - RNA, 55 nt, Human
gagcccagcugcggcccucagcccugcccggugggcgcaggagcagacugggcuc

SEQ ID NO: 4175347 - RNA, 64 nt, Human
gagcccagguucugcuuccagcaccacucaggguguuaggucauagguagaaccugcacaguuc

SEQ ID NO: 4175348 - RNA, 128 nt, Human
gagccccaggacccaucaguccugcuggacaacugugagacugcuucugaacccagugaccuccaucucugggagcaguugcaucuccaguggucuccaccacaggcuggacagggucaagguggcuu

SEQ ID NO: 4175349 - RNA, 56 nt, Human
gagcccucauugaaucugcauuuuauagcauguacugugcaaguuucggggguauc

SEQ ID NO: 4175350 - RNA, 68 nt, Human
gagcccucgggcgagcccgcgcggggcugcacuccaccgggccggcgcugggggccgcgcgggggcuc

SEQ ID NO: 4175351 - RNA, 65 nt, Human
gagcccucuucugaugccaguaaccaugaugacucaacacggucacccaucagaguccagggcuc

SEQ ID NO: 4175352 - RNA, 67 nt, Human
gagcccuggcagguuacaaccaguuagcaccagagucugccuugaagaguuuccagccugcuugcuc

SEQ ID NO: 4175353 - RNA, 58 nt, Human
gagcccuguagcaagucaugucccuguaacgaugagugagcugacagcuaaggggcuu

SEQ ID NO: 4175354 - RNA, 69 nt, Human
gagcccuguguggggcugggcagugcagggaaggaaggaggcugagcuugcagugccagccuugggcuc

SEQ ID NO: 4175355 - RNA, 67 nt, Human
gagcccuuccaauugugagauuuuuuaauuauuauuauuauuuuauucuuuggagagauggggucuc

SEQ ID NO: 4175356 - RNA, 71 nt, Human
gagccggcggcagacggggauuggcaggcgcccgagcccagggcccgggccauggcugccccacaggccuc

SEQ ID NO: 4175357 - RNA, 89 nt, Human
gagccggucucuuuacaucucaaauaccagguauuuagguggcuuucuuggaaccuggcauuagggacacgugugaacgggccaggcuc

SEQ ID NO: 4175358 - RNA, 79 nt, Human
gagccuaggacaauggaggaccauccugguuucaccagaucacuacuaggggaaccagggggccuuccuucccacacuc

SEQ ID NO: 4175359 - RNA, 69 nt, Human
gagccuauagggguuuggaaagcagauuuuaugaaauuuaggaugagauauauuuccugcccaaggcuc

SEQ ID NO: 4175360 - RNA, 80 nt, Human
gagccuccauuuccuucuguuacaagucuugcauuguaaaacagcaaaggcaaacauuccacagaaggaaggaaagguuu

SEQ ID NO: 4175361 - RNA, 59 nt, Human
gagccucuggcuuucuggggccaucucaacaucagagauauauccagagcacagagcuc

SEQ ID NO: 4175362 - RNA, 113 nt, Human
gagccugaaucccccucaccucuagacggcacuuuccagucuauagagcagguucccauacagcuuuguaagguaggugugaucaggcgcucucaaggugaggaaacaggcuc

SEQ ID NO: 4175363 - RNA, 63 nt, Human
gagccugagccgccugagcggcggcguggcgcaggccgagcucuaccuggcggcucacggguc

SEQ ID NO: 4175364 - RNA, 70 nt, Human
gagccugcagcugacuucauaggaagacacaaaauaguuggugucucccuuuugagaggcucagaugcuu

SEQ ID NO: 4175365 - RNA, 57 nt, Human
gagccugcgcugccgccacccuuuaucuccaacgcgggagcgggacugcgcaggcuu

SEQ ID NO: 4175366 - RNA, 88 nt, Human
gagccugugcuuugagcagggcucugaaggagacagcugcuccugggcauacuggagccauuuccuucagggucaccagcucagguuc

SEQ ID NO: 4175367 - RNA, 81 nt, Human
gagccuugcagauuacaugauaauuauacuuaagggcugccaaggaacuucaggaauaauuaucauaugauuugcagguuu

SEQ ID NO: 4175368 - RNA, 58 nt, Human
gagcgacgcccaucgcgcuaccuccagaccaggagguagggcuaggcugcgucugcuc

SEQ ID NO: 4175369 - RNA, 75 nt, Human
gagcgagagcuggcuuucugcaaaucuccauggaauccagcuauggcccugugcugaaagcaaucaauucucauc

SEQ ID NO: 4175370 - RNA, 105 nt, Human
gaaagugcuguguuacagagcccuuagggucagcagccuccgaaccccugcacggaaccaggggcuggauuacugaacugagucugucucacaugcaaagcuuuc

SEQ ID NO: 4175371 - RNA, 106 nt, Human
gaaaguggggagagauaugguugggaaggugaacaugaugcagauucuaaaaggccaauggagcacguagcguuaguugccuacccaacagucacaacccccuuuc

SEQ ID NO: 4175372 - RNA, 94 nt, Human
gaagcagugcauuaauauuucuucuaaagcccuuuguacacacaguaguccuacugaaggaaugaaugacauauuagcucuauuuauaugcuuc

SEQ ID NO: 4175373 - RNA, 130 nt, Human
gaagcagugcucucuagugaggaugggggucugucugcaaagauuggaagccacacucauucagugggcuccaaaauccuguagccucccucuauaucuuaauaauuuuuuuuuuuugagacagaguuuc

SEQ ID NO: 4175374 - RNA, 57 nt, Human
gaagcauauagguacugaacuagcaaauaaaggauccucagucaguaccggugcuuc

SEQ ID NO: 4175375 - RNA, 61 nt, Human
gaagcauggagaccguggugauaguugccauaggugugcuggccaccaucuuucuggcuuc

SEQ ID NO: 4175376 - RNA, 121 nt, Human
gaagcauguaaagcuagguggaccaaugcauucugcagauauucucccaaguguugcauccaaguggaugaacuggaaggauugcagaugucauuguagaugaucuagugccaggugcuuu

SEQ ID NO: 4175377 - RNA, 62 nt, Human
gaagcaugugucugugaagugaguagaugagugcauaaaauaucuuugucagaacaugcuuc

SEQ ID NO: 4175378 - RNA, 61 nt, Human
gaagcauucacaccaugggcuauuacggcaugacccggaaggcagugaugugaagugcauc

SEQ ID NO: 4175379 - RNA, 56 nt, Human
gaagccaauauaaaagcaugugauuaaauaauccagaugcugaauuauugugcuuu

SEQ ID NO: 4175380 - RNA, 80 nt, Human
gaagccacucugcagcucggccagcuguuccuugaccucacaggucugggagagcacguggcugacagcgguguggucuc

SEQ ID NO: 4175381 - RNA, 83 nt, Human
gaagccaugacugugugcccaguccuggccaguaacaugaagaaaacagguccucagguggggaggcaugcaguucugacuuc

SEQ ID NO: 4175382 - RNA, 86 nt, Human
gaagcccagaggguccuccuuccagguccagggauguggacaagugccguuuugcauuuuccuagccuggaagauccucuggcuuu

SEQ ID NO: 4175383 - RNA, 129 nt, Human
gaagccugcagggguggcgugggaggggaaagaaaagaugaacugucuucacccauggcuagauccagaggcugaaugaugucaucaugucucucuuucccuuaucuuggucacucaucucugcuuuuc

SEQ ID NO: 4175384 - RNA, 84 nt, Human
gaagccuuauguuauuuucuaagauaaaacuugaaugaaauuucuugaaguuucuugaaucuuggagugggacuuucaggcuuc

SEQ ID NO: 4175385 - RNA, 87 nt, Human
gaagcuaacuuccucaaugauucugggaguguaggaugguuacgaagccaauuucaacugucuugccuacucagcauuggcuguuuc

SEQ ID NO: 4175386 - RNA, 87 nt, Human
gaagcuaucugauugcaccggucacuuucauuagguuaacaugugcacauuuagccaaacaggugaaauugauuuaugccaggcuuu

SEQ ID NO: 4175387 - RNA, 79 nt, Human
gaagcuauuacugcaugcaccuaagcuucuagaaguuugcaccugaaaagcuucugagguccaugcaguacugagucuc

SEQ ID NO: 4175388 - RNA, 114 nt, Human
gaagcucuguaguccuacacugaaguguguucccuuggcuguucauauggggcuggguuugguugaacuuccauucuguauaaaugcuagaacacaguuacuacagauugauuc

SEQ ID NO: 4175389 - RNA, 77 nt, Human
gaagcugcacauuguccucugaugccuucccuggauuugugcagagacugggagggcuuucagggaggaucaguguc

SEQ ID NO: 4175390 - RNA, 73 nt, Human
gaagcugcccugggucuugcugcugccucuccccuucaaagcagcugucuccagauacaggauugccagcuuc

SEQ ID NO: 4175391 - RNA, 105 nt, Human
gaagcuggggaagggaauugcaggcagcagaaguagaaguacagguaaacugcacacauguguuucgagacuguugaguaguucagugacuugucccuaagauuc

SEQ ID NO: 4175392 - RNA, 121 nt, Human
gaagcugugcuugcuuugaaagagcugugcuaaguaucugcagaauagcugcuccaaaaauggaaucuuuauuccagguacuugguuucuaauuuuuuuuucucuugcagguguaaccuuc

SEQ ID NO: 4175393 - RNA, 57 nt, Human
gaagcuguggggaggaggcuagcagaugcucuuugcauccuucuugucaucagucuc

SEQ ID NO: 4175394 - RNA, 55 nt, Human
gaagcugugugaagcucugaaguuguccuuagucucacguggucacaugagcuuu

SEQ ID NO: 4175395 - RNA, 130 nt, Human
gaagcuguguuuccugagcuggagccagagaaucggucugggaucccugagggccgguuguuuuuaccauagaugacaaguacaggggccuguccuggcuucugcugguaccagcuugcauaauagcuuc

SEQ ID NO: 4175396 - RNA, 78 nt, Human
gaagcuuacacaacugucuuuauauauuuggaaaauuucagcugaaagagagagggaguagagauugugucuggcuuu

SEQ ID NO: 4175397 - RNA, 69 nt, Human
gaagcuuccugcagcuccugagcucagagacagcaguggcuucucugugcaggaugcugaguucacuuc

SEQ ID NO: 4175398 - RNA, 102 nt, Human
gaagcuuuuauugcccuagaaagaggcugcccauaaacuuuccaccugcuuuaaccgcuggggaauguguggguauccacgauuucuggccaaugagaauuu

SEQ ID NO: 4175399 - RNA, 128 nt, Human
gaaggaaaggaugaaguacaaauuguguaaggguugacuuuacaguuuucuuagggcaauagucugcucuaugaaaaacuguuaagcucuuuucaugacagaauaccuuuaugacaucccuuucauuc

SEQ ID NO: 4175400 - RNA, 96 nt, Human
gaaggaacuuuugauuuggacugauagaauucacccggagcuggagagcuauucugaguggaaacuaucaauacauuuagacugauuuguuuuuuu

SEQ ID NO: 4175401 - RNA, 91 nt, Human
gaaggaagacaccaugggacaggccagacaggagacugagaauucugaaaccuuaguccucaucuuggcuugguccuuacggucuaccauc

SEQ ID NO: 4175402 - RNA, 55 nt, Human
gaaggaagaggugcuuuuaccaccacccaaggaugaaagcagugauuucuccuuc

SEQ ID NO: 4175403 - RNA, 88 nt, Human
gaaggaagcagcuguuuugacuuauuccuuugaguuucuuuaaauuaccuuaguuucauaugcaaaauaguauuaacaugcuuuuuuc

SEQ ID NO: 4175404 - RNA, 80 nt, Human
gaaggaaggccagagagaguacugggcucugagauagagauuuccguuccagcauuuauguauuuuucuaguuaucuuuc

SEQ ID NO: 4175405 - RNA, 62 nt, Human
gaaggaauucugagcuuagauugcuugcuucuuuuagcuugaauacagugaagaauuucuuu

SEQ ID NO: 4175406 - RNA, 95 nt, Human
gaaggaauuuugcucuugucacccaggcuggagugcaguggcaugaucucgucucacugcaagcucugccucccggguucaagcaauuccccuuc

SEQ ID NO: 4175407 - RNA, 73 nt, Human
gaaggacaagauuuuaugacucuuuuuccaggacaccuggcaaagccaaauuuucaucaaggucauugcccuc

SEQ ID NO: 4175408 - RNA, 106 nt, Human
gaaggacagacagggucggcucuugguggguuaaguggggcguggcugugugcucagcugaggaauacuagauguaugcagaaugagaugauucgguuuguguuuu

SEQ ID NO: 4175409 - RNA, 57 nt, Human
gaaggagcuaccaagacugaauguggcuaauaaagccucuuuaguuccuggcccuuu

SEQ ID NO: 4175410 - RNA, 65 nt, Human
gaaggagggaagcccagcuguucccacuguucucaccacaugggagcagccugccucccaccuuc

SEQ ID NO: 4175411 - RNA, 76 nt, Human
gaaggagggccagcggcacagccuggcccuggaccgagcacaccggggccgucaauggacucgcuggagguccuuc

SEQ ID NO: 4175412 - RNA, 79 nt, Human
gaaggaguagggacagagacuugcuggaggcaccuggagaguguguuuccucacuucucugacucuucccagauccuuu

SEQ ID NO: 4175413 - RNA, 68 nt, Human
gaaggaguaggucaugcucuaauuugcauccauggauguauguuaguguauuaucuaaaugacacuuc

SEQ ID NO: 4175414 - RNA, 73 nt, Human
gaaggaugauugaagaaugugucugaucauuguaaagauuuucaaauacauggucaaucaacuuuuguccuuu

SEQ ID NO: 4175415 - RNA, 71 nt, Human
gaaggauucaccuacaaguuucaaagagaucauggcucugcugacaccuugauuuuaaacuucuagccuuc

SEQ ID NO: 4175416 - RNA, 65 nt, Human
gaaggauugcccagaagagacgugaaggggagcauuagcaucucuucauggccaucugguucuuc

SEQ ID NO: 4175417 - RNA, 86 nt, Human
gaaggauuugucacaaagcgcgguggucgguuaccgguuaccacauaagccaaggccuugaucugcuguguuugaggaaacccuuu

SEQ ID NO: 4175418 - RNA, 78 nt, Human
gaaggcaaaggggaaugcuuguggguucuaguucauuuuugagggcuccagcucaaauucagcuuccaguuugucuuu

SEQ ID NO: 4175419 - RNA, 76 nt, Human
gaaggcaaucaagcagagagguuagaacacaggcuuuggaauuagaccuggauuugaauuccucucugaugccuuc

SEQ ID NO: 4175420 - RNA, 68 nt, Human
gaaggcagcuaagauggauaaugaacagugaugauaauucaggucauuuagccguucuuaguucuuuu

SEQ ID NO: 4175421 - RNA, 68 nt, Human
gaaggcauucuauucuacauauuggagccaaagaggaagaaaaaagugugaggaugagucaugccuuc

SEQ ID NO: 4175422 - RNA, 57 nt, Human
gaaggccauuagagccugugccuuuucuuuggcuuccuugcagucucucuggucuuc

SEQ ID NO: 4175423 - RNA, 55 nt, Human
gaaggccguucaaaccucaacauugaucacccggugcagaggacguggcggccuc

SEQ ID NO: 4175424 - RNA, 55 nt, Human
gaaggccuaggaaggaagccuuaagcuacuugaugcugcuucuuaacuggucuuu

SEQ ID NO: 4175425 - RNA, 92 nt, Human
gaaggccugaagaagcaucuaggugacugacauacagggaauucaucccuuaucuuucuguccuagauucugagcucuuuucauuugcuuuc

SEQ ID NO: 4175426 - RNA, 82 nt, Human
gaaggcgaaacuuaagacacauuucucagacgggccugggccacuuuccugugcugagugaugugacuuacgauguguguuc

SEQ ID NO: 4175427 - RNA, 75 nt, Human
gaaggcugcaguucucaauuucuauugaucauaauuucuauacauuuauggaauggagaaagucugcagcucuuc

SEQ ID NO: 4175428 - RNA, 80 nt, Human
gaagggaaggaagugaaguggcagcuagaaaucaggcugugagccugaaguuucacgcgucauucaauguccaaucuuuc

SEQ ID NO: 4175429 - RNA, 63 nt, Human
gaagggacaccagaagacauaagcagaaggaaggcuuuugcuccugguucugguguacuuuuc

SEQ ID NO: 4175430 - RNA, 78 nt, Human
gaagggauucugguuguguuuuacacuuggggagugucuuucuucaaagauuugauaaagccacgagugagugccuuc

SEQ ID NO: 4175431 - RNA, 77 nt, Human
gaagggauuguguuuuuaguaugcacuggguuuaccaaagguguaucuuauguuguauucaaaaucgccauucauuc

SEQ ID NO: 4175432 - RNA, 55 nt, Human
gaagggcugcaggucugggcccccuuuuuggguacgcuggccccuaucucccuuc

SEQ ID NO: 4175433 - RNA, 66 nt, Human
gaagggcugcaucacaauggccuguagacuucauccuucccucacucugccuguguucagccuuuc

SEQ ID NO: 4175434 - RNA, 63 nt, Human
gaagggcuuauuuacccucacugcagcccaacuaugcugcucuguaaucuaaagaagcucuuu

SEQ ID NO: 4175435 - RNA, 87 nt, Human
gaaggggaaggaaagggucaucauucugacaagucuacauaccaaauugguugcagagcuuaagagagagcccacaucuucuguuuc

SEQ ID NO: 4175436 - RNA, 76 nt, Human
gaaggggaggaggccaguggaaggaagcacugauuccucugggaguccuggcuucuaucacugcuucugcucuuuc

SEQ ID NO: 4175437 - RNA, 125 nt, Human
gaaggggguuagauggaggaaguaauaauugggccucaaauccuauuauauuucuuuuggauaguguaauggagcuuagaguuaucccaaggauguuaucgccgacaucuuucuuuaccccuuuc

SEQ ID NO: 4175438 - RNA, 58 nt, Human
gaagggguccugucaacaaacaaugggaagcuucagucucaacaggauccuccacuuc

SEQ ID NO: 4175439 - RNA, 68 nt, Human
gaaggggugucuuggaaaguuaucauuuuccuguacucagcuagaauguuccuuuucauuuucccuuu

SEQ ID NO: 4175440 - RNA, 61 nt, Human
gaagggucuuuaugcaaauaccuuucaggaaggcgugcgccucaccuguguuugcuccuuc

SEQ ID NO: 4175441 - RNA, 58 nt, Human
gaagggugggagaaucuuuaauccuuggcaugggggaauuaagaaucucugacucuuu

SEQ ID NO: 4175442 - RNA, 73 nt, Human
gaaggguugaggccagacauaucgcucccaaacuuaaacaguuuccacgugagaguuuggcuccuaaaucuuc

SEQ ID NO: 4175443 - RNA, 63 nt, Human
gaacuaaaguucacggucagcuuuaggaauucuaaaaggcugaaagaccuugaaccuuaauuc

SEQ ID NO: 4175444 - RNA, 62 nt, Human
gaacuaaaugaaauuacugguguucaguuuucaccuauaaaaccagcaguuucaugugguuu

SEQ ID NO: 4175445 - RNA, 78 nt, Human
gaacuaagugguggagccaggaaaugugguuugcauuaucauauguggcuucaaguuuugccuccccauccucaguuc

SEQ ID NO: 4175446 - RNA, 63 nt, Human
gaacuaggagacucccagcuagucuugguaguucccaagaacugugcuccaggcuccaacuuc

SEQ ID NO: 4175447 - RNA, 90 nt, Human
gaacucaggugugugguggaaggcagcacaugugaccuaaucuauauuuugacaaagaagaaagcucccugcccucccuugcaccaguuc

SEQ ID NO: 4175448 - RNA, 55 nt, Human
gaacuccagggaacagagccaccacauugacuguggccugauacuuccagaguuc

SEQ ID NO: 4175449 - RNA, 122 nt, Human
gaacuccuaacccacaagcucucuccccucuaccuucccuuuccugagccacggcccagucaguuaaucugggcucugaagggugacagguuuggggauaaaagacaaaaacccauggaguc

SEQ ID NO: 4175450 - RNA, 75 nt, Human
gaacucugagacgcaguguuggggaacagugggagcucccagcucagcacccagcacucagcaggcucauaguuc

SEQ ID NO: 4175451 - RNA, 84 nt, Human
gaacugaaaugauaccuucaggugaguccagaguccaaauccucaaaggagggauuuaggaaaggauucgagaggaucagguuu

SEQ ID NO: 4175452 - RNA, 67 nt, Human
gaacugcaaccccaggacaaguucugaccugacccagucuggcccaggcuccuggggcaccauguuc

SEQ ID NO: 4175453 - RNA, 71 nt, Human
gaacugccuggccagacccuauagagguacaauuaggucacucuagggcaucugaccauggguggcaguuu

SEQ ID NO: 4175454 - RNA, 68 nt, Human
gaacugcuuuaucugagaaguccuuuaaauugcuucgucugaggaaaagaagaggguaaaggcaguuc

SEQ ID NO: 4175455 - RNA, 89 nt, Human
gaacuggacuuaauuauuuagauaugguuggaguagcacagacccaagcaaaacugcaccuccuuuguuuuagauuauaagucuaauuc

SEQ ID NO: 4175456 - RNA, 69 nt, Human
gaacugggcucaggggaccuccuggugccaccugcauaucugagcccauggaguuccucuggucuauuc

SEQ ID NO: 4175457 - RNA, 56 nt, Human
gaacuguauaggagcaguguuucuuuauuucacuggaaauauuuucuugacaguuu

SEQ ID NO: 4175458 - RNA, 66 nt, Human
gaacuguaugaaauugucauuuuuauagguuaaaaauugugaaauguugguaauuuuauauaguuc

SEQ ID NO: 4175459 - RNA, 107 nt, Human
gaacugugagaaauacuaaguuggugcaaacguaauugugguuuuugcaucaaccuaauaaaaaacugcaauuauguuugcagaaaccuaauauauuucuguuguuu

SEQ ID NO: 4175460 - RNA, 59 nt, Human
gaacugugcugguccagggagcugguuuugagaagccugggcuuccacgagcagagguc

SEQ ID NO: 4175461 - RNA, 119 nt, Human
gaacuguuuuuuaauaugagacugagggaugauauccuggaucucacaggggcuggauuuugccugaguguuagagcuaagauaacaucuuauucuugucuauauuucaagaagcauuc

SEQ ID NO: 4175462 - RNA, 65 nt, Human
gaacuuaguagucuacuucuuauugcuguaccucaaaccagugccaaaguauggcucuuagguuc

SEQ ID NO: 4175463 - RNA, 61 nt, Human
gaacuuaguuuuucucugacccuguugaaucacaguucaacaauagagauaaagugagauc

SEQ ID NO: 4175464 - RNA, 55 nt, Human
gaacuugaaugagaacuuuugccaaucuaugauuugagcauguccauucacguuc

SEQ ID NO: 4175465 - RNA, 105 nt, Human
gaacuugcuuuucaaagguagcaugcaagacaaucuuuaaaauccuuacuggauucuuagacaugaucuuguucuuacaugcagcagaacuuguugagaaguuuc

SEQ ID NO: 4175466 - RNA, 69 nt, Human
gaacuugggcagcauccuccacagucaaacguucuaagcucuuuugugugacugggcuggcccauguuc

SEQ ID NO: 4175467 - RNA, 62 nt, Human
gaacuuggugggggagggaauagaugucugccgaccauauucacagcugccgcacucaguuu

SEQ ID NO: 4175468 - RNA, 68 nt, Human
gaacuuuaucaaaaguuguuuaccauuguggaauaucacauuacuaacaauuguugaacuuaggguuu

SEQ ID NO: 4175469 - RNA, 55 nt, Human
gaacuuuauugauucucagggguugcagcauaaacuccugagauuuaagggguuc

SEQ ID NO: 4175470 - RNA, 92 nt, Human
gaacuuuugaaaaauauguauaucugugucccaaaccccaaaaucccagauuuaauuggugugggugggacaucaucuuuuuuuaaaagcuc

SEQ ID NO: 4175471 - RNA, 66 nt, Human
gaacuuuugggaagccgugugacugucaucauuccagcuagaacacuuucuuccuccagaaaguuu

SEQ ID NO: 4175472 - RNA, 59 nt, Human
gaagaaaggacagagugaaacugucagcucauguugccucagugcuuccuccuuucuuu

SEQ ID NO: 4175473 - RNA, 68 nt, Human
gaagaaagggcacagggaaagagugcaccuaaaccuacaggugugauuaccucugugccuugggcuuc

SEQ ID NO: 4175474 - RNA, 78 nt, Human
gaagaaaguggguuuauuguauuucccuuaagauugugagggaguguggauacaguagaaugagccaacaguuucuuu

SEQ ID NO: 4175475 - RNA, 71 nt, Human
gaagaaauugugaucaaaagcugggauuguuuucagaaaaaccuuauccuggcuuuaggucagaggccuuu

SEQ ID NO: 4175476 - RNA, 79 nt, Human
gaagaacacaauuuuuuaucuauguuuucgcgaaggggaccagagcguuccuuccuuuguggggcgguggguaaucuuc

SEQ ID NO: 4175477 - RNA, 61 nt, Human
gaagaacauguuaaaagauucacauuuagaaauucuggaguggggcccaggacuguucuuu

SEQ ID NO: 4175478 - RNA, 88 nt, Human
gaagaagaaguucucuggggacuugguuggagccggaccuguccgauaugguuuccaauccaaacuucaccuuuaaggaagucuucuc

SEQ ID NO: 4175479 - RNA, 56 nt, Human
gaagaagaugaguaauuuuuccuuaaugauggaaacauucucuccaugucuucuuu

SEQ ID NO: 4175480 - RNA, 82 nt, Human
gaagaagggggcgaagacgugauugaaugugucggugcucauuaguucuucugucagucgaucacgaggugccguuuucuuc

SEQ ID NO: 4175481 - RNA, 66 nt, Human
gaagaauggaguugugcuguccgcggugcugaaaguuccgaucccauguagugacuucauuccuuc

SEQ ID NO: 4175482 - RNA, 129 nt, Human
gaagaaugggccagggcugggagacaaagacccagauggcgaggccgggacaggcuggaguccggcuucuccgguccaggaugcccgcuuuugcuuuuucaaaagucucaugcccugugcuuuuuccuc

SEQ ID NO: 4175483 - RNA, 103 nt, Human
gaagaauguguagaaacugagagaagggauuuuaagucacccuuucauaauucaccucagaggauacuaaacauucuugucucucaauaaguacaucuuuuuc

SEQ ID NO: 4175484 - RNA, 83 nt, Human
gaagacaacguuaaagguaacaugaacugcuuuugccaugaggcaauaaagcuguaaaugauuaucuuuuuaguucaguuuuu

SEQ ID NO: 4175485 - RNA, 69 nt, Human
gaagaccuauuuguucaguggagagcaaggcuuacaucuaccuguuacuccuuuggcagauuaugcuuu

SEQ ID NO: 4175486 - RNA, 61 nt, Human
gaagaccuguuagcauucagcugcauuccuguggauuagaaagcuccagugcugacgcuuc

SEQ ID NO: 4175487 - RNA, 79 nt, Human
gaagacggcccaaaccaaguaccucaaauccagugucccaagaacuguuuuuaguguuugagguuguguaccugucuuu

SEQ ID NO: 4175488 - RNA, 63 nt, Human
gaagacucacaagugaugugaauggcaaagcuuggcuugaagcuguucccuugugccucuguc

SEQ ID NO: 4175489 - RNA, 69 nt, Human
gaagacuguuuuucggugugaggcaugaggcacguaagcuguaaagugcucuucaguggugagcucuuc

SEQ ID NO: 4175490 - RNA, 111 nt, Human
gaagagaaagagggagaagggggggagagagagagagagagagagagaggcauuucagcuuuagcuuaauuggcuuauuuccucaaacccauugcuuugucgcguuucuuu

SEQ ID NO: 4175491 - RNA, 96 nt, Human
gaagagaaucauaaugcuuugauucaaaaaccacuccacgacuuuuagaaaaaccacaccuagucugugggcaugggaaucucaaugaggcuuuuc

SEQ ID NO: 4175492 - RNA, 78 nt, Human
gaagagagacaugcauugagaauuucucagggaugaggauggccaaaagauucuagagaacucgagugccuuugauuc

SEQ ID NO: 4175493 - RNA, 89 nt, Human
gaagagagaggucucagggaugguugagaauugguacuguagcaagaaaggauaccaauuccgaucacccaauaaauaucccugucuuc

SEQ ID NO: 4175494 - RNA, 94 nt, Human
gagcgaucccauuuugaaagccagcuuuucuuaucauuauaaggcaacuguguuuauaagaauaagacaaggcuuccugcugagaaacaugcuc

SEQ ID NO: 4175495 - RNA, 72 nt, Human
gagcgccuaaccuggggcgguuucccaauaagucugucuaacguugggaccucuggcccagaguaguguauc

SEQ ID NO: 4175496 - RNA, 57 nt, Human
gagcgcggugcagccccuggaguugagcacgcuuuguuuuccccugcucuggugcuc

SEQ ID NO: 4175497 - RNA, 61 nt, Human
gagcggaaggccuggcugauccggagccccaaaaggaauucugacaacaugccuuuugcuu

SEQ ID NO: 4175498 - RNA, 81 nt, Human
gagcggccagccagauaagcagcagccguuauaggcuugagccugauaaaaaauguugcuugaggccgggcaugguagcuc

SEQ ID NO: 4175499 - RNA, 89 nt, Human
gagcgggguggcauuaggccaggugcauagcccagugcugcucucucuggacuuucugcucucucuggacuuguuugcuagcugagcuc

SEQ ID NO: 4175500 - RNA, 87 nt, Human
gagcuaaauugccuuuucauguuuuauucaguaauuauagauacuauaauuucacugauaugaagucauucuacaggcaguuggcuc

SEQ ID NO: 4175501 - RNA, 126 nt, Human
gagcuacaugaugguuguucuuucguuccuccauuggauccuucaacauuuuugaacaucuauuauuuuaaaggccuugagcugggugccagggauauaaagaugaaagaacagaauucauaucuu

SEQ ID NO: 4175502 - RNA, 84 nt, Human
gagcuacauuaagcugccagccuucauuaucaauccaugcacuucucauuaggauaaacagaggcauggcauggaugguggcuc

SEQ ID NO: 4175503 - RNA, 56 nt, Human
gagcuaggccugaccuuggaguuugagaucacuuccaagaaguagggccuggacuu

SEQ ID NO: 4175504 - RNA, 79 nt, Human
gagcuauugguccuaggaagggcagggccuaaaagauacgccuuuuacagcuuacauuuuaccuuggacacuuuggcuu

SEQ ID NO: 4175505 - RNA, 77 nt, Human
gagcucaaagggaaauguguuguucauuucuaaaaaguguuuaggguauuaugaaauauguuuucuucauugacuuc

SEQ ID NO: 4175506 - RNA, 57 nt, Human
gagcucaagcacauuuuguggugccaaaauauggcuugccucagaggguuugaguuu

SEQ ID NO: 4175507 - RNA, 70 nt, Human
gagcucaccucauugcucuacagcaacaguuuuaacuacuggagccugccuggagcuugaggugauccuc

SEQ ID NO: 4175508 - RNA, 79 nt, Human
gagcucagccacuacaauugguuccauucuacaguaauuauucucaugugguuuguggaacucaauugugaggucccuc

SEQ ID NO: 4175509 - RNA, 110 nt, Human
gagcucagggaaagcaaaaaaggaaguggggaauuugccugacagaccccagugagcaaaauuagcaucagccacaggcaggagguucuccaguuauuuuuccucugcuc

SEQ ID NO: 4175510 - RNA, 73 nt, Human
gagcuccaaauauguguaaaguacuguguugagccuugaggauacaguaaacaaugcagcaaauuucuggcuu

SEQ ID NO: 4175511 - RNA, 86 nt, Human
gagcuccaugccaccaucuggcuguguugaccugugguuuguggcucuagcuguucuuucaauaugccaucaaugguggggaguuc

SEQ ID NO: 4175512 - RNA, 57 nt, Human
gagcuccauuguaaucaccugguggcuugucuguuuccaccaggagacagugagcuu

SEQ ID NO: 4175513 - RNA, 115 nt, Human
gagcucccuaggggcaaguauagguggcuaagaguugaagaaauaguuuugauugguucuucucaauagaaauguauuuuggacuagucacuauugccagccuuuggguugaguc

SEQ ID NO: 4175514 - RNA, 75 nt, Human
gagcuccgauaagcaauucuugugcuccauauggcgacuguugacugggaccacaggaauugcucugugguguuc

SEQ ID NO: 4175515 - RNA, 57 nt, Human
gagcuccuauggucgguggcucugcaacuucucacggcagcgccuggacggaggcuc

SEQ ID NO: 4175516 - RNA, 103 nt, Human
gagcuaccucuuuaccaccaaugugcaaugcaaucuuuauuauauucuaggcagaauagauguauaauauacguguguuucagcgugugguaggguguaucuc

SEQ ID NO: 4175517 - RNA, 67 nt, Human
gacaggucaccucucaucacaugcuacgugacaguuaccuguagugugcaggggggggaagcagguc

SEQ ID NO: 4175518 - RNA, 84 nt, Human
gacaggugugccaugauuggaaggaagccaaggaagguuucuaggaugcuggugacguucuguuucuccaucaggaugcuuguu

SEQ ID NO: 4175519 - RNA, 87 nt, Human
gacaguaauaccuuucuaacacuugauuacagaaucacauuugaacuauguacaagaucuuaggauguuggaggugguaggacuguu

SEQ ID NO: 4175520 - RNA, 69 nt, Human
gacaguauaaaauuaaaccuuagguuagcagggccaaaugcuggcagggccugaaucuuauacucaguu

SEQ ID NO: 4175521 - RNA, 77 nt, Human
gacaguauucugggggaucuuugguaacauuucuucugaaaauugcuugucuucuucccuacuagaauguagcuguu

SEQ ID NO: 4175522 - RNA, 71 nt, Human
gacagucacaguuuuaagugugauccacaguggucagaaauuuggauuccaugucaaaauacagaacuguc

SEQ ID NO: 4175523 - RNA, 61 nt, Human
gacagugacagcuuggaaagcagggcauuagaccagcuauugagggaggcuguuuacuguc

SEQ ID NO: 4175524 - RNA, 73 nt, Human
gacaguugauagugucugacauuuaagagcacuuauacuuuuuaaguucucuucaacuggauucuaaauuguc

SEQ ID NO: 4175525 - RNA, 76 nt, Human
gacauaagcaaaggaauuaacaauauauuuaggugcaggcacauuucuaaaugugguugaucagcugacugagguc

SEQ ID NO: 4175526 - RNA, 64 nt, Human
gacauaauccuccucaccuacuggucucccugggucccuccaccaauggugagguguuacuguc

SEQ ID NO: 4175527 - RNA, 60 nt, Human
gacauagcuugguacuaccagggagucagaauacucagaacucaggagacuaacuauguc

SEQ ID NO: 4175528 - RNA, 63 nt, Human
gacauaggagcucugugccucacugacuaugagcuugucagagaacugcagcccuuccuuguc

SEQ ID NO: 4175529 - RNA, 87 nt, Human
gacauauuuacuccugccauuuacucgugcuucauugaauuucuucauuuugacauucagagcacuggguagaauucacguuguguc

SEQ ID NO: 4175530 - RNA, 56 nt, Human
gacaucaggaagacaugagaggcuaggcucagugccucuccagugguuccugauuc

SEQ ID NO: 4175531 - RNA, 67 nt, Human
gacaucaggauuuuauagucaggaaaaagacuguucuguuugcccacgucucugaagaucugguguc

SEQ ID NO: 4175532 - RNA, 70 nt, Human
gacauccacgaacuaauggaggcuguuggacagacaagucuagagcuuagagaaugaguuugggguaguu

SEQ ID NO: 4175533 - RNA, 63 nt, Human
gacaucugccuaaguggcccuguuggagccuggggaaagcagggcuguguagguaaugauguu

SEQ ID NO: 4175534 - RNA, 58 nt, Human
gacaucuucugcucagaaucacaacagauagugagugguucaagugagaaguaauguu

SEQ ID NO: 4175535 - RNA, 96 nt, Human
gacaugaacuuccaguauaauguuuaauguuagugguaaugaaaagcauccuuguauugcuucugauuuuaaaugagugcuuuaagauuuuauguu

SEQ ID NO: 4175536 - RNA, 130 nt, Human
gacaugacccugcucccaaaccccuuuguggcacccauaggcacuuggcguguuggagacauccgcuggccaccggaugcuuucccaugcacaaggucccacagaggccaccagggaguuggguauuguc

SEQ ID NO: 4175537 - RNA, 64 nt, Human
gacaugauuuacuaaaauuuguuuaguguaauucauuaugcaaguuauauagaugaaucauguc

SEQ ID NO: 4175538 - RNA, 59 nt, Human
gacaugccaagcuucagcugaaacucaagccucaugcaguuuucucugcuuggaauguu

SEQ ID NO: 4175539 - RNA, 94 nt, Human
gacaugcuauuuuauaauugcuuauuagacccaauuuauaugacuuccuuuuauauuuaaguggaguuaauaugcaauuugaagagaggcaguu

SEQ ID NO: 4175540 - RNA, 76 nt, Human
gacauguaaaggguguuaaauuacuccgcggagauguguucgaggcaaugggugguuaaacuggccuguguuuguc

SEQ ID NO: 4175541 - RNA, 57 nt, Human
gacauguagaguuccaggcccugcaccccagaccugcuggcuaagaaucugcauuuu

SEQ ID NO: 4175542 - RNA, 70 nt, Human
gacauuaacccauuagacguggaagauugugcuccaagacuuuuuccagcuucagggugggaaagauguc

SEQ ID NO: 4175543 - RNA, 77 nt, Human
gacauucagcucuaggccacugcagccccucccugcccccagcauggacacagcuaauggcuuaggacugaauuguu

SEQ ID NO: 4175544 - RNA, 69 nt, Human
gacauugaacaguacaaaugauccagacuuuugcucuaccaaaccucggggcaaugucuuuucaauguc

SEQ ID NO: 4175545 - RNA, 60 nt, Human
gacauugaagucucccaccuggccauggccaugggucauccugguggcagauuuuagguc

SEQ ID NO: 4175546 - RNA, 56 nt, Human
gacauugacuuucccuucuccucauuucacagaugaggagucaaggagucggaguc

SEQ ID NO: 4175547 - RNA, 61 nt, Human
gacauugaugaagauaauagcauugguugaaaauuaaccccuacacauguuuauugauguc

SEQ ID NO: 4175548 - RNA, 74 nt, Human
gacauuggcuguucauugggaucggaacucuaguuugcuucauuccuacuucacaacugccauagccagugguc

SEQ ID NO: 4175549 - RNA, 71 nt, Human
gacauuucucacaguucuggagguugggagguccaagaucaagaucccagcagaaucugaugagggcuguc

SEQ ID NO: 4175550 - RNA, 55 nt, Human
gacauuucuuugcuacugccugagccccagcagccagagaacagcaggaaauguc

SEQ ID NO: 4175551 - RNA, 88 nt, Human
gacauuugcuugaacccaggaggcagaggcugcagugagcugagacuguacuacuccacuccauccugggccacagagcaagacuguc

SEQ ID NO: 4175552 - RNA, 56 nt, Human
gaccacgcauaguauauaaacuuaucacaaacaaagggugauucugugaugugguc

SEQ ID NO: 4175553 - RNA, 56 nt, Human
gaccacugaaugcacuucuaauagagcuuuaaucuaaagaaguuaguucagugguu

SEQ ID NO: 4175554 - RNA, 79 nt, Human
gaccagcuagaugauuuugaugcaguaaagacaaguuaagaaaauuugucuuuacugucaacaagacaguaaacuuguc

SEQ ID NO: 4175555 - RNA, 113 nt, Human
gaccagcucaaguaaaggcuucagugucuuugaucugggucugacuugaaugccuggagucagaacagaagaaggaacacgguuaucuuugaagcucacacugguugcugguu

SEQ ID NO: 4175556 - RNA, 94 nt, Human
gaccaggcuggcgggggagucaggaagggaggcugcagcucagugcuccugcagccaccuccugcucugcucacugguucugaacaaccugguc

SEQ ID NO: 4175557 - RNA, 110 nt, Human
gaccagggagauguuagggagugagcugggccuuaugaguaccuggaagagagcauucuaggugaaggggcagucagugcaaaggcccugagguaggcguauaccugguc

SEQ ID NO: 4175558 - RNA, 79 nt, Human
gaccagggcacuugcgaugcucacgggacugcauaggaaacuuggugcaauagacugugguauuaaagagcuuuugguc

SEQ ID NO: 4175559 - RNA, 65 nt, Human
gaccagguacauggagaagaacagcccaaagaggaagggcugcaauucugguuuaucugaaaguc

SEQ ID NO: 4175560 - RNA, 67 nt, Human
gaccauagcaguggcauuuuaauggaugucagccucuugagaguuugaauagugucaguguuagguu

SEQ ID NO: 4175561 - RNA, 56 nt, Human
gaccauggccauggcagcccugcuggccugguaggaggaguugcuguggccugguu

SEQ ID NO: 4175562 - RNA, 67 nt, Human
gaccauggcuuaccccaggagcagcacuuccagagcaguugccguucccaucugugagccaacaguc

SEQ ID NO: 4175563 - RNA, 76 nt, Human
gaccauuccaucaggcaccccuugaguaggggaugaggucucauccucugaaauacauggugaugugugggagguu

SEQ ID NO: 4175564 - RNA, 59 nt, Human
gacccacaaaagcgaauauguuuagcucuucgcagauauuauucuagcucuuguguguc

SEQ ID NO: 4175565 - RNA, 129 nt, Human
gacccacucccgguaguucuggguggugccgggcgggcgcuggggugccgacagggagggcacguagucugaugcccuccacaguggcuccaccccguaccgguuccuguugagcacuguaggugggac

SEQ ID NO: 4175566 - RNA, 57 nt, Human
gacccagaaggagugcccuagaaaauucuggauuguuuucuagcucuacuuuugguc

SEQ ID NO: 4175567 - RNA, 85 nt, Human
gacccagagagcaaaaccggagcauuacagccuuuggagggaaaaagccuucugcuguaguugcaucuguuguuuucugucuguc

SEQ ID NO: 4175568 - RNA, 68 nt, Human
gacccaggucagcacuuggaggugcaagggagguccccgaugcgccuccugcugccugcccugagguc

SEQ ID NO: 4175569 - RNA, 59 nt, Human
gacccauaguuauaaggcaacacuguucaugaacauguuuugugccuugacuaggaguc

SEQ ID NO: 4175570 - RNA, 56 nt, Human
gacccaugauuauaucuuugacccuaaguucagguauaagcauaguugucaggguc

SEQ ID NO: 4175571 - RNA, 91 nt, Human
gacccauuuaacaauaaacuagcucuuaguuuagaggguagaaauucauacucacucugcagcugaagggcugggcagauuuaagaagguc

SEQ ID NO: 4175572 - RNA, 65 nt, Human
gacccauuuacuaaaugcucuggagagcuucaagaucugaaucaggcccagagcaggaaaggguu

SEQ ID NO: 4175573 - RNA, 58 nt, Human
gaccccaggaaagacaggcucaagggcacaagguucugagucagucugcccuggcuuc

SEQ ID NO: 4175574 - RNA, 58 nt, Human
gaccccagugagggggugggugcagguuucagcaacaugccaggccugagcugggguc

SEQ ID NO: 4175575 - RNA, 57 nt, Human
gaccccucugcagccauggaggccacgcuagccccacccgcuggcugagagaggguu

SEQ ID NO: 4175576 - RNA, 124 nt, Human
gaccccugcugcagaaagggccacgacagauuacagugagccccugaggacaucuuugagguuggggccucugagcucaggucucaggaggugucugcugguggccugaugggcugcgaggguc

SEQ ID NO: 4175577 - RNA, 77 nt, Human
gacccgaaagagcaggaaaucaguuuuaauuuaacguaauauuaaucagagcaacuuuuccugcuuugugcaggcuc

SEQ ID NO: 4175578 - RNA, 64 nt, Human
gacccggcccacucucaucugcugguauccugcuguuucaaaaccagccagagggcccaagguc

SEQ ID NO: 4175579 - RNA, 73 nt, Human
gacccuaagcuccucgugugcuaggauccaggucucuucucugggggcuuggcuccuggcucacagguugguc

SEQ ID NO: 4175580 - RNA, 62 nt, Human
gacccucuggaguuccugcaggcuguggccucugagccaccuguugggaacucccgaagguu

SEQ ID NO: 4175581 - RNA, 55 nt, Human
gacccucuuccucuucgauuccuccacggugccagagaucaaggaggggaagguc

SEQ ID NO: 4175582 - RNA, 82 nt, Human
gacccuggggaucuaaaguguuucaugaaagauuaauguccuugaucuguuuguaaguguuuuggaaaaaucuuccaugguc

SEQ ID NO: 4175583 - RNA, 115 nt, Human
gacccugggggcucaggauccagcaaggggcggcaggaguaaaggaggaaggaaugacaggugcaaauaccuucccaccaaagcccuuguugcccucuggcuccuccccagaguu

SEQ ID NO: 4175584 - RNA, 84 nt, Human
gacccuggguacccagaagagguuuggccccuucccagcaacuaugaugggacccucaacaucugcuucuggguuggauggguc

SEQ ID NO: 4175585 - RNA, 66 nt, Human
gacccuuguugaggcccacagggaguaccaagccacggcugggccuacccuguggcccuggggguc

SEQ ID NO: 4175586 - RNA, 62 nt, Human
gacccuuuacaaguacaccuaacagcuggacuaagaguguguagcagcauuugggagggguc

SEQ ID NO: 4175587 - RNA, 91 nt, Human
gaccgaaaauaaaacucucuugagaaacuuguugcccuccugaaaauucugucuggaaugggacuuagcaauaggauuuuuaaguuugguc

SEQ ID NO: 4175588 - RNA, 58 nt, Human
gaaguuaggcuuuccuaugcuuguuuaugguacugaggcaaggcaaugccaugauuuc

SEQ ID NO: 4175589 - RNA, 81 nt, Human
gaaguuagggucagagucccuguuucccguuaaauccuaggaagagccagcaggagacaugggggugguggaccucacuuc

SEQ ID NO: 4175590 - RNA, 63 nt, Human
gaaguuaugaaauuuggacagcuuggaaucagcauuuccaagcuguccaaauuucauaacuuu

SEQ ID NO: 4175591 - RNA, 81 nt, Human
gagcucacagugagcccacuccaggagaggggagagaacacagccaucuccgagagggagcuucggugaaaggagagcauc

SEQ ID NO: 4175592 - RNA, 57 nt, Human
gagcucagggggcuccggggcguggguucccacaccaugggcuugcucucugagcuc

SEQ ID NO: 4175593 - RNA, 82 nt, Human
gagcucauucuguuaaauagacugcagugcacccugggaaauauugguucugugccugcaguucuauuuguucaaguagcuc

SEQ ID NO: 4175594 - RNA, 68 nt, Human
gagcuccacuuagcaaggccacucaggaaacagauggaccaacuugaguucuuuuucugugugagcuc

SEQ ID NO: 4175595 - RNA, 61 nt, Human
gagcuccagcaucucugccaaaggggacaaacuuuaucuguaacagagaauguggaaguuc

SEQ ID NO: 4175596 - RNA, 64 nt, Human
gagcuccaucaugugugagcuaugauuuacuugccuucucaugucuggcacauaagaggagcuc

SEQ ID NO: 4175597 - RNA, 79 nt, Human
gagcucccaucguggcacacccuccggcuaucuacagugaugacacacuggagcaguggcuggauggugugcugggcuc

SEQ ID NO: 4175598 - RNA, 57 nt, Human
gagcucccuggagguucagauacagagaauguauaggagcccauacucaaggagcuc

SEQ ID NO: 4175599 - RNA, 128 nt, Human
gagcuccgggcccucagccugcuaaauuggugcaaggcucuucuccugacgagagccggcucugaaaucugccggcuucaaagggagcgagaucauguauaaaccauaaugugggugcaccguggcuc

SEQ ID NO: 4175600 - RNA, 63 nt, Human
gagcuccuaguuggggagugacuuccuugacaccaacccagcaccuccuuagcuaugaccauc

SEQ ID NO: 4175601 - RNA, 69 nt, Human
gagcucuaggaaucuauaugccuuauuugcuacuauaacccagauacugugugcagaguccuaaugcuc

SEQ ID NO: 4175602 - RNA, 66 nt, Human
gagcucuccaggcagggcagccaucaagugcagaggccuugagacggaguugugccuggcaaguuc

SEQ ID NO: 4175603 - RNA, 60 nt, Human
gagcucuggacccagacaaaccuggauuaggaucuuagguuagaucugguuccagcacuu

SEQ ID NO: 4175604 - RNA, 79 nt, Human
gagcucugugcggggccagaguccaaagucuucauuugcucaauguaaauauccacacugugucccugccacucaguuc

SEQ ID NO: 4175605 - RNA, 65 nt, Human
gagcucuuacuugaaguuuaaugguagauuccuguaacaccaggguacuguuggauuuuuagcuc

SEQ ID NO: 4175606 - RNA, 55 nt, Human
gagcugagcagggagccucacugugagaaggugaacugaggaguccugaucaguc

SEQ ID NO: 4175607 - RNA, 64 nt, Human
gagcugaggcugaggccucacugucaccuucugugagguccaugacauccucacuccugagcuc

SEQ ID NO: 4175608 - RNA, 57 nt, Human
gagcugaucaaugacugcaacagugaggucaggauguacaguuguuugacucagcuc

SEQ ID NO: 4175609 - RNA, 80 nt, Human
gagcugaucccugcaauuugcucucauggggugucagaacauuaaauaucccagggugaaaugcaguaggcuucagauuc

SEQ ID NO: 4175610 - RNA, 69 nt, Human
gagcugauggaagaaaagacccccugcucuucuccucccagguggaauuauuuugucuucccuuaguuu

SEQ ID NO: 4175611 - RNA, 57 nt, Human
gagcugcacaucugaggcuaauguuacccgcuacuuggacuuuccuugaugcagcuc

SEQ ID NO: 4175612 - RNA, 56 nt, Human
gagcugcagacuugauacaggaaggaucucuuccaugauucugggauuuggagcuc

SEQ ID NO: 4175613 - RNA, 60 nt, Human
gagcugcauagcugggauccucaaggcuacacacacacgcuuggagcagggaugcgguuc

SEQ ID NO: 4175614 - RNA, 56 nt, Human
gagcugcaucccaggcauucuaugauuuauaacagaauagcauucaggaugggcuc

SEQ ID NO: 4175615 - RNA, 55 nt, Human
gagcugcaugcaacucgaaaaucguuuuaagguuuaaaaguuguaauguaggcuu

SEQ ID NO: 4175616 - RNA, 72 nt, Human
gagcugccaaguuucucaguuuaaggacuaauaaaguugggauguggguaauucugggagacuggguaguuu

SEQ ID NO: 4175617 - RNA, 67 nt, Human
gagcugccguuucuaucacugauccuccaggagaaagccuuuggaauuaguguugaaaucagggcuc

SEQ ID NO: 4175618 - RNA, 58 nt, Human
gagcugccugaacaagcagcagcugggaaucuugggaaauguugcuucucaggcgguc

SEQ ID NO: 4175619 - RNA, 92 nt, Human
gagcugcugcugggggcaggugagggugggggcacaggggcagaagaaaaugucugaggggccagaccccaccuagacuguggcgguagcuu

SEQ ID NO: 4175620 - RNA, 61 nt, Human
gagcugcugugugcucaggcaggucuccuuuucccagaucacuucaguacacaguaggcuu

SEQ ID NO: 4175621 - RNA, 110 nt, Human
gagcugcuuuugcaucuguuauauggaaauaaagccaccuauuuccuacacacauuagguaaagaagaaguguuauuuuuagaacagaagcaacagauauaauucaguuc

SEQ ID NO: 4175622 - RNA, 57 nt, Human
gagcuggaagggaaaucucuuggcaagcugugguugccacccuucucuucccagcuu

SEQ ID NO: 4175623 - RNA, 58 nt, Human
gagcuggacagagauucgggagcaaugcacgagguagcuggccgaccccucugugcuc

SEQ ID NO: 4175624 - RNA, 87 nt, Human
gagcuggaucauuuuaauacugcguagaaugccaugguuugaauaaacacgucauugaguaauacuguaguguuggccauuuagguu

SEQ ID NO: 4175625 - RNA, 119 nt, Human
gagcuggcugguuggcagaggauggagaacagaggcuaggggccaacuauaccgggaugggucgugggaccucuguaagccucaguuucuucaucauaaaauucagagaccagaaguuc

SEQ ID NO: 4175626 - RNA, 83 nt, Human
gagcugggaagagcuggccauggccugcgccaucccuggauuuccacacugguggcugcacccuggcuaacucuuuagggcuc

SEQ ID NO: 4175627 - RNA, 57 nt, Human
gagcugggccugcgagugcugcgccgacggggccugcuccacaucgaggcucagcuu

SEQ ID NO: 4175628 - RNA, 70 nt, Human
gagcugggcuuuagggcaggcaguguuagaccugaggacugaugcacuagccguagagauuacuagacuu

SEQ ID NO: 4175629 - RNA, 61 nt, Human
gagcuggggcucagugggcaggggucagggggagcccugcagagaccacugaccuuagcuc

SEQ ID NO: 4175630 - RNA, 64 nt, Human
gagcugggugguuuugaugugaauugugggagcaaugagaucagauuuuggccauuuuggguuu

SEQ ID NO: 4175631 - RNA, 60 nt, Human
gagcugguccaauuaugaacuguugucuugacaacugggaaggacugauuggaucauuuu

SEQ ID NO: 4175632 - RNA, 63 nt, Human
gagcugucaguucauuagcacuuccaacuagagugggaagaagcagagaacuggauaaagcuc

SEQ ID NO: 4175633 - RNA, 67 nt, Human
gagcugucucuuugggccuuuugauuuuccuauuugaaaauccacaacgguuccaaacgaguagcuc

SEQ ID NO: 4175634 - RNA, 98 nt, Human
gagcugugauucauguucuccuggguccuggagggaaccugcaccugguucagagcuuggcacagguggccaguacucaaggauauuggugacuucuc

SEQ ID NO: 4175635 - RNA, 105 nt, Human
gagcuguggacuaucaugaaagggagagaacugucaagaagaugggauaugagaugucaaauuuuuauugcaguauaauuccuguaugauuuugaugcccaguuc

SEQ ID NO: 4175636 - RNA, 107 nt, Human
gagcuguucuuaaugcaagcggacugucccauuggagaacggucauguaagccagguuucaguguguuugcugcccucuccuguccgcuuacgugcacugcagucuc

SEQ ID NO: 4175637 - RNA, 63 nt, Human
gagcuuagcaggaggcuggaguggauccauccaucucuggcccaugauccugcuaacaagcuu

SEQ ID NO: 4175638 - RNA, 62 nt, Human
gagcuuauuacacaggauuugccuuacucugggaaggaaccagaccugcugaaaugaaguuc

SEQ ID NO: 4175639 - RNA, 55 nt, Human
gagcuuccuggagaacaaccccucguguggggucugggcugagacuuggaagguc

SEQ ID NO: 4175640 - RNA, 80 nt, Human
gagcuucgguugccucauucggaauucgguucccuuucaggguugcugugagggucuagugaggugauguauguaaguuc

SEQ ID NO: 4175641 - RNA, 60 nt, Human
gagcuucuuggcucagcacuugggagggaaagccuccagggcugguggcugcagaggcuc

SEQ ID NO: 4175642 - RNA, 97 nt, Human
gagcuuggaaagauuaaucaacauuccaaugugguagagucacaaguauuauguccugauucaacugcaaguuugcuuaguuuauguucuuuugcuc

SEQ ID NO: 4175643 - RNA, 62 nt, Human
gagcuuggaaggggcgugugguagcauuuguaccaugcauuugcauacugaccucuaagcuu

SEQ ID NO: 4175644 - RNA, 61 nt, Human
gagcuuggaucucuggggaccuggggcaggcugcugcaauuuuccccaagaguucuagcuc

SEQ ID NO: 4175645 - RNA, 85 nt, Human
gagcuuguucccaucccagagugagccaggggcaggucuggaaccaggacuguuucuccugccaccugggccaggacacgugcuc

SEQ ID NO: 4175646 - RNA, 61 nt, Human
gagcuuguuuuaaaaugcccacccuguuagaacauggcagggccaggugcggaaacagcuc

SEQ ID NO: 4175647 - RNA, 90 nt, Human
gagcuuuaucaguguccuauacugugcuaagugcauuacauacaugaucucauuuaguuuugcaguagcaggcacugguuuucccaguuu

SEQ ID NO: 4175648 - RNA, 108 nt, Human
gagcuuugaaugggggcugggagagguggugggaaguaugcagcaagucagguuuauagagcugcccauacuuucaccccucucucaggccucauuaucucaucucuc

SEQ ID NO: 4175649 - RNA, 68 nt, Human
gagcuuugguaucugagagugcugaguuggaaaccuagcuaugucucuuuacucuuagaacccuguuu

SEQ ID NO: 4175650 - RNA, 59 nt, Human
gagcuuugucuccuggagacccugagccuacagccauggggucaacaggacacaaacuc

SEQ ID NO: 4175651 - RNA, 71 nt, Human
gaggaaaagccaggaggggagagugugucaguaucacuguagugcugaucuucucaucuauccugccccuu

SEQ ID NO: 4175652 - RNA, 65 nt, Human
gaggaaaauaugcuuuaaguuauagugauacuucaugacaacccacagaagcauauuuguucuuc

SEQ ID NO: 4175653 - RNA, 60 nt, Human
gaggaaaaugcaacaggaaugcacagaggaaugaugcaaacacuugugguguucuuccuc

SEQ ID NO: 4175654 - RNA, 66 nt, Human
gaggaaacuaauuaguagaauaaucuuuguuucccaguuugaaagauuacugugauugcuuuccuc

SEQ ID NO: 4175655 - RNA, 59 nt, Human
gaaugcugccuguggcccuucugggugaaauucaccuauucgauacaggcaggcuuuuc

SEQ ID NO: 4175656 - RNA, 82 nt, Human
gaaugcugcuaacugaauuacaaagucuggggccuaaugauuaccagugccagagcuccaggguuuuguagugucagcauuu

SEQ ID NO: 4175657 - RNA, 128 nt, Human
gaaugcuuuuacuuaggaagcacgagaccugugcugcagaccgucuguuggagcuggccgcggcaggacggcgaucaccuuccuggcaggccccuccuggauucugcccucugcuucugaaagcguuu

SEQ ID NO: 4175658 - RNA, 111 nt, Human
gaauggagaaaaugcuauauaacagaaaccucccugaauauuuuccuccagucuaagcagggaaaaucucauuaucaggaagggacucucuguguauaugcucucugccuc

SEQ ID NO: 4175659 - RNA, 93 nt, Human
gaauggcaggggcugguacagucuggaacugcuggcuaugaguaaauaugacagcagggcuuuggcuggcuuucacugggccacuugucauuc

SEQ ID NO: 4175660 - RNA, 90 nt, Human
gaaugggaagauauaugugaaggaguuaucagugguuaucaguugaaugaugacauaugguuugauuuguucuuugauguccuccuauuu

SEQ ID NO: 4175661 - RNA, 66 nt, Human
gaaugggcaauaguugcuaacuuccauuuugguaacucuaaguuauggaagugcaacuugcucauc

SEQ ID NO: 4175662 - RNA, 58 nt, Human
gaaugguuauguggauagcagauaaccaaaguugucugcugaugucacauagccauuu

SEQ ID NO: 4175663 - RNA, 115 nt, Human
gaauguaaauaaggaccuggccaauuuguucuagcacugccuggaagacagggaaucuuggucaaccagaaguuguguaggucauucuuaaauugccaaagucccaaagucauuc

SEQ ID NO: 4175664 - RNA, 97 nt, Human
gaauguaagcugacucaagaauggauauccggcucauuaauauuugcuucauagaaauaggcucaaauguucuucucgagucugaguagguacauuc

SEQ ID NO: 4175665 - RNA, 102 nt, Human
gaauguacaaggaagcaugaaaggguuaggacaagugaaauuucaugugucgacauggauaaauuuuacuuuccugccugccuuaaaucuugguuguauuuc

SEQ ID NO: 4175666 - RNA, 66 nt, Human
gaccuguuucucccaacgcccuaguuuuaaccuugauagagcauggaugggaguggacagauaguc

SEQ ID NO: 4175667 - RNA, 57 nt, Human
gaccuuagguuguucaucuguuaaaugaacggauaggaccagguaaccucuaagguc

SEQ ID NO: 4175668 - RNA, 88 nt, Human
gaccuucagagaagaugacugaaugcuuuggagccuucuaagccacagcuuggauuuuauccugaaggcaugaggagucacugaaguc

SEQ ID NO: 4175669 - RNA, 56 nt, Human
gaccuucuuccaccaaaaacguccucuaucuagagaccacagguggcagaaggauc

SEQ ID NO: 4175670 - RNA, 99 nt, Human
gaccuuggagcccuccugcugaggagugagaaauugguuuccucugccuuucugugucauggaagccacccuccuuccagccccagaggaucuucuguc

SEQ ID NO: 4175671 - RNA, 67 nt, Human
gaccuuguucacagcuuugugugugaacccagguuccacagauguaugaaguggugagaacuugguc

SEQ ID NO: 4175672 - RNA, 57 nt, Human
gacgagggugagaaaaggaguagagcugaauguuauguuauucuguuaaccuuuguc

SEQ ID NO: 4175673 - RNA, 83 nt, Human
gacgaugcccgguugugccugggacacgagauuuucagugcugaagcugggggagucccaggcaaaccagagugggcgagguc

SEQ ID NO: 4175674 - RNA, 69 nt, Human
gacgauuaucucccacucaguccuggugggcauuauguaugccaggugggagcggagacugauuuuguc

SEQ ID NO: 4175675 - RNA, 57 nt, Human
gacgcaacccuuucuguaaccauauggccgaaucgucauggaagaaagguuuguuuc

SEQ ID NO: 4175676 - RNA, 62 nt, Human
gacgcacaugagagacuguuugggagcuucuggggagcccugcuaguugucucagugauguc

SEQ ID NO: 4175677 - RNA, 118 nt, Human
gacgcgauuucuccuccgcccacaccugcggacuggcgcaugcguugugugaugcucucgggcgccaccagccccaugcgcugugcuuugcaccccacggguggggagagaaggcguu

SEQ ID NO: 4175678 - RNA, 125 nt, Human
gacgcgguauguuugccaaggauggccuggccacugcgggccucugcccaaaccuccccaggcucacugccuggacaggcagggguagcauguggcgugcugggccuugaaaacuccacuggguc

SEQ ID NO: 4175679 - RNA, 68 nt, Human
gacgcuacacuuacaguauuguuaaacucuuucaccagaaggagaagauuaaucuguaauacagcguc

SEQ ID NO: 4175680 - RNA, 69 nt, Human
gacggaagccaucuuuguuccccaccaggcuaagcgauuuuccggagggggaguaagaucccuugcguc

SEQ ID NO: 4175681 - RNA, 109 nt, Human
gacggaagugccaggaaaguguuaaugcuucaauuuccuugauucuugucccuuaauuuuuaggggucauugaaaucagaaggguuagacucucuagaggcuguugguc

SEQ ID NO: 4175682 - RNA, 75 nt, Human
gacggcacccagcagguccugggcguggccugcccuguauggccuaaugccccaccugcugagcugggcgcccuc

SEQ ID NO: 4175683 - RNA, 71 nt, Human
gacggcucaggcuuuccgaagcgcgcggugcgcuguccagcacugcguguuccugaagcgcgcuggccuuc

SEQ ID NO: 4175684 - RNA, 65 nt, Human
gacgggagucagagaaaacagcccuguggccuucagagccgcuuaaguugucugugacuugaguu

SEQ ID NO: 4175685 - RNA, 64 nt, Human
gacgguaagaggaaaagcuccaaguaaggaauaaaccuaacuucagcgaguucucuuaauuauc

SEQ ID NO: 4175686 - RNA, 86 nt, Human
gacgguacaggucaaagguuaguuauguuaauauauuuauuugcgaaaauauacaaaagcccugauuaaccuuggcuuuugaaguc

SEQ ID NO: 4175687 - RNA, 79 nt, Human
gacgguucucagucuauuggguaaauacauagccagcuucucacccccaaagcccagccugucuuucccaaugaaccuc

SEQ ID NO: 4175688 - RNA, 62 nt, Human
gacguaucaaggccggacaagaugguucccgaucgucagaauuccuguccgcgccuugcguc

SEQ ID NO: 4175689 - RNA, 81 nt, Human
gacguccgugccccaguugcuggcaccugugaguauguuaugcuuuguggcaacaggggcuuugcagaaggaauggagguu

SEQ ID NO: 4175690 - RNA, 74 nt, Human
gacgucugccucucgggacacuugggacucgauuccacagcuccagaaaacccaggaaacccgaaggcgaccuc

SEQ ID NO: 4175691 - RNA, 70 nt, Human
gacgugaacuucacaaauccuugguuacugaauccugcauugccugagagcuuauuugugauguaacguc

SEQ ID NO: 4175692 - RNA, 126 nt, Human
gacguucaaugaaaaggcacggaggccugcaggacaggcuguugggguccaggguuucuugaguguuggauuuggaugcuugggacacugcaggggcuucagucuugcagggugaccuuucauuuc

SEQ ID NO: 4175693 - RNA, 60 nt, Human
gacuaagaaaagugugcaguccaguugauggcaauugcaacagguagacuuuuccuaguu

SEQ ID NO: 4175694 - RNA, 83 nt, Human
gacuaagccugauaucaagucgggcaucacugagucauggaaggucaggaaaacccggguugacucugcuacuaggcuugguc

SEQ ID NO: 4175695 - RNA, 67 nt, Human
gacuaaguggaagaacugcuuguccuccagcccgaggaagcuagaaggucuucuuuugugcuugguc

SEQ ID NO: 4175696 - RNA, 93 nt, Human
gacuaauauagacaaugguauauucaagggcacuuaacuucaauuggucaaguuaagugucucucgaauuaugcuucuuggacugcccauguc

SEQ ID NO: 4175697 - RNA, 72 nt, Human
gacuaccugcugucuuaggacuugggguaauuuauguagauuaccaaagaauauuuuaaauaguuggucguc

SEQ ID NO: 4175698 - RNA, 66 nt, Human
gacuagagcaggaggcaugaagccaagaguccaacuuucaguggcuucuugacuucuuggcugguu

SEQ ID NO: 4175699 - RNA, 84 nt, Human
gacuagcagcuguagaacuuguuguaagaaaauaugauaauuacaaagauugacaugugcuaugacaacaguccuuugcuaauc

SEQ ID NO: 4175700 - RNA, 117 nt, Human
gacuaggaguuaaagccuuguccugugaaaucaaccuugagcccagccucgagaaaugagagaagaguuuguccaggggccaaggggacuucacgcuuggcugaugaacuccugguc

SEQ ID NO: 4175701 - RNA, 120 nt, Human
gacuaguaggcaauuuaaauaagugcacagucuuguaagagagaauugcaaauuauugcaaugcucuaauaauugcaauaugauccuuacaagaaaaaugcacauuugauggcaauaguc

SEQ ID NO: 4175702 - RNA, 78 nt, Human
gacuaguugucuuagacaacagacacuuauuuucuccagaggcucucagaagucucagaugagguuggcagcaugguc

SEQ ID NO: 4175703 - RNA, 59 nt, Human
gacuauagugcauuauuuacaguaagucauuuuuauuugguaagaugaugcgcuguguu

SEQ ID NO: 4175704 - RNA, 94 nt, Human
gacuauaguuuccugugccaugagaaaguccucguucugaaguuuaacucuccaacacugucacaugaaacuugcucaucacaguggacuaguc

SEQ ID NO: 4175705 - RNA, 57 nt, Human
gacuaucucuucaauuugaaugaauggcaaaggauccucaggcauuugaggagaguc

SEQ ID NO: 4175706 - RNA, 79 nt, Human
gacuaugauacaugcuuuucaaucuaucuuaaggugaccuucacuugcacggaaagucugaaaauguacagucagaguu

SEQ ID NO: 4175707 - RNA, 72 nt, Human
gacuaugcugggcagaauuuuaggauggcccccacaugugguagccccuugguguuccugcaguguaucguc

SEQ ID NO: 4175708 - RNA, 56 nt, Human
gacuauuuuauaaacuagugaaucagucuaacuagauugcugguaggugaauaguc

SEQ ID NO: 4175709 - RNA, 67 nt, Human
gacucaaauucuggcaguuccuuguugauauauuccuucgguguuucuuuggcauugcuguugaguc

SEQ ID NO: 4175710 - RNA, 59 nt, Human
gacucacacagaccuuccugcucccaagagacaucaugaagcccaggccugugugaguc

SEQ ID NO: 4175711 - RNA, 59 nt, Human
gacucacuacccuccagcacaagacuuagaagcaggaagucugguuuagguagugaguc

SEQ ID NO: 4175712 - RNA, 65 nt, Human
gacucagaguugguacuuagccugaggucagaguuuagucuggaguuggugccaagucugggauc

SEQ ID NO: 4175713 - RNA, 57 nt, Human
gacucagggcaucaucaugaauauaauuauuguuauauuagauguugggccuuuguc

SEQ ID NO: 4175714 - RNA, 58 nt, Human
gacucaguuuuauccacugacucacaguuguggucaaaguugaagaagggcaugaguc

SEQ ID NO: 4175715 - RNA, 71 nt, Human
gacucauagggcgaggagacggaggcacaguugucguagacgauggccgagucacucucgucacuguaguc

SEQ ID NO: 4175716 - RNA, 72 nt, Human
gacucaucaggauucaccccagagcugggaauacuaucucuuuccuugugggguggauaccuggguaaaguu

SEQ ID NO: 4175717 - RNA, 101 nt, Human
gacucaucucucacuugggcucaggaguuugaggcugccgugagcuaugauugcaccacugcaccucagcacuccagccuggacaacagagcaauccaguc

SEQ ID NO: 4175718 - RNA, 58 nt, Human
gaggcacugagagugggggaugagaaacgaacuccguccccugcacagucagugccuu

SEQ ID NO: 4175719 - RNA, 55 nt, Human
gaggcacuggaggaaaggagaagccaggggauuccucucucuuccccucuaccuc

SEQ ID NO: 4175720 - RNA, 99 nt, Human
gaggcagaagaaucgcuugaacccaugagguggagguugcagugagccgagauugugccauugcacuccagccugggugacacagcaagaccuagucuc

SEQ ID NO: 4175721 - RNA, 56 nt, Human
gaggcagagguaacauuucuaggauaccuucuacaaugcaaaauacugucugccuu

SEQ ID NO: 4175722 - RNA, 68 nt, Human
gaggcagaugcaucacuugaggucaggaguucaagaccagccuggccaacgugaugaaacccugucuc

SEQ ID NO: 4175723 - RNA, 59 nt, Human
gaggcagccucaguggaccucguccuugcacgggggaagcuccacgguggggccgccuc

SEQ ID NO: 4175724 - RNA, 89 nt, Human
gaggcagcuugggacugacucucaagcacaaguccaccauguguacagguggcagugcuugcgggucuacccagggaguaacugaaauc

SEQ ID NO: 4175725 - RNA, 130 nt, Human
gaggcaggacugauauuuaacugguaaggaagguagccuuguaagaaucgauguuuauuuagacugucugcucugauuggucaguguugaauuuuuugcaaaucauucuugccaucagaucaucugucuc

SEQ ID NO: 4175726 - RNA, 98 nt, Human
gaggcaggagaaucacuugaacccaggaggcugagguugcagugagcugagaucaugccacugcacuucagccuggugacagagugagacuccaucuc

SEQ ID NO: 4175727 - RNA, 99 nt, Human
gaggcaggagaaucacuugaacccgggaggcggagguugcagugagccgagaucgcgccacugcacuccagccuuggcaacagagcgagacucugucuc

SEQ ID NO: 4175728 - RNA, 100 nt, Human
gaggcaggagaaucacuugaacccuggaggcggagguugcagugagucgaaaucgcaccacugcacuccagccugggcaacaagagugaaacuccaucuc

SEQ ID NO: 4175729 - RNA, 99 nt, Human
gaggcaggagaaucacuugaaccuggcaggcagagguugcagugggccaagauugcgccauuguacuccagccugggugacagagcgagacucugccuc

SEQ ID NO: 4175730 - RNA, 99 nt, Human
gaggcaggagaaucgcuugaacccaggaggcagaaguugcagugagccaagaucgugccacugcacuccagccugggcgacagagcgauacuccgucuc

SEQ ID NO: 4175731 - RNA, 100 nt, Human
gaggcaggagaaucgcuugaacccgggagguggagguuauggugagccgagaucacgccauugcacuccagccugggcaauaagagcgaaacucugucuc

SEQ ID NO: 4175732 - RNA, 99 nt, Human
gaggcaggagaaucgcuugaaccuggaaggcagagguugcagugagccaagauugugccauuguacuccagccugggugacagagcgagacuccaucuc

SEQ ID NO: 4175733 - RNA, 99 nt, Human
gaggcaggagaaucgcuugaaccugggaggcggaaguugcagugagcugcgaucgcgccacugcacuucagccugggcgacagagugagacaucgucuc

SEQ ID NO: 4175734 - RNA, 99 nt, Human
gaggcaggagaauggcgugaacccaggaggcagagcuugcagugagccgagauugugccacugcacuccagccugggugacagagcaagacucugccuc

SEQ ID NO: 4175735 - RNA, 100 nt, Human
gaggcaggagaauugcuugaacccaggaaguggaggcuucagugagcugagaacacgccacugcacuccaguccugggcaacagagcaagacucugucuc

SEQ ID NO: 4175736 - RNA, 99 nt, Human
gaggcaggagaauugcuugaacccuggaggcugagguugcagugagccaagauugugccacugcuuuccagccugggugacacagcaagacucugucuc

SEQ ID NO: 4175737 - RNA, 84 nt, Human
gacuccugauuuuaugauucaguuucuuuuccaucugaagcagucuucuguggcugggagccuggcuucgcaggaccagguguu

SEQ ID NO: 4175738 - RNA, 75 nt, Human
gacuccugggaccucugggaaggcuccuuagcccaggcaacugaggcaguugagcuuccugaggaccuggggguu

SEQ ID NO: 4175739 - RNA, 76 nt, Human
gacuccuggggucacugucuagucauacugucuuucuuagugucagagucagcuuaugacacagucucaaggaguc

SEQ ID NO: 4175740 - RNA, 81 nt, Human
gacucuacauuauuaauuaccauaaaguuuaucuuucuggccauuuucauuagaaagguuuauggucaguuguugagacuc

SEQ ID NO: 4175741 - RNA, 91 nt, Human
gacucuaggucuggacuuuaaggccaggcuguggucggcagaagcuguggaagucugugaucacaucugggcugaagcagaagccuuuguc

SEQ ID NO: 4175742 - RNA, 77 nt, Human
gacucucagaguagcacagugcuucucagaugggggugauuuugcaccccaguagacauuuugcaacaucuggaguc

SEQ ID NO: 4175743 - RNA, 57 nt, Human
gacucuccccaugucaguguacccugcaauaugcaggaaccugugcguagggauguu

SEQ ID NO: 4175744 - RNA, 68 nt, Human
gacucugaagcaugugcuggggcuuuuuguaugugcugugucaaaaagguaagcacaaugagaggguu

SEQ ID NO: 4175745 - RNA, 59 nt, Human
gacucugagcuccuagguaaaacugccugcaauugcagucacaucuuagcagccagguc

SEQ ID NO: 4175746 - RNA, 66 nt, Human
gacucugguggcaucucuuuccagauuuguuuugaaacaagcuugaaaacaagauuucacccaguc

SEQ ID NO: 4175747 - RNA, 62 nt, Human
gacucuucaaagguagcuggggucaggccuuuuucaaagggucucuugccaugccucagagc

SEQ ID NO: 4175748 - RNA, 67 nt, Human
gacucuuggcagggauauaguggcagggauauaguaaaacaggccacacauaugguugguaggaguu

SEQ ID NO: 4175749 - RNA, 81 nt, Human
gacucuuuccucuggagaacuuuaggaaugggacaggcaacaucuauccaaacauauagucucucuuggaggcagggaguu

SEQ ID NO: 4175750 - RNA, 111 nt, Human
gacucuuucuuauguuucuuauaaugucaauugcuggcagcuggaucugcaugcacacugcuguguuggagcuuucaguaauggccuacaagaacagcaugagggagaguc

SEQ ID NO: 4175751 - RNA, 60 nt, Human
gacugaaagcuuggaauguuccuauaucaauuuuaauaaggagaaauucccuuucaaguc

SEQ ID NO: 4175752 - RNA, 74 nt, Human
gacugaacuggcaaguccuaaacacacacaaggccuggcaccaccagcuacgguguucagggcugcuggcaguc

SEQ ID NO: 4175753 - RNA, 59 nt, Human
gacugaaguguagguguuuuccuacuggguuucucuuccugggaaaacagacacuaguu

SEQ ID NO: 4175754 - RNA, 55 nt, Human
gacugagaauuggcuuuuuccuuucaaagaggauggaagucacuguuuucuuguc

SEQ ID NO: 4175755 - RNA, 59 nt, Human
gacugagcuucugcaacacuggcaaggcuuugcccuccuaacagugucagaagacaguu

SEQ ID NO: 4175756 - RNA, 56 nt, Human
gacugagcuugaauccugguugcuccucucugugugaccuugggugagugacgguc

SEQ ID NO: 4175757 - RNA, 69 nt, Human
gacugaggcacugggagagcacacuaggcaugagaaaguugagugugacugauuuagugcauguagguc

SEQ ID NO: 4175758 - RNA, 64 nt, Human
gacugcaacagcauggcucaauauuugaaaucacuacgguuaaaagcagucauauugugcaguu

SEQ ID NO: 4175759 - RNA, 57 nt, Human
gacugccuuuuccauuacuuaauuuuuaaaaauacuauuaggagugggaaggguauc

SEQ ID NO: 4175760 - RNA, 68 nt, Human
gacugcuccuuguuggugucuccucaguacccagcccagugcauuggagaucagagacuagggcaguu

SEQ ID NO: 4175761 - RNA, 63 nt, Human
gacugcuucauuaaaacaauauuuucaagaacagucuuggacuuugaagucagugaaguaguu

SEQ ID NO: 4175762 - RNA, 85 nt, Human
gacuggauguuuagagaaauauugggacucagagcuucaauacugaaaaucugguaauuugaauguguguauguauauuacaguc

SEQ ID NO: 4175763 - RNA, 87 nt, Human
gacuggcaaaugcggcaugcugcagggaaugcuugucucaugcagaaggcagagaacgacccuggcaguacugccuggagcacaguu

SEQ ID NO: 4175764 - RNA, 89 nt, Human
gacuggcagugggaagaacaguugggaggugagcccuuucuuccugggcacagagcugggcuauuucucagcuucuuggauagucaguc

SEQ ID NO: 4175765 - RNA, 55 nt, Human
gacugggguugguaugugggaagaaaccgauuugucccugcuuucuggcccaguc

SEQ ID NO: 4175766 - RNA, 100 nt, Human
gacugguacucucugucauaguaagcagaaugacuuccuuuuuaaaggcaucaggacuuucuugugcauuuaccuggaggucauuuuggggauuccaguc

SEQ ID NO: 4175767 - RNA, 84 nt, Human
gacugguuuauucacuacuguccucauuuguuugaacacacuacaauguucugugggauaguagcugagagacaagcaauaguc

SEQ ID NO: 4175768 - RNA, 55 nt, Human
gacugguuucuagccucauaguuguuacuaagaagcuguguccuagcagccaguc

SEQ ID NO: 4175769 - RNA, 59 nt, Human
gacuguacugaaaagccacaaggaccagguuggcugguuuguuuacuuuucagucuguc

SEQ ID NO: 4175770 - RNA, 64 nt, Human
gacuguacuugagagaggaacugcacuaguucagcaguagauggucuuagcuuaagucaugguc

SEQ ID NO: 4175771 - RNA, 63 nt, Human
gacuguacuuuagaaaguguagugaaacccacucguucacuugguucuaacuaguguauaguc

SEQ ID NO: 4175772 - RNA, 81 nt, Human
gacuguaucaauaguaagauggaggcugcauuuggauggaugucugcccgacuccagucuuuauucacuauugauaaaguu

SEQ ID NO: 4175773 - RNA, 73 nt, Human
gacuguaucuggccugugccaccagcuugcuccugcucucuaucuugcaagaacacugccagaauacacuguc

SEQ ID NO: 4175774 - RNA, 77 nt, Human
gacugucaaaaccuuggaggcaaggguuaucauuuauaauuagguacuuucugcaacccccuaguguuuuuacaguc

SEQ ID NO: 4175775 - RNA, 66 nt, Human
gacugucaucguaauauaccucagugaaaugaagguuaauucugauguacaaccugcaugacaguc

SEQ ID NO: 4175776 - RNA, 56 nt, Human
gacugugcuggagcccucuggaggggccagacaaccccaacaguugcaacacuguc

SEQ ID NO: 4175777 - RNA, 73 nt, Human
gacuguuaauaaguaguaguuauuguuauuuuacuuaguggcaggaaguuaacuagauuuauuuaucacaguc

SEQ ID NO: 4175778 - RNA, 55 nt, Human
gacuuaaaugcuccccucagggcagcaacagccuuaaggaagagcauuuuagguc

SEQ ID NO: 4175779 - RNA, 98 nt, Human
gacuuacacaaacguacagccacaggugacucucauuuauuccuguaaaucauguacucaguuaucuggcuguacaaauagaguuaaaauuguagauc

SEQ ID NO: 4175780 - RNA, 82 nt, Human
gacuuacauguuuuauagcugaaaaccuaaggagugacaauaguacaugugacauucuuaacaguuaaaaacugaguaaguc

SEQ ID NO: 4175781 - RNA, 60 nt, Human
gacuuacauugcaucauugaaaugccagaauugucuuggcaggcagugggguaaggaguu

SEQ ID NO: 4175782 - RNA, 73 nt, Human
gacuuagcaguuuagaauaugucucaauuuuuaaaauauuuguugaaaugauuuacuuuagaucuguuggguu

SEQ ID NO: 4175783 - RNA, 66 nt, Human
gacuuauguauaauguuccacauacccguguaauacaauggauagacggaaagcuguacauaaauc

SEQ ID NO: 4175784 - RNA, 62 nt, Human
gacuuauucagauugguuuaagcuaguuagacuuaaaacugcugcccaaacugaauacuguu

SEQ ID NO: 4175785 - RNA, 59 nt, Human
gacuuauuggucuuggaagguuuuguguguauucuugccaggaaaugaggcaauggguu

SEQ ID NO: 4175786 - RNA, 100 nt, Human
gacuuauuuccuuuggcaagaggggaggagcuuuucuugccuucuaagagguuucaggaaaauccucucuuacugucuuccuaaguguaccacguggguc

SEQ ID NO: 4175787 - RNA, 64 nt, Human
gacuuauuugcccauguuuagcagauuuuuaccugagaacaaccucugggccacuugauagguu

SEQ ID NO: 4175788 - RNA, 76 nt, Human
gacuuauuugguugauggcuggaagagucgaagagucaaggaggacggacccuuagcggccauggaauaauaaguu

SEQ ID NO: 4175789 - RNA, 70 nt, Human
gacuucaaguguacaugaacacaugacaguagaacaaaucuguguccggguguucugugcacuuuucguc

SEQ ID NO: 4175790 - RNA, 79 nt, Human
gacuucaguuccaccugggaacucuaggaggcuauauacaacauaucuuagaguuauccuguccuaggggaggggaguc

SEQ ID NO: 4175791 - RNA, 61 nt, Human
gacuucaugcuuuagagagaugaagauaaaauaagaaugacuucauuuguuaguagaaguu

SEQ ID NO: 4175792 - RNA, 64 nt, Human
gacuuccauuuuuguuugucagaguaaggacugggcacgaccaccuucaaacuagauagaaguu

SEQ ID NO: 4175793 - RNA, 76 nt, Human
gacuucuacuuucaaacugcccagcacaccuaugaaauuccaacauucuuuucaggagcugcagaguggggagguu

SEQ ID NO: 4175794 - RNA, 56 nt, Human
gacuucugagcuauccagcuguggcaauucaucagcuaggaucuccucuggggguc

SEQ ID NO: 4175795 - RNA, 118 nt, Human
gacuucugggggucacaggccucuuugaggaagcuuuugaucgcccaguaguaugcacaucaaccauuuugcauucgauuuuggguucacagggcuccugaaacccacucccagaauc

SEQ ID NO: 4175796 - RNA, 78 nt, Human
gacuugaacauugucacauuccuagcuugggcucagaaauugccuguugcuacuuuugugacuuaaugcuucuagguu

SEQ ID NO: 4175797 - RNA, 120 nt, Human
gacuugacugaccugacccucggggauccauccacguggcccacccaaguaaugcaccuuuuagaauauuugcugaaauaacugccaccugguggcaucuucugggucaaugucacuguc

SEQ ID NO: 4175798 - RNA, 130 nt, Human
gacuugcugaagaccgcauggcugggagacggcugaggucaggcagccugauucuaacauuccaugcuuuuuccgcuguauuauccuacagauguuucuccgucacacacugcacuacuuagcugcccuc

SEQ ID NO: 4175799 - RNA, 56 nt, Human
gacuugggaaucaccccucaggcccauucuccaaugcugagcccagaucccagguc

SEQ ID NO: 4175800 - RNA, 61 nt, Human
gacuugggggccauuaaggggccuccuccaucagacugggggcccuuuaagagcucccauc

SEQ ID NO: 4175801 - RNA, 93 nt, Human
gacuuguaccucacugaggcugagaguuuguucuacuucuggucugaauaagcaaauguuuaguuucaguuccucuucaaauucaggacuguc

SEQ ID NO: 4175802 - RNA, 128 nt, Human
gacuugucaucccaagauaauucaugauggauuuucaaagguuuuaugcuaagagaaucuucccaagaaauguauauggauaaaacguucugaaaaacaauguggaauaaugucugggcuugagaauc

SEQ ID NO: 4175803 - RNA, 77 nt, Human
gacuugugugcacauaugucauagguauguguauacauacaagguacauauacugcauacauauguguacauauauc

SEQ ID NO: 4175804 - RNA, 130 nt, Human
gacuuuacaaguaaagcaaaguuugauucguggauuuaggaggaaagguaugugcauacaugcauguguguaugcauucauucauucuuucuaauguguaaaucauaaguuuucaaauauuugaaguguu

SEQ ID NO: 4175805 - RNA, 94 nt, Human
gaggcaaaacuguggccuggguccuggacuuggggaggcuagauucuuguaacacaagaaccucccuguguccucccucccacagcccaaccuu

SEQ ID NO: 4175806 - RNA, 64 nt, Human
gaggcaaaggccacuggggcgauggcgagaaacccucuccccauucuccaagggucuuuucuuc

SEQ ID NO: 4175807 - RNA, 90 nt, Human
gaggcaaauuauaugaaaguuugaaugagauuuaagacugucaaaacuauucuuuaggauuaagacauucagauauuucuaauguuccuc

SEQ ID NO: 4175808 - RNA, 87 nt, Human
gaggcaacacagguagggaccacuccgacauguaggggcugcccuccaagcucccuguccugaguuguccaaacuucugucugccuc

SEQ ID NO: 4175809 - RNA, 61 nt, Human
gaggcaagcccagugggucuaaacgcaguggucugagguagaucgggugggcuuucaccuc

SEQ ID NO: 4175810 - RNA, 115 nt, Human
gaggcaaucccagcaccuucacagcaccaggaucucuccaagagccuucccagagaaaagggccauucagaccauccugcuguuagugagcuacuuugggugcuggguggaccuc

SEQ ID NO: 4175811 - RNA, 60 nt, Human
gagucacugggugacuuuuggagguagcaacaagcucaugaagaaggcauucaguggcuu

SEQ ID NO: 4175812 - RNA, 71 nt, Human
gagucagaaacucacucuauagcuacauaauuuuuacucuuuuuccauguaggaacagugauuuuggacuc

SEQ ID NO: 4175813 - RNA, 59 nt, Human
gagucagcuccuaggaagugccagcgcccacgcaccugugagcuccuggagucugacuc

SEQ ID NO: 4175814 - RNA, 56 nt, Human
gagucaggcuagggugacaggcucagggaagccccacauccucaauggccuuacuc

SEQ ID NO: 4175815 - RNA, 57 nt, Human
gagucaugcacugucuuucucccauucccagucugugggguuugagagagcugacuc

SEQ ID NO: 4175816 - RNA, 65 nt, Human
gagucauugcacacuagcucagccuagauguuagccugggugugacccugggugggcaauggcuc

SEQ ID NO: 4175817 - RNA, 55 nt, Human
gagucauuugggggcuucuugacuuucaugucuggugccugaaauagaaugacuc

SEQ ID NO: 4175818 - RNA, 58 nt, Human
gaguccagagauuaagcaccucugacagcucuuugucuugcuuauccauuuuggucuc

SEQ ID NO: 4175819 - RNA, 60 nt, Human
gaguccccucuaacccaacuuuauuauguauuaauaauaauaaagcugcucagggggcuc

SEQ ID NO: 4175820 - RNA, 67 nt, Human
gaguccccuguccagggccagccagagagugcggagccccaccaugagcugggccugcaggggucuc

SEQ ID NO: 4175821 - RNA, 104 nt, Human
gaguccccuuuccuucuguguccauccugggaaguggugagggccugaggaggcaacgggacagcuuccucgaccaccugcucugagggcaccaugggggacuc

SEQ ID NO: 4175822 - RNA, 65 nt, Human
gagucccugaggcucuccugaauaauggccaccacagcaggccuugacugaaugccucuggacuu

SEQ ID NO: 4175823 - RNA, 63 nt, Human
gaguccuggguucugguguuuuguguguuaaggcgaucagggcugucagggaccucaggacuc

SEQ ID NO: 4175824 - RNA, 105 nt, Human
gagucuaagccagugauucuugguuacuuagaagccauucuaaaacuggaaauaauuccaguggacaauuucugaggaaauaagugaaugacugguguuauacuu

SEQ ID NO: 4175825 - RNA, 69 nt, Human
gagucuccaauccaugccugucagccacucuagaugaccugaaguagacagguaaggguugggagaauc

SEQ ID NO: 4175826 - RNA, 85 nt, Human
gagucucgcucuuuagccaggcuggagugcaguggcgccaucucggcucacugcaagcucugccuuccggguucaagugauuuuc

SEQ ID NO: 4175827 - RNA, 84 nt, Human
gagucuggcucugacgcccaggcuggagagcaguggcucgaucucggcucacugcaaucucugccucuuggguucaagcgauuc

SEQ ID NO: 4175828 - RNA, 68 nt, Human
gagucugugcuugcugaaaggcauuuagaggucccuucugggugccacacagcaugcuuggugaacuc

SEQ ID NO: 4175829 - RNA, 60 nt, Human
gagucuguggucuggguuccccuguuuccuuaggcugagccaguuguagccacagaacuc

SEQ ID NO: 4175830 - RNA, 73 nt, Human
gagucuugaaagcacauuagaguaaaugagagugacugacccucugaaauucuugugagcuuuccaaggacuc

SEQ ID NO: 4175831 - RNA, 86 nt, Human
gagucuugcucugucgcccaggauggagugcaguagcgcuaccucagcucacugcaagcuccuccuccuggguucaugccauucuc

SEQ ID NO: 4175832 - RNA, 92 nt, Human
gagugaaaucuagagacaauuugaauauagagcaaagggagagaauacagaaaccacacuccacauauagaauuggucuuaagaguucccuc

SEQ ID NO: 4175833 - RNA, 69 nt, Human
gagugacagggcagagaggcaggcuugggucuguccagcuccaaagcccaugcucuguccaugcaucuc

SEQ ID NO: 4175834 - RNA, 68 nt, Human
gagugagaauuguuguccuguccuugaagcaaaucaccuucaaguauuacaguguaauauucacauuc

SEQ ID NO: 4175835 - RNA, 81 nt, Human
gagugagaggucguuaucuuugcuggaggagugcuuguucuuuggcaaggacacagcucuucaguaagauggucuuuucuu

SEQ ID NO: 4175836 - RNA, 79 nt, Human
gagugagaugacaacaaguaaguuuauauauauuuugugaaagcaugauaauguggauuuauugugauauauuuuguuc

SEQ ID NO: 4175837 - RNA, 64 nt, Human
gagugagaugauggcacacagacauccccgccccagcuaggggaggggccugcugcguuuccuc

SEQ ID NO: 4175838 - RNA, 115 nt, Human
gagugagccacugugggaauucagggagguggcgcagugaccaccccuggagggauauguguguggcaggggucgagggucucgcccuucccugcuuccugcgcguggcuuucuc

SEQ ID NO: 4175839 - RNA, 118 nt, Human
gagugagcuggcagcccuaggagcagcgggacaugccccucagugggugucucaccugggagacaaagcucgccaccucugagggcgggucauucuugcuguccugccaggucaccuc

SEQ ID NO: 4175840 - RNA, 94 nt, Human
gagugagguacuugauaugcgguguguuucuucucugugaaucaauucagcugagaagcaaagaacugcacuucagacuucaggcguuuuauuc

SEQ ID NO: 4175841 - RNA, 76 nt, Human
gagugagugggugacaguuaacagguuuccacagugauuagugagugggugacagugaacagguucccacugccuu

SEQ ID NO: 4175842 - RNA, 56 nt, Human
gagugauaggugugcagugaugcugggaagagagaauucauugaacauaauuacuu

SEQ ID NO: 4175843 - RNA, 108 nt, Human
gagugauccuccauccagagcaguggagcagggcuccccaggcccgaggugagugccaccugugcuggguguggcgucuugagcgcugcaugguucugauccugacuc

SEQ ID NO: 4175844 - RNA, 84 nt, Human
gagugauggauguagggccugggcaucacaggccuggggaggacccaugggcugugggacccuggaccagccgcguaaucucuc

SEQ ID NO: 4175845 - RNA, 64 nt, Human
gagugauugcaguguguguuccaugagguaguaugcacacagagccuucauacacuaaacacuc

SEQ ID NO: 4175846 - RNA, 58 nt, Human
gagugcaguggcgcgaucucggcuuacuaagaggcccuguuaugagccacugugacuc

SEQ ID NO: 4175847 - RNA, 62 nt, Human
gagugccaagagaagaggcuggugaauuaggaaagagugagaucuuuucagucuugguaguu

SEQ ID NO: 4175848 - RNA, 63 nt, Human
gagugcuggcuccaucacugggugauggcugggcaugccacuaacauccuuggggucugucuc

SEQ ID NO: 4175849 - RNA, 57 nt, Human
gaguggagguggcuagugcuguuaucagggcauaaaacagcagccaaacuucuauuc

SEQ ID NO: 4175850 - RNA, 122 nt, Human
gaguggagugggacaggcuuugguggcugacagcacagagcuaggaguggagggaguggauuucaguuucugacccugccacuggcuugcugugugaccuugggcaagugucuugcccucuc

SEQ ID NO: 4175851 - RNA, 55 nt, Human
gaguggauuuguugucuucugcucuccugccauaugaagacacagaguucaucuc

SEQ ID NO: 4175852 - RNA, 57 nt, Human
gaguggcagaggcucugggaccagacuaccuggguuugaaucccagcucugccacuc

SEQ ID NO: 4175853 - RNA, 55 nt, Human
gaguggccaaacugaggaccugcugcaccagcuccugggucucuguuggcuucuu

SEQ ID NO: 4175854 - RNA, 107 nt, Human
gaguggcugacaauaucaaauucugcaggcacaucugaaaagaugcacaaguagcugcuggauuuggcauuuuucagaugacugguaaccuugguaagguuaguuuc

SEQ ID NO: 4175855 - RNA, 124 nt, Human
gaguggcuugaaaagaguauguguucaauagcaaagugugagauuaaaccgaaucauucaaauaugacugacacaggucaaaucuacuuuugcagugaccuacgacacuuuuuucaugcuauuu

SEQ ID NO: 4175856 - RNA, 73 nt, Human
gagugggaaaauacaaauagccuugaaaauauagccagggauuuuacgagugcuaaugauauugugccuacuu

SEQ ID NO: 4175857 - RNA, 75 nt, Human
gagugggguauggagauuagaauacuucgauuguuuaauaauaauuugcauaauagugauuuguauaucucauuu

SEQ ID NO: 4175858 - RNA, 61 nt, Human
gaguggguaggccucuggugccugcagagccucauguaacuggcaucaggacuacccaguu

SEQ ID NO: 4175859 - RNA, 76 nt, Human
gagugggugucucaagaaugggggucccuccaggccaccauuaccaagaguuccccaauuugagucaccucugcuc

SEQ ID NO: 4175860 - RNA, 64 nt, Human
gaguggugaugacagcaguuucuggcucaagugccacagacuaccacuguucuuacugaaauuc

SEQ ID NO: 4175861 - RNA, 63 nt, Human
gagugguuuucaaauugccuuccguggagcuggaggacuccaaggaggagcuggagauugcuc

SEQ ID NO: 4175862 - RNA, 97 nt, Human
gaguguauccucuagaucuggugggcacuagaaucccuucaagaagcccugggugaagggcuccagauucuggaugacuggguuuucuggaugacuc

SEQ ID NO: 4175863 - RNA, 61 nt, Human
gaguguauggaaggaagagauuuuuaguaaaaucaugaaaucuuuuccaaaccauccacuu

SEQ ID NO: 4175864 - RNA, 61 nt, Human
gagugucugcuuugagucaggugucguaauuauuuuuuacaccauuuucacagcaaaccuc

SEQ ID NO: 4175865 - RNA, 68 nt, Human
gagugucuguauuuugggcaagagaaggaucccauugauccaaccacuugccagagggcuugacauuu

SEQ ID NO: 4175866 - RNA, 67 nt, Human
gagugugaacgcugcugcuuucuggugcuguuuccugcaagccacaaucugcaucagcauucaucuc

SEQ ID NO: 4175867 - RNA, 65 nt, Human
gagugugaccucaucuuaacuggaacccaucugcaaagauccuauuuccaaagaaguucacauuu

SEQ ID NO: 4175868 - RNA, 80 nt, Human
gagugugagccuuucggaguaggagagaggcuggggaaguccagccccuauccucgcuccaccccaccagauggccacuc

SEQ ID NO: 4175869 - RNA, 68 nt, Human
gagugugggcucugcugcguaccaguuggguggcuuugggcagguggaaguuggcagagcgccgccuc

SEQ ID NO: 4175870 - RNA, 69 nt, Human
gaguguguucucauuucauguguuuacaugggcaacaccaaguucuuaauucagaaagggaauaaacuc

SEQ ID NO: 4175871 - RNA, 55 nt, Human
gaguguucccacaccccaguuguuaggacaaggugcuagggaagggggacaccuc

SEQ ID NO: 4175872 - RNA, 80 nt, Human
gaguguucccauuuuggaugcggauugguacgguagaggaaaugagaagccaacaagugccaaguauccagggauuacuu

SEQ ID NO: 4175873 - RNA, 55 nt, Human
gaguguucugcuugaacuuagcuugcagcuucaagccugagcagcggcagcacuu

SEQ ID NO: 4175874 - RNA, 85 nt, Human
gaguguuuuacagaucuguugauuuguuuccagggcagccagauaucugccacacagcaaucuuagcagaaauguagaaugacuu

SEQ ID NO: 4175875 - RNA, 78 nt, Human
gaguuaaaagcccucucagcagcagauaaauauagcuauguuugguccagguuacaguugcugagggaacuauaacuu

SEQ ID NO: 4175876 - RNA, 61 nt, Human
gaguuaaaggaaaauaacuuuaagaaucacucauacugugaaaguuguuuugcuucagcuu

SEQ ID NO: 4175877 - RNA, 60 nt, Human
gaguuaauguguacacaaagggcuuaugacauaguccuugcccuguguaguuacaugcuc

SEQ ID NO: 4175878 - RNA, 74 nt, Human
gaguuacagugcagcuuauaaagcaucaaugaggaagugcauugaccucuauugugacuggcuguuaaaaacuu

SEQ ID NO: 4175879 - RNA, 57 nt, Human
gaguuaccaugaauuguuagccgguugaauccuaaauugacaacaaaaugguaauuu

SEQ ID NO: 4175880 - RNA, 90 nt, Human
gaguuaguagcucauggauugaauauaaauuagaugauugaaauaugauauuuaaugaagcuugauucaguccaugagcuacauaagcuu

SEQ ID NO: 4175881 - RNA, 56 nt, Human
gaguuauaaccuaguuuaacuggauuuagaaaacugguuaaacuaggcuacaacuc

SEQ ID NO: 4175882 - RNA, 66 nt, Human
gaguuaugacuugagaauucauaauuaucuaggaaugucuuggcucauguuucucugucgugauuu

SEQ ID NO: 4175883 - RNA, 77 nt, Human
gaguuauuuauuuuggucuuuuauuuaaagcagcccuaauuuuuagauuguuugaauaacagacaaauuagaagcuc

SEQ ID NO: 4175884 - RNA, 77 nt, Human
gaguucaggaaauuugucucaaauuauuuaacuagccaauggcaggucuggauuuugaacaaaauucugucuuacuc

SEQ ID NO: 4175885 - RNA, 55 nt, Human
gaguucaucucuuccugcccugcuucugagggaagcuguuaaaagguaugaauuc

SEQ ID NO: 4175886 - RNA, 67 nt, Human
gaguucauuucuguuggagaauuugccucuucaauuccuugagcaggcuuuccacagaaggaggcuu

SEQ ID NO: 4175887 - RNA, 56 nt, Human
gauacuuggguagaaguuucccaagcaauuacuuuaucaaacagugccuaaguguc

SEQ ID NO: 4175888 - RNA, 64 nt, Human
gauacuuuaggaagaugcuuuuucuggguaaacuaaaagccugacguggcucuuccugauguuc

SEQ ID NO: 4175889 - RNA, 66 nt, Human
gauacuuuguggaauccuggaugaggaggcacagaaauacucccaccauaguuauaacaaaguguu

SEQ ID NO: 4175890 - RNA, 129 nt, Human
gauacuuuugguagaagcguuguguaaaauguguggaguaaaaaguuuuugcagauaauguguuugacauaccauauuauuauauuggaugagacuuucuuccaccugcagauguuucucuuugucuuc

SEQ ID NO: 4175891 - RNA, 63 nt, Human
gauagaaaacugaguuuucaguaucugaagacuauagauacugaaaacugagucuuccguauc

SEQ ID NO: 4175892 - RNA, 74 nt, Human
gauagaagacgcugagagugguggcucacaguaauucucuccucccugucaugcaccucuccauguccccuuuc

SEQ ID NO: 4175893 - RNA, 95 nt, Human
gauagaauagaauuagguauucagcgcaugcucaguaaauaccuguggaauagaucaauccacagaguggcaugaaugaagccuucugucucauc

SEQ ID NO: 4175894 - RNA, 71 nt, Human
gauagaaucuguuccugaggcaccagagaacuccagggaauauucucugauuguuuagugaauagagcauc

SEQ ID NO: 4175895 - RNA, 87 nt, Human
gauagaauuauaaauuuuaaagcaaguagaagccugaguuauuacuagucauaucuccuucaauucugcuuuauaggugagguuauc

SEQ ID NO: 4175896 - RNA, 83 nt, Human
gauagagaaagccaaugguuuugcagguuuguggagcaccagcaacuguuccucaaauuagcagaucauagguggcuucuauc

SEQ ID NO: 4175897 - RNA, 73 nt, Human
gauagcucaaagguuaaguguggacccugaagccagacugccugguuccacgcugugugaccuugggcaaguc

SEQ ID NO: 4175898 - RNA, 80 nt, Human
gauagcucugguguaggguaaggaugggagccucuguuuucuuaacagcuaagcucucagauacuaagccaguaguucuc

SEQ ID NO: 4175899 - RNA, 79 nt, Human
gauagcuuuacagaagaguuuagagugguauaaaaaggacgcacuucagaaccaagcuagcucuagcuuuagggcucuc

SEQ ID NO: 4175900 - RNA, 64 nt, Human
gauaggaaauaaagggauagugaaacuuaaaucucuauguuuuacaaguucugaaauuuccuuc

SEQ ID NO: 4175901 - RNA, 102 nt, Human
gauaggagacgccgugaggaugguguuggagagggcgggaacggcccaccccuauuguaugggcggcugagucuucucggacaccuccugaggucuccuuuc

SEQ ID NO: 4175902 - RNA, 78 nt, Human
gauaggcaagcaggaugaagcccagggagaacguacggcugcuucccagcaugcauucgccugcugucucuuccuauc

SEQ ID NO: 4175903 - RNA, 85 nt, Human
gauagguuagucagccagucacaguuccuacccaguaaacacuugcaguuuauuuuugacagaauuguacuucaacuggcuuauu

SEQ ID NO: 4175904 - RNA, 74 nt, Human
gauagguucagcuuucauccugaaaaguuguuuaaacacuuuuaauuuguuucaagugaugaaaugaauuuauc

SEQ ID NO: 4175905 - RNA, 97 nt, Human
gauagguuucugagugugcagcaucuguuggauggauaaguuguuugugcccaacguguucauagaggggugauccaacacuggugucagggccauc

SEQ ID NO: 4175906 - RNA, 72 nt, Human
gauagugccaggcauuugacagacacuuccagaaaacaccgaaugugcaucuacuaugugccaggcacuguu

SEQ ID NO: 4175907 - RNA, 70 nt, Human
gauaguggaggggaugcaaagcuucauuguucuuauugaggcaaaggaaguauuccuuagauucauuguu

SEQ ID NO: 4175908 - RNA, 74 nt, Human
gauaguggcgcauuguuuacauggcugugcugauugcagcagccacugugcaggagcaguguagauaccgcauc

SEQ ID NO: 4175909 - RNA, 56 nt, Human
gauaguuuuuuuucagugcaauguauaucaugucuuugucugaaaaggaagcuauc

SEQ ID NO: 4175910 - RNA, 123 nt, Human
gauauaaucauuuaugcaaaugccaggauucuauucgcugaagagguuccagguugaguuacauuugagaagcuggagaauguggaugauccuggagagccguuuagcauacaaagagauauu

SEQ ID NO: 4175911 - RNA, 66 nt, Human
gauauacaauccacaguugauuuucuaaagugguaaaauucacuuuucuuuguguuuugguguguc

SEQ ID NO: 4175912 - RNA, 101 nt, Human
gauauaugagucagaaguucagaauauauucauguugucaggucuggaaguacuguuuugacagugaggguguagcauuuagaugaucugacaaauauauu

SEQ ID NO: 4175913 - RNA, 56 nt, Human
gauauauuaacacccacuugccucauguaauugugaggauuaaauguuaguguguu

SEQ ID NO: 4175914 - RNA, 65 nt, Human
gauaucaucucggugaaacauuuggugcuccagguaacagugugccagggccacggggagguauu

SEQ ID NO: 4175915 - RNA, 67 nt, Human
gauaucuguucucuccacaugucagcacccauucaugucaugguuuggaaauggggagaacagauuc

SEQ ID NO: 4175916 - RNA, 97 nt, Human
gauaugaggaaagcaagagaaucugcugugaaaggugaauauuucagaaauacuuguaguaugcauauuucaaaguaaguuaugcugauaucauguc

SEQ ID NO: 4175917 - RNA, 81 nt, Human
gauaugagggagggaaaaugcaaaugaugaaacuaacuuuuccuacuucagaaaggaaaauguuugccucuccuuccaguc

SEQ ID NO: 4175918 - RNA, 80 nt, Human
gauaugcaguaaacagaauucaggcaagauaccucuaagcuguuuugaacccucugauauuuuguauuuauguguuuguc

SEQ ID NO: 4175919 - RNA, 56 nt, Human
gauauggcacauuuuguuuauccauuuaucugucgauggacaauugagugucuguc

SEQ ID NO: 4175920 - RNA, 72 nt, Human
gauauggcugcccacguuggugcuucccggacuccccaagaggugauggagcauuacgugagcauguacauc

SEQ ID NO: 4175921 - RNA, 81 nt, Human
gauaugggaagacccuguguaccuguucccuugcaaggacugucuuucauggaaggcuaggugcuaggcccugccuguguu

SEQ ID NO: 4175922 - RNA, 88 nt, Human
gauauuaaugggaaaaauagaguauacuuuaaaauuguggauaggaauuaaaauaucagguuaaauauaugcuguauucauugauauc

SEQ ID NO: 4175923 - RNA, 69 nt, Human
gauauucaugaaagcuguuagagcccccagucugcacccggagaugggggauuuuacagcgugaguguu

SEQ ID NO: 4175924 - RNA, 97 nt, Human
gaggcgggagaaucgcuugaacucgggaggcggagguugcagugagccgaggucgugccauugcacuccagccugggcgacagagcgacuccgucuc

SEQ ID NO: 4175925 - RNA, 67 nt, Human
gaggcgggcagaucaccugagguuggaauucgagaccagccuggccaacauggugaaaccucgucuc

SEQ ID NO: 4175926 - RNA, 68 nt, Human
gaggcgggcgcaucaccugaggucaggaguucgagaccagccugaccaacguggugaaaccccgucuc

SEQ ID NO: 4175927 - RNA, 68 nt, Human
gaggcggguggaucaccugaggccggaaguucgagaccagccugaccaacauggugaaaccccgucuc

SEQ ID NO: 4175928 - RNA, 68 nt, Human
gaggcggugugagcaaugugugguuaauguuagggaaacagugcauuuacaccaguuuacacuuccuc

SEQ ID NO: 4175929 - RNA, 59 nt, Human
gaggcucaaaccuggacagagcugguagccaaauuaaccgugaacccaguuugagcuuc

SEQ ID NO: 4175930 - RNA, 59 nt, Human
gaggcucaccucaauguuucugaguccacuucagaaauuccaaacacugggugagccuc

SEQ ID NO: 4175931 - RNA, 120 nt, Human
gaggcuccaagggguuaagcagcaugccccaggucacacaacggaaauggaaccaggguucuauugcauccccauugugccccagggcccaugcuguuaacugccuggcuguuuggccuc

SEQ ID NO: 4175932 - RNA, 56 nt, Human
gaggcucuggaguagguacacagaauaagacauggugcuugucuuuaaggagccuc

SEQ ID NO: 4175933 - RNA, 71 nt, Human
gaggcugaaaccguuauccacugacaucuaucucacauugguugaaggucacuguuaaggguauuagcuuc

SEQ ID NO: 4175934 - RNA, 97 nt, Human
gaggcugaagauacaggagcauggaugauugauggagcacaucccuaagggagcaggaggggaugaaauccagaucacagguggugggauuagccuu

SEQ ID NO: 4175935 - RNA, 60 nt, Human
gaggcugagaguggaucccagggauggucacgaaccuccagagagccacuuuauaguuuc

SEQ ID NO: 4175936 - RNA, 113 nt, Human
gaggcugaggcaugagaaucacuugaaccugggaggcggagguugcagugagccgagaucaugccaccgcacuccagccuuccagccugggcaagagagcaacacccugucuc

SEQ ID NO: 4175937 - RNA, 72 nt, Human
gaggcugaugguccagacuuugaccucucagaaagugcugggcugccugagaggggucuggauguucggcuc

SEQ ID NO: 4175938 - RNA, 56 nt, Human
gaggcugcagcuaucagacauuuccaaagggagugucuucgacuccugcgugcuuc

SEQ ID NO: 4175939 - RNA, 58 nt, Human
gaggcugcaggcaaugcugccccagacccaggggcgaagagucuuugccuggggccuu

SEQ ID NO: 4175940 - RNA, 71 nt, Human
gaggcugcccaacuggaguggacccagggccucccagacugcccucccgccacugugaguuggcuggccuc

SEQ ID NO: 4175941 - RNA, 98 nt, Human
gaggcugcgccguggaggggaggaggcuaagugggcucuggaaucagccagaccccagguccaggcccaccuuggccacuuacgaacugugcagccuc

SEQ ID NO: 4175942 - RNA, 73 nt, Human
gaggcugcuggcuggucaugucaugagcccaggucuucuucuugggcacaaccagaugccauuucucagccuc

SEQ ID NO: 4175943 - RNA, 94 nt, Human
gaggcugcugugagaugcacagauccccaggacccuugggcuggcccccucagaggcuugagggccuggugaccuggguccucugagcagcuuc

SEQ ID NO: 4175944 - RNA, 118 nt, Human
gaggcuggaccuccaaaaggaauggcuguguggggcagccaggaaagcuggacccuggggaccauggcccuguacccuggcuuggcacagacacaauggcgcguucugucuagcacuc

SEQ ID NO: 4175945 - RNA, 105 nt, Human
gaggcuggaucauucuccgugguggcuggagguagggagguccugugcaguguagaauguuuagcagcauccuuggccuccacccacugaguaucucuagcacuc

SEQ ID NO: 4175946 - RNA, 66 nt, Human
gaggcugggggcagccugaccccacguggaagagcuuggggucaugaggcugcugucaccaggcuc

SEQ ID NO: 4175947 - RNA, 70 nt, Human
gaggcuguccuguggaaagcuagccgcugcuuccuccaugaaagcuguuagaaauccgggggaugaccuu

SEQ ID NO: 4175948 - RNA, 99 nt, Human
gaggcuuaaggggcuguggggucagcaggccuggccuguuccagccaucccaggcaggcgaguguugcucugcagacccagaaucacagccuuggccuc

SEQ ID NO: 4175949 - RNA, 67 nt, Human
gaggcuuagucucuaggcaggguccuggagugccgcuccagagucccugcucaggggucugauucuc

SEQ ID NO: 4175950 - RNA, 70 nt, Human
gaggcuugauuggucccuccaggcucaggugcucaucaaugagcccaagcuaugaggugaccucacccuc

SEQ ID NO: 4175951 - RNA, 90 nt, Human
gaggcuuuacauucuugcugauuuugauguaccuaccgaguguggccaaagguggcucuugguaagacauuagagguuacagaauuccuc

SEQ ID NO: 4175952 - RNA, 55 nt, Human
gaggcuuugguuauaaaagaucaaagacauacacuuugaucuucacuagaaccuu

SEQ ID NO: 4175953 - RNA, 75 nt, Human
gaggcuuuucagggucauuucuucacacucucugcagggaagcacggagacagcaggaagaaauauccuaaccuc

SEQ ID NO: 4175954 - RNA, 56 nt, Human
gaggcuuuuggcuaauaacuguuaaauacuuaaugacucuuaaaagccugagucuc

SEQ ID NO: 4175955 - RNA, 113 nt, Human
gagggaaaacagagggaaugugcccacauggugccauggccauucaccaauccuaugguuggggguugguauacgugcauaccauauugggccuguuuauacauguggcccuc

SEQ ID NO: 4175956 - RNA, 109 nt, Human
gagggaaaucugcagguccgcuucaaagcccuggucugccacccacaccccuccaaauguggagaaugggggcuacaggccacaugcaguuguggaccugcggaaccuc

SEQ ID NO: 4175957 - RNA, 75 nt, Human
gagggaaucucauguggcauagugugaucaugggaaugacaucccaccaucuuugccauaugauguaauccacuc

SEQ ID NO: 4175958 - RNA, 75 nt, Human
gagggaaugaguggcagaagccaagucugcaguugggaaaucaugggacgugcuggcuuuuccucucugauccuc

SEQ ID NO: 4175959 - RNA, 72 nt, Human
gagggacaaggagguaagaagaaagggagggcuuugcuuucaaguuuguauuucuguauuucuaaguuccuc

SEQ ID NO: 4175960 - RNA, 76 nt, Human
gagggaccaacggggcugguuccauucguuuaucacaaaggaaagacuguugccugaacuuagccugguggcccuu

SEQ ID NO: 4175961 - RNA, 66 nt, Human
gagggacugaggaaggaguuaggcaguugcucaaagcaggcagccuggauagaccccucuccccuc

SEQ ID NO: 4175962 - RNA, 70 nt, Human
gagggacuuguuuacaagcaguucugaccaccuuagugguguacuguuuucuaggcaaaaaauaucuguc

SEQ ID NO: 4175963 - RNA, 72 nt, Human
gagggagagagagaaacacaacucaggauguccaucaggauuuaucugcagcagugugucucauuuuaacuc

SEQ ID NO: 4175964 - RNA, 86 nt, Human
gagggagagagagauucuggcugcagucccuguaauaaccucuaauuagugcaaugaauaacagccaccaucucuucuguuuccuc

SEQ ID NO: 4175965 - RNA, 66 nt, Human
gagggagagaguccuggaggcaaaugaagacuccugguggggagaucaucagccccaggggaccuu

SEQ ID NO: 4175966 - RNA, 80 nt, Human
gagggagauuggcccucagaggcagccuugugauaggacagaaguccagaagcauccuggcucuaggugucaucacuguc

SEQ ID NO: 4175967 - RNA, 55 nt, Human
gagggagauuuuagaaauuacuuuacauaauuguaauaguaaugaagucuuguuc

SEQ ID NO: 4175968 - RNA, 125 nt, Human
gagggagcugggguuugggguauaggggucugggguuccagaccacggguguucugaggacaaaaccugaaggaggccgggauucuggagauucugccucuaaauccaccucccccgucucccuu

SEQ ID NO: 4175969 - RNA, 58 nt, Human
gagggagcuugauggauguuugugaaauaauacaggggcucugcugcaagucuuccuc

SEQ ID NO: 4175970 - RNA, 67 nt, Human
gagggagggaacgagagaaagaagcaaacauuuuaaauuuuguucugugaaucuuuuuucccacuuu

SEQ ID NO: 4175971 - RNA, 56 nt, Human
gagggagggccaggucccaaccaaugagaaggcaaauggcuccuggcuccucccuc

SEQ ID NO: 4175972 - RNA, 102 nt, Human
gagggaggucaggggcaccccaucuggccagucuguggaagccaggcaggggugcagccccgcugggggcagggcuggcugagggagcccccuucuucccuc

SEQ ID NO: 4175973 - RNA, 87 nt, Human
gagggagucagcugcagcagcuuugguaggggaaaggagagcucagcgcuacacccacacuuggggagccugcugcgccacucccuc

SEQ ID NO: 4175974 - RNA, 90 nt, Human
gagggagucaugagcgagcaggggccucuggugccugaagcgccccucaggaagagcgggucucaccggaaggccacacucaucuccuuc

SEQ ID NO: 4175975 - RNA, 77 nt, Human
gagggcaaauaggagucaaggcuauuaugugggaaaucuggcaccagauuaccugcuuuagaacuccaguuucccuc

SEQ ID NO: 4175976 - RNA, 109 nt, Human
gagggcaauuaggaguuaaaaucuagccuuuucauuguuccucgagcauuguccaagcucagagcuggguaugucuggaggaaggggcaaaagguguccuuugccaguc

SEQ ID NO: 4175977 - RNA, 55 nt, Human
gagggcagagacagugauucaccaacagcacagguggaucccuccuuuaacucuc

SEQ ID NO: 4175978 - RNA, 69 nt, Human
gagggccaaagagcaagagccuguuuaccuuccccaagguccacauuuccucuugcuucuucaucccuc

SEQ ID NO: 4175979 - RNA, 84 nt, Human
gagggccugaggccuuggagagggaacugggaggccuggcuucuagcccggcucugccucugacccucuggccucaguguccuc

SEQ ID NO: 4175980 - RNA, 65 nt, Human
gagggccuuacccagccuggauguccuagaaagcuuccuggaagagggaccccaggcuggcccuu

SEQ ID NO: 4175981 - RNA, 59 nt, Human
gagggcgcggcugcccaccugacgaaccuggccugugucagaguggugguuuugccuuc

SEQ ID NO: 4175982 - RNA, 79 nt, Human
gagggcguguggugcaggccaagcugcgagcuuccggaaacccggcuuccagugacuuuggucgugcgcucacccccgc

SEQ ID NO: 4175983 - RNA, 65 nt, Human
gagggcuaagauaauggcuggguaaaguaccuucuuauuucuagucagccauaucuaguguucuc

SEQ ID NO: 4175984 - RNA, 129 nt, Human
gagggcugaaugcuucuuccuggaaaaacucucagcuccuaagugagugguugugauggcuuuuccuaagacugccugcauccuuaggguagagaguagaaaccuuauauugcuacaacucagcaucuc

SEQ ID NO: 4175985 - RNA, 67 nt, Human
gagggcugccugcucugcauugaagcugcuuuguucauuucucagugacaagagccuggcggcuuuc

SEQ ID NO: 4175986 - RNA, 76 nt, Human
gaggggagugguugggggcuggggagaugcuggcugugcugcuucucuguucuaacccuugcagccuauucuucuc

SEQ ID NO: 4175987 - RNA, 78 nt, Human
gaggggauguccugugcauuguugaguguuuagcagccucccuggccucuacccacuagaugccagcagcaucccuuu

SEQ ID NO: 4175988 - RNA, 79 nt, Human
gaggggcaccucuccccgcagcugucuaugugugggggcaccucuccccgcagcuguccauguguggggggcgccccuc

SEQ ID NO: 4175989 - RNA, 73 nt, Human
gaggggcaguugauugugcuaugaaagcccaacagggcuaagcccagccacagucaaccuguccauaguucuc

SEQ ID NO: 4175990 - RNA, 65 nt, Human
gaggggcccguggcucagcuggcccaccaaccccaagcauuggccaagccagcugcacggcccuc

SEQ ID NO: 4175991 - RNA, 77 nt, Human
gacuuuacagacccugaguuacagauauauaucagggaaaaaaugugcuauuucuguaacucagggucuguaaaguc

SEQ ID NO: 4175992 - RNA, 84 nt, Human
gacuuuacauggaacugaaaucugaauuuagagaugguucacaucguuuccacucugaaacacuuuuuaguaaagauugaaguc

SEQ ID NO: 4175993 - RNA, 68 nt, Human
gacuuuacucaaugaaguagccugguuaaaagggcaaugccagccgggcuauauuucuuugucuaguu

SEQ ID NO: 4175994 - RNA, 129 nt, Human
gacuuugauuaaucuuauucucuugaccaucaguacuauagcuuauuaauccacaaaguauuauaaaguaccugcuuuggaaauaagaggcuaaaugguaauaaugggggagaguuuaguucugaaguc

SEQ ID NO: 4175995 - RNA, 78 nt, Human
gacuuugcaaacagaaaugcaggacgcuccucccucccccaccggaggauguccagcuccuuuuugcuugcgacaguc

SEQ ID NO: 4175996 - RNA, 83 nt, Human
gacuuugcuguggucccauagguaagcgugcagguccaagcgucggcucuacuguuuacugccugugugaccacgggcaaguc

SEQ ID NO: 4175997 - RNA, 71 nt, Human
gacuuuucuggaauccucaaaacaugagagccagacuuuaggagcucucaucucuggacucuagacugguc

SEQ ID NO: 4175998 - RNA, 72 nt, Human
gacuuuugcaaucugauuccaauguaacaaauauguauguguguauacaaauuggaaucagauugugaaguu

SEQ ID NO: 4175999 - RNA, 80 nt, Human
gacuuuuucagugaaagcuacuguuaggcaugacauuuacaggcaacugaaacugaucagaugcauuuauuaagaagguu

SEQ ID NO: 4176000 - RNA, 78 nt, Human
gacuuuuuccaaaaugucagaagcuuuacuucugaaugugacacuucaucaggaggcaaaggucucugauaaaaaguc

SEQ ID NO: 4176001 - RNA, 73 nt, Human
gacuuuuuucucuccuuacccugagaggcauaccaaaauaguuaccucucagggugaggaaagaauuuaaguc

SEQ ID NO: 4176002 - RNA, 99 nt, Human
gagaaaaauuaaguugguacccacauugucugagauguguuucagaggacaauuacuuuccagagcaguuuucagaucaaaaugguaucauguuuucuc

SEQ ID NO: 4176003 - RNA, 63 nt, Human
gagaaaagaguaagggugggggcuuguaaagcuguuuuuccucaucugaccccaucuauucuc

SEQ ID NO: 4176004 - RNA, 73 nt, Human
gagaaaagugauuaugcugucaaagaagcaaaaggagcuuccaacaguaauagugaucauugaggaguuuuuc

SEQ ID NO: 4176005 - RNA, 83 nt, Human
gagaaaaucuuguugagccaauucuuuaagacucccucuugucucuuugagucuuacaagaaauaagccaaugagagguuuuc

SEQ ID NO: 4176006 - RNA, 71 nt, Human
gagaaacacugggauuugguguacuuccucugcucuuuuaaacaucaguucuuauuuggccagugucucuc

SEQ ID NO: 4176007 - RNA, 92 nt, Human
gagaaagaaauauguaccuucugauacugacaucauuuauggagaacagaauggugugauucaguacaugauguauguuacuucugauacuc

SEQ ID NO: 4176008 - RNA, 100 nt, Human
gagaaaggcgccuugguuucaacagcagcagaccagcauauguuuacuuaauuccuaagacaugaugacaguggucucugcgccacuaaaagcuuuucuc

SEQ ID NO: 4176009 - RNA, 66 nt, Human
gagaaaggucuuggcucuggccgcacagcagccugugcccaguugaggccaggacucagacuucuc

SEQ ID NO: 4176010 - RNA, 73 nt, Human
gagaaagucuuaauguaaguuuaguagaguccuuggauggagaacuaauuauaucauacauugccgcuuucuc

SEQ ID NO: 4176011 - RNA, 123 nt, Human
gagaaaguggggaguguugggaugacauauuuugaaagcuaugaguuaauauaugcauuaaauauauuaagucaguuguauuagcauauaugauucaguuuucagcgacagcucuguuuccuc

SEQ ID NO: 4176012 - RNA, 112 nt, Human
gagaaaguguggcccuaccaacaccuugauuucuugcuugcauauugucucucccccucaaggacucuaucaagacagugcaagaagagcaggcaccugguccgugcugcuc

SEQ ID NO: 4176013 - RNA, 129 nt, Human
gagaaauacuuggcaugcugugaauuuggccuaggcagcaguacucaauauccuggcaggagagaaaacucccuaauuugagugucugcuguacaccaaguuuccauuauaucaauauuccuauuucuu

SEQ ID NO: 4176014 - RNA, 55 nt, Human
gagaaauaggaggagagaaauauguuugaaucaaacauuucucuuuuccugccuc

SEQ ID NO: 4176015 - RNA, 86 nt, Human
gagaaaugagccuacuuuaauuuucugcagagacagacuguaauuuguaacaucucugaucagaaauugaggcggcauauggacuc

SEQ ID NO: 4176016 - RNA, 64 nt, Human
gagaaauguauguauguacuuuuguauguaugcauacguaauauacagcuuaugcauauaucuc

SEQ ID NO: 4176017 - RNA, 59 nt, Human
gagaaauuucucucuacuucuguucucaaaaggcauuucggaugugagagaaucuucuu

SEQ ID NO: 4176018 - RNA, 72 nt, Human
gagaacacagaacagggcccaaggggucgggcuucaagccuugacuucuucuagcccugcacucugucacuu

SEQ ID NO: 4176019 - RNA, 68 nt, Human
gagaaccagaguauauuauaguaauacauacuugcuuaugguccaguauaaugucucuaucuguucuc

SEQ ID NO: 4176020 - RNA, 62 nt, Human
gagaaccucuccacaagucuggcacagauguucuagcaucucuaggaugugagaguguucuu

SEQ ID NO: 4176021 - RNA, 60 nt, Human
gagaaccugugacuuuccucuauuuuguugguaauuauaagcaggaggcagucacagcuc

SEQ ID NO: 4176022 - RNA, 81 nt, Human
gagaacuaggcacuuaggaaugugucuguugccugggaaaccacaccuggcacagagacaguccugagaucccuggcacuc

SEQ ID NO: 4176023 - RNA, 56 nt, Human
gagaacugggaaucucaggaacaugggaucccagaucaaaagaaucccagugucuc

SEQ ID NO: 4176024 - RNA, 70 nt, Human
gagaacuuacaaggaugauagcugcaucuuuuuagauagaaauacgcaguuguguuguuguacaggacuu

SEQ ID NO: 4176025 - RNA, 106 nt, Human
gagaagaaagggagagaguuggaugaucucagagcaguagaaaacagccuuuuaaacauagaagguaugucuguuuuagacuauaggaugaucuuuuuuuuuucuu

SEQ ID NO: 4176026 - RNA, 98 nt, Human
gagaagaaagggguauuuuagggaaaggaaauuauuucugcaauggaugagaacaacagccaucaucagauuucuauuucaaauacauuuucuggcuu

SEQ ID NO: 4176027 - RNA, 57 nt, Human
gagaagaacuuagcuuucuaucucauggaacgccaagauagguugcaaguccuucuc

SEQ ID NO: 4176028 - RNA, 96 nt, Human
gagaagagauaugaauaaacaauguccugugagaugauaaauucuguauuuuuucaagcaccuggaauauugauucaugucucccuaaaauaucuc

SEQ ID NO: 4176029 - RNA, 61 nt, Human
gagaagaugagcuuuccugguuggugaaccaaacuccucagcaaggcugcauucucaucuc

SEQ ID NO: 4176030 - RNA, 79 nt, Human
gagaagaugaggagaagggcacggagaaaagcugcugccuuuuuucauucuacccuuucucacuccuuauccucuucuc

SEQ ID NO: 4176031 - RNA, 55 nt, Human
gagcacuugugacagcgagaucugggagaugucucagggccuguugcaagcguuu

SEQ ID NO: 4176032 - RNA, 70 nt, Human
gagcagagcagacagcagcagaggggcucccuagagcagcugggggcccugccugugccgucgcucuuuc

SEQ ID NO: 4176033 - RNA, 99 nt, Human
gagcagagcugcauuccuuucuggagguccuagaggauaauucauucccuugccuuuuccagcuuccagaggccaccuggauuccucagcucaugacuc

SEQ ID NO: 4176034 - RNA, 57 nt, Human
gagcagagcuucucaaaguaaaacuagccguguugcuacaaagggaaauucuggcuc

SEQ ID NO: 4176035 - RNA, 98 nt, Human
gagcagaggaaucauaaugcauagcuuuuguuuaagccacuaaguuuugcugugguuuauuauacaacaaaagcuaaguguuagaauaaucucuccuc

SEQ ID NO: 4176036 - RNA, 64 nt, Human
gagcagcaccccuccuggcuaugaagaugcccucccucuucucuagggcacuggggugcuauuc

SEQ ID NO: 4176037 - RNA, 63 nt, Human
gagcagcagccuaggguuccaucaugagcggaacacugaugugugggaucgggcuugggguuc

SEQ ID NO: 4176038 - RNA, 87 nt, Human
gagcagcaggcucuggcgcucuuccucagggcggaugggcagguucagcucuucuuccuccucccugggaaagccagagucagguuc

SEQ ID NO: 4176039 - RNA, 58 nt, Human
gagcagcagguggggcuggcuuucuaggggcgcagaaggggccccccgccggcugguc

SEQ ID NO: 4176040 - RNA, 58 nt, Human
gagcagcccaaggccauaagaccuuugucaaagaauucaaaggaacccuggguugcuc

SEQ ID NO: 4176041 - RNA, 130 nt, Human
gagcagccuucucuuucccucuuucugggucuccauggaacagacagcugagacaagguaaggucacacuugugaaguucugugccgugaagccacagaaaggauagucagguuagggaacaggcucauc

SEQ ID NO: 4176042 - RNA, 65 nt, Human
gagcagcgugaggggcucccagcaucagacacaaacgugaucuucagcagggccucucugagguc

SEQ ID NO: 4176043 - RNA, 58 nt, Human
gagcagcuccagccgcaugacuucacggcacaggcaaagucaaaggcaaggagagcuc

SEQ ID NO: 4176044 - RNA, 67 nt, Human
gagcagcucugggugacccaguuaggaagucagcaggugugugaccuggcucauccagguguugcuc

SEQ ID NO: 4176045 - RNA, 78 nt, Human
gagcagcugaauggcucccugcuaaauauucaaaugucccccacccuuuugcaguuagauggggucauguagcuguuu

SEQ ID NO: 4176046 - RNA, 102 nt, Human
gagcagcugggcgccgccuuggaaucagcugggggagcaccucuccuugggacgggaugacagggcuucccaggcgguccccacaagcccgcgccccagcuc

SEQ ID NO: 4176047 - RNA, 59 nt, Human
gagcagcugguaggugaacccaggcagucuggcuacaaaguuccuaugccauguugcuc

SEQ ID NO: 4176048 - RNA, 55 nt, Human
gagcaggacagcagcuuccuggauccccucaguuggacuuaguugcucucugcuc

SEQ ID NO: 4176049 - RNA, 56 nt, Human
gagcaggcucugccugugugucacguccacauggugaacauggcagacgucugguc

SEQ ID NO: 4176050 - RNA, 91 nt, Human
gagcaggcuggagaagcagcuucagaggcgggcgcaggaggcaguucucagcugcgcccucuggaagccugucauccaguucacccugcuc

SEQ ID NO: 4176051 - RNA, 75 nt, Human
gagcagggugggggucugaguggugcugacucaggacuggguccuccucacuccuucucaggggccacccugcuc

SEQ ID NO: 4176052 - RNA, 55 nt, Human
gagcaggucuuucauggugcaugcagaagcuccugucccaccaauuaagacccuc

SEQ ID NO: 4176053 - RNA, 86 nt, Human
gagcaguuugguuuuuuucuagcucaaagauucuaguguaacaaauaguggauaccuuaguugugaaaguuccuuccagauuucuc

SEQ ID NO: 4176054 - RNA, 89 nt, Human
gagcaucaacuggauggagucacccuaagcuuuccuuccaccuggguggaaucauugugacaagcucccgguggcccuccugcaugcuc

SEQ ID NO: 4176055 - RNA, 103 nt, Human
gagcaucauuuuaaaagauacugcugccugggccccacauccagugcagcugaccuaacuggucugcagugguguccagguguacuguuuuugaaggaugcuc

SEQ ID NO: 4176056 - RNA, 63 nt, Human
gagcaucucuuugauggcuccugugagcugacagcagcuauggagucacugaaaagggaaauc

SEQ ID NO: 4176057 - RNA, 62 nt, Human
gagcaugugucgguggccucagggcagcagcugccuggugaauguucauggacuggaugcuc

SEQ ID NO: 4176058 - RNA, 59 nt, Human
gagcauucauugcccuuaccuugacuaugaaggagugaagauggaguaguguaaugguu

SEQ ID NO: 4176059 - RNA, 74 nt, Human
gagcauugaaacaauguugucuccaagaggaaauaaauaauccucacacuuagggagggcauuguaauauguuu

SEQ ID NO: 4176060 - RNA, 87 nt, Human
gagcauuuaacucauuuacauuuaagguuaauauuguuaugugugaauuugauccugucauuaugauguuagcugguuauuuugcuc

SEQ ID NO: 4176061 - RNA, 117 nt, Human
gagcauuuaagcaaaugaacgacacagggacagcuuugggcaaugcuaugagugggucuccagcaccccuuucucuucauuaguguucucaagcugaucucugguugcuuagagcuc

SEQ ID NO: 4176062 - RNA, 79 nt, Human
gagcauuuagcuagagucacagcagccuuguugguuucgaguccaaauggccucgaagguuauugucuuuacguuguuc

SEQ ID NO: 4176063 - RNA, 62 nt, Human
gagccaagaagggccauguggauuggcugcuuugggcaauucacugaacuucucugagacuc

SEQ ID NO: 4176064 - RNA, 58 nt, Human
gagccaagcucuucuccaugagucauguucaauagaaguguucacaagggcuugguuu

SEQ ID NO: 4176065 - RNA, 70 nt, Human
gagccaagggcgugcuggagaggccugagagaagaaggaacggcccuucugaccagugcccuuuugguuc

SEQ ID NO: 4176066 - RNA, 66 nt, Human
gagccaccaugcccgcccgcuucgucuuuucacuggacuaaugaagauacagguguggaaugguuu

SEQ ID NO: 4176067 - RNA, 87 nt, Human
gagccacgcuaagccgcugcccaggagagguggggcugcgccgcagccaggacacccucucccugggagcaacagcauccuuggcuc

SEQ ID NO: 4176068 - RNA, 110 nt, Human
gagccagaaaagcuaagguaucaucuggagcugcaggagucggggggaaacccccugcuuuuguuccacaguuuugaagugggugaucccuccagcuuuugcuaugguuc

SEQ ID NO: 4176069 - RNA, 67 nt, Human
gagccagcuguucacauuuccaaaaccccuaugucaacgaauggguuuuggaaaugugaucagccuc

SEQ ID NO: 4176070 - RNA, 77 nt, Human
gagccaggacaucucuagcugcugcaaggacagcuuccccgagggcugaauaagcagacuggagaacuccugugcuc

SEQ ID NO: 4176071 - RNA, 75 nt, Human
gagccaggcauguuuuccauauuuagaccaacuuguugccuauuauaagaaagcugauggaaaggauuuuggguc

SEQ ID NO: 4176072 - RNA, 62 nt, Human
gagccagggaugcagagguugcagugagcggagaucaagccacugcacuccagccugggcuc

SEQ ID NO: 4176073 - RNA, 128 nt, Human
gagccaguucccaaacccaggucugcucacucccagcugggccuucugcaggguccucaccccauggcagauggcucagacacuggggcccagugacuggcugcuccuggugagggggagcuggacuu

SEQ ID NO: 4176074 - RNA, 84 nt, Human
gagcccacgugggauucacaccuccuagaguucacagcacaaguuugcuguaacaguagauaaggucuugguugcccugagcuc

SEQ ID NO: 4176075 - RNA, 64 nt, Human
gagcccagagaagucuugccuggauuuuguucuuugcacaaguucuuuaaccuuucugggcauc

SEQ ID NO: 4176076 - RNA, 62 nt, Human
gauuaguauccuuauuaagagaaagagaccagagcuuccucucuaccaugugaggauacauc

SEQ ID NO: 4176077 - RNA, 73 nt, Human
gauuaguauuuucaccauaugagguaaaacauuuuaaucauuguuaucuuauugugaugaugaagaacuaauu

SEQ ID NO: 4176078 - RNA, 90 nt, Human
gauuauaaaguuaaggugagucaaucuuuuggaguuuaugagcauauaagcaaugacacucgaaaaauugaugcuuuaaugaaaauaauu

SEQ ID NO: 4176079 - RNA, 75 nt, Human
gauuauaggucugaucugucagucaugaagguuuauaacaaauaguauagauugaagcagaucaagcaugaaguc

SEQ ID NO: 4176080 - RNA, 84 nt, Human
gauuauauaaauacuguugguuaucugaauuggcuuuacacugaauauacauuaacucagagaacuggcauguuuagaaugguc

SEQ ID NO: 4176081 - RNA, 126 nt, Human
gauuaucauguacaagagugagauuaucauguacaagagugagauuaucauguacaagagugagauuaucauguacaagagugagauuaucauguacaagagugagauuaucauguacaagagauc

SEQ ID NO: 4176082 - RNA, 55 nt, Human
gauuaucuuaaagugacugcccuuguucuuccaaagagcagaucauuagauaauu

SEQ ID NO: 4176083 - RNA, 81 nt, Human
gauuaugaggcaguacacacaaagcccugcugaguggugggcaggccauacguccuuugagugauagcugcugucauuauc

SEQ ID NO: 4176084 - RNA, 65 nt, Human
gauuauggagacaggcagcuagugggucagugaacuagauucuguaugucugcucucuaauuguc

SEQ ID NO: 4176085 - RNA, 86 nt, Human
gauuaugguuggcugauuuagaaauuccaaaaguauuuuaaacauuaaagacugagaaacaauucuggaagucaaauuucauaauc

SEQ ID NO: 4176086 - RNA, 66 nt, Human
gauuauuaaacaccugucuaguguagcuuagggagguuuuucuagacugggaguuugcaguggauc

SEQ ID NO: 4176087 - RNA, 56 nt, Human
gauuauucaguucccuucacucucaucacuuauggggagaauguagcugaauaauu

SEQ ID NO: 4176088 - RNA, 77 nt, Human
gauuauugcuggcccagggucaccuaggaaauugguagcagcauccaggacuuuugacucugaguucagugcccguc

SEQ ID NO: 4176089 - RNA, 65 nt, Human
gauucaaaaguuugagcuccaagagucuagugugauccugagaguggagcugaauuuuuggcauc

SEQ ID NO: 4176090 - RNA, 72 nt, Human
gauucaacuugguucucauguuuuacuguaaugucaaauuagcuuggaauaaaaugagaauaauucugaguc

SEQ ID NO: 4176091 - RNA, 57 nt, Human
gauucaggcuggcaggcagaauuuggccuuggggcuauagccugccaacuccugauc

SEQ ID NO: 4176092 - RNA, 72 nt, Human
gauucauacugugagaugaccaacugacuggugcuuugacuaaccacuuucagcauuuuauaguaaaauguc

SEQ ID NO: 4176093 - RNA, 69 nt, Human
gauuccacagucuuugcuuuuaaccagagguuagcaaacuacuucuguaaagggaagacaguagguauc

SEQ ID NO: 4176094 - RNA, 78 nt, Human
gauuccauguaugacaucugucuuggagauaaucuauacuugaagauaugucaaaaaagauuauguuucauuggaauc

SEQ ID NO: 4176095 - RNA, 65 nt, Human
gauuccucaaacucugccugcaucucccccaagccagagaggaugcaggguagacaggugagguc

SEQ ID NO: 4176096 - RNA, 61 nt, Human
gauuccuggccccaccccuggagagucuggcucagcagaucugggguaggcccaggacuuc

SEQ ID NO: 4176097 - RNA, 113 nt, Human
gauucggugucugguaagggucccuuuccuagauggccaucuuuccaauacaaccucacaugauggaaggggugaagggugucucuggggauucuuuuauaagggcacuaauc

SEQ ID NO: 4176098 - RNA, 85 nt, Human
gauucuauauuuaccuuugccucugcuuuuuccuucagugauaagagugcagggauuauguagggguugagauggggaaugaauu

SEQ ID NO: 4176099 - RNA, 63 nt, Human
gauucucaauuuugccaaaggguuaggaaaccuacugcccuguuggcaugauugcaaagaauc

SEQ ID NO: 4176100 - RNA, 114 nt, Human
gauucucucuuuucagcaauucaggugucaagcagggagcugagauguaaugguuuccuucagauuucuccuaaaugaccugauuuacucaaagaaugaagauaucugagaauc

SEQ ID NO: 4176101 - RNA, 55 nt, Human
gauucucugugggaagucugagucaauuauagggacaucaggcuuugagagaauc

SEQ ID NO: 4176102 - RNA, 66 nt, Human
gauucugagccugacacacaaauucuugugcaagugauucacugagggggugguuucaggagaauc

SEQ ID NO: 4176103 - RNA, 66 nt, Human
gauucugagcuacauaguacugggugucaaaagguuacagagacaucccuauaccagcugagaguc

SEQ ID NO: 4176104 - RNA, 93 nt, Human
gauucugcagaacagcagcacgucaagcugucacucaguuaggcucgucucagcuggaccugcugauguaucugccuuagcaugaaaggaauu

SEQ ID NO: 4176105 - RNA, 74 nt, Human
gaguuggcaaaugcuauuugggaacaacaugaaaaaaaguaaauguaucagaaauagcauuggcucugaagcuc

SEQ ID NO: 4176106 - RNA, 56 nt, Human
gaguugggccgcacuaggcuggacagcggucaagggcucugggguuggcccaucuc

SEQ ID NO: 4176107 - RNA, 66 nt, Human
gaguugggcugggccugaggccaaaugaguuggcagggucucccuggccucugccuugccccacuc

SEQ ID NO: 4176108 - RNA, 56 nt, Human
gaguuggucgagccacuucggggacaggggcaggccucugucugcuucuccaacuc

SEQ ID NO: 4176109 - RNA, 79 nt, Human
gaguuguguguuuguggcugugucugugugcaauaauaaacaucuuuuguggguacuuacagcaauaaugacaccgcuc

SEQ ID NO: 4176110 - RNA, 110 nt, Human
gaguuguuaaugucccagaagguuuggugugcaggugucagugcagcucucugcauguaaaaugccagcauguacuguacccacuucuacccuuuccguaaaaucaacuc

SEQ ID NO: 4176111 - RNA, 62 nt, Human
gaguuuaauggcaagaaggcugcagccugacuaaggcugucggcuugauucugccauggcuc

SEQ ID NO: 4176112 - RNA, 62 nt, Human
gaguuuacucuuuauuucacucugugcugcacauccuuguguaugaauuaaagauuaaaguc

SEQ ID NO: 4176113 - RNA, 76 nt, Human
gaguuuaucuucucagucaccugugagucuuccuuugagagugggacuugcagaguggcuugguaggguagagcuc

SEQ ID NO: 4176114 - RNA, 59 nt, Human
gaguuuauuugacuggauucucagccgaaucagugcugggagccacuguuuuugaacuu

SEQ ID NO: 4176115 - RNA, 85 nt, Human
gaguuucagauucccuuuaaguagaauauauuauaaaaauugugagaggcaaggaugaauauucagacaagggaguuuaaaauuc

SEQ ID NO: 4176116 - RNA, 59 nt, Human
gaguuuccaaaucccugaagggcugcccaugguuaaagcagauggguuugugacagcuc

SEQ ID NO: 4176117 - RNA, 118 nt, Human
gaguuugaaacagagaauaccugaguuccagguucuccucaggcugcucacacuugucuuuucagaaagaccagccaaacugagggauccuguugagcuauuuucugaauucuuacuc

SEQ ID NO: 4176118 - RNA, 83 nt, Human
gaguuugaggguuacgaauaagagauaaagcaaggaaagggcuuuucuuugccaaauuuaucuuuuuuucacccauaaaacuc

SEQ ID NO: 4176119 - RNA, 77 nt, Human
gaguuugccagagagucucuuauucccuauugcugcugcuccucaccaggcccuggcagaugaagaccuuggcccuc

SEQ ID NO: 4176120 - RNA, 81 nt, Human
gaguuuuaucuuuuuagcuguugcauaaaagcauuuaauuuaucuugaguuaauuuuuauguauagugugugguagagguc

SEQ ID NO: 4176121 - RNA, 86 nt, Human
gaguuuugcuuugucacccaggcuggaguguagucgcaugaucucagcucacugcaaccuccgccucccaguuucaagcgauucuc

SEQ ID NO: 4176122 - RNA, 82 nt, Human
gaguuuuuguuaggaaauuucauuugaggucugaaaauccaucucuagaccuacauucuggauuuucacauaauuaaaacuu

SEQ ID NO: 4176123 - RNA, 63 nt, Human
gaguuuuuuauucuggcuggugggaauaggcaccaccuccagcccuguaaggaugaggcacuc

SEQ ID NO: 4176124 - RNA, 85 nt, Human
gauaaaagagagaugauuuguaccaucaaggagcuuacaauucuccaggagacacaagguacauagaugcauaacucucuaauuc

SEQ ID NO: 4176125 - RNA, 78 nt, Human
gauaaaggucacacucccagagcugaggcuacgugagucuaagcuguuaccucaguuaugggaguguggcuggaacuc

SEQ ID NO: 4176126 - RNA, 77 nt, Human
gauaaaguuaagucauuucugauuauagagauucuaauuauagauauuugugguauagagaugauuauuauaauguc

SEQ ID NO: 4176127 - RNA, 78 nt, Human
gauaaauaaugggaugagugauaggaaggaaaaugauuuuuguucuuuuucucuuuuugcaucucaaccucuuuaauc

SEQ ID NO: 4176128 - RNA, 78 nt, Human
gauaaauaauugaguuggucaauaugaguaaugguuagaacaaucccuggcacauagugagcacucaagguauuuguu

SEQ ID NO: 4176129 - RNA, 98 nt, Human
gauaacauaagcaaagggauagcuauuauuauuucuguuauuauuuagauuucaacaagcagucaacagaagugauagcuauuauuaagagugauauu

SEQ ID NO: 4176130 - RNA, 74 nt, Human
gauaacugauugcaucugaaggagcaugagagagugauugagaucacuuccagccccugucagcaaacaguauc

SEQ ID NO: 4176131 - RNA, 84 nt, Human
gauaacuugcacuuucuguguugugcaaaaaucuuuaaauuauucuugaaacuuuuacaauacagaagguaaggaaguuuuauc

SEQ ID NO: 4176132 - RNA, 81 nt, Human
gauaagaauauugguuccuaugaccuuccuugcuagaugguaaauuucauaaggccaaggggccauagucucauuuuuauc

SEQ ID NO: 4176133 - RNA, 81 nt, Human
gauaagagagcacagcugagagcuggaaagugauugacaccugacgcuacuguccuagauccagcugugcugaggcuuauc

SEQ ID NO: 4176134 - RNA, 57 nt, Human
gauaagagcagugcgagugucugcuggugucaucaucauuugcuugacucucuuguu

SEQ ID NO: 4176135 - RNA, 67 nt, Human
gauuucauaguuaaucuuuuucacacaaacaagaaguugagugaagcaggcauugacugaugaaguc

SEQ ID NO: 4176136 - RNA, 57 nt, Human
gauuuccaggucauuaauaaaguuguuuaauaagaucuuuugugcagccugggaauu

SEQ ID NO: 4176137 - RNA, 66 nt, Human
gauuucuagucugaauuaucuuugacacggucccauuuaccugugaaacauuuaggguagaauuuc

SEQ ID NO: 4176138 - RNA, 78 nt, Human
gauuugaaagcagagcagggcacuuauggccaacauuuaaugguuuuuaaacauauggcucuauuugcucuucaaguc

SEQ ID NO: 4176139 - RNA, 95 nt, Human
gauuugcaaacaaaucugaguuauuuguagggauuauauguuuaacuaauagcaaauguucuaaauuacaugugauggauuuguuuagucaaauc

SEQ ID NO: 4176140 - RNA, 60 nt, Human
gauuugcauucugaaagcuaccaaggaguagaggcucugacaguuuuuaagaauuaaauu

SEQ ID NO: 4176141 - RNA, 60 nt, Human
gauuuggcuaacacgcguuuuguucugauugaucagugggaaccggcaguuuagcuaauc

SEQ ID NO: 4176142 - RNA, 128 nt, Human
gauuuggcuuccccugggcagauguggcuuccccugggcagguacagacccucugggaagguguggcucccccugggcagguguggcuuccccugggcagaugcgucuguccuugggcaggugggguu

SEQ ID NO: 4176143 - RNA, 75 nt, Human
gauuugggacaaaggagaaucagcguuucacguucaaaauugaacugggaagcuguuuugcuuuuaaguuaaauc

SEQ ID NO: 4176144 - RNA, 65 nt, Human
gauuugggggugaauuaaauauagccaggucaacuuuguugacacagaauuuacucccgauaauc

SEQ ID NO: 4176145 - RNA, 62 nt, Human
gauuugguaaaagaaucagggagccuuagaauaaagguuucugauucucacuuuggcaucuc

SEQ ID NO: 4176146 - RNA, 75 nt, Human
gauuuguucuuauaccugaagcaggugauguuucuguagagacaucugaaugacagcgggagugaaggacaaauc

SEQ ID NO: 4176147 - RNA, 81 nt, Human
gauuuuaagcuggcugucagggugagcuggcuuuggcccccagccagggcugcucccaauucugcugccuugcuguacuuc

SEQ ID NO: 4176148 - RNA, 126 nt, Human
gauuuuagauacuucaaccuuaaguugauauuauguaacugugguucagcagagauaagagcaggagauuuuuuugggaucauuaugcauaguguacauuggcuuuugguggggguacuuagaauu

SEQ ID NO: 4176149 - RNA, 94 nt, Human
gauuuuagcuauuucaccuugauggagugaugaaugauucacauuagaacagaugauucacagacuucacaaggcagaaauuuuagcgccuguc

SEQ ID NO: 4176150 - RNA, 93 nt, Human
gauuuuagggaagaaguuaguuaaacuagcgacuuaagaauacaugcuuacaggucaguuugacugaauuuuaccacuuucauccccaaaauc

SEQ ID NO: 4176151 - RNA, 109 nt, Human
gauuuuauccuugugucacugagaauagcagacugguaacuaauuccaaaagagagagagggaaguuuugaaugggcuguuguuuuaaagagcugauacagaugggguc

SEQ ID NO: 4176152 - RNA, 88 nt, Human
gauuuucaauauauggcaaaagugugaaauuaaggaaagauuucuaugaaauuuuuugcacacucugcuaaaugaauuauugaaauuc

SEQ ID NO: 4176153 - RNA, 81 nt, Human
gauuuucccaacauuuuauggcaauuuguuucauuugccgcaggcccguaacgaugcaaauugccauaaagugggauaauc

SEQ ID NO: 4176154 - RNA, 80 nt, Human
gauuuugaauucuguaacuuuacugaauuugucuauuaauucuuacaguauuugguggagacagaauaacuuuuaaacuc

SEQ ID NO: 4176155 - RNA, 70 nt, Human
gauuuugaggugacacaauuuacuccauaucacuggaauuguaacuggaguugugucaucuuuguaaauu

SEQ ID NO: 4176156 - RNA, 129 nt, Human
gauuuugauuuuaucuucuucaaauauucuauggccaagaaguauuccugaccuuauguuuuccaaccacuguucauaaaacuguugaucauuucuuggcuguagugaggugaaaggaugaucaccauu

SEQ ID NO: 4176157 - RNA, 126 nt, Human
gauuuugguucuguugucaaguauucuaggaauccuuucucauuucauuucugugcaaaauggauugacaugagaaaugaagagagucaagguugccaagauucauuugucagcaugcaucgaguc

SEQ ID NO: 4176158 - RNA, 80 nt, Human
gauuuuugcucugggagaagcugaugugaagcaccaaugccuucacuugcucaucaugcuauuuccuaaaguauuggauc

SEQ ID NO: 4176159 - RNA, 98 nt, Human
gauuuuuuucauuucagauugugugacuuugggcaauucacucaaccucuuugagucuuuuuguccugauuuauaaaaugaaggaauugaaaaauauc

SEQ ID NO: 4176160 - RNA, 56 nt, Human
gcaaaaaaguccauaguauguguuccuuaauagaaggcaacacaguacuuuuuugc

SEQ ID NO: 4176161 - RNA, 92 nt, Human
gcaaaaaggagaggagauuguggcauuuuccacagcuucauuuguuccugggaaaaccauguaucuauuuccuuuucuaacauuucacaugc

SEQ ID NO: 4176162 - RNA, 56 nt, Human
gcaaaaaggcaaaugaagaaaauucugacuuuuggaauucuuuguuuccuucuugc

SEQ ID NO: 4176163 - RNA, 81 nt, Human
gcaaaaauuaaugacgcagauaauaauugcuauggccacaacaaagcgggagaauuauuguuugaaguuauugacuaaugu

SEQ ID NO: 4176164 - RNA, 89 nt, Human
gcaaaacaaugaguggguggccggaugggagugucagagucagacuaucccggcuccaacuccuagcuggccucucaccagcaguuugc

SEQ ID NO: 4176165 - RNA, 58 nt, Human
gcaaaacacugguuuggcauuagaugguagccaucuaauacuugcucaguggccaugc

SEQ ID NO: 4176166 - RNA, 129 nt, Human
gcaaaacagugaugguauaguacagagguugguggggaagcuaucagugagcaguaugcauugaccugauggauguccagcucaugauacuaucuuuauucauccugugcacuaauuuucugagucaac

SEQ ID NO: 4176167 - RNA, 99 nt, Human
gcaaaacccuaucgauaaagcaaugguaaugauuuauguaaauugacauucuuuuuuaugagguuuacaaaguuauuuuauucuacuccaggguuuugu

SEQ ID NO: 4176168 - RNA, 64 nt, Human
gcaaaagauacauguuaggagcaaccguggguguucugcgggcucguuagcuguauucaguugc

SEQ ID NO: 4176169 - RNA, 57 nt, Human
gcaaaaguacagccggauuucuguuucccuacagaaauuggaaagccauauuuuugc

SEQ ID NO: 4176170 - RNA, 78 nt, Human
gcaaaauacuacagcagguuuuaacuuugaaguguuuaaaugcauuucauugaacuaaagaaucugcuguauuuuugc

SEQ ID NO: 4176171 - RNA, 61 nt, Human
gcaaaaugaaugugaaaaauagaaagauguuucuacuuuuguguccuucacaucauguugc

SEQ ID NO: 4176172 - RNA, 93 nt, Human
gcaaaauguaaggaggcacucaagcucagcuuuacgcaagggcagggccagcaguugcaggaaacugagugugagccccuccuuacauuuugu

SEQ ID NO: 4176173 - RNA, 93 nt, Human
gcaaaauucaaggaagcacucccucucuaguccuugcaaguauagaguuggcacuuguccagaccugaaagggagugcuuccuuaaaucuugc

SEQ ID NO: 4176174 - RNA, 77 nt, Human
gcaaacaaguucaaggcagguccugagguuagagcuuuauuagcuucaugguaaaucugccuuuaccgggcauuugc

SEQ ID NO: 4176175 - RNA, 91 nt, Human
gcaaacagaaucagacugaccugaguucaaguccuugcucucuggugcaauagcuuugugaucuuagccaagucauuugaacacucucugc

SEQ ID NO: 4176176 - RNA, 74 nt, Human
gaguuguugcuucugcugauauuuugugaggguuucuuugcagccucacaaaacaccagcagaagcaacaacuu

SEQ ID NO: 4176177 - RNA, 125 nt, Human
gaguuuaaaagugaggggcugaacagggcugaagggaggugcucauuuucuccuacugaugcuauucauacuagucaguaaucagggcuucacuuucaugcaucucugaccucaagcuagaauuc

SEQ ID NO: 4176178 - RNA, 74 nt, Human
gaguuucacaggauggacugcauuuuauuuucugaacuuaaaaguaaaaaacauuacucuguccugagaaauuu

SEQ ID NO: 4176179 - RNA, 95 nt, Human
gaguuugaagccagccucaucuuaggagaugguccucuagggauggcuaacaguaucccuauuguccuuuccugaaggaggacuucuuucaauuc

SEQ ID NO: 4176180 - RNA, 60 nt, Human
gaguuuggcagauaagucuaaaguggggaugaaauguucuaggacuugguuuccaggcuc

SEQ ID NO: 4176181 - RNA, 70 nt, Human
gaguuugucaguggucauaguagaaaauaauaaaauuuuauguuuuagcaagauucacugaaucagacuu

SEQ ID NO: 4176182 - RNA, 97 nt, Human
gaguuuugcuuuucauuuuguaaaaugcuacauucacuuaugcaagacacaguucaugggugaggaugaugaggcagcuuaaaaugagggaagucuc

SEQ ID NO: 4176183 - RNA, 88 nt, Human
gaguuuugcuuuucccuuugucuucugagguagauuuauaggcagcucuuguuauuuacacuaaaggaaggaggagagagagagauuu

SEQ ID NO: 4176184 - RNA, 74 nt, Human
gaguuuuuaacauucuuaacuuagaaacagggaaacugguguuuauggaauuaaguaaugcgucccaaagacuc

SEQ ID NO: 4176185 - RNA, 83 nt, Human
gauaaauacugaaacuuuuccuuuauuuaccaauuuucauuuuaauaaguuuguuuauuaggggagaguugugaacauuuauu

SEQ ID NO: 4176186 - RNA, 95 nt, Human
gauaaauucaccaugcuauuuguacagcauucgaguuguuuuccccuagauuaagcaauuugcuucucucuggcaaaugccaugugaaccauauu

SEQ ID NO: 4176187 - RNA, 56 nt, Human
gauaaauuuaacagaguucuccauuuuuauaaugguauacacugguaagauuuguc

SEQ ID NO: 4176188 - RNA, 58 nt, Human
gauaacuagaacagaauuugguaccuggaaguugggugcugauauuguuuuggugauc

SEQ ID NO: 4176189 - RNA, 78 nt, Human
gauaacuuucuaagaaggguacaauaaggcauacucucuaacugugugaccacaagacgcuuauuuuuggaaaauauc

SEQ ID NO: 4176190 - RNA, 66 nt, Human
gauaacuuugaaucuucuaacuguauauaucauuauguacaaaguuuucuuggauugagaguauuc

SEQ ID NO: 4176191 - RNA, 76 nt, Human
gauaagaaaauugccaaaagcuaaaggguugugugacuuugcuugugucaaugcuuuaguuucugguaagaauauc

SEQ ID NO: 4176192 - RNA, 86 nt, Human
gauaagcugguggacacugugcuagccuuuuuuccuuuauguagcaggcucucuagaaggcuggccauggugcccuuggcugaauc

SEQ ID NO: 4176193 - RNA, 83 nt, Human
gauaagugggucacuucuuggguuugcugggguuucaagucaguguaagaaaugaaccuucauaaaauuaagugccacuuauc

SEQ ID NO: 4176194 - RNA, 60 nt, Human
gauaaguuugaucugacaaagcuggaaauaccuguuuuagcucuaucaggccaaaauguc

SEQ ID NO: 4176195 - RNA, 93 nt, Human
gauaaucuccaaggaaucuagaaagggagcaagguugggggagaauggaaaauuuaucuaccuguaucuuucugggauucauaggucauccuc

SEQ ID NO: 4176196 - RNA, 96 nt, Human
gauaauguggggcuuuacuuugggaggcugaguugagaggauuacuugaaaucaggaauucaagaccagcugggcaacaaaaugaaaccccauguc

SEQ ID NO: 4176197 - RNA, 87 nt, Human
gauaauuaauugcuugugcaagaaaccuggaaugguaaauucuuacuauuaccaaaucauucaugcuaacaagcugcuuggauuauc

SEQ ID NO: 4176198 - RNA, 76 nt, Human
gauaauuggucuacuuuauagaugucucuuauuuaauauucuuuggagaauuucucuguggaguuagacugguauc

SEQ ID NO: 4176199 - RNA, 69 nt, Human
gaugugucuccguuucaaggcaaugguagaauuaguugaucuccuugguuuugcugaauggacacgugc

SEQ ID NO: 4176200 - RNA, 105 nt, Human
gaugugucugggauuucuguuagcuagaucucucauaaauuccaagucuuaguuugggauggaaagagguagaggaucuggacuuuucagagacuuaguagcauc

SEQ ID NO: 4176201 - RNA, 55 nt, Human
gaugugugcuuuucgcagugucaauuuuaugaugcucuaagauugagcagacauc

SEQ ID NO: 4176202 - RNA, 62 nt, Human
gauguuaaagguugguaagucauucuacaccugcauguaacuucuugcuugucuuuaacauu

SEQ ID NO: 4176203 - RNA, 85 nt, Human
gauguuccaaugacuaguggcauccuaacccucuaacacguagaucaagguauaucaagggugacuaacucaguccugaaacauc

SEQ ID NO: 4176204 - RNA, 87 nt, Human
gauguucuuuccauugauagcauguagaguuauauauauauauggaaauaauucuacaugagaaaauguauuuagaccagaaccuuc

SEQ ID NO: 4176205 - RNA, 92 nt, Human
gauguuggagguacaagagcacaggcagaaauucacagagccuuuucaugccucugcuggugucuaaccuggcucuucuaccaucuaacauc

SEQ ID NO: 4176206 - RNA, 78 nt, Human
gauguuuggcucauccucauugggguccuucagcuccuggagcuucagccagagguggaugagucacaccacggcauc

SEQ ID NO: 4176207 - RNA, 78 nt, Human
gauguuugguguuuuugaacuuguaauuacuguaguaaagguuauuacaaugcagaaaauagacccccaaaccauauc

SEQ ID NO: 4176208 - RNA, 73 nt, Human
gauuaaauagucuggcuucaacuuuacugaaaagauuuaaguaaucuugccagagaggagaaagcauuugauc

SEQ ID NO: 4176209 - RNA, 130 nt, Human
gauuaacuaugguccacuaacuaucugaaugaacauacaagaagcuguuugcaguggauggagacugaguaguuccaucacaucacugaagacagaagauuuuauucugauuaauuuuccauuguaaauu

SEQ ID NO: 4176210 - RNA, 58 nt, Human
gauuaaggguucagaaugcagugguagccugcuacucuggccaucuuggaccuugauc

SEQ ID NO: 4176211 - RNA, 130 nt, Human
gauuaauaaugaauguuuuauuaauaguucaucuuauaauuguaagugcugaguuaagggaaauuugauagcuuuuccugcacuugaucuuacagucaagagccacauuuuaaaauccauugcucuaauu

SEQ ID NO: 4176212 - RNA, 121 nt, Human
gauuaaucaauguuagaaauuguagaaauuuucaaagaugcaucuagguucuuuauucauguuuuaguggacaaaagaauaagaugagucauuuacuucaacgcuaacauuugguuuaauc

SEQ ID NO: 4176213 - RNA, 58 nt, Human
gauuaaugagggccugcaaccuccucagucuuguauuagggaggaggguuuucaaauc

SEQ ID NO: 4176214 - RNA, 97 nt, Human
gauuaauucagcaugguuuuacucaucacugaauaucccuaucuuuugcaguagaauuuucuagguccugugguuuggguaaaauguuggaaugauu

SEQ ID NO: 4176215 - RNA, 84 nt, Human
gauuagaacaaccuguguucuggaauacaguauuuaaacagugagauuggcauugcugucuuccaggauggugaagguuuaauu

SEQ ID NO: 4176216 - RNA, 74 nt, Human
gauuaggggcagauguuauaugaucugagacauuuuccuggccucagcuuuugauaaugucugaaauuuuaauc

SEQ ID NO: 4176217 - RNA, 90 nt, Human
gauuaggugggauaacuuuaugagacuguuuuacacacuaguacaauacaauuauugagugaaucugucugcaucauguccuuucuuauu

SEQ ID NO: 4176218 - RNA, 63 nt, Human
gauuauauaauggaagcucuuguucacuuauugaugaauaaucuugaguuuccauuguagauc

SEQ ID NO: 4176219 - RNA, 130 nt, Human
gauuaucagauugaauacuggaaagaaacugauuauugccauuaucauuuaugauacccaaauuucucuuccugguagccaagagugaauggcuugguuuuauuugguaacuucuauuuuguauuauuuc

SEQ ID NO: 4176220 - RNA, 58 nt, Human
gauuauggauggacaguggagcccugaguucuaaaucagaaucuguccauuucuaguu

SEQ ID NO: 4176221 - RNA, 86 nt, Human
gauuauguauauguauauauuuaaagugcguuguagaaggcuaugaucuucuaaagcaggaguguauuugcauguaaaaugugguc

SEQ ID NO: 4176222 - RNA, 82 nt, Human
gauuauguguugacuguuuagaaauuuguccaauuuuaaaauuuuuguuggacuguacacaucuacauaucaauauguaauu

SEQ ID NO: 4176223 - RNA, 71 nt, Human
gauuauuaguuuccucucuaggagugagcuggauaguuuccacaguuuaggaugagagaacacugaagguc

SEQ ID NO: 4176224 - RNA, 90 nt, Human
gauuauucaagguuuacauucugaaauaaaugguuugugugaaguugggaacuagcagaauuauuagagugaacaaugcuuugaauccuc

SEQ ID NO: 4176225 - RNA, 58 nt, Human
gauuauucucaccauuucucccuuccauuuguuaggucauuggaaagguagaguaauc

SEQ ID NO: 4176226 - RNA, 119 nt, Human
gauuauugaacaaccuaauuuacugauguaguucagugccaguuugcuccuucuauaggacuguauaagacucugcauggcacuuagcaauuucagguacauuaaaauguucaauuauu

SEQ ID NO: 4176227 - RNA, 68 nt, Human
gauuauuuuacuauuccugacaccuaggcacucaguaaaugccuaggugucagguauagaauuuaauu

SEQ ID NO: 4176228 - RNA, 57 nt, Human
gauucaaagacagacucauuucaagggcacucagacuccuagaagguccuuugaguu

SEQ ID NO: 4176229 - RNA, 106 nt, Human
gauucaaucauauugaacaaaagacucauccuguuguuacuguucuacauacagugaauauuuuuacugguagugcaaaguaauacaggcuccaguaagaggaauu

SEQ ID NO: 4176230 - RNA, 59 nt, Human
gauucacaacugcccugaagggguggcaucggccccuuuacacguaaggcuguugaguc

SEQ ID NO: 4176231 - RNA, 70 nt, Human
gauucacacccacauggaaauucacaguccugagggcagggcuguguugggaaucauguggguggagauc

SEQ ID NO: 4176232 - RNA, 62 nt, Human
gauucacacuuuacuucuuuccaagugguuuauugauuuguggauucagugaaaugugcauc

SEQ ID NO: 4176233 - RNA, 130 nt, Human
gauucaggauguauucagaguguggagaaggguuucucugggaacauaaaugaagugggagccagaaugaauauuuucugcuucaaaugucuucuugagugauccugccacugaaguucauucugugaac

SEQ ID NO: 4176234 - RNA, 77 nt, Human
gauucaugggauguagguauacagagauuucuggggcuguucugggcuauuggagaucuuguagaccuaaacuauuc

SEQ ID NO: 4176235 - RNA, 64 nt, Human
gauucccagaggaguucugggauguaugccucugagaucaucuuagaauccuggacugggacuc

SEQ ID NO: 4176236 - RNA, 88 nt, Human
gauucccuggcaguucucauuaguucagcauucccgaaguguccccuguuuggaggcagaggggaagcugaggaauugaaggagaauc

SEQ ID NO: 4176237 - RNA, 64 nt, Human
gauuccucauggcugucgcagggccgugcgugagcugcugggccuuggcgauccguggggcauc

SEQ ID NO: 4176238 - RNA, 62 nt, Human
gauuccugggcaggacgagagucugggcuggcucggacuuaauuuuuguccucucaggguuc

SEQ ID NO: 4176239 - RNA, 61 nt, Human
gauuccuuuguuuauaaguacugugcuugcauaguuuaauaaaacaguaaagaaaggaauu

SEQ ID NO: 4176240 - RNA, 126 nt, Human
gauucgucaaugaaugaaaagucaaguaauaaaugugucuguuguuugugugcaaaaauguuauuacuaacacacccuuagcaguggcauacauuuugaguguuuuuccauuagucgugauguauu

SEQ ID NO: 4176241 - RNA, 64 nt, Human
gauucuaaucuucagccagcaugaaaaacacuggauuaggagugcuggagugagauuaugaguu

SEQ ID NO: 4176242 - RNA, 71 nt, Human
gauucuagcuggacucauucuuccccuuuuggcagaucaauuagugucaagaacuuugguccugcagaguc

SEQ ID NO: 4176243 - RNA, 55 nt, Human
gauucuauguggcaucaagcucagugguucucaacucugguuccacacuagaauc

SEQ ID NO: 4176244 - RNA, 85 nt, Human
gauucucaggauagugucuguguggacuguauuuuccccucaaaucaggaaagcagcucauggaguaggcacugcauggagacuc

SEQ ID NO: 4176245 - RNA, 62 nt, Human
gauucucagugugauuuugaguaggcgacagagaguucucaauucuagacaacacugaaauc

SEQ ID NO: 4176246 - RNA, 85 nt, Human
gcaaaauucagaagguggaacauaccgaaaauacuuaaggauauacucuaaaggcaaauguguguuugugcuuuuuagauuaugc

SEQ ID NO: 4176247 - RNA, 57 nt, Human
gcaaacaaggacauacauccugugcucauacagccaugcaccauguaugggguuugu

SEQ ID NO: 4176248 - RNA, 80 nt, Human
gcaaacagaguaauggcagaccuccuggccacaaagcaaaguaguuugugcuagcagaacugucgucaucucuggagugc

SEQ ID NO: 4176249 - RNA, 61 nt, Human
gcaaacaguuuugccaaaaggacaaagauaacagauguguucacuugggagaccuguuagc

SEQ ID NO: 4176250 - RNA, 128 nt, Human
gcaaacaucggaaggcaagaggccagguugaacagugguuagcagcuuagacugccugggauuuguccagcucuggcuuggcuagcugugacacugugggcagcuugcuuguucuucgugugucuugu

SEQ ID NO: 4176251 - RNA, 57 nt, Human
gcaaacaugcugagaaauaagaugucuggcggcuacucuugauuugaggcuguuugu

SEQ ID NO: 4176252 - RNA, 60 nt, Human
gcaaacggggucagccguauugaagugagccagcuuuuccaaccugagcugaacccgugc

SEQ ID NO: 4176253 - RNA, 129 nt, Human
gcaaacugaccugugcugccuacacacuaacuuuccugggccuggggccugcacaggcugaaugguccuugagccuucacucugcaucugagcggucuugggcccgcugaguggcaguggcaggaaguc

SEQ ID NO: 4176254 - RNA, 66 nt, Human
gcaaacuuccaggguggcuugagcauaaugaugcuaucaaccagcucagaugcccuaggagguggc

SEQ ID NO: 4176255 - RNA, 56 nt, Human
gcaaagaaaguuuuaaugagguuaaaggaaagguucuauauuaaaauuuuuuuugc

SEQ ID NO: 4176256 - RNA, 57 nt, Human
gcaaagagcugggacuuaaagugcaguuggccugaauucaaagcccagcucugcugu

SEQ ID NO: 4176257 - RNA, 75 nt, Human
gcaaagauauaaagauguuuauuauauccucuggaugccaugaugacaugauugccauuugauagguauguuugc

SEQ ID NO: 4176258 - RNA, 74 nt, Human
gcaaagaugucagauccucagaaagucuagcucagugucaccaguuuuccaaaugaaggauuugaguucuuugu

SEQ ID NO: 4176259 - RNA, 64 nt, Human
gcaaagcagaacccucucuauccagcacaccuuauccuggcuccuggaggaugcuucucuuugu

SEQ ID NO: 4176260 - RNA, 76 nt, Human
gcaaagcaucugcacccuuggucagcucugcaguggauuucuucugcagggcagauaugacuguaggggauguugc

SEQ ID NO: 4176261 - RNA, 55 nt, Human
gcacugcagguggguggagaggagauucaucucucuggucccacucccugugugc

SEQ ID NO: 4176262 - RNA, 76 nt, Human
gcacugccugcaguucaugggcucugccuugaagacuuggaggccaaggggcaggugugcagagcuguuggucagc

SEQ ID NO: 4176263 - RNA, 57 nt, Human
gcacugcuuugcagcuuaagagcaggguuugaaucccagcuccacuaaagcagcugu

SEQ ID NO: 4176264 - RNA, 56 nt, Human
gcacugggagcugccugccgguccuuuaacaaccggcagcgcgagcguccagucgc

SEQ ID NO: 4176265 - RNA, 64 nt, Human
gcacugggguccagauggggagaagauguucugccauaagaaaaucuccuggucugguccgugc

SEQ ID NO: 4176266 - RNA, 81 nt, Human
gcacugguggucacuagggcagguuggcaucccgggcagggguuugauccuggcugggccccccugcugugucaccagggc

SEQ ID NO: 4176267 - RNA, 58 nt, Human
gcacugucucugucuuaacucccagguaggcucugaaauugaugacagggauggaagc

SEQ ID NO: 4176268 - RNA, 69 nt, Human
gcacugugagcagggaaguuucugucucuggaaauacaaucaaaacaugugcuuuuauugcucaggugc

SEQ ID NO: 4176269 - RNA, 68 nt, Human
gcacuuaacuacaagggcggucucuguuucuucaccagagagagaagauuuuccuguguaauuugugc

SEQ ID NO: 4176270 - RNA, 67 nt, Human
gcacuuacauucacaugcauuggcaaaaguguaggugaggccaccuacuggguaugcugugaagugc

SEQ ID NO: 4176271 - RNA, 80 nt, Human
gcacuuacugagcagaauggagggaagagucaccagaaucauuucuauucauucuuucucucuaaucaagcacauagggc

SEQ ID NO: 4176272 - RNA, 56 nt, Human
gcacuuaggguauguacugggcacgucacugccuagguacuuccuccccuaaaugu

SEQ ID NO: 4176273 - RNA, 63 nt, Human
gcacuucaugacuuugucaaauuacuuaucauauucuguagggugacauagcucuuggggugc

SEQ ID NO: 4176274 - RNA, 91 nt, Human
gcacuuccacugcgagacagacgugaguggacagagcugcccguucucacagugcaggucugucuccagcacacacaaaguggaggauugc

SEQ ID NO: 4176275 - RNA, 72 nt, Human
gcacuuggaggacauuuuagcagaaggagcauuugaacuugguccuaaaaguagagauguuugcuaaguagc

SEQ ID NO: 4176276 - RNA, 120 nt, Human
gcacuuguaguauaucucuguccaguggaacagauguugccuguaucuacaaauaauucaaaaacagaucgaaggcaugcaacauccaauuccuuuuggcacgauuuacguacauuuugc

SEQ ID NO: 4176277 - RNA, 58 nt, Human
gcacuuguugguggugaaaucacggaugaccuugacguuggugacugccccaaaaggc

SEQ ID NO: 4176278 - RNA, 96 nt, Human
gcacuuugauauacucaauaugaucuuaaaauaauguugugaagaaggaagcucagaaugcuucaauauuguuucaagaucacagaggacaaaugc

SEQ ID NO: 4176279 - RNA, 59 nt, Human
gcagaaaccacagugucuuuuaggcccuagccucagaagacaccuacugucauuucugc

SEQ ID NO: 4176280 - RNA, 62 nt, Human
gcagaaacuaaggugcuguggacugauuugggagcaguuuuguccauuuaucaugguugugc

SEQ ID NO: 4176281 - RNA, 65 nt, Human
gcagaaacuguguuacuagaaugucuugcagaaacauuacauuugguuacuaauauaggaucugu

SEQ ID NO: 4176282 - RNA, 67 nt, Human
gcagaaagaauaggguauuugucaaaaaggaaacaugcuucugguuagacucaccuuauaguucugu

SEQ ID NO: 4176283 - RNA, 56 nt, Human
gcagaaaggagaccagcucugccccgcaugggguaaaaagcagugucuuuucuugu

SEQ ID NO: 4176284 - RNA, 61 nt, Human
gcagaaauaucuuaggaguauaugagggaguaaccauucagcuuuccaaaaagaugucugu

SEQ ID NO: 4176285 - RNA, 75 nt, Human
gcagaaauuaaccugagggagauuaggccugagcuuugaaguucacgguuuuguuuuccuucagcccaguucugc

SEQ ID NO: 4176286 - RNA, 85 nt, Human
gcagaacaaguggagggcacagagggucuugaagaacagggaugcagccccugcuuccaagacaccuuuagucacucccuacugc

SEQ ID NO: 4176287 - RNA, 93 nt, Human
gcagaacaguuuccuauuuugagacuugacaccuaauuagucaucuuacuauuuaagcugaaaaauagugucguguuuuggguaacguucugc

SEQ ID NO: 4176288 - RNA, 85 nt, Human
gcagaacucuuguuuccagcaaauaguccauuguugacguggugauagggcaaguaguuugcugauggaaaaaagagaggucugu

SEQ ID NO: 4176289 - RNA, 70 nt, Human
gcagaagccacugguaaacugguaggaacacuuaaaucuuaauuuuuacaaauugcuagaggcugaaugu

SEQ ID NO: 4176290 - RNA, 60 nt, Human
gcagaagcccggucagcgcacgugcccgcgagaccugcaaacuugugccaccggcucugc

SEQ ID NO: 4176291 - RNA, 64 nt, Human
gcagaaggguugcaaaaggauaguacgauaagaucuugguccuuacaacuuguuauuuuucugc

SEQ ID NO: 4176292 - RNA, 88 nt, Human
gcagaagucauuggugccagcacuggcccauuccugucuggcuguugcucagccuggacaaagaguggguauagugaacgccuccugc

SEQ ID NO: 4176293 - RNA, 76 nt, Human
gcagaauaaaauuugccuuaccuucuuccaagagcccccuacuguuggaaauaagggaggcaaaaucuuacucugc

SEQ ID NO: 4176294 - RNA, 62 nt, Human
gcagaauacauuuuguuuuccuucaacaugccaaggaagugccaugaaaaugugauuucugc

SEQ ID NO: 4176295 - RNA, 64 nt, Human
gcagaauagugacuuuccuuaagcucaaaguuugauuugagauuaaaugugaauauuauucugu

SEQ ID NO: 4176296 - RNA, 66 nt, Human
gcagaaucuccacuuugccuuuugacccuaguuaucuagaacucugggaugagaaaaggguucugc

SEQ ID NO: 4176297 - RNA, 73 nt, Human
gcagaauuauaucuuuauuaugucuaucugcuauggguagaaaacaagcauggcauuugaagguagaagaugu

SEQ ID NO: 4176298 - RNA, 130 nt, Human
gcagacaauauuaaagcaguauccauuuucagagccuuugauuagcacaugaggaaacaaggguauaugggaagcuauguaauuugccucauguugguuuguuggucugaagaguacaacuuugauaugc

SEQ ID NO: 4176299 - RNA, 68 nt, Human
gcagacacagggaaggcaaggaagggaggcggguaugcugcuggggagcuuuguuuuguuuuguuugc

SEQ ID NO: 4176300 - RNA, 72 nt, Human
gcagacagcugccucuguguagaucuugaaaggaacugcagggcaaucuacgcagaagcaucucccuacugc

SEQ ID NO: 4176301 - RNA, 55 nt, Human
gcagacaucaagcacaggcccagugugcaucugcugggcuuuuggaauggucugu

SEQ ID NO: 4176302 - RNA, 71 nt, Human
gcagacaucuuuguuucaucuguccagcauccucucccgugccuugguacugggcuuugaagccaggcugc

SEQ ID NO: 4176303 - RNA, 61 nt, Human
gcagacaugaccaccaaccaggccacacuugggccugcguugcaccuugaucguaauuugc

SEQ ID NO: 4176304 - RNA, 56 nt, Human
gcagaccagccccuggagcugcugacgcugcagcagcacccagcaggcaggugugu

SEQ ID NO: 4176305 - RNA, 99 nt, Human
gcagaccuccgcgcagcggccgcgggcgcgaggggaggggucuggagcucccuccggcugccugucccgcaccggagcccgugggguggggaggugugc

SEQ ID NO: 4176306 - RNA, 60 nt, Human
gcagaccugaccuugggcagcaacuaggaggaagaccugcugagcuggggugaagguugc

SEQ ID NO: 4176307 - RNA, 73 nt, Human
gcagacguggcucuguuucccuguguaaaaagaacaucaugcuugcugcagggauuucagagacacuuagugc

SEQ ID NO: 4176308 - RNA, 68 nt, Human
gcagacuguucacgaugucagaugguucaugauuuuuuuccagguuugauacagaagaaucaguuugu

SEQ ID NO: 4176309 - RNA, 93 nt, Human
gcagagaagagcauccugguuuuaugaaguccuguuguaaccauaaugaaagaggaaaagaaacuucaaagccaggauugcguaggucuaugc

SEQ ID NO: 4176310 - RNA, 66 nt, Human
gcagagacuaguagugcagacugcccaggguaauuugggucugguuuuccacucaugaguuuuggc

SEQ ID NO: 4176311 - RNA, 69 nt, Human
gcagagacugagggcagcugcaggcuaccaggaauugcuggcagugaagcugucuuuagguuuuucugu

SEQ ID NO: 4176312 - RNA, 69 nt, Human
gcagagagaaugguaaugaggacuugaaggggucuucaccaaguccauaugcaucaugggaugcucugu

SEQ ID NO: 4176313 - RNA, 65 nt, Human
gcagagagagcagggaagggucugcccuggcaaucaagucagccaagcccacccuggcucuuagu

SEQ ID NO: 4176314 - RNA, 58 nt, Human
gcagagagugaagcuugggaaucuugaauauauugcgggauuugcuugucugcucugc

SEQ ID NO: 4176315 - RNA, 67 nt, Human
gcagagcaccaaagugaaagauguagcuuuccccgcuccaggcuaucagcauuagguccugcugugc

SEQ ID NO: 4176316 - RNA, 75 nt, Human
gcagagcagaugguggggcaggaaaaucuguggccaucucgcaauaaguuauuuuucucucucacucugcccugu

SEQ ID NO: 4176317 - RNA, 62 nt, Human
gcagagccaggagcccaggauccagcgcacugggcaccgaccugggaccuggucaucuuugc

SEQ ID NO: 4176318 - RNA, 77 nt, Human
gcagagcccagaggugggagccuggucacaugcacaguugcauuacuuguccacgcccacuuccggccugggccugc

SEQ ID NO: 4176319 - RNA, 59 nt, Human
gcagagcccaugcaacaggccuagcgacacauuucgcaaugucuuaugcaaggguaugu

SEQ ID NO: 4176320 - RNA, 61 nt, Human
gcagagcccucaaggccgaugcaugccaggcugggcucugucaccugccuagggucucugu

SEQ ID NO: 4176321 - RNA, 59 nt, Human
gcagagccgugaauggauuucaaggacaagacuacaucaagacuccccacaggcucugu

SEQ ID NO: 4176322 - RNA, 103 nt, Human
gcagagcucugggguuggggccaggguccccgggucuccugugcccccagcacugucggguaugagguuaaccgggcucacccuguccuggcccuuguucugc

SEQ ID NO: 4176323 - RNA, 123 nt, Human
gauguguuuaguuuguucacaauuucguaaaugaagccuuaauauggauguucuugccauguugagaugacaaugcuuagauccaguuaauagcuucauuguauguugaauaaaccucacauc

SEQ ID NO: 4176324 - RNA, 75 nt, Human
gauguguuuauuugcacacagucuccugugguccagaacacuucugccccccauaggugugugcaaaugcuacuc

SEQ ID NO: 4176325 - RNA, 71 nt, Human
gauguuaaauguaaauagcugcucagaaguaauuuuuagcugcuauuguugugguuauuuucauuagcauc

SEQ ID NO: 4176326 - RNA, 72 nt, Human
gauguuagccaauguuauaggauuauuugaaugaacccuucauccuccauuuuggugugacauugggacauu

SEQ ID NO: 4176327 - RNA, 62 nt, Human
gauguucaaguaccuuugugucuugauuugccuuagcauguagaaaagggacuuguaacauu

SEQ ID NO: 4176328 - RNA, 67 nt, Human
gauguuccuuaaaaaaagauugaugguggaugccgggcuucggguaccauuuaucauuuugaauauu

SEQ ID NO: 4176329 - RNA, 69 nt, Human
gauguucgagcagaagaccagggucaguacaccugcaaauaugaagaccuugaaacuucagcagaacuc

SEQ ID NO: 4176330 - RNA, 76 nt, Human
gauguucugagacuucugaagcuagaacauaagaauucuugcaacuucugcuaaaggaaguucuccuggaauacuc

SEQ ID NO: 4176331 - RNA, 58 nt, Human
gauguugcacagggaugcccagaaguggcgaggacugaaggggcauggaugcagcauc

SEQ ID NO: 4176332 - RNA, 96 nt, Human
gauguuuaacgccugucuuuucaacuuggucuacugagucuucaauacuggugacugagcugcuugaagugaacucuggacaagguggagagcauc

SEQ ID NO: 4176333 - RNA, 63 nt, Human
gauguuuaagaaagucuuccauaguguacccaccucacuaugcuagaaguuuucuucagccuc

SEQ ID NO: 4176334 - RNA, 85 nt, Human
gauguuugaauucaaaauuuuguuauuuaaucugugaaucaaauuuuaguagaagacagauaacaaaacaguuuuuucaaggauc

SEQ ID NO: 4176335 - RNA, 77 nt, Human
gauguuugccugcccaaggucaccuaguuaguaaaugauggagucaggacauuaccugaccuuggcugacugacauc

SEQ ID NO: 4176336 - RNA, 98 nt, Human
gauuaaaauuuugaaaauauuaguuggcacuucauaauaugaaaugaaauuaugaaauuuuauauacaagaggguuaauuauuuuuaaagggcuaauc

SEQ ID NO: 4176337 - RNA, 59 nt, Human
gauuaagcuggagaaaccugggaggguagcagcuggcuuucgagggaaucuccaauauc

SEQ ID NO: 4176338 - RNA, 57 nt, Human
gauuaaggguuaucauuugcagugaagaccauuacaaaugaccauagccacuuauuu

SEQ ID NO: 4176339 - RNA, 81 nt, Human
gauuaauuuggccuguauguaugugaauagggcaacgauuuuaaaauauugucuuauuuuaucauaagcacugaauuauuc

SEQ ID NO: 4176340 - RNA, 130 nt, Human
gauuacaggcaugcacaccacaacuggccaaugcugucuuuugaagcuccugacuggggccaauuagcucucaugucaggggugucaauguucugagacaggccgggcacaauggcucacgccuguaauc

SEQ ID NO: 4176341 - RNA, 112 nt, Human
gauuacaguguguguagcugaaggcauuauuccacagcucagaauuuuuuuucaucuggaaaguaguaaucucaauugugaaauagugccuucagcuguggacauuauaauc

SEQ ID NO: 4176342 - RNA, 65 nt, Human
gauuacaguuagguguguagugguauaucucacuuguuucuuuaucaccagcuccuagcugaauu

SEQ ID NO: 4176343 - RNA, 71 nt, Human
gauuacguuugaguacagcugccuuuuuguacccaucauauaacccaaaggcaaugucucgauugguaguu

SEQ ID NO: 4176344 - RNA, 75 nt, Human
gauuacuuaguuuagucucacuuggaauuuugcagauugggaaguggaggccaagaggcagaaugcagagaaguc

SEQ ID NO: 4176345 - RNA, 73 nt, Human
gauuagaagaacuuguuagccuaagaaagaguucaaagaaagggcaaggcugaauguuugaguuuuucuaauc

SEQ ID NO: 4176346 - RNA, 66 nt, Human
gauuagaaugggaagauacaagaugaccugugaggaaauguaaggccacuuuauccccauuuaguc

SEQ ID NO: 4176347 - RNA, 78 nt, Human
gauuagauagacuugauguuaaaggggaugaggguuauucuguauuaauucuuucucuacuagcagagcugucaaauc

SEQ ID NO: 4176348 - RNA, 72 nt, Human
gauuagcagaggcagagucacaaagagucuuuuauaaaccuugguagagaguuuguacuuuacccugagauc

SEQ ID NO: 4176349 - RNA, 116 nt, Human
gauuagcugauguaggaguagcagcagaagcagcagcaaugacaacagaacuagaguccaagguugaucucuguugcugucuuugcucagcuuugcuuugcagacauaaguggguc

SEQ ID NO: 4176350 - RNA, 97 nt, Human
gauuaggcgggaagguguucgucuuuucuuacuaugguugcaagcucuucagaauaacuguagcaaagaacagcucuggauguuuucaugcuuaauc

SEQ ID NO: 4176351 - RNA, 62 nt, Human
gauuaguuauuucauuguugagggaaaauucauucaguuaacauuaaaagagauaauugauu

SEQ ID NO: 4176352 - RNA, 84 nt, Human
gauuauagaugagagugugggauaguucaucagcaugugaguagaugcuagauaaacuggaaccauugccucuucucugucuuc

SEQ ID NO: 4176353 - RNA, 55 nt, Human
gauuaugaugcgaggucagagcaguuguuuucuguccugaacuggcaucagaauc

SEQ ID NO: 4176354 - RNA, 59 nt, Human
gauuauuugucacugcacuugaaauuuaaaucaaauuuaauguuugguggcaaaaaguc

SEQ ID NO: 4176355 - RNA, 94 nt, Human
gauucaacugccucccugggacguggggagagggggguguguguucacgucacccuuucuuacucacacgcucuuuuacacacagucaugauuc

SEQ ID NO: 4176356 - RNA, 65 nt, Human
gauucaagucucaauguauuauggugagcaaaagagggccagcaagaugaaguugagcuaggauc

SEQ ID NO: 4176357 - RNA, 74 nt, Human
gauucacaggguuuaauugcuuguugucacacaaugauaaguggcacaaucaguauuuagacccagguguauuc

SEQ ID NO: 4176358 - RNA, 80 nt, Human
gagguccucauaauuauaaacugcaguagguauaacaagaggcuaaauacauagcugugguuuuaauuagcuggugcuuc

SEQ ID NO: 4176359 - RNA, 65 nt, Human
gagguccugggagcuaguagaguaaggaaagauguuuaguuucccugccugacagcacccaccuc

SEQ ID NO: 4176360 - RNA, 69 nt, Human
gaggucgggcuggcuuuauggggcuuguggccagcaggacugugcaaggcccaugcucagaaggaccuc

SEQ ID NO: 4176361 - RNA, 123 nt, Human
gaggucuacuggggcaggacccugauggccagcgagugggucagcguugcagcaacaugcccugcucagaucuuucccauuuucccucccuuucccuuaggagccuguuccucucacgcccuc

SEQ ID NO: 4176362 - RNA, 78 nt, Human
gaggucucacuauauauauugcauuggcuggucuugagcuccugugcucaagcuguccuccugcaauauugggauuac

SEQ ID NO: 4176363 - RNA, 83 nt, Human
gaggucucacuucuuugaaaggaagccacacagcuguuuuuuccugacagcugugaggcuacuuuccaagggagggagucuuu

SEQ ID NO: 4176364 - RNA, 111 nt, Human
gaggucugggaaggagcccggcgugguggggcgggccuguaaucccagcuacucaggaggcugaggcaggaggauugcaggaucgcucuuacccaguuucuuucuuucuuu

SEQ ID NO: 4176365 - RNA, 79 nt, Human
gaggugaaaugauuugcuuagucuuacgaauauuugggagccaaacuucaacuggaaugggcuauccugauuucaucuc

SEQ ID NO: 4176366 - RNA, 64 nt, Human
gaggugagaggccugagagcuggaggcuuguugguuugcugcucuuucugucuguccauccauc

SEQ ID NO: 4176367 - RNA, 59 nt, Human
gaggugaggaugggggagcagggaaguaaaucucauauuccucuuugcauccucaacuc

SEQ ID NO: 4176368 - RNA, 55 nt, Human
gaggugaguggcuggagcccauagcuuccuacucuaaggcuucccuacucacuuc

SEQ ID NO: 4176369 - RNA, 71 nt, Human
gaggugcagaaaaaaguccuuuaggaggaaugacucuuacaaaaauaaggcuuuaccucuuucuccaccuu

SEQ ID NO: 4176370 - RNA, 75 nt, Human
gaggugcagaagcaaguagugauucuuuccuggaaauguuaauaaacaagaaaauuacuauuguuccugggcuuu

SEQ ID NO: 4176371 - RNA, 57 nt, Human
gagguggaaagagcaugaaucuuaaaaucagacagaccuguguucaaacuccaucuc

SEQ ID NO: 4176372 - RNA, 71 nt, Human
gagguggcucuggguuguuacacuggauuuacuagcagagugacuuugguuugagcaagucaguccaccuc

SEQ ID NO: 4176373 - RNA, 99 nt, Human
gaggugggaagauugcuugagcucuggagguggagguugcagugagccgugauugugccacuguccuccagccuggaugacagagcaaaacccuaccuc

SEQ ID NO: 4176374 - RNA, 98 nt, Human
gaggugggagaaucacuugaacccaggaguuggaggcuguggugagcagagaucgcaccauugcacuccagccugggccacaagggugaaacugucuc

SEQ ID NO: 4176375 - RNA, 71 nt, Human
gaggugggaggaucaccugaggucaggaguucaagaccagccuggccaagauggugaaacccccccaucuc

SEQ ID NO: 4176376 - RNA, 99 nt, Human
gaggugggaggaucgcuugagccugagagguuggggcugcagugagcugugauggcagcacugcacuccaaccugggcaacagcgcgaaacccugccuc

SEQ ID NO: 4176377 - RNA, 99 nt, Human
gaggugggaggauggcuugagcccaggaguuggaggcugcagugagccaugguagugucacugcacuccagccugggcaauagagugagacccugucuc

SEQ ID NO: 4176378 - RNA, 99 nt, Human
gaggugggaggauugcuugaacccaggaggcaagguugcagugagccaagaucaugccacugcacuccagccugagugacagagcgagaccccuaucuc

SEQ ID NO: 4176379 - RNA, 93 nt, Human
gaggugggauuuguggggcacgugccuaaggagcaggccuaggaaagagugagaugaagcaggcugguccccauugcccaccccucccaccuc

SEQ ID NO: 4176380 - RNA, 58 nt, Human
gagguggggcaggaaagugcuguggugucccccaguggcagcugucaugcccuagauc

SEQ ID NO: 4176381 - RNA, 98 nt, Human
gagguggucaccuauaggagauaguugauucauauagauaugcgugcacaagcauguguuuguguuggauuauuaucugucucgagggugagcaucuu

SEQ ID NO: 4176382 - RNA, 63 nt, Human
gaggugguuuguggugacucauaaaaggauaacuaccuuauugauaaauacaagaccagccuc

SEQ ID NO: 4176383 - RNA, 59 nt, Human
gagguguagagaaagagcucugucuccucccugggagaauacuccuuucccuacaccuc

SEQ ID NO: 4176384 - RNA, 59 nt, Human
gaggugucuggccuuuguaggaguaucucauugaggagucugcuaaggucagaauucuc

SEQ ID NO: 4176385 - RNA, 60 nt, Human
gaggugugagggacagagaaaggggugagacccgugcccagauugcuucuccucacaccc

SEQ ID NO: 4176386 - RNA, 129 nt, Human
gagguguggccagaacaagccagcuccuggggugggguuacucauugugccuagggcgagguggaaggaagagauggccccacagaggaggugacauugagacuggcuguggagguagaacagcauuuc

SEQ ID NO: 4176387 - RNA, 84 nt, Human
gagguguuguacugugguuaagagcaaggauuuggugucgagcugcuugggcuggagcuuguugcuuccccacugcuugaccuu

SEQ ID NO: 4176388 - RNA, 63 nt, Human
gagguuaggccagcgcugcuagcucccggccgucucugccuggcuccugaggcuuggccccuc

SEQ ID NO: 4176389 - RNA, 86 nt, Human
gagguuauaaguggauagcaagccuucggaguuacauccugccccacagaucucugagauaguuucuaucaauuguuguaguccuu

SEQ ID NO: 4176390 - RNA, 122 nt, Human
gagguucagugacuugcccaaggucauagagcuggaaauuggcagagcugggacuggaagccaggccaggcaccuggcuccugaguuucagcucuaagccuaggccauccuacgcugaccuc

SEQ ID NO: 4176391 - RNA, 65 nt, Human
gagguucggcuccagguuggaguuugcuccaugaggaugggccaugccugccugagcugucccuc

SEQ ID NO: 4176392 - RNA, 62 nt, Human
gagguucucagaacaaguucaggguugcccagaaguuguuuuuagagaagcccugaagccuc

SEQ ID NO: 4176393 - RNA, 63 nt, Human
gagguuggaaugucuguuucaacaagcacaaugggucccuacagugugaagcaggcaugccuu

SEQ ID NO: 4176394 - RNA, 59 nt, Human
gagguuggcgcccugccuggcccagagcagccaggcccagcaaccagcgccaaagccuc

SEQ ID NO: 4176395 - RNA, 63 nt, Human
gcaggcucugaggucccaggauucuguggagauucacaggggaccuaggacccucggagcugc

SEQ ID NO: 4176396 - RNA, 62 nt, Human
gcaggcugaguugggaaaccaagcaaaucccaugcuuccuggcuugcccaaauccugccugc

SEQ ID NO: 4176397 - RNA, 77 nt, Human
gcaggcuggugcacagggcauauuuuagagggaccauaacacaccccuauacuagaaaugcaguguacugugucucc

SEQ ID NO: 4176398 - RNA, 59 nt, Human
gcaggcuucaagcacagcuuuuagagacugcaacucagcuggugugugcuggggccugu

SEQ ID NO: 4176399 - RNA, 83 nt, Human
gcaggcuucugccacugggugaguugaugaaggagaugaugucuccucucauaaugcugcaccaaacagauggaauggcaagc

SEQ ID NO: 4176400 - RNA, 70 nt, Human
gcaggcuuuugaaaccgaaaaucacaucugugaaaaaugucauagcuguguaugguuuacaaauauuugu

SEQ ID NO: 4176401 - RNA, 57 nt, Human
gcagggaaguuugaucuuuuucggauuuugcgguuauauuagaugagaugucccugu

SEQ ID NO: 4176402 - RNA, 76 nt, Human
gcagggaaugagauagaggaagaaugggauuucuaacugaaauuccacagcucagccucucuuuucaaaacccagc

SEQ ID NO: 4176403 - RNA, 83 nt, Human
gcagggagcagacggcucggggacccuggugagcaggccuggggagcuggugaccauggugugcccugugcggggcuccccgc

SEQ ID NO: 4176404 - RNA, 70 nt, Human
gcagggauauguauugaaugaucauuuguacaguuugcaaaaugacacucauucagugucaagugucugc

SEQ ID NO: 4176405 - RNA, 55 nt, Human
gcagggcacaaggacgcacaggcccuccugcaccgucaccgacuucugcacuugc

SEQ ID NO: 4176406 - RNA, 60 nt, Human
gcagggcacacaagaaugauaaagaugucuaaaaaggauguuauuuuaagugagcuuugc

SEQ ID NO: 4176407 - RNA, 127 nt, Human
gcagggcacaggggacuucccuucucuggugacaguggugacagcagggacauguaggaagggccaggcuuauuccucccucagcugucagcgucgccgucuucagacugaggccccccaaguccgc

SEQ ID NO: 4176408 - RNA, 62 nt, Human
gcagggccagccccacccucucugguuggcugaaacuagaauggcgugagguuuggcugagc

SEQ ID NO: 4176409 - RNA, 64 nt, Human
gcagggccagggcucaggcugucucggagcccccggagugcuugagcucuccuggaagcccugc

SEQ ID NO: 4176410 - RNA, 89 nt, Human
gcagggccgcggccucuccccuguccuugggcugagccuggccagcugcaggcagcucuggcgucagggagcgagggcgguggguuugu

SEQ ID NO: 4176411 - RNA, 57 nt, Human
gcagggcgaaugcugcuugugucuuauccaggacagacuggccugucucgcaccugu

SEQ ID NO: 4176412 - RNA, 105 nt, Human
gcagggcgaugacauagccggaguccugugggcaagcaggcgagggccuggagcagcaagucugccugugccucccuguccugccugcccaccugcucccccugc

SEQ ID NO: 4176413 - RNA, 81 nt, Human
gcagggcugcacugcuucuggaggcuuuaaaggagaaucaauuuccuugcguuuuacagcuucuagaggcuagccaccugc

SEQ ID NO: 4176414 - RNA, 55 nt, Human
gcagggcuugaaucaaggaagucuugauaagggacuucacacucucaaccacugc

SEQ ID NO: 4176415 - RNA, 69 nt, Human
gcaggggaugcuaauaaaaugcaggauuuuggacacugagcaagguaagagucugccuuuuucuccugc

SEQ ID NO: 4176416 - RNA, 63 nt, Human
gcaggggcagcagcugaggaaugaaacugggaaggagccugggaacccuguuguugccuuugc

SEQ ID NO: 4176417 - RNA, 118 nt, Human
gcaggggcagugaugugaugagguuugcucuaauggaaggcuugcagcucuguggcaccuggacacaugcagauguuuuugaguagcgggcuuuccugccucucccacugcacuaugu

SEQ ID NO: 4176418 - RNA, 106 nt, Human
gcagggggagugaauaggggguaggagagguuggccaugggauuaguuacagcugagggccuggcuucacuuucucaguuccucuguuagaaaaucaccacuuugc

SEQ ID NO: 4176419 - RNA, 61 nt, Human
gcagggguccucccagccaggagcugugggcagccuccaggagguaugaguggcccccagc

SEQ ID NO: 4176420 - RNA, 69 nt, Human
gcaggguauguuuuuaucuacugugagguuccuggggcggagaugugcaguggagcgagaacuuccugu

SEQ ID NO: 4176421 - RNA, 61 nt, Human
gcacuagaaguacgccuuguaaaaaguaacagugcugggaaaaaggguacuuuaagagugc

SEQ ID NO: 4176422 - RNA, 118 nt, Human
gcacuagauaucuuccagcuuuuagcauuguaaaaccugcauguuucuaaaagcaucuuaaugggaaugcugcuuuugggaccugggggcauuugcugagugcggcuggagcuggugc

SEQ ID NO: 4176423 - RNA, 79 nt, Human
gcacuauucuaggagguucuugaacaucuguaaaguaauauauacucuaugagauaaauggugcccccuggauuugugc

SEQ ID NO: 4176424 - RNA, 69 nt, Human
gcacucaggguaggguaaaugaugcaucaugccugcuggcaacaugggcccuaucuggaaagcgagugc

SEQ ID NO: 4176425 - RNA, 61 nt, Human
gcacucagguuaccucccuuuguaagcaagugccucuuuugaucaaagcaggugacagugu

SEQ ID NO: 4176426 - RNA, 97 nt, Human
gcacuccaucagauucuuauucagcaccacuuccagagaaguaaugaggacaauuaagcauaacguucugauuugggcauaagguucugauuugugc

SEQ ID NO: 4176427 - RNA, 65 nt, Human
gcacuccuugcgagagguuuaacuggaugcgacacccccagugucagccugggcaaggaacaugc

SEQ ID NO: 4176428 - RNA, 94 nt, Human
gcacucgucacuuuuguccaacuccacuucagcucaguauugguucugaaauacaguuaaacgaugauggggucaaaggaaggaguggcggugu

SEQ ID NO: 4176429 - RNA, 66 nt, Human
gcacucuaggcguauuccugaaccugaaggcucauguuucagacaggacuucauaugugugggagc

SEQ ID NO: 4176430 - RNA, 63 nt, Human
gcacugacuuccagcaacuuccuccaggcgagcgccuggaggcagucaccugaagucaugugc

SEQ ID NO: 4176431 - RNA, 80 nt, Human
gcacugagcuccauuccaggggccccuccauggcugacuuucggggaaggagcugagggagcgcccuuggagcaccuugc

SEQ ID NO: 4176432 - RNA, 60 nt, Human
gcacugcaucuacuggcaaguacagucuguuucugacugacuucgucuaugaugcugugu

SEQ ID NO: 4176433 - RNA, 55 nt, Human
gcacugcuauuuagcuccaucauuuauaugugaauauaaguuaguguagcagugc

SEQ ID NO: 4176434 - RNA, 67 nt, Human
gcacugcuccagguguggcuuguauuuuugcuguguuagcaucaccuuggagcuuuauuagaagugu

SEQ ID NO: 4176435 - RNA, 59 nt, Human
gcacugggggcagcagugagggccucuuagcagcccagcgcacugacugccccuauugu

SEQ ID NO: 4176436 - RNA, 59 nt, Human
gcacugguagagaauuguagccugcaagaacucaauguuccaggaguucuaauaggugu

SEQ ID NO: 4176437 - RNA, 71 nt, Human
gcacuguccuaguugaagaggcugucaucacuuggguuaagugugacagcacgguucaacugcugcugugc

SEQ ID NO: 4176438 - RNA, 119 nt, Human
gcacuguucugggcacagcuucugcucuccaggagcucagagucuacuaggggauagaaaugaguagauagucaccucuuggagacauaggggcuggauuugagguccauaccaugugc

SEQ ID NO: 4176439 - RNA, 55 nt, Human
gcacuguugauaacauuagaaaguuugguuuucaagcuuguguguaucacagugu

SEQ ID NO: 4176440 - RNA, 73 nt, Human
gcacuguuggaggaggaagaggaguuaauuucaucaauuaacucuuccaacacuccuuccauuuaguaauagc

SEQ ID NO: 4176441 - RNA, 97 nt, Human
gcacuguuuccagagccagucacuccagccugccucagugcacaccugggcaccaggcaggugucuggaagugacucauucucuaaagaacauuugc

SEQ ID NO: 4176442 - RNA, 61 nt, Human
gcacuuaauauuguaugcuuuggguacuuuagguaugcaaagaugaaauauuaaaggaugc

SEQ ID NO: 4176443 - RNA, 65 nt, Human
gcacuuagcuggcaggagaaacggggugcagcugugccugcccuucuuucucacugccacugugc

SEQ ID NO: 4176444 - RNA, 66 nt, Human
gcacuucagucggguugaagagagcaggaguuggcuguccguggcuagaucugcccacugaaguuc

SEQ ID NO: 4176445 - RNA, 59 nt, Human
gcacuucuggccuggccuguguucagcugagaaaugcugccaggcagguagaggagugu

SEQ ID NO: 4176446 - RNA, 80 nt, Human
gcacuugaguccuugcuuuagaaucugcuucuggggaaacccaaaguaaggcaauuccuaaaaugcaucagacccugugu

SEQ ID NO: 4176447 - RNA, 88 nt, Human
gcacuugcucugggaaauggcuacuugucaaaauaaugacggauucaaaucucaauggcguguagucacauuuccauaguaaauaugc

SEQ ID NO: 4176448 - RNA, 59 nt, Human
gcacuugguaaauacucuuuggagacaguaaugcucaaagguuguguuugcuguugugc

SEQ ID NO: 4176449 - RNA, 62 nt, Human
gcacuuucugccucucaggcgcuguuccaggcacagagauggagugggagagggcagacugc

SEQ ID NO: 4176450 - RNA, 55 nt, Human
gcacuuugagaggcugaggcaagaggauuguuugagcccaggaggucaaggcugc

SEQ ID NO: 4176451 - RNA, 61 nt, Human
gcacuuuuccaaauaaaucaguucuaauucuuauguaagaauaugaugguuggagaauugc

SEQ ID NO: 4176452 - RNA, 97 nt, Human
gcacuuuuuguucauaguucuguuuugaaggauuggucaacgagccauaucauaaacacuguuaaaaugggacucuugugcaugaauaaaucugugu

SEQ ID NO: 4176453 - RNA, 69 nt, Human
gcagaaacaaacucuauaggcagaagcaaucagcauagauuaauuuagccuauggaguugaguuucugu

SEQ ID NO: 4176454 - RNA, 79 nt, Human
gcagaaacagagucaaauaauuuucucaauagugacuacuuuaauggucacagaggaacaaaguuauuuggaagucugc

SEQ ID NO: 4176455 - RNA, 84 nt, Human
gcagaaagaaucuuugugcccaacucaauggcaaaacaacuuccauauuuacugaaagcugggcacaagauucuuuccuaaugc

SEQ ID NO: 4176456 - RNA, 64 nt, Human
gcagaaagagcgugaauuuuaacaucugauaaauuuggauucaaauuccaguucuuuuaccugc

SEQ ID NO: 4176457 - RNA, 67 nt, Human
gcagaaagcacuugaaaucuggcaguguuauugccaagaaacauuguggucucuaagugcuuggugc

SEQ ID NO: 4176458 - RNA, 63 nt, Human
gcagaaaguagaguguagcaguuucgaugaaugagagacagccaugcacuucugcuguucugc

SEQ ID NO: 4176459 - RNA, 90 nt, Human
gcagaacaugucaugaauguuguuucggccuuucuucauccaucuccuccuuucaaauggggaaacugaaacaucaucauguuguuuggc

SEQ ID NO: 4176460 - RNA, 130 nt, Human
gcagaacauuaugaauuggaaguuguaacacuaauguagucauagauguuggagugaaaauuguaacaaugccacauuaaguguaugcauuuucuuuauuacacaucuaaauucagaaauauuaaaaugu

SEQ ID NO: 4176461 - RNA, 88 nt, Human
gcagaagccagcucccuccucaucccucugccaggcccagggcugagcaguccuggggcaggugggugaggaaggcagauguggaugc

SEQ ID NO: 4176462 - RNA, 91 nt, Human
gcagaagccuauuauuuauugacauguaggcuacaaggagguuaaaagaaaaccuccuuccuugaugucaaauaagugauacaaaaacugc

SEQ ID NO: 4176463 - RNA, 55 nt, Human
gcagaaggucauucaguguccaguuaaauguccuggacacugauaaucuuguugc

SEQ ID NO: 4176464 - RNA, 55 nt, Human
gcagaaggucuggcacuucaggguaggcagugcucugcagggcuucccucucugc

SEQ ID NO: 4176465 - RNA, 113 nt, Human
gcagaaucgugcgggcugggcccuggcagugccucccaggcaccccucauuuugugccucuuugggaaggacgugucaguggcauagugugggagacacugguggguucaugc

SEQ ID NO: 4176466 - RNA, 76 nt, Human
gcagaaugugggcugaguguggaacuaguuugguaaaauuuuaaaauggaaauuuuguacucauuuuacauuuugc

SEQ ID NO: 4176467 - RNA, 89 nt, Human
gcagaauucuuuaggagacucagcauucccugggucgaauggcuuaggagaaccagagcugacccaaggauugaacucuagaauucugc

SEQ ID NO: 4176468 - RNA, 126 nt, Human
gcagacaauagcaaaugacaucccaagaacuaccagucacucugugagagcuacgguuacuugaguugugaugguugagucuggagagauuggcagugcucuugaguuuuaugcuaaguugccugu

SEQ ID NO: 4176469 - RNA, 116 nt, Human
gagugcaagcuuuagaguaagugggaccugugucugcauucuguguaacucaguagcugugugacauaguagcuguguaacaugagaauguuccucaaucucgcugagcuucaguc

SEQ ID NO: 4176470 - RNA, 80 nt, Human
gagugcaauguuacaucugagcaacagaacacuagguaguuucuauguugucuugccucagguggcaguagguagcacuc

SEQ ID NO: 4176471 - RNA, 58 nt, Human
gagugcacauuuuuucugcugcaugaguggauaaugagcagcagcagaagugugccuu

SEQ ID NO: 4176472 - RNA, 58 nt, Human
gagugcagaaauucccuuccugcaaaucacuuuuugcuaaagggaggcuuucucacuc

SEQ ID NO: 4176473 - RNA, 63 nt, Human
gagugcagaugccagccccaguccuuggcccacggaccagggcacaggagucugaagccacuc

SEQ ID NO: 4176474 - RNA, 103 nt, Human
gagugcauuaguuacucgguccaauaucauucuaauucuccucguaguucauugaauuugagccuguuaggagauaaaauguaucuuuagcuacuauguacuu

SEQ ID NO: 4176475 - RNA, 67 nt, Human
gagugccucuucugugcuuggaaaaugguuagauccugagcguggucucccacagaaagaaguauuc

SEQ ID NO: 4176476 - RNA, 61 nt, Human
gagugcguguuuggggaugugggugggucuugccuggucucucaaacccagaugcucauuc

SEQ ID NO: 4176477 - RNA, 99 nt, Human
gagugcugagaagaaucaggaguaaguuauaaguauuuauuuuuaaacaaguuauauaaauauuugcaagcauuuuuccgguuccuuugauagugacuu

SEQ ID NO: 4176478 - RNA, 102 nt, Human
gagugcuuauccgucagaucucugcuucauguuuggaguuugcucacuuaacacaucagaaguggcuuuguuccguauggcagcaaguucugcagaagccuc

SEQ ID NO: 4176479 - RNA, 78 nt, Human
gagugcuucugguucuaagcaguuuuucuuguauuaauuucgaguuaauuagguuagauuacugugagguaggcacuc

SEQ ID NO: 4176480 - RNA, 80 nt, Human
gaguggaagccugagguucccgugacuuccuuucucugcucccugaguuguuucacagggcaggccccaggccucuacuc

SEQ ID NO: 4176481 - RNA, 77 nt, Human
gaguggaauggugguguuggugggggagugccuguuuacugguaguaggaguaacucucgucaucauauuccagcuc

SEQ ID NO: 4176482 - RNA, 69 nt, Human
gaguggaccaagggcucuggacagaguggaguggacagcagcuccucugccccuacccuuuggcugcuc

SEQ ID NO: 4176483 - RNA, 56 nt, Human
gcagggucuagaacgcccacaugugcggaacuggggaauagagcuggagacccugc

SEQ ID NO: 4176484 - RNA, 129 nt, Human
gcagggugaaggauggauuugaaaggccagagugauacugaaacagaggcucccugcacuugucuugaagugcuuguuacaagaguagacagccuucuuuagugcccuuuaaaccguaauagaaaaugc

SEQ ID NO: 4176485 - RNA, 56 nt, Human
gcagggugcuuagaaauggaccugccuagagggaggucuggacccuuggccccugc

SEQ ID NO: 4176486 - RNA, 78 nt, Human
gcagggugggguggagcgcagggugcuggcggccugcgugagcgccagcccugcacgcugccuccgccggcgcccagc

SEQ ID NO: 4176487 - RNA, 68 nt, Human
gcaggguugccauggugauggggggugucagggacccgcccuaaccacuuccccuguggcgagccugc

SEQ ID NO: 4176488 - RNA, 57 nt, Human
gcaggguugguguccucugcggccucucuccuuggccuguggacggccacccucugc

SEQ ID NO: 4176489 - RNA, 123 nt, Human
gcagguaagaaauucccccaugguuuuccuguucuuuauguugggaaaagucagauuuucugucacaggcaagaaaucuucuccagacauaaggggauuuaaauuaugacaguuuuuaccugc

SEQ ID NO: 4176490 - RNA, 83 nt, Human
gcaggucgcggggcuguggagccgcgagggcugacggcgcucgccgcaaguuugcagagcggcccccgcagcgcagcggcagc

SEQ ID NO: 4176491 - RNA, 73 nt, Human
gcaggugccaggggaugcacgaaggcgccucggagagaccccuuucuccgggugcccacgugccccuacuugc

SEQ ID NO: 4176492 - RNA, 103 nt, Human
gcaggugcuuucugacugagacugggaaccugugcuaggaggggcucccaucaccuccaggccuugcagguuaacuggaugcccaguauaguuugacauuugc

SEQ ID NO: 4176493 - RNA, 66 nt, Human
gcagguggagcucagcaaaggucuguguggaggcuacacaugggcuuuggugagggaucuccuugu

SEQ ID NO: 4176494 - RNA, 65 nt, Human
gcagguuccuuuuagcuuugcccuaacaggggaucuguacuuggacacugcuauaaaggaucugc

SEQ ID NO: 4176495 - RNA, 69 nt, Human
gcagguucucagaaaggauuugaaauucauuuacuauuuuaagagauucaaagaucuucugaaaucugu

SEQ ID NO: 4176496 - RNA, 66 nt, Human
gcagguuggcgcccaggacgccgccgcuguacuccccggcggccgcguccagggccgccaggccgc

SEQ ID NO: 4176497 - RNA, 80 nt, Human
gcagguuuaaguguagugcuaagggcagccuaacuagauuaacuacugaguuauuguccaggcacauauuuuaaaauugu

SEQ ID NO: 4176498 - RNA, 74 nt, Human
gcagguuuugaaggaggauugaggcgguggggcccagugagaaacuggggaaacuguccaguucuccccacugu

SEQ ID NO: 4176499 - RNA, 85 nt, Human
gcaguaaauguaccuuuguccagauggacaucaggcuucagugccaauauuguaccucuaacauauggacaagaacauuuauggc

SEQ ID NO: 4176500 - RNA, 64 nt, Human
gcaguaaggaggggaaggguuuucugccacgucuguggucucuucauucuucucuuccugcugu

SEQ ID NO: 4176501 - RNA, 59 nt, Human
gcaguaaguccacuauauccuucucugucacauccuuagagaugggcgggggcuucugc

SEQ ID NO: 4176502 - RNA, 65 nt, Human
gcaguagcuauuuagcccagauaaguguuuuacugucugagcugauugagcuaaauguaucuugc

SEQ ID NO: 4176503 - RNA, 70 nt, Human
gcaguaucacguagugacaagaucacagggccaagaacuaggagccugggucuggucacuaagucacugu

SEQ ID NO: 4176504 - RNA, 96 nt, Human
gcaguaucugagguguugaugaaacagcaggaacaucuugccaguggucacuuuuaucucccacuggucuuugcuguugcauuucuuaugugcugc

SEQ ID NO: 4176505 - RNA, 70 nt, Human
gcagucacauagguauacacauaucuuaaaagucacugaagauuugugcauuguacuguaugugaauugc

SEQ ID NO: 4176506 - RNA, 55 nt, Human
gcagucaccaucugacaguuuucauugcuaucaaaaacagucaaauguugauugc

SEQ ID NO: 4176507 - RNA, 99 nt, Human
gcagucagaaggauaggcugcacuguguaacagauaacucgaugaucucaguggcuuuguacaucagugcauauuuuuugcuuaugcuuucugucuagu

SEQ ID NO: 4176508 - RNA, 78 nt, Human
gcagucaguaaaggauggugaaauacaagugugauugauuguaaaagcacuacaauuucgcuucauuuuaaacauugc

SEQ ID NO: 4176509 - RNA, 106 nt, Human
gcagucauguuggccaacucucauuuuagguguaagguauaucagccuccuucagucucaggugcaguccuuauaccuaaaauugagggcuggccaagaugacugc

SEQ ID NO: 4176510 - RNA, 61 nt, Human
gcagucauuuucaaaacauguaauccauuucuuaauuaugcauggagguggaugugacugc

SEQ ID NO: 4176511 - RNA, 60 nt, Human
gcaguccagaguagucgaguauucuguaacaaaauaacaggguuacuuauuuuggauagu

SEQ ID NO: 4176512 - RNA, 56 nt, Human
gcaguccaguggguguuaauuaggugaaccugcaaauaaacaugcauuagaacugc

SEQ ID NO: 4176513 - RNA, 75 nt, Human
gcagucccauaugcaaagcuguggguuagguuuaacuaagaaucaaugugaccuacagaucuuugaauguguugc

SEQ ID NO: 4176514 - RNA, 56 nt, Human
gcaguccuaugucugcaccagagccgccucacgggccuaugggcaggcaaggaagc

SEQ ID NO: 4176515 - RNA, 64 nt, Human
gcaguccugggcacagcccugggggccaggagacgccuccaucagccgugggcccaggcgcugc

SEQ ID NO: 4176516 - RNA, 102 nt, Human
gcaguccugucgcuuuaaacagagcaaggcagcuuucacugcuuuugaaucccgaccgagcggggcacugccgugcuuuguuuucuuugccuuuaagagugc

SEQ ID NO: 4176517 - RNA, 67 nt, Human
gcagucugucucaaguucuugcacucauaucacuaaugaaaagaguuaugaaguuugacacaacugc

SEQ ID NO: 4176518 - RNA, 78 nt, Human
gcagugacacagcuuucugaagagcaucuuacuaacuaggauuaugugugugugcuuuuuuugaaguaguuuuaaugc

SEQ ID NO: 4176519 - RNA, 63 nt, Human
gcagugagcagugagugugcugcaggguuaggagcaggcccucagcauccuccugcucagugc

SEQ ID NO: 4176520 - RNA, 65 nt, Human
gcagugauuuugcucagauaaacguaguguuaaguaagacuuuuuacauugucugaucacauugc

SEQ ID NO: 4176521 - RNA, 58 nt, Human
gcagugcaggacaaaucagugcagcagaugagagauguccacugugguccuucacugc

SEQ ID NO: 4176522 - RNA, 72 nt, Human
gcagugcucuuuuuuaaggaugcaguggugaucuuuuuguucaagugcugcaaauccucagaaaggguuagc

SEQ ID NO: 4176523 - RNA, 98 nt, Human
gcaguggcccagcccugcaaggccccagauggugucccaggcucaggcugugcagucgcagucggggccuggaggcaccaggccuugcaggccacugc

SEQ ID NO: 4176524 - RNA, 92 nt, Human
gcaguggggccaagaguguuucagucuuccuagaucagccacacugccaucaaggucuggagggcaccugaggcaccaagggucccaaaugc

SEQ ID NO: 4176525 - RNA, 73 nt, Human
gcagugguccugccagccagguccagguccccucagacagacccuggaucccagaagcacagggcccaccagc

SEQ ID NO: 4176526 - RNA, 81 nt, Human
gcagugguggguaaaacugcuggcacuuuagcaugaaucaaugcaguggcuccaaaccguagucauuuuauucuucauugc

SEQ ID NO: 4176527 - RNA, 115 nt, Human
gcaguguggggccagagcuacuguccugggcuuuuggccuguuccccaucuuaccauacaugaauugggacacaaaccagaccaggagucaggguuucuuaaggccuuaaagagc

SEQ ID NO: 4176528 - RNA, 71 nt, Human
gcaguguguguaugagccuccagcugggccagggaccaacuuuccaggcccagaugaauucucaucauugc

SEQ ID NO: 4176529 - RNA, 103 nt, Human
gcaguguucgagagagugagcagggggccacagucacagccacagccacagcugcuguuagugagucccugugcccaacaccaccucugcuccuaugcacugu

SEQ ID NO: 4176530 - RNA, 57 nt, Human
gcaguguuuuacagaccagcauuucuagagaaauaugggaguuguuggaaaugcugu

SEQ ID NO: 4176531 - RNA, 121 nt, Human
gcaguuaagggagaaggcuuauuucucuuugugcguuuuaguagguuacauuagucgggaaugcuuacuuugaugaucaaugagcgauaucagagccuggagacccaauuuuuaaaacugc

SEQ ID NO: 4176532 - RNA, 69 nt, Human
gcaguuacauauuuaguagguuaaaaugacuccagcguucggacuuguggauggcuucugaacaacugc

SEQ ID NO: 4176533 - RNA, 56 nt, Human
gcaguuacugucuuuuccuaaauggguacacacuuguguaccaggggcagcacugc

SEQ ID NO: 4176534 - RNA, 75 nt, Human
gcaguuagagagccuuucggagccacgcuguacccagucugguugugcagcugugccugaaaaguacucuuaagc

SEQ ID NO: 4176535 - RNA, 93 nt, Human
gcaguuaggguuggcugucugccaaaaggugcaccugcuggcagcagagccggaagcagcaguucuuuugagaagcagacauuuauuaagugc

SEQ ID NO: 4176536 - RNA, 61 nt, Human
gcaguuaugugaaucauguguuauaagagggggcuuaaaggcaugguuagacaugguuagc

SEQ ID NO: 4176537 - RNA, 63 nt, Human
gcaguucacaagcguaggugcugaagcacauuuugguuuaguauuuaauaacuugucaaaugc

SEQ ID NO: 4176538 - RNA, 87 nt, Human
gcaguucacccaagugcagagacugcuucuuccuucugcucacauuuucuaaccugcagaguuuauuucugacuuggcuaggacugc

SEQ ID NO: 4176539 - RNA, 71 nt, Human
gcaguucaucuuccucccagugccugacggagggcacaggcuugcgggagggcacugggaaugugggcagc

SEQ ID NO: 4176540 - RNA, 74 nt, Human
gcaguuccuccccagagcucugacccaggcauugauaugggcccuggaagguagggcagcugggagggacaugc

SEQ ID NO: 4176541 - RNA, 74 nt, Human
gcaguuccuccccagggcucugacccaggcauugauaugggcccuggaagguagggcagcugggagggacaugc

SEQ ID NO: 4176542 - RNA, 68 nt, Human
gauuucucaacucucaagagaagcuauuauuuccuggagagaagcuauuauaugagagcugagaaguu

SEQ ID NO: 4176543 - RNA, 74 nt, Human
gauuucuggaauuggauccucacuguggugugacagaaccauggucaaguuuaugugugggucuacuagaaguc

SEQ ID NO: 4176544 - RNA, 57 nt, Human
gauuucuguggcuuguacauaugagggcuucucucuuuccuguaaaacccagagguc

SEQ ID NO: 4176545 - RNA, 60 nt, Human
gauuucuucaggagcagaggagcuauuucucauuuagacaaauguuccaaggaaggaauc

SEQ ID NO: 4176546 - RNA, 67 nt, Human
gauuugaaagcaaucagauucagaugucaguugaagcucuagacaucgaagagauuguuuuaugauu

SEQ ID NO: 4176547 - RNA, 62 nt, Human
gcaguuuuauugguugaaaucuggcacagguaccacuggacuaagacugccaguagggcugu

SEQ ID NO: 4176548 - RNA, 70 nt, Human
gcaguuuuuucaauugguuuguaguccucaauaauuauauauuaaauugcugucaaaccaguaagacugc

SEQ ID NO: 4176549 - RNA, 56 nt, Human
gcauaacagcaguccucuucucaugcaucugcugagcccauugggugcuguuaugu

SEQ ID NO: 4176550 - RNA, 94 nt, Human
gcauaacuguauuaggugaaaugagccuuguguguguaaaguguagccuaccauauuccagcagaccaucaaggcucagcuuaaacgaaaaugc

SEQ ID NO: 4176551 - RNA, 69 nt, Human
gcauaaggaguucugggaaagcuaucugaaagauguaagucaagaugguucucagaaacucaacauugc

SEQ ID NO: 4176552 - RNA, 71 nt, Human
gcauaagguuaugauucaggauauggauucuggagccugaauccagucugguaugaauccuagcucuaagu

SEQ ID NO: 4176553 - RNA, 73 nt, Human
gcauaauuagagaauucauguuacuagcacuuauuaaugcuuugccuguaaugugacaucucucaauuauagu

SEQ ID NO: 4176554 - RNA, 69 nt, Human
gcauacaguucuaccaggagagguugauucucuuggauugaacagugucucuccagguaggauaaaugu

SEQ ID NO: 4176555 - RNA, 79 nt, Human
gcauacauacagaacuuuaggauuuucacagguaccuuaugagguaguuguagccuccuugagguugugcaaagugugu

SEQ ID NO: 4176556 - RNA, 97 nt, Human
gcauaccuaggccagcagcacagggcuucugagcaggagugggaggcucagguccucugcccuccccugcucagaacucuggugaagcugaggaagc

SEQ ID NO: 4176557 - RNA, 84 nt, Human
gcauacggcucucuuacaggugagaccuuccacguuaccugcagagcagccaccugggagucacaccugagaaagagcagaagc

SEQ ID NO: 4176558 - RNA, 57 nt, Human
gcauacgggagaaacaucugcucuccucaacuaggauaggugggagccccaguaugc

SEQ ID NO: 4176559 - RNA, 74 nt, Human
gcauacuuuuuguuuaggaugcucuauucugacuccugcgauuuuggcaaggggugcuuucucugagaguaugc

SEQ ID NO: 4176560 - RNA, 78 nt, Human
gcauagaacauccaggcugcgggucucaagucggcacugcugacguuugggacauuagucguggggacuguccugugc

SEQ ID NO: 4176561 - RNA, 57 nt, Human
gcauagacccugauggagugaguaauaugagguugcaaaugguaccaagggucuugc

SEQ ID NO: 4176562 - RNA, 61 nt, Human
gcauagacgucuaccaagggcaguucuuaccuaaaagggagagcuguuuggacaucugagu

SEQ ID NO: 4176563 - RNA, 77 nt, Human
gcauagagccugauacauaguagcaugucauuacauuuuguuuagugaagauauagcuuguguucagaacaauaugc

SEQ ID NO: 4176564 - RNA, 81 nt, Human
gcauagaggacauucuuuucccaacugcuuuaaggugaaugaguccuuggauaguagaggagaggaacaagguguccgagc

SEQ ID NO: 4176565 - RNA, 68 nt, Human
gcauagagugguuaacaguuuagaaacuguuugaaucuugauuuucuuacugugugaccucucuaagc

SEQ ID NO: 4176566 - RNA, 84 nt, Human
gcauagcaaaccuccagucaccuggaugagaaacuuacaaauauguauuguucaacacugagguugcugcaguguuuguuaugc

SEQ ID NO: 4176567 - RNA, 63 nt, Human
gcauagcuucugggagcagaaugguuggguuuaaauuccagcccugcuacucacaagcugugu

SEQ ID NO: 4176568 - RNA, 76 nt, Human
gcauaggcugagaaucaggauucaagaucagcuguaaaccccagacugguaaccaguucugaucccauguugaugu

SEQ ID NO: 4176569 - RNA, 55 nt, Human
gcauagucugaugguuugaaauauaucguguaacuuucuaaacuguuaggcuugc

SEQ ID NO: 4176570 - RNA, 116 nt, Human
gcauauaacauucucgaggaacugaggaagaacuagaaacuaauggauuauuaaggaaauugaugggaugaggguuucuuguucuuucccuuauccuuucuuauguuuaaauaugu

SEQ ID NO: 4176571 - RNA, 68 nt, Human
gcauauaagcucgguggcucaugccuguaaccccacccagcacuacccacucaggagcuuaucuaugc

SEQ ID NO: 4176572 - RNA, 62 nt, Human
gcauauauaaacaauuuccaccucuccugagaaguuccucguuuuagguggacauugugugc

SEQ ID NO: 4176573 - RNA, 73 nt, Human
gcauauaugugugugugugugugugugugcacacuuauauuuuuaaugcauacaucaugcuccauauauuugc

SEQ ID NO: 4176574 - RNA, 59 nt, Human
gcauaucuguuucugaggauacaugauuuccgauuaucuuugucucuggagcagaaugc

SEQ ID NO: 4176575 - RNA, 59 nt, Human
gcauaucuucugacaugaucagguuaaauagaagccuggcauauaaauagaagaugugc

SEQ ID NO: 4176576 - RNA, 56 nt, Human
gcauaugaaauuucuaguucugcuuuugcauguacaggagcgguuuuucauguugc

SEQ ID NO: 4176577 - RNA, 75 nt, Human
gcauauguagaaugugugaauugauuugcagaagucuugaauuccugaaaauaauuucacaagacugccuuaugc

SEQ ID NO: 4176578 - RNA, 130 nt, Human
gcauauugaaaucaccugagaagcauuaaaaagucuugaugcugccuagucagagauucugacuuaauugguccagggaguuggcuggauagugggcuguuuuaaagcuucucaggugacuccagggugc

SEQ ID NO: 4176579 - RNA, 70 nt, Human
gcauauugagcauuagaaguuaauuauauuuccacugagauacccaggaugauaauguucacauauaugu

SEQ ID NO: 4176580 - RNA, 74 nt, Human
gcaucaagaguugcuggauguuuacaugucuaucccccaucaguaagacucaacuaccacaacucuugagaugc

SEQ ID NO: 4176581 - RNA, 77 nt, Human
gcaucaagaugucacugaguuggguuuuauuuuaguuccaaguauuguaucuguuuagcacccagccagcuuggugc

SEQ ID NO: 4176582 - RNA, 69 nt, Human
gcaucacacugauuuucuaaaagaagucacugaucuuacgaucuguuauauuuuguagaguugugaugc

SEQ ID NO: 4176583 - RNA, 63 nt, Human
gcaucacagcacaccugacauguagguaauaucacuuccugcuauucuggauguuguugaugc

SEQ ID NO: 4176584 - RNA, 76 nt, Human
gcaucaccaucucugugaccuucaccugugcauaauugggaugaggugaagguggaacgcagagcaugggauaugc

SEQ ID NO: 4176585 - RNA, 120 nt, Human
gcaucacuuggguacuuguuagaaacgcaaauucucaagguuuaucccaccuuuacuaaaucagaaauucuggagaugggacaaagaaaucuguguuugaacaagcccucucuacgaugu

SEQ ID NO: 4176586 - RNA, 67 nt, Human
gcaucagaggggccagguagugguuaggggcagggacuuugcagccacaugaccugggucuagaugc

SEQ ID NO: 4176587 - RNA, 128 nt, Human
gcaucagagucaccuggguggauuguuagaacucauauugcucgccucauccccaaagugccacuuucgguaggucugaggugggcuuguggauuugcauuuccaacacguucccgggagcaugcugc

SEQ ID NO: 4176588 - RNA, 92 nt, Human
gcaucauaucacuugagagcuuguuagcaggcuccgucccaaacugacuggaucagaaucugcauuuuaacaagaucccaggugauuuaugc

SEQ ID NO: 4176589 - RNA, 80 nt, Human
gcaucaucuugacuuuguagguaauugugucugagaucaggggcacuugccugcagggagacaaauuauaagaaugaagc

SEQ ID NO: 4176590 - RNA, 104 nt, Human
gcaucaugaguaucaucugaaagcuuguuggaaauguagcaucuuccccagauuugcugaaucagaaucugcauuuugaacaagauuccuggugauucaugugc

SEQ ID NO: 4176591 - RNA, 71 nt, Human
gcaucaugcuuccuccaaacuacccucuacuguauucugaagagguuauuugcagauggaauucauagugc

SEQ ID NO: 4176592 - RNA, 80 nt, Human
gcaucauggcugggaggagaguaugauggagacugaauccuccgccaaauauaauucuccaccuuuagugccacuggugu

SEQ ID NO: 4176593 - RNA, 55 nt, Human
gcaucauuugagcaagugacuggagugauccacauuacaaagcuacagauguugc

SEQ ID NO: 4176594 - RNA, 79 nt, Human
gcauccacauuuguucuucacuguuguuagcagaggcgguccuuccagcuucagcgugacaccaguggcgggugugugc

SEQ ID NO: 4176595 - RNA, 79 nt, Human
gcauccagggagguagccucaaaagcagcucuguagucucccaggguggcugcaauggcuaacuucugacuggacacgc

SEQ ID NO: 4176596 - RNA, 59 nt, Human
gcauccagucuuggcuccuggaaggcucauguggccaagagggagagagacugaggugu

SEQ ID NO: 4176597 - RNA, 65 nt, Human
gcauccauuguuuauguguuucucauuccuguuaaacugugagcuccaucaucugcaagggaugc

SEQ ID NO: 4176598 - RNA, 85 nt, Human
gcaucccaaguacagcugggaaucagcuggggagugcugucaagaauucucccuaucaauugauuccaggccaguuugugauugc

SEQ ID NO: 4176599 - RNA, 88 nt, Human
gcauccccgugccucuccuccagugggucccucagguagaaucggggcaggccccacuggacguucagggaggaggcucggaggaugc

SEQ ID NO: 4176600 - RNA, 90 nt, Human
gcaucccuaaucagcucucacguuucacacuucccuugcaaucucuggauuuugugaagaguagacauguggugccccauuacuggaugc

SEQ ID NO: 4176601 - RNA, 65 nt, Human
gcauccuaauucugaaacagugucaaucccugguuuagacugaucuuguuuuagaguuuuaaugu

SEQ ID NO: 4176602 - RNA, 130 nt, Human
gcauccugagagccuuggaagagggaacagauuugaggcacuguccugacagucacccuggugcagucaguggagagcuuccaggauucauaucccuauaacccagggccacacuucucaacccugaugc

SEQ ID NO: 4176603 - RNA, 69 nt, Human
gcauccuuaguguuuucucuugaauccugucuucuccuucauggucucuggaggggacacugcagaugc

SEQ ID NO: 4176604 - RNA, 61 nt, Human
gcauccuuccugcugggccuggcucagaagagaaagucaugucagacccggggaagggagc

SEQ ID NO: 4176605 - RNA, 57 nt, Human
gcauccuuguccguggccguuggugcauuugcuuauauggacaggggcauagguugc

SEQ ID NO: 4176606 - RNA, 62 nt, Human
gcaucuacuacaguguucaacauguacuugaaaagcaugugucaaaugauguagcugggugc

SEQ ID NO: 4176607 - RNA, 86 nt, Human
gcaucuaugcacugcacugaggugaaggggugcuuuuccucaguguccaucagagucuccuuggccucaaugccugcuacagaugu

SEQ ID NO: 4176608 - RNA, 100 nt, Human
gcaucucaagcuuuccguucauuauuuuaauuuaucaaaagguaagaauuaagcuuugaagauaacaguaagguauuguacuacuaagcauaugagaugc

SEQ ID NO: 4176609 - RNA, 102 nt, Human
gcaucucacauuagccuccugccucuucauuugugagacaguugauaguguuugucucuuaauucagaggcaguuauagcccccguuaaaugugaaaaaugc

SEQ ID NO: 4176610 - RNA, 78 nt, Human
gcaucucuauugaucaucuugugcugacggcucaauggucagugugugggcaacaguaaggugauuaagaggaggugc

SEQ ID NO: 4176611 - RNA, 56 nt, Human
gcaucucuuacccacgagccaggccagcuggucuguuccacugacuaagagcaugc

SEQ ID NO: 4176612 - RNA, 58 nt, Human
gcaucugccggacgccucacucagcucaagaccaggagugcaugcgccgcugagaugc

SEQ ID NO: 4176613 - RNA, 66 nt, Human
gcaucuggcauguaucacaucaaggccagagcaguguggcccagcagauggcuaugugcuagaggc

SEQ ID NO: 4176614 - RNA, 71 nt, Human
gcaucuggcuuugcacacacaauaacaaauguauucucaauauacaaucgugugagcaaaugucugugugu

SEQ ID NO: 4176615 - RNA, 66 nt, Human
gcaucugguccacauucucaaggcugguuggagaagccuggagauuauuugguccaaucuugaugc

SEQ ID NO: 4176616 - RNA, 62 nt, Human
gccacugagcucugaugagauuugggguuuauuuuucucagaugucauuugaaguucauggu

SEQ ID NO: 4176617 - RNA, 117 nt, Human
gccacugaugagcagcagccauguuucuguggucucccaugucugugggucucagugagggccacaaggugaggaccaagaaugugagcaagcauggccacugcugccaccgcaggc

SEQ ID NO: 4176618 - RNA, 55 nt, Human
gccacugcaaccuuggcacacaccugacaguguuuaugcuggagguugacagggu

SEQ ID NO: 4176619 - RNA, 61 nt, Human
gccacugcgggagaccuaggcuuuuacacagaggccacauugugauucccgcaggaauggu

SEQ ID NO: 4176620 - RNA, 62 nt, Human
gccacuggcgcugugcagagugugagcuggaaacaucguaguuacuuugucagcuuaguggu

SEQ ID NO: 4176621 - RNA, 87 nt, Human
gccacugggccuugugugucucaucuuccagcagucuagccuguugguguuuauuugguggguuacuuaacaggguucuaagugagc

SEQ ID NO: 4176622 - RNA, 87 nt, Human
gccacuguggguucagcuggcuucucugcagacauuaaagcugauuuggucucuguuuaggaagccagauuucugaucccagucggc

SEQ ID NO: 4176623 - RNA, 78 nt, Human
gccacuuauuggagagucagaaagcagacaggggauccuagugagcugguugccuuuguccuuucucacuguccuggu

SEQ ID NO: 4176624 - RNA, 58 nt, Human
gccacuucugcauugaaugaccugggaagaaaaccaauuuguuuaaaggugaagaggc

SEQ ID NO: 4176625 - RNA, 63 nt, Human
gccacuucuuuaauguauacaaaagacaugaaaaaugucccuuuggucuuaaagaaggcuggc

SEQ ID NO: 4176626 - RNA, 63 nt, Human
gccacuuugagccuuacuguuucucagucugcugaauccauuuaacagggggcugcagagggc

SEQ ID NO: 4176627 - RNA, 63 nt, Human
gccagaaagaggaggaccugggacucaucuagcuuccugguccugaaucucuuucucuugggc

SEQ ID NO: 4176628 - RNA, 55 nt, Human
gccagaaaugcaaauuccagggcccccuuggaacuucagaaucagcauaucuggc

SEQ ID NO: 4176629 - RNA, 69 nt, Human
gccagaagcauuucaaggcuacagaaaccuuagucuaaaacauagucuagcugagcccagaagacuggu

SEQ ID NO: 4176630 - RNA, 63 nt, Human
gccagaagggggaagggauuguguuugggggcugauuaugcugaccuuucaacccuucuuggc

SEQ ID NO: 4176631 - RNA, 127 nt, Human
gccagaaguccagggucaaggcuuuagcaggguuggcuccuccuggggcucugagcgagacaugcccaugcugcucuccuugcuccugguggccacuugcgguccuuggcaaaccuuggcuucuggc

SEQ ID NO: 4176632 - RNA, 80 nt, Human
gccagacacagcugggcauaugugcagcccggccacaggguggccacuuggcaugugugccagcaguuaagcccucuggu

SEQ ID NO: 4176633 - RNA, 71 nt, Human
gccagagaauccggagaguccauuggauuugcaaaagcaguggcccauggcucuuggggucuucucugagc

SEQ ID NO: 4176634 - RNA, 101 nt, Human
gccagagagagagagagugaaacuuuuaugcccaacgguguuuggaugagcaagauaauuacacccuuguccauagcagaugcucuguucuucgcuuuggc

SEQ ID NO: 4176635 - RNA, 69 nt, Human
gccagagaguuuaauucagagcugaauaacuggaagaaagaacucagcacugaaucuggauuugcuggu

SEQ ID NO: 4176636 - RNA, 60 nt, Human
gccagagauucugguuagguguauuucacauagaaagcuaccuuggcagaauugaauggu

SEQ ID NO: 4176637 - RNA, 61 nt, Human
gccagaggacucugggcguguauggggaguagguaucccuggguacgcagggcuccucugc

SEQ ID NO: 4176638 - RNA, 62 nt, Human
gccagaggaugaggugaacauauuuguaugcucuguggucuacaaauguauuuuauuuuggu

SEQ ID NO: 4176639 - RNA, 59 nt, Human
gccagaggcagggggagaaagaugaugucucaugaugccagcgcuuccucuucacuggc

SEQ ID NO: 4176640 - RNA, 73 nt, Human
gaucugcacucugagaggcuuggguccaaguuugacucagcuauucuaucuuagagaaucugcugugcagauu

SEQ ID NO: 4176641 - RNA, 60 nt, Human
gaucugccagugggaagaauacauuuugaagaggcuucagugucuuuccauggcuggauc

SEQ ID NO: 4176642 - RNA, 61 nt, Human
gaucuggauucaagucccuguuuucagcuccuugaaaauuguaggaacugaaucaaguauc

SEQ ID NO: 4176643 - RNA, 59 nt, Human
gaucugucuaauauugacagugggguauuagaguuucccacuauuacuguguggcaguc

SEQ ID NO: 4176644 - RNA, 66 nt, Human
gaucuuacugcucuugguugaguugguguccaauagacaguuucagagguuagagcagugggaguc

SEQ ID NO: 4176645 - RNA, 78 nt, Human
gaucuuacuuaauccucaccgcaagcccaugagcugagcacugugcaugcaugcuacugggagguagugggugggauc

SEQ ID NO: 4176646 - RNA, 105 nt, Human
gaucuuacuuaauucucacgacaccccugugggcuaccuaucaaucuccucauuuugcaaaugaagaaacaggggcuuggggaggugagguaucugagcaagauu

SEQ ID NO: 4176647 - RNA, 61 nt, Human
gaucuuagucccauagcccaacuuacaauuaugccaguuaggacacuugagggcuaacauc

SEQ ID NO: 4176648 - RNA, 91 nt, Human
gaucuugaacuguuguaauugaucaaggccuauuuguugccugaguauaaauggaggcaaauaauauacuuugaucuccuuacacaggauc

SEQ ID NO: 4176649 - RNA, 79 nt, Human
gaucuugcugguucugauuuuauuucugacugggcaaaagucauuuacagacaacaacaaagucguugccuagaagauc

SEQ ID NO: 4176650 - RNA, 60 nt, Human
gaucuuggagggucuuccacagccauguaauaccauggucacaugacccuuuccaaaauu

SEQ ID NO: 4176651 - RNA, 55 nt, Human
gaucuuguuucaguuccagagaacauuuaagauccucuggguugaaaucaagauc

SEQ ID NO: 4176652 - RNA, 77 nt, Human
gaucuuuaauggagcuaauuuagcaguagaaaguguuacaaauuuccauuccucaaagguagcccauuagccagguc

SEQ ID NO: 4176653 - RNA, 69 nt, Human
gaucuuugguagcuuccuuaaaugaccuuccauguucccuagaaugucaucuuaaggacugcuauaguc

SEQ ID NO: 4176654 - RNA, 73 nt, Human
gaugaaaaauuugaggggaggaaggaggggcaggagaggggccccuuagaugucuuccuccggauuuuuuguu

SEQ ID NO: 4176655 - RNA, 59 nt, Human
gaugaaauagcaaaggcauuugagauuagaguccaaagggccuugaaugcuauucuguc

SEQ ID NO: 4176656 - RNA, 67 nt, Human
gaugaaggccacuuuguguugagaacuguagggaaacuugauuuucuuacccaaaggguauuuuauc

SEQ ID NO: 4176657 - RNA, 64 nt, Human
gaugaaguggacccuggacagaccccggcaggaaguggaagguuuuucucugggucccuucauc

SEQ ID NO: 4176658 - RNA, 101 nt, Human
gaugaauaguuuuaaacaagaguauccuuucuagccucaaaguuucuauuaauaagcauuaauaagcuuugcuggagagaccucuuugggaaguauuuguu

SEQ ID NO: 4176659 - RNA, 63 nt, Human
gaugaauauccuuuuauccuguaaugaguucccaggugggagcaguuagggauacaaguuauc

SEQ ID NO: 4176660 - RNA, 77 nt, Human
gaugaauuuagucuuuggauguaagauaaagugggccaaagggcuccugcuuugucauuccaaaagaguccuucuuc

SEQ ID NO: 4176661 - RNA, 61 nt, Human
gaugacagcaggauuggauacaucucauggucuuaccauuugagaucccucuguugccauc

SEQ ID NO: 4176662 - RNA, 66 nt, Human
gaugacaugcucauuuccuggguucaucugcugaggagggcuggcaggaccugggcugaugucauc

SEQ ID NO: 4176663 - RNA, 65 nt, Human
gaugaccagcuagaaaugggauugguauccugaaugauauggagauauuuuuugguugguccuuc

SEQ ID NO: 4176664 - RNA, 109 nt, Human
gaugacgcugaugcuauaaaaggcaaugugaggggacagcugaguuauugaagcaagcuuuucugaguucugcccuacaccugaauuuagugguuuaaguagcgcuguc

SEQ ID NO: 4176665 - RNA, 85 nt, Human
gaugacuuaacgcagggcaaccuuaagauucacugcagggcauuuaguacugcuaugcagagggaaaaggugcuccugaggcauu

SEQ ID NO: 4176666 - RNA, 72 nt, Human
gaugagacaacaugauggggaagaacaagaaaaauuucccauggaucucguuuauuuuuaucaugggacauc

SEQ ID NO: 4176667 - RNA, 129 nt, Human
gaugagacaguggcguagcauguuuguguuguggcacaguguaaugccauggcauagcauggucguggugguguggcauggcguggcaucguguggcauagcaugguuguguuguggcauagugagguc

SEQ ID NO: 4176668 - RNA, 73 nt, Human
gaugagaccucuuuauugacuuguuuguccuggugggcuguuucucuaccaggcaacugugaaugggcucauc

SEQ ID NO: 4176669 - RNA, 79 nt, Human
gaugagagcccuccggguggaugggagcaagggaagauuuccuacccaaagcuguaccccaaccuaugagucuucuuuc

SEQ ID NO: 4176670 - RNA, 60 nt, Human
gaugagauaguauguagcaccugaaaacagcagagugucaggugugcggacugcugaguc

SEQ ID NO: 4176671 - RNA, 81 nt, Human
gaugagauccccgugucccucauugacgcugugcccaccagcgccgaaggcaagugugagaagggacuggauaaugccguc

SEQ ID NO: 4176672 - RNA, 69 nt, Human
gaugagccuguccugcugccagagaaaggcuaacagcagagccccagguacuggcagcaggaagccauu

SEQ ID NO: 4176673 - RNA, 93 nt, Human
gaugagcuaucagguugccagugggcccuguucuuaggaucagaagaaucuggcugagccuuuggggcuuucugguaacucugagucuaaauc

SEQ ID NO: 4176674 - RNA, 70 nt, Human
gaugaggaguaagagaguaccaucaucauauucuugucaaaguaaaugaguuggauuuauauucuuuauc

SEQ ID NO: 4176675 - RNA, 80 nt, Human
gaugagggaguuauauguuaggcaaucuuucuuguuauauuauagcuggauucaauuucuugauacaaacucuccuuuuc

SEQ ID NO: 4176676 - RNA, 56 nt, Human
gaugaggucauguuuuacauauuuaccauuauguaauauaacuuuggccuaacauc

SEQ ID NO: 4176677 - RNA, 81 nt, Human
gaugaggucauucugccucagcugauuucagauuuauuuuucaagcuggagccagugugaggcuuuggagauagccuuuuc

SEQ ID NO: 4176678 - RNA, 57 nt, Human
gaugaggugguucaagagccuugucauaaugaaaggcaauucagggccaccgucauu

SEQ ID NO: 4176679 - RNA, 80 nt, Human
gaugagucugccagugagagccugucuggaugucgucagcugugaugggccuacagguugucacggacuuggcggcucuc

SEQ ID NO: 4176680 - RNA, 123 nt, Human
gaugauacauuguaauguuuugggugugauuccuuugcuuuucacacugguuaaaaggauuuuuuuuccgugaucaccaaggacagagggaccagagcccagucuuucaggaaaugauacauu

SEQ ID NO: 4176681 - RNA, 89 nt, Human
gaugauacuguaccuguccugggaaugggaugcagugccuugggugguuucaggagauugacacacuuccaggaccaggcauuuucauu

SEQ ID NO: 4176682 - RNA, 63 nt, Human
gaugauauacaaacuccgaaguuuguaccuucaucaagguaagacuuaggaguuuuagacauc

SEQ ID NO: 4176683 - RNA, 73 nt, Human
gaugaucugugacaaugggucuugaaggcuccuguuuuccacagaggcucuccaggucucaugcacuggucuc

SEQ ID NO: 4176684 - RNA, 112 nt, Human
gaugaugaugaugaugaugaugaugaugauggcagcagcuaacuuaggcagcacuuacuagauguccuacacuuuucuguacuuuuacaucuauauuaucucacuuaucuuc

SEQ ID NO: 4176685 - RNA, 129 nt, Human
gaugaugaugguuuugauaauuucauucacaugugccuggcaagacacuugauccuguauuucugggacaggcaucaauguugggccaaagcaaauggccagguuauaaggguccaucauauucucauc

SEQ ID NO: 4176686 - RNA, 61 nt, Human
gaugaugcacuauguaccaguuccaaggaauacacuaaugaaucaguacauacugcacauc

SEQ ID NO: 4176687 - RNA, 67 nt, Human
gaugaugcauaucuccuaucuccucaaauguauuccaguaugaggaacaugggagaaaugucuuauu

SEQ ID NO: 4176688 - RNA, 55 nt, Human
gaugaugucaugaugaagacgaugaugccauauuguugauaaucguguugucauc

SEQ ID NO: 4176689 - RNA, 71 nt, Human
gaugauguugaguucugcauuaacgaggaaaguaucaccuuaauuauguaauaggguaacauaacaucauu

SEQ ID NO: 4176690 - RNA, 60 nt, Human
gaugauuugaccaaagucuucuaugucuuuagcuagaacaacauggaaggucaaacuauc

SEQ ID NO: 4176691 - RNA, 83 nt, Human
gcaggaugggagcuggggccagggaucuggccugaggcgucccagcuguggcugacuccugguccccacuugcuccucccugc

SEQ ID NO: 4176692 - RNA, 58 nt, Human
gcaggaugggagcuucacuuugucucaguugcucuggcaaagagaagccucaccuugu

SEQ ID NO: 4176693 - RNA, 59 nt, Human
gcaggauguaauccccuuuggagggaccccuaccuuucacagagcauacugcauuuugc

SEQ ID NO: 4176694 - RNA, 86 nt, Human
gcaggauugcauacugagaaaaguaugagcucuggggccagguugcuggacucaucaccuuuucucauuuccuuaagcagugcugu

SEQ ID NO: 4176695 - RNA, 60 nt, Human
gcaggauuggccuuuguaagggaaaauuucuuguucagcucauacauaugccauuccugc

SEQ ID NO: 4176696 - RNA, 88 nt, Human
gcaggcacaaugacaggcacagcuacuugcucacucucuagaagcucuuagaggccuccagcugaguuuugcugucucugugcccugc

SEQ ID NO: 4176697 - RNA, 64 nt, Human
gcaggcagaaaaauguaaaaagagagacuggccuagucucccagccuacaucuuucucccaugc

SEQ ID NO: 4176698 - RNA, 62 nt, Human
gcaggcagaaaaaugugaaaagagagauuggccuagucucccagccuacaucuuucuccugu

SEQ ID NO: 4176699 - RNA, 58 nt, Human
gcaggcaggugagucaaaacagacgaggaagcucugccuugucaccucaucagcuagc

SEQ ID NO: 4176700 - RNA, 108 nt, Human
gcaggcagguguguguguguguguguguguguguguguguguguauguauguauguguggguauguaugucugcauacacauacauuuauacaacucugcuggucugu

SEQ ID NO: 4176701 - RNA, 69 nt, Human
gcaggccacugucuccucuggggaggcuggcucucuuuggcccacccagcucuaggagugguggcaggu

SEQ ID NO: 4176702 - RNA, 56 nt, Human
gcaggccuaagagaaggcauuggcacaauagccccuuacuuccuucaaggaucugc

SEQ ID NO: 4176703 - RNA, 106 nt, Human
gcaggccucagucauccugagaacaugggcaugcacagcgggugucugucaggggaagccccucugggggacuugcuguggucccugggguggcuggugaggccgc

SEQ ID NO: 4176704 - RNA, 74 nt, Human
gcaggccugggagucaucuugucucagacuuguucacauaucauuuagucuuguacauugauuuuaggccaugc

SEQ ID NO: 4176705 - RNA, 67 nt, Human
gcacaguguucacuuaacaauggaugcaugaaaaugacagcauccuggggagcaagagcaaugacgu

SEQ ID NO: 4176706 - RNA, 57 nt, Human
gcacaguuagcuccagucuuagccccacuggaugggguugugugauccugagugugu

SEQ ID NO: 4176707 - RNA, 84 nt, Human
gcacauaaagaauguacaguuuagaaccauagauggcaauuuuaaauggaucaucucaaaauuaugcugcacauguuuaugugu

SEQ ID NO: 4176708 - RNA, 85 nt, Human
gcacauaccucucucagggcucugcaugcacacgcaaacaaacguacauauguguguuugcagguguccacacgggagcaugugc

SEQ ID NO: 4176709 - RNA, 55 nt, Human
gcacauccaaugauuguuuugaccaacaguggucagugacguaaacugcaugugc

SEQ ID NO: 4176710 - RNA, 86 nt, Human
gcacauccccacccucauuuauccaaaagccaguuuauucuagaaaaugugaacuagucuacagugaugaugagguggggguuugc

SEQ ID NO: 4176711 - RNA, 56 nt, Human
gcacaucuagaacaauuacaggugggaaauuucuugccaccuacuuuuggauuugc

SEQ ID NO: 4176712 - RNA, 57 nt, Human
gcacaugucuguucacauguuacaaugacagaauugaggaguugugacagauacugc

SEQ ID NO: 4176713 - RNA, 90 nt, Human
gcacauguggcagggucugggcccugagauguucuucuaguuggggcugggagaacgagcgaggggccaggcccuccucuacacugcugc

SEQ ID NO: 4176714 - RNA, 69 nt, Human
gcacauucauuucacacaacuuccuugucugagcuuaaaucuggaggaggugugaauucugggugcugc

SEQ ID NO: 4176715 - RNA, 65 nt, Human
gcacauucgaacaggagaccuacuccuuaauauuaaggagccaccuaggagcuguuuguuugcgu

SEQ ID NO: 4176716 - RNA, 129 nt, Human
gcacauuuagugguuugcugauagcagguauuuaggaggcugaucugggccaugcuggaaccaccuggccuggcagauggcugcaguauauuuuagagaagucccuaagugugccucaguacacacugc

SEQ ID NO: 4176717 - RNA, 105 nt, Human
gcaccaacaucacuuggaaguuuguuagaaaugcagaauuucagacuccaccuuacugaacuagaaccugcauuuuaacaagaugcccaggugauuuuugugugc

SEQ ID NO: 4176718 - RNA, 96 nt, Human
gcaccacagcagcguuccuccguguguuugcucagcauuccaagcuccuccacucugauacugccuucauauggauaugaaccucugugauugugc

SEQ ID NO: 4176719 - RNA, 99 nt, Human
gcaccagaaugcacagggcacucugcaggaacagaacucacucccaaguaugggaggugaaagguugcugcagagaacagguaccuggcaacugacugc

SEQ ID NO: 4176720 - RNA, 57 nt, Human
gcaccagacccagccuuguaguucgaggagaggaagaaaggcagaguggguuggagc

SEQ ID NO: 4176721 - RNA, 60 nt, Human
gcaccagagugaguggacugucgcuggcugacuguuaaugcugucugccucauccggugc

SEQ ID NO: 4176722 - RNA, 63 nt, Human
gcaccagcuucaccagggccaugguugugaagaagaucgagacccgugaugggaagcuggugu

SEQ ID NO: 4176723 - RNA, 71 nt, Human
gcaccaguagaaugagaaaguguagcaggacaugaacuucuuguuuuaauguuuucuuucucuuucuuugc

SEQ ID NO: 4176724 - RNA, 84 nt, Human
gcaccagugcugaguggcagaucucuggucuggaagccacguucuucucacuauaccauguugccauuuuucagcaacuggugc

SEQ ID NO: 4176725 - RNA, 112 nt, Human
gcacccaauccuucucuuuggaugguaagcaaauuggaugucugugagaagccggcaaauuuuauuaugaacacauaguuugcuacuuaacuauccuuaagaccccgggugc

SEQ ID NO: 4176726 - RNA, 115 nt, Human
gcaccccauggaaguuugaaagauaacucauuuccagcuccggugugcuuauuuccagaacgugagaaguggggagcccgugaggccccuggaguuuccuuguccauggaugugc

SEQ ID NO: 4176727 - RNA, 61 nt, Human
gcacccccacgaggccucuccaaccucagaggcucugaggagguugccagucugggggugc

SEQ ID NO: 4176728 - RNA, 83 nt, Human
gcaccccucugaaaggcaaaauuuaggacaggagcuuaagagaguuuacaggcuuugcuuccuguucuagccucagauucugc

SEQ ID NO: 4176729 - RNA, 82 nt, Human
gcaccgucugucccaucacaguuuuaccauuugguacucucuggagcauugccauggccuagaccugugauuaaauuggugc

SEQ ID NO: 4176730 - RNA, 83 nt, Human
gcaccuaaccuuauggaagacuuccuggaagagaagacauuucugacgaucucuucaaagaauuuuaguaauuuaguaagugc

SEQ ID NO: 4176731 - RNA, 59 nt, Human
gcaccuaggcugcucaccaggcucagaggcggcucugagguuuacugacagccuugugu

SEQ ID NO: 4176732 - RNA, 75 nt, Human
gcaccuauaaaugcaugcugugugccugaaauacacuaaaagguauccguucuuacagcauguuuguguguuugc

SEQ ID NO: 4176733 - RNA, 69 nt, Human
gcaccucacaaggcuguggggagaacugaguaucucuuagcugucucauaugguuuagugguuuagugc

SEQ ID NO: 4176734 - RNA, 59 nt, Human
gcaccugaaccuuaaugcauuccuuaaaaguuuucaaugggagcaugagucaggggugc

SEQ ID NO: 4176735 - RNA, 117 nt, Human
gcaccugccagccggguaagcagaugagcagggacccuacuagcucacaccuggauggagaucaggaacaggaagcagugggagucccugccuuuuguuguccaguuugcauucugc

SEQ ID NO: 4176736 - RNA, 69 nt, Human
gcaccugcuaugugcuuugcacugugcuauguuguuacauguuaugugcaagauacauaagacaugguc

SEQ ID NO: 4176737 - RNA, 76 nt, Human
gcaccuggaguugccugggacugaauaaacacuuagccaacccagugugucuaccagcaccagcauauuccagggc

SEQ ID NO: 4176738 - RNA, 61 nt, Human
gcaccuggggccagcuuaaccaaggggcauacaaauauucccagcauggccuacagugugc

SEQ ID NO: 4176739 - RNA, 60 nt, Human
gcaccugggguacacagcuacaaacacacccagcuacaugcaguugucacaccccugugc

SEQ ID NO: 4176740 - RNA, 62 nt, Human
gcaccugguucuuagguacucauauuuaauuucuaguuggaauuugagaccaagaaaagggc

SEQ ID NO: 4176741 - RNA, 68 nt, Human
gcaccugugaggggcgccugggucccagugcggcgacucugcacuggccuaagcgccucagccggugu

SEQ ID NO: 4176742 - RNA, 75 nt, Human
gcaccuugaggaucaugccugccuugugucaucauaacccagugccuacagcagagccugguacuuacuaggugc

SEQ ID NO: 4176743 - RNA, 58 nt, Human
gcaccuuggcuuucuugguggcuuugguacacccagugucccaaggaugccugggugu

SEQ ID NO: 4176744 - RNA, 78 nt, Human
gcaccuuucccaccccuuccuguuugcauuccucagagucagauuucagcuaaagggauggaaauuaaauaaaggugc

SEQ ID NO: 4176745 - RNA, 57 nt, Human
gcaccuuuuucuaggagaaugugauguacaaaauauucaauuuuuuuuaaaaggugc

SEQ ID NO: 4176746 - RNA, 65 nt, Human
gcacgaagcaaagcugaugagaaggcaaaugccagcuuuugaaaaugaagucuaugcuucugugu

SEQ ID NO: 4176747 - RNA, 60 nt, Human
gcacgaggcaccgcuguuuuguuaaagaccagcaucguuggcaagcaggguccauugugc

SEQ ID NO: 4176748 - RNA, 55 nt, Human
gcacgagugucucacggagucaccugcagugacagggcucagagacaccuguugc

SEQ ID NO: 4176749 - RNA, 98 nt, Human
gcacgauuagcauuugaggugaaguucuguuauacacucaggcuguggcucucugaaagucagugcaucacagaacuuugucucgaaagcuuucuagc

SEQ ID NO: 4176750 - RNA, 66 nt, Human
gcacgcagccuuuucccugcacgcuuuggauguaacagugcaggucauguggcgggacugacgugc

SEQ ID NO: 4176751 - RNA, 124 nt, Human
gcacggaccacaggcaaagaagagagauagucagacccaggauuggggcugccggccuccugucgccccagccccagcuuccuggccuucaagaccagaccccucuuccacuguggucuugugu

SEQ ID NO: 4176752 - RNA, 58 nt, Human
gcacggagaugaacaguguggaaaaaucacuccugggaucuguacacucaucuucugc

SEQ ID NO: 4176753 - RNA, 80 nt, Human
gcacgggcccgcugagccgcgcacugggcauguacagcaccgcgucucccaggcugauguucagcgggugcucgaucagc

SEQ ID NO: 4176754 - RNA, 71 nt, Human
gcacguccaugugaagagaccaccaaacaggcuuugugugagcaacaaggcuguuuauuucaccugggugc

SEQ ID NO: 4176755 - RNA, 75 nt, Human
gcacgugucuguacagaaugcuugguaaggcauggguguaaucaugcguauguguaugucugugugggcaugugu

SEQ ID NO: 4176756 - RNA, 66 nt, Human
gcacuaaaccaacauguaauaaguauuuaauaguuguucauugcuguuguuauuguugguuggugu

SEQ ID NO: 4176757 - RNA, 102 nt, Human
gcacuaaauuuaaauugacauaaguugguagaaaggacucugcuagugccauaauuuaggggaagcuccuaacuacggaaaugugugaauaggaaguauggc

SEQ ID NO: 4176758 - RNA, 85 nt, Human
gcacuaagcacuuccccacuaguggccccaugugguugugugucaucgcugacuaccuguuacaggugaggaagcuggguggugc

SEQ ID NO: 4176759 - RNA, 79 nt, Human
gcacuaguaaaucuaauauguauguguuuucuuuggauuucuuauaaaugaauucuucacauacuuuugguuacugggc

SEQ ID NO: 4176760 - RNA, 62 nt, Human
gcacuaguagaagguuuaugugggcauaauaagagugcccaagguggccuuuuacucugugc

SEQ ID NO: 4176761 - RNA, 56 nt, Human
gcacuauagcugcagcacagagcaaugauagcuaauauuugcugacagcugugugu

SEQ ID NO: 4176762 - RNA, 61 nt, Human
gcacuauguuaaucacuguaguuaagauaauuccuauuauaagacaugguugaucuagugu

SEQ ID NO: 4176763 - RNA, 75 nt, Human
gcacuauuagaauccaugguugcaguggccccugaagcccugcugaaucccauggagucugguuguuaacagugc

SEQ ID NO: 4176764 - RNA, 65 nt, Human
gcacucagagagcugggcuggagcuccaagcggaaaccgcgggagccgagcccagcuaggaaugc

SEQ ID NO: 4176765 - RNA, 66 nt, Human
gauguccugggucaaauccuggucccgccacuauuuucugugugaccuuugagugugacucauauc

SEQ ID NO: 4176766 - RNA, 64 nt, Human
gaugucuauaauaacucaucuuuugggaagcuaacuagcuuccaacaauguguuauuguucauc

SEQ ID NO: 4176767 - RNA, 65 nt, Human
gaugugaacagagcugacuacaaggcagaagaaauuaugccuuaguugcucucucugagaacauc

SEQ ID NO: 4176768 - RNA, 63 nt, Human
gaugugagggcagccccuuuguuggccaaugacaaguuacaugguuuaccccuguccuauauc

SEQ ID NO: 4176769 - RNA, 57 nt, Human
gaugugagggggaagaaugaagcagaaaaagacuguuucaugagauuccuccacauc

SEQ ID NO: 4176770 - RNA, 86 nt, Human
gcaggccuuuaucccugccucaacaaacagaaugguacaaaagugaugcucugugacuucugaggcuagguuagaaaaggccaugc

SEQ ID NO: 4176771 - RNA, 60 nt, Human
gcaggcguguuucacgugccagaaagcacaucuucuguguuaggcacaagcaugcugugc

SEQ ID NO: 4176772 - RNA, 79 nt, Human
gcaggcuaagagcacaguuuugucuugguuuccaguuugugcuccacuacuuaucagcugugugaucuuggccaagugc

SEQ ID NO: 4176773 - RNA, 61 nt, Human
gcaggcuaugaguuucucaccaacgugagaaaucaggaguggaggggaagcucuagccugc

SEQ ID NO: 4176774 - RNA, 81 nt, Human
gcaggcuaugugguuuuaggacugcaucccaccaacucagaugcugaugugggcagccuguccggagaccccacagacugc

SEQ ID NO: 4176775 - RNA, 81 nt, Human
gcaggcugaaggucaggcaggaugcccccacugguggguggcugaggagggucuucugguuggcagcacugucggccuagc

SEQ ID NO: 4176776 - RNA, 58 nt, Human
gcaggcugccaaggcuggggaggacaagguucccucuugaguucuuuaaaagcugggc

SEQ ID NO: 4176777 - RNA, 63 nt, Human
gcaggcugcugagauccuuaggcagcccagaacacaggcggccucgggucccuugcagccugc

SEQ ID NO: 4176778 - RNA, 70 nt, Human
gcaggcuggcaggaggaggugcuguaaugauggcaguagguuacugcagccaccaccucugcugaacugu

SEQ ID NO: 4176779 - RNA, 74 nt, Human
gcaggcugugugacacuggccaucuggguuucuuccccugacucccaaagcccagguccaguucacugcacugu

SEQ ID NO: 4176780 - RNA, 129 nt, Human
gcaggcuuuccuuaauauauaucacagacagcuuucugaguuauggucacagcacaaucagcuaucaaauugaaacuguuucccuccauaaccucagccuugaaguuuuuucuugauaugaaccuuugu

SEQ ID NO: 4176781 - RNA, 97 nt, Human
gcagggaaauggguuaggaggcaauugcaguagucagaggugacagugguuugcacuaguguacaagugguggagauggcucugucucauguccugu

SEQ ID NO: 4176782 - RNA, 71 nt, Human
gcagggaagacauggcugucucuuuuggccacugugguggacaggggcugcuguugucacugccucccugc

SEQ ID NO: 4176783 - RNA, 57 nt, Human
gcagggaagaucuuggagcugcuagaucuuuaagagcaaagucucaaccuuuccugc

SEQ ID NO: 4176784 - RNA, 65 nt, Human
gcagggaagugauggaguucgaucuguguuuuagacagaucgcucacauuuggcuucuagccugu

SEQ ID NO: 4176785 - RNA, 84 nt, Human
gcagggaggagaccacaggcagggagcuggaaaggaugccaggcccagcaaaggggaucucaguuaccuuccaucccgcccugc

SEQ ID NO: 4176786 - RNA, 70 nt, Human
gcagggagggcuugacaagggcuggagccccuggucaaggggcacaaccaguucuaucgggucaccuugu

SEQ ID NO: 4176787 - RNA, 67 nt, Human
gcagggaguguaaauggugcucagcggcaguauaauaucuucaugcccucuuuugcuugcucccugc

SEQ ID NO: 4176788 - RNA, 55 nt, Human
gcagggaguuggagaaggaguauuuuacuccuuuaaacuccuuucaagucccugu

SEQ ID NO: 4176789 - RNA, 73 nt, Human
gcagggcaagggcuggagaggaaagguugucucccauuccucaugggccacccugccuuuaagccuccccugc

SEQ ID NO: 4176790 - RNA, 62 nt, Human
gcagggcagagcugucuaaauggccagaugacugugguucauggcccacggcccugcucugc

SEQ ID NO: 4176791 - RNA, 119 nt, Human
gcagggccaagaccagagugaggcaggagccagccugccuuuguaugacccugagagugaugccuccuucaauuuugcacugaggcacgucaccugccucacccuagucccagcccugc

SEQ ID NO: 4176792 - RNA, 84 nt, Human
gcagggccugucccagcuuuguuccuggugggggcucccugguguggagcuccagcuggggccgaaguggaugacauguguugc

SEQ ID NO: 4176793 - RNA, 79 nt, Human
gcagggcgugcaggagggagggagcagugauuaagagccaaagcucgcaucagaccugucuccucuugccaagucuugc

SEQ ID NO: 4176794 - RNA, 63 nt, Human
gcagggcuauuggaaggagaugcugaauagaaagaaaagaggcacuugacagcccagcccugu

SEQ ID NO: 4176795 - RNA, 67 nt, Human
gcagggcucagguguuaccuccucuagggaccuugcuucuuuugugcccuacagcaccugugccugc

SEQ ID NO: 4176796 - RNA, 76 nt, Human
gcagggcugagucauauagccuucccacggcugcauauugugugaaaggacagggauuaugacugacagccccugc

SEQ ID NO: 4176797 - RNA, 56 nt, Human
gcagggcugagucaugugugccucuugcaagcucugggcaacaucucuguuacugc

SEQ ID NO: 4176798 - RNA, 72 nt, Human
gcagggcugcugaaacuuguuuguacaccucguguugaauuaaaguaugaauucagacucagcaacuccugc

SEQ ID NO: 4176799 - RNA, 56 nt, Human
gcagggcuguuuagugaauagggguacccuaccuuguucuagacuaguagcccugu

SEQ ID NO: 4176800 - RNA, 71 nt, Human
gcagggcuugcagcagcuagacuggcagcacacggggacacagcagcuggacuggcagcagcagggauugc

SEQ ID NO: 4176801 - RNA, 63 nt, Human
gcaggggaguucugagaggaacugugauuguccagaguggaguuucuuugagacuugcccugu

SEQ ID NO: 4176802 - RNA, 103 nt, Human
gcaggggcagaggcacggauaaccacauuugguucauugcaggcgccggggacaucacucaggcccggcaaggagccagucauccagacugcaugugcccugc

SEQ ID NO: 4176803 - RNA, 73 nt, Human
gcaggggcagugguccaggcuacagcuacuguuauggucagaaggcugauucucacugaccucuguugccugu

SEQ ID NO: 4176804 - RNA, 74 nt, Human
gcaggggccugaugggaucgggaucucuccggccucagggacggggaaggccgguccagucagguuuccccugc

SEQ ID NO: 4176805 - RNA, 56 nt, Human
gcaggggcuacucugagcuuccucacagccuggaggucuccggggaguagaccugc

SEQ ID NO: 4176806 - RNA, 73 nt, Human
gcaggggguauuucaguauuauacaacugcugugaccagacuuguauacuggcugaauaucagugcuguuugu

SEQ ID NO: 4176807 - RNA, 58 nt, Human
gcagggggugggaagucuagaauccaucccagagggugauucgauccccaucccgugu

SEQ ID NO: 4176808 - RNA, 68 nt, Human
gcaggggguuggggugccacaaaauuauuaagguguaaucaaauuggcuuccccuaccuuccaauugc

SEQ ID NO: 4176809 - RNA, 71 nt, Human
gcaggguaugggggaggugcuaccgagcucccaagugcucuccaggaacaccacccucccagcaccuaugc

SEQ ID NO: 4176810 - RNA, 69 nt, Human
gcagggugaaggucacauagaaacaguuuuuguucuugugcucuugcuuucuguugugaccucucuugc

SEQ ID NO: 4176811 - RNA, 60 nt, Human
gcagggugacguugcccaccucuggcuccacgcagaugcuggugaaguaacgcgcccugu

SEQ ID NO: 4176812 - RNA, 76 nt, Human
gcaggguggugaugggcaucaaacaugacguggaacauguccccuucauggaggguuuccaucuaaaugcaucugu

SEQ ID NO: 4176813 - RNA, 83 nt, Human
gcaggguucucagcagugauggagggcaggggagagauguaaaggcuuugagacugguucccaucgcuggaaagaggcucugu

SEQ ID NO: 4176814 - RNA, 57 nt, Human
gcagguacaggggcugccaugggguuuuuauauaccugugcaguccaaugugcuagc

SEQ ID NO: 4176815 - RNA, 88 nt, Human
gcaggucacgggggcgacugaucuucucccggguguuugcagggcacgcggcuuguccaugcguauccagggagcgucucuaaacugc

SEQ ID NO: 4176816 - RNA, 58 nt, Human
gcaggucuggcauagagccugcaugcugugcagaucccuacuuguuccccaggccugc

SEQ ID NO: 4176817 - RNA, 69 nt, Human
gcaggucuggugagagaacaguuaaagaaaccugaggacccgcucuuuacucugucuugagccaucugu

SEQ ID NO: 4176818 - RNA, 66 nt, Human
gcaggucuuagagagauguuauggcaacucaguucucuggguccuugcuaacuucuaugagccugc

SEQ ID NO: 4176819 - RNA, 56 nt, Human
gcagguggagcaguagucugguuccuaugagaggcagauguuuaggcaccaucugu

SEQ ID NO: 4176820 - RNA, 69 nt, Human
gcagguggccggcaguuuuagaaauccaagcacacuagggucucagagguuucugcucagcccccuugc

SEQ ID NO: 4176821 - RNA, 60 nt, Human
gcaggugucaguccccaagguggccaucauagcaauggagaccauuggaaugacaagugc

SEQ ID NO: 4176822 - RNA, 55 nt, Human
gcagguguccugggcuggcaguacugcccaccugcugccccaggccugcaccugc

SEQ ID NO: 4176823 - RNA, 93 nt, Human
gcagguguccuuaaguagggagaggcaggcaaccaccugggaagauguuaaaugcacacauccccggguucugucugcccuuggagauucugc

SEQ ID NO: 4176824 - RNA, 59 nt, Human
gcaggugucugacugccuucuucacccuccagucauugaggucugagcagaugaccugc

SEQ ID NO: 4176825 - RNA, 58 nt, Human
gcaggugugcagcccuggaggaggccuauggguauuccagugugugcagauuaagugc

SEQ ID NO: 4176826 - RNA, 85 nt, Human
gcagguguuggagagcaguguguguugccuggggacuguguggacugguaucacccagacagcuugcacugacuccagacccugc

SEQ ID NO: 4176827 - RNA, 104 nt, Human
gcagguuagaagacacaagcaaagacaguuugaguggagaugugaugaggcggucaucaaacaguccuucaaauaaguuguuuuguugguuuuuuacaaucugc

SEQ ID NO: 4176828 - RNA, 118 nt, Human
gcagguugguggcacauguuuuuauugcuguucuuuaaaugaagguccugacacugcaagaugaacucagggaugccucauucagaguuacaccagugcuuuacucccacucuucugu

SEQ ID NO: 4176829 - RNA, 73 nt, Human
gcagguuucugauugcucuguuucugaugcuguccaaaguuacagagccagucagucagaaacucucuccugu

SEQ ID NO: 4176830 - RNA, 88 nt, Human
gcagguuugcucacaugaaauuuuguacugccacagcugacgugggcucgacuccauucacuggcagacagaacucaggcacaucugc

SEQ ID NO: 4176831 - RNA, 71 nt, Human
gcaguaaacuaguuuuagcucuagcaacugaagcagccauucuacaguugagauugggauaguuugccugc

SEQ ID NO: 4176832 - RNA, 63 nt, Human
gcaguaaagcucuuaaugagauuauccaggauugggacuauuuccuuugagaguuucauuugc

SEQ ID NO: 4176833 - RNA, 59 nt, Human
gcaguaaauaggucgauugugacaaaaagguuucagucguugcaauugcuucuugcugc

SEQ ID NO: 4176834 - RNA, 86 nt, Human
gcaguaacaauguccagggccagagcuuggcagcugggggccaccagcggccugcccugcccucuggucucccacauguaggcugu

SEQ ID NO: 4176835 - RNA, 75 nt, Human
gcaguaagaggaaguuuauauuguaauuguaucaugaaaaugagaaccauaauuuacaacugcuuuuaauacugc

SEQ ID NO: 4176836 - RNA, 67 nt, Human
gcaguaagugaggaagucagaaauucuugucuuuccacauguauugucugacuucuuuaguuacugc

SEQ ID NO: 4176837 - RNA, 73 nt, Human
gcaguaaugaggagcccagcaccaucacuuggguaauagagaacaaguggggaaccuggacuucuaccucugc

SEQ ID NO: 4176838 - RNA, 77 nt, Human
gcaguaccaaugcuuggauucuggggugggcuaugaccucauuuggccaguuuccaccuaggcaauuuguguccugc

SEQ ID NO: 4176839 - RNA, 96 nt, Human
gcaguaccucuggcuucuucaggaguccaucuggccugguggaguuuugccuaaguuuccacggccuguaaggacccaggagcagaaacuggcugc

SEQ ID NO: 4176840 - RNA, 73 nt, Human
gcaguacuccuggauuuucuaagacaauuauuauuugaaauagucugucuaauauuauucaggcauguguugu

SEQ ID NO: 4176841 - RNA, 66 nt, Human
gauguggaugaucuuagaugguuuaguagguaaaauaaugaucugccuaagagguccuuccacauc

SEQ ID NO: 4176842 - RNA, 71 nt, Human
gauguggcugcucuaaagcccauuuuuaucuaaauauuuacaacaaaguuggucugcugaacagccguauc

SEQ ID NO: 4176843 - RNA, 96 nt, Human
gauguggugaugcaugucuauaguucuagcuacuugggaggauggccugaacccagggguucuagaccagcuuagacaacauagcaagaccacauc

SEQ ID NO: 4176844 - RNA, 61 nt, Human
gauguguaacaugcugugacauggguguugucaaaagcacuggacaggaauauugcauauu

SEQ ID NO: 4176845 - RNA, 59 nt, Human
gaugugucccuuucaacucagacuuuucauuuuagagaauggggcagauggggcaaauc

SEQ ID NO: 4176846 - RNA, 70 nt, Human
gauguguuccugaggguuccaucucagcaugaccacaugaguacagcaaagaaacccucagucccacguc

SEQ ID NO: 4176847 - RNA, 69 nt, Human
gauguuagaaacaaguuucucuuugggacaauguguauucuccuugcagaguuuuuguuuccuuccauc

SEQ ID NO: 4176848 - RNA, 77 nt, Human
gauguuagaguagaugaagggagagcguagauacaguggcuguagugcucuguucuuccuacauucacauuaaaauc

SEQ ID NO: 4176849 - RNA, 92 nt, Human
gauguuccaggcuccuccuucuucccccagcccugcuccaacaaguuucccaaacuacagcaggcccaagcuggggggaaggagggaacauu

SEQ ID NO: 4176850 - RNA, 89 nt, Human
gauguucgaugccaagaacaugauggccaugugcaacccgcgacauggccgcuaccugaccauggccaccguguuccgggccgcauguc

SEQ ID NO: 4176851 - RNA, 61 nt, Human
gauguucugcuaguggcuuugggauacacacaguucagcagauaaggcacaggagaacauu

SEQ ID NO: 4176852 - RNA, 55 nt, Human
gauguucugggcagagcacaaaaaggcugguagucagguguucucuucagaaauc

SEQ ID NO: 4176853 - RNA, 61 nt, Human
gauguugccuugguuuaugcuagggcacccacccuugccuuugcaccaucagugcaauguu

SEQ ID NO: 4176854 - RNA, 61 nt, Human
gauguugucugagugcuggguggucugucccugugcugugcccugugcucaugggaacauc

SEQ ID NO: 4176855 - RNA, 84 nt, Human
gauguuuacaggagaaacaguguuuuugcuuauauaugugugaaaguguaugaagccagaaucuguuuauaacugguauauauc

SEQ ID NO: 4176856 - RNA, 75 nt, Human
gauguuuaguuauacaguuuugggucugcuauguugauggcuccucuuuuuaaaacuguauacauaaguaauauc

SEQ ID NO: 4176857 - RNA, 91 nt, Human
gauguuugguccccaguguucccucggguucauggggaggauggcuuggagggggcaaacauggagucgggggaacauaugggaggcuguc

SEQ ID NO: 4176858 - RNA, 70 nt, Human
gauuaaaaauaacccaugcugaaagcaggagagugaccuuugcaaaagcaguaaugggauauuuugguuc

SEQ ID NO: 4176859 - RNA, 110 nt, Human
gauuaaagacuuuugaaagauaugcguacuauauacuguguauuuugagugaaaaaaaucagagagcacaauuauuuaugcaguaugacuuuaguuuuauuaguuuuuuc

SEQ ID NO: 4176860 - RNA, 95 nt, Human
gauuaaagcaguaauuccaaugcggguggggguucagauucagaaauacuggaaagcuuuguuuuccucacccugugucuuggaaccgccggauc

SEQ ID NO: 4176861 - RNA, 60 nt, Human
gauuaaaucacgugccuaaagauacacagcuaaguauuggagcugggauuugauuugauu

SEQ ID NO: 4176862 - RNA, 64 nt, Human
gauuaagaguuaucagagagagcuuacuuucaaguaaguuuaacccucugggacuaauggaauu

SEQ ID NO: 4176863 - RNA, 80 nt, Human
gauuaaucucucuagggcauuugcucuuaauaaccaugaaucguuguuucauaagcuugaagccuuggcgagauuccauc

SEQ ID NO: 4176864 - RNA, 106 nt, Human
gauuaauuuauuuuuauuuugcauguuuuaaggcuguggggauuacugcucugaagcagauccaaauauaguucuugaauucuauguagagcugaaagaaucaguc

SEQ ID NO: 4176865 - RNA, 89 nt, Human
gauuacaccucuuuaccucuucgugcuucagaaauuauuuuccuucaaguguucuaagaggcuaaugaagaaugaagucauguuuuauc

SEQ ID NO: 4176866 - RNA, 59 nt, Human
gauuacagccuggcuucccaccagggacuccucugagugagacaccaaaggcuguuguc

SEQ ID NO: 4176867 - RNA, 120 nt, Human
gauuacagguuaucucuguggccagguccaauauggucaggcuccuagacucaucccauugggcuauccauggaucugaacucauaugugucuuggacccacagggaucaauccuuaguc

SEQ ID NO: 4176868 - RNA, 78 nt, Human
gauuacaguauagggcuuauauuguaugagucuuagagaaguuggauucuacauagcugguggccuuguagcuguguc

SEQ ID NO: 4176869 - RNA, 94 nt, Human
gauuacauagaaauguuaaaguuuacagugcacauggguugggccaaagaaagugcuugacacaugugcguagacucuuuauugacugcggauc

SEQ ID NO: 4176870 - RNA, 63 nt, Human
gauuacaugggcuugugaguccuuucaacauggauaggaaaggaaccucuaagccucuguuuc

SEQ ID NO: 4176871 - RNA, 89 nt, Human
gauuacauuucaguuaauugggagugaaagcguugugaucaagagugagaacaaugcguauuuuacuccaaucuagcuuaagccuaauc

SEQ ID NO: 4176872 - RNA, 91 nt, Human
gauuacucaaugcagucucuauuuguuucuuguucuuuuguccuuagggcuugucccacuagaaagguacagauuaugguguuugacaguc

SEQ ID NO: 4176873 - RNA, 79 nt, Human
gauuacugggagaaaauuacugugacuagccaucugguuucccagccaauacuguugauucauagugcuucuaguaguu

SEQ ID NO: 4176874 - RNA, 77 nt, Human
gauuacuguuuacuucaauuauaugccaguuauauauacuccugacugguuuucuugauugaacauagaccuugguc

SEQ ID NO: 4176875 - RNA, 68 nt, Human
gauuacuugguggauaacagcugggauuugggacuucccccaaagauuccuuuauucuccaagugcuc

SEQ ID NO: 4176876 - RNA, 75 nt, Human
gauuacuuuuauugaugcuuggauugggccaucucuggccaguuggcucuuucugacacagcccuaagagugauc

SEQ ID NO: 4176877 - RNA, 61 nt, Human
gauuagaauugaggagugaccuuugcauucaucaauaugaaggucaacacugauuuuaguc

SEQ ID NO: 4176878 - RNA, 64 nt, Human
gauuagagguacaaaccuucacuuccccaccuccacuuagggaaagagguguuugacuucaguc

SEQ ID NO: 4176879 - RNA, 66 nt, Human
gauuagauacaugacucacacauucugcagucguauuuugcaguaaauugagagucauguuugauc

SEQ ID NO: 4176880 - RNA, 67 nt, Human
gauuagcuaaacucucagguucuuuccagcucagauguuuuuggauucugagagucugugcuuaguc

SEQ ID NO: 4176881 - RNA, 61 nt, Human
gauuaggacauggauguauguuuggagggccacuauucaaccugcuacacuuguccuaauu

SEQ ID NO: 4176882 - RNA, 66 nt, Human
gauuaggcuaaaggaacugcugcuauggaaccagcauggugcuaaggaugaggauucugccugauc

SEQ ID NO: 4176883 - RNA, 101 nt, Human
gauuaguaugguaaaaguauauaugcacuuuagaaugaggauuuaauucuaauacuacuucacuucuuccugguagcauauuacuuaccuaugccucaguc

SEQ ID NO: 4176884 - RNA, 74 nt, Human
gauuauaggaaccucugcaaugcaaugucaugaccacugggguuuggcauuggagaugcaagaaccuaaauauc

SEQ ID NO: 4176885 - RNA, 124 nt, Human
gauuauaguuuguaacauguuugaaacagaagcuucgaaagagugauuucucaacuuaguguuaaaugauuuugucugaagucugacucuuuguaagcuuguuuguuucaucaaauuuuaaguc

SEQ ID NO: 4176886 - RNA, 88 nt, Human
gauuauccucgaaauucuguaguuugaauuuaggcauuuucgguuuuaugagagugauugguucgaauguacuaauuugaagguuguu

SEQ ID NO: 4176887 - RNA, 76 nt, Human
gauuaucugaguggggagagguaucauugagaucccaccuaaucacaaaggaucacaaucccucucucugauauuu

SEQ ID NO: 4176888 - RNA, 60 nt, Human
gauuauggcugcagaucaagggcaggcauuuaugccuccucccaguuuauagcagugauc

SEQ ID NO: 4176889 - RNA, 69 nt, Human
gauuaugggcuucugaaccaggcccuggauauggcuauguacauauuuccuuucuagaagccuaaauuc

SEQ ID NO: 4176890 - RNA, 93 nt, Human
gauuauuaacuaaauauuuguuuugugcauuuacaacauggaguugcugcuuuaacacuauuugaaaguguacaaaaacugucagugauaauu

SEQ ID NO: 4176891 - RNA, 69 nt, Human
gauuauuccaggcacagaaggaggguugauucugccauuuucuugcuguuuucuuguccugguauaauu

SEQ ID NO: 4176892 - RNA, 78 nt, Human
gauuauugaacagaaaccaucagagugccuucuuauaaaauaauugaccacucagaugcaugguucuguuuagaaauc

SEQ ID NO: 4176893 - RNA, 124 nt, Human
gauuauuucuaggccuuccuguagucucuaaagcuguuaucuaaguguagacuaaaagaggucaaugacuuggccuucuauauuccagauacagauuaggaggugccggaggcuuagcauaauu

SEQ ID NO: 4176894 - RNA, 56 nt, Human
gauucaaaguuaaugaagaugccucauuucguugguuucuucgaugauuuuguguc

SEQ ID NO: 4176895 - RNA, 72 nt, Human
gauucaaguaaaguagcgccuaacuaaugugggguuucuuuucaaauuauuuacugcuauuguucuugauuc

SEQ ID NO: 4176896 - RNA, 78 nt, Human
gauucaaguucccugggggcucauauauaggaauggucauaccccuaaucugucugugaccucuuuggagccugguuu

SEQ ID NO: 4176897 - RNA, 78 nt, Human
gauucacaaauaacaggugcagagacuccgccaccugccuccgugggacaucgcucugucacuuuuauuuacugaauc

SEQ ID NO: 4176898 - RNA, 63 nt, Human
gauucacauuguuaauuuagccauuuugaaauucagaugagugagcaaguugauaauggccuc

SEQ ID NO: 4176899 - RNA, 57 nt, Human
gauucagagguggcagggguguccagcagggcugggugucaggagccaguucuaguc

SEQ ID NO: 4176900 - RNA, 83 nt, Human
gauucaggcuccugaggguccuuguuguacccuaagcaccaaaauugcuaguuacagaucuaggacuguuuuuuccuagaauc

SEQ ID NO: 4176901 - RNA, 61 nt, Human
gauucagggucaccagagaucugcaugaaguuuauauuuagcagcugucguugcccgaauc

SEQ ID NO: 4176902 - RNA, 111 nt, Human
gauucauaagaaagaguaaaaggagguguuugauagcugaaaagaauaggcaagcuuuccuuucugauaauuuugugaaaucacuuccuuuauaugacuuaaaauuggauu

SEQ ID NO: 4176903 - RNA, 76 nt, Human
gauuccaaguccugccagcugcuucccucugagcucacucauggcagcaaaugucuggcuggggcugaguggacuc

SEQ ID NO: 4176904 - RNA, 77 nt, Human
gcaguagggaauuagaggcagugaauggccagguuuuuuuuaagagccucaugcugcaucucugagguccuaucugc

SEQ ID NO: 4176905 - RNA, 65 nt, Human
gcaguaggugaaggccuggggccgauguggggcaccuugucauguaggucugccuuaucugcugc

SEQ ID NO: 4176906 - RNA, 61 nt, Human
gcaguaguccauaaguacucugcagggauaucucaugucagaagcaccuguugacugcugc

SEQ ID NO: 4176907 - RNA, 55 nt, Human
gcaguauaaguggauuauguccuucauagaagggaaguagaaucaguugugcugu

SEQ ID NO: 4176908 - RNA, 63 nt, Human
gcaguauauccauuacuucauaugaugauuucguuuaacuugaaaaaagugauggaugacagc

SEQ ID NO: 4176909 - RNA, 67 nt, Human
gcagucaccugaagacuugaccauggcuagagaaucugauuugaugauggcucaucuacaggacugc

SEQ ID NO: 4176910 - RNA, 76 nt, Human
gcagucagagggaacaggaguuaaccaugggaaguugggaugcuaacagccccaggcucuccacccucugugcugc

SEQ ID NO: 4176911 - RNA, 67 nt, Human
gcagucaggugacgugauugaaauguuagagcugagauucaaacaacucauuuaugcaagcugaagc

SEQ ID NO: 4176912 - RNA, 65 nt, Human
gcagucaguagcugacuucacaacagagacccgacagaagcccuuucugugauaggcugcgacgc

SEQ ID NO: 4176913 - RNA, 59 nt, Human
gcaguccuagggugcucugcagaguucccagacagcuugcagguggcuccagggacugc

SEQ ID NO: 4176914 - RNA, 58 nt, Human
gcaguccuuaugagaugcugccuuccucuuuuuugaaaggcauagaugauaaggaggu

SEQ ID NO: 4176915 - RNA, 55 nt, Human
gcaguccuugcuguguaauaaauauggagucacauuuguucacacacagggcagc

SEQ ID NO: 4176916 - RNA, 92 nt, Human
gcagucgguuagacaaaagggggcagauaugaauuucaccaauugguuuucuuauuguccugcuuuuguuuuguuuuguauuaaaugacugc

SEQ ID NO: 4176917 - RNA, 61 nt, Human
gcagucucucaggauuuaagcucgacucucuucccacacaguuccugucugaggaggcugc

SEQ ID NO: 4176918 - RNA, 73 nt, Human
gcagucugaauucuguguaacucuauccucauucauaccacauuuuggguggcuucggggaauuugagauagc

SEQ ID NO: 4176919 - RNA, 69 nt, Human
gcagucuuauuagguuaacccugcucagugaaagcaagcaggcuuacuuucugauuagauaaaaugugc

SEQ ID NO: 4176920 - RNA, 114 nt, Human
gcagucuuuacgaugacuuucuuguagugucugaugaggucugugugaaaauuuacaguuaaacacauacacacacagagagauuauucauugucccaaucucagaaggacugu

SEQ ID NO: 4176921 - RNA, 70 nt, Human
gcagugaagauggcagguugggauugcauaaccuugaccagcgcuuguccuuccuucccucuucuucugu

SEQ ID NO: 4176922 - RNA, 64 nt, Human
gcagugaagccucggaaccaagcuccaaacacuucugagggccgugucuccaaggcuucccugu

SEQ ID NO: 4176923 - RNA, 85 nt, Human
gcagugacucgggaugggcaggcaagguggcgaguccccugugaugguggcuuucacuggugucugcguucagccuguaacaugc

SEQ ID NO: 4176924 - RNA, 69 nt, Human
gcagugagaugauagcaggagacaaaugaacacaucacccaaccucucugggccuguuuucucaucugc

SEQ ID NO: 4176925 - RNA, 63 nt, Human
gcagugagcagugaguguggugcaggguuaggagcaggcccucagcauccucaugcucagugc

SEQ ID NO: 4176926 - RNA, 62 nt, Human
gcagugagcuaugaucauguuacuacccucuaggcugcagugagucaugaucaugcuauugc

SEQ ID NO: 4176927 - RNA, 62 nt, Human
gcagugauuccagcaucagaagaugugcugguccagccggccccucugcugcugcguccugc

SEQ ID NO: 4176928 - RNA, 72 nt, Human
gcagugauuuguuacagcagugauuucagacuaauacaugcuuucucugagaaugccuuugaacaucacugc

SEQ ID NO: 4176929 - RNA, 72 nt, Human
gcagugcacacuuuaauagcccguauuccacgugaaagcuaugugucuucuguggguuugaacuguuucugc

SEQ ID NO: 4176930 - RNA, 62 nt, Human
gcagugcagugggacagggcgcccuccauucuguucugcccugcccuguccucuugcuuugu

SEQ ID NO: 4176931 - RNA, 89 nt, Human
gcagugccuucaaacacccaggcuauugugcagcguguugcuacugucugugaugccugcgaggcaugggugagaggaggaggcggugc

SEQ ID NO: 4176932 - RNA, 57 nt, Human
gcagugccuugcuucucugucucccugcucaggagacagggcucccagcaggucugu

SEQ ID NO: 4176933 - RNA, 59 nt, Human
gcaguggagagccacaucgauucaccuguguucuugaucuuacaguguucuuccacugc

SEQ ID NO: 4176934 - RNA, 66 nt, Human
gcaguggcaagagccuggucucgggaaccacacagaccucagcucaaauccaggcuccaucacugu

SEQ ID NO: 4176935 - RNA, 57 nt, Human
gcaguggccacauggaggaggaggcccacccggaacucugcccacacuggccacugc

SEQ ID NO: 4176936 - RNA, 85 nt, Human
gcagugggaggaggccuugaggccaggagcugagugagagccaggacucucagagacgcuggguuugggccuuuuccagacgggc

SEQ ID NO: 4176937 - RNA, 59 nt, Human
gcagugggauugggauuggaaccuagguaguuuaguuugggagucacauucuuuacugc

SEQ ID NO: 4176938 - RNA, 100 nt, Human
gcagugggcuacccaggcccugggagcagagaugcaaaaucggccccucgcccuugucuugccuucucugaucuccagggccagaggguggggccagugu

SEQ ID NO: 4176939 - RNA, 70 nt, Human
gcagugguccaguucacacccauguuggucccuggccaccugugcuguguggguguucuggcccagcugc

SEQ ID NO: 4176940 - RNA, 58 nt, Human
gcaguguagacuuuaguugaugauuccgguggggagaccaaagugaaauuuacauugc

SEQ ID NO: 4176941 - RNA, 67 nt, Human
gcaguguauuccugcugaaaaucuuuaacauacuguugaaaaucuuuaguagaggaauauauucugc

SEQ ID NO: 4176942 - RNA, 63 nt, Human
gcaguguguagaguuuaggaaauaaaacucuuuguuuuucugcuucuuucaucuacacguugu

SEQ ID NO: 4176943 - RNA, 62 nt, Human
gcaguguuaccuugggcugguuccuccaccucuaacagcaucuggcccaugguaaaugcugu

SEQ ID NO: 4176944 - RNA, 64 nt, Human
gcaguguucuugcugaggagucugggcaugagcagaugcuccaggccuucugaggacacucugc

SEQ ID NO: 4176945 - RNA, 61 nt, Human
gcaguguucuuguugcuuuuauggagaagaagauuuuuggaaguaauauugggauuacugc

SEQ ID NO: 4176946 - RNA, 57 nt, Human
gcaguguugguuugcucugcagccuuucauuuugcugccgucuuaccaaacagcugc

SEQ ID NO: 4176947 - RNA, 88 nt, Human
gcaguuaacauuauuguauuaauugaaaugaaugcugacagagauuuuguuggcuuuacaacaaauugaauauggauaauguaaccgc

SEQ ID NO: 4176948 - RNA, 69 nt, Human
gcaguuauguauguguuugagaaguguuucuaauguauucgcaacacucagacacagacauacacaugu

SEQ ID NO: 4176949 - RNA, 57 nt, Human
gcaguuccucaaagguuaaauguaaaguuacauauuuacauaugacccagcaacugc

SEQ ID NO: 4176950 - RNA, 70 nt, Human
gcaguuccugugcccuguucuuuccggggcugcccccugcuuuucgggagccagcagggcauggagcugc

SEQ ID NO: 4176951 - RNA, 70 nt, Human
gcaguucgugccuaagcgcaagugcccgucuauuccgugggggcugccugugcccaggcacacacgcugc

SEQ ID NO: 4176952 - RNA, 76 nt, Human
gcaguucuaagaauguaugggugagaaaguugaccucuuuggauuaacacuugaacucuacauguugggucuuugc

SEQ ID NO: 4176953 - RNA, 62 nt, Human
gcaguucucagccaggcggcaggcggagcccagcagcgggugccuguccuuggcugcacugu

SEQ ID NO: 4176954 - RNA, 56 nt, Human
gcaguugcaggauuuguguuguuuaaagcacacacacaaacacagcuuguaucugc

SEQ ID NO: 4176955 - RNA, 70 nt, Human
gcaguuggcugugccugugcucuguaugucuucuccacucuggcauccaggccgcaggggcagccccugc

SEQ ID NO: 4176956 - RNA, 69 nt, Human
gcaguugguagcaggcaagcuuucuccugggugucgccuugaaaaguugcaaaauugcucuucaccugu

SEQ ID NO: 4176957 - RNA, 56 nt, Human
gcaguuguuaaauacaugagccauuuccuauggcaucaaguacuuuugacaagugu

SEQ ID NO: 4176958 - RNA, 61 nt, Human
gcaguuguuaagagccaggacugcugcagcagguaguaaacuccuuuggccuuagagcugu

SEQ ID NO: 4176959 - RNA, 92 nt, Human
gcaguuguuuacugaguacuuguuuugugcugaugcuuauacuaagcaccuuaaagcuugugcuguaguauuuaauccuucaaucuuccugu

SEQ ID NO: 4176960 - RNA, 83 nt, Human
gcaguuguuucacaaggcaguuggacuucacuuugagaagcacugcucuuaaagcuuacuucaauugugccuuaugggucugc

SEQ ID NO: 4176961 - RNA, 130 nt, Human
gcaguuucaggaaagucugccaggcaugagcugagaccuuaagagaugucagcuagaauuagccacugucaguauaucugcuucugggucccacucuucauccugcuuuucaagguuuucaaauauacac

SEQ ID NO: 4176962 - RNA, 67 nt, Human
gcaguuucaggauucugugucugacaauguuagccaaggcuauuugguagaagaauaugaguauugc

SEQ ID NO: 4176963 - RNA, 58 nt, Human
gcaguuucucucaauaagcaucgauugagcagcuauucgacgcuuaacagaggacugc

SEQ ID NO: 4176964 - RNA, 80 nt, Human
gcaguuugacagccucaaaagauacuugcaucuaacugggagcaucuuaguaagaaugcuuucuucagucuacaaacugu

SEQ ID NO: 4176965 - RNA, 83 nt, Human
gcaguuugcaaagugguauaagucugaagaucagaugaaauagcacugguuuaaaagacauuaugcuuaaaggcuuugccugc

SEQ ID NO: 4176966 - RNA, 65 nt, Human
gcaguuugucuugauucagaacacguugcccaaccuucagcgugguuggauuuugggccagcugc

SEQ ID NO: 4176967 - RNA, 87 nt, Human
gcaguuuuaaagucuacuaauuuuauucuauguguuuaaaaaaauugauaugugaauggcaguuggauagcacucuaaaaagcuagc

SEQ ID NO: 4176968 - RNA, 55 nt, Human
gcaguuuuaccugagcugcuggagaauccccagcaaagacucugccaaaaacugc

SEQ ID NO: 4176969 - RNA, 103 nt, Human
gcaguuuucuagaaagugagucaaguauaucuagucauuaggaauuuauguguccuuugcgcuuuguugaacuaauauauaaacucacuuuuagaaaggcugu

SEQ ID NO: 4176970 - RNA, 110 nt, Human
gcaguuuuuaacaguuuaugauuuucacugaauguguguguguguugugugugugugcauacaugcauacguguguuuaaaacaaauuugaagucaacugcagaaaacgc

SEQ ID NO: 4176971 - RNA, 55 nt, Human
gcauaaauuuggccugggcuggcauauuaaagcugagucacauccauuuuugugu

SEQ ID NO: 4176972 - RNA, 77 nt, Human
gcauaacagguuuuucaaggauuaucuugcuaguuacguaaauagcaagagacuuauguggaaaccugugauuuugc

SEQ ID NO: 4176973 - RNA, 114 nt, Human
gcauaacugauuuuuuuuuuaagaagguugaaugacuacuuuuaaaagucuccuaagaguugagaauggaaaauuuccuuggaccauuuuuuaaaagaaaaucuagaagaaugu

SEQ ID NO: 4176974 - RNA, 130 nt, Human
gcauaacuguguaugaguaauggucagagguauuuuacuuacgcaugacuuuggacuugcuagcucuaguucaaauggaugagaagucauguggaagaauaaccuuggcagguacuuguuauaaacaugu

SEQ ID NO: 4176975 - RNA, 90 nt, Human
gauucccaggagaauauaauguucuuguaagaguuuuguaucuuguuuacuaaugaaaagagagaauaugguguauauucuuggggcuuc

SEQ ID NO: 4176976 - RNA, 117 nt, Human
gauucccauuuggcucgacuuccuuucuuuuugcuuucuguugaacagagucugaagaauauagucaagaccucguguucacgcaggacguuuagcuaggagagcaucuuggguguc

SEQ ID NO: 4176977 - RNA, 64 nt, Human
gauucccuggaggcagagcagagcucuugucuuugcaggagcugcagauucugccuuggguauc

SEQ ID NO: 4176978 - RNA, 118 nt, Human
gauuccuucaacuauuuuauucuuuugugauguauauacuuuuguaaguuggcugaaauccuuuguggauugaggugaggguaaauauaggcaaaggaggaaaaugaauuauggaguu

SEQ ID NO: 4176979 - RNA, 75 nt, Human
gauucucauaggagcgcaaacccuauugugaacagagcaugugagguauauagguugcugcuccuuaugagaauc

SEQ ID NO: 4176980 - RNA, 81 nt, Human
gauucuccauguucucucuccuuuugaagugacccuagaagucauauguuaaggauggcagagcugaaagauggaagaauc

SEQ ID NO: 4176981 - RNA, 67 nt, Human
gauucucccuggcucugagcccaccuccagggugacacucaaacuuuaggagugggagagcgagauc

SEQ ID NO: 4176982 - RNA, 115 nt, Human
gauucucuagucacauugccuagucauggucuugugagaguaacaguuaguggauccaggcuuugaacucugcuuuauacagaccuaguaaucuaggcagagacuggauugaauc

SEQ ID NO: 4176983 - RNA, 58 nt, Human
gauucucuuuucucuguuucaauagaucuauccaagcugacucagggaaaggagaauu

SEQ ID NO: 4176984 - RNA, 66 nt, Human
gauucugagccacagagcuauuucucuacuuccucuagaggcugagauguggguuuguucaguguc

SEQ ID NO: 4176985 - RNA, 63 nt, Human
gauucugaugcaaggagccacuauacucugaaaaucacagcuuaauggaacuugcucaaaguu

SEQ ID NO: 4176986 - RNA, 63 nt, Human
gauucugggaaguuggcagccagcugcacuaggagugaguuaugaugucagcuuuccagaauu

SEQ ID NO: 4176987 - RNA, 95 nt, Human
gauucuuauuuucucccauacaaagucuuggguucuaggcugggcgcgguggcucaugccuguaaucccagcacuuugugggaggcaggacgguc

SEQ ID NO: 4176988 - RNA, 79 nt, Human
gauucuuuaaaagucuugggaaauaaacagauugacuuucacuuuacaugguuuauuuaccuaaggaccaaagagaauu

SEQ ID NO: 4176989 - RNA, 56 nt, Human
gcaguccuccugccucagccucccaaagugcuggaauuacaggcaggagucacugc

SEQ ID NO: 4176990 - RNA, 55 nt, Human
gcaguccugggauucuguccuuauuauaaaaggccaugggucuuuaaaggauugu

SEQ ID NO: 4176991 - RNA, 59 nt, Human
gcagucuaaauuggagccgcaggacccaguguucugaguccuggcguccaauuuccugc

SEQ ID NO: 4176992 - RNA, 100 nt, Human
gcagucuagccagggcccgugugccauuacaaugaaguaauaauguauuuauaacacaccuaaccacugauggcuucuauugcuguggcauucccucugc

SEQ ID NO: 4176993 - RNA, 66 nt, Human
gcagucugaccccagaaucuaugcuuuacaccacugucagguagagauaauggggggaaaaagagc

SEQ ID NO: 4176994 - RNA, 56 nt, Human
gcagugaagauuugggcucuggagucaaaauaucuaggaucaaauaaaaucucugc

SEQ ID NO: 4176995 - RNA, 78 nt, Human
gcagugacaucacuccaggguugggcuugggcuggcugugcucagcugagccccuguacccugagugcuucccacugc

SEQ ID NO: 4176996 - RNA, 69 nt, Human
gcagugaccuucgagcugcggguuguuggagcauccuccugccugauacacugcggugcgaggugcugc

SEQ ID NO: 4176997 - RNA, 78 nt, Human
gcagugacugaaccaccccggagcagacggcgggcgcuccacagaggggccuuccugcugcuccgggccgagcgcugc

SEQ ID NO: 4176998 - RNA, 66 nt, Human
gcaauagucucucccacaccauccuauuuccuuggauaugaggcauauugcuggagaugacugugc

SEQ ID NO: 4176999 - RNA, 129 nt, Human
gcaauauacacaagguaauguuucucaaagaguuuccauugaaaugcuaauuccucacagugccccaugaaaaaggaauucugcauguucaguuggguuugagaaaugcugcaucugguauccucucuu

SEQ ID NO: 4177000 - RNA, 59 nt, Human
gcaaucaagacaugcaauugccacuuuaaucuugaagauggugguucauauuuucuugc

SEQ ID NO: 4177001 - RNA, 120 nt, Human
gcaaucagcaucuaugaaucucacuuaacagaacauauuggugauuagccaaugcuaaaacaagugacugucagcauggggcaaugcaugugcuucugcagugaaaauagaucuuauugc

SEQ ID NO: 4177002 - RNA, 66 nt, Human
gcaaucaucuggguuaaugugcucagccaguacauggaugagcuacuuuauuagccaagguacugc

SEQ ID NO: 4177003 - RNA, 81 nt, Human
gcaaucgauuuaggcugguauucacaauauuuaaagagucaccuucugacuuuuaacaaugugugaugcucagaggauugc

SEQ ID NO: 4177004 - RNA, 63 nt, Human
gcaaugaaaaugaggacuccuguaagcaagcaaagcgcgcgcggcugucauuauuuccgaugc

SEQ ID NO: 4177005 - RNA, 60 nt, Human
gcaaugagagagugcuuuuuacaaugauauaguaguuuacuguagccagccucucaaugc

SEQ ID NO: 4177006 - RNA, 62 nt, Human
gcaaugggcaauuugccuacacacuucaugaaucaacauuuauugggugcagugcccacagc

SEQ ID NO: 4177007 - RNA, 77 nt, Human
gcaaugguggcaauucaaagacagcaccaucaacacacugcuuggcuugcccuuccucuggauugccuucauuuugc

SEQ ID NO: 4177008 - RNA, 59 nt, Human
gcaaugucugugcuaaaaacugggaauacaguggucaaaaauuuagacagacauccugc

SEQ ID NO: 4177009 - RNA, 82 nt, Human
gcaaugugguuuccccuugcuacccuugccugccaggugaccuguugugucuccauggcuugcaauggaguggggccaaugc

SEQ ID NO: 4177010 - RNA, 117 nt, Human
gcaauucacauucacugcauucauagcccaaaagaucaaauauauuaugccacaguccaaguguucauuguaauugugugcacauguaugggugugugugugugugugugugugugu

SEQ ID NO: 4177011 - RNA, 73 nt, Human
gcaauucacauugaagaaauuuuaagucaugauggcaaugggaacuugaaacaucuuuaaauguagagcuugc

SEQ ID NO: 4177012 - RNA, 86 nt, Human
gcaauucccacaugucagagggccaucucuaucuucagagaagacacuuugaaauaaggcucuucugaaauuugacauggaaaugu

SEQ ID NO: 4177013 - RNA, 126 nt, Human
gcaauugacagaucacuagauaaaagaguuucugaugcuguguccuagugaaagaaucagguuuuuucaguugauauucggcaagucagugaacuaacggguuaucugaauugcccuugcaauugc

SEQ ID NO: 4177014 - RNA, 76 nt, Human
gcaauugcagggucuuaagugcuuugugucuuucugaaggaaagacacuugagguuuuuaggugcgccugcagugc

SEQ ID NO: 4177015 - RNA, 99 nt, Human
gcaauugccugauagaagugucagggccuggaacugugggcagggcccgaaagccucccuguguccaguuccagguuguggagcauuuggcaaggcugc

SEQ ID NO: 4177016 - RNA, 66 nt, Human
gcaauuuaguuaaugugcacuccuuguaggcccugguuuuggcccgaguguauuuggguagagugu

SEQ ID NO: 4177017 - RNA, 80 nt, Human
gcaauuuuagaggucacagaacagaggguuuuagaauuagaaaugauuuuagauuccauguucuuucauucuuuaauugc

SEQ ID NO: 4177018 - RNA, 66 nt, Human
gcacaaaaaaacuggaagcccucgaaggagaccuaaguucagaucagggcucacacguuuucuggc

SEQ ID NO: 4177019 - RNA, 84 nt, Human
gcacaauguagcauuugacuaaggaaacaacuuguauuuuuccccccucuucuuuagggaauugcuuuguuuucuuguauuggc

SEQ ID NO: 4177020 - RNA, 68 nt, Human
gcacacacaaauaaaaacacaaagcuacguuuuucagguuuuguucuagaucguguuuguggcugugu

SEQ ID NO: 4177021 - RNA, 58 nt, Human
gcacacagggauuuuugaaugggucggaagugagcgagcugcucagaaacuugagugu

SEQ ID NO: 4177022 - RNA, 61 nt, Human
gcacacaugcauguaagaccucuugggcagcugggaggcaguucuuccugcguguucaugc

SEQ ID NO: 4177023 - RNA, 80 nt, Human
gcacacauuucacaguuuaauggcaaggauuuuuaaaagauaacaugugaaaaggcuuuguaaacuguggaguucuaugc

SEQ ID NO: 4177024 - RNA, 90 nt, Human
gcacacgugugugugcacagcauguuccauguguggucagcuugcccucaggcguguuacuuaccugggacagcaaaugcaugugugugu

SEQ ID NO: 4177025 - RNA, 61 nt, Human
gcacagaacccuaucuuucggaacagagucacagaggugcgacagaagcggguuuugcugc

SEQ ID NO: 4177026 - RNA, 96 nt, Human
gcacagacaucuggggaggucaggccugcuccuaccaccuauugcucucagaaaaagcggaggggccugguuggccucuguugaugacaauugugu

SEQ ID NO: 4177027 - RNA, 63 nt, Human
gcacagagagaagaggcugagcuaggcagaacucaggcagggcagccucugacucugcuuugc

SEQ ID NO: 4177028 - RNA, 63 nt, Human
gcacagagcaaggaugggucuauaguauagagccuccauacaucucaucugugcucuccgugu

SEQ ID NO: 4177029 - RNA, 80 nt, Human
gcacagagccggccaaacgcagccuguguuucccaucuauggaugccagcacacaggcagcgucauugcugcucgagugu

SEQ ID NO: 4177030 - RNA, 86 nt, Human
gcacagaggagaaagcacucggcuucauccagggccagaauuaucaagaaaugcugcuuggaggagguggugcuugauucuugagc

SEQ ID NO: 4177031 - RNA, 64 nt, Human
gcacagauagaccuuaugagauuugacuucaauucuagucaaguucauaauuucuuauuugugu

SEQ ID NO: 4177032 - RNA, 70 nt, Human
gcacagccuuggguucucugggggggcccaggaaaccaccacucuccccggagaucccugguuccacugc

SEQ ID NO: 4177033 - RNA, 126 nt, Human
gcacagcgcugugugacuuuugucacuuuucaugauguauaagcacagcugccuuuuuuaggaaucgugagcuggagucgugagcaaaguguugcaggaguagcauuuuucaggagagugaggugc

SEQ ID NO: 4177034 - RNA, 60 nt, Human
gcacagcugccauggcugcacuugccagaugggggcaagagggcugguggcagcugcugc

SEQ ID NO: 4177035 - RNA, 59 nt, Human
gcacaggcacagagggccacugguacucacaugggcuaaagcaauucugcugcuuuugu

SEQ ID NO: 4177036 - RNA, 62 nt, Human
gcacaggugguuagccacgauucgaugggguggcuucauuccagagugugagcuugccgugc

SEQ ID NO: 4177037 - RNA, 78 nt, Human
gcacagugagguccaguaacuuguccaagguccgagagacaggacuggauccagguggucugaccucccaaccugugc

SEQ ID NO: 4177038 - RNA, 91 nt, Human
gcacaguggcaggguuccaauuccuuauggcagugagugugaagacauuucugcauguaggguaauauuuauggcuuugucagcuguuggc

SEQ ID NO: 4177039 - RNA, 88 nt, Human
gcacagugggaaggcggccauuaagcuuuguugcagcagcacuggcugugcuucaaguucuuaauguuuuucucuugccaucugaugu

SEQ ID NO: 4177040 - RNA, 55 nt, Human
gcacaguugugacaaccaucgcaaacaugaguguccuggagucacgcuguugugc

SEQ ID NO: 4177041 - RNA, 56 nt, Human
gcacaguuuuaucuuauacugaugcagacagcaugguugccugagauaagacuggc

SEQ ID NO: 4177042 - RNA, 70 nt, Human
gcacauagaagugccugaccuagccuggagagucagggaaagcuuuccaucgucggugcacuuggauugc

SEQ ID NO: 4177043 - RNA, 71 nt, Human
gcacauccagaugcagaggccuuggcugggaagcgguucucagcucagguagacucagcaucugccugugc

SEQ ID NO: 4177044 - RNA, 75 nt, Human
gcacaugaggaggcaggggcuggcucacccagggcucugaggaccaggcugagcaccugccuuucaccccauggc

SEQ ID NO: 4177045 - RNA, 97 nt, Human
gcacaugauuuuuauuaauauccugauauuucuccuauuaauauugagcauuuagguuucagaaaugaagcaggaguuauuagauaggaauuagugu

SEQ ID NO: 4177046 - RNA, 76 nt, Human
gcacaugcuguuucucaaauuauuucagcuuaaaauguuuaauaugccaaggugccauauuuuggaauagcauguc

SEQ ID NO: 4177047 - RNA, 69 nt, Human
gcacauggaaauguauucaguggaaacuauggguaaacacuauacuacacauugacuauauuuacuagc

SEQ ID NO: 4177048 - RNA, 74 nt, Human
gcacauggacuaauagaguaacacaaacgaauuggcauaauuccuucuccugcuauuguuacuaguucaagugu

SEQ ID NO: 4177049 - RNA, 82 nt, Human
gcacauggcuguguacauccaaaugaauuagaauucgguaccacugagauuucaguuccuuggcuggccacauuccaagugc

SEQ ID NO: 4177050 - RNA, 63 nt, Human
gcacaugguaggcauuugauguucauuuauucacuaaauaugcaucgaguaccuccugugugc

SEQ ID NO: 4177051 - RNA, 67 nt, Human
gcacaugugggcagauacauuugauaugugaacuucugauaccugcaaagucucugcccaucugugc

SEQ ID NO: 4177052 - RNA, 64 nt, Human
gcacauuuauugagcacccguugugcguguguggcaccugccccaacagguguuuaaugauugc

SEQ ID NO: 4177053 - RNA, 99 nt, Human
gcaccaaauuccuugcagcuucaagcagguugacagagcugagacugaaauaaaaacaccaacaggauuaggccuguuccugacuguggaguuuggugc

SEQ ID NO: 4177054 - RNA, 92 nt, Human
gcaccaacauaugugagcucuguaccugcggagaugagauguugucauguauugaucucaacccagagcagaggcuccgcaagugccugugc

SEQ ID NO: 4177055 - RNA, 69 nt, Human
gcaccaagacccggcaagaugaaggcccccugucucucugcagagcugccauccccugcugggcugugc

SEQ ID NO: 4177056 - RNA, 111 nt, Human
gcaccaagccccacuuucagcuucccucucagauuggcagcuguccacuuucuggggucgaagaagagaacagcugcaaauuguuagaggagggguggcagcggggggugu

SEQ ID NO: 4177057 - RNA, 111 nt, Human
gcaccaauaaugccucuuuuuauacugucuuauuuuagcauuaaagguaagacauuauuucucccauaguuaauggcaugucuuugaugcuaggcagaggggccagggugc

SEQ ID NO: 4177058 - RNA, 63 nt, Human
gcaccacacagcugugucuaauuauggcuggaaguucuauuuaaaaagaggccagcugggugu

SEQ ID NO: 4177059 - RNA, 93 nt, Human
gcaccacuggccauagucuacauuguuaucuguaaguguccccuugcaagaaugggagaggcaugcaaacagucuagaguaggugccaggugu

SEQ ID NO: 4177060 - RNA, 71 nt, Human
gcaccacuguacagcagauauaguguuuuuaaugucauggauauuguaccugaaaguaagugaagaagugu

SEQ ID NO: 4177061 - RNA, 86 nt, Human
gcaccagaggucccggacuuucccguugcaauuccgccaucugcuggucggucucaagauagcaggcaagguccgugccucggagc

SEQ ID NO: 4177062 - RNA, 58 nt, Human
gcccaggauggagaauaguggugugaucucagcucacugcuaccuccaccuccugggu

SEQ ID NO: 4177063 - RNA, 91 nt, Human
gcccaggauuaugugcauuucauaugggcauuggcaauauuuuaagugaaugugggcuaugaacauguuaaauuugugaaugaucaagggu

SEQ ID NO: 4177064 - RNA, 99 nt, Human
gcccaggcacugcccguccaucugcuguugcuuccuggcagggcgagcgggccauacaucacuuagccaugccgaggaggcugggccgggcagcugggc

SEQ ID NO: 4177065 - RNA, 129 nt, Human
gcccaggcccguguucaaagaaacgccuugcccagcccgaugcagcccugcccugagcauacgugaaugcucugggcuuaccugcuuccugcugccuggggccaagguguccucacuggcugugcuggc

SEQ ID NO: 4177066 - RNA, 62 nt, Human
gcccaggccucgcagcccucgcuuucuuccuaacaaaguggcugaggcaugcaggccugggc

SEQ ID NO: 4177067 - RNA, 58 nt, Human
gcccaggcuagcguagagugcagcauucauagcuuacuauaacuucgaaguccugggc

SEQ ID NO: 4177068 - RNA, 80 nt, Human
gcccaggcuggagugcaauggcacgaucucggcucgcugcaacuucgcuugccggguucaagccauucuccugccucagc

SEQ ID NO: 4177069 - RNA, 58 nt, Human
gcccaggcuggagugcaguggugcgaucuuggcucacugcaagcucagccucccgggu

SEQ ID NO: 4177070 - RNA, 58 nt, Human
gcccaggcuggagugcaguggugcgauguccgcucacugcaagcuccacccuccgggu

SEQ ID NO: 4177071 - RNA, 58 nt, Human
gcccaggcuggaguucaguggugugaacacagcucacugcaaccuccaccuccugggu

SEQ ID NO: 4177072 - RNA, 81 nt, Human
gcccagggaaggugcggaacagugguguccugggcugcccccuugcccuuucacuuuaaucugacaccuuagcuccugggu

SEQ ID NO: 4177073 - RNA, 59 nt, Human
gcccagggcagggcaagagugaauucuuugcuggauucuucaugcccaggccuuggugc

SEQ ID NO: 4177074 - RNA, 59 nt, Human
gcccaggggcggguaaaaggccuccgggagcgcggggcccggacccagccucugcaggu

SEQ ID NO: 4177075 - RNA, 57 nt, Human
gcccagguggagugcauuggcaugaucucgacucacugcaaccuccgccugcugggu

SEQ ID NO: 4177076 - RNA, 58 nt, Human
gcccagguuggagagcaguggcaagaccuuggcucacugcaaccucugccuccugggc

SEQ ID NO: 4177077 - RNA, 66 nt, Human
gcccagguuucaucugcuccguggccggcacugugcaggcagaggugagccagugagccucugggu

SEQ ID NO: 4177078 - RNA, 61 nt, Human
gcccaguaauagagugccagggauggggaccucuucccuccgagguaagccugugccaggu

SEQ ID NO: 4177079 - RNA, 71 nt, Human
gcccagucaaguuuucagaaauugcgacccaggccaacaaccugacugcaacuucaugagagacccugagc

SEQ ID NO: 4177080 - RNA, 69 nt, Human
gcccagugggaaucaccaauuggaaaaucggcauaagaaugcugauauucuaccugcugaccaaggggc

SEQ ID NO: 4177081 - RNA, 57 nt, Human
gcccagugguaaaagcaggccugcauggggagcccggcucugcuuuuaccacugggu

SEQ ID NO: 4177082 - RNA, 114 nt, Human
gcccauaagacuguuggagaagaggaaaaaaagaucacaugugguugaaaguaaauuugguuuguguuuuuaucuuguaugugucucuucucaucuuucacacuggcuuggggu

SEQ ID NO: 4177083 - RNA, 81 nt, Human
gcccauccccacuuauccccugggccuggcgcuggacacagccauccagcagaggacaggaaagggguagguguggacggc

SEQ ID NO: 4177084 - RNA, 69 nt, Human
gcccaucucugcccuccagccuuugugcagcugcugagcaguucagggagagcgggacggguggugggc

SEQ ID NO: 4177085 - RNA, 66 nt, Human
gcccaugcgcccuggagcagauggacuguggguacacgagccucugaacucuugggcagcaugggc

SEQ ID NO: 4177086 - RNA, 56 nt, Human
gcccauggcagaacugugagcagaacuggacaaguagcacacauuucugacagggc

SEQ ID NO: 4177087 - RNA, 99 nt, Human
gcccauggcuguucacauugaggcuuaacuuggaaagggaggcccauuuuaacucugcaauucgaccuucccugguguuagcccaaugacagugauggc

SEQ ID NO: 4177088 - RNA, 109 nt, Human
gcccauguuggggaacagaucugaaagcauugugaauuguaaguauuuuauguaggaaaguuaaaugcaacaguucauaguuuuauguucugccaacuuaaccaugagc

SEQ ID NO: 4177089 - RNA, 96 nt, Human
gcccauuggaccauguuugaaaccccaggccucccuuuuccagccauccuucccuggguggcagagucugggcuugggcagaaagguucaaggggc

SEQ ID NO: 4177090 - RNA, 109 nt, Human
gcccauugggaauggcuuauccaucucacacagcauuaacugggacagcucagugauguggcuggcaagucagugcugaugauggaucugauggaagcucaaccagggc

SEQ ID NO: 4177091 - RNA, 79 nt, Human
gcccauugugaugcucucuggcuaguccaucggggucuacaugaaagaacccgaguaucuccagggaguuucugugggc

SEQ ID NO: 4177092 - RNA, 110 nt, Human
gcccauuucucauuuuccucugugcucccauggagcugauccaaugguuuuuaagggagcucugagcuuggacaagcucugaagggcauggggcaagacaagaaacgggc

SEQ ID NO: 4177093 - RNA, 84 nt, Human
gccccaaccccccuugauggacagggaccacuguccuggcccaacucagggcuuccuccuuccugcugucauuuggguuggggu

SEQ ID NO: 4177094 - RNA, 129 nt, Human
gccccaacccccugcucuccaucccucgcgucccgccgcgccuuugcccuccgcagccgccggggcugcagggcacggugcgcgugggaggcugcgcgggccaggguaucccaggggguuccggggggc

SEQ ID NO: 4177095 - RNA, 65 nt, Human
gccccacacgauuccuguuuaaacagacauagcagucaacaaagcaggcaucuguggcacaaggc

SEQ ID NO: 4177096 - RNA, 128 nt, Human
gccccaccacuaguuguuuuugugaucuugggcaaguuacuuuaccucuuuagcucucagucuaccuguuaguaaaauggcauuaaagugucugccuccuaaggguuauugugaggauuaagugaggc

SEQ ID NO: 4177097 - RNA, 63 nt, Human
gccccagagcaacacccuuuacaucgacccacacugguccaugcagccaugugcuuauggggc

SEQ ID NO: 4177098 - RNA, 77 nt, Human
gccccagcaccuccucugugcagcuguggguagucauaucaacaaagggagacccagggcagccagcggggaggggc

SEQ ID NO: 4177099 - RNA, 59 nt, Human
gccccaggaguuggagccugcagugagucaugaucguaccacugcacuccagucugggc

SEQ ID NO: 4177100 - RNA, 63 nt, Human
gccccaggcaucccauuaaggagcaugaaggacauugcucuuagcaauaggaggccugagggc

SEQ ID NO: 4177101 - RNA, 90 nt, Human
gccccaggccagagcguguagcaugcgccaccaccagccccgggggcuucucaaugcuggucgcugcuguauaugagcccaucugccggc

SEQ ID NO: 4177102 - RNA, 67 nt, Human
gccccagggacaaagucugugauucugauuauauuuugaacauuaacuucagucuauaucugagggu

SEQ ID NO: 4177103 - RNA, 63 nt, Human
gccccagggcugcugccugggcuggacagcacugccccagccacagcuuccagcuccugucgc

SEQ ID NO: 4177104 - RNA, 69 nt, Human
gccccagugcaaagaaaucagcuuuguuccuucacuggaaaagaugcacguuucucugacuacuguagc

SEQ ID NO: 4177105 - RNA, 68 nt, Human
gccccauaguauuuugcuuuuacagccaacuggacuacuaagaacaguuauaagagcagacuguaggc

SEQ ID NO: 4177106 - RNA, 59 nt, Human
gccccauucugcugaugaggcuaagugaaccacucagcuuccuacagcuagaaacaggc

SEQ ID NO: 4177107 - RNA, 66 nt, Human
gcccccacugcacccaugagcucaagggaggaauuugcuuccccugcagaugagggcagugguggu

SEQ ID NO: 4177108 - RNA, 73 nt, Human
gcccccauccccugaaggagcuggcugucucaguccugggcucgcgcacuucaccccggcagauggagggggc

SEQ ID NO: 4177109 - RNA, 57 nt, Human
gccccccaacaccuguugaccuacuggggaccagagccugcaucaggcuuggggggc

SEQ ID NO: 4177110 - RNA, 56 nt, Human
gcccccgaggaggugaugucgcucagggcgaucacaucucccacuuccuugggggu

SEQ ID NO: 4177111 - RNA, 72 nt, Human
gcccccgcaguaccacaggcugaggccggggccgcucacucuggcggcuuggcugccuuuggauguuggggu

SEQ ID NO: 4177112 - RNA, 120 nt, Human
gcccccgggccagcugucacccgaguggggugggaguggggugacugccugcccagcggucagggcagcagccacccagcugcucauuaacucagaggcagccacuggcuucagggaggc

SEQ ID NO: 4177113 - RNA, 58 nt, Human
gcccccuagugcagagaugguggcaguggccaagcagccuggacuugggcuggggggc

SEQ ID NO: 4177114 - RNA, 62 nt, Human
gcccccucccucccuacgugagcucacccugcaagaggguggggugagggggagaggggugc

SEQ ID NO: 4177115 - RNA, 88 nt, Human
gcccccuccgcucuggccaagcugcagcgccugcgccgggagcggaagcggccggcgggcacuggcggccucggccugggcggcgggc

SEQ ID NO: 4177116 - RNA, 71 nt, Human
gcccccuggcaccaccagacaccaggagggcacugcugcucuuaauugaaagucuuggugcaggugagggc

SEQ ID NO: 4177117 - RNA, 61 nt, Human
gcccccuggucuacuccuuuccccggacuccggagucccuggagaaggggacgcggagggc

SEQ ID NO: 4177118 - RNA, 95 nt, Human
gccccgagccaaucagcuucuauuucauguugaucuuucgagggugaaaaccuacuggagaagagcaugagcaaagccauuguauuugcuggggc

SEQ ID NO: 4177119 - RNA, 76 nt, Human
gccccgcggcccgcagagucaggcgugagcuucgcccuuucugaaagggccuccgccugggcaggcgccggggggc

SEQ ID NO: 4177120 - RNA, 65 nt, Human
gccccgcuccagcggagcacgugcagugagaggcuucagaaacaggugccuuccgcggagcucgc

SEQ ID NO: 4177121 - RNA, 68 nt, Human
gccccggaaggcccagcccguccucgugcugucuccggccggugcucgugcugaggcucuccucgggc

SEQ ID NO: 4177122 - RNA, 69 nt, Human
gccccggcccgugggccagcgggcagucuacucacgugggccuccgcauggcccagcgccgccaagggc

SEQ ID NO: 4177123 - RNA, 68 nt, Human
gccccggggucugucucaaggggaggcagcugcugcggccucccacauugaggacaugcuuggggagc

SEQ ID NO: 4177124 - RNA, 59 nt, Human
gccccguggcgcuggccugugggaucccgggcgcggccugggccagggccagccggggc

SEQ ID NO: 4177125 - RNA, 65 nt, Human
gccccucagccugagucaaggauucuccauaucuguguagagucuuccaggcagccugaggaggc

SEQ ID NO: 4177126 - RNA, 77 nt, Human
gccccucagcugcugagaauugcaggcaaguugcucugccucucugugccuuuguuuucucaucucugaaauggggc

SEQ ID NO: 4177127 - RNA, 55 nt, Human
gccccuccgggcgcgucauagcgcagcugcagccggacgcggucccgagacgggc

SEQ ID NO: 4177128 - RNA, 93 nt, Human
gccccuccugccccagcccacccgcuugccuuggugcucagcccucccauugggagcagguuggggcgagcuggaggcccgggcuggaggggc

SEQ ID NO: 4177129 - RNA, 99 nt, Human
gccccuccugcuucucggucugugugcuuugggaagugacuugugggaagggaguucugaggguauuuccaccagaggaucauagaagaaggaagaggc

SEQ ID NO: 4177130 - RNA, 57 nt, Human
gcagugcaugcaaugcaaaugaauaaagucagugcauuugcauaaggaugcuacugu

SEQ ID NO: 4177131 - RNA, 60 nt, Human
gcagugccgaagguagugguuguaaagagaacuucuggggagacucacaccuuccgcugu

SEQ ID NO: 4177132 - RNA, 66 nt, Human
gcagugcuagggcagagcacuccugaaugacuggaaaucacauggaggcaggcucuagaaggcugc

SEQ ID NO: 4177133 - RNA, 81 nt, Human
gcagugcugcuuacauggucccagucaggcacaagaaaguccugacgguauuuagggagcagcguuucagagcaucauugc

SEQ ID NO: 4177134 - RNA, 98 nt, Human
gcaguggaaguggcugcaagagcaacaguggcaguggugggaccccuuugcccagcguccccugugcccuguguuccugaggcagccgacucugcugc

SEQ ID NO: 4177135 - RNA, 77 nt, Human
gcaguggaggucaaugucuugcugagccaaugugagccuucuguggggccuggcaaagcuagacauucccucucugc

SEQ ID NO: 4177136 - RNA, 72 nt, Human
gcacccuggagacuucuugaggguugggggaagcccccaucuucccugagggauuuucggaaggcagggugc

SEQ ID NO: 4177137 - RNA, 71 nt, Human
gcaccgcuguggcugcagcccagcggcacggccccguggcucccgcuggccaugcacccucagucugucgc

SEQ ID NO: 4177138 - RNA, 67 nt, Human
gcaccuauauaaugugcuccaugagacaguuuuccaucauguaaucaguagugcauugaauaagugc

SEQ ID NO: 4177139 - RNA, 74 nt, Human
gcaccucagaaagcaagaugcauccgucaagagucgcaccuccauggaaggcguguugcuaaugugaaaugugc

SEQ ID NO: 4177140 - RNA, 66 nt, Human
gcaccucaggacuuccaaaacacagcauggcaguugaaaacugucuuggaguuggaaguguggugu

SEQ ID NO: 4177141 - RNA, 67 nt, Human
gcaccucuuucucacuuuguuaguucuggccucacguuaguaacuugaaguugcagaaaguacuugc

SEQ ID NO: 4177142 - RNA, 64 nt, Human
gcaccugcaggagcugugcggugaggggcugguggccucugcacccccggcuccucguuugugc

SEQ ID NO: 4177143 - RNA, 121 nt, Human
gcaccugccccuugaauuguuggauaauugaauagaagcugauaaacuacuucccuauaagccaaaggagggggguagcaaguggccucuguugaagcucccaauacagagggggaggagu

SEQ ID NO: 4177144 - RNA, 80 nt, Human
gcaccuggaggcugccagcugggaacccccuuuaggcgacgucagcgccguugguucucagccugagccgcccccugugc

SEQ ID NO: 4177145 - RNA, 62 nt, Human
gcaccugguacacaccuccaauggguacaacacugacccaggauaaucuguguaucugaugc

SEQ ID NO: 4177146 - RNA, 63 nt, Human
gcaccugucucggccuggcugugucaccucacuuuccuggggugccagcccugacacaggagc

SEQ ID NO: 4177147 - RNA, 64 nt, Human
gcaccuguucuuuuacuucauuggauccuuacaagagucccauguaagaaggagacaggauugc

SEQ ID NO: 4177148 - RNA, 56 nt, Human
gcaccuuccugaauggauuguugugaggauuaacugcacacauacaugggaagugc

SEQ ID NO: 4177149 - RNA, 93 nt, Human
gcaccuuuuucuauagccugggaauaaaucuugucuugaugcugcaauuucaagauucuguucuuuauguaugguaucguagacaaaaggugc

SEQ ID NO: 4177150 - RNA, 66 nt, Human
gcacgccagcuccugcaggccucguuuugaagccgaggucucaacugcagggagcagauggcgugu

SEQ ID NO: 4177151 - RNA, 64 nt, Human
gcacgccuguccccaggagaguccggcgcuucaccuguucccuccauuccaggacgggcucugc

SEQ ID NO: 4177152 - RNA, 80 nt, Human
gcacgcuauagaauuugcacuaaaucugcucagcacaauauccaaaaguuugcagagacuuggagcuaaauugggugugc

SEQ ID NO: 4177153 - RNA, 88 nt, Human
gcacguauucgauaucuaaccugguuaaugguuacaugguuuuauacauauguaaaaauucaucaggcugagcauuuaagaucugugc

SEQ ID NO: 4177154 - RNA, 84 nt, Human
gcacguauuuaguuuuguaagaaacugccaagccucuuuuucagaguggcuggaccauuuugcauucccacuagcaauaugugc

SEQ ID NO: 4177155 - RNA, 76 nt, Human
gcacguguaaccccugaacucgcauaugacuccagcccacaggcacgcucaauguggguucgaguuacacacaugc

SEQ ID NO: 4177156 - RNA, 72 nt, Human
gcacuaaacuuuuaugaagacaggcaguauauuaucacuguuguaugcuaaggccuuaacucauggaggagc

SEQ ID NO: 4177157 - RNA, 58 nt, Human
gcacuaaauguucacaugcaauuuucaagagaagauauacaucuggauauuugugugu

SEQ ID NO: 4177158 - RNA, 77 nt, Human
gcacuaaguguaugacgaagguaguauaugauucacaguagcuauauugaauauugcuuucucagacguuuaguagu

SEQ ID NO: 4177159 - RNA, 92 nt, Human
gcacuaggagagccaggagugucuccacacagcaaagagacacccugaaauuaccucugauuugcuucuuagauauuccucucucucugugu

SEQ ID NO: 4177160 - RNA, 63 nt, Human
gcacuauucaugaaucuacauugugguauuguuuaaaauaacaugaugugaagcaugaacugc

SEQ ID NO: 4177161 - RNA, 80 nt, Human
gcacucacccccacuauauacccaggaaaaaccaugguauugguuaccauugcccccuagugucuguggaggaggagugu

SEQ ID NO: 4177162 - RNA, 88 nt, Human
gcacuccagugccagccucaaugucuauggugcaaauguaaaaaugaacaauuuuucaccauagacacugguccuggcacuggaaugc

SEQ ID NO: 4177163 - RNA, 74 nt, Human
gcacuccccauaagacauguccaggcugugagggggacucagacucgcccauguuucuuuaugucuugguuugc

SEQ ID NO: 4177164 - RNA, 95 nt, Human
gcacucuaagauuuucuacucugagguuuccugaagaccuuuuaucuauuuuacauauauagucugggcuucagaguuagagaguuauggagugu

SEQ ID NO: 4177165 - RNA, 61 nt, Human
gcacucuccuggcugccacaguaggaaucaccuggcugcugaggaggaacccaggagaggc

SEQ ID NO: 4177166 - RNA, 66 nt, Human
gcacucuggcuugguaaaaacuucuauacaguguacaggcuggcagaagccaagaacagacagugc

SEQ ID NO: 4177167 - RNA, 74 nt, Human
gcacucuugucuuguuucuugcauaggaucuccucaugaccagguucuauaaaacucaagagcaauuugagugu

SEQ ID NO: 4177168 - RNA, 78 nt, Human
gcacugaaguuauuuuaccuguuaaaggaaucuaauucuuucaggucacuuuagccagaugugaaggacaacaguugc

SEQ ID NO: 4177169 - RNA, 62 nt, Human
gcacugagcuuuggaggagcagggggcaaugagguggccggugugacgaggacucaaugugc

SEQ ID NO: 4177170 - RNA, 63 nt, Human
gcacugagggccagcccauaaugccaaaggcuuugcagaguccuugcugugcccucgggaugc

SEQ ID NO: 4177171 - RNA, 106 nt, Human
gcacugcucccggagguacucauucaggaaauggaauucuuguguucauaaaaaugaaggcacaggaaucuucauuuuuuaaccagcccucccaggugacagaugc

SEQ ID NO: 4177172 - RNA, 70 nt, Human
gcacugggccugguucgggaagcugacaaucaaacacccugcagcauuugcugaagcaggagccagcugu

SEQ ID NO: 4177173 - RNA, 59 nt, Human
gcacugguuacccugaguggcugcaggcagagcugauggucagcagguccagccagugc

SEQ ID NO: 4177174 - RNA, 92 nt, Human
gcacuguauuuucaacccacucuuacucugaaaacuuucuccuuauaguugagaaguuacaguuaggggugaugacagaagaauauacaugc

SEQ ID NO: 4177175 - RNA, 58 nt, Human
gcacugugcuagagagaacaagaacauuccucuugcucuccagaggcucacagcaugc

SEQ ID NO: 4177176 - RNA, 65 nt, Human
gcacugugcuagguaucagggauaaaccaucaauguagcaaggucccugcccucaaggacagugc

SEQ ID NO: 4177177 - RNA, 67 nt, Human
gcacuguguacagaaagaagggagugaaaauuagacaaaguucuuucuuucaagaaguucacagugc

SEQ ID NO: 4177178 - RNA, 57 nt, Human
gcacuuaagcaaagaaggugacaaugucagcaagucucuuucaagagcuuaaugugc

SEQ ID NO: 4177179 - RNA, 89 nt, Human
gcacuuaggucaucucagggguuccuucuagaggguaaaaccaucccucauuaaaggaaaucaccugcauaaagcccaugccagagugc

SEQ ID NO: 4177180 - RNA, 88 nt, Human
gcacuucaguuagauuccuugaguuuggaucagaaauacaccacgagcuucugcuuaauucaagucugaagaggacuaauaaaagugc

SEQ ID NO: 4177181 - RNA, 93 nt, Human
gcacuuccuuccuaguguacacguguagggguguaugacugagcagauacugcugcaggcagccccucuacuggggccucugggaggcagugc

SEQ ID NO: 4177182 - RNA, 58 nt, Human
gcacuucuugguucuccugggcuguugcagaauugugcucuaaagaacccagaggagu

SEQ ID NO: 4177183 - RNA, 59 nt, Human
gcacuugaaaagaucaggugcaauucaauuaugaagucguaucugacuuuuugaagugu

SEQ ID NO: 4177184 - RNA, 101 nt, Human
gcacuugcuagaaauauuccaaggucagggagcccugugauucuguugugugacacaguaaagcugugcuagacaguccggggcuggcagugggagagugu

SEQ ID NO: 4177185 - RNA, 75 nt, Human
gcacuuggacuggacccgaggaauguuggauuaaaaagccgauucccguuccucuacuccagcuaccccaagggc

SEQ ID NO: 4177186 - RNA, 59 nt, Human
gcacuuggaggugcccacacagaauauaauaucucgugacaggaugucucuccacgugc

SEQ ID NO: 4177187 - RNA, 78 nt, Human
gcacuugucagaggcuguggcaucacaucaggacaacccugaaaccaggucacugagaagaguaacagcaggcaaggc

SEQ ID NO: 4177188 - RNA, 65 nt, Human
gcacuuucagacauuacagcuuuacugaggaacauaacucagauuuuugagaugucuguuugggc

SEQ ID NO: 4177189 - RNA, 84 nt, Human
gcacuuucucugaggauacuucucaugggcucugagcaggcaguccuggacccguggaaaaggggguagcuuuccugagagugu

SEQ ID NO: 4177190 - RNA, 64 nt, Human
gcacuuucugagacaacuuagcccucgagaauuccacauuucuuguuuuguuguccagaguagc

SEQ ID NO: 4177191 - RNA, 90 nt, Human
gcacuuugugaaguaauauguucugaguuuuucacaucuuuuaaauuuauuuuuaaagcuguagaguuacuugcuguucuuucaacaugc

SEQ ID NO: 4177192 - RNA, 67 nt, Human
gcacuuuucaaaugggaaacucagaaacugagaccucccuucagaaccuguccauauuugaaaaugc

SEQ ID NO: 4177193 - RNA, 57 nt, Human
gcagaaacugaggaguuagacuagggauccccaagggcccuuuaagcuuuaguaugc

SEQ ID NO: 4177194 - RNA, 65 nt, Human
gcagaacagcaguuaugguucauuucccucuaguaagagaugguggagauuggcucugugucugu

SEQ ID NO: 4177195 - RNA, 94 nt, Human
gcaucaccugggagcuguuaaaugcagaauuucagguccuaucccaggccuaccaaacuaaauucugcaauuugacaagauccccaagugacgc

SEQ ID NO: 4177196 - RNA, 84 nt, Human
gcaucaccuuucccagaccucaacaaaguuuucuugacgucucuaaugugaccaaagagcuguucagugucgcugaggagaugu

SEQ ID NO: 4177197 - RNA, 130 nt, Human
gcaucagcaucacuggggaacugguuagaaauacaaauguuugggcugcaucccagaccggcugacccagaaacucuggggaugagguccagugaucuguuuucacaagcccuccaggggauucugaugc

SEQ ID NO: 4177198 - RNA, 57 nt, Human
gcaucaguuuggaacauucaggccugagcguucaggacggaugaagccgacuguugc

SEQ ID NO: 4177199 - RNA, 68 nt, Human
gcaucaugaguguguaagggaucaaagaguuccuucugagcucuugaaaauuuacaccugcauggugc

SEQ ID NO: 4177200 - RNA, 125 nt, Human
gcaucaugguucagaagagggauuacaaaugccauguagucagugcaaaugcuauguggucaguccccauagcaaaacccacugcauuaccggaugagauccuugaggacugaaccagaggaagc

SEQ ID NO: 4177201 - RNA, 68 nt, Human
gcaucaugguuuugagaaacagagugccuacacagguuuguuaaugcacucaucugaagcuauggugc

SEQ ID NO: 4177202 - RNA, 60 nt, Human
gcaucauucucaagaacauauguaggguggggcaucaugacauacuuuugagaagggagc

SEQ ID NO: 4177203 - RNA, 73 nt, Human
gcaucauugagaggauugauuuaucuggcgugcuguaaugacugcagauguggaucuguuauucuagaugagc

SEQ ID NO: 4177204 - RNA, 61 nt, Human
gcaucauuuaauuauaggggcugguggguuaacguuccacagcucuguucauagauggugc

SEQ ID NO: 4177205 - RNA, 71 nt, Human
gcaucauuuuucuuucuaucaccuuuccuugaaaauacaucuucagcucuggguaggaggaaucuuggugu

SEQ ID NO: 4177206 - RNA, 57 nt, Human
gcauccaaauguuucauuucuuuuggaaucuguccaugucgagauacaucuggaugu

SEQ ID NO: 4177207 - RNA, 64 nt, Human
gcauccacugugagcaugaacaggacuacaggcuguuaguugugucauuugcugaugugucugc

SEQ ID NO: 4177208 - RNA, 85 nt, Human
gcauccagaucuugguuucuaaguaccauuauccaguaaaggagcuagggcuucuugaagaaaugguugguucuaaggcuugggc

SEQ ID NO: 4177209 - RNA, 74 nt, Human
gcauccaggcugccccucugcgucugccccgcucaccaugaccuugcgcagcuuguaguuccgggcccggaugu

SEQ ID NO: 4177210 - RNA, 56 nt, Human
gcauccauucacucaacuuagauggcauuuccuuugucguuugaguuaauggaugu

SEQ ID NO: 4177211 - RNA, 76 nt, Human
gccacauucaagcucuugacagcuacaucuggccaguggcuacugaacuggacaugcaguucucaaggguaguggu

SEQ ID NO: 4177212 - RNA, 73 nt, Human
gccacauucacagagggggaagcaucacuccugcaggaaggaaaggaagugaguccccugcuugggaaauggu

SEQ ID NO: 4177213 - RNA, 65 nt, Human
gccacauucuauucugcaggacaaggcacuucaaaucuuuuuaccuggaggauaaauguguccgc

SEQ ID NO: 4177214 - RNA, 62 nt, Human
gccaccacacccagccugggugacagagucuuacucugucacccaggcuggagugcaauggc

SEQ ID NO: 4177215 - RNA, 62 nt, Human
gccaccagcuccaccagggcagguggcucacaagccaugacccuuacaggugguguuggggc

SEQ ID NO: 4177216 - RNA, 70 nt, Human
gccacccaugcuguccugccagggauggcauaggaaagucaugccuuggaaggcgguguguugugguggu

SEQ ID NO: 4177217 - RNA, 58 nt, Human
gccacccuggaauagccccgggaggagacauggcccucagaggccuguccaggguggu

SEQ ID NO: 4177218 - RNA, 62 nt, Human
gccaccuccaccuauugccagcccaguuucacgaaaggaaggcugaaaggugggaggauggc

SEQ ID NO: 4177219 - RNA, 74 nt, Human
gccaccugacaggucugaaagccucagucacacauagaccacuggacugugugacuuuucugauaugcgauggc

SEQ ID NO: 4177220 - RNA, 74 nt, Human
gccaccuuuucacccagcgggcgcacacucgggaucugaacucucugauagaugggccaugcuggggagacagc

SEQ ID NO: 4177221 - RNA, 123 nt, Human
gccacgacucagauugcauccaagugagcacuauaucucuuucaucuuuuucuuauggugcagaagcacaagagggugagcagguacacauggugacucuuaagaauucaacucaaaacuggc

SEQ ID NO: 4177222 - RNA, 56 nt, Human
gccacgacuggguucugcagucuccggaaggauuuuaguugacccccaguccuggc

SEQ ID NO: 4177223 - RNA, 79 nt, Human
gccacgcgcauuccugagcagggcucugcagggcgcggcgugcacggcucuggaaccugccaggaugcgcugauguggc

SEQ ID NO: 4177224 - RNA, 64 nt, Human
gccacggccuuggguggccacugcuggguggaucccacuggacaguggcacccacgggcugggc

SEQ ID NO: 4177225 - RNA, 61 nt, Human
gccacguaguuuguaguauuuuguuacauaagcccugacaaauacauacacuguacguggc

SEQ ID NO: 4177226 - RNA, 115 nt, Human
gccacuagggaaaauauucuccaaugauaagcccagcuaguucagagagauauguaaucuuuuucguaaaaucucuggcuaguuccugggauaucagaaauauuuuuuagauggc

SEQ ID NO: 4177227 - RNA, 79 nt, Human
gccacucuacugugagauuuuuaaauaacuugguacauguagcuaagaaggguuuaaaguuuauaguaauaggauuggu

SEQ ID NO: 4177228 - RNA, 81 nt, Human
gccacucuggacccuccugcugagagccccagcugagacacagacccuuggccaaccccaggaauguccagcccugugagc

SEQ ID NO: 4177229 - RNA, 70 nt, Human
gccacugaaggagccgacauuaagaaguuggguaauuuaacuucagagcugugugguuugacggugaugc

SEQ ID NO: 4177230 - RNA, 97 nt, Human
gccacugcuccugcguguaggccuggaucucugggagcagugugcccaauaacugcuccagcaccaagagcuccagcaucugcuccuuggagcaggc

SEQ ID NO: 4177231 - RNA, 87 nt, Human
gccacugcuucaaugauauuauauaucaucugccucaucacugcaugcccugcuggcauguguggucagaugauaucugcagcuggu

SEQ ID NO: 4177232 - RNA, 63 nt, Human
gccacugucucugauaagcucgaggguagcaaccugcucuugugucaccauggauaaaguggc

SEQ ID NO: 4177233 - RNA, 66 nt, Human
gccacuguuauuacuacuauacauuuucuuuuccacuaauguagaacagguuaaugacagauuggc

SEQ ID NO: 4177234 - RNA, 64 nt, Human
gccacuucaccacagucucaucuacgcuguguuagaggguuagcaugugcuguggggauguggu

SEQ ID NO: 4177235 - RNA, 71 nt, Human
gccacuuccaugcccuccuugccuucacugcuuccagcagggcugguguggagaggcuggcauucgguggc

SEQ ID NO: 4177236 - RNA, 101 nt, Human
gccacuuguaguauucagcuggcggcugaccugguaccuuagcagaaauggcugaaggcugggcucagccagcucuuuuugaauacaggcucuuacguggc

SEQ ID NO: 4177237 - RNA, 58 nt, Human
gccagaagugucuaucaagaugucaaauauaauuguacuuuuggugaucauauuuggu

SEQ ID NO: 4177238 - RNA, 65 nt, Human
gccagacagggugauaugcuggcucucgcugaagcugagagcuguguucauucuaccauccuggc

SEQ ID NO: 4177239 - RNA, 86 nt, Human
gccagagaguggaggagcacuugacggggucuuccuuggauagguaacuuuggaaaucagaccccaagggcauuucauauuuuggu

SEQ ID NO: 4177240 - RNA, 84 nt, Human
gccagagaugugagcucucuccuccugcauuaaccauggcaggauaguggcuggagcaggacggggagugguaucaagagaggc

SEQ ID NO: 4177241 - RNA, 57 nt, Human
gccagagcugagugagguucuucauaacacccaagaacgaaugcuucagcucuaggc

SEQ ID NO: 4177242 - RNA, 96 nt, Human
gccagaggcagggcuuggaccccaggcagggccuaacagagcucucguaccagcuauugaugugucuuccuggcuuacccuagcuccugcccuugc

SEQ ID NO: 4177243 - RNA, 85 nt, Human
gccagaggcauuauuuugccauccuaggcagcauuaacaaguuaaaaaaauucuagguuccaggauggcaauaaugaauuuuggu

SEQ ID NO: 4177244 - RNA, 57 nt, Human
gccagaguaacccuuuccucuuaggagagcagggagcuauuucaggguuauuuuggu

SEQ ID NO: 4177245 - RNA, 94 nt, Human
gccagaguugccggaguuuuggcaacuugugucuuccauaauagagcuggggcauugauggaaauggagggugcuagaaccuugugacuuuggc

SEQ ID NO: 4177246 - RNA, 116 nt, Human
gccagauaaaauauagagagccaaguuaaauuugcauuucagauaaacauacuaaaauauuauccaccguuuaucugaaaugcaaauuugacugagcauccuguauuuuuguuugc

SEQ ID NO: 4177247 - RNA, 60 nt, Human
gccagaugccguaaagaugggcaugaacaauaucccuucugucugaauauggcuucuggc

SEQ ID NO: 4177248 - RNA, 69 nt, Human
gccagaugggcuuuagcaaaugacagcagauuauuacaagcuaauucaggugcuaaggcugaucauagc

SEQ ID NO: 4177249 - RNA, 74 nt, Human
gccagauuuaucuucaugaccucuguguuuuagaugaggucucagagauagaggucagaauuuucccucuaggu

SEQ ID NO: 4177250 - RNA, 70 nt, Human
gccagcaaaauuacaaguauuuaagaugcugucagguaacuggggguacauauuugguaauaagugcugc

SEQ ID NO: 4177251 - RNA, 65 nt, Human
gccagcaagccaggucuguggcuuugacaggagcaaacacagcccugagcugcucucugcauggc

SEQ ID NO: 4177252 - RNA, 70 nt, Human
gccagcaaguaucaccaaagccugaaccucacacccaccuucuaagccaugguguguacuuaaacuuggc

SEQ ID NO: 4177253 - RNA, 61 nt, Human
gccagcaggcugcgauugcucauuguguuugguuauaauuagcagcauauucugcgauggc

SEQ ID NO: 4177254 - RNA, 59 nt, Human
gccagcauuccuuggcuccuggcugucuauuugcaucuucaaagccagcaguagcuggu

SEQ ID NO: 4177255 - RNA, 94 nt, Human
gccagcauuggcccaaaggcaugggaugaacuugaucugcuuccuuaggagaaggcacacucgaguguccggugaaggcuaugaugcaaaaggc

SEQ ID NO: 4177256 - RNA, 105 nt, Human
gccagccagccccgcugggaagggcaguggguagcagcugaaguuuuccucgcuuccagcucccacucucacugcugacuaaggugugcggaggcugauguuggc

SEQ ID NO: 4177257 - RNA, 56 nt, Human
gccagccaggaagaaaguaagaacucuaaccuuacuuuguuuuucuucugguuggc

SEQ ID NO: 4177258 - RNA, 82 nt, Human
gccagccccagccccuguuuuuccagucagagccggagcuagaucggcugggcccuggggauaggggugggugggguauggc

SEQ ID NO: 4177259 - RNA, 59 nt, Human
gcagaacauggaaagagaacuagagugaugaaucaaguugaacucaaucuuuguuuugc

SEQ ID NO: 4177260 - RNA, 73 nt, Human
gcagaacuuuucagcaaagaaaugucagugagaggcagauuaaaagggucucuaacuauuucuuucuuuuugc

SEQ ID NO: 4177261 - RNA, 98 nt, Human
gcagaagcagcaucgggccagcuucaugggugugcaaccugugcagucacacaaggucccaggcccagaagggccucauaauugguuugaugcucugc

SEQ ID NO: 4177262 - RNA, 68 nt, Human
gcagaagcuggcuugcaugcuaaggagcuuguccugaguuuccuaacacaguguaagcaagcaucugc

SEQ ID NO: 4177263 - RNA, 74 nt, Human
gcagaagggagcaggagccugccugccagcugugucuccuaaggcagcccuggcugggcuucucuccccucugc

SEQ ID NO: 4177264 - RNA, 55 nt, Human
gcagaagugcuccucagaagaguuggaagaguuucagcucuccugaagcaucugu

SEQ ID NO: 4177265 - RNA, 63 nt, Human
gcagaaguggauucuacaauuuucauagucuuaagagaaaaauguugcuguuucuauuucugc

SEQ ID NO: 4177266 - RNA, 66 nt, Human
gcagaaguggugcugugccacuuaugggccuaagccuugagaagacuuggcagccuccacuuuugc

SEQ ID NO: 4177267 - RNA, 73 nt, Human
gcagaagugugucuggcggcccagugggguccuggcagccccacaguggaauguguugucgggcaaaggcugc

SEQ ID NO: 4177268 - RNA, 104 nt, Human
gcagaauaacugucauuucuaccucacagcauugucacaaggcugcaaugaaguaugcuggugugcuuugugauaugcugugucuaaauuucagucguuagugu

SEQ ID NO: 4177269 - RNA, 55 nt, Human
gcagaauacugagagcugauugaaccaggaagaacaagaagccucaguggccugc

SEQ ID NO: 4177270 - RNA, 58 nt, Human
gcagacacauccacuccuacaggugucugacgaccuuggggguguagcugugauuugc

SEQ ID NO: 4177271 - RNA, 61 nt, Human
gcagacagagucugugaaacuuuuuauacuggucuauuaaauuuucacuaggcuccccugc

SEQ ID NO: 4177272 - RNA, 71 nt, Human
gcagacagugagcugagacuggaagcugaguuuucugacuccuggcccacuccuagcuucuuaauguuugc

SEQ ID NO: 4177273 - RNA, 87 nt, Human
gcagacauuucaguugcagcuucccagcucacucauaaguacguccucuguccgugcuuggggaugggaagcccagcaucucucugc

SEQ ID NO: 4177274 - RNA, 96 nt, Human
gcagaccgaaguuuccccaggccugggaagacuaagugggaggcgcccaccgugcgaagauccucccggcuuccagggaagggaggcugggccugc

SEQ ID NO: 4177275 - RNA, 130 nt, Human
gcagacgccgcacuuguggcgcagguugugcgugagcaggugcauggcgagcgcgggcauggacacguaggccuugccgcacgucgggcauuugcgcgccagcuggcuguccaggcugcggugcgucugc

SEQ ID NO: 4177276 - RNA, 91 nt, Human
gcagacgcucugggaaggcagccaguucagguuucuuuuucuucagggaaaccagaccugucuuuggcugaaagucucucuggugugcugc

SEQ ID NO: 4177277 - RNA, 80 nt, Human
gcagacuacaacaguucaguugagcucaacaaaauguacuaacucacagaauugugagcucaauauggugguuguuaugc

SEQ ID NO: 4177278 - RNA, 97 nt, Human
gcagacuagucuuccguggcaagcagagcgcuccagucuucaguagggagcugcugaauaggcacagagggcaucugccaccuuuagaccagucugc

SEQ ID NO: 4177279 - RNA, 72 nt, Human
gcagacugagugaucagcuuggguccguccaugugggggacggagcagauggaguggucaaauugggucugc

SEQ ID NO: 4177280 - RNA, 62 nt, Human
gcagacuguacacuggacuuugucuuuaugcauacaaauggccuuuuccagugcuugguugc

SEQ ID NO: 4177281 - RNA, 61 nt, Human
gcagagaggagcuuucccaggugcaagcccucagaaaagccugggagccaagccucugugu

SEQ ID NO: 4177282 - RNA, 81 nt, Human
gcagagagugagcagcaacgcggcccuacugcuuuggagugagagucgaaagcgauggaaccugccugcaccacauccugc

SEQ ID NO: 4177283 - RNA, 74 nt, Human
gcagagauaugaacgugaccgugugccagaagaaggaagggcccagcuggccagauguuacguccaauccaugc

SEQ ID NO: 4177284 - RNA, 60 nt, Human
gcagagauccuugcuggaugacaguugauuugguggcuguugcuaggauagaauuucugc

SEQ ID NO: 4177285 - RNA, 55 nt, Human
cugcagcuccaggugcaagucaugguagagacaccaaugcgugcauggggcucag

SEQ ID NO: 4177286 - RNA, 55 nt, Human
cuggauggcugcaccuagcccuuucugcuugcagauauagcagguuaguuuccag

SEQ ID NO: 4177287 - RNA, 65 nt, Human
cuggaugucggcauuuagcaaggaguuggucaaacagcugacacuagcuaaaugcugauuaacag

SEQ ID NO: 4177288 - RNA, 120 nt, Human
cuggauguguuguugagggaaggcuagccuggguagcuguaggucauuuaaucaccuagugaagcuagaauuaguguguuuagaucucaguugggaagcuuucuuuggagauaagucugg

SEQ ID NO: 4177289 - RNA, 70 nt, Human
cuggauuccuggaguugucuguacucaucuggaaccagagaaacagagaaaucagcuucagccuccccgg

SEQ ID NO: 4177290 - RNA, 62 nt, Human
cuggauucuuacuucugcaggguucaaggauuuacauuaggaaacccugagagguggucugg

SEQ ID NO: 4177291 - RNA, 63 nt, Human
cuggauuuuugaaggacuuuuuuuuacuugaaaaaggcuaaagacaguggauucaaaauccag

SEQ ID NO: 4177292 - RNA, 72 nt, Human
cuggcaagugguugggauggauuugccccgagccagucacacucucuuugcuuccauugugaccacugucag

SEQ ID NO: 4177293 - RNA, 79 nt, Human
cuggcaaugucugcaaugggugugggaugggaaguggcagcccaugggccacauaauuauugucaguaugcauuaucag

SEQ ID NO: 4177294 - RNA, 86 nt, Human
cuggcaauuguccacugucugccgaguggccuuagaaacgccaccauagccauuuuccugguagccaaugaaaugacaguucccag

SEQ ID NO: 4177295 - RNA, 65 nt, Human
cuggcacaguuaacauaugcuacaaacaaccaucuucagacaguguagcgaaccaacugugccag

SEQ ID NO: 4177296 - RNA, 71 nt, Human
cuggcacauaauugaacgugaugaguaugagcuucuguuuggaacucagguguacaauuuuaugugugcag

SEQ ID NO: 4177297 - RNA, 63 nt, Human
cuggcacaugacagaugcaaaggauuggaaaauauuugaauacagaaauuugcaugugugcag

SEQ ID NO: 4177298 - RNA, 112 nt, Human
cuggcaccaacuuuauuuucugggagcccagucugcuuaggaaaggaaaagucaccaaaguucauuguuuuccuaggcaguuggugcuccaugaguuuaaagggagcuccag

SEQ ID NO: 4177299 - RNA, 63 nt, Human
cuggcacugguaguuucagcaaccagcaaucauugcuucugcuuaucacuaacucugugccag

SEQ ID NO: 4177300 - RNA, 60 nt, Human
cuggcagagggcacucaggaugucuucucauccucauggaccucagacuguccuuuccag

SEQ ID NO: 4177301 - RNA, 62 nt, Human
cuggcagaguugggucucaaauucccagaguuugagguggugggacucacucuuuuggccag

SEQ ID NO: 4177302 - RNA, 68 nt, Human
cuggcagcaaggucucccugcaccuggucucacagacaggccagauccuggugaggcuuagcuuccag

SEQ ID NO: 4177303 - RNA, 59 nt, Human
cuggcagcuuagcacucugguuuuuaugugugaagccguaauauuuggugagcugugag

SEQ ID NO: 4177304 - RNA, 57 nt, Human
cuggcagcuuucucacccaugaccugaggcagauucuuggguuaagaagguugugag

SEQ ID NO: 4177305 - RNA, 61 nt, Human
cuggcaggagagcgucagaucaggaggagcaacuuccugagcuuggcuuaucuccagcugg

SEQ ID NO: 4177306 - RNA, 58 nt, Human
cuggcaggagcauucacagaggaguaucaaauucuuuuccugggaugucuccucccag

SEQ ID NO: 4177307 - RNA, 57 nt, Human
cuggcaggaucuaaccagggaaggggagcuaccuagggcaaggaguccugcauucag

SEQ ID NO: 4177308 - RNA, 58 nt, Human
cuggcaggcagacuucugcaaggaaucacauuguucuagcaaaaguugugccugccag

SEQ ID NO: 4177309 - RNA, 60 nt, Human
cuggcagggcuaaaggccacguucucacacugcuccuggagguuggccaggccccgccag

SEQ ID NO: 4177310 - RNA, 59 nt, Human
cuggcaguguccagcucgugaugggcuuaguugcauuaucacuagaguuacauugccag

SEQ ID NO: 4177311 - RNA, 88 nt, Human
cuggcaguucuaguggucacugguaaaugcuauuccuauauuuuuauuagaggagaggaaucauuauuacaaccaaagaaacucccag

SEQ ID NO: 4177312 - RNA, 60 nt, Human
cuggcaugcccaggguauguggaaucaaagaugcuuugagaaauacuuggugcugcacag

SEQ ID NO: 4177313 - RNA, 60 nt, Human
cuggccacugguggucauaggcuguaaucacuuggcaaccguugauauauugguggccgg

SEQ ID NO: 4177314 - RNA, 59 nt, Human
cuggccagcauggcugaaguacgugcacccuuccaccucuucucucccugcugguccag

SEQ ID NO: 4177315 - RNA, 55 nt, Human
cuggccaggcuucauccuggaaccaucuuuguggcugggagcuggaacugggcag

SEQ ID NO: 4177316 - RNA, 75 nt, Human
cuggcccagagggagacacuccuagccauucccuguaagcugccacuaagucccggaggucccuucugguuucag

SEQ ID NO: 4177317 - RNA, 71 nt, Human
cuggcccagcacuccaaguagggagcucuuuauggauauugaucgcugcucuggagaugagcuaggaccag

SEQ ID NO: 4177318 - RNA, 61 nt, Human
cuggcccuaggcaaacacagauuugcuuucucacaguauauacuaguuuugccugggcuag

SEQ ID NO: 4177319 - RNA, 56 nt, Human
cuggcccugguaaggacacccaggagagggccagggugccuguauuuggggcacag

SEQ ID NO: 4177320 - RNA, 59 nt, Human
cuggcccuguaggaugugaguuugcugccggguaggacauucgagguuugcaggguggg

SEQ ID NO: 4177321 - RNA, 95 nt, Human
cuggccgaggggcaggcuccucgcggccucccugggacuccgggcgugucguccagccccgaggccggcgacgggcagauccgccucacggacag

SEQ ID NO: 4177322 - RNA, 64 nt, Human
cuggccuaaaauugcuucugcaucuguucucugcagcaagccuaugaauuuuaaucacggccag

SEQ ID NO: 4177323 - RNA, 130 nt, Human
cuggccuagccauccacacugaccuugguuucaaggucccucggcccccccguggagauaaaugcaccaugcugugggccucugaggacagccuuggcuuggguuaaaacgcuaauguggcuggcaccag

SEQ ID NO: 4177324 - RNA, 58 nt, Human
cuggccucuuaggacauccucuaugaucaacugcacuggaggaagggacuugggccag

SEQ ID NO: 4177325 - RNA, 68 nt, Human
cuggccuggcagagguggcgcgccaucccugccacagacuggcaggaauggguccccuccagguguag

SEQ ID NO: 4177326 - RNA, 68 nt, Human
cuggccuuggaauggggcagaaaauggggcugcaaaccagcccugcuggcccccauuucaggguccag

SEQ ID NO: 4177327 - RNA, 61 nt, Human
cuggccuuguuccuccccaagugcucaacucuucccugacuugggcaggacacaggggcag

SEQ ID NO: 4177328 - RNA, 92 nt, Human
cuggccuuuauuuuucugguuguucauacuccaacagcuagcaccguacguugggguccaaugaagcgagcagcaguagauggcauggccag

SEQ ID NO: 4177329 - RNA, 60 nt, Human
cuggcgagcaggaggcgacggcagaggaaacuucaacccgaugaacuuccugguugcggg

SEQ ID NO: 4177330 - RNA, 76 nt, Human
cuggcggcagccccgggguggggagacgagcuccggagucggaagagcuggguuuucuuccgggccuagccaccag

SEQ ID NO: 4177331 - RNA, 68 nt, Human
cuggcuaccucuggccuucaggcaucauuuugcacaacagaaagaggccuggaggcagaggugaccag

SEQ ID NO: 4177332 - RNA, 88 nt, Human
cuggcuagauggcuagauugcaagaacuccagcuggcuuccucuucuugccacucacccacaguucuaguacuuucugcuucugucag

SEQ ID NO: 4177333 - RNA, 99 nt, Human
cuggcuauaaguauuguauuuggagaggagaaaaaagaggaugcaucacugcagugcuuuagucuguccuuuucuacccagguacaaauuuaauuccag

SEQ ID NO: 4177334 - RNA, 74 nt, Human
cuggcucagcugucacagccuggcucugacaaagccucagaacucaauugccaugugaagcuggacuuggccag

SEQ ID NO: 4177335 - RNA, 107 nt, Human
cuggcuccccacguuugggcuucauuuuugucuccgguuugugcuacucuuucuucauccaaaaaggcguuggagaucccgagaaucugcugcagcuuggaagccag

SEQ ID NO: 4177336 - RNA, 55 nt, Human
cuggcucccucgcugaggugcuccuucagugcccacucaucagcgagggcaccag

SEQ ID NO: 4177337 - RNA, 56 nt, Human
cuggcucugaguggcucuaauucagguucucugauuuuuagccucucugagcugag

SEQ ID NO: 4177338 - RNA, 59 nt, Human
cuggcucugcagagggcccagcuuugccagccacauggcgaggcugucugcaagaccgg

SEQ ID NO: 4177339 - RNA, 80 nt, Human
cuggcucugcaucucugugccagagggcacucaguuccugagccaagaaaggccacucuggucacagaaaggcaggcugg

SEQ ID NO: 4177340 - RNA, 67 nt, Human
cuggcucuuucagccgcuggagggcuggugugaugacaucccuguacuccgggguggcugaggccag

SEQ ID NO: 4177341 - RNA, 58 nt, Human
cuggcugaguuacuccacugagaaggauuucugcagcucuaguggcuugcuuagcuag

SEQ ID NO: 4177342 - RNA, 59 nt, Human
cuggcugcagcuccgaggaagaagaguccugggcggacuccucaggcugcugcugccag

SEQ ID NO: 4177343 - RNA, 79 nt, Human
cuggcugcuguuuggaagaggcucuggugggaguuggugggcugaugccuuagaccaaacaagagcuggcaguagcugg

SEQ ID NO: 4177344 - RNA, 75 nt, Human
cuggcuggcauagcugcaaggccgcuccugaagcuaauugagcuuccugagaacauggcagcuuagugcagucag

SEQ ID NO: 4177345 - RNA, 56 nt, Human
cuggcugggagcucgccugcggcccuggaagccgcgguucucagcaucccagccgg

SEQ ID NO: 4177346 - RNA, 92 nt, Human
cuggcuguaacugagaugcugcucuguaaagugaugaggccggggaggccacaucugcucugggcagcacucgcagagcuguugcagcacag

SEQ ID NO: 4177347 - RNA, 80 nt, Human
cuggcuguggagggcuccugaggcccuucugguacaauuguccauguuccacggcaaacucagaagccuucccacagcag

SEQ ID NO: 4177348 - RNA, 61 nt, Human
cuggcuguggucacagguaacugacaguuugugcuucccaagaauccugugauccgguggg

SEQ ID NO: 4177349 - RNA, 76 nt, Human
cuggcuuccuuucuaaaaugauuucugcuguuuccauaacugaauaacagcacagcaggauuugaaaggaagagag

SEQ ID NO: 4177350 - RNA, 66 nt, Human
cuggcuugcaggagaugcugaugcugcugaccaaacauugaguaucaaggaucuccagcacccuag

SEQ ID NO: 4177351 - RNA, 71 nt, Human
cuggcuugggucuaccugccuuuguacucugcagacacacaaaccauguauagggcauguuucuccaccag

SEQ ID NO: 4177352 - RNA, 62 nt, Human
cuggcuuugcugaucugugcccugcucauggacauagcaggacuggugccagacaagguagg

SEQ ID NO: 4177353 - RNA, 58 nt, Human
cuggcuuugcuggacugggagucccagggcagugugcuccucccucuugcaaugucag

SEQ ID NO: 4177354 - RNA, 65 nt, Human
cuggcuuuggaacaaaucauagggauaauuuuauuacuuucucacugugcuucuuccuaagccag

SEQ ID NO: 4177355 - RNA, 55 nt, Human
cuggcuuuuuucccauuaugcagaguguugauuuggaggggggaguaaaagccag

SEQ ID NO: 4177356 - RNA, 97 nt, Human
cugggaagaagacaacucuguccucaguauuguggagcagaucacauaugugugaacacucuguauuaacugagaagauaugaggucuuuuucgcag

SEQ ID NO: 4177357 - RNA, 59 nt, Human
cugggaagaagggacaacagcggacugucuaaaggaugccuggauuccuuguuucucag

SEQ ID NO: 4177358 - RNA, 105 nt, Human
cugggaagaggcgcuccucacuuccuagaugggauggcggccgggcgcagacgcuccucacuuuccagacugggcagccaggcagaggggcuccucacaucccag

SEQ ID NO: 4177359 - RNA, 60 nt, Human
cuuggucgaugggcuggugcauugaacacaugcaugugcuuggugccagccugucccagg

SEQ ID NO: 4177360 - RNA, 68 nt, Human
cuuggucuuguggcaucuuuccagacacugucagggaugguaggccauggaaagauucaaagaccagg

SEQ ID NO: 4177361 - RNA, 60 nt, Human
cuuggugagacucccacccaccgacaugcucugaugugaagggugagguguuuagccagg

SEQ ID NO: 4177362 - RNA, 56 nt, Human
cuuggugauuuacuuguaaauuuccuaaauggggaagccacacaaaggucgccaag

SEQ ID NO: 4177363 - RNA, 63 nt, Human
cugcaggccaggcaacauucugaaguuuuguuuuaggcuaagaauaggugcuuggcuacgcag

SEQ ID NO: 4177364 - RNA, 61 nt, Human
cugcaggcuuccagggcuguggggccaaaugugcccucuccugcccucauggcagccucag

SEQ ID NO: 4177365 - RNA, 63 nt, Human
cugcaggggccucgagcacagggacugcaaccuuccucccgcugcauuguauucccccugcug

SEQ ID NO: 4177366 - RNA, 82 nt, Human
cugcagguggaguaccugagucuuagguuuacauuggucuuuuggggcaccagugagaaugaagauaaggcugaaccugcag

SEQ ID NO: 4177367 - RNA, 77 nt, Human
cugcaguaggagaaaaggccacuccuaggagcucugguauuuuccagaagcuuucagucagccuucccuuguaucag

SEQ ID NO: 4177368 - RNA, 63 nt, Human
cugcaguauggcucuuaugcucaggagauagaguagucagacccaagagagccaugauuguag

SEQ ID NO: 4177369 - RNA, 65 nt, Human
cugcagugaguuggggucuggggaagcuacaagggcagcacucagucugcagcccacuugggcag

SEQ ID NO: 4177370 - RNA, 62 nt, Human
cugcagugaucagagagaagcaguggaaucaagcaugacuucaguaguuuugaucugagcag

SEQ ID NO: 4177371 - RNA, 79 nt, Human
cugcagugcuuagcauauuaugugaucaauauauauuuaaugaguaaaugaauaagugaugucauauauaagcaggcag

SEQ ID NO: 4177372 - RNA, 59 nt, Human
cugcaguggauugucauuuuuucuugaauaauaauuucaagaugauauuuuaucuguag

SEQ ID NO: 4177373 - RNA, 77 nt, Human
cugcaguucgcauggcaggcauaaggagcgcuaauccagugaugacagcaucuuuaugccuaccugggaagaugcag

SEQ ID NO: 4177374 - RNA, 84 nt, Human
cugcaguugucuugcauguuuauuaguguaaugaaucacauuuaugaaagcauuacaaaguuauaaacaguuauaacagcgcag

SEQ ID NO: 4177375 - RNA, 66 nt, Human
cugcaguuugcuaagagacaaaagaauauuuuauaauuagccuuguguuuugcuugcaaacuuuag

SEQ ID NO: 4177376 - RNA, 112 nt, Human
cugcaguuuugcaagucuagcaagaacuggcuuucauuucaagcacgucucaaggauggagacguuuagaggggaaagcacauuugcaaaaaaggaaagaccaaaacuccag

SEQ ID NO: 4177377 - RNA, 116 nt, Human
cugcauagggcuccaaaugcaucuaugugcccuuucugcuuugcagacaguguuccaaguaucuggcugcaaagauuggguaaguagagcauucauaauggcuuucacacaugcag

SEQ ID NO: 4177378 - RNA, 67 nt, Human
cugcaucaaugacaaugauuuuuuagaguaguuuaaaaugaaacuuuucauugaaucaugucagcag

SEQ ID NO: 4177379 - RNA, 129 nt, Human
cugcauccugccuugauuucccaucugugacaagaggccugaggcugccuggagcccaugucucccuggaggugguuccgcuuggcacccagccucugcgggcggcggggaggagccgaggugguggcg

SEQ ID NO: 4177380 - RNA, 55 nt, Human
cugcaucucucugggcucuggggucugaaaagacuaggagcugauggggaaguag

SEQ ID NO: 4177381 - RNA, 63 nt, Human
cugcaucuuuucauuugccagcugguacugccaucugcgauuccagguacauggagaaugugg

SEQ ID NO: 4177382 - RNA, 70 nt, Human
cugcaugccugggaaagugaggucauuauuucaguccuaaaaauaacuucuacuauuugcagaaaugcag

SEQ ID NO: 4177383 - RNA, 83 nt, Human
cugcauguuagucuaacguucugauagaaaugacaugcauuuaugcugccauuuguuacuaucaggacucgacucgugugcgg

SEQ ID NO: 4177384 - RNA, 58 nt, Human
cugcauuagucaugcuuugcagauuugcaaagaggaauuucagagucagcaaaugcag

SEQ ID NO: 4177385 - RNA, 86 nt, Human
cugcauuuaauuggcauuggugggcaauucauuggaggcauugcaaugugacuucaggaaaugucugccuaccauagugcuggcag

SEQ ID NO: 4177386 - RNA, 100 nt, Human
cugccaaccuccugagccucauggucaucuugagucaagggaauugugugagauccacucaaguggccuugauggcuuucuucuugcaaagguugggcag

SEQ ID NO: 4177387 - RNA, 99 nt, Human
cugccacaggcagccugcccugccugccggugugggucugucaucaggauggugguggcucacagccggcuggcaggggcuuguccuuccccguggcag

SEQ ID NO: 4177388 - RNA, 83 nt, Human
cugccaccaaucuccucaccuccgugcacaagauuauaaaggucagagcucugugcugguacaugugaggaugcauguggcag

SEQ ID NO: 4177389 - RNA, 87 nt, Human
cugccacugccuuggccaccuauccucaccucauagcucgcagcgcgaggcgauaggccagguccgggucaugaggcagcagugcgg

SEQ ID NO: 4177390 - RNA, 59 nt, Human
cugccacuuacuaggcauggugcauuaggaaugucagaugguauguagggagguggcgg

SEQ ID NO: 4177391 - RNA, 80 nt, Human
cugccagaguaguuggucccccagccauguccggccuggacacaggacucaugguggggccagacuucagcucugggcag

SEQ ID NO: 4177392 - RNA, 73 nt, Human
cugccagccgccauguuaucucccagccuggcuagggugccugcuagccugcaguggcuaugguggugugcag

SEQ ID NO: 4177393 - RNA, 66 nt, Human
cugccagcucgccacaaugacacauaaugauuuuugcaaagugugugucaaauguccugagcuuag

SEQ ID NO: 4177394 - RNA, 55 nt, Human
cugccaggauucugugaaccccuccaaaagcugugacucuaugggguccuggcag

SEQ ID NO: 4177395 - RNA, 58 nt, Human
cugccaggcccagcuccagagcugcccacuccaggaagcccugagccagccuggucag

SEQ ID NO: 4177396 - RNA, 62 nt, Human
cugccaggguucauugauuccaggcucuucuagaaauuccaggaggccagucagucuggcgg

SEQ ID NO: 4177397 - RNA, 75 nt, Human
cugccagugcauucuggcagaacaggugcuuagcugauggcacuugauaacugggggaagcacauacucuggcag

SEQ ID NO: 4177398 - RNA, 55 nt, Human
cugccaguuggcacagaggguucugacccuuuccaaaacccuuuccaaacugcag

SEQ ID NO: 4177399 - RNA, 91 nt, Human
cugccaugucuugggagcauucuguggcugucuuuccagaggggcugaugggcuuccugguuagucacaggguacccagagagucuaccag

SEQ ID NO: 4177400 - RNA, 85 nt, Human
cugcccacuuuagagagcagucuggaagaaacagcgacgucagcucagcucaacaauguguuuccuucaggcucucuuggggcag

SEQ ID NO: 4177401 - RNA, 56 nt, Human
cugcccagcaacagcucugaugccaugucaaacugguuagagcugcuuccuggcag

SEQ ID NO: 4177402 - RNA, 59 nt, Human
cugcccagcagggagcuaccuggaguuggucuggcccagcagaagcucccgcugggugg

SEQ ID NO: 4177403 - RNA, 85 nt, Human
cugcccagcuccuuggaugggcaggcuugauaaccaggaacaccugccuuuucagcucuccuguccagggaagggaggugggcag

SEQ ID NO: 4177404 - RNA, 64 nt, Human
cugcccagggauaagccuagagaaagcagucccucagugaucuaauaguuuggcuuuggagcag

SEQ ID NO: 4177405 - RNA, 64 nt, Human
cugcccagucuccgggccagcccugcuggggcagugugggagggagggcuggcggaggcggcag

SEQ ID NO: 4177406 - RNA, 60 nt, Human
cugcccccaccauaguucagaccacguaaacuacuucacuggaucuaaagguggauguag

SEQ ID NO: 4177407 - RNA, 77 nt, Human
cugcccccgcccucugcugcuugccagucauugcuuauuccugggaaaagugcgaguagauucggacgccggggcag

SEQ ID NO: 4177408 - RNA, 58 nt, Human
cugccccuauggcugaugcguggagugcggcugucccagccaugcagccugggggcag

SEQ ID NO: 4177409 - RNA, 70 nt, Human
cugccccugggagcagagccaccauuuggccaagccaaggacuucuggagggccuguuugucaagggcag

SEQ ID NO: 4177410 - RNA, 59 nt, Human
cugcccuaugggcgucuguugucuggaucugcucacgagcagcagagacccauggggag

SEQ ID NO: 4177411 - RNA, 60 nt, Human
cugcccuccaccgacgaacccacaccaaugagcucagugcugggguaguuuguggcacag

SEQ ID NO: 4177412 - RNA, 64 nt, Human
cugcccugcagguugagcagccagguugagcugaaagccugcaccugaccaaccugcuggaugg

SEQ ID NO: 4177413 - RNA, 69 nt, Human
cugcccugccuggccaguguggcuccuuucccugagcugugauuucagccuggcccuggccaguggcag

SEQ ID NO: 4177414 - RNA, 58 nt, Human
cugcccuguucuggacaggcacaaagaccacgacuuugugggggccgggagaggguag

SEQ ID NO: 4177415 - RNA, 110 nt, Human
cugccgcugcagggcgcacggcuucccggcggucggcgacuucugcucuggcaacuuacgccaggguugugugcuggccgcugggagcccaggugacgccaugggggcag

SEQ ID NO: 4177416 - RNA, 62 nt, Human
cugccggaggcguccccucuuucugcacuccaacuuggaggaggaggguuggccuuagguag

SEQ ID NO: 4177417 - RNA, 99 nt, Human
cugccggcucaccccgucuccaugcccucugguuugugucaucuccaaauaucaaaagcagucaucagagguuauguggaggggagggggagcuuucag

SEQ ID NO: 4177418 - RNA, 61 nt, Human
cugccgucuuugucagccauugugggucagaauuguccacagaggcuuaaaugaguggcag

SEQ ID NO: 4177419 - RNA, 56 nt, Human
cugccuaauauccauugggagcaaaugguaugccaaacaucauaauggguguucag

SEQ ID NO: 4177420 - RNA, 110 nt, Human
cugccuacccauuuucuuucuacccagguucugccaaggaggaccugaaggcugagcaucagaggcuccaggauccuuuggccacuucuuaagagagagacaggagacag

SEQ ID NO: 4177421 - RNA, 88 nt, Human
cugccucccugcuccuggcugcgucugcucugacaguucuccuccuugagccucugcacagagcagggcagacacuaaaggguggugg

SEQ ID NO: 4177422 - RNA, 64 nt, Human
cugccuccucacguccacaguggugugcacccggaagcacaggcuugaggacgaugagcggcag

SEQ ID NO: 4177423 - RNA, 112 nt, Human
cugccucuuugucaggaaggucuucaggcuuuuccugccuccuacuacccucacauauuguagugccaauaaaggucagggaaacuaccuugggcccuguugcagaaggcag

SEQ ID NO: 4177424 - RNA, 77 nt, Human
cuuccuuccuuccucacccacuacacucaagggccagagauggccuagguguugagugggggagaaagggaagggag

SEQ ID NO: 4177425 - RNA, 64 nt, Human
cuuccuucucagcccucgaggaugcauauagcuaauuaagcaggcccagagacagagagggggg

SEQ ID NO: 4177426 - RNA, 69 nt, Human
cuuccuuucagaggaaggccuguccugcuggaacuggagccaaggggaggcugccuaugaaggcagaag

SEQ ID NO: 4177427 - RNA, 67 nt, Human
cuuccuuugugagguccugugggggcucacacauccuguggcccuuacauuucuccucugaagcuag

SEQ ID NO: 4177428 - RNA, 69 nt, Human
cuuccuuuucccaugggugccgaccauggugccagcuccagguaccccauggggacaccaugaaggagg

SEQ ID NO: 4177429 - RNA, 102 nt, Human
cuucgaacuccucagauccagcaauucacauguaccuaaaaaagcaagaacagucuucguccugggaucacaguggcagggauuuggggagaaaaauugagg

SEQ ID NO: 4177430 - RNA, 93 nt, Human
cuucgcauuauuuuaaggaaaggcauuaugauuugaguaccacaauucugugaagacauuaagucuaugucaccauuucaaucaugcaagagg

SEQ ID NO: 4177431 - RNA, 56 nt, Human
cuucggagggcugggcagccccaggagacagggcagcagcugcaggcccuccgagg

SEQ ID NO: 4177432 - RNA, 62 nt, Human
cuucuaacuacuccacucccacaacaggauguucugcucugauuggcagggagaguuugaag

SEQ ID NO: 4177433 - RNA, 87 nt, Human
cuucuaaguaaucuuuaaaguguucaguuuuggaaacuuuauucuaaguacuuaggugaagguuuggugagcuaagauuauuuaaag

SEQ ID NO: 4177434 - RNA, 85 nt, Human
cuucuaauuggugcucuuagugaucuugaauuacacuuucuaaacaaaaugaagauuauggugauuaaggauauugaaaaagaag

SEQ ID NO: 4177435 - RNA, 61 nt, Human
cuucuacacguggcugugccaagaaaggggccuccuccuuuggcauaccuuagugguggag

SEQ ID NO: 4177436 - RNA, 92 nt, Human
cuucuagaaaucaugauccauuuagagucuugcaauuuuaccaagcagagugagugaaaugccuugagauuuugacucgucuuuucaagagg

SEQ ID NO: 4177437 - RNA, 90 nt, Human
cuucuagggcaccaauccuucucucggcucugugucaguguuugucgacugugugccugugcagaaacugggaaggaaggagcugggaag

SEQ ID NO: 4177438 - RNA, 80 nt, Human
cugcuaacagcucuguguggcuguaaucugguuuaugcaaauccagucacuuugcagcccacagggaaagcuggaaggag

SEQ ID NO: 4177439 - RNA, 66 nt, Human
cugcuagaugaugggguggcuguccagugugacaagcagcaagggaggcucaaguaucacgggcag

SEQ ID NO: 4177440 - RNA, 61 nt, Human
cugcuagcugugcuuggaaguuugcuuggaaacuagcagcuuaccucccacagcucuccag

SEQ ID NO: 4177441 - RNA, 78 nt, Human
cugcuaggcaggcuguccaggcuccuuugggaauguguacauggggacuaaaauguuuggggcagaaccuccuagggg

SEQ ID NO: 4177442 - RNA, 60 nt, Human
cugcucacaaaaaacccuaacugaaaauuccccagugcacaggguucccuuguucagcag

SEQ ID NO: 4177443 - RNA, 57 nt, Human
cugcuccacaccuccauuuccucucugaaaauggggguaguguggaggguggaccag

SEQ ID NO: 4177444 - RNA, 64 nt, Human
cugcuccagcccagcuguccccuucacgcugcugagagugauauccaccuggaguuggguguag

SEQ ID NO: 4177445 - RNA, 77 nt, Human
cugcucccacggcacaggauguugcucccaugucccugcagggaugugacaagcaguucuucaaugccucggugcag

SEQ ID NO: 4177446 - RNA, 81 nt, Human
cugcucccggaggcacagcccuggucggggccccucuggaggaggguucuugccgggcucugcuccucgccggcggggcag

SEQ ID NO: 4177447 - RNA, 92 nt, Human
cugcucccuaaagucacagucuaugguggaggugcaaacaagcgauccuguuggggcuucaggguacuuccuccugugugcuuugcacguag

SEQ ID NO: 4177448 - RNA, 83 nt, Human
cugcuccuaagcauguccaauagaagggagaagcggugaauucuaauuacucaguuuuuccuccuuauuggcugcuggaguag

SEQ ID NO: 4177449 - RNA, 64 nt, Human
cugcuccuuguggcacugggcagggccuacguucaaggcuagcaguguacucaacaagggacag

SEQ ID NO: 4177450 - RNA, 60 nt, Human
cugcucuccuggcugugcaugcaaggcuucucuguuagggcagugcagcuuggaggguag

SEQ ID NO: 4177451 - RNA, 57 nt, Human
cugcucucugggccucccuuuccaagggucaggcaccuuagauggggcccaggacag

SEQ ID NO: 4177452 - RNA, 74 nt, Human
cugcucugcaugguuauauaagauggguaggcuuguuaggcgguagccacaaccuguucguuuccacagaggag

SEQ ID NO: 4177453 - RNA, 55 nt, Human
cugcucuggcuguguacuucagugucauucacacuuaaguacucagcaagagcag

SEQ ID NO: 4177454 - RNA, 62 nt, Human
cugcucugugcgcugcagaauuuguggguaucccugggaggccuggaccagccacagagcag

SEQ ID NO: 4177455 - RNA, 60 nt, Human
cugcucuuauuuguaggaugaaacuguguaaucacugucaguucuuccagauagaggcag

SEQ ID NO: 4177456 - RNA, 88 nt, Human
cugcugaaaaaauacagaaugcaauucucuugauauagcuugaaaauaguuuuuuaaaaaauauggaacuauucuguguagaagguag

SEQ ID NO: 4177457 - RNA, 94 nt, Human
cugcugacccagaaacguccagaaggucccuuagccagaacgugaucuccugugcugaggguaacacuucgggauccccaaagggucauggcag

SEQ ID NO: 4177458 - RNA, 66 nt, Human
cugcugacggaaggcuguuucugguagugauggugaaaucuggccaaggaugccgucuggaggcag

SEQ ID NO: 4177459 - RNA, 68 nt, Human
cugcugagcucagccugaggccuggcuccuccaggcugggggaaaaccaggcuugcugugcucggcag

SEQ ID NO: 4177460 - RNA, 76 nt, Human
cugcugagugggcucagccuccucacuucgagccauguugacugccucguggaggcaccgugagcuuucucagcgg

SEQ ID NO: 4177461 - RNA, 55 nt, Human
cugcugauuccucaguuaaaaagaagaaaauucccuuggaacaguggaucagcag

SEQ ID NO: 4177462 - RNA, 56 nt, Human
cugcugccucacuccagcccaauacacaggcuugugugguaugcugcaggcagcag

SEQ ID NO: 4177463 - RNA, 69 nt, Human
cugcugccugaugcuuucuggacaugaaaugaaaugguccagggcuaaaucagguuccccacugggcag

SEQ ID NO: 4177464 - RNA, 72 nt, Human
cugcugccuuuccaccuucuggugcuccagcuccucuuccagcucuugaaggugggaucgagaggacagcag

SEQ ID NO: 4177465 - RNA, 81 nt, Human
cugcugcgucuuuauugauuccuucaagcuucacauccauguuagauauauuuguagguauuaaugagacagagcaugcag

SEQ ID NO: 4177466 - RNA, 63 nt, Human
cugcugcugccuggcucugggaggccuggaaaggcccugagccucuugcacgcucagaggcag

SEQ ID NO: 4177467 - RNA, 58 nt, Human
cugcugcuugauugcaggaaguucuccccaaugucacuccugccuuaguccagagcag

SEQ ID NO: 4177468 - RNA, 61 nt, Human
cugcuggagugaagcuuauuuuucaguuaaaauugaagaacaacuuuacaucccacugcag

SEQ ID NO: 4177469 - RNA, 67 nt, Human
cugcuggcagcugcugcauuacguuguuauguuaaugccuacagaacugcagacagugccaaugcag

SEQ ID NO: 4177470 - RNA, 59 nt, Human
cugcugggucccccugcugauugauuaaaucaucaucacuggggugaagcccaaaguag

SEQ ID NO: 4177471 - RNA, 89 nt, Human
cugcuggugagccugucaaugccaccugucugaugccauacugaugacaccugugugcccucagcagguggugggcaggugaguggcag

SEQ ID NO: 4177472 - RNA, 56 nt, Human
cugcuggugaugucugggcaugugucugcuucacaguccaguguuaugaucaguag

SEQ ID NO: 4177473 - RNA, 55 nt, Human
cugcuguccaaggugccuuacauauuguccaaauauggccacuauggugcagcag

SEQ ID NO: 4177474 - RNA, 67 nt, Human
cugcugucuuauguagauacugagaauauuaaaccuguacucuucucauuugcuacauaagcaccgg

SEQ ID NO: 4177475 - RNA, 103 nt, Human
cugcugugguucaacugcacuuuaggccaacuaggcacagggaaaagcaacccucucugcuccucacauggcgcuaaaugcaggagaaacuuccucccagcag

SEQ ID NO: 4177476 - RNA, 56 nt, Human
cugcugugugaccauggacagguaaagucacaucucugacuaucuucacagggcag

SEQ ID NO: 4177477 - RNA, 63 nt, Human
cugcuguugccgugguccaggcaguggaugaugaugaucuaaagcaaggaauuggcaacagag

SEQ ID NO: 4177478 - RNA, 87 nt, Human
cugcuuaacauuaccuaguuuuucagcaaauacaaaaguuuuauaaguucaaaaguuauguguauucugagguagguauauuaacag

SEQ ID NO: 4177479 - RNA, 122 nt, Human
cugcuuaaggaaagugcgugggaaaguggccauuuggaauagauuuguuagaaaaguuugaaauucuuggacuucaacuaauuuguuuuccauggaucccaugaggauacuuguaaaagcag

SEQ ID NO: 4177480 - RNA, 81 nt, Human
cugcuuacacuuuguucuuuuagaagguauuuuaggugcccacacuuuucuguaucaaaaggauuauugaaugcugagcag

SEQ ID NO: 4177481 - RNA, 85 nt, Human
cugcuuaguaaugagguuauauuuaauucacuucucacuuugaaaauaguugauugguggguaaaaauagaguugacacaagcag

SEQ ID NO: 4177482 - RNA, 57 nt, Human
cugcuucacccugccugagaaccagggagcacugcauuucuccacaggguggaggag

SEQ ID NO: 4177483 - RNA, 75 nt, Human
cugcuucauacagugcacauuucuuaggaaagaauaaacuaugauuagcuaagaggucuguauuagucaggguag

SEQ ID NO: 4177484 - RNA, 56 nt, Human
cugcuuccauaaauaaugugcuccauguaaauaaggagucauuaaaaauggggcag

SEQ ID NO: 4177485 - RNA, 59 nt, Human
cugcuuccucccuguaaaggcagguggugggggagccguucugugcaguggaggggcag

SEQ ID NO: 4177486 - RNA, 58 nt, Human
cugcuucucggugcccuucuuagacugguuguaggugauaacagggcccuagaaagag

SEQ ID NO: 4177487 - RNA, 129 nt, Human
cugcuucugaaauuuaugcucaguucucuggccuccuagcaaauguguuaugcuaugcuucccagagacuugcucugugcauguacagcuuaggcaucagcuaagggcccugagagggauuuuaugcag

SEQ ID NO: 4177488 - RNA, 62 nt, Human
cugcuucugcaccaugauggagccucauuagauugucucuagggucccuuccauggugccag

SEQ ID NO: 4177489 - RNA, 58 nt, Human
cugcuugaccuguuguucucacauacagagcuggaugugagaacagcaggucaagcag

SEQ ID NO: 4177490 - RNA, 66 nt, Human
cuugagacucuguaguggguguuugagcaauuaaaaguacccaagaacagagugagcugucucaag

SEQ ID NO: 4177491 - RNA, 87 nt, Human
cuugagauggagcuggagagcuagccuaggccaggaucaugaagaaccuaauuguccaggcuaaggauuuuuaguuuuguccuaaag

SEQ ID NO: 4177492 - RNA, 78 nt, Human
cuugagcucuagggaagaaaggcacagaccauggaaggucacaccgucuccacugcuccuuccucccugaagcucaag

SEQ ID NO: 4177493 - RNA, 69 nt, Human
cuugaggacgugaggaguauuuuuaggugcugaaugcagcccugaaauauuuccacggccacucccgag

SEQ ID NO: 4177494 - RNA, 78 nt, Human
cuugagguagaagugaaagacuugaugucacugugagaagcaguauacuaaagggcaaaguuuucaucucauaacaag

SEQ ID NO: 4177495 - RNA, 65 nt, Human
cuugaguaucuguggauuuugguauccuagggggaucccggaaccaaucucccgcagauacuagg

SEQ ID NO: 4177496 - RNA, 90 nt, Human
cuugauaauacguuuagugcaaucucuuccucagcaugauuaacuguaauagggcugcugcugaaaaggugugcuuaauguauuguaaag

SEQ ID NO: 4177497 - RNA, 57 nt, Human
cuugauccaauauacuauaguagguuugugaauguucuugcaagugucuuggacaag

SEQ ID NO: 4177498 - RNA, 80 nt, Human
cuugauggauggugccuggcagggucagcugcuuggugcagguuccugugcccaugucaugguacgugcuguccgcuaag

SEQ ID NO: 4177499 - RNA, 108 nt, Human
cuugauuugggccagugaagacucucagggagauuguuuagcuaccauggcaucugagaagcaaagcugaggccuuagcaagagacagcccugcuagcccaaguugag

SEQ ID NO: 4177500 - RNA, 75 nt, Human
cuugauuuuaaaaacuuuuuauucuaaugucuauugauacaguagaaaagaauaggaaguuuaagcacaauugag

SEQ ID NO: 4177501 - RNA, 59 nt, Human
cuugauuuugucucuggcccuguaccauuucuucugguuugaggcccagcagagucggg

SEQ ID NO: 4177502 - RNA, 58 nt, Human
cuugcaaaacugaaaggucugucugggcucagcugauaagauguuuugguuugauaag

SEQ ID NO: 4177503 - RNA, 59 nt, Human
cuugcaaauuaaagaggauagcaagcaggcagcuuucuuuccucauuuaguuuagcaag

SEQ ID NO: 4177504 - RNA, 56 nt, Human
cuugcaugcaaaaaaaucugcauugcaaaaaaaccugcauugcuugcagcugcaag

SEQ ID NO: 4177505 - RNA, 72 nt, Human
cuugcauuuauagugcuaugcuaggugucaaaauucaaaauggaaaauuagcacaguucacuaugauacaag

SEQ ID NO: 4177506 - RNA, 71 nt, Human
cuugccagggacucagucaggggacuuugggagaaagacuugauagccaggcugacuggguucuaggcagg

SEQ ID NO: 4177507 - RNA, 65 nt, Human
cuugccauuuaggcuggcuguggucugauggccucuccacaguccaggagcaacuugaaggcaag

SEQ ID NO: 4177508 - RNA, 129 nt, Human
cuugccccaagccagagaccccaaggucugcaguagagguccuaggagcuguggugucccgauugagggggcugccccagccuggggccuucuugggaugugucucuccucauuggcuccaggggcaag

SEQ ID NO: 4177509 - RNA, 62 nt, Human
cuugccccaggugcugagguuggaagaggguucccuaagcuccuccugagcaccugugccag

SEQ ID NO: 4177510 - RNA, 95 nt, Human
cuugccccuuguuuucggccucaguccagucucacucuuggcaggagacuuucuggcaaaacuuaguguggauaaggguugauagacuaugcaag

SEQ ID NO: 4177511 - RNA, 87 nt, Human
cuugccuagacgagacacagugcauaaaaacaacuuuugggggacagguauguuuucuugcagcugcgguuguaaggucuuggcaag

SEQ ID NO: 4177512 - RNA, 73 nt, Human
cuugccuggcaucuagcccugggauuauuaaggcagagaaaauauugccucccgggguaagggccagauaaag

SEQ ID NO: 4177513 - RNA, 89 nt, Human
cuugccuggcucccuucucgggguucccgcgcccuucuccgcccagggcagcagcgcgcggggcccccgggagccgaagagcaggcggg

SEQ ID NO: 4177514 - RNA, 128 nt, Human
cuuucccccggcaucugucuggggacuggcucugugaacagacgacuggauggaaggauauggugccucuccacucagugucugguccagggcucugggcccagaggguugagguggggauggagcag

SEQ ID NO: 4177515 - RNA, 57 nt, Human
cuuuccuaaucagacaccagggcaaaugggcugacccauggucugaucauaggacag

SEQ ID NO: 4177516 - RNA, 59 nt, Human
cuuuccuccuguagcuccggagcccccuggaguccggcccuggagaucgggagaggaag

SEQ ID NO: 4177517 - RNA, 77 nt, Human
cuuuccugcuuuccauaugaaaaagcuguugcucagggagggcaugcgguuugcucacuguggcacaaaggggaaag

SEQ ID NO: 4177518 - RNA, 81 nt, Human
cuuuccuguaacuuagcaugguuacuaaauagaccuguagcacuaauauuuacauaguaaccaguggcuuacagaagaaag

SEQ ID NO: 4177519 - RNA, 58 nt, Human
cuuuccuuccccacauaagcaagagggcgaacuccuccugucugcggaggaguggaag

SEQ ID NO: 4177520 - RNA, 76 nt, Human
cuuuccuuccuucuuccaugguagguuucuuaaagaacauuucuauugauuggcuuccuggauuaggguuggacag

SEQ ID NO: 4177521 - RNA, 75 nt, Human
cuuuccuuuccagcccuuuccuucucagcuuuuagacauguuuuguaaaaguaggggaagggguggauacauaag

SEQ ID NO: 4177522 - RNA, 120 nt, Human
cuuucgguaagguagacugcguguuaacaguuaggcacggguacagcaacggagaacagcucuaauuuugcaauugcuugucacuguucauacuccaugugaaguuaaugcugcuggagg

SEQ ID NO: 4177523 - RNA, 78 nt, Human
cuuucuauacaggcgggacgugggaggaucagacagguaaggacucucugagcccagcgucccguucuguaaaaugag

SEQ ID NO: 4177524 - RNA, 87 nt, Human
cuuucuauucaguuucuucuauuuugaacuaugcuaaggaaauuugggcuuaauguggugcagaaauggaauagaaaugaaaggaag

SEQ ID NO: 4177525 - RNA, 83 nt, Human
cuuucucaccugggucagacaguuguuuugacacaguaaccuaagggaaaaacauacagcauuguucacccagguggugaaag

SEQ ID NO: 4177526 - RNA, 65 nt, Human
cuuucucaugcugcaaauggcuguuucucugguucacucaaagcagcauaugacagcauccaaag

SEQ ID NO: 4177527 - RNA, 74 nt, Human
cuuucuccaagcucagucacauugugguuugauuucccaaauuuuagcuguccaguggauuggaauaaggaaag

SEQ ID NO: 4177528 - RNA, 59 nt, Human
cuuucucuaaggucccguucuggauauucucccuguguucaaggcccuuuuagggagag

SEQ ID NO: 4177529 - RNA, 81 nt, Human
cuuucucuccuuuccuaaucccaaugacauuuaugauuccuauaaagucacaguuuaggggauaugggaaagguaaggugg

SEQ ID NO: 4177530 - RNA, 66 nt, Human
cuuucucuuuaugcaucuguacaucuguaugucuacaaacacacaaacacaugcauagagagagag

SEQ ID NO: 4177531 - RNA, 64 nt, Human
cuuucugauguaaggaacuaggcgaaugcgaauggcucuuggcuguuucuuugcugucagagag

SEQ ID NO: 4177532 - RNA, 57 nt, Human
cuuucuguucaccgcuccugcuuuauuaugcuguaaacugguauggugagaagagag

SEQ ID NO: 4177533 - RNA, 73 nt, Human
cuuucuuaauaucuuggccccaggauuuuaggauaaagacccucuccugauguucaagguaugguacugaaag

SEQ ID NO: 4177534 - RNA, 104 nt, Human
cuuucuucugcaaguggucucagaguuccagugugagagaacaugaggccuucaucuuccauaaucaucacuggagaguucaugacacaugagacagaagaaag

SEQ ID NO: 4177535 - RNA, 65 nt, Human
cuuucuugcuuuccuggcucucacucuacagacuuccaucaugagaggccagcacugcagggaag

SEQ ID NO: 4177536 - RNA, 57 nt, Human
cuuucuugguccugaagauggcugcagauccucacugugucucuuuucccaggagag

SEQ ID NO: 4177537 - RNA, 90 nt, Human
cuuucuuuucucccccucugccuuuaagaacuaguugucugaccucuugaaaugagguaacaauucucaaaagaggggagaaccagaagg

SEQ ID NO: 4177538 - RNA, 60 nt, Human
cuuugaauugccguuucaucugcaggaaugcuacuccuguuucaugaaaccagauuaaag

SEQ ID NO: 4177539 - RNA, 68 nt, Human
cuuugaccuuugcuuagcaucuacuggagaugguaucaugcccuuuagagcagggaaaucugucagag

SEQ ID NO: 4177540 - RNA, 126 nt, Human
cuuugacggcaguaucuaugucuauucauacuuguagccaucauagcaucugacacagugcauugcauauuguaagagcccaguaaaugcuuaaugaggguauauauggaucagauugcccagaag

SEQ ID NO: 4177541 - RNA, 58 nt, Human
cuuugagcuucaauuuuuggcagggaaaaaaaugacaccugucuuaauuaacucagag

SEQ ID NO: 4177542 - RNA, 100 nt, Human
cuuugaggcuaucucuuggcacagccacugaaucgggaagcagucacaaaugcuuagaggaguccagauucuguggaugugccaagagauagucccaaag

SEQ ID NO: 4177543 - RNA, 78 nt, Human
cuuugagguagccacagauagagacuuacauguucauggcuaguuacugaauuuguauggaacuacuuuuacucaaag

SEQ ID NO: 4177544 - RNA, 58 nt, Human
cuuugagucaucggaugugucauuggccccauuugacagaugaaaguguggcucagag

SEQ ID NO: 4177545 - RNA, 70 nt, Human
cuuugaguguugugucuguacugucauagguccucugccuucccaggcuagaccaacauaaaauucaagg

SEQ ID NO: 4177546 - RNA, 73 nt, Human
cuuugaucuacucacuaaacaauucauccucuauagaacugagggugcaaaggugguugguaguggguuaaag

SEQ ID NO: 4177547 - RNA, 89 nt, Human
cuuugauguugccuacuguacuuuucuuggcuagauugucuacuuuuuccuuauuaagcagccuggacaagugcaaaacaauauuagag

SEQ ID NO: 4177548 - RNA, 64 nt, Human
cuuugauucagagagaauuagcacauuauuuuucgugaagaacauaguucucuuugauccaggg

SEQ ID NO: 4177549 - RNA, 90 nt, Human
cuuugauuuuauucuacucuuggacucugguuuaguaggggacugaagaaaauuuuugguuauacuauaaccaggagcaagaggucaaag

SEQ ID NO: 4177550 - RNA, 99 nt, Human
cuuugcaaagagagaaaaauagaacccacaaaggauuucagcuccaccuugaaauguugaaugggcugggguucuguguagggcuuuauuugagcaaag

SEQ ID NO: 4177551 - RNA, 98 nt, Human
cuuugcaagucuaccuggcccuggcauguaaugacagaauauagaggaagauuucauggaagauguagggucagggaccuucuugaauaaauacaaag

SEQ ID NO: 4177552 - RNA, 86 nt, Human
cugggaagcugccgccuggcauucucuccagagagagucucagcugcucuugcugucuagaaugaucacuugguguaguuucccag

SEQ ID NO: 4177553 - RNA, 130 nt, Human
cugggaaggugagcaguucaucuuaacacaaugguucacugaaauaaaagugggguucuuacaguaacaaagaugaaaacauuuauauuuaguggggaauuaguuaucucugucauagccuaccccuuug

SEQ ID NO: 4177554 - RNA, 67 nt, Human
cugggaagugaggagcgccucugcccagccgcccaucgucugggaugugaggagcgccucugcccag

SEQ ID NO: 4177555 - RNA, 99 nt, Human
cugggaauaagucguguuagaaguaaaacacacaguccaccggcagguaagaaccaccugaugggggacuuguuuuucugcgcugagacuucuuuucag

SEQ ID NO: 4177556 - RNA, 65 nt, Human
cugggacagguucagcaguuuauaaaauaauagccaauaucuugugaaugcuuaauauguuucag

SEQ ID NO: 4177557 - RNA, 62 nt, Human
cugggacccagcccaagucuuucuggcugucuccagcuggaacagaaguggcuuggucucag

SEQ ID NO: 4177558 - RNA, 127 nt, Human
cugggaccggauucugaggggcagaggucagcgggcuggagccgcuggcccccagggguuccaugccucauccugugucuggcccagccccugaucccaccagcccacgggaguccaagugccccag

SEQ ID NO: 4177559 - RNA, 56 nt, Human
cugggaccucggggugaucaaauguuaaaaaaggacauggcuauaaaagguuccag

SEQ ID NO: 4177560 - RNA, 64 nt, Human
cugggaccugugugccugggccagucccaugccugccccaagcccugaggcccacaagucccag

SEQ ID NO: 4177561 - RNA, 55 nt, Human
cugggagaauuuguugaaggauauucuuacuuuuccuuccuugaaugccuucuag

SEQ ID NO: 4177562 - RNA, 58 nt, Human
cugggagacacugaauucugccaauaaccucaauaagcuuagaagcagguucucccag

SEQ ID NO: 4177563 - RNA, 70 nt, Human
cugggagaccccaugagaaagauacagagacagacuuuccugcauccuuccauggguuucaaaaauccag

SEQ ID NO: 4177564 - RNA, 129 nt, Human
cugggagagcugggagagucaggccauggguuccaccccuggauucaguucucguuucuggguaggaaaccuggaacauuugacuaggaaagccaaggccucaccuuucccaggacacucucagcccag

SEQ ID NO: 4177565 - RNA, 82 nt, Human
cugggagaguccuguugucucuuccuguugacgagaccgagguuuugccagacagucugaaggaggcgcugcuuguucucag

SEQ ID NO: 4177566 - RNA, 62 nt, Human
cugggagauugaggccauggugugggcgagccccucacccccauguggacuuagcuuccugg

SEQ ID NO: 4177567 - RNA, 67 nt, Human
cugggagccaaggagagaggccuuggaaaaagucagcccugccaacuccuugaucuuggacuuccag

SEQ ID NO: 4177568 - RNA, 76 nt, Human
cugggagcuuguuaggaaugcagaaucucaagcuccucccuacugaaucuaaagcugcauuuuaacaagaucccag

SEQ ID NO: 4177569 - RNA, 57 nt, Human
cugggaggcgggaggcagguggugggaggaagccuucugcagcccaaagucucuuag

SEQ ID NO: 4177570 - RNA, 57 nt, Human
cugggagguggagguugcagugagcugagauugggccacugcacuccagccuuccag

SEQ ID NO: 4177571 - RNA, 66 nt, Human
cugggaguacugggggaugucacuuacuguagaauagacagggagggacacugucaugcucaccag

SEQ ID NO: 4177572 - RNA, 64 nt, Human
cugggaguugacgaggcuuguaacaaucuacugggaugaugugagccuuuauuaaccucaucag

SEQ ID NO: 4177573 - RNA, 58 nt, Human
cugggaucaggguggcaggggaauaggaugaaacuagccacuucuaucuugcuccugg

SEQ ID NO: 4177574 - RNA, 72 nt, Human
cugggauccaaaauuuacuguagcauuucauugacuuacagcuagugugaccauagauuuuggauuuucuag

SEQ ID NO: 4177575 - RNA, 72 nt, Human
cugggauccaaaauuuacuguagcauuucauugacuuagagcuagugugaccauagauuuuggauuuucuag

SEQ ID NO: 4177576 - RNA, 59 nt, Human
cugggaugcuccggccuggauggaggcucuccgcccucucccagcuccgagcgccccag

SEQ ID NO: 4177577 - RNA, 129 nt, Human
cugggauucacaggugcugaccacugugcguuugaccaucugucaguaaagaagcaagugccaacuccccuguuucuugggugcucacaucauggagacagcacaucguccaccauguguuaucaucug

SEQ ID NO: 4177578 - RNA, 98 nt, Human
cugggcaaaggcuaguuagaguggcguccuaggaaaggagggggcuaacaguguuucugguucaucuucuauccucagccccugccuagcuuguccag

SEQ ID NO: 4177579 - RNA, 63 nt, Human
cugggcacagacccccugggccuccugccucuugaccugagugcccaaagaccugcugcccag

SEQ ID NO: 4177580 - RNA, 64 nt, Human
cugggcagagcuaacaccugagcuguuaaagauccugcauucucagguaagggcccugcugcag

SEQ ID NO: 4177581 - RNA, 103 nt, Human
cugggcagcaggcagcagggagcaaagcaggagagccugggcgagcgcacgaagggugaggcucccaucccggggucuccuccgccucugugccuggucacgg

SEQ ID NO: 4177582 - RNA, 56 nt, Human
cugggcagggagacucagccuugaccagagcaagggaaggcuucuacccuguccag

SEQ ID NO: 4177583 - RNA, 65 nt, Human
cugggccaaaugucugcauaaguucaaagucuuucuuuucauuuccagcagcauauuugucucag

SEQ ID NO: 4177584 - RNA, 58 nt, Human
cugggccuaggauggaagggccccuaaauacauccagccagucccaauccagggccag

SEQ ID NO: 4177585 - RNA, 60 nt, Human
cugggccugagcucugaagaguacaggucggcuccucucucaacccaggacucagcccag

SEQ ID NO: 4177586 - RNA, 69 nt, Human
cugggccugguagggcuugaaacaugaaagaacaaugaaaaguuaagcauuaagcauuauuacucccag

SEQ ID NO: 4177587 - RNA, 79 nt, Human
cuuuuaccacaaaauggauguuucccuucugauuugggagacuaugucuucuuagaagaaacaucuaaaaaugggaaag

SEQ ID NO: 4177588 - RNA, 77 nt, Human
cuuuuacccaggggccauuugcuagucuaaggggagcagcugaaaaugaguagcuucauggaaccugaggcuagagg

SEQ ID NO: 4177589 - RNA, 96 nt, Human
cuuuuaccucauccucauauaucuagaauauucuaaugguuaaguccuuucucuuucccaaguuaaagauccaugggaauguuuggcaggugaaag

SEQ ID NO: 4177590 - RNA, 71 nt, Human
cuuuuagcucaggaugacuucaaggaggaaguaaaauuugauuaacucaugucaauuugagcacaugaaag

SEQ ID NO: 4177591 - RNA, 85 nt, Human
cuuuuagguauuucugagcagucuagccagguguucaguuuaugggcacggaguuuaugaggcugcuuuagauucauuuacagag

SEQ ID NO: 4177592 - RNA, 73 nt, Human
cuuuuauaaaugugcacagguuagaagggacuuccaggaugucuguuuuaacccugacauguugcaaggaagg

SEQ ID NO: 4177593 - RNA, 67 nt, Human
cuuuuaugaaccauaggcaagacaauacauugaacuguacuuucuuccaaaugccugagguuugaag

SEQ ID NO: 4177594 - RNA, 79 nt, Human
cuuuucaauuaucuuuguaugaccuacuacacuaaaggcaucuugaagcuauguaugguuuauagggaaauuguagaag

SEQ ID NO: 4177595 - RNA, 80 nt, Human
cuuuucagaaugccaggagagugcaugcagggauuccaucugaucacccucagugcucucucucugguccugcuggauag

SEQ ID NO: 4177596 - RNA, 58 nt, Human
cuuuucaggcuacauuaugggaucacgugaagaaaauuccaugaaggagacugagaag

SEQ ID NO: 4177597 - RNA, 69 nt, Human
cuuuucauggcacaggauuuuaaucaguccuugaaaucaucuuugaccugguccuugucacaaggagag

SEQ ID NO: 4177598 - RNA, 71 nt, Human
cuuuuccaccaucuaagagaaaggaaguucagagccuuagcuucaacaccacaauuucuuaacuggaaaag

SEQ ID NO: 4177599 - RNA, 87 nt, Human
cuuuuccauugacacaggcaaacacagaaaguagggauaaugcaaaaggcaaccuacuuuccugugucuguguauucaguaaaaagg

SEQ ID NO: 4177600 - RNA, 70 nt, Human
cuuuucuggcuacucucccugcuucagggaagacguggucucccaggacucagaggagaagccagagaag

SEQ ID NO: 4177601 - RNA, 81 nt, Human
cuuuucugucuuggaaugaaucuuuugucucgugaauaagcaacucugggcuccuaugagaugagaggccacauagaagag

SEQ ID NO: 4177602 - RNA, 68 nt, Human
cuuuucuuuaugguaucugccucaaauccaccuccccuaaagagcugggaggguacacgagagaagag

SEQ ID NO: 4177603 - RNA, 66 nt, Human
cuuuugaucucccauugugguuucccauugguucaacccaaucacaguuaguaagggagaaaagag

SEQ ID NO: 4177604 - RNA, 67 nt, Human
cuuuugcugaauuugcuuugacugucagcaaguuggauuggauuuguggcucagaguaggguaagag

SEQ ID NO: 4177605 - RNA, 75 nt, Human
cuuuugggcugcuuugguacauagcaauacgaaaaggcuaugugcuuuuacuccccagaguagccucuucaagag

SEQ ID NO: 4177606 - RNA, 95 nt, Human
cuuuuuaauaggcagugcuuugaucaagugggaaauaguaauggacaaauaaaaucaaugaucauuaucuaacuugaugccugcuuuucaaaaag

SEQ ID NO: 4177607 - RNA, 61 nt, Human
cuuuuuacaaagccugucuucucugugauaaaagauagccuauggaaggugaugugaaaag

SEQ ID NO: 4177608 - RNA, 78 nt, Human
cuuuuuacaaguuauugggagagggaaugggagggacuuaauucuucccagauuccugcucuuauauaauguaaaggg

SEQ ID NO: 4177609 - RNA, 64 nt, Human
cuuuuuacaggugagaaaacugaggcacagguuaagugacucacuaagcucucacuguaaaugg

SEQ ID NO: 4177610 - RNA, 127 nt, Human
cuuuuuaggaaaaugaugucuggcuuguuggaugaauuaacuugcacccuagcugugaagcaaaggagcuucagagcauucgggugacaaauugcacagauaagauggcauuucuuuucugucugag

SEQ ID NO: 4177611 - RNA, 62 nt, Human
cuuuuuaucucuuaaugauguuaaggaaaggucaaagcaucuaacagaugggagauggaaag

SEQ ID NO: 4177612 - RNA, 99 nt, Human
cuuuuuccggggguuauuuucauuuuuggcuguccugcuccaaguuaaacagaggagaaacagcaucauauaguggaagaaacucagaccuggggaagg

SEQ ID NO: 4177613 - RNA, 72 nt, Human
cuuuuucugccugcagucugcagcggaggcuguucaaugugcugcccgcugcagcuggcugcagggaaauag

SEQ ID NO: 4177614 - RNA, 82 nt, Human
cuuuuucuuugguagaaauucacagauucuaaaauuugcaugaaaagaaacugugcguaaguagccaaaauaaaugaaagag

SEQ ID NO: 4177615 - RNA, 83 nt, Human
cuuuuugaucccuuugguuucucauccucuggaagaaugaucaggcauuguucauacagugaaggcuacaagagaucaagaag

SEQ ID NO: 4177616 - RNA, 59 nt, Human
cuuuuugcccauuaugcuucuagaauaugguauguucuggaagaauaaugggcaaaaag

SEQ ID NO: 4177617 - RNA, 129 nt, Human
cuuuuuuaccccaccauguugcuuccaguucacaggguuucuagcagagucucuuuaggcuaaauuguugccuugaaugggcaauuugcuugaaauguagcuggaugugcagcaucuuugcucauguug

SEQ ID NO: 4177618 - RNA, 104 nt, Human
cuuuuuuguuauaguuuaaugacuauacggaauagccaaaguaagucuuuuaaaauuaaguuugcauuguaauauuuaguucaaaagaaacuagagccuaaagg

SEQ ID NO: 4177619 - RNA, 91 nt, Human
gaaaaaaauguugcggaagcuuucuuuauguguaucaucuucuagccuacgauaaaccagaaguaaaagcuaccuuccacagcuuauuuuc

SEQ ID NO: 4177620 - RNA, 88 nt, Human
gaaaaaauggcucacucuguuagaggaaagugcugacagccauggaagcaagcacuuccucaacaagucccgccucugucauauuuuc

SEQ ID NO: 4177621 - RNA, 123 nt, Human
gaaaaaccuaguuaauugaggauuauauuuaguaggggguuucaacugaaaguuucaccugagguguaggagaacuugggguugaauguuuaguacuuuccgcuuguccuuuaauuaggauuc

SEQ ID NO: 4177622 - RNA, 72 nt, Human
gaaaaagagaugcaacagagaaaauauugagcauauuucuagaggagcuuaaauuuccugcauuucucuuuc

SEQ ID NO: 4177623 - RNA, 130 nt, Human
gaaaaaucaggauaaaugccucaacagcugucaauguuaaauaaucccuuaaagcugugaaagccuucauuugcuuucaggaguugugacauauggucaaaaauagcuugaagauuuauuaugucauauc

SEQ ID NO: 4177624 - RNA, 72 nt, Human
gaaaaauugagguuugaacuguugaaaagccaaccuaugaggcuuaggauuuaauuucagacucagcuuuuc

SEQ ID NO: 4177625 - RNA, 61 nt, Human
gaaaacacugcaggguuuacuugacuugcccaagaucacuaaacuaguccugcauguuuuc

SEQ ID NO: 4177626 - RNA, 67 nt, Human
gaaaacacugccugcuugacugaggucacagcuguuuacuggccucaguuccuaagcugcaguuuuc

SEQ ID NO: 4177627 - RNA, 81 nt, Human
gaaaacagacacuagugcagugaauaagacauggguuugggguugcuaaugguuuugaaucacugcgcuucacuuguuuuc

SEQ ID NO: 4177628 - RNA, 67 nt, Human
gaaaacagagggagucacauauaagccuaaugaaccaaggcucaaaugaggccaccuucuacauuuc

SEQ ID NO: 4177629 - RNA, 66 nt, Human
gaaaacaggaugugaggaggccauuugugguuaauggccauugguaggggggcacuuccuguuuuc

SEQ ID NO: 4177630 - RNA, 82 nt, Human
gaaaacauaauguucuuaaaucauguggcaaacuccccucagucauaugauuuguagacauuugauugacaugcuaauuuuc

SEQ ID NO: 4177631 - RNA, 103 nt, Human
gaaaaccugaauaaaaggacaauggccuucaggcuuagugauaagaaaaguuaacagugaccugaaugucaauuuuuuggccuauuuguucuuugagguuuuu

SEQ ID NO: 4177632 - RNA, 105 nt, Human
gaaaacucauagcgcaaugagagagcggugcgauccucccagguuuccgccaaaaaacccuucagaucacagcauccuuuccuuuccauugugcucugaguuuuc

SEQ ID NO: 4177633 - RNA, 87 nt, Human
gaaaacugaugccgaaaggcuguuuugaaaaggaguuguuccaagaucucccagcagugaccuucagaccuuucuguaucaguuauc

SEQ ID NO: 4177634 - RNA, 55 nt, Human
gaaaacugugcuugauuucagagcacgacucuaaauccacgguauaguuggauuc

SEQ ID NO: 4177635 - RNA, 64 nt, Human
gaaaacuguggcuggaguaugaggaaaggcguaccccuugcuucugauuugggccaggggauuu

SEQ ID NO: 4177636 - RNA, 58 nt, Human
gaaaacuuggaucucuagaaugguucauuucagagcuuuuccagauagccaaguuuuu

SEQ ID NO: 4177637 - RNA, 68 nt, Human
gaaaacuuggauuugguuaauuuagguuucuagaauauaaauccugaagaauucaaauccagauuuuu

SEQ ID NO: 4177638 - RNA, 96 nt, Human
gaaaagaaaaagaagccuaaaugaugcuauuauggcggcuaauuaaauuucuucuugcuguuacaaugcauucauuuuugaggaucauuacuuuuc

SEQ ID NO: 4177639 - RNA, 74 nt, Human
gaaaagaaaccauguguaaauuagauaacucccagaguucauaauuuuuaugcgucuucguagguuugcuuuuc

SEQ ID NO: 4177640 - RNA, 92 nt, Human
gaaaagaacaaaucuagaauaccguaacugaaucagacuugaaaaugaucaucuguacaagauuuuaugcguaucuacgauguguucaguuc

SEQ ID NO: 4177641 - RNA, 67 nt, Human
cuguacaaagacagguagcaggacagauauggcgcacaggcuguacuuugugguuccugucuuacag

SEQ ID NO: 4177642 - RNA, 67 nt, Human
cuguacaagggucugcugaacuggugguuucagcagacuacccaguuccuaagcauccaugagacag

SEQ ID NO: 4177643 - RNA, 87 nt, Human
cuguacacgagaugggagagcuggguggacuuguaguucagcugguuguugggcaugaacuugugcagcucacucuuuuuguagcag

SEQ ID NO: 4177644 - RNA, 59 nt, Human
cuguacagauugcacacggggaagcuggcagucuuucacaccauguucauucucugcag

SEQ ID NO: 4177645 - RNA, 57 nt, Human
cuguacaucucugaggacaguaccagagcccaugagguccucccuugaauugugcag

SEQ ID NO: 4177646 - RNA, 63 nt, Human
cuguaccgcagugacauuccuugauacuugucauggugauccagugagugcagcuguugucag

SEQ ID NO: 4177647 - RNA, 86 nt, Human
cuguacuaacugugcaacuuuucugugaauuuaaguauuccgaaacaguauuuauuuuaaaacauaggguagagguugcacaacag

SEQ ID NO: 4177648 - RNA, 66 nt, Human
cuguacuauuuguucacuaugaagagguuggggaaugaucacugaccucuaaguaacagagaaugg

SEQ ID NO: 4177649 - RNA, 104 nt, Human
cuguacugugucuggguugcagggaccugcagaaagcucuggcuaccagccaggugugcucggguguggccuucucgcuggccuuguccccugugcauagacag

SEQ ID NO: 4177650 - RNA, 81 nt, Human
cuguagaaacauguuuggauguucuguaagugucuauaaaaacagauagauugcagacuuacuucgagaaaugugcuacag

SEQ ID NO: 4177651 - RNA, 73 nt, Human
cuguagacaucagccaggucagauaguuaucaacacggaugauugucuaauugacuugguguggugccuagag

SEQ ID NO: 4177652 - RNA, 130 nt, Human
cuguagagucucucuuuuacagggauaguugugauuggauuaagggcccacucugaauaaucccauuucaagauccuuaauuuaaucacauccccgaagaucccuuuuccuuaucagauaaaauuuacag

SEQ ID NO: 4177653 - RNA, 61 nt, Human
cuguagaugucuguguccaaauuuccucuucuuauaaggagaggcagcagucauacuacag

SEQ ID NO: 4177654 - RNA, 76 nt, Human
cuguagcucuccacuguccuuugcugguucuuccuaauguuccuaaccucuaacauugcagugguaggugccccag

SEQ ID NO: 4177655 - RNA, 75 nt, Human
cuguaggaaaccauucaaugaggugccugccagacuuucuggguugcuggcugggguaccaguugaacuugcuag

SEQ ID NO: 4177656 - RNA, 67 nt, Human
cuguaggccuggcaugagaccugagagucugugucguaacaaguucucaggugaugucagaccacag

SEQ ID NO: 4177657 - RNA, 59 nt, Human
cuguagucccagcuacucaagaggcugaggcaccagaaucacuugagccugggagacag

SEQ ID NO: 4177658 - RNA, 71 nt, Human
cuguauaacagguggauaugcauggucccugguaccuaguaggugcuccuuaaauauuuacuguuaaccag

SEQ ID NO: 4177659 - RNA, 64 nt, Human
cuguggauguguuuuagaugucauuuuauacuuaacggugauugacaauucauuauaucuacag

SEQ ID NO: 4177660 - RNA, 55 nt, Human
cuguggauuuaggcagagcugaccuguccagaguuacucuccuaauaguuuacag

SEQ ID NO: 4177661 - RNA, 56 nt, Human
cuguggcacauguggcaaggccuucagucagggaccaagccuagucgugcacacag

SEQ ID NO: 4177662 - RNA, 61 nt, Human
cuguggcagguggagccuccugcaggcacucuguguuuccaggaggguuuucugccuucag

SEQ ID NO: 4177663 - RNA, 61 nt, Human
cuguggcuaugguguacauacuuucugauuuaucucaaacagucgugcauaauaguuaugg

SEQ ID NO: 4177664 - RNA, 77 nt, Human
cuguggcucagugaagggugccaaguacaccugugcccuccgcugguagcugcucuaacacccuucugagcccgcag

SEQ ID NO: 4177665 - RNA, 55 nt, Human
cuguggcuucuagguccccgauguagaccaacaaaugaccugagcagagcuauag

SEQ ID NO: 4177666 - RNA, 67 nt, Human
cuguggcuuuuccggggagccuuuucuucucccugaagucacccccgcauaucccggagagccacag

SEQ ID NO: 4177667 - RNA, 90 nt, Human
cugugggaaaagcagacugggaugcgggguugacagcugagacccacaccugcccagcgcccacauucugucccagcccaccucccacag

SEQ ID NO: 4177668 - RNA, 72 nt, Human
cugugggagcugggcuuggccaggucgcucaacccguggggagaaggugucggguuagcucagcccccgcag

SEQ ID NO: 4177669 - RNA, 76 nt, Human
cugugggagggguaugauagggaggugaaauucuuacugaauuucagcaagacucuauuggucauucuuccuucag

SEQ ID NO: 4177670 - RNA, 55 nt, Human
cugugggcuguacugagggcaggcugcagaaagaucugucuuccucagccuaagg

SEQ ID NO: 4177671 - RNA, 90 nt, Human
cuguggggagagcuauggguguggguuccauucuucgggggccacuucaccccccaaaugcccccacacuccuggguccucuccucacag

SEQ ID NO: 4177672 - RNA, 70 nt, Human
cuguggguugcaggguaggugacagguagucaggauauugacuccugccucucuacuucuguggccccag

SEQ ID NO: 4177673 - RNA, 89 nt, Human
cuguggucagcugagcugccugccuugccuggaggaacgcaggucccacagcugccucuguccggcaggcaggcaaguuguaccuucag

SEQ ID NO: 4177674 - RNA, 57 nt, Human
cuguggucaugaguccuuccauggugccaaaguugucauggaugaccuuggccaggg

SEQ ID NO: 4177675 - RNA, 59 nt, Human
cuguggugauaacauggcacucauguaggccauuugguugucaguuauaaucaccacag

SEQ ID NO: 4177676 - RNA, 94 nt, Human
cugugguugacaaucuucucauacugggcacagccauuggccauggugcuguccaugugcaaggaguggcuguuguuccugaacagaaccacag

SEQ ID NO: 4177677 - RNA, 82 nt, Human
cugugguuugggaguucauagugacaugcauucuggcuugcagucauacauugguuagucaaaugcguguucucagacacag

SEQ ID NO: 4177678 - RNA, 67 nt, Human
cuguguagucagguggucccacuuggggaauaaccacagguauggggggcuggcuaggggcucacag

SEQ ID NO: 4177679 - RNA, 72 nt, Human
cuguguauaaauauaaugcuguuuuaugccaaaaccguuggugaaaagucaugcaauguaaaauauauacag

SEQ ID NO: 4177680 - RNA, 67 nt, Human
cuguguauugaaaaaggguuaagauugcaaaaaucaaucuuaggcaauuugauuuuucaagacacag

SEQ ID NO: 4177681 - RNA, 55 nt, Human
cugugucccagccaggauaaugagggggaggcugucugguugccuggggacacag

SEQ ID NO: 4177682 - RNA, 93 nt, Human
cugugucugucacugagggcucaggcgggcccugcaggcagauaaggccaugggucuggcugcagcccucgccuagccacacauggacaacag

SEQ ID NO: 4177683 - RNA, 74 nt, Human
cugugugacacaguagcaaguacauaucagcuguuaagaaacaaagaucuugcuuuccuacuggagacauaugg

SEQ ID NO: 4177684 - RNA, 77 nt, Human
cugugugacccaggacaaaauaaccaggugauuuucuucugaguuuaaucugaaugucuugucugugguaaacauag

SEQ ID NO: 4177685 - RNA, 103 nt, Human
cugugugcaaagcaguguauauuuuuucugucuugaacucccacugacuauagcaugcucauggggcucuucaaguggaggagacacgcagcuuugcucacgg

SEQ ID NO: 4177686 - RNA, 56 nt, Human
cugugugcacgacuaggcuuggucccugacugaaggccuugccacaugugccacag

SEQ ID NO: 4177687 - RNA, 84 nt, Human
cugugugccaggcucuucguacuuggccuucuacacacgacacagugcucaggaggaugagcuacgaggagcucccuuuuacag

SEQ ID NO: 4177688 - RNA, 77 nt, Human
cuguguggaaaucucagggaagcuauggugagggccucauugcuggcccugcagagccagcccugaccuucccaaag

SEQ ID NO: 4177689 - RNA, 130 nt, Human
cuguguggaugagcucugacaacaggcugucugggucuggugagcuccugaaagcggggacugguggagaguacccuagggugggagcucaugaggagggggucuguggggucuggaagccauucuagag

SEQ ID NO: 4177690 - RNA, 73 nt, Human
cugugugucaaauagaguuauuaacacccgcacaguuggacauaugcgaguuaacuauggcuuugucacacag

SEQ ID NO: 4177691 - RNA, 56 nt, Human
cugugugugaccagaagagagcacucucugagcucagaaguuugguuguaacaugg

SEQ ID NO: 4177692 - RNA, 57 nt, Human
cuguguguuuauaucauuuccucaacucagauacugaggcaggauucaaacacagag

SEQ ID NO: 4177693 - RNA, 57 nt, Human
cuguguucauauucauccugucauuugagcucugugacagccuugugauggagacag

SEQ ID NO: 4177694 - RNA, 99 nt, Human
cuguguugaaauuaccuuaccauuuaggguuauauaccauagcauuuauagaugaaaugacaugaugguugaacuuaaagggaauggguagggauauag

SEQ ID NO: 4177695 - RNA, 77 nt, Human
cuguguuggaguagacagugggaaguaugggacccagaggcaggugcuugauuucuuccauugccucuucaaagcag

SEQ ID NO: 4177696 - RNA, 55 nt, Human
cuguguugggcugggcugggcuaagcugggcuaggcugggcugagcuggacggag

SEQ ID NO: 4177697 - RNA, 56 nt, Human
cuguguuucugagaaguggggaaaacugcucuugcuuugaguccucaguaacacag

SEQ ID NO: 4177698 - RNA, 75 nt, Human
cuguguuuggugugaguucauaccacaccccguugucccgaggguuucugcggauugaagucacacugagcucag

SEQ ID NO: 4177699 - RNA, 77 nt, Human
cuguguuugucuucuaaucaguuguucacucugaaaaugugguucaauucuuugaguauaacugagaacaaacaggg

SEQ ID NO: 4177700 - RNA, 70 nt, Human
cuguuaacuguugugcgggucucuggcuucggacugccuaugguugaauccuggcaccaacaauuaacag

SEQ ID NO: 4177701 - RNA, 103 nt, Human
cuguuaaugauaacaggugugcuuguuagcaugcuuaauggauauuuugauuaguucauauccaaaguaugcaaacauuuuugauuaccuguuuauaguacag

SEQ ID NO: 4177702 - RNA, 87 nt, Human
cuguuacaagugaugcaccaauacugacacauuguuauuuacuaaagugcguagcuuacaucagaguugguuccuuguguuguacag

SEQ ID NO: 4177703 - RNA, 126 nt, Human
cuguuacaauuuuugcaaaggcaguuucacagucaagguggaccagaaaaauucaguaaauagucugaaaaauauggaauacuccacuuuuauuucuuaguuguugcuuuuuaaaaggaguaccag

SEQ ID NO: 4177704 - RNA, 63 nt, Human
cuguuagaaaguuuauaguuccucaguguagugugagauagaggaaguauucuuuguuagcag

SEQ ID NO: 4177705 - RNA, 62 nt, Human
cuguuagucauauguggcauuuucuaaucuagugauaagagucugugucauugugaauacag

SEQ ID NO: 4177706 - RNA, 84 nt, Human
cugggccuuggggaccacacugggagcuggaaugggagaagcugaaacaauuuccucacccacucccugucaccuuaggcuggg

SEQ ID NO: 4177707 - RNA, 55 nt, Human
cugggcgggacagcgccaggccuacagucaccacggaaugugcucucucacucag

SEQ ID NO: 4177708 - RNA, 72 nt, Human
cugggcguuguggcucacaccuguauuccuagcacuuugggaggccaaggcagguggaucgcuugaauccag

SEQ ID NO: 4177709 - RNA, 62 nt, Human
cugggcuaauuaagcacagcuggguguacaucagccccagucaagugugacgauuaggcugg

SEQ ID NO: 4177710 - RNA, 119 nt, Human
cugggcuagauugggcugggcuggacugggcuaggcugagcugggcugagcugagcuggacugagcugggcugggcugggcugggcuggccugggcuggccugggcugggcuggccugg

SEQ ID NO: 4177711 - RNA, 89 nt, Human
cugggcucaggucaugcuucugccauacugaggacacauugugauuuucauuacaguuggaauuuugggugucagaggccugggcccag

SEQ ID NO: 4177712 - RNA, 72 nt, Human
cugggcuuugcuccguuguccucggccaagcaccugcccuggcugcaagggcacggacccugccacgcccag

SEQ ID NO: 4177713 - RNA, 74 nt, Human
cuggggaacgggccaucgggugcgggaagccacgcagaacggggucuccagcagcccgaaggcccaucccacag

SEQ ID NO: 4177714 - RNA, 79 nt, Human
cuggggacacagagcucacagucuccuggagggggugagagaugacugacagguggucuguggugcagugugaccuggg

SEQ ID NO: 4177715 - RNA, 67 nt, Human
cuggggacgagcugugagcacuuggcgugucgucguugagaagugauuugcaugcuuaauuccccag

SEQ ID NO: 4177716 - RNA, 56 nt, Human
cuggggacgucgggcaguguucugaacagcgggagccagugccucaacuuccccag

SEQ ID NO: 4177717 - RNA, 76 nt, Human
cuggggacuuugguucuccauguggccuaaauuuccacauaguaugguggcuggguuccaugggugaaauccccag

SEQ ID NO: 4177718 - RNA, 58 nt, Human
cuggggagacgaucgauguucuuggccagcuuuuaaugacaaucgauucucucccugg

SEQ ID NO: 4177719 - RNA, 62 nt, Human
cuggggagccuggggacccuccugaguucuccuccggcucuggaccucuccuggcuuccaag

SEQ ID NO: 4177720 - RNA, 57 nt, Human
cuggggagugaagguaauuacacuagaauaacagguguaaaccagggucauccuuag

SEQ ID NO: 4177721 - RNA, 84 nt, Human
cuggggauuuauuuguucauggguuguuaugcaauccuaagguugagugcaauacagaagaguggcaagggagaaucacuccag

SEQ ID NO: 4177722 - RNA, 90 nt, Human
cuggggcagaccccuccauuuagcucagagcccagaggggaacagggagugacaagucacaccugggcucugaggagggagucgucccag

SEQ ID NO: 4177723 - RNA, 67 nt, Human
cuggggcaucugacagauaaauaaacaagauaguuucucaacaauuuguacagaauuuugccuucag

SEQ ID NO: 4177724 - RNA, 130 nt, Human
cuggggcccagggcugugugugugugugugugugugugcgcgcucauagguguguuugcaggcauguguacguguguguguaugugcauaugugcacacaugcaucuucagggacucaugacaaccucgg

SEQ ID NO: 4177725 - RNA, 129 nt, Human
cuggggcccuggcccaggcccagugugugcgugcauggccguguguaugcggggccccuggagagggacgggaggagagguagcaucacacgcacauacacacacacagaugggcugggccuggcccag

SEQ ID NO: 4177726 - RNA, 65 nt, Human
cuggggccgcccagcccagaaagguucggacacugcccagguccgaaugggcaggggggucucgg

SEQ ID NO: 4177727 - RNA, 57 nt, Human
cuggggcucacuccagcccuggcaaguagccagauauccuuggguugagacccucag

SEQ ID NO: 4177728 - RNA, 105 nt, Human
cugggggagggcggaguuaagguggcgcuggagcuggucccgcucguguauggcauccuggagccggcucuguguggccgccaaggucuccugacucucccgaag

SEQ ID NO: 4177729 - RNA, 55 nt, Human
cugggggcagggagguacccuacaggagaagccagguggggccuccugucccugg

SEQ ID NO: 4177730 - RNA, 65 nt, Human
cuggggggccuggugggugggggcaguaggugagcuccgccugccccucuugcuggcccugucgg

SEQ ID NO: 4177731 - RNA, 93 nt, Human
cugggggguggcagagagggggugaggacaggagcacugcuuuggagucuggaggcugcuucuauccucauucuacuuccuaccagcucucag

SEQ ID NO: 4177732 - RNA, 86 nt, Human
cugggggucagaggucacugcagguuuaacagagugcucaggaggguagcaucugaauaaagacuugcagaugacaagccauucag

SEQ ID NO: 4177733 - RNA, 56 nt, Human
gaagaagccucuguggaucugaccaucuucuugcuccacuuggcagguguuucuuc

SEQ ID NO: 4177734 - RNA, 73 nt, Human
gaagaagguggaguagaacaagcuauuguacauuuuaaaaccaucagggaguuugauuugucuaucuucauuc

SEQ ID NO: 4177735 - RNA, 67 nt, Human
gaagaaguaggugcuaauuucaucuggaaacuugaucgauaaauuaguguuauuagcaagcuucuuu

SEQ ID NO: 4177736 - RNA, 109 nt, Human
gaagaaguaugcagggcugggcaguccaggugaaugguaggguuuaggguacugcaaagcaucucugagcuuuuauuaucaaccugucuuaacuuguauuuauaaauuc

SEQ ID NO: 4177737 - RNA, 65 nt, Human
gaagaauacagcagauggagacaaauagauuugauuucuaucuccacaauaugcauguauuuuuu

SEQ ID NO: 4177738 - RNA, 79 nt, Human
gaagaaugaauagauuucuggaaaugcacaacuaauuggcagaauuucuaaguuaguguuguccagacuuucauccuuc

SEQ ID NO: 4177739 - RNA, 85 nt, Human
gaagaaugcccaguucauagguuugcugugaacauaaaugagguaagccaugauuacugcagggccuauggagugaacacucuuu

SEQ ID NO: 4177740 - RNA, 95 nt, Human
gaagaauguuugaaaaugaaacaauuagcuguaauaucaccacagaacaggaaugguuuuguuguggcuguuguuuguuuucagcauguguuuuc

SEQ ID NO: 4177741 - RNA, 57 nt, Human
gaagacacaauugguggguccacuuggaaggaucaaggacccuagguuuugcucuuc

SEQ ID NO: 4177742 - RNA, 83 nt, Human
gaagacagugguagugaugaugauguuagagacagugauaaugauauugaugauucugaucaucaucauggugguagugauuc

SEQ ID NO: 4177743 - RNA, 121 nt, Human
gaagacaucuguacaggccauccaugcaggagggugacaacugcaaaggaggcuaggacacuuuggggugauuaauguuugcaguugucauccuccugcacagaugccuucaagugccuuc

SEQ ID NO: 4177744 - RNA, 91 nt, Human
gaagacucgcuugaacccaggaggcggaguuuacagugagccgagauugugccacugcacucuagccuaggugacagagcgagaguccuuc

SEQ ID NO: 4177745 - RNA, 68 nt, Human
gaagacucucaggucuuuaggucaguucauugcgaugagaaucaagcuagccugaagccugugucuuu

SEQ ID NO: 4177746 - RNA, 58 nt, Human
gaagacuuaggaagcuuuugaggacaaacauugccucaugauguuugcugagggauuc

SEQ ID NO: 4177747 - RNA, 62 nt, Human
gaagagaagguguaggccauccuggguccaguaagacuuuauggcagacucucuucuccguc

SEQ ID NO: 4177748 - RNA, 61 nt, Human
gaagagaccuuuaaaguagcugcaguguaauugagaagaccgcucagucacaggucuuuuc

SEQ ID NO: 4177749 - RNA, 61 nt, Human
gaagagacuuugcagugucccuaggauucaguagucucucaguaaaugguaaagucucuuc

SEQ ID NO: 4177750 - RNA, 58 nt, Human
gaagagagaguuccuaggcaaaauauacccugauauuucaauaggagcaucuuucuuu

SEQ ID NO: 4177751 - RNA, 128 nt, Human
gaagagaugaaucaugugcauaauuucuacaaguuaacaacauauaagaagcagaauucuacagaugauaaaguagaauauguuugacaucuaagaauucuuacuuuagaagugcaguuuagcucuuc

SEQ ID NO: 4177752 - RNA, 64 nt, Human
gaagagaugaggcugauaguugaagauguccuuuguuuacaacacuguucagccucuucuguuc

SEQ ID NO: 4177753 - RNA, 62 nt, Human
gaagagccaggugucgcugugguccucugcaucugggccgccgccgcgacucuuuggccuuc

SEQ ID NO: 4177754 - RNA, 62 nt, Human
gaagagcuaaaggcacaggcuuugucacauccaccucaaguccauuguggcuuuaccucuuc

SEQ ID NO: 4177755 - RNA, 62 nt, Human
gaagagcucauggugcuaucucagggcgagccaagguugcuucaugggggccaugagacuuc

SEQ ID NO: 4177756 - RNA, 57 nt, Human
gaagagcugacagugucauccugucuauggacgggaggcuggcgauggucauuuuuc

SEQ ID NO: 4177757 - RNA, 65 nt, Human
gaagagcuguucuuuggucaaagguauacaggugguauacugaugaugugaagaaacacaacuuu

SEQ ID NO: 4177758 - RNA, 55 nt, Human
gaagaggagggguuagcagggcacuccaaucuuugucuggugccuuucacucuuc

SEQ ID NO: 4177759 - RNA, 65 nt, Human
gaagaggauucaugugcaagagaagacauuggaugagauuuguaaucucagcauaagaacccuuc

SEQ ID NO: 4177760 - RNA, 61 nt, Human
gaagagguucaacguggucaucaccagguuuuucaaguagaacuccguguugggguucuuc

SEQ ID NO: 4177761 - RNA, 59 nt, Human
gaagagugaaucugaaaggcacuauaguugacagaauuguacagcccagauuccucuuc

SEQ ID NO: 4177762 - RNA, 70 nt, Human
gaagagugggcaggagccucgacuacuggcaauuaaaugcuucuacccaagucacuucuguucacauuuc

SEQ ID NO: 4177763 - RNA, 65 nt, Human
gaagagugucugcacauaggaucucaaaaacuauuuugaaucagugaauuguguagauguuuuuu

SEQ ID NO: 4177764 - RNA, 116 nt, Human
gaagaguucagaauauccuugaaauauuuaacuucugcagaaaagugcaugcuguaucaguuuaaaauacuauguaauauugauguagaguuuuuccaguuaugacuagacucuuc

SEQ ID NO: 4177765 - RNA, 60 nt, Human
gaagauaauguguuuauuucugugaaacuaaaaaacagaauaucguagcauauuaucuuc

SEQ ID NO: 4177766 - RNA, 64 nt, Human
gaagauaccuugaguaaguggaauuagccagacacucuucaaaugacaccucauagguaacuuc

SEQ ID NO: 4177767 - RNA, 89 nt, Human
gaagauagacuuuaucaugacuuccagcaauaucuucuuucucucaacuucauugcuguuuacuuaggaagacagaaaagccuauuuuc

SEQ ID NO: 4177768 - RNA, 58 nt, Human
gaagauaggagcagaagcacuagauacaguauuuggucugagcaacugcccuaucuuc

SEQ ID NO: 4177769 - RNA, 70 nt, Human
gaagauauaaacggagucaucccuucccucaacaaauuuacaccagguggggcagcucuguuuuauuuuc

SEQ ID NO: 4177770 - RNA, 81 nt, Human
cuguuaugcugggcauuggcucucacguguguucuccagucucugaccauacaauccagccauugccacaaucacauaugg

SEQ ID NO: 4177771 - RNA, 62 nt, Human
cuguucagguguacucccuuggccacuuaaagggccccguggucacaggggaccaggagcag

SEQ ID NO: 4177772 - RNA, 100 nt, Human
cuguucagucagugcccuugcaggccaggugcucuguggaauaucaccccugcucaugggucuccugugccugggaggccagccguuucuggcugagcag

SEQ ID NO: 4177773 - RNA, 56 nt, Human
cuguucaguccacuaagacccuuguuagaggaggcggggggucuggaccagaacag

SEQ ID NO: 4177774 - RNA, 70 nt, Human
cuguucccgcaggcucuggccagagacugaccguguacuuggccuuccuggucagaggcugcuggaaggg

SEQ ID NO: 4177775 - RNA, 73 nt, Human
cuguucuccuacuuugccuuucauauagauuuguagauuuuuacaaguccguaaagggcagauaugaagacag

SEQ ID NO: 4177776 - RNA, 56 nt, Human
cuguucucuguucuauugugauuucuagguagaagaauaaguagaugggagaaggg

SEQ ID NO: 4177777 - RNA, 72 nt, Human
cuguucuuaucgucuuaauaucugauacguccuccaucugaggacaacauauuaaauggauuuugggagcag

SEQ ID NO: 4177778 - RNA, 72 nt, Human
cuguucuuuaguuccacugcaauggcuggccaaucgucccccuccuccuuguagcugaaaguaaagaaguag

SEQ ID NO: 4177779 - RNA, 84 nt, Human
cuguugaagucaggugauggggacagaaagguucauuguucuauuuuuguuccuuuuauauggcucaucacagagcuucaacag

SEQ ID NO: 4177780 - RNA, 78 nt, Human
cuguugauguaagauuguauuugauugucauaucguuuguugagaugauggccacuuaaauaugcugcagaucaaggg

SEQ ID NO: 4177781 - RNA, 120 nt, Human
cuguugcauagggaacaagugggaguggugcugguggcuuugcaguuagccuaggauugagcaauugcugcaacuguugcucucugcagcuucagcguuacuucuuacugguggugacag

SEQ ID NO: 4177782 - RNA, 110 nt, Human
cuguugcauggagaacaaugugucugccuaaaauucagggcuuuguuaaaggagaaaggggagaaggaauauuggaguaggcagaugguguucuuagccauugucaacag

SEQ ID NO: 4177783 - RNA, 130 nt, Human
cuguugccaaaacuuuauucuaggcugugucuggcagcuaauaaaagcaguucuuucuguacacagaaauucacuguauuucuugggcuucacguugcuagucaaugguuauuagaggcuugcaagcaug

SEQ ID NO: 4177784 - RNA, 77 nt, Human
cuguugccaaguugauuuuucuggcucagccgggaggcugcucccuggcucuguucuaaauuaauaaggccaaucag

SEQ ID NO: 4177785 - RNA, 65 nt, Human
cuguugccucugggagacugcuacugagcucuaaaaauagcaucuugcagguucucagaggacag

SEQ ID NO: 4177786 - RNA, 61 nt, Human
cuguuggaaugaaaggcguugaucaccucaugauuagcugguugucacagcuuuccaucag

SEQ ID NO: 4177787 - RNA, 91 nt, Human
cuguuggccuccugcagaugaccagccgagauaaacagagggcacccacucucuguugcaaugugcauggugaugugaaggaaucaaucag

SEQ ID NO: 4177788 - RNA, 62 nt, Human
cuguugugaccacaggucucuccuggaugucuucuuuccuccugagcaccagucacuaacag

SEQ ID NO: 4177789 - RNA, 114 nt, Human
cuguuuaaaauggcccccauguguaggacugaagugcugucuaguguuccuaagcacaggaaggcuggaugugccucaccgagaaaauacguguagucaauaaguuuuguucag

SEQ ID NO: 4177790 - RNA, 105 nt, Human
cuguuuaaaguugauuucgggugaaacuggaagcacaaaauugugggcacauuuaacuaacaauucagugaccuaauuacuuacagaauucaacuucugccucag

SEQ ID NO: 4177791 - RNA, 97 nt, Human
cuguuuaaccuuuggucuccacaagcuuucuccuuuuaacaaaaaggucuauuauuucgaguugucaggagauaauuugugaguuguuaaaggacag

SEQ ID NO: 4177792 - RNA, 65 nt, Human
cuguuuaguuuucuuccugcaauuggcauuuaaaagaaaugagcaauuaggaagaaaacaagcag

SEQ ID NO: 4177793 - RNA, 60 nt, Human
cuguuuaucucuaaccuguuuauugacccuguguuuauaggcaggacucagauaugacag

SEQ ID NO: 4177794 - RNA, 66 nt, Human
cuguuugaacagugaucuacauguggcauuuaaacugcuaccuuuuauuucacuguugagagacag

SEQ ID NO: 4177795 - RNA, 66 nt, Human
cuguuugaaugugcugguaacugcuuugcuucuugaguagagccaccaccaccauagcccagccag

SEQ ID NO: 4177796 - RNA, 99 nt, Human
cuguuugccguggaagaaaccugugugcugugaugaaugccacugugccgagucagcauggcggacaguuuaacuccaugaccuuccgcagguagacag

SEQ ID NO: 4177797 - RNA, 75 nt, Human
cuguuuggggcugugauuuuggcuuuuggucagucuuucaugaccacagcuucuuauaucacugggucccuguag

SEQ ID NO: 4177798 - RNA, 76 nt, Human
cuguuuuagagaaguuaggaaauaaaaguguucacaacagccgaggucaucuuuaacuuuucacuuuucaaagcag

SEQ ID NO: 4177799 - RNA, 118 nt, Human
cuguuuugagaaucaacugggcccagcauacuguaagugcaaaaguguagguaaauuauugucauugcucacauucugaaugccugacaguaagugcucaaaaaauuugguagaauag

SEQ ID NO: 4177800 - RNA, 129 nt, Human
cuguuuuguggcugcugauuaaaucuccaggucucacacagaguagauuuuguagcuuuucuauaaaaauuagacuacuaguagugaaaaccuguucuguuuaauauagcaauaaauguuuuucaaugg

SEQ ID NO: 4177801 - RNA, 88 nt, Human
cuguuuuuguguacuugacuuucugcuauacuuucugucccuggagagggagcagccuuggugucagaaaguccguuuaccuaugcag

SEQ ID NO: 4177802 - RNA, 61 nt, Human
cuguuuuuguuuauaguaaauggucucagccugcuggguugaaauacuagaauagagacag

SEQ ID NO: 4177803 - RNA, 56 nt, Human
cuuaaaauacuucaguugcucucugugcauagcagaggcacuguuugugguuuggg

SEQ ID NO: 4177804 - RNA, 66 nt, Human
cuuaaaccagguacugauauugcugcugaguuugcaaauuaagauguaagaucagagcuuggugag

SEQ ID NO: 4177805 - RNA, 130 nt, Human
cuuaaacuuuucucuuuaauccaaaaaagcaaauuaucuugcuugggcaucaccugaucuucucucuccccugcucagaaagucagugucauaucaagaagaugcuugagucugauugaaguacagguag

SEQ ID NO: 4177806 - RNA, 97 nt, Human
gaaacugauagaaagggcagcuucacaauaauguccauccucucuucuuuggagggugcauuuuacccuguguauagcugcucuccagcacaguuuc

SEQ ID NO: 4177807 - RNA, 68 nt, Human
gaaacuucaaaaguuucagcauuugaaaauuauuauuuugucagugcacagagauuuuuguuuguuuu

SEQ ID NO: 4177808 - RNA, 56 nt, Human
gaaacuugauaauugaaacagaauggaaacagaaaguguuuggauuucaagcuuuc

SEQ ID NO: 4177809 - RNA, 67 nt, Human
gaaacuugggugacccugagcaaaaauuacugaaacucauaccuguacuugcucccaccccaguuuu

SEQ ID NO: 4177810 - RNA, 95 nt, Human
gaaagaaauuaguucuaaguuauuuccucgugacugaaauugcaaaugucagauuccauuacaagaggcugagauggaaagagcucauuccuuuc

SEQ ID NO: 4177811 - RNA, 57 nt, Human
gaaagaagugauuaugcuguugaaaucgugaagauuuuacagguaacacuuccuuuc

SEQ ID NO: 4177812 - RNA, 61 nt, Human
gaaagaaucaacuaugucucuggcaugcacaucaaugaugagaacaguguuguauuuuuuc

SEQ ID NO: 4177813 - RNA, 59 nt, Human
gaaagaauguggguggauaugauguccaccccuugauaugauccuccacaccuucucuc

SEQ ID NO: 4177814 - RNA, 73 nt, Human
gaaagaauuacagaauagucuuugaugguuucuugggguucuuucucaaacauaucugauuuuccauucuuuc

SEQ ID NO: 4177815 - RNA, 82 nt, Human
gaaagagaauguuugccugacuagaguggccugagcagccagagugaggaagucaucagcaggcacuaagggauuuucuuuc

SEQ ID NO: 4177816 - RNA, 73 nt, Human
gaaagagaccuaucugugagcuagcaagaguuaucauucccacuagcucuuuauagaaaugagugucuugguc

SEQ ID NO: 4177817 - RNA, 57 nt, Human
gaaagagaggggcugagaugcagaccagucuguucucucaguggcuuccucacuuuu

SEQ ID NO: 4177818 - RNA, 62 nt, Human
gaaagagaugucguuugucuucguauagacggaaauagggggaaaucaaaagauauuucuuc

SEQ ID NO: 4177819 - RNA, 57 nt, Human
gaaagagcuggcauuuauagucuuuagagcucuaaagauucaggcccauguuuuuuc

SEQ ID NO: 4177820 - RNA, 80 nt, Human
gaaagagcuuuagaagugaaauagcuguacaaaugguggacauuguuuuuauugagcaauucaucuuuaaaugcuuccuc

SEQ ID NO: 4177821 - RNA, 63 nt, Human
gaaagaggaagcugaugcccacgguucaacuaaaaaggaaaauguauuagguguuccucuuuc

SEQ ID NO: 4177822 - RNA, 111 nt, Human
gaaagagucaaugcauuaauuuccagcauuuacagguuaagugacacuuaauaaaucauugaagagucgcuuaaccugugaaugagacccguaaaugaaaccaucucauuc

SEQ ID NO: 4177823 - RNA, 83 nt, Human
gaaagauauuaaauauccaagaaacaauuaauuccauaaauguauuauuauuggaauugcagggguuuugugauauauuuuuc

SEQ ID NO: 4177824 - RNA, 66 nt, Human
gaaagcaaguguaucuauuagucagugauacaagugucaccaaguugaugaaugcauaaaucuuuc

SEQ ID NO: 4177825 - RNA, 80 nt, Human
gaaagcacacagcuugcaguacuuguuuuugagccaagaggcagcagaaauauuccaaguacugcagcuuugauguuuuc

SEQ ID NO: 4177826 - RNA, 77 nt, Human
gaaagcauaaugcugucagaaaagaaugugagcuguagugucuauggcuuuuggcuucucucuguagcauuccuuuc

SEQ ID NO: 4177827 - RNA, 68 nt, Human
gaaagccacacuggaggcuaugugcuaagccaaguucucauacucggccaggaccucccagagcuuuc

SEQ ID NO: 4177828 - RNA, 67 nt, Human
gaaagccagauugaagccuugcauagauuuuugcuucauuuauccugcaaggcuugcaauggugauc

SEQ ID NO: 4177829 - RNA, 81 nt, Human
gaaagcccuguuucuuaaucuguguggguucgaccuaaucagguggacacuuaaaaacagauaaagcaucagagagcuuuu

SEQ ID NO: 4177830 - RNA, 61 nt, Human
gaaagccuaagacagaaagacugggcacuauaaugacaggcuuugucucugucuugcuuuu

SEQ ID NO: 4177831 - RNA, 77 nt, Human
cuuagaaaggcuuuauuugaucuauaugccuugugccaagaaccaggaauaagaagauuugaugauagcucuucaag

SEQ ID NO: 4177832 - RNA, 62 nt, Human
cuuagaaaugcagauucucaggccccgcccuccagccacucgaucagaaucugcacuuuaag

SEQ ID NO: 4177833 - RNA, 88 nt, Human
cuuagaaggaugagacaaauuuuuauagugagaauuaugcccagucagggcagcauuuuccauagaaagaaguuauaaaauuucuaag

SEQ ID NO: 4177834 - RNA, 64 nt, Human
cuuagaggcagaagaaauugacaaaagacauaacacuuuuuuguuaucuguaaucugugcuaag

SEQ ID NO: 4177835 - RNA, 101 nt, Human
cuuagauuccagacauggcccugcucaaagcccagaugggagcauuucauauaaugaggccuuuucugucuggcuacuagugggcucucuugauauuuaag

SEQ ID NO: 4177836 - RNA, 71 nt, Human
cuuagauuggagaggcauggugggaaugcgacucaugaguuagaauuuacagccuugccaucuauaucaag

SEQ ID NO: 4177837 - RNA, 56 nt, Human
cuuagcgugguggguuccucauccugccuucacccggaugucccaccgccccugag

SEQ ID NO: 4177838 - RNA, 79 nt, Human
cuuagcucauucuucugaugugaugccuagcugccucugccugugauacaugaggcauucacagaaggcaccagcuaag

SEQ ID NO: 4177839 - RNA, 60 nt, Human
cuuagcuucacugggucucaguuucccuaucuguauauugggagcaguugugaagcucag

SEQ ID NO: 4177840 - RNA, 103 nt, Human
cuuaggaacuucaguucugucaguaccacugaauaucuguagaucaucauuauauaucugaauacagauauucagugguacugacagaauaccauugccuggg

SEQ ID NO: 4177841 - RNA, 87 nt, Human
cuuaggaagaugcacuuucccugugaauauuuaaagagaggcagucuguuaaaugcucagcucggggacucuggccauuugccuaag

SEQ ID NO: 4177842 - RNA, 69 nt, Human
cuuaggaagucagagcaacugagacauuggagaucaucuaguguguucccagcuuuggaccucuuugag

SEQ ID NO: 4177843 - RNA, 75 nt, Human
cuuaggauguaagagaaggaucuguuccaggccucccuccuuggcuuguagacaucugucuucucucucccugag

SEQ ID NO: 4177844 - RNA, 61 nt, Human
cuuaggcuucuugauaaaaugcagauuccuaugaaucugaauugcuaagggcaggcccagg

SEQ ID NO: 4177845 - RNA, 65 nt, Human
cuuagggagaaugccucugcagguacuaaaaaaugagaguuaaugcaugaaauauuuucuguagg

SEQ ID NO: 4177846 - RNA, 59 nt, Human
cuuagggccuccagaaggaaaccuguacaaccuugguagcuucuggagguuacccugag

SEQ ID NO: 4177847 - RNA, 57 nt, Human
cuuaggucugagauugacauaaaggggaaccggucccuagauuuccucagggcugag

SEQ ID NO: 4177848 - RNA, 77 nt, Human
cuuaguaggugaggccagagaguuugcauuucuaacaaguuccagaugaugcgaaugcuguuggaccacacuuuaag

SEQ ID NO: 4177849 - RNA, 60 nt, Human
cuuagucagagcagggcaggcagaggggauucaucaaaaugccugccuccuuuggcuagg

SEQ ID NO: 4177850 - RNA, 67 nt, Human
cuuaguccuuuaucaaacauuuauggguuuacucuguacugugcuaguugaugggagugggacuagg

SEQ ID NO: 4177851 - RNA, 60 nt, Human
cuuagucucaagguauggaaauguuuuaaaacuuuuucauauuauuccuugagucuuuag

SEQ ID NO: 4177852 - RNA, 70 nt, Human
cuuagugccaaauauugcugguguauuaucauuauuggcuuacaccauuuucugcaguguuucacuuaag

SEQ ID NO: 4177853 - RNA, 73 nt, Human
cuuaguuucucuguauguuuaccuagaagcuugccuucucuagugacaggauacagcagagaucaagacuaag

SEQ ID NO: 4177854 - RNA, 94 nt, Human
cuuaguuuucugaacugugaaaaaauugcuggcagagcugugaauccaguguaaauacuagcaguccuguagcgacuuuuuucguuuuacuaag

SEQ ID NO: 4177855 - RNA, 72 nt, Human
cuuauaacaacaguuuacuuuaaaaaaugaccucuuuuuuccccccauguugaaguucugcuguguuauagg

SEQ ID NO: 4177856 - RNA, 79 nt, Human
cuuauaccacaggugaguuugcuauuguacaccucugugaauaaugcagcuuuguaggcagcacaccugugcaaaugag

SEQ ID NO: 4177857 - RNA, 79 nt, Human
cuuauauauacacacacagguauauauauguacauauacacacauauauguauauguacgugugugugugugugucaag

SEQ ID NO: 4177858 - RNA, 81 nt, Human
cuuauauucuuacuacaguaacuggaauucuucuucagcuccuaugagccagggagacaacauuacugguuuagauguaag

SEQ ID NO: 4177859 - RNA, 68 nt, Human
cuuaucuucuccagugcuucugcacaguaaauggaaucacuaucuguguuacacuuugagaagauaag

SEQ ID NO: 4177860 - RNA, 85 nt, Human
cuuaugaaccaggaggugaaacuucaccagacaccagauuuuccagugccuugaucuuggacuuuccagccuccugaacuaugag

SEQ ID NO: 4177861 - RNA, 60 nt, Human
cuuaugaacuguggacaaccacuuuuccugcuaugagaaaguugauuugcaguuuaagag

SEQ ID NO: 4177862 - RNA, 65 nt, Human
cuuauggagaggaaucauuauuagagaggcugacucugcaauaauguaugucacucccccaaaag

SEQ ID NO: 4177863 - RNA, 71 nt, Human
cuuauggcugucuuggaaaaggcaaagagaaaaacauuucucuuuguuuuucuuccaaaacaucuagugag

SEQ ID NO: 4177864 - RNA, 103 nt, Human
cuuaugucaucuuccaucuuccucucuaauugaucagacaagccauaccucauugugugacuaaaacuuaagagguguuagugagaauugcccaaaacauaag

SEQ ID NO: 4177865 - RNA, 74 nt, Human
cuuauguuucaucaguauauuccuuggucuuuagcccaagguuggaguguaggacuugugugaacacuuguaag

SEQ ID NO: 4177866 - RNA, 72 nt, Human
cuuauguuuccagcuguggauuggguacuuucuaaacagagaugucugaccacuagacugaugaagcaaaag

SEQ ID NO: 4177867 - RNA, 69 nt, Human
cuuauuagucauuagucggcauuacuuaucacuguugauuauagcaaugcuuauugcugacuauagaag

SEQ ID NO: 4177868 - RNA, 111 nt, Human
cuuauuaucugguagccucacuggccucuggcugaggacuaacgcuggaagaaaaguaaacugguguuggcuggccuagagguugucuucuggggcugcuaguuugguaag

SEQ ID NO: 4177869 - RNA, 72 nt, Human
cuuauucuacuuuggacauaaaggacugauauccacugaaucugucuacuaagguaugucuaaaagcauaag

SEQ ID NO: 4177870 - RNA, 129 nt, Human
cuuauucuauagacuacaauuucuaccuauauucaaauggcauuuaguugcguauugcauauauuuuaucugauuuguagcuacaugucugaagcuaggacaaugauauuaguaaauaguacaguaaag

SEQ ID NO: 4177871 - RNA, 67 nt, Human
cuuauuuaugucugucucuaauaucuagcauggugugucucauugauagcagacaucuauaaaugag

SEQ ID NO: 4177872 - RNA, 56 nt, Human
cuuauuucagcccugggcacccuguaagcaggguuggccagagaugcugauauaag

SEQ ID NO: 4177873 - RNA, 56 nt, Human
cuuauuuugauccuugcuucuugugaucaauggcacuuaagccaggucaagauaag

SEQ ID NO: 4177874 - RNA, 55 nt, Human
cuucaacaaccaugugcugucugugcggaucaaggggggcaugugagugcugagg

SEQ ID NO: 4177875 - RNA, 61 nt, Human
cuucaacggaucaugugaccuuugagugguugccucugggacaucauaugauucuuugagg

SEQ ID NO: 4177876 - RNA, 109 nt, Human
cuucaacucugacugcagaaggagcuauuguauuuaggagaaaaggguaaagacaacagaccacuuggcccuuguucugaacuuaaauauucucggcagagcaguggag

SEQ ID NO: 4177877 - RNA, 83 nt, Human
cuucaacuucaugauugauucuuuguaucuuaauuuuguaaauuuaaaauuucagauauuaaagaaugagguaguggagggag

SEQ ID NO: 4177878 - RNA, 61 nt, Human
cuucaaguguccccuucauccagauaucaggaaacaucaugggccuguggggaucuugaag

SEQ ID NO: 4177879 - RNA, 68 nt, Human
cuucacaaacuucaugauggcacacagcagguuucucaaauaacuguugguguauguaaguugugagg

SEQ ID NO: 4177880 - RNA, 66 nt, Human
cuucacacccacuaaaaugauguuuaaaaaaaauggaaaauaacaaguguuagcaaggguguggag

SEQ ID NO: 4177881 - RNA, 76 nt, Human
cuucacagacgccuccccucgccucuaggaauccugucccccaugggcugggagguggugggggcagucuaugaag

SEQ ID NO: 4177882 - RNA, 92 nt, Human
cuucuguugguuucuacagcuuuauacccaucaaaagguauaucaaaauaacuuuucgguaugcagcuguuccagagacaucugacagauag

SEQ ID NO: 4177883 - RNA, 84 nt, Human
cuucuguuuuuacucucuaguucuauuugcugauuuuuguuaauauuuauaauaacagaaauaguaggugagggaaagcaggag

SEQ ID NO: 4177884 - RNA, 55 nt, Human
cuucuuacuugucuugcauauagggaaaucuugaauguaggucuuggugagcuag

SEQ ID NO: 4177885 - RNA, 98 nt, Human
cuucuuaugugugccaugcauuggaaugcauuugaagagacacucuuaaaacaaagcacuucucuuuaaaguguugcauaugcauucauuuaaaguag

SEQ ID NO: 4177886 - RNA, 56 nt, Human
cuucuuccuccagucucugaggcuuuagggguccucagggauagaaaggaagacag

SEQ ID NO: 4177887 - RNA, 59 nt, Human
cuucuugauugcuuucaaaccagacuuuuuauguuuguggaagauaaaggaucaaggag

SEQ ID NO: 4177888 - RNA, 69 nt, Human
cuucuuggguccuggcugaagaucucugcugcccccagacucagaagagccacuccaggacucagggag

SEQ ID NO: 4177889 - RNA, 60 nt, Human
cuucuuuagggaucucuugcugugugauugcuauaggggagccaagaaucucuaaagaag

SEQ ID NO: 4177890 - RNA, 57 nt, Human
cuucuuuagucauugucauuccuuugaggcgcaaguuccaaagaaucauuagagaag

SEQ ID NO: 4177891 - RNA, 57 nt, Human
cuucuuuccuguuccacugaagucuugaaucuaaugucugggaaauugggaaagaag

SEQ ID NO: 4177892 - RNA, 74 nt, Human
cuucuuuguccucugauuucuagguauauccagccaaugagaugcauuuuaagaagauaugagggucaaagaag

SEQ ID NO: 4177893 - RNA, 129 nt, Human
cuucuuuugaagcacgauuugcucccuacaagccacaagacauuuuguugaaacccuuguuguuugaaguaccaagcauaacaacagacucuguguuugugggaagggauuggcucuuucaccagauag

SEQ ID NO: 4177894 - RNA, 69 nt, Human
cuugaacccgggaggcggagguuguggugagccaagauugcaccauuguacuccagccugggugacaag

SEQ ID NO: 4177895 - RNA, 55 nt, Human
cuugaagaaaguauguugggaucauaaugaugucacccucaguucucucuucagg

SEQ ID NO: 4177896 - RNA, 80 nt, Human
cuugaagccuguuacuuauuuguaaagguccauaguaagauugaacuuacuauuuggaauuuuaaauugguagcuucaag

SEQ ID NO: 4177897 - RNA, 79 nt, Human
cuugaagcuuugacuccacuccuaacuccuagcacccucaaacccucaggggaggagauaggggugucagggggucaag

SEQ ID NO: 4177898 - RNA, 79 nt, Human
cuugaauuagagugaaaugcaauuguauguacuccauguuguauaacuuggaugacacuugguucacacuuuguucaag

SEQ ID NO: 4177899 - RNA, 126 nt, Human
cuugaauuuauuuggcccagagggagguagacaaggggcaguuaauaugucuuugcauguuaagaugacaguuuagagcaugaugaccaguuuuuagucuucauugcagucugggcuggaggcagg

SEQ ID NO: 4177900 - RNA, 56 nt, Human
cuugacauuaguuaugcagauaaggcaaccgggugcucucuuaacuaauggucaag

SEQ ID NO: 4177901 - RNA, 96 nt, Human
cuugaccccguaaccacuucgacagccaucagcacacgcugcagcaccacacaugcaguguguggugagggcugcccaacugcuuagggggucaag

SEQ ID NO: 4177902 - RNA, 66 nt, Human
cuugacuaauuacacugagcaguugucuguugcuacaacuucugccaaacagcuguuauuguuggg

SEQ ID NO: 4177903 - RNA, 79 nt, Human
cuugagaagcggauccauagagcaacucaucuccacugaaacaguagaacaaugaauuucuggaggaauuguuuucagg

SEQ ID NO: 4177904 - RNA, 74 nt, Human
cuugagauaugcagcuggaacuuagaggagagguaaacaccucucaguuuaaauuuagguugcugucaucuaag

SEQ ID NO: 4177905 - RNA, 77 nt, Human
cuugagauggaaucuguguggagggcucagccugaggauaaaaugaguucaucguuugcacauguuucauucuuaag

SEQ ID NO: 4177906 - RNA, 96 nt, Human
cuugagcagguuucuucaucucucuguguuccaagucuccauuuaugaaacugggaugacuucugcuuuacagaguugauaugaggcuugcaugag

SEQ ID NO: 4177907 - RNA, 63 nt, Human
cuugaggacuucaggccuggccaggggggcaccucuggcucaggagcuguguucagagucaag

SEQ ID NO: 4177908 - RNA, 56 nt, Human
cuugaggagccagauguagaguuuaguuguagauguauacauccggguuacuuaag

SEQ ID NO: 4177909 - RNA, 63 nt, Human
cuugaggcaucacuucuugcuuuguuuccaagugagcauaugcaagaacaggugcuuggcaag

SEQ ID NO: 4177910 - RNA, 81 nt, Human
cuugagggacuuccagcgggucauggcugcuccagccccugcuccgagcagcucaaagccugcaaggaacagaaucacaag

SEQ ID NO: 4177911 - RNA, 86 nt, Human
cuugaguuauuguuaauuagagguaugugaagugauaccauacuaugguuuuaaaaugcauuucucugauuauuuauaaggucaag

SEQ ID NO: 4177912 - RNA, 81 nt, Human
cuugaugacuaugauaagucaaaggcauaauaauuguuauuaugguuauuagcuuuaaagacuuugauucacauucacaag

SEQ ID NO: 4177913 - RNA, 73 nt, Human
cuugauguccuguagcaggaaaacugcucccaagcugcaaucuguggcuugaauucugcuugcaaauaucaag

SEQ ID NO: 4177914 - RNA, 97 nt, Human
cuugauuaagacucacaggucaaauaucaucucucuuuucugcaugcuaauuaaaagcaacucuguucuuagguauuugacagucauuugaaucaag

SEQ ID NO: 4177915 - RNA, 76 nt, Human
cuugauuccugucuggggccagugcugggugggcccagcuccccacuuacccacagggcacagacaggaagcaaag

SEQ ID NO: 4177916 - RNA, 94 nt, Human
cuugauucugucaagccagauagaagaacucauuuuauauagugacaauagacaugaguaaauuaucuguuaaaaaggcacagagagaaccaag

SEQ ID NO: 4177917 - RNA, 73 nt, Human
cuugcaaagcuguaaugcaugcuuucuuuuaucucucaaaguaauagaaaugagauuagagcuuuucugcagg

SEQ ID NO: 4177918 - RNA, 63 nt, Human
cuugcacagaacucuuagagguucuggggccaaaagauuuccaucucugagaaguuuuucagg

SEQ ID NO: 4177919 - RNA, 103 nt, Human
cuugcagagaugaugauaagccugcagcaggugacaacgaguggacucaccuccaagcucuucauuuuuugcauaccuguguccauugccaucucucugccag

SEQ ID NO: 4177920 - RNA, 64 nt, Human
cuugcagaguccuaaacacucaggacugaaucacagcacccauggagguagggcuuaaggcaag

SEQ ID NO: 4177921 - RNA, 61 nt, Human
cuugcaggcccagccuuacaagcacaaguugagugcucagccuguaacugggacugcacag

SEQ ID NO: 4177922 - RNA, 83 nt, Human
cuugcauaaagucaauaagugguagggcugagauucaaaucuaaauacuagauuaugcauuccaaccuuauucacuauguggg

SEQ ID NO: 4177923 - RNA, 129 nt, Human
gaaugguuuuuagaacugagugagauuacuuaggaaauaaauacuuaugguuaauaaaggguaauguguucuaaugagaaguaauuugugcuuguuuauuuuuacucuucuauguuuuaaaaagaauuc

SEQ ID NO: 4177924 - RNA, 67 nt, Human
gaauguacagugauaagagggcagaagucacaggacagacucugaaucuuaauaauuguguguauuc

SEQ ID NO: 4177925 - RNA, 71 nt, Human
gaaugucuccaacuuggggaaaagcucugucuacaguagaucaugcugcuuuucugaaguuuaagacauuu

SEQ ID NO: 4177926 - RNA, 64 nt, Human
gaaugucuccgaagcuggauugauguggggaaagcaccuuucccuucuaguuuugagagacuuc

SEQ ID NO: 4177927 - RNA, 64 nt, Human
gaaugucuucaaaacuagacugauguggaaaaaacaccuuucucuucuaguuuugagagacuuc

SEQ ID NO: 4177928 - RNA, 70 nt, Human
gaaugugaaacugaagcauccauacucaccauuacacccaggaaguguggguguucucacuuagauaauc

SEQ ID NO: 4177929 - RNA, 78 nt, Human
gaaugugagaucgugagaacacacagcugguuggcaagcagcaucaaccagcucuuucuuuucacuauauuacauauc

SEQ ID NO: 4177930 - RNA, 78 nt, Human
gaaugugauaggaggagacccaagcucugcagaggacucuccaguauaaaacagauuggguuugcuucugugccacuc

SEQ ID NO: 4177931 - RNA, 58 nt, Human
gaaugugucacccugucccaugccacagccugagacagugugcagguguuucauauuc

SEQ ID NO: 4177932 - RNA, 79 nt, Human
gaauguuccaugccuucugccagauuaagggugggauucuaccacauauuugccaugaagaguguuugaaaacacauuc

SEQ ID NO: 4177933 - RNA, 95 nt, Human
gaauguuggagcugggaaugauuuuggagaggaaaaaaaugcaucucaaauuuugcagcaauuucuccccaaaggacucacucucaccaccuuuc

SEQ ID NO: 4177934 - RNA, 93 nt, Human
gaauuaacagggagggaacacagaagggcugaaaaaugaggugcuguucuccuucuuuuaccucagcugcugugauuccugcuaucccaauuc

SEQ ID NO: 4177935 - RNA, 122 nt, Human
gaauuaacuagggaauuuucaaaaacuucccaugccuggccccuauccuuagagaaucagauuuaacucguuuggauuaguucccagguguggguauuuuuuagaaguucacacagugauuc

SEQ ID NO: 4177936 - RNA, 70 nt, Human
gaauuaauaauggggggaagauaucagggacguuuauuuugcauccaagaaaauuuucucucuaugauuc

SEQ ID NO: 4177937 - RNA, 82 nt, Human
gaauuacacuguagguggcaggcagcuucuaggauggccccaaugaucccugcuuccugauauucauacuguuguguaauuc

SEQ ID NO: 4177938 - RNA, 63 nt, Human
gaauuagguaauagaacuaguaauuaagaugguucaccucuaacacaguucuguggccuguuc

SEQ ID NO: 4177939 - RNA, 85 nt, Human
gaauuagugacaggaauguguggaugcggaaguagagggcaaaaccauuaaagucuacuuucacucauacuuauucauuauauuu

SEQ ID NO: 4177940 - RNA, 101 nt, Human
gaauuaguugggccaagauauguguauuuccaucgaucagcagugacucugcaagagagaaagcugauaugggacuguccaguguccuguccaaaagauuc

SEQ ID NO: 4177941 - RNA, 72 nt, Human
gaauuaugaaucugucgaaugcaguccuauaggucuucccuacauacuccauaaugacagcaucuguaauuu

SEQ ID NO: 4177942 - RNA, 81 nt, Human
gaauuauuuugauagcuguugccaauuuccaugguguaaauacucccaccguggccaguuucaagcuaccaacaugauguc

SEQ ID NO: 4177943 - RNA, 73 nt, Human
gaauucacaguggguggcuaaguggcugacucuggggucagacuggguuugcagccaccuguucugugaguuu

SEQ ID NO: 4177944 - RNA, 76 nt, Human
gaauucgaccacagcagugcaagaggagaguaacccccucuuuccucauuugcaguguguguaugacuaagaauuc

SEQ ID NO: 4177945 - RNA, 71 nt, Human
gaauucuaccccaugguccccacgcucugaaaagugguggaggagaugguuggguuaacaacuaagaguuu

SEQ ID NO: 4177946 - RNA, 73 nt, Human
gaauucuaugauguaaaauaaguugugagcuuugaguaaaggccuucccacauuccuuacaugcauaggguuu

SEQ ID NO: 4177947 - RNA, 69 nt, Human
gaauucucuggagaacuuccaguuucccaagaagaaacuuagcaaaucuuuuggauucucuagggaauc

SEQ ID NO: 4177948 - RNA, 94 nt, Human
gaauugcugaauugauuguggccuguguggcuuccugggagauggcccaggcuagcugguugggaugcucacagcuguggucauucaccaauuu

SEQ ID NO: 4177949 - RNA, 60 nt, Human
gaauugggagaaguagcugguuuacuuguaugcuuauuuaacuuguauuucuccuuauuc

SEQ ID NO: 4177950 - RNA, 99 nt, Human
gaauugggugucuccaggggcaggccagccguaucaaugauuaaauugaucuaggugguaggucuguuuugaacuguucucuguaaaggcaccaauuuc

SEQ ID NO: 4177951 - RNA, 85 nt, Human
gaauuggucucugagcccagcucuaccucagacuugcugcuuaugccgcaguguagauccugaggcuuggugaguugcccgguuc

SEQ ID NO: 4177952 - RNA, 57 nt, Human
gaauuggugcucuggcacauuccucucuccaucugaggagugugaagagccuagauc

SEQ ID NO: 4177953 - RNA, 77 nt, Human
gaauuguagagggaacagaagcauucagaaccuaacacuucagaguaucuguuccuuucucauuuaauagauaauuc

SEQ ID NO: 4177954 - RNA, 76 nt, Human
gaauuguaugcugucuugauagcaaugcuugaauggacgucauugauguugggcacucaagacagacauggaguuu

SEQ ID NO: 4177955 - RNA, 70 nt, Human
cuguucucaauaugugcuuuggccacuugggaaguggucccaagucauuguuuagucauguuagcuacag

SEQ ID NO: 4177956 - RNA, 69 nt, Human
cuguucucccugcgugggcuccaggguccguuugauaagcugcuuuccccgggguccugugggagacag

SEQ ID NO: 4177957 - RNA, 75 nt, Human
cuguucugaagggcccgcagggcuuaagggaggaaagcggcuucccacaggggcucuguggguucuuuuggggag

SEQ ID NO: 4177958 - RNA, 57 nt, Human
cuguucugcagacuuggaagguggucuggugacuccuguccuauucugcaguaacag

SEQ ID NO: 4177959 - RNA, 76 nt, Human
cuguucugcccacccugagccuugauggcugagccuugagcagcucagcuaggggaccaagguggcccaaggacag

SEQ ID NO: 4177960 - RNA, 79 nt, Human
cuguucugcuguuuucuuuguccuagcauucuacauagagaaacugucuaguguuaaggcaaaguaaagguaagaaggg

SEQ ID NO: 4177961 - RNA, 83 nt, Human
cuguucuggaggccagaagucugagaucagggugccaauauggucagguucuggugaagacucucuuucuggcuuucagacag

SEQ ID NO: 4177962 - RNA, 78 nt, Human
cuguucugucgugucgggggaggaaguugcugccccucagugucccugagucucgguuuccccuccaacaaucagcag

SEQ ID NO: 4177963 - RNA, 56 nt, Human
cuguucuucacauuucauugaggagcacggggaagcuuuggggugggaagaagcag

SEQ ID NO: 4177964 - RNA, 100 nt, Human
cuguugaagcuaaaaagauggaagacaugaugauucuccuuccaguuguauuucauuucgauuaauccuuuaugguuuuccucccuucugguuucugcag

SEQ ID NO: 4177965 - RNA, 72 nt, Human
cuguugaggugggugucaggucagagcccauggacuccucuacacagcuuugagcuggcagcuucccagcag

SEQ ID NO: 4177966 - RNA, 70 nt, Human
cuguugccaggcuggagugcaaugacaugaucucggcucacugcaaccuccaccucccagguucaagcag

SEQ ID NO: 4177967 - RNA, 86 nt, Human
cuguugcuccuucuugcauugggcuggccuguaucaagugaagggguugggcacuguagcuggugcuggggggagcuaauugacag

SEQ ID NO: 4177968 - RNA, 72 nt, Human
cuguugcuuuggcaaugucauuuucaaucauacaggaguauguguuguugaucguaacauuguagagcacag

SEQ ID NO: 4177969 - RNA, 73 nt, Human
cuguuggaguuuguuuacucuuggacagacaugacuuucuguuucuccagagagaaaaacaagcuuuacacag

SEQ ID NO: 4177970 - RNA, 55 nt, Human
cuguuggcuauagggagauggggcagggaagcccagauccucuauaagccagugg

SEQ ID NO: 4177971 - RNA, 79 nt, Human
cuguugguggccuggcugccuaggugcuagggguggguuuggccacacccuggaggcuggaggcaguaggggccagugg

SEQ ID NO: 4177972 - RNA, 67 nt, Human
cuguuuaaugagcuggaggaggaaguggcuccugaaagcaaguccuuuucuuggcucaggcaugcag

SEQ ID NO: 4177973 - RNA, 60 nt, Human
cuguuuaugucacuguagguggaggauggugagaauucucuuaacagugcuacagagcag

SEQ ID NO: 4177974 - RNA, 65 nt, Human
cuguuucacaguagaaaucauuaugucaucaaauuggcuuaauuucaaacugcuagugauaacag

SEQ ID NO: 4177975 - RNA, 73 nt, Human
cuguuucagugaaguaauggugagagauauagguauuagguguccuuacuauuacuuacauuuuuugauucag

SEQ ID NO: 4177976 - RNA, 108 nt, Human
cuguuuccuggggauuccucucuugacucuauauauacuucacugcuuaacucaagaucucuuuaaagaggugcagugagugagaauuauugggggccugggaggcag

SEQ ID NO: 4177977 - RNA, 66 nt, Human
cuguuucucacuuuccagacuuuucaaaauuaucaguaauuuaugaaggguggagaagagcaaugg

SEQ ID NO: 4177978 - RNA, 66 nt, Human
cuguuugaguccugcuuucaauucuuuuggguaaacaccuaggaguggaauugcuggaucauacgg

SEQ ID NO: 4177979 - RNA, 107 nt, Human
cuguuugcuggcuguaucuuggaagcuggaacagaagcacuggagagauaguaaaccaacauucuccaucuguccauuuaggaaaugccaccugagccagcagccag

SEQ ID NO: 4177980 - RNA, 93 nt, Human
cuguuugucuggagauuaggagaggggaaggauggaggaagccucaguggcuuccaagguccucuccacccacucccaguuccagaaaggcag

SEQ ID NO: 4177981 - RNA, 75 nt, Human
gaaggguugacacuugauuuuuauaauaaauggucuuuguauuaugcuguuaggaaaaucaaaauauugcccuuu

SEQ ID NO: 4177982 - RNA, 109 nt, Human
gaagguauauggaguaaagugcaugcaauuaagguuuaaauuuucuguuggugucgccaaagauuuuagaauuugcaauuuuauaguguacuuuucuaguguguccuuc

SEQ ID NO: 4177983 - RNA, 74 nt, Human
gaagguauuuuucuguguuaaaauuugucuuguugauguaacagaauuuuuacacaggguaaauaugugcuuuc

SEQ ID NO: 4177984 - RNA, 63 nt, Human
gaaggucagaggcaauuugaauaguaguaguuggcagaauacagauucagugucucugacuuc

SEQ ID NO: 4177985 - RNA, 86 nt, Human
gaaggucuguugcugucuuuuacuaucauuuacugucucccugcuuggaaaguaugaauuacugauaggacuagcaaucuaccuuc

SEQ ID NO: 4177986 - RNA, 69 nt, Human
gaaggugagacagcagauuagcaaugauuccacaccaagugucacuguacuaacugcucuuucacacuc

SEQ ID NO: 4177987 - RNA, 90 nt, Human
gaaggugauaauguucugaaucaagcaacucuccagugguagaaaacaccacagcccagagaucuugauugagaacauuuuauucccuuu

SEQ ID NO: 4177988 - RNA, 70 nt, Human
gaagguggccuggggucucaauucuagcgggcugaugcagcccaccuggcucugaggcuccagauucuuc

SEQ ID NO: 4177989 - RNA, 99 nt, Human
gaaggugguagauucugcaaugcggccugagguaguaaaaugggcagguaagggugugauuccauuuguaucugggcugcugugggaugcuguugauuc

SEQ ID NO: 4177990 - RNA, 55 nt, Human
gaaggugguaucaugaccucagcagagagagggcucugaagaugguaccagcuuu

SEQ ID NO: 4177991 - RNA, 73 nt, Human
gaagguguaaaggguauggccucugggguccuugcuagacuggcagguccaucgcccuuuacucagugccuuu

SEQ ID NO: 4177992 - RNA, 60 nt, Human
gaagguguucauaccauauuaaguaaagagaacggacuauaagacaguaugaauacuuuc

SEQ ID NO: 4177993 - RNA, 84 nt, Human
gaagguuuauaaagaugcuauagugaaggagucucuggggacacaaaucgaguggcuguuuuauugugauuuuuacagauguuu

SEQ ID NO: 4177994 - RNA, 80 nt, Human
gaaguaaagcacaaacacugaguaucagaguugggaaucaccucagguaucccagccuguacccagugcaaaaugccuuc

SEQ ID NO: 4177995 - RNA, 66 nt, Human
gaaguaacaaggacuuguaguuuuaugccuaagcaaaacuuuaaauuuguaccucuguguuacuuc

SEQ ID NO: 4177996 - RNA, 94 nt, Human
gaaguaacacauugagagcaaaggggggcaauaauucuguaugcaaagugucagugcaacagacuuuauuaacucuuguuaaaauguucacuuc

SEQ ID NO: 4177997 - RNA, 79 nt, Human
gaaguaacagcuauuuaucuuucaugauaagggccaacucuagagauucaugucaugguauuuaaguaaucauuacuuc

SEQ ID NO: 4177998 - RNA, 64 nt, Human
gaaguaccaggccaccucgacacagccuuccugcucuuccuucuccagguggccugggagcuuu

SEQ ID NO: 4177999 - RNA, 83 nt, Human
gaaguagagaagauaaguaacgagccucaguucucauagguaguaagaggcaaagcugggauucgaacuuguuuuucugauuc

SEQ ID NO: 4178000 - RNA, 58 nt, Human
gaaguagcaggaaggguccuccccgagccuggggagggagcauccccuugcugacuuc

SEQ ID NO: 4178001 - RNA, 57 nt, Human
gaaguagcccuaaggugacagugagcaugacgcucggaguuaucaaggggcuacuuu

SEQ ID NO: 4178002 - RNA, 80 nt, Human
gaaguaggguacuagucacacaauuguguacauuugucaaaauuuauaaaauuguguacuucaaaaggguaaauuauuuc

SEQ ID NO: 4178003 - RNA, 90 nt, Human
gaaguaucucucgccugcugaauucuaccauccauuucccucuugguggaagcagaaugggcuagaauuuaggcgagagaaguaugaguc

SEQ ID NO: 4178004 - RNA, 88 nt, Human
gaagucagaaaugagggagugaaagugaggggcaaauauucuagagccauauaagccucugcaucaucacuccagcccucugcauauu

SEQ ID NO: 4178005 - RNA, 63 nt, Human
gaagucagaaauuauucaggaauuuguaggccaagauaaagccaugauaagauuucugauuuu

SEQ ID NO: 4178006 - RNA, 66 nt, Human
gaagucagacugcuguggucuagagacuuuguauuugcccauacucuagauccgcaguaaaacuuu

SEQ ID NO: 4178007 - RNA, 70 nt, Human
gaagucaguaaugcuggaugacuuacauucuugacaacuuguggcaacugaauucagcauucugcacuuc

SEQ ID NO: 4178008 - RNA, 81 nt, Human
gaagucucuuaaagaugacaugacuucagauuuucuuccuucuguuagaacuuugaaggguggagugugaaaucuggcuuc

SEQ ID NO: 4178009 - RNA, 63 nt, Human
gaagucugaaccagauggcaagguucuacuaagggcaaagaaccuucugaccucucggacuuc

SEQ ID NO: 4178010 - RNA, 103 nt, Human
gaagucugacucuaaaguucauauucuugauauagauaguuaaucccugaauuuauuugggaaacucaucaguuuagaaaccuauggaccauagaaucggcuc

SEQ ID NO: 4178011 - RNA, 60 nt, Human
gaagucuggcugacgagaguuauuccauucaaaaggcaggcuuucuuagaccaagacuuu

SEQ ID NO: 4178012 - RNA, 83 nt, Human
gaagucuguaagugggggaaguaauuauaaaccaagggagaucauuguccuguuuacaagccacuuguuaagccacagacuuu

SEQ ID NO: 4178013 - RNA, 57 nt, Human
gaagugaaagagaacaaguccccgaggccuuaggauuuguguuuccccagucacuuu

SEQ ID NO: 4178014 - RNA, 55 nt, Human
gaagugacagaagaaucaagagcaaaccagagcucuugagucuaaucugaacuuu

SEQ ID NO: 4178015 - RNA, 105 nt, Human
gaagugaccaaacuguguugccagggcacaguguuccagagcagugguucccaaauuugcaugagaagcaccuggagggcuuguuaaaauacagauugcagcuuc

SEQ ID NO: 4178016 - RNA, 78 nt, Human
gaagugagaaugacaaagguuuuagaaucuguuggaccugggcaagucccacgacuuuucugagacucauuugaacuc

SEQ ID NO: 4178017 - RNA, 63 nt, Human
gaagugaugacgcuguguuuuucaucccaggccaaaacgaaagaagaaauggugucauucuuc

SEQ ID NO: 4178018 - RNA, 71 nt, Human
gaaguggcuuggagcaggugaugggggcaaacaaugucugccaggccacguagcuucaagauaaacccuuc

SEQ ID NO: 4178019 - RNA, 64 nt, Human
gaaguggucaaagacuagauuucagugcucugucauuuacugacuauguggccuugaccaaguc

SEQ ID NO: 4178020 - RNA, 87 nt, Human
gaaguguacacuuugccccuggccgccuucuucccuccugguguccuggguggacacggaggugugucuggggaagguguguccuuu

SEQ ID NO: 4178021 - RNA, 57 nt, Human
gaaguguagaugaaauuaaacccaguauucaccacugggacauuucuauuugccuuc

SEQ ID NO: 4178022 - RNA, 70 nt, Human
gaaguguagcugggagugucugauggguggggcaaaguguuuugcacuugucaccucucagcugcugcuc

SEQ ID NO: 4178023 - RNA, 59 nt, Human
gaagugucugacacaaaauauguacuuguaaggguggguaacuacaugucaggcacuuu

SEQ ID NO: 4178024 - RNA, 120 nt, Human
gaagugugggcugucuuggcguugccaggagacaucagugggugccaucgugcccuucuuaguuuggaaggggcacaauuguacccaagucucugagugugagcuuaagugcccugcuuu

SEQ ID NO: 4178025 - RNA, 64 nt, Human
gaaguguuuauauuauggaaauauacaugagauaaaacaugauauuuuaugguauaugcauuuc

SEQ ID NO: 4178026 - RNA, 61 nt, Human
gaaguuacacaugaagguccaauguuacuucaagcaucuaucuucaauguguguuuauuuu

SEQ ID NO: 4178027 - RNA, 89 nt, Human
gaaguuacguuuuagauguacuuuguuuucaugaaacagcucuaagagauguuguuaaaugaaaaaagcacacgauaaaaauguaacuc

SEQ ID NO: 4178028 - RNA, 58 nt, Human
gaaguucuggcagcauggagccugugcucccacuggggcuggaccaugcugccccuuc

SEQ ID NO: 4178029 - RNA, 70 nt, Human
cuuggcugcucuuccuugccuugcuucaucauacaaacaauaauaaggucgaggcaggaauucugcgaag

SEQ ID NO: 4178030 - RNA, 73 nt, Human
cuuggcugugacaguuucucagacuuuccuuguuuuuugaugaucuugagaguuuugaggaauagcaaucagg

SEQ ID NO: 4178031 - RNA, 90 nt, Human
cuuggcuucuguuguuggacagaaugaugcaggcuccauaugacaguguguuugcaaagaucauuuucuccaucugcagaacaggcccag

SEQ ID NO: 4178032 - RNA, 106 nt, Human
cuuggcuuguaauauuauugcuucugagcagaggucaagauacuugggcuuuucuucauguaagaggcacucugcuuuuagaggaaauaggguuuauauuguuagg

SEQ ID NO: 4178033 - RNA, 70 nt, Human
cuugggagccagggagcccugaaccagagggucaaggaccccuggacggaguauuccccgggcucccggg

SEQ ID NO: 4178034 - RNA, 55 nt, Human
cuugggaguagaggcaggagcagggcuggcuuacauuuccugccugugccccagg

SEQ ID NO: 4178035 - RNA, 74 nt, Human
cuugggagucacaggccuggaugaggggcaugacauggaggacaugcccugagugaggguguguggugagaaag

SEQ ID NO: 4178036 - RNA, 77 nt, Human
cuugggaugcuuuuccugccacaggccuguggagauggaccagggcuggccagcucaggcuugggaggaggcccagg

SEQ ID NO: 4178037 - RNA, 116 nt, Human
cuugggauggacacagauauacauagguuucuaugcaugguagcagaaaguugagggcacucuugucuggaauuucuauuuugucuguaagauauuagguguggucacauucugag

SEQ ID NO: 4178038 - RNA, 83 nt, Human
cuugggcacagcaaguuacagugcuuggcaauaagugcccuagguacugaaaugaaacugcaccuguggcuugaguguucagg

SEQ ID NO: 4178039 - RNA, 113 nt, Human
cuugggcaucaugugaaaaaucugauugacuauguuaauaucuauuguuauuuauauugaaaauaagauccugaagauauguuuagauuaugaauuuuaaaaugagacuugag

SEQ ID NO: 4178040 - RNA, 89 nt, Human
cuugggcuuuacguaaagaaauugugccauuuuuucaagccagauauagcuucuguaucaacaaauggaacacaaaucuuuagucuagg

SEQ ID NO: 4178041 - RNA, 69 nt, Human
cuuggggagcugugcagugacuacagauagaaagaugggguucaucagagcaccacacaguucccuggg

SEQ ID NO: 4178042 - RNA, 61 nt, Human
cuuggggaugcaaagccagugugccaaaaugaccuacagcauucucaggcccauccucagg

SEQ ID NO: 4178043 - RNA, 108 nt, Human
cuuggggcugccggucuggcugcugaggccagguggugaaagugggcccugggcagccugagggcagcucucaccucuggccagcaaacuucuagacugcaccuugag

SEQ ID NO: 4178044 - RNA, 62 nt, Human
cuguuuuacaaaugacggcauucaaagcaagaaacuuuuaugccaguuauauuguaaaugag

SEQ ID NO: 4178045 - RNA, 67 nt, Human
cuguuuuaucugucauucacccuguuuucuugaggcuaggaaauagacacuuggacagacaaaaugg

SEQ ID NO: 4178046 - RNA, 77 nt, Human
cuguuuugacaccucugggagaggacacuuggagaggaaucccucccuuguacucacuccucucugagagaaggcag

SEQ ID NO: 4178047 - RNA, 70 nt, Human
cuguuuugagaagauaggggaauacuuugucagccucagcguauuggaguauuguucaucuucaagacag

SEQ ID NO: 4178048 - RNA, 75 nt, Human
cuguuuugauaagcuguggucaccagguggcgcuacacacacgcugucaaguccaacaguuuuucagaccugcag

SEQ ID NO: 4178049 - RNA, 128 nt, Human
cuguuuugcaucuccuguuacaggaugugaccauuugacauauccuugcugacaauugaacaaaaugcucuaauacggcaaagaaugagugaguacauaauucugaugaaucugaugaaguaaaacgg

SEQ ID NO: 4178050 - RNA, 108 nt, Human
cuguuuuguaacacuggagucuauugaaggcaugaaacuuccaggggaagucuuggacaguaaauugugcuuaauuucagucaauuuuagcuguuaacaugaaagcag

SEQ ID NO: 4178051 - RNA, 74 nt, Human
cuguuuuugacaucugaauuuagcaguuuugguauaaaaagccacaagagcauugcagguguguuuaagaacag

SEQ ID NO: 4178052 - RNA, 72 nt, Human
cuguuuuugugagaaucaaugaaauauuaugcuugauguuacugugaucaugauacuaucugacaagggcag

SEQ ID NO: 4178053 - RNA, 63 nt, Human
cuuaaaagagaugacggcaggguaagugcaaaguaaaaccuccuugcucuagucucuugggag

SEQ ID NO: 4178054 - RNA, 58 nt, Human
cuuaaaaggucuuuuuucuaacaccaugaugauuguguguuuuaagaggccuuuuuag

SEQ ID NO: 4178055 - RNA, 89 nt, Human
cuuaaaaguaauagucaacauuugagaugcaauggucagaggauauugugcuguugccaucuaaaauguuacuguuucuuacuuuuaag

SEQ ID NO: 4178056 - RNA, 55 nt, Human
cuuaaaauauugccgaauuguucugaaauaaagugacuuuugguaauauauuaag

SEQ ID NO: 4178057 - RNA, 69 nt, Human
cuuaaaauggucuauauauuugagcaaaucauaauugcuuggcuagcugaguauacagacuauguuaag

SEQ ID NO: 4178058 - RNA, 73 nt, Human
cuuaaagcacuuuggaaauugucuauaagagggcagggucuucaaauagcuccuccaaguccuagguuuuaag

SEQ ID NO: 4178059 - RNA, 71 nt, Human
cuuaaagccccugagaguugauauucccuguggaggagaauuguauugauuuuucagagguaaaauuuagg

SEQ ID NO: 4178060 - RNA, 79 nt, Human
cuuaaaggcccuaccuccaaauauaaucacauuggaaguuagggcuucaaaauaugaauuuggaggaggccuaauuaag

SEQ ID NO: 4178061 - RNA, 79 nt, Human
cuuaaaggguuuggaauuucgguuugcagaauuuuucugguccgcagagucuguugaccaagucuucuuccccuuagag

SEQ ID NO: 4178062 - RNA, 74 nt, Human
cuuaaaguguccuagcuaggaggcaggaagacggacaaaaugaccaguagucuccuggcccuaggacuuuagag

SEQ ID NO: 4178063 - RNA, 76 nt, Human
cuuaaaugaggcaccuggggugauauccuggcacccaauauacaggaaaaauauugccugaguguuucauaauaag

SEQ ID NO: 4178064 - RNA, 64 nt, Human
cuuaacauuaggguuccccguggcagcuucauccugagcacugccugugagcccugguucuggg

SEQ ID NO: 4178065 - RNA, 66 nt, Human
cuuaaccuaucagaagacuuacaguaucguuugagaagacaaggcuugaauucugauggguauaag

SEQ ID NO: 4178066 - RNA, 113 nt, Human
cuuaacuaguuuucauguuguuccuaauuuuaacuaggacaugcagaaucacuuagugugagcuaagcuguauuuaguuaaaaugcuaagaauuaucugggugcaaaauuaag

SEQ ID NO: 4178067 - RNA, 84 nt, Human
cuuaacuuuuguaaacauuugcuaccuuuuuuauuaaaugacauuuguuggaaugaagaaaaagguaauaauacacuaguuggg

SEQ ID NO: 4178068 - RNA, 129 nt, Human
cuuaagacuuucucaagauguuggagcugagugggacccuggggaccaucuagcccaacccaagagaagggaguugggcuagaugauccccagggucccauucagcuccaacaucuugagaaagucuag

SEQ ID NO: 4178069 - RNA, 70 nt, Human
cuuaagauaauccauuauaauguuauacacaauuuugucguguuugaacgcagugguggguugucacgag

SEQ ID NO: 4178070 - RNA, 60 nt, Human
cuuaagccacugagauuugggguuaaauuuuaucuauagcauaaaccucuguggcuuuag

SEQ ID NO: 4178071 - RNA, 60 nt, Human
cuuaaggaaaagucucuuuuaaaacauaaaugauguguugggagaauucuguuccuugag

SEQ ID NO: 4178072 - RNA, 84 nt, Human
cuuaaggaggcaaaaaauguccuuccauuuugaucuguaaagaacccuuagccaagcuuggaaggaucauggugcuuucuggag

SEQ ID NO: 4178073 - RNA, 71 nt, Human
cuuaaggcuucagcacagguauauguggggcuuuugguuauucaguuaccugauuuggaguuugccuuaag

SEQ ID NO: 4178074 - RNA, 87 nt, Human
cuuaaguuucuauggccauggaaugguugaaugacgaaccaucuucccacauuuauaugguuucauuccaugcugaaggagaauaag

SEQ ID NO: 4178075 - RNA, 73 nt, Human
cuuaauagcucaugucagcagcaacacaaaagguacagugauuuuuuaaaugcuuggacaagacucuauuaag

SEQ ID NO: 4178076 - RNA, 68 nt, Human
cuuaauagguggugggauuaaaaauguuuugcaguuacuugacaacaugaucccaccugccuauaaag

SEQ ID NO: 4178077 - RNA, 55 nt, Human
cuuaauagugccauguacugcccucucuugacuguaaaccuggcgcuguucaaag

SEQ ID NO: 4178078 - RNA, 78 nt, Human
cuuaaucccuuccauuaaacuuguggacccagugccuguguguauugggcuaacuuuuaaugaaauaggcaaguuaag

SEQ ID NO: 4178079 - RNA, 74 nt, Human
cuuaaugacgugugccaagucccuuuggcuagauaauuauucauaggucccagggauuaggacauggauguaag

SEQ ID NO: 4178080 - RNA, 80 nt, Human
cuuaaugcuccagauccagcugagcugcagcugcaugcagcugccugagugaccccagcuaagaucacauggagcagaag

SEQ ID NO: 4178081 - RNA, 71 nt, Human
cuuaauggugauuucagugaaagaucuggagaugcuucaacaaauuuagacauagcugaaaucauuuuaag

SEQ ID NO: 4178082 - RNA, 100 nt, Human
cuuaauuauuuaccugcuacuguuauugugucugcugaaccuaugauaacuuaaaaaaaggauucugguuacauuguuacagcuggagguuuuuguuaag

SEQ ID NO: 4178083 - RNA, 59 nt, Human
cuuacaagcaaaacaacuguagaauuuagcccaaagucuauguuagugauguuuguagg

SEQ ID NO: 4178084 - RNA, 59 nt, Human
cuuacaguacuucuaauaugauuguacuagcaagacaugcuauagagaagugauguagg

SEQ ID NO: 4178085 - RNA, 62 nt, Human
cuuacuaaaugcuuucuaugaaagaggccucggauuaaggguuucuuacaaaggcagguaag

SEQ ID NO: 4178086 - RNA, 128 nt, Human
cuuacuguauguuagauacucucuaugucaaucucucauucaguccucacaaccucacuaaaagacuucauauuauagaugagaaaauugagaauugaagagaugaaguaggucacacagcuaguaag

SEQ ID NO: 4178087 - RNA, 56 nt, Human
cuuacuucauguacuuuaggaagggcagagcuuccuccaagccuuugugaagugag

SEQ ID NO: 4178088 - RNA, 67 nt, Human
cuuagaaauuguuacucauucaugaugacgcugaugaugcucauaacgaugacuaacauuuacugag

SEQ ID NO: 4178089 - RNA, 58 nt, Human
cuuagaacacugagaaagugaugaggauauucuuuuucuaagagcucaguguuuuaag

SEQ ID NO: 4178090 - RNA, 88 nt, Human
cuuagaacauuugagucuuagaacuacagugccuagaacuauaagauuuuagaaauguggauucuuggacucuuaaccaugguccuag

SEQ ID NO: 4178091 - RNA, 65 nt, Human
cuuagagacuugggggcuuuggauaggcuucagcugggauggucauccaauccccagccucaaag

SEQ ID NO: 4178092 - RNA, 59 nt, Human
cuuagagccuuacucuucuugucuguaaaauaaagaugaggaugacagcaggcucagag

SEQ ID NO: 4178093 - RNA, 64 nt, Human
cuuagauaaaaguguucaauaaauguguauuguaugagcagguuuugugaauaguuuaucuaag

SEQ ID NO: 4178094 - RNA, 55 nt, Human
cuuagcccugagaguucugagccaccccuguggauguucaagaaaaggggcuaag

SEQ ID NO: 4178095 - RNA, 92 nt, Human
cuuagcuagcuucaggaguacuuuuagagaugaagauguuguugucgaaagaggccaggcauucuagaaguaguguguuugaggcaguugag

SEQ ID NO: 4178096 - RNA, 66 nt, Human
cuuagcugcaguagccacauuucaagugcuuaauagacacacauggucaguggcuacucuguuggg

SEQ ID NO: 4178097 - RNA, 61 nt, Human
cuuagcuuuaaaagugagaucucugcuuugcagauaaaacaauucucacuugugaagaaag

SEQ ID NO: 4178098 - RNA, 75 nt, Human
cuuaggaaaauuuaauucucuucugugguaagcauugucugccuucuauaggccaaaggauuagagauuucucag

SEQ ID NO: 4178099 - RNA, 73 nt, Human
cuuagggaauuagaaauaaacaaauuuuccaaaauauaaaaggaagguuaguaauauuucuauauuuuucaag

SEQ ID NO: 4178100 - RNA, 65 nt, Human
cuuaguaacucuuuuuuuaaguguagcccauguuucgcuuuggguugugugaaaagauuacaaag

SEQ ID NO: 4178101 - RNA, 56 nt, Human
cuuaguaccaucagguagcuugcccuauggaaggagaagaaacuugaaaguacaag

SEQ ID NO: 4178102 - RNA, 78 nt, Human
cuuauaauauaccagguccuugggauagaaagaugaauaaaauauggaauauuuccccaaggagccagauguuaagag

SEQ ID NO: 4178103 - RNA, 60 nt, Human
gacaguggcccuauuugaggaccccacagggcaguggaguugaugacuggggucaggguu

SEQ ID NO: 4178104 - RNA, 57 nt, Human
gacagugggggacccaggugcuguccuucuggaaagcauccaggugcccccaggguu

SEQ ID NO: 4178105 - RNA, 104 nt, Human
gacaguguuucugccagugugcccuuugggaugcuagacaccucagauaauauauauucagaggacucuggauaucacuaagcuuggcaaaaugacacauuguc

SEQ ID NO: 4178106 - RNA, 66 nt, Human
gacaguuauaacccacaugauagcaaugcgcaggggcugcaaugcagggcaacauggggugcuguc

SEQ ID NO: 4178107 - RNA, 63 nt, Human
gacaguuguacagaaggcacuaaggucaaauaauauuugaccaguacuauuuuuuacaauguc

SEQ ID NO: 4178108 - RNA, 59 nt, Human
gacaguuuccuuuacugugugcauuuuuacuguacacuguauagaguagaguaucuguu

SEQ ID NO: 4178109 - RNA, 88 nt, Human
cuuggggcuuuccugggcaucccauguggaagucagcaggcaagaccaaguccaggcucccgcuccacugggcaccaggcuccccagg

SEQ ID NO: 4178110 - RNA, 78 nt, Human
cuugggggguucuaagugcacccuuuccuuaaggcaauacagaaggcacaggcuaggggaacacuagaaucuuuuaag

SEQ ID NO: 4178111 - RNA, 80 nt, Human
cuugggugcuucuuuuuugucuugucuguggcugcuuaagucugauggcuccuacauaacccagcgaacucgcacccgag

SEQ ID NO: 4178112 - RNA, 73 nt, Human
cuuggguguucaucuuucccaccaaucuuaucuccuacaagugagauggguguccagggaggaucugcccagg

SEQ ID NO: 4178113 - RNA, 101 nt, Human
cuuggguuuuuauuuagcucuacauaugcgaucauaggaugcagaagauauaucuucuacuggacacguauauauagaugcuuaaauguggcuaucccaag

SEQ ID NO: 4178114 - RNA, 60 nt, Human
cuugguaagauauuagagcaauuccuagcaaggaugcuuaacuuccuagucuauaccagg

SEQ ID NO: 4178115 - RNA, 101 nt, Human
cuugguaggcucuugugaacugacaucugccaguuuggucguggaaaauuugaugauucuuuuggauagaugaugguaugaaguuagguaagccauccaag

SEQ ID NO: 4178116 - RNA, 80 nt, Human
cuuggucaggcagccuguagauggagccagcuaagagcaaagcucugggaagccuguaugcagaaauggaaguggccagg

SEQ ID NO: 4178117 - RNA, 70 nt, Human
cuuggucauuucuuguccuguugugucccauauauaaccgacagacaaaaucaggaagaggugaucuaag

SEQ ID NO: 4178118 - RNA, 84 nt, Human
cuuggucgguguacaugcuccacuuucuccugugggacuuaguuuucucaucagaaaaaugagaagagcugcuuacugguuagg

SEQ ID NO: 4178119 - RNA, 72 nt, Human
cuuggugacuguuuugagcaugugggggugagcugggugacucgucccccaggcucugacacaggagcuggg

SEQ ID NO: 4178120 - RNA, 59 nt, Human
cuuggugccacagcagcuugcgccagagcaggcgcaggugaaagaggcugggcagcaag

SEQ ID NO: 4178121 - RNA, 130 nt, Human
cuuggugugucugaauccacaaggcugguuaaacauugcagggcaggaccauggacagggccccgaggcacuuguaggggugguuuucggcuuaugcuguauugaccgagacccguggaaauauauuuug

SEQ ID NO: 4178122 - RNA, 60 nt, Human
cuugguuagguuaugaaugcccacacaguuuuguguggguauucauucauuuaugcuaag

SEQ ID NO: 4178123 - RNA, 130 nt, Human
cuuguaaagaaguuacagauuaaggagagagagaaugagucuuugaagaaaucagucaccuuaugaggcuggucuaaugagucaaguauuauauucucauuuuacaaauuuaguaauuuugucauaccag

SEQ ID NO: 4178124 - RNA, 80 nt, Human
cuuguaagaauauguagucaaguggauauaugaucaauacgguuaccuuuuccucuuguacuguucauuucauuuauaag

SEQ ID NO: 4178125 - RNA, 130 nt, Human
cuuguaccuugggggcaaucaagaggcaaacugguuagcaugacuuagaaucaggaggcuauguguauucuuagcuccaugucugacagcugagugugucucaguuuccucuucagucuccuccucacag

SEQ ID NO: 4178126 - RNA, 94 nt, Human
cuuguacugaucauuggcacccaguuugucucaggguuuuuggguuauucuuucugccccuacuaacaucugaucgaacagugccagaugcaag

SEQ ID NO: 4178127 - RNA, 59 nt, Human
cuuguagugugcucuucauauugucagaacuggauuggcccuggaaggcuuacugcagg

SEQ ID NO: 4178128 - RNA, 68 nt, Human
cuuguaugcugaauaguucacucuucugccaugaauauugagggcaggggggccauucaguguguggg

SEQ ID NO: 4178129 - RNA, 67 nt, Human
cuuguauucaauauuauuguugcugcucauucaaaugugaugcuguuccaguuauauuguuuaaaag

SEQ ID NO: 4178130 - RNA, 61 nt, Human
cuuguauucagugauuucacaauagcucuccagagaauguuuaaagacucacugaaacgag

SEQ ID NO: 4178131 - RNA, 110 nt, Human
cuuguauuuuuaguagugaugggguuuugcuauguuggccaggcuggucuugaacuccugaccucaggugauccacccgccucggccucccaaagugcugagauuacagg

SEQ ID NO: 4178132 - RNA, 61 nt, Human
cuugucaaagcuagagaguggcagagugggcaugugaccucaggucucuuuggcuuccaag

SEQ ID NO: 4178133 - RNA, 69 nt, Human
cuugucacccaggcuggagagcaguggcaugaucucagcucacugcaaccucugccucccggguucaag

SEQ ID NO: 4178134 - RNA, 69 nt, Human
cuugucaggugacuccucagucaaaaaggagcccaguagagaaaugggcuggugagagcaccugauggg

SEQ ID NO: 4178135 - RNA, 57 nt, Human
cuugucauuaucuuccccuuucuuggggagcaguaacagaggggaggaauugacaag

SEQ ID NO: 4178136 - RNA, 75 nt, Human
cuugucccauucagguacuuguuuuggcuaguuaacguaauuuccccuagcacagauguacuuugaggggacagg

SEQ ID NO: 4178137 - RNA, 98 nt, Human
cuuguccuugcuucacaccuacaauauucaaaguuuugggaaauaacauccaauuggcuuggccaaggcucuggguuucauaggugggaaguagcaag

SEQ ID NO: 4178138 - RNA, 79 nt, Human
cuuguccuuuugucacuucuucagcuuuccuugaguuagacucaauaaaagaagaggaaggugaaccacgaauaacaag

SEQ ID NO: 4178139 - RNA, 71 nt, Human
cuugucucaaucaaagcacugggcuuuguagucgcuuuccagagccgaggccaauguguuuuaugaaaaag

SEQ ID NO: 4178140 - RNA, 61 nt, Human
cuugucuccaauccuaacguaacagaaauguauaugagguuacauuaggauuagagacaag

SEQ ID NO: 4178141 - RNA, 99 nt, Human
cuugucucccuuuuaaccacuagcuaauuuagcgauggagaauaguuucgcuuuuauuacagcuuugauuaucuggugguugcaaauaagucagauagg

SEQ ID NO: 4178142 - RNA, 55 nt, Human
cuugucugaguuuggccacacacagcaauccgggcugguccagacuucagacuag

SEQ ID NO: 4178143 - RNA, 103 nt, Human
cuugugaccucacugggcauugagucugaggccuuggcagcuaagggugguguuccuuagggaacugggaggccauccagacaggaggcacaguacaaacaag

SEQ ID NO: 4178144 - RNA, 59 nt, Human
cuugugcaaauccucgagcacauaugucaaguauguuucugggcacacauuugcacagg

SEQ ID NO: 4178145 - RNA, 60 nt, Human
cuugugcagccuccucuugcagggggcugugaccccuugaaggaaaggucgcugcccagg

SEQ ID NO: 4178146 - RNA, 75 nt, Human
cuugugccaucugaauuugccuuaguuucaucuggaaagaggagguauugaugggcuuucagaauccaggacaag

SEQ ID NO: 4178147 - RNA, 99 nt, Human
cuuguggaggucuuacaagaaacugaaaguggcuucauaauuuguauauaauucauaaggccuguuuauguauucugucacugacucuucaauuauaag

SEQ ID NO: 4178148 - RNA, 61 nt, Human
cuuguggccuccuguuccuggguacagaugaaccuguuugccauggggauggggccacggg

SEQ ID NO: 4178149 - RNA, 60 nt, Human
cuuguguagacaucucuagaagacuugauggacuaaucuuuaagaguucauuugcaugag

SEQ ID NO: 4178150 - RNA, 68 nt, Human
cuuguguugcuuaucauugcucuucucagaagauggaggaaaacaugagcucuggagcagcaaucaag

SEQ ID NO: 4178151 - RNA, 60 nt, Human
cuuguuaaaaugcagauucagaacccuggggauggggccugauucugcauuucuaacagg

SEQ ID NO: 4178152 - RNA, 68 nt, Human
cuuguuaaaaugcagguccgcaucuguaaguucugaagcagggccuaggauucugcauuucuaacaag

SEQ ID NO: 4178153 - RNA, 82 nt, Human
cuuguuacguggcucaggcugaucuauuaauagaauuccugaccucaagcaguucucuugcuucagccucccacauugcagg

SEQ ID NO: 4178154 - RNA, 58 nt, Human
cuuguuaguauugucuuauuucauggagggauacagggaaugaggucccacugaggag

SEQ ID NO: 4178155 - RNA, 75 nt, Human
cuuguucaggagaggguggggaaaggauuucucccagcugauggggaacuggagaaugcccucuuuuuggccagg

SEQ ID NO: 4178156 - RNA, 62 nt, Human
cuuguucaguccugacuuccugacagaugccauuauucgcauuuaaggaagcaggaaacaag

SEQ ID NO: 4178157 - RNA, 77 nt, Human
cuuguuucaagugugugggcaggcaguggucggggagggcgcucugguauaucagugcacuccauacuugaguugag

SEQ ID NO: 4178158 - RNA, 76 nt, Human
cuuguuuuucuucaggcuacauuugcucugagaagccaugagcuggagcuuucuggagcacaagucagaugacaag

SEQ ID NO: 4178159 - RNA, 67 nt, Human
cuuuaaagugguucuuacauccguggucaaaaaacagaccauggucaaagacagaccauuaccgaag

SEQ ID NO: 4178160 - RNA, 84 nt, Human
cuuuaaauagccccaggguuucucugaggugacuuguagcuaauacaauaucacaggaggagaccaagugggugcaguuuccag

SEQ ID NO: 4178161 - RNA, 67 nt, Human
cuuuaaaucucuggcagaaauaaacuuuugaauaauauuaaaguuuggucccuccacggauuuaaag

SEQ ID NO: 4178162 - RNA, 79 nt, Human
cuuuaaguguuuucccagcccagguaugaugauaugaagcaacccccuuccuugucuccacuggccuggggccuugagg

SEQ ID NO: 4178163 - RNA, 78 nt, Human
cuuuaaucauugcuguauaauucaugcucuuauugucuaaacacaaacaacugagcugaaauuauauagguguuagag

SEQ ID NO: 4178164 - RNA, 88 nt, Human
cuuuacaacacaccaggagaguagacugcaacauuguaaugugccacaauauauugcaacauuguaaguuuauauuagguauaggaag

SEQ ID NO: 4178165 - RNA, 73 nt, Human
cuuuacagauuagucuaagaugcuaggaguugcaaagagacuuaacaggcuugaauggauauaaucuguacag

SEQ ID NO: 4178166 - RNA, 65 nt, Human
cuuuacaguuaaggaaauggagguucagagagauucugagcucuuccccaucuuacaucuggaag

SEQ ID NO: 4178167 - RNA, 96 nt, Human
cuuuaccuugccuaagucugcagucacuuguagaaugggaaucaugaaagcccuugccucauagguaguugugagaaugacuuaguguaagugaag

SEQ ID NO: 4178168 - RNA, 72 nt, Human
cuuuacuaucaggaauaaacaauuacaucugcggggagcagaagaucuuuguuuguauuuuugaaaggaaag

SEQ ID NO: 4178169 - RNA, 101 nt, Human
cuuuacuauucuauugacuuucaguuaguaccuaguggcauguaaaaagaauuuuuaaaaaauagccacuguaccacacugaggcacgaugugguguaaag

SEQ ID NO: 4178170 - RNA, 82 nt, Human
cuuuacuguaacaauuucuuacuauuguauugccuuucuuuucaauuuaaaaggauaauaagagaaauaguuacagggaaag

SEQ ID NO: 4178171 - RNA, 90 nt, Human
cuuuacuucuuagcuuuguccuaggucucucuuucccuccuuguuguccccacuggagaagagaccuuuugugauagagcugcaguaagg

SEQ ID NO: 4178172 - RNA, 70 nt, Human
cuuuagauuucuauguaucacuugcuuuuucaaguucauaugaaaagaauaguggagcaagagucuggag

SEQ ID NO: 4178173 - RNA, 75 nt, Human
cuuuagggauauaacuaauacuggccaugagcauuuucuguuccucugucagucaugguuguugcaacccuguag

SEQ ID NO: 4178174 - RNA, 73 nt, Human
cuuuaggugaacuucagauggguagcaggcauccaccaggcagcuucugggcaguuggaaauuucaccugaag

SEQ ID NO: 4178175 - RNA, 58 nt, Human
cuuuaguuugcuguccccugggguagaccgcaggaaggacuuucggacagugcugaag

SEQ ID NO: 4178176 - RNA, 70 nt, Human
cuuuugaaaugugucauauucaaagucaccagaaguuuucuguuugaaggaauugaauacguuuuuggag

SEQ ID NO: 4178177 - RNA, 66 nt, Human
cuuuugagagcugggugaagugccaucaaauuuaauuuuugaguguacaacauuuaguuuauaaag

SEQ ID NO: 4178178 - RNA, 78 nt, Human
cuuuugagguguugaauaguuggcugaaacugcacagguaaguaggggcagcaagaaaauucacaugcucaucagaag

SEQ ID NO: 4178179 - RNA, 129 nt, Human
cuuuugaguaguuguuuauucaaaaauaugccuacgucuuuagcaaauuacucacagggucagcgacuguugacccuguguguuuguuagacuuugaguguaagugacaauauaaacacagccauauag

SEQ ID NO: 4178180 - RNA, 56 nt, Human
cuuuugcacccagaguuauuugguuugacagacugccaaauccugagguucaaaag

SEQ ID NO: 4178181 - RNA, 65 nt, Human
cuuuuggagguuuaagucggguggugggaagagauacauuuccauuccugauauggccacaagag

SEQ ID NO: 4178182 - RNA, 95 nt, Human
cuuuuggcuaucaugaauaaugcugcugugaacaaugauaugcaaguuucugugugcauguauguuuucaguuguauuagguauauacauaggag

SEQ ID NO: 4178183 - RNA, 108 nt, Human
cuuuugggccuauuggcacccagggaaauuaaugaguuaaucuauuuucuuaaauaccagggagagauugaacauuauuuaaucugugggcucaaaauggccuuaaag

SEQ ID NO: 4178184 - RNA, 58 nt, Human
cuuuugggugccugugaagcgugccuacgucguggcccuugcccaggccucccaaaag

SEQ ID NO: 4178185 - RNA, 62 nt, Human
cuuuuguugcccuugucgcaggccgcaagcucugcaggccgugaacagagaguguccgagag

SEQ ID NO: 4178186 - RNA, 62 nt, Human
cuuuuguuuauuucaucuuuguauugucaccaaccacacagcagggguggaauaaacguuug

SEQ ID NO: 4178187 - RNA, 72 nt, Human
cuuuuguuuucugauucucgugugguaguguauuuacuccuuuuuggccaguugagccccagaaaaaagaag

SEQ ID NO: 4178188 - RNA, 103 nt, Human
cuuuuuaaagaaagauaaaguccuauaagugacugcagggaauucacuaagcuuuuugggcaaaugggcucugcagcauuaggucuauauuugcuuuaaagag

SEQ ID NO: 4178189 - RNA, 62 nt, Human
cuuuuuaagcaucugcuaugcuagugugugagugcaugcuagugugugagauguucaacaag

SEQ ID NO: 4178190 - RNA, 69 nt, Human
cuuuuuaaucuguuuaauucauuuucacagaucagugcauuugcaaaaguggagagcagagacaugagg

SEQ ID NO: 4178191 - RNA, 95 nt, Human
cuuuuuacauacuauuucauuugauccucacaacaaucuuaggaaguaagcacucuuaauuaaauuucuaagugaggauaccaauguguagaaag

SEQ ID NO: 4178192 - RNA, 55 nt, Human
cuuuuuacucuguugucucagccgcacuggggcggaggcggucaagggugagaag

SEQ ID NO: 4178193 - RNA, 78 nt, Human
cuuuuucagcucuaaguuuuaugcaaacuuuauuaaacagaucaaauauuuuugaugaaaauuuugggcugaauugag

SEQ ID NO: 4178194 - RNA, 74 nt, Human
cuuuuuccuuaggcagauguuaacaggaaaagauaguucuucauuuauccucaaacuucugcuucaagagaaag

SEQ ID NO: 4178195 - RNA, 81 nt, Human
cuuuuugaaaagucugcauuacaugccauagacacugugugucucugugugugugugugugugugugugugugucagaaag

SEQ ID NO: 4178196 - RNA, 64 nt, Human
cuuuuugccugagggcuucuucaagacagaagaauaugcacacucugcccacagagcauggaag

SEQ ID NO: 4178197 - RNA, 60 nt, Human
cuuuuuggacccauaauaggcaucauucuucaaaaugauuuccaugauugggccagaagg

SEQ ID NO: 4178198 - RNA, 80 nt, Human
gacaauaauuguggaaauaauguuugaaauauuagggauauaaaccaguccugagagacaguguuuguauaauuccuguc

SEQ ID NO: 4178199 - RNA, 59 nt, Human
gacaauagugaauaaaccggugaaauaauaaucaagucugugguuuauuuacuaguguu

SEQ ID NO: 4178200 - RNA, 82 nt, Human
gacaaucaaaagaauucugacaauagaauugguuuaauuuuuaaaaguuuuuaauucuauguuagagucugccaagguuguu

SEQ ID NO: 4178201 - RNA, 55 nt, Human
gacaaucagccauauccagggugggcacuugcuugggaaauguuugcugaugguu

SEQ ID NO: 4178202 - RNA, 65 nt, Human
gacaauguaggaguaugacaguagugaaauucauuuaucuauauucuuauguuccuuuuauuguc

SEQ ID NO: 4178203 - RNA, 86 nt, Human
gacaauuaucacaggaaguuuggaaagccucaauucuauauaaaacagauguagguauccaaaacuuuuucauugaaugaaguguc

SEQ ID NO: 4178204 - RNA, 71 nt, Human
gacaauuaugggaguuaggauucuaucugcccagauaccaaaagacagaggcccucucucuccugaugguu

SEQ ID NO: 4178205 - RNA, 60 nt, Human
gacacaaaagauagcaucuuaacauaguauuacuuaacaaagauggcugucauuucuguc

SEQ ID NO: 4178206 - RNA, 74 nt, Human
gacacaaauuuaucuuucaguucuagaagucagaagcccaaacugggucucacugggcugaaauuaaagguguc

SEQ ID NO: 4178207 - RNA, 70 nt, Human
gacacaauucccacacuugaagcccucuggugugaauauaugagagauggccuuaggugggaauugucuc

SEQ ID NO: 4178208 - RNA, 57 nt, Human
gacacagaguauuuuaaguacucaugaaaauugggagacuuaagaugcuuugggguu

SEQ ID NO: 4178209 - RNA, 70 nt, Human
gacacagcugugauggagggacauuuucuggccaaacgcagcagaaguugauccugcguuuccaaguguc

SEQ ID NO: 4178210 - RNA, 55 nt, Human
gacacagggcugaggacacaaguaaagauugucuggcucaguuucaguccugguu

SEQ ID NO: 4178211 - RNA, 63 nt, Human
gacacagugugcugcagagaacauuuccagacaacaagagaaauagcuccguggcacacucuc

SEQ ID NO: 4178212 - RNA, 78 nt, Human
gacacaguucauaauuugaaggaauaggcuguucaaaagagaaacuuguaucagaucaaauaaugaucauacuguguu

SEQ ID NO: 4178213 - RNA, 59 nt, Human
gacacaguucuguucuaguaggugacauuuccugcucauuacuggagaauggcugaguu

SEQ ID NO: 4178214 - RNA, 68 nt, Human
gacaccagaaucaucaucugaagccuauucagggacaucccagagguuccgaugggaucuggcauguc

SEQ ID NO: 4178215 - RNA, 57 nt, Human
gacaccagguagccuggagaagguagaggaagcuguccugccaggaaacugaguguc

SEQ ID NO: 4178216 - RNA, 80 nt, Human
gacaccagugggcccuguguauccccugugcuuguuauagaguuggcacacaguauuacaauaggugcucauuaaauguu

SEQ ID NO: 4178217 - RNA, 87 nt, Human
gacacccagccuuuuuaugcccuuuuucugucccaaugcuuagcuucacugagccuggagacaaggacaaagggcuggugggauguc

SEQ ID NO: 4178218 - RNA, 76 nt, Human
gacacccugcaguggugugaccagccauguucaccguggaguuguugguuuuggcauggcaacccugcagggaguu

SEQ ID NO: 4178219 - RNA, 78 nt, Human
gacaccuaacaauuauucagugacuuaagagauauacuagucuguuucuuagucauguaauaguccagguuagguguu

SEQ ID NO: 4178220 - RNA, 74 nt, Human
gacacgaauguggcauuugcugaaucuuggagcaguagaauaguucuucaugucagaaagcuauaugguguguc

SEQ ID NO: 4178221 - RNA, 55 nt, Human
gacacuacguggcucacauuucagacacaaugaaaagcagguccaugcugguguu

SEQ ID NO: 4178222 - RNA, 64 nt, Human
gacacuagacauuagaccugcuaguggccccucaaaggcuggccucugcagccuaguuaguguc

SEQ ID NO: 4178223 - RNA, 56 nt, Human
gacacugcacuuggggcccacagacacugagggcuugcuugaaaagugcaagaguc

SEQ ID NO: 4178224 - RNA, 70 nt, Human
gacacugcaggcagagaggagcauuuaaucaaucaauuaauuaauucagugaaucucuguugagcguauc

SEQ ID NO: 4178225 - RNA, 57 nt, Human
gacacuguaacuucccaucuccuggucauaggaacaugauucugggcagucaguguc

SEQ ID NO: 4178226 - RNA, 59 nt, Human
gacacugugguuucugccucucucucagaucacgugcucugggggaaaagccagguguc

SEQ ID NO: 4178227 - RNA, 60 nt, Human
gacacuuuaggauuuaaaagucuggcuguaaacagcuucucuuugaguuuuuaaacuguc

SEQ ID NO: 4178228 - RNA, 80 nt, Human
gacacuuuccucuacuuccaggcggacaaagcccuuucuggugaaagcccggggcugcccuccugggaagagggaagguu

SEQ ID NO: 4178229 - RNA, 84 nt, Human
gacacuuuccuucaacuauuuaagaauaaaaggggcaacaaaaauauacugugccucaguuuucucagauaugaaauggugauc

SEQ ID NO: 4178230 - RNA, 57 nt, Human
gacacuuucucagguaaagcauccuuggcacuauggaugcugauaacuaggaguguc

SEQ ID NO: 4178231 - RNA, 70 nt, Human
gacagaaagcaaugucucugccugguuuuaccaucugucaaaaucucagagucauuguuccuuccauguc

SEQ ID NO: 4178232 - RNA, 63 nt, Human
gacagaaggcagccagauccuuuggguugccaaaccccuccauucugaaggcugccauuuguu

SEQ ID NO: 4178233 - RNA, 59 nt, Human
gacagaauuuuccaucauguggaaugaccuuaacaauacggggguggaaguuucuaguu

SEQ ID NO: 4178234 - RNA, 71 nt, Human
gacagacaaauucugggccccaucccagaccauugcaucagaagcuguaggucaaggcccagaaaucuguu

SEQ ID NO: 4178235 - RNA, 63 nt, Human
gacagacacagggccaugauugccaugccuuccaugcacaacuccagguccuuugaaucuguc

SEQ ID NO: 4178236 - RNA, 55 nt, Human
gacagacaccugggggguugcuacgugaguaagcacuuugagcccuagugucuuc

SEQ ID NO: 4178237 - RNA, 57 nt, Human
gacagacacuauugguaugccugcuacaguaagcagccacccuucugagugauuguu

SEQ ID NO: 4178238 - RNA, 117 nt, Human
gacagacuacuggagaccuguaaucaccucgaaggcuggaccuggaugaaucuucuguaagauccuagcaacuucagcuuuguucaggguaguuuuaggauucuauguaacuuuguu

SEQ ID NO: 4178239 - RNA, 56 nt, Human
gacagacugguuccagaccauuugcuaccccaggaaauggcugggcaaggucucuc

SEQ ID NO: 4178240 - RNA, 65 nt, Human
gacagagcggcuugccuggacuauuauagccacuaauugauuuccuugccuccuguccuucuguc

SEQ ID NO: 4178241 - RNA, 104 nt, Human
gacagaggacgaugacugcugugcucauagucaagagauuuaagauauuccuaaacugccgcccuugaauuacaugacccugaguagauagugaucauucuguc

SEQ ID NO: 4178242 - RNA, 65 nt, Human
gacagagugcagggcuagaagaagucaaggcuugaagcccgaccccuugggcccuguucuguguu

SEQ ID NO: 4178243 - RNA, 94 nt, Human
gacagaucuuuaacagccugcugcauccaggcuauuguucuacugacuguugccuguagguggaugugagcauguuguacaaaggagaucuuuc

SEQ ID NO: 4178244 - RNA, 61 nt, Human
gacagcagcuugcgugucuggucuuuccuccuuaaaaggcucagaaacuaaaggcgcuguu

SEQ ID NO: 4178245 - RNA, 55 nt, Human
gacagcccuggccccagguggucucaggaagugagcugcggguuccaggacuguc

SEQ ID NO: 4178246 - RNA, 62 nt, Human
gacagcucaaggcuuggaguaagcuuggcuguauccacagccuugucuccagccuaaguuuc

SEQ ID NO: 4178247 - RNA, 109 nt, Human
gacagcucuggugucuggugauggggcgguaagggagcuuaggagaucaggcagcccauuuaugucuucuuucuuucugacucccaaccccacaaagacagagggaauc

SEQ ID NO: 4178248 - RNA, 75 nt, Human
gacagcugaguuauugaagcaagcuuuucugaguucugcccuacaccugaauuuagugguuuaaguagcgcuguc

SEQ ID NO: 4178249 - RNA, 96 nt, Human
gacaggagaaucacuugaacccaggaggcggagguugcagugagccgagaucgcaucauugcacuccagccuuggcaacaagagugaaacuccguc

SEQ ID NO: 4178250 - RNA, 58 nt, Human
gacaggaggcagagcucaggugguaaugcucacucccacugcugcucaccuccugcuc

SEQ ID NO: 4178251 - RNA, 68 nt, Human
gacaggauaggagcuuuucuuccaguuaaugaagugaggcuucauggaggaagaagauuuucuuaguc

SEQ ID NO: 4178252 - RNA, 64 nt, Human
gacaggcuagguugcuguccucaaagagcuugccaucucuuauacauagucgaccuuguuuguc

SEQ ID NO: 4178253 - RNA, 99 nt, Human
gagaagagucccugggaaauuaaauaauauuugaagcuucaaagcuguauguuuagguuuuagaacaucagauauuaggacccagugauaagaauucuc

SEQ ID NO: 4178254 - RNA, 65 nt, Human
gagaagauacacuagaggaaugagaucuccuacaugaguaaaguguuuucuaauguguuuuucuu

SEQ ID NO: 4178255 - RNA, 55 nt, Human
gagaagauguuguuauugagcacuaagacacugggguacaaguaggcguuuucuc

SEQ ID NO: 4178256 - RNA, 70 nt, Human
gagaagccgaggccacacagcaggagcuugguacauccacuucucucugcucaguggcuucugcucacuc

SEQ ID NO: 4178257 - RNA, 105 nt, Human
gagaagcuggcucugugacuuggcgagcugagguguaggccugagacgcucuuuuccagcaccuccgcaguucaccuguuuucacacgugaggacugaguuucuc

SEQ ID NO: 4178258 - RNA, 68 nt, Human
gagaaggaaauucucaucucaugaaaccagagaaaucccugcagacaugggagugagaaugccagcuc

SEQ ID NO: 4178259 - RNA, 92 nt, Human
gagaaggacugcaguacacuacacgaaggcauugcaccugugugugaucaggcuuggugucagccccuugguuaguguugaacguuaauuuc

SEQ ID NO: 4178260 - RNA, 109 nt, Human
gagaaggagucgggugguaacgguuggggucaggaagaauucugccaaguaucuuuacugucauucugaccauagccucuuuguucccgcauucgaacuuuugguucuu

SEQ ID NO: 4178261 - RNA, 58 nt, Human
gagaaggauguucuaguuugcugagagaccuuaggcaagcagagcccauccaugucuu

SEQ ID NO: 4178262 - RNA, 58 nt, Human
gagaaggcaccaugagaugcugguuuuccucugaagcuugcugcuaggugccugccuc

SEQ ID NO: 4178263 - RNA, 88 nt, Human
gagaaggcagcaguggggcgguaugucagcauggcuaagucuguggaugcugacuucucucugcagugguucucacucuggccuucuc

SEQ ID NO: 4178264 - RNA, 61 nt, Human
gagaaggcuagagacuugcccaagcuugcccaggaggcuugagugagaaccuggccuucuu

SEQ ID NO: 4178265 - RNA, 65 nt, Human
cuugccucuucuuuuuucugcuugaccuggagggaucagaagccauauuuagggaggaggcauag

SEQ ID NO: 4178266 - RNA, 60 nt, Human
cuugccugugagcuccguccuagucgggccaccgcugaccagcuagaugagcuuggcaag

SEQ ID NO: 4178267 - RNA, 103 nt, Human
cuugccugugccuguccuccuggccucauagccaagcugugucccugagcuggggauggcuuggggaucugaggucauauaagggcugggucucccaggaaag

SEQ ID NO: 4178268 - RNA, 96 nt, Human
cuugccuguuagagaaauggcauaaguuuuaugguauugugcaucuagaauguucuuagcaccaccugaaaauuauuauuuccgcugauaguuaag

SEQ ID NO: 4178269 - RNA, 129 nt, Human
cuugcuaggccccaaauacauccagcaccugcagacccucaagugugaucugaaaaagaugccacucauaucuuucauucuagucugagguuuugucugagagggcauguccauguggccuugugcagg

SEQ ID NO: 4178270 - RNA, 56 nt, Human
cuugcugucuugcauuuagagcccaggguuggguacuuaggaauggggacggcaag

SEQ ID NO: 4178271 - RNA, 61 nt, Human
cuugcugugugagugacugcaucucacugcuuucuagcgugaggcgaagcugcaacagaag

SEQ ID NO: 4178272 - RNA, 76 nt, Human
cuugcuuaccuaguuagcuccacauaggcauccucacaucccauugcuuugguuaaguuuuucuggucaaagcaag

SEQ ID NO: 4178273 - RNA, 89 nt, Human
cuugcuuggucugcugugugcuuacuuggguuuuggacuaagucaaaacugcaaaaucucaggccauaacacagaggagcuuaagccag

SEQ ID NO: 4178274 - RNA, 78 nt, Human
cuugcuuuaggaaacaguagccuuugcucacacagaaccuugaucaaaggccagcaaagcuacucuccaugaagcagg

SEQ ID NO: 4178275 - RNA, 105 nt, Human
cuugcuuuguggaacuuuacucacuucauucauuuggagaauaguaaugaauaccuacuauauuucagguauggugugaaauauuuaaguaaauauauaagugag

SEQ ID NO: 4178276 - RNA, 116 nt, Human
cuuggaagaacuuaauugcucauaaaauuaauuuauggauggcuuuauuugauguuuggaaacaggaauacaaaugaaccaacuuugauguuuaugaguuuccaugguuagccaag

SEQ ID NO: 4178277 - RNA, 58 nt, Human
cuuggacuuuagucucucuccaucacuugacagcuauggagacaugggcgaaucuaag

SEQ ID NO: 4178278 - RNA, 88 nt, Human
cuuggagaaggcaucccauuggauccccugcuuuggaaugggcaucacuucaugcagggcauaggguccaguuugaccuugagcuaag

SEQ ID NO: 4178279 - RNA, 75 nt, Human
cuuggauauugagccugagaaagaagcagaguagagcuugaaguagcucuggagucuucucagaagauauugaag

SEQ ID NO: 4178280 - RNA, 66 nt, Human
cuuggaugauacaugugcauauauguguacuuauucacacaugaauucacauguauuuuaccuaag

SEQ ID NO: 4178281 - RNA, 93 nt, Human
cuuggauuaggccguggagguaggugacagaaggugccagaaugccaggagguuuugacauuauccuguuacuggaugcccuggcgguccagg

SEQ ID NO: 4178282 - RNA, 58 nt, Human
cuuggcaagagggaugcaagguuugggcuggggcuggggcccaguacccucugccaag

SEQ ID NO: 4178283 - RNA, 55 nt, Human
cuuggcaaggacccacuuagagaaguguuacuuagagaaggcuccuuuugccaag

SEQ ID NO: 4178284 - RNA, 71 nt, Human
cuuggcaauagagcuguucaguguaaugauccaagaagguccuuagaaggcugaauaauucugaggucaag

SEQ ID NO: 4178285 - RNA, 64 nt, Human
cuuggcacauggcaucccccugccuauagcagcaagagccuuccaggcagggggagcagccagg

SEQ ID NO: 4178286 - RNA, 80 nt, Human
cuuggcauggguggugggcaggucacucugccucaguccugccccagcugaagaggcgucaccaccacccccaugcccag

SEQ ID NO: 4178287 - RNA, 72 nt, Human
cuuggccaauguuacauaacccauuguccugucauugugacauauggaucuggucugugagcauuauuuaag

SEQ ID NO: 4178288 - RNA, 56 nt, Human
cuuggccguuucacugggcaguuaauaaucaaguuaauucccagaaacagcacaag

SEQ ID NO: 4178289 - RNA, 90 nt, Human
cuuggccuaacaagcggcagcccuggcuagggcgagggcaguugcuuccgaggccccgccccagccugggcugagccgggagcggccgag

SEQ ID NO: 4178290 - RNA, 91 nt, Human
cuuggccugggcucaucccacccauccugcaucucuugcccugcaauccacaggcccaggauggccauggccccugugagcccgcaccggg

SEQ ID NO: 4178291 - RNA, 64 nt, Human
cuuggccuucggaguggccaugcuccaucccucgucuuucuguguggccucuguagaggccaag

SEQ ID NO: 4178292 - RNA, 70 nt, Human
cuuggcgaagccgucugcaggacacgugccccuuucaucacaaggccacgucuccuuccagagcgccgag

SEQ ID NO: 4178293 - RNA, 77 nt, Human
cuuggcuauucugcuuuuguugcuuguacuuuuggagucauacccaagaaaucaugacuaagagcagugucaucaag

SEQ ID NO: 4178294 - RNA, 66 nt, Human
cuuggcuauuuccggaguguguuagccaaucuacccugugguuuucuuucucuggaauuggugaag

SEQ ID NO: 4178295 - RNA, 127 nt, Human
cuuggcuuccuauaaauuguuuuguccuuccucucagcugcaaucagaagcuaagggcucccgcaggccuuguucugaucugcugcagggaauggaggguuuuugaaacagagaggacuuggcugag

SEQ ID NO: 4178296 - RNA, 75 nt, Human
cuuggcuuucuuccuugcugucugcuccaggcggacucccuccaccaggcagccucggcaagggcagccucgaag

SEQ ID NO: 4178297 - RNA, 65 nt, Human
cuugggaugaauacugauuagaaaaaaauaugugauuguuggaaucagugcaguuuuaugccaag

SEQ ID NO: 4178298 - RNA, 62 nt, Human
cuugggaugucacggcagauguaucaaacuacaaaaacgguacacugacaaccauccacgag

SEQ ID NO: 4178299 - RNA, 73 nt, Human
cuugggcacuagcggauucucgacagaaccacaaaguggaguuggcugcagaugagucuguucauggccccag

SEQ ID NO: 4178300 - RNA, 55 nt, Human
cuuggggaagccacugaucccuggcccuagagggccagaucgggggcgccccaag

SEQ ID NO: 4178301 - RNA, 77 nt, Human
cuuggggauauugguaugcaggugacuagcugaauucauuucaugaaggaagcucccuguauagagaaucccuuuag

SEQ ID NO: 4178302 - RNA, 83 nt, Human
cuuggggcgaaugaucugauggaagagcuaacaauaucuacuucucuuuuggguguuguuuuugcucccaucugucccucaag

SEQ ID NO: 4178303 - RNA, 66 nt, Human
cuuggggcugucacucuggcaugcguagguaaagaaccacagaucggagcuggcaggaaccucagg

SEQ ID NO: 4178304 - RNA, 58 nt, Human
cuuggggcuucuuucucgcccaggcucuggaaugucuggcugggaagggggcccgaag

SEQ ID NO: 4178305 - RNA, 57 nt, Human
cuugggugugacuuuuggaaaacaugcguuuguauuucuguuggguauauauccaag

SEQ ID NO: 4178306 - RNA, 78 nt, Human
cuugguaggcgccuguuuucuguugauuuucccaucacuauuugggguuuuuccuaccagcaagacauguuuaucaag

SEQ ID NO: 4178307 - RNA, 55 nt, Human
cuuggucccauugcagaugacuguagaacacaccauucucugugaugggauuagg

SEQ ID NO: 4178308 - RNA, 114 nt, Human
cuuggucuugaaaugauuuuucuuuaggucaccuuucauaguuaaaauaguuugcuuucuuauaguuuacuuuuugucugcugaguuaaaguggcagagagaauugagcccgag

SEQ ID NO: 4178309 - RNA, 59 nt, Human
cuuggucuugggagcagggacaggauagucagaguuccccuccaugcccaggcaccaag

SEQ ID NO: 4178310 - RNA, 115 nt, Human
cuuggugaaaauuuuacugcuuggaauccagugauugugaaaacauuaagaagcaccaauguuuucauaaugucacagucaaaacaauucucaggcgaugaguucuaccaccaag

SEQ ID NO: 4178311 - RNA, 61 nt, Human
cuuggugcaggggacagggcaagcuuagagauggaagaaagcggcaguccucugcucuaag

SEQ ID NO: 4178312 - RNA, 60 nt, Human
cuuggugccaauucugugccaggcacuaugcugcaugcuugacacaguuuucucauuaag

SEQ ID NO: 4178313 - RNA, 65 nt, Human
cuugguggagcugugaguagaaucugucuugcugaacagagucuuauuugcagugucacacuggg

SEQ ID NO: 4178314 - RNA, 57 nt, Human
cuugguguccauaguaugugucuggcuuuaguuuguuccaggucuguggucaccagg

SEQ ID NO: 4178315 - RNA, 77 nt, Human
cuugguuagccagaaaaauccucccuuguccuucccuaagccagcaugggugggauuuuccaucacuugcaaccaag

SEQ ID NO: 4178316 - RNA, 73 nt, Human
cuugguuauuuuugauucuguggauucuugauuguaacauuuaaugaaauaucuaaaguguuaaauagcuggg

SEQ ID NO: 4178317 - RNA, 108 nt, Human
cuuguaaaaauuauucaacauauacagaaauuuaaaaagcagcauugcagguuaugugagauuauguaugucugcucuuuggaacuagguugaaaugauagcuacaag

SEQ ID NO: 4178318 - RNA, 91 nt, Human
cuuguaacuccaguuuuuccauugguaaaaugagagugauaaaugauaucguucacaucguauuauugggaagguugaaaaagugugcagg

SEQ ID NO: 4178319 - RNA, 60 nt, Human
cuuguagcuacuuuaggaaguaguuuuacuucucuuuacuuccacagugagaacugcaag

SEQ ID NO: 4178320 - RNA, 60 nt, Human
cuuguagcugcuucuucugaaggcuggguccccucacggcuucaggguggcagccacagg

SEQ ID NO: 4178321 - RNA, 87 nt, Human
cuuguaggagcugucuguagggcacaggagguucgggguagggauuuuauguaggucaucuacagacagaaaacucacuuuuacgag

SEQ ID NO: 4178322 - RNA, 62 nt, Human
cuuguauauguauauguguacauauguagauauuuacaugcauggacauguauauauguggg

SEQ ID NO: 4178323 - RNA, 63 nt, Human
cuuguauugcagaauaaaaagcaaguggccuagaauuagguaacuuacaucauucugcacaag

SEQ ID NO: 4178324 - RNA, 63 nt, Human
cuugucaggaaaugucccagguugugggcuaggcccuagggccaggaugcaacagggaacaag

SEQ ID NO: 4178325 - RNA, 77 nt, Human
cuuguccuccuccuccucuugcuccagggcacucgcagagguucuuuucacaaaggagcuggaggauggggggcagg

SEQ ID NO: 4178326 - RNA, 81 nt, Human
cuuguccucuguguguccuguuuuaaaauagugcugugcaggguugcacugucaaugugcgggagauuaauggagcacaag

SEQ ID NO: 4178327 - RNA, 57 nt, Human
cuuguggaggcaggcagaguuucuggguugcuccccuaccugucugucuucagcuag

SEQ ID NO: 4178328 - RNA, 89 nt, Human
cuuguggcacaguacaauaacuagucuuauaguacauaaagggaaggguacccucccaggaauuaugagauugguguauuucacacaag

SEQ ID NO: 4178329 - RNA, 70 nt, Human
cuuguguguuaauuuucccuuucucuguagaauccagaauggauauaagggaugugaaagaacacaggag

SEQ ID NO: 4178330 - RNA, 67 nt, Human
cuuguuaaaauguagauucugauucaggcaccugcaguggggucugagcuucugcauuuccaacaag

SEQ ID NO: 4178331 - RNA, 77 nt, Human
cuuguucucuacugccuggagcauuggugcucaauaaauauucauugaguaacugaaagccauguuguaagaaaaag

SEQ ID NO: 4178332 - RNA, 87 nt, Human
cuuguucuguuaguaaacaaacauagguuugaaaguccuaaaacaaggaagacuuucaaaccuauguuuguuuauuaacagaacaag

SEQ ID NO: 4178333 - RNA, 83 nt, Human
cuuguugaaaauacagauuccuaggcagcaccuaaauuuggauacagcuggucuggggccugggaaucugcauugucagcaag

SEQ ID NO: 4178334 - RNA, 69 nt, Human
cuuguugcccaggcuggagugcaauggcacucucuuugcucacugcaaccuccaccucccagguucaag

SEQ ID NO: 4178335 - RNA, 64 nt, Human
cuuguuuauuaugcacuguagacaucauuuucacaaagcugaguaauauaggcauuuagauaag

SEQ ID NO: 4178336 - RNA, 62 nt, Human
cuuguuuccucaaaguuguauaaauauuugaucacaaauuauacuguauuuuggggcacaag

SEQ ID NO: 4178337 - RNA, 55 nt, Human
cuuguuugauaggaaggacagguguuagugaacucuccuucagacgacaagcaag

SEQ ID NO: 4178338 - RNA, 129 nt, Human
cuuguuuuaaaaaaaugaggcuaauauaaaugucagucuuucugucucagaugugcuuuguguaucagaggagacgagacaugugaauucacauuuaugugacuagaccuaaaaucacuuugaaauaag

SEQ ID NO: 4178339 - RNA, 112 nt, Human
cuuguuuuuuguacuagccuuuggaaguaugucuuuggguauuauuuuccuccuucaacuaauguagaaaugagaucagagauaacucaacuaaggccacacaguugauaag

SEQ ID NO: 4178340 - RNA, 86 nt, Human
cuuuaaacaagguaaccucauuguuucugcuuuucaugauggucucaucaaggaagggguaggaauaaucauagccuguugcaaag

SEQ ID NO: 4178341 - RNA, 66 nt, Human
cuuuaaauauucuugaaagauccugguaacugauuuauaguugccaauuauaagaaugauuuaagg

SEQ ID NO: 4178342 - RNA, 71 nt, Human
cuuuaagcccucagagccucuuugacuuugaauuguagaaaagagagcucagagaaaacuggggcuugggg

SEQ ID NO: 4178343 - RNA, 88 nt, Human
cuuuaagcuguggcuuggcauggggcaaggguaggucuagccuauggccugcaaauccuggagccaugguaacaaagcugguuugaag

SEQ ID NO: 4178344 - RNA, 78 nt, Human
cuuuaaucugcauacuugcugcauuguaaauuucuugaucaugaugacacaguuaauaaguaguaagucagugugaag

SEQ ID NO: 4178345 - RNA, 84 nt, Human
cuuuaauuagguggccuggguacaugaaguaucuuuuuggaugccuagaacacaaaaagggacgacaacaggccaccuaauaag

SEQ ID NO: 4178346 - RNA, 97 nt, Human
cuuuaauuucaagguguugucucuuguggauguugggaaguauuguacuugaauauuugaagauaaauauggagaaaagcaguggugagaacuaaag

SEQ ID NO: 4178347 - RNA, 58 nt, Human
cuuuacaauucaagggaacucucaauauugguuugagucaccugggaauuuuguaaag

SEQ ID NO: 4178348 - RNA, 81 nt, Human
cuuuacaugauuggaucaccauuuuuguuucauuuauuuaaccaagagauggaauagaggugcugauauuauuaggugaag

SEQ ID NO: 4178349 - RNA, 70 nt, Human
cuuuacaugcuuuaucggauugacacugcagagaagccuuugauguucucgguuggauaaacagguuuag

SEQ ID NO: 4178350 - RNA, 61 nt, Human
cuuuaccagauuccauugcaagggugaaaaagcucagugaaccauaauggggcuggucaag

SEQ ID NO: 4178351 - RNA, 95 nt, Human
cuuuacuagcaugcagucuuaauagagaaaaacugugcugaaguuuagaaaggcauaguuuacauauguugagauauauauugcuguucguaggg

SEQ ID NO: 4178352 - RNA, 66 nt, Human
cuuuacuucaggggcagggugggggauucugguagagaccauaucacugugcccauugagguagag

SEQ ID NO: 4178353 - RNA, 72 nt, Human
cuuuacuuucuucuacuacuuggagaaagaacaaggaaacuuguugaucaccuuagcuagaggaagagaaag

SEQ ID NO: 4178354 - RNA, 63 nt, Human
cuuuagauggcuuaggaggccccacuggcacccuugccuccagccacacuaagcaucuugaag

SEQ ID NO: 4178355 - RNA, 71 nt, Human
cuuuagauguugcuuuaacuaugaaaaauggcaguaaauuacuaugugaacauguuaaauagcauuuagag

SEQ ID NO: 4178356 - RNA, 59 nt, Human
cuuuagcauucugccugaucuuuaugcccuaagacugcuuagcagagcagaagcucaag

SEQ ID NO: 4178357 - RNA, 86 nt, Human
cuuuaggaaagcucagaucuuguuggaagauccaugcaugacugaagagaugguagcauucaauaaagauuuugagcgauaugaag

SEQ ID NO: 4178358 - RNA, 75 nt, Human
cuuuaggaacaugcccuuaccuuccuuauauaaagaguacggaucugaaagagaaauuaaaggcuguuucuuaag

SEQ ID NO: 4178359 - RNA, 68 nt, Human
cuuuaggaggcugaggcaggaggaucaccugaggccaggaguuugagaccagccugggcaccauagag

SEQ ID NO: 4178360 - RNA, 75 nt, Human
cuuuaggcgaggcagugggcggggugccugggauaaaaucaugaccagaaccugaaacaguccuugcccucaaag

SEQ ID NO: 4178361 - RNA, 95 nt, Human
cuuuagggauuguuuuuaugaaacucuuuccacgauuacuuuaagaguucuaaaaguuguuagcgaugagauuuuuauuggagcaauuucugggg

SEQ ID NO: 4178362 - RNA, 82 nt, Human
cuuuaggggguauauuuucuggaacuaugccugauagcaauucugcagcaaucuggauagucaggagauauauaccagaaag

SEQ ID NO: 4178363 - RNA, 96 nt, Human
cuuuaggguuguuaaaguggaucacuguuccuugguuuguaaacauauucaccucuucaauaccagagacaguguuuaccucuaacuucuuuaagg

SEQ ID NO: 4178364 - RNA, 65 nt, Human
cuuuaguaaaguucaacagccagaaauauuagccauuuggccuggcuaaaguuggauaauuagag

SEQ ID NO: 4178365 - RNA, 69 nt, Human
cuuuagugcuuauuacugugcugucuuugagagcagaucuccugacuucuauuauaaugaggucuaaag

SEQ ID NO: 4178366 - RNA, 117 nt, Human
cuuuauaaagguguuauucugcugcccaguuuuguaauucucaaaaauagugccaggucuucuauagcuuuuuucagaauucaugggcuuacaaguacuguaugcaucuuuaaaaag

SEQ ID NO: 4178367 - RNA, 114 nt, Human
cuuuauaucuugugcacugaguggaauccaguggcugagucauuagacaggaagcucaagagggucugugucuguuuugcucaccauuuuguuuccuuggugcuugguauguag

SEQ ID NO: 4178368 - RNA, 60 nt, Human
cuuuauuauggaacugaagauccucuuaggaauguuagguucacagucuacauaguaaag

SEQ ID NO: 4178369 - RNA, 129 nt, Human
cuuuauucauauuugugugugcaguccuuuguaacuguuugcaaauuucgucuccucagacauucuuucuuccugagguaauagaugugcacaccacuggggcacucagacacagguaugcugucuugg

SEQ ID NO: 4178370 - RNA, 56 nt, Human
cuuuauuguccuucuuaggugggguugggcucagccaguagaucgggaggauguag

SEQ ID NO: 4178371 - RNA, 85 nt, Human
cuuuauuuucauuaagcugaaucccaagugaaauaguuucuuuucccuuacuuacuggaacuuucauucugcuuugaaaauaagg

SEQ ID NO: 4178372 - RNA, 62 nt, Human
cuuuauuuucuuugauggguuguucacaauagaaacugagcaauccaucagagaaaauaaag

SEQ ID NO: 4178373 - RNA, 100 nt, Human
cuuucaaaaugcagguuccugugccaucucuagagacugaaguuuaccaggucuguaguuauucuggugagguagucagaaggaccaugcauugagaaag

SEQ ID NO: 4178374 - RNA, 79 nt, Human
cuuucaaagcuauacuucgauggaguuuccuauacuagugaaaucuguuuuaaaugaacaucaagaauagccuugaaag

SEQ ID NO: 4178375 - RNA, 59 nt, Human
cuuucaaccucauagaaagaaaauguuggacaauauuuuccgaacuugagguagaagag

SEQ ID NO: 4178376 - RNA, 62 nt, Human
cuuucaaucuggcauguaagcuuagaggucgccacucuauccuaacaaguuagauuugucag

SEQ ID NO: 4178377 - RNA, 62 nt, Human
cuuucacaagauuugagaugcugucaaaaauaaaugccagcuccucagauucugugugaaag

SEQ ID NO: 4178378 - RNA, 61 nt, Human
cuuucacauaauugaccuugaaacuuugccucugggggaaucacaggucaaugugugaagg

SEQ ID NO: 4178379 - RNA, 88 nt, Human
cuuucagauacccccuaguuaugccagaagugcagagugcauuuauguuucugaauccuccuugcuggucugguguaauuccugaaag

SEQ ID NO: 4178380 - RNA, 101 nt, Human
cuuucaggauugcaggugggacuauguuuuggaggcuugauggauuuuucaguuauuuaguucauucuuucaaggaauaguuauugagagccuccugggag

SEQ ID NO: 4178381 - RNA, 125 nt, Human
cuuucagggaugaacugaacaaauuauauggcuccagucaucugucacaucagggguguugacagccacuguuuucaaaucugagugccgcugacuuuugcuguauuugguuauuuuccugagag

SEQ ID NO: 4178382 - RNA, 60 nt, Human
cuuucagggcaacacuucuuuuugauuccuauguuuucaugagaagggguugcccuaaag

SEQ ID NO: 4178383 - RNA, 62 nt, Human
cuuucauguuggagaggcccacauugcaaggaaccuagcauggccuccagccaacagcaaag

SEQ ID NO: 4178384 - RNA, 70 nt, Human
cuuucauuacaaccccaaauuacaaauuuaugucuuaagccuugucuuuguagaaaggguuguaugaaag

SEQ ID NO: 4178385 - RNA, 130 nt, Human
cuuuccagaaaccacacuugaguccacagcagagcggaaggggcaggaggcaucaggaccauuuccagauuucucucuggcccugauugucuagauuugcauccaaucacugcaagaguuuauacaaaag

SEQ ID NO: 4178386 - RNA, 118 nt, Human
cuuuccagcaggacacagucgaagagaccacaccaagcagaugggcacaagagacagacucaggaauuuugcuucugucucuuaugccuugagguccuuaucuucccaacacagaaag

SEQ ID NO: 4178387 - RNA, 61 nt, Human
cuuuccaggcuauccggugaagggaguggaaacauuugcuucugggucccagccuggcaag

SEQ ID NO: 4178388 - RNA, 84 nt, Human
cuuucccugaggcuaaggugccagacgaauugggauucuccuucaaccuaauuucugcuacugcacccuagugaaagggaugag

SEQ ID NO: 4178389 - RNA, 75 nt, Human
cuuucccugcuuagaaggauuucagcagaggagguaauaauggaugcuguagaauaaauucuugcauugggagag

SEQ ID NO: 4178390 - RNA, 95 nt, Human
cuuucccuuggcugcccucagguuugacucugcccagccgcuugucugcgagaccccgggggacaaggguucugcagagccugcagaagggaagg

SEQ ID NO: 4178391 - RNA, 66 nt, Human
gaaacuugaauucugccauucagagacuguuuucacucucuguggcuucuauuuaacuuuagauuc

SEQ ID NO: 4178392 - RNA, 69 nt, Human
gaaacuuuggcuaaaagccagaaauaagcacuagcauuuauuugugucucugucuuagcccaagugauc

SEQ ID NO: 4178393 - RNA, 65 nt, Human
gaaagaaaccuagaaggaagggucucuuuguaaauagauggauucuaaaccucugguuucgguuc

SEQ ID NO: 4178394 - RNA, 78 nt, Human
gaaagaacugaaguauuacucugaauguauuugcucacauucuagagugguaaacucagagaauacuucuuaucuuuc

SEQ ID NO: 4178395 - RNA, 60 nt, Human
gaaagaauacuucguaaguaggauccuuuucauuuugggaucaaauuuaguauucuucuc

SEQ ID NO: 4178396 - RNA, 56 nt, Human
gaaagacgggugccugugugugcgcuuguuuguguguacacauguaacaguuuuuc

SEQ ID NO: 4178397 - RNA, 90 nt, Human
gaaagagaccccugccccgugcagggccugcagagaaagguugaggauaagggccacugaggaaagcugcagcgguacgggggcucauuc

SEQ ID NO: 4178398 - RNA, 62 nt, Human
gaaagaggcaucucagcuuccucuugcuguccuguaccagaggucagcugcaugccacauuc

SEQ ID NO: 4178399 - RNA, 61 nt, Human
cucaccaucugguuauggaaggcaaaugacaacuagucaugaacuuccuagccagacugag

SEQ ID NO: 4178400 - RNA, 65 nt, Human
cucaccauggccccuggcacacggaggaugaaggcagccacgucccugucagggucaucugugag

SEQ ID NO: 4178401 - RNA, 61 nt, Human
cucaccugggggcucugaggcauuugagcacuucagcucaguuuuucagcccugaggugag

SEQ ID NO: 4178402 - RNA, 87 nt, Human
cucaccuugcugagauuucucuugacuaccaguuaggaaccguuagguuucaaggucaacuaugggauuccauuagcacuuggugag

SEQ ID NO: 4178403 - RNA, 57 nt, Human
cucaccuugugauccacccgccucggccucccgaagugcugagauuacaggugugag

SEQ ID NO: 4178404 - RNA, 57 nt, Human
cucaccuugugauccucuugccuuggccucccaaagugcugggauuacaggcuugag

SEQ ID NO: 4178405 - RNA, 89 nt, Human
cucaccuuuauuuuguuuucgucauuucuggagugggucaauuacuuaacccugaauagagaugugauauagcagagucuuaggguggg

SEQ ID NO: 4178406 - RNA, 75 nt, Human
cucugccaucuaaaacuacuaucaaaccuaccuuuugucuccagugguggguccugaggggagcugaagguagag

SEQ ID NO: 4178407 - RNA, 78 nt, Human
cucugcccucccugcaguuccaagagcucugggugacagcucaacccaaggcugcagugagcaugagggaggaaagag

SEQ ID NO: 4178408 - RNA, 70 nt, Human
cucugcccuuggcuggaauuacucugggccauguaauauuucaucucucagaguccccaguggguuugag

SEQ ID NO: 4178409 - RNA, 93 nt, Human
cucugccuggugucccauguauccccugcaugaggagcugagucaggucugcaguccuggugaggggacaucacggacaaucuguuggcagag

SEQ ID NO: 4178410 - RNA, 57 nt, Human
cucugccuuggcaaccacagcuuuaguuuuagagaaagcccuugaacaagggcagag

SEQ ID NO: 4178411 - RNA, 55 nt, Human
cucugcggucagccagcccuggguuuggugcuccaggaaaggccagcacguaggg

SEQ ID NO: 4178412 - RNA, 79 nt, Human
cucugcucugcaucacuguggcccaaaaccucagguagagcguccccuaccuggaaacacgcuagugaugagagcaggg

SEQ ID NO: 4178413 - RNA, 58 nt, Human
cucugcugagccagaguccccagguucaguuuacuccgggaaacucugcuuaacagag

SEQ ID NO: 4178414 - RNA, 63 nt, Human
cucugcugcuuugccaguggaaaugcucagaagaagguggaagaccauuggcaggcaguggag

SEQ ID NO: 4178415 - RNA, 86 nt, Human
cucugcuuuccuggguagaccaugggcuccugggacauaagaagugaaucuuguguacguuggugucucugggacccagagcagag

SEQ ID NO: 4178416 - RNA, 77 nt, Human
cucuggaaaaccucuggguuccgugguuugguuagauuaggaauuuccagcaucauacaugaucuaggggaccagag

SEQ ID NO: 4178417 - RNA, 91 nt, Human
cucuggaagggcuuucauaaucaucuuaucugacucauuuuccaccuaaggaaagagagagugcagaaggguaagagaccaaauuucggag

SEQ ID NO: 4178418 - RNA, 60 nt, Human
cucuggagcaccgggcuauccagaagggagaccaugauccuggagcuuggagcucuuagg

SEQ ID NO: 4178419 - RNA, 72 nt, Human
cucuggauuuucccauccuugugcuacaaccugaaaacucugucuaggcaguaagaugggguaaucguaggg

SEQ ID NO: 4178420 - RNA, 58 nt, Human
cucuggcagaaggcagaaauucauuuucuuuagaugagagcuuuagcuucagccagag

SEQ ID NO: 4178421 - RNA, 69 nt, Human
cucuggcagagucugcugucugcagaggugcugaugauaaccccugcaggugacaccacucuuccugag

SEQ ID NO: 4178422 - RNA, 64 nt, Human
cucuggcaggggaagaaaggaaacggggaaucucucuugaccuuuucauugccuuagcgcagag

SEQ ID NO: 4178423 - RNA, 71 nt, Human
cucuggcucccgcagcccccaugguuugggcuuugggcucuucacaugugcagggcagcggagagcaagag

SEQ ID NO: 4178424 - RNA, 64 nt, Human
cucuggcucugacaguugauccaaagcacgcuacaggaagcacacugguuagcuaaaguuagag

SEQ ID NO: 4178425 - RNA, 77 nt, Human
cucugggagcuuaagacaguuccaaucuuaccccacacuuccggggauccugauuuaacuggucuaggggcccaggg

SEQ ID NO: 4178426 - RNA, 57 nt, Human
cucugggauagagccucggucugagcacucucuuuauacccagcucugugcccuggg

SEQ ID NO: 4178427 - RNA, 60 nt, Human
cucugggcaggacgccaggccugugaaaccugcuaaaacaggccuggugaguauccaggg

SEQ ID NO: 4178428 - RNA, 76 nt, Human
cucugggcccugcuguuuggcauuggugucuguaucucugaccagaugaaggcuguguagauggauggaugaagag

SEQ ID NO: 4178429 - RNA, 63 nt, Human
cucugggccugucccugauugaggauucuagcaggaguucucaaacacugcugggccuaagag

SEQ ID NO: 4178430 - RNA, 56 nt, Human
cucugggcugaauggcugaacccuggauccccuggaacaaucacucuggcccagag

SEQ ID NO: 4178431 - RNA, 87 nt, Human
cucugggcuuuugcuaggcuguaaccccugccaggaaggcucagccccugucccuggcuaccucgccuuguucuucaaaguccagag

SEQ ID NO: 4178432 - RNA, 83 nt, Human
cucuggggccagguggaaauggcuuuccuaggggaugggguggcuccaacucaggcuagucagaccccugcggggccccugag

SEQ ID NO: 4178433 - RNA, 65 nt, Human
cucuggggcuucuccucaucucugcagcucugcugggaccuccugagguggagcagggucuagag

SEQ ID NO: 4178434 - RNA, 103 nt, Human
cucugggguccuuaaauaucggucucccguagguugcuguagucggccaauucguaggccuggcagguggcgcccucggccaccucgugugggacgccuaggg

SEQ ID NO: 4178435 - RNA, 63 nt, Human
cucugggguuagaucugaugcuagagucagauauuuagcuguucaccuuuucuauccccagag

SEQ ID NO: 4178436 - RNA, 72 nt, Human
cucugggguucaggagagagaaauuggggcuagauuuaagaauuucauagccuucuuuacugaagccugggg

SEQ ID NO: 4178437 - RNA, 62 nt, Human
cucugggucaccaucggggauucugaacccaguuggguguuguuucccaugcuggcccaggg

SEQ ID NO: 4178438 - RNA, 58 nt, Human
cucugggucuauaaugcagcugauuaauaugaaucauaucauugugucuggcucagag

SEQ ID NO: 4178439 - RNA, 70 nt, Human
cucugguucaauuuagaaagcacaguucguugcaauuauggccaagcuguauguauucugggagacaggg

SEQ ID NO: 4178440 - RNA, 58 nt, Human
cucugguugcagcugaaguuccuggagaaaauauauugagcuuuugaugcugccaggg

SEQ ID NO: 4178441 - RNA, 73 nt, Human
cucuguaaaugugaucauuguguuaggcaaagaauugcucaucaacaugaugaucauggaguacacaaaagag

SEQ ID NO: 4178442 - RNA, 70 nt, Human
cucuguacaauagcuauuaucuccauuuuagaacugguacuaauggcuggagagaguuagcauuauagag

SEQ ID NO: 4178443 - RNA, 98 nt, Human
cucuguaccuauggaucuuggacucccaagaccuuucccugaaugugguaagaauuuaauaagaaagguucuugggaguucacagaccagggacagag

SEQ ID NO: 4178444 - RNA, 58 nt, Human
cucuguaccuuaaaagggcuuucagucuuuccaagggcccuuugcucuuugguuagag

SEQ ID NO: 4178445 - RNA, 57 nt, Human
cucuguagccuguaagagagcagcaaagaggaaugaguugcucagguauagacaggg

SEQ ID NO: 4178446 - RNA, 73 nt, Human
cucugucaaaugcugaguucaaauggugaagcugcguauugacagcuucuucugauuugucagucuggcagag

SEQ ID NO: 4178447 - RNA, 55 nt, Human
cucugucagaguguuguccccaucauguggccucaggcauccuucugacccagag

SEQ ID NO: 4178448 - RNA, 83 nt, Human
cucuguccagcuggccuaacuucagggccuccugaaauuccucuggguucuccaggccccuggaguccuggcaguugaugggg

SEQ ID NO: 4178449 - RNA, 64 nt, Human
cucuguccuuggcuauccagggcuuaugcaauggcucaugaauggagcagccaugaugacagag

SEQ ID NO: 4178450 - RNA, 96 nt, Human
cucugucgcccaggcuggagugcaguggcaugaucuuggcucacugcaagguccgccuccuggguucaugccauucuccugccucagccuccugag

SEQ ID NO: 4178451 - RNA, 76 nt, Human
cucugucuuccuggagggggaaauguucauugaaauuuguucaggaaccauuuucucuuuauauauguggacagag

SEQ ID NO: 4178452 - RNA, 68 nt, Human
cucugugaaccccuccuuucuuugugcuggugucugggaccaaaaagggggaauaugggagggcagag

SEQ ID NO: 4178453 - RNA, 61 nt, Human
cucugugcugaaagauuaaaaugacuuccaucauacagguguuacuugucucagcauggag

SEQ ID NO: 4178454 - RNA, 60 nt, Human
cucugugcuucaauuuauaguacuuaucuguaaaaugggauaauaaauagaggcagaggg

SEQ ID NO: 4178455 - RNA, 71 nt, Human
cucuguggcagcugugggacacuggucuaaggacuacacccugaugccuggugaguuacagaggccaugag

SEQ ID NO: 4178456 - RNA, 83 nt, Human
cucuguuagcugucaaaguguuuaaaggggcaagagguaauaugauccuucugaacugaaagcugcuuugucaggaauaugag

SEQ ID NO: 4178457 - RNA, 58 nt, Human
cucuguucucugauugucugauaggcguauaguuugccucuccagacagagaacaggg

SEQ ID NO: 4178458 - RNA, 62 nt, Human
cucuguugucaguggaagcagcacagaucuucccugcaccguguggccauuugaaaacaggg

SEQ ID NO: 4178459 - RNA, 61 nt, Human
cucuguuuggggugagguacucuaagcucuuggacaugagugaugucacccacagacaagg

SEQ ID NO: 4178460 - RNA, 57 nt, Human
cucuguuugguucuccgguaugguucuuggaguuguauuagagaacacaaacuaaag

SEQ ID NO: 4178461 - RNA, 73 nt, Human
cucuuaaccagaaaaugcacuugucuggaagacuauucaacaugaagacagugugguuguuucugguuaucag

SEQ ID NO: 4178462 - RNA, 74 nt, Human
cucuuaacguuuuucuagacucaaagaggauauaaauguuuccucugcaugagcuagguuccaggaacaaggag

SEQ ID NO: 4178463 - RNA, 78 nt, Human
cucuuagcaucuaccuguuucuugacugacucaugagcgauccaugcccauggcagucagagauaagagugacaagag

SEQ ID NO: 4178464 - RNA, 130 nt, Human
cucuuauugauuaccugaaauagugugccagggcucaucugagacugacauaauaauacugaauaauuccugaacaauuauaguggaaguugagaugauauccuuuagcuguuggucuuaaugaguuaag

SEQ ID NO: 4178465 - RNA, 108 nt, Human
cucuucaaggcuauaagaagacuugggagaagagaaaugucugagacuucugaacuuuggcagauaaaguugguguuagaguuuuucagcucccgaagccaucaggag

SEQ ID NO: 4178466 - RNA, 62 nt, Human
cucuuccuaugccaacauucugugaguccuacaacagcuacaaaauguucugcugggaggug

SEQ ID NO: 4178467 - RNA, 66 nt, Human
cucuuccuauguucauuuuaagagcccucauuugucucuauuccagcuacagugaaccaggaggag

SEQ ID NO: 4178468 - RNA, 80 nt, Human
cucuucgacuggggcagaguagcugggguguggaaaaggaacaccuucauacaacuuccagcuuucagccccuuggagag

SEQ ID NO: 4178469 - RNA, 60 nt, Human
cucuucuccugggugccaggcugauaauagaauuaaagcccagcauauacuaggccugag

SEQ ID NO: 4178470 - RNA, 83 nt, Human
cucuucucgaaguuucucuguaccucugucccacccugcugaauggguuuggcaccaaaggagaagauccuucaugaggagag

SEQ ID NO: 4178471 - RNA, 59 nt, Human
cucuucucucagagggaaacaugagugagaaccugacucgcaaccccuaugagauagag

SEQ ID NO: 4178472 - RNA, 86 nt, Human
cucuucucucuuucacagggcagaucauuucugucuuaguacaaauaagaaaauagauaggaaagggccuugggaccagugaaggg

SEQ ID NO: 4178473 - RNA, 75 nt, Human
cucuucugaaacauuuauggcugagauuuaaaacuacuggaauugagacauucagagguaagggucucagaacag

SEQ ID NO: 4178474 - RNA, 104 nt, Human
cucuugaggggaaagagggugaaaacuauuggccuagaacaagggugaucuaccccaguuguucagaggccaguguuuucaugccuucucuuucccuuuaagag

SEQ ID NO: 4178475 - RNA, 117 nt, Human
cucuugaguagcuaggacuacaggcgccugccaccaugccaggcuaacuuuauuuuucauagagacagggucuugcuauguugcccaggcuggucuucaguuccuggccuuaagcag

SEQ ID NO: 4178476 - RNA, 59 nt, Human
cugauggccaccaaaguccuguggcuuaccaaagcuuucuuauuugguggcuguauuag

SEQ ID NO: 4178477 - RNA, 71 nt, Human
cugauggccauccugccaccugcacagcucccuuccaggacucagggagcuguugaaggugcagggcccag

SEQ ID NO: 4178478 - RNA, 85 nt, Human
cugaugggcuaugguuuugcuuccugcuaaggcugccuggaugaucuggcccuggggcagggaagccccaagagccuugagucag

SEQ ID NO: 4178479 - RNA, 71 nt, Human
cugaugggucauguacucagcuuuuagacaggcauaacuuuauguccuuuuaaaaugugagaaccuaccag

SEQ ID NO: 4178480 - RNA, 78 nt, Human
cugaugguugcuguacuguuuuuuaucuguugugauggccuuaggcuuggguggagagggaacagugaaaggcaucag

SEQ ID NO: 4178481 - RNA, 100 nt, Human
cugauguaaugagcccuccccucuauccuuaucugucuggucgagucauucugggcugacugggcaccaucaugagauaggcaggaggucucaucauugg

SEQ ID NO: 4178482 - RNA, 99 nt, Human
cugauguaugaggccuccccucuauccuuaucugucuggucgagucauucugggcugacugggcaccaucaugagaugggcaggaggucucaucauugg

SEQ ID NO: 4178483 - RNA, 63 nt, Human
cugaugucuuauggucuugggcuucccucugacuuucaggggacagugacaaaugagacacag

SEQ ID NO: 4178484 - RNA, 124 nt, Human
cugaugugauucuaaaguuuauguuuuuaagaacuguucugugcuuuaucuccauggugcugaauguuuuugauaggugaagaggagugucuuaagagcaggggcuuaggacuuguaaggucag

SEQ ID NO: 4178485 - RNA, 66 nt, Human
cugauguucucuuuugcuguugauguauccaggccauuugcagggaacagaaagagagaaugucag

SEQ ID NO: 4178486 - RNA, 82 nt, Human
cugauuagaagaauacuugauguucaugauaauuguggugcaagacaguuuuaaguauguuuuuaguauuuuuauaguucag

SEQ ID NO: 4178487 - RNA, 60 nt, Human
cugauucugaggacccugugacgagcaggcccuggcuugucauugugacuacagaaccag

SEQ ID NO: 4178488 - RNA, 105 nt, Human
cugauuuucuuguugcauuuuauuuuacuuaugaguauaaguugcauuuuauuuuacuuaugagugucagcuaauuauucaugaauuaaacugaaggaugaucag

SEQ ID NO: 4178489 - RNA, 68 nt, Human
cugauuuuuuauaucuggggguuauuuaggauuauucacauaaaacccuuuaagauuugaauagucag

SEQ ID NO: 4178490 - RNA, 74 nt, Human
cugauuuuuugcugagcccuggcuuugggucaaaccaugcugaaugcuaaggcccaggagaaaauaaaaggcag

SEQ ID NO: 4178491 - RNA, 67 nt, Human
cugcaaaguguccuaaaagccauaugggagauagacuucuucgcagcugcaaaggaaacauuugcag

SEQ ID NO: 4178492 - RNA, 59 nt, Human
cugcaaaugggcuuuagguggcuuagucugaugaguaagccaugacugaccccaugcag

SEQ ID NO: 4178493 - RNA, 109 nt, Human
cugcaacaugcccucugucauaaauucgugaauauauuaaaaaggguugggcagagcagcaauuucacuaauaauauuuacugcuuuggggauggagaggagauuguag

SEQ ID NO: 4178494 - RNA, 68 nt, Human
cugcaaccccauuucaaugccuucaacauaguggguguuaaguccuuauggaauugaaauggguucag

SEQ ID NO: 4178495 - RNA, 65 nt, Human
cugcaaccuaauccccuuugccuuguaaucugacauagacacagguacaagggauuaggaugugg

SEQ ID NO: 4178496 - RNA, 67 nt, Human
cugcaagccaggaagagaauccucacuagaaacugaacuaguaggaaccuugaucuuggauuucuag

SEQ ID NO: 4178497 - RNA, 115 nt, Human
cugcaaguacagaaaggaggucaacuugacuguggcuuagggauuaggcuaaagagagagagagucagagcccugugugccaugugaaagaaucugguuuccauucugcaggcag

SEQ ID NO: 4178498 - RNA, 58 nt, Human
cgguacacuagcuauuaacuucacauggcuauugcacacuggaaguguggcuagucug

SEQ ID NO: 4178499 - RNA, 56 nt, Human
cgguacggcguguuggucccagcgguucagcugagguagggacgugccguaggccg

SEQ ID NO: 4178500 - RNA, 85 nt, Human
cgguccugcuuccccagaggugaggcagcuuuuggccauguuguugguagcaaagacucacuuucagcucuggaagcuuuggcug

SEQ ID NO: 4178501 - RNA, 58 nt, Human
cggucugaucuggaaauagggccucaauaugugccgccaguguuuccgucaguacacg

SEQ ID NO: 4178502 - RNA, 58 nt, Human
cggucuucaggguaugggaaagggacucuucugugccuucuugguccccuggguccug

SEQ ID NO: 4178503 - RNA, 75 nt, Human
cggugacuuugcauugugcuggagacagucaggguaguguuugcuggcuguggcucucacaagcaaaugucacug

SEQ ID NO: 4178504 - RNA, 86 nt, Human
cgguggaugggguugagauagaaaaauguagauggcccucauaaacuaguggugcucuuaacauauuauuuuagcacaggccauug

SEQ ID NO: 4178505 - RNA, 67 nt, Human
cgguggccuggcggucccaggguaccccacaggcccuacuaguuggggacugacagccaggccuccg

SEQ ID NO: 4178506 - RNA, 81 nt, Human
cgguucaagcugaaaauguuacacaggaagacauaccauguaaaggucagauucuucuacuauaauaauuuucuugaucug

SEQ ID NO: 4178507 - RNA, 66 nt, Human
cgguucugggugcaggcguguguguuagcgcgaggggcguuuucacaucccgcgcgcccuuaaucg

SEQ ID NO: 4178508 - RNA, 65 nt, Human
cgguugcuggcaucuuaauguucuguagguggaauauuuccaauaaacacaaggugccguaauug

SEQ ID NO: 4178509 - RNA, 90 nt, Human
cguacauuauauuucuauaggaggacaguauuggucuuuacacagauuuuaagguucuguccugcuaugagguuccaugauucaaauacg

SEQ ID NO: 4178510 - RNA, 55 nt, Human
cguaccacagcagugucugguacugaguaagagcucaaugaauauugcuuggacg

SEQ ID NO: 4178511 - RNA, 68 nt, Human
cguagcccuucaaaauuuacgcaguuuguacauauagauaugugcuguauauauuuugaagugauacg

SEQ ID NO: 4178512 - RNA, 76 nt, Human
cguaggcaguuagcacucaguuuccagaugaaaaggugaagauccuucugggaagugagaugcugugugcauuaug

SEQ ID NO: 4178513 - RNA, 93 nt, Human
cguaggccgcauucugggaguuguaguccgguggagcggggguuggcgccgcccgcggacccagccggacuccacuucccgucgagcccugcg

SEQ ID NO: 4178514 - RNA, 90 nt, Human
cguaguaucuauucuuaauuccaaagacugagugaaggaaaugauccugccuuccauuucucauggauauaagaacuguuuagagcugcg

SEQ ID NO: 4178515 - RNA, 94 nt, Human
cguaucugucuaucuggcaguuuacagaguucugaauuuuuaauauauauuuugucuuuaggcacuuuguagcauggugccacugauggauaug

SEQ ID NO: 4178516 - RNA, 57 nt, Human
cgucacuuuggucacacugggcacugggaaggauguucugcaggugaccuggugaug

SEQ ID NO: 4178517 - RNA, 102 nt, Human
cgucagaauugcacugcgguaauuuauuuccugccaguacacaagggcugaggguggagguggggcuggaagauggguacugccgcaagagcagugaugaug

SEQ ID NO: 4178518 - RNA, 111 nt, Human
cgucagggagcuuuagguucauucccucaccugccacagcucagucauucuccaaauucuucuuauggggcugccugaggcagugagagaagcaucugauuaaccgugaug

SEQ ID NO: 4178519 - RNA, 69 nt, Human
cgucauaccagaugugaccacagguaucagaagacagaugucuuuaauuccuuuauuauuuguaugaug

SEQ ID NO: 4178520 - RNA, 79 nt, Human
cgucccugcgcccgucggagcggcgcccuggccgaagccugucacucucggaaggggccgcgcucggacaccaggggcg

SEQ ID NO: 4178521 - RNA, 86 nt, Human
cgucuaggaaugaguuaggaagagcuuucaaucacuguguccauuugugggcaaguguuuaacuucguccugaagcauauuuaacg

SEQ ID NO: 4178522 - RNA, 75 nt, Human
cgucugcaucagccuggcuuccugcacagugucugcgccggugcacaccuuagaggggagcugcgccaucagaug

SEQ ID NO: 4178523 - RNA, 60 nt, Human
cgucugccuaaggacugccuucuugggcugccaagguacuggcuuauccuugguuagacg

SEQ ID NO: 4178524 - RNA, 76 nt, Human
cgucugguggguagaggccagggaugcuguuaaacauccuacaacauauaggauagcccccugcccccaaccaacg

SEQ ID NO: 4178525 - RNA, 71 nt, Human
cgucuuccuggcucaguguugaaggggugcuccaacaugcacccagagcccuuagcacagacuuggagaug

SEQ ID NO: 4178526 - RNA, 78 nt, Human
cgucuuuagagguuacauugguagccugaaacuucagauuuuucuugauuuuucauguggcgaugucucuggaagaug

SEQ ID NO: 4178527 - RNA, 96 nt, Human
cgugaagagccucuuguuucugcagcugaggugaggcuggaaaggagcuaccacucacuuauugcucaucucaugcucagccaaggguuugucacg

SEQ ID NO: 4178528 - RNA, 72 nt, Human
cgugagggucacaggcaaguacacaggcucauggauuuguccagagaacauguguacaugccugcacucaug

SEQ ID NO: 4178529 - RNA, 56 nt, Human
cgugaguguuaacccacugcuucuaaacccgugaagccugucaugugacgcugaug

SEQ ID NO: 4178530 - RNA, 80 nt, Human
cgugaucucugcccucaggguguauaguguagaaguuuguaaagaagcuuuguuucacauacaccuuaacagaguacaug

SEQ ID NO: 4178531 - RNA, 56 nt, Human
cgugccgcuccaggucucgcggugagcggaacagcuucucgcacucggagcagccg

SEQ ID NO: 4178532 - RNA, 77 nt, Human
cgugcuagaugguaguguggcugauugacauggucagcuggaggagaaugauuguguguuagccaucaauggacaug

SEQ ID NO: 4178533 - RNA, 67 nt, Human
cgugcucccuccagaagcucuaggggagaauucauuccuugccucuuccagcuucugguggcugcug

SEQ ID NO: 4178534 - RNA, 130 nt, Human
cgugcuguauaccaauuguaagcaugcaucuuucucagacuuuggauucauuaucuggauauaaaauucauauccuaauaaaaugaaguauguagugagaagugugcucaagucaagcagcccaugaaag

SEQ ID NO: 4178535 - RNA, 83 nt, Human
cgugcugucagucccugccagaggcaaaguuuuaguuaauuccaggcaaggccugccucuggcagaaaaggggugugugugug

SEQ ID NO: 4178536 - RNA, 77 nt, Human
cguggaccuucccuguggccuguacccgucccucaacagagacaggcaauuaccagcgcccaggcuguuguccgacg

SEQ ID NO: 4178537 - RNA, 66 nt, Human
cguggagaaagcugacuuggcuggugugguacagagaagccagcuuguuuacaugcuuauuccaug

SEQ ID NO: 4178538 - RNA, 88 nt, Human
cguggagccaggucgggccgcggcgagcaagccgacccccccaacuuucgaggggucucgccgccccgcuccucucccggcuucgucg

SEQ ID NO: 4178539 - RNA, 109 nt, Human
cguggccuuuccccuuccagagggcagggcggucucagcacccucuugguccacagcugaucuuuuuuagcugcugaagggucuggggcugugcccuggggaagccaug

SEQ ID NO: 4178540 - RNA, 96 nt, Human
cgugggacaguguuaaaucaugcuaguauuacauuuuuguguguaugguuuagauacauuuccagaacguauugcugacauacgcauugucuugcg

SEQ ID NO: 4178541 - RNA, 73 nt, Human
cgugucccaggcccucugcacccucgucuuggggcaggcccugggcgcuggggucagaguggagcaggucaug

SEQ ID NO: 4178542 - RNA, 76 nt, Human
cgugucugcuguguugcugggguggugggcugagcccugagcgggauggccaagcucucauuccagcacagucacg

SEQ ID NO: 4178543 - RNA, 67 nt, Human
cguguggaucauagcguuuacauguggauuaacauuugcuaauccaaaacugaaucuguggcacaug

SEQ ID NO: 4178544 - RNA, 93 nt, Human
cguguggggcagggagauggcaggcccugugggggugucacuggcccaggucacuuugcagggcuugauauccagacccacuugcccgucacg

SEQ ID NO: 4178545 - RNA, 60 nt, Human
cguuaaacaugcaugaagaaguuauauuuuguguaaauguacuucccagugugauuagcg

SEQ ID NO: 4178546 - RNA, 71 nt, Human
cguuagaccucaauaccaggcaccacgcaauaccuggugcauugugugaccacuggaauagaggaugaaug

SEQ ID NO: 4178547 - RNA, 78 nt, Human
cguucagcucaagcaauaauuuucaaaucucuauccaauucuuuugcaugucagaaauuauugcuagagacugcaaug

SEQ ID NO: 4178548 - RNA, 78 nt, Human
cugccacuucaggaagugacccaaugauggccaaagcuuuacugaggcccccagcugcauacuugccaagaggggcag

SEQ ID NO: 4178549 - RNA, 63 nt, Human
cugccagcccuucugacaucuggggaaaagggcucagcagaugugccuccagggcuuuggcag

SEQ ID NO: 4178550 - RNA, 69 nt, Human
cugccagcugcugcgguuauugcuaccuuccuguuuuaagaugaaagcaaugaugguagacacgugcag

SEQ ID NO: 4178551 - RNA, 57 nt, Human
cugccaggcgauggauuggcugaccuugguucaggccuccacaucuugucuguucag

SEQ ID NO: 4178552 - RNA, 61 nt, Human
cugccaggcugucccagguccgggaugccaucggcaagugggcggggacaggccuggguag

SEQ ID NO: 4178553 - RNA, 59 nt, Human
cugccagguuggcgcucgcucucagacuuacugugaggccuucagcccacacuugccag

SEQ ID NO: 4178554 - RNA, 57 nt, Human
cugccaguuaguuaccuuauuacaaauuuaccuuagaugagguaauucacuaagcag

SEQ ID NO: 4178555 - RNA, 60 nt, Human
cugccauccacggcccacucaucacauacauccagcugggcugggcuuuacagagggcgg

SEQ ID NO: 4178556 - RNA, 59 nt, Human
cugccaucugagccaaaagugccuucuuuaaaauucccacugugggguucaacuggcag

SEQ ID NO: 4178557 - RNA, 79 nt, Human
cugccaugcagauuugcauuguagacccucuaaaugccuuuugcuuagaaaucugcugccaugcaaauuugcauuguag

SEQ ID NO: 4178558 - RNA, 80 nt, Human
cugccauuguguuuuaaaguguugaagaaaauguucaugcucaugggcauggaaaagauauuauaagacuuggaugggag

SEQ ID NO: 4178559 - RNA, 77 nt, Human
cugccauuuacuagcaugccagggaacuauggaugaguuagaacucauucccccauaaugguauuuuaauguuguag

SEQ ID NO: 4178560 - RNA, 75 nt, Human
cugcccaacaugccaaugccugcuaguccaaagccacuugaguccugggagcagcauugccaugugcaagagcag

SEQ ID NO: 4178561 - RNA, 100 nt, Human
cugcccaaucucuucucccugcauaguucaccgcugauaccuguuuccccaacuucacuugguagcaaaggaugacuauguaccaggaauugacaugcag

SEQ ID NO: 4178562 - RNA, 82 nt, Human
cucccagcaauucaacagcugucugccuaucucugagcugcaggcaguuuagugagagagcagauacgcugucuagaaggag

SEQ ID NO: 4178563 - RNA, 69 nt, Human
cucccagccauacugacaucaacaaaaauagccacacacauuuuugaaugcccaagguuuggcugggag

SEQ ID NO: 4178564 - RNA, 84 nt, Human
cucccaggaggcccugggcccucugagccucaguuuucuugucuggugauggcugagggccagggcuagucucaugcaguggag

SEQ ID NO: 4178565 - RNA, 61 nt, Human
cucccaggcuggcaggcagcagugcugaggacaagcucacuguugagagucggucuggaag

SEQ ID NO: 4178566 - RNA, 110 nt, Human
cucccagucuuugucuauaucuauacuuacuuugaaugucacaagcaaaugagcugacaccaucauugcaaagugucaugcaaaguaagagagcuacagugaaaagggag

SEQ ID NO: 4178567 - RNA, 60 nt, Human
cucccauaauucucauaugucaugggaggaacccagugggaggugauuaaauuauggggg

SEQ ID NO: 4178568 - RNA, 88 nt, Human
cuccccacagaugccaaauucucagccucuuuuggaugaugaugaaauaauagaaugguuugcuagagcauuagguauggguggagag

SEQ ID NO: 4178569 - RNA, 81 nt, Human
cuccccauaugccucccugacugcauuugccaugugccugucaagccggggaccaaaugcaggucagcaggugucagugag

SEQ ID NO: 4178570 - RNA, 56 nt, Human
cuccccauggcaacaguuaugggacuccucccauaguccacgccugucuuggggag

SEQ ID NO: 4178571 - RNA, 63 nt, Human
cuccccauuccucucggugguggugggggagccuuuucaaccaagacuguuaggaguggggag

SEQ ID NO: 4178572 - RNA, 99 nt, Human
cuccccgcuccaacucuagcccaacccccgucgacgcccccuucuacgcuacguggcuagggaucuagaccaggacugggagccugagggguggggcag

SEQ ID NO: 4178573 - RNA, 67 nt, Human
cuccccggugugggaauggcggucgugcacucuggggguggcguuguucucguucccuacuuggggg

SEQ ID NO: 4178574 - RNA, 60 nt, Human
cucccgaggcuuuagaagaauauaauugccguucuaagaagaaucugaggccucuaggag

SEQ ID NO: 4178575 - RNA, 59 nt, Human
cucccgcaccuccacccagacacacacacacucguucugcacaggagggccguggugag

SEQ ID NO: 4178576 - RNA, 78 nt, Human
cucccgccccacccuucuuuccacgccccuccggagcucccggggaggaagcuggaacacgggauugggguucgggag

SEQ ID NO: 4178577 - RNA, 59 nt, Human
cucccggcuuuuccacucagccucagaaacucuggaagagguggaaguggcuucaggag

SEQ ID NO: 4178578 - RNA, 61 nt, Human
cucccgggcucggggccccuucacuggaggcugcacccccucccaggcugcgagucccgag

SEQ ID NO: 4178579 - RNA, 74 nt, Human
cucccgucgggcuggagagucccacguggggcacagaggagaggaggugcccggggcucugcaugccaugagag

SEQ ID NO: 4178580 - RNA, 80 nt, Human
cucccgucucggccaguuuccugguggagggacaggcuuagcuaaggcuuugcucucccuccagccagcuggggcaggag

SEQ ID NO: 4178581 - RNA, 60 nt, Human
cucccgugcccccaccuggcuggccuguguuacccgccaggcacucacggggcacuggag

SEQ ID NO: 4178582 - RNA, 82 nt, Human
cucccuaacuuucauguucauuuggaaccugcucccuccccaaggcacucugaauggucucaaggacauaaaagcuagggag

SEQ ID NO: 4178583 - RNA, 105 nt, Human
cucccuaauaugcaagcuuagguugcuuuggaauuuuccagguacaguguuggagaaguuguaacacaggaggaggccagagcguagguuuagugugguggggag

SEQ ID NO: 4178584 - RNA, 80 nt, Human
cucccuagugagaugaacccaguaccucagauggaaaugcagaaaucacccgucuucuucugugucgcucucgcugggag

SEQ ID NO: 4178585 - RNA, 74 nt, Human
cucccuaucagcgcuggcccacaccuaaucguuccagcuagcacccaggagugggcucagcuuccaguggggag

SEQ ID NO: 4178586 - RNA, 64 nt, Human
cucccucccccgagagcauaggcugcguuugugggaaaccagggcucagcgcgcugggagggag

SEQ ID NO: 4178587 - RNA, 60 nt, Human
cucccucugccuuugcuuuggcugucacagucccugacuuugcuucagggcagcagggag

SEQ ID NO: 4178588 - RNA, 75 nt, Human
cucccugagguggugguggaggcauagcugacucauccagauuuguucugcuggccucaucacugacuucuggag

SEQ ID NO: 4178589 - RNA, 58 nt, Human
cucccugggcccauuuaaugcaccaccuaucccugugcugggucccaagccuggggag

SEQ ID NO: 4178590 - RNA, 56 nt, Human
cucccugggccucaguuucucuguaacaucugucagacuucauggguccaggugag

SEQ ID NO: 4178591 - RNA, 58 nt, Human
cucccuguggcaugcgcucugaugggucagcacaaaggaggcaccugucacaggugag

SEQ ID NO: 4178592 - RNA, 86 nt, Human
cucccuguguuuuccauggcuugauagaaagcuaguuagcucaaggcauuagcauaguuguguaucaggccaggcauauaacggag

SEQ ID NO: 4178593 - RNA, 59 nt, Human
cucccuguuuugaggguuagaaaugucaaaccauagacugacaaaggcaaggcaggggg

SEQ ID NO: 4178594 - RNA, 62 nt, Human
cucccuuauuuucuagcuugcuugacaauuucacugucugagcuacuuaggauauaacagag

SEQ ID NO: 4178595 - RNA, 73 nt, Human
cucccuuuuggauauggggagagggucaggauaccuuaauuuacaguucgccaugucucuucacagaagggag

SEQ ID NO: 4178596 - RNA, 66 nt, Human
cuccgaggagccaggggaccuucacagagcuucggcaaguucugggaggucacauuggucuugggg

SEQ ID NO: 4178597 - RNA, 59 nt, Human
cuccgauuucauugacaaacauggcucgugaaugugagccuggcaccugcagaucggag

SEQ ID NO: 4178598 - RNA, 78 nt, Human
cuccgccuccucucuguccugauuuacccccugccuggcacaaaaaugaacagagaagucaccaagaggaaggcggag

SEQ ID NO: 4178599 - RNA, 88 nt, Human
cuccgcuuaccuggcuggcucccauugguccuuccucaaccugcucuccuuggggaggcaauucuggaccacccaagacaagcuggag

SEQ ID NO: 4178600 - RNA, 69 nt, Human
cuccgggacccagguagggaggaagauuuugcucaggucauuaucuggcucuuccuggaguuccgagag

SEQ ID NO: 4178601 - RNA, 129 nt, Human
cuccguuccgagcgcgcugcgguuccguuccggaccgcgcauccgcccgccccgcgcaccgaggcuccgcgcggcgcgcccccgggugugucguucgccgguaccaccgcagagcgcgggggaaugggg

SEQ ID NO: 4178602 - RNA, 69 nt, Human
cuccuaagaauuccaucgcagaguauuucugguuuuauacaaauauuuugugcagaguuugaauuggag

SEQ ID NO: 4178603 - RNA, 55 nt, Human
cuccuaagcagcggaggccugacacuccauggacugcauggcugcugcuugggag

SEQ ID NO: 4178604 - RNA, 99 nt, Human
cuccuaauauucacacucuuucuauuccuuuccuuuuuagugugggagggaccugguaacuugcaucuaaugaggagaauauggcaaaaaggauaggag

SEQ ID NO: 4178605 - RNA, 65 nt, Human
cuccuaauuuuugagauagcuguguuuugccaccagaacauuacugcuugggagagguaagggag

SEQ ID NO: 4178606 - RNA, 75 nt, Human
cuccuacaaugagcaguucuucgggccagggacacggcucaccgugcuagguaagaagggggcuccaggugggag

SEQ ID NO: 4178607 - RNA, 55 nt, Human
cuccuaggugcucacugggguccggggagguacagcccccaugagcacuggggag

SEQ ID NO: 4178608 - RNA, 73 nt, Human
cuccuauaugucuaguaauugaccuguagaaaauaauuacauucacuacaaauuaaugggcauguuuagagag

SEQ ID NO: 4178609 - RNA, 55 nt, Human
cuccuauauugcuucuguccuggguaacuccaggcaaaacagauuuguaugugag

SEQ ID NO: 4178610 - RNA, 130 nt, Human
cuccuauuuguccaaccccacagcuggugcucuaaaccauaauggcuauugauuucuuuugggaagaaaguucugugagaaccagugccaggguagaaaaccugaacuguaacugaugaacugaugggag

SEQ ID NO: 4178611 - RNA, 128 nt, Human
cuccucauucccguuauaccuuuucuguugauguuggcucuaaucucugauaaggaaaaauuauuauagggaauucuagaaguccacaaagaccuuagagaucuguaggguguaaaaaagggaaggag

SEQ ID NO: 4178612 - RNA, 112 nt, Human
cuccucccaggccuguguguggugggccaugccaggcugccugggaggaggaagguggggagcuccucccaggccuguguguggugggccaugccaggcugccugggaggag

SEQ ID NO: 4178613 - RNA, 58 nt, Human
cuccuccuggacacaggcugugucaauaccaugaauuaacagcuguaguuggagugag

SEQ ID NO: 4178614 - RNA, 108 nt, Human
cuccucgggugaucuuagacaaggguucugugccuccugcugcugcgccagcugccaggggccuggggcucggagcucucacacuuacuucugggguuguccaaugag

SEQ ID NO: 4178615 - RNA, 56 nt, Human
cuccucuguauugauugggacugacuagaaugucugucccagucagccagagugag

SEQ ID NO: 4178616 - RNA, 57 nt, Human
cuccucuuggcugucacugucaguucagguuguugccugaugcaugccuuugagggg

SEQ ID NO: 4178617 - RNA, 66 nt, Human
cuccucuuuacccgcauggucuuaaggugacuuuuagagagaggacacaggcaaugugagugggag

SEQ ID NO: 4178618 - RNA, 61 nt, Human
cuccucuuuggggauuuacacagcagcugaagcacaacagagcuguccuagaaaugaggag

SEQ ID NO: 4178619 - RNA, 60 nt, Human
cuccugaccucgugauccgcccuccuuggccucccaaagugcugggauuacaggcaugag

SEQ ID NO: 4178620 - RNA, 60 nt, Human
cuccugaccucgugaucugccagccuuggccucccaaagugcugggauuacaggcaugag

SEQ ID NO: 4178621 - RNA, 60 nt, Human
cuccugaccuugugauccgcccgccuuggccucccaaagugcucggauuacagguaugag

SEQ ID NO: 4178622 - RNA, 130 nt, Human
cuccugacgacacacccuuucuuuccucuggccuccuguggacccuucuucauuuaggucugguucuucugagcugcaggcugagcggggucccagagcucacauguagggcaguggcagugacaggcag

SEQ ID NO: 4178623 - RNA, 78 nt, Human
cuacugggcaggagggcucuauggagaugaugccacuucacauuuaaaaaucuuuccauuucgcaucauugcccugag

SEQ ID NO: 4178624 - RNA, 59 nt, Human
cuacugucaaugugagccuugggaagcaggacuagaaccagugcucaaucugacagugg

SEQ ID NO: 4178625 - RNA, 87 nt, Human
cuacugucuacucaugaaguuucuaauuggaacuuugaggaaugaaaauuucucaaagugagaaauugagaaaugaaaauucaguag

SEQ ID NO: 4178626 - RNA, 56 nt, Human
cugcccagaagccagaugggcacuggaggaaggccaggucuuggcauuuggggcag

SEQ ID NO: 4178627 - RNA, 128 nt, Human
cugccccacaaaucugagcaggcaauaaaggauggucuuauuuauuguauugccuuauaccuuugagauaaugcacaugacugaacuauugauuuuuuauugcaccagacagugcuauuugggagcag

SEQ ID NO: 4178628 - RNA, 84 nt, Human
cugccccacugcuaaaauguacaacuugauuauauacaaaauaauuucaauuaagaagguaauacauuuuugcugugguaacag

SEQ ID NO: 4178629 - RNA, 115 nt, Human
cugccccauaacucuggucacaguuucccacuaagucugugcuguuggugaggauuugcaauaggaucugcaguaggacuugguuguuuauuaugagccagagucccugguuugg

SEQ ID NO: 4178630 - RNA, 62 nt, Human
cugccccucagccaggugggaggugccagccuccugucauauacauaccuccucaggggcag

SEQ ID NO: 4178631 - RNA, 65 nt, Human
cugccccuggcuuuaccucacuggggcucauccccuggaagagacucagauggagccuggggcag

SEQ ID NO: 4178632 - RNA, 58 nt, Human
cugcccucccaguugguccguguccccuuccaggcuugagaccagauccugggggcag

SEQ ID NO: 4178633 - RNA, 71 nt, Human
cugcccugcagcuccacggacucgucuucucgggucaucccgagucccccccucuguggagcucagaguag

SEQ ID NO: 4178634 - RNA, 129 nt, Human
cugcccugggccaccuggaucccccugcugggcucugagcagggacaugacuggucucugugcaggccgcagggcagcuuagucccugucacagccccagaaugaucgcccccaccaggcccaggucgg

SEQ ID NO: 4178635 - RNA, 57 nt, Human
cugcccuucuccagcucaugccucuguaucuggacaugcuguggggagugaggguag

SEQ ID NO: 4178636 - RNA, 130 nt, Human
cugccgcgcaacuuccacucuaauucagcgaccaagggcccuggcagcgguuugcagccugggggccacgcuccccaggcucaggccugcucguuggccugcuccuagugccuggacccaguugggggag

SEQ ID NO: 4178637 - RNA, 56 nt, Human
cugccgucagcucuguuuccaagcaauuagaaggcagagggagaagagcccggcag

SEQ ID NO: 4178638 - RNA, 55 nt, Human
cugccguugaagugucauaacaagguguuaugcuuccccucucauuucagcgcgg

SEQ ID NO: 4178639 - RNA, 58 nt, Human
cugccuagaaaaccaggcuccucugacagacguugaacuugguauaugucugggacag

SEQ ID NO: 4178640 - RNA, 81 nt, Human
cugccucaacaaucagcacugaguuuaucuuuaugcuuggcaccaaguaggugcucaguaauugauuguuaacugauguag

SEQ ID NO: 4178641 - RNA, 76 nt, Human
cugccuccccucccacuuuagccagcucucagggggccccccaccacccugagcacugagcuggaauuggaggcag

SEQ ID NO: 4178642 - RNA, 89 nt, Human
cugccucgcaggggcccaucacaucugauuagugacugauuccagauccaucauuuguuuaucaggaugugccagcugcugcuugguag

SEQ ID NO: 4178643 - RNA, 75 nt, Human
cugccucggccucccaaagugcugagauuacagguaugagccaccaugccuggccucuucagcacuucugagcag

SEQ ID NO: 4178644 - RNA, 88 nt, Human
cugccucggcucgccgcuuccagaguaaggcgcugcccaccugguagcuguguucauucuggauguaggcuccggcgggugggggcag

SEQ ID NO: 4178645 - RNA, 65 nt, Human
cugccucuucgcccagccuuugauucccccuccuuugucggauagugucugcggcggggaggcgg

SEQ ID NO: 4178646 - RNA, 68 nt, Human
cugccucuuuagcuagugguuuacugggcagaaaauauucagcugcaguucaaugcuugcuuaggcag

SEQ ID NO: 4178647 - RNA, 68 nt, Human
cugccugaguuuuaagaugcgcuucuguuggucguccaacaaggcugguaucuuaaagaugaaugcag

SEQ ID NO: 4178648 - RNA, 82 nt, Human
cugccugcagucaacaauaugccagacucaauuguuuucagauccucaguuggguccugcaguuuguaaaaucuccaggcag

SEQ ID NO: 4178649 - RNA, 68 nt, Human
cugccugccccugccaggcagcugucuccaaauccagcggauuccuuccuccaggggcaaaaugguag

SEQ ID NO: 4178650 - RNA, 63 nt, Human
cugccugcuuaccaugcaucaggcacagaguuaggucuuguguuauaggggugagcugggcag

SEQ ID NO: 4178651 - RNA, 105 nt, Human
cugccugcuucccuuacucuuccaacaagguucuaagcucugaaauaaaucuggauauaucuucugcuuuuucuauauuucuacuggggccuggaacagcagcag

SEQ ID NO: 4178652 - RNA, 87 nt, Human
cugccugcuuugcugaggaagcaaaggcuugugugggaaggaagaucacagcugguccgcagccucaaagagcaggaagcaggacag

SEQ ID NO: 4178653 - RNA, 129 nt, Human
cugccugggcauaaccuggaaaaugcauuggaggaaagugggccacagguugauuggacauggugcuggaggucucaccaggaaacugugcccacgaccucugcauuuuuucucauccccuagauguag

SEQ ID NO: 4178654 - RNA, 83 nt, Human
cugccugggugaaggcuucuuuuauuaggcugaaaugggaaguacaugaggcuuccuugcaauaaaaggagcccuucccguag

SEQ ID NO: 4178655 - RNA, 57 nt, Human
cugccuguuuccucuugcuccccaggcuggcugagcaccugcggaggaucagagcgg

SEQ ID NO: 4178656 - RNA, 69 nt, Human
cugccuuaaauguguguguccaagugucuuagaaaaagagaaaauuuaaagagacacacauauagguag

SEQ ID NO: 4178657 - RNA, 74 nt, Human
cugccuucacagugcucacaguucagugaagaaaaugacaaaacaaggaauuaagaugaagcugugaugggcag

SEQ ID NO: 4178658 - RNA, 75 nt, Human
cugccuuccagcaucucugcacccucccccacgcccugaaggaaguggggguggaggagagagcgcugcaggcag

SEQ ID NO: 4178659 - RNA, 72 nt, Human
cugccuugauccacagcugcgguaggagacgaggaccgugacugucuccuuccagucugggguaccaggcag

SEQ ID NO: 4178660 - RNA, 65 nt, Human
cugccuuguuccaggaaggauuuaagaugguuuauauuccaguccuuuaaugcuggaauggcuag

SEQ ID NO: 4178661 - RNA, 109 nt, Human
cugccuuugcaaacuuccuuuugcagcauguucuaaucaagagguuucuguccagaaaauaaccugaauuuaauugaaaugaaaagagaggaaacauagcagcggguag

SEQ ID NO: 4178662 - RNA, 68 nt, Human
cugcgaggugucccggccugcggggcucgggcacccggugcguccugggggcugggucgugugcgcgg

SEQ ID NO: 4178663 - RNA, 62 nt, Human
cugcgccucggugagccgguccccagcccuguuuccccuggggcccugaucugugagcgcag

SEQ ID NO: 4178664 - RNA, 60 nt, Human
cugcgcgcuggcgucacuuagcaaccgaucgacagcgggcugcuggguccggcgaugcag

SEQ ID NO: 4178665 - RNA, 57 nt, Human
cugcggccugaggcuugaaagagaaaagcccuccucugggccucaaguggguggcag

SEQ ID NO: 4178666 - RNA, 57 nt, Human
cugcgggaagggagggaccucagucuccaugggaggcucagggacucccucccucag

SEQ ID NO: 4178667 - RNA, 72 nt, Human
cugcgggggacaaggcaaccagggaggcuucccagaggaggugccucguuccugaccuuggaaaccaggcag

SEQ ID NO: 4178668 - RNA, 64 nt, Human
cugcgguauggaugugugacccagugacaauguucacugccaguuguuuuguccagugccacag

SEQ ID NO: 4178669 - RNA, 87 nt, Human
cugcggucuuggcaaauuuggugucuuaguuucccucuuagcuuuggcuguggggaaauucagagcuuaauuuacaguuacaugcag

SEQ ID NO: 4178670 - RNA, 55 nt, Human
cugcgguuagccauaacauaucuacuugccaaacaagugguuuagguuaccgggg

SEQ ID NO: 4178671 - RNA, 130 nt, Human
cugcguuguuaggugacuuccauuugaucuuauagaacccauaaaguauagaucuguggguuggaaugauagccauagaacuaaacucuauuuuuugaaagcaaauaagauguaccuaauaugucuucug

SEQ ID NO: 4178672 - RNA, 64 nt, Human
cugcuaagcagcuauuucuuccagagaguauuuauauuuuaauagaaguagcuguuaauaucag

SEQ ID NO: 4178673 - RNA, 84 nt, Human
cugcuaagucugcaggguauuuguggcuggauugauuuuaccucauuaaauaugaaaaugaauaaguuaacccaggcuuagugg

SEQ ID NO: 4178674 - RNA, 81 nt, Human
cugcuaaucuguguucuaauggcugagggauguguuguauauucagcaucacaccuaccucauuauggacaccacaggcag

SEQ ID NO: 4178675 - RNA, 115 nt, Human
cugcuauaccagaguuccacucuccauccuuccuuguaaugccuguguuuccgcauuggcuccugaugcaggugugugcaagggagggcggcaaguguacauucuagguaugcag

SEQ ID NO: 4178676 - RNA, 65 nt, Human
cugcuaucuagaguccugcugagaacaaagcugagugacauguucucuuucugcuuuagauacag

SEQ ID NO: 4178677 - RNA, 88 nt, Human
cugcucaaguggccuucucuaaggcugccucugccagaggagccacguaaggccaccucugccagaggagccgugggccacagagaag

SEQ ID NO: 4178678 - RNA, 129 nt, Human
cugcucagagaagaccacugcccaguguccuuuagagccuggacaucucaggcccaguugagacaagcauuguuccaggggguccaagcugauaagaaggacacagaaucaggguaguuuuuagauuag

SEQ ID NO: 4178679 - RNA, 61 nt, Human
cugcucagccccagacucaagagaaccccucugcacauuucuggagucauuuucugaguag

SEQ ID NO: 4178680 - RNA, 60 nt, Human
cugcucagcggaaggaagagcgguccccuuccccacccgcauucccgaucagcagagcag

SEQ ID NO: 4178681 - RNA, 83 nt, Human
cugcucauaaacuuucuguuccuucauccccugaucuguugauucuguaacauuauagagggaaggaagaauggauuaagcag

SEQ ID NO: 4178682 - RNA, 75 nt, Human
cugcucaugauuauuaccuacaccgagcucaccaggaccagcaggugaaguggcagguguguaguaucccagcag

SEQ ID NO: 4178683 - RNA, 78 nt, Human
cugcucccagggcacggguccucagggaauguccacaggaauuaccacugcaggcuuccuggggccuccugcaagcag

SEQ ID NO: 4178684 - RNA, 126 nt, Human
cugcuccuaguaagaagccaacuagaauggaacugaggaauaacugaguugccagcauaguuuggaagacucaggaauuauucagcucaacuguccauucccaguucaggagucuucaaagggcag

SEQ ID NO: 4178685 - RNA, 71 nt, Human
cugcucggcgcgcauggcugccaggggaaaguauuguccuuaaauccagagcggcgauacgcgcaggggag

SEQ ID NO: 4178686 - RNA, 67 nt, Human
cugcucuagaaggucucccugccagugucucuggaucuggccuggugggugcugccucugugagcag

SEQ ID NO: 4178687 - RNA, 94 nt, Human
cugcucuauuugcauaucacuuugaauggggaaaauggcuuauuuaaaaugcucaucugucauccaguucacauggugagucaaaguggagcag

SEQ ID NO: 4178688 - RNA, 56 nt, Human
cugcucucugcuuccaagauggugccuaucgcugugucuucaaaggcagugggcag

SEQ ID NO: 4178689 - RNA, 58 nt, Human
cugcucuggucucuucauguuucuugaugucagguucaagugaagugccagaagucag

SEQ ID NO: 4178690 - RNA, 81 nt, Human
cugcucuuauuugggguauagagagggaagagaauagagaaauggggcuguucugacccugagucuauuuucuaaaagcag

SEQ ID NO: 4178691 - RNA, 56 nt, Human
cugcugaccaugaagugggggaaacugaggcuccacacaguuuauccaguuagcag

SEQ ID NO: 4178692 - RNA, 109 nt, Human
cugcugagcacucacuggcccagccaggccuguucccagaagcaaucacguggcuggauuccuaaacaggcccuaggaauugggccaguccuugccccgugcucagcgg

SEQ ID NO: 4178693 - RNA, 56 nt, Human
cugaccccaaggcagugcuuuccuccacagggcaaaggcacucagccuugggacag

SEQ ID NO: 4178694 - RNA, 112 nt, Human
cugaccgugugauggaggcuggccuuggcacuugggcagugagcauuugcagugcaaucucgguuugcauguugucauuggccuguguuaaggagccuuugcagauggacag

SEQ ID NO: 4178695 - RNA, 60 nt, Human
cucuucccuacuacaggauccaagcauaggucaugcuggagcugguauagggacaaagag

SEQ ID NO: 4178696 - RNA, 72 nt, Human
cucuuccucaggucagaccaaggccucuucccuugcucuuuauggaagccagccuugucugccucuuuagag

SEQ ID NO: 4178697 - RNA, 71 nt, Human
cucuuccuccuucauuaacuauuggaaugcagaggacacuuaacugcaaauugugaaugaaggaggaagag

SEQ ID NO: 4178698 - RNA, 77 nt, Human
cucuucuaaccaggauagaagucucuuuucucuuucauauaaaacuaggauaggaauugagaugcuauuugggagag

SEQ ID NO: 4178699 - RNA, 56 nt, Human
cucuucucugccaccaccuucucuaugccacacggaggcacuuaggcagagcagag

SEQ ID NO: 4178700 - RNA, 79 nt, Human
cucuucuggggaaugcacuuccacacucgaggccaaugcugaaauaggcaugcaaggggugugaagugaccuggaaggg

SEQ ID NO: 4178701 - RNA, 59 nt, Human
cucuucuuggcccccaugagggcccaccuaucacugccaucgugguugccaggagugag

SEQ ID NO: 4178702 - RNA, 72 nt, Human
cucuucuugguauuuggggaaauauuuuccuccccguccauuccaggaaauggcuccaagugccaaggacag

SEQ ID NO: 4178703 - RNA, 78 nt, Human
cucuugaacaauauuacuguuuuuaaaauugcauccccaagggguacagauggaaugggggaacaaaguuguucugag

SEQ ID NO: 4178704 - RNA, 57 nt, Human
cucuugaagggcaucugaguuacacaucuccuuggugacuacacaugacugcaggag

SEQ ID NO: 4178705 - RNA, 65 nt, Human
cucuugaccuuuucauguaucucugucuccuaauuuggcaggaaauauaggaaaaggaacaaggg

SEQ ID NO: 4178706 - RNA, 101 nt, Human
cucuugcuauauagucacaagaaagccuuugucucaggcucugcuuuggggaacacuugaccuaagucagacaugggucuuauuuggauugagaagcagag

SEQ ID NO: 4178707 - RNA, 71 nt, Human
cucuuggcucauggcuggaagcucaguuagucaaaugaagauugacuuggugcacagccaaaccucaagag

SEQ ID NO: 4178708 - RNA, 108 nt, Human
cucuuguaauuuuucagcagaaaggcacuagaugaucuugcccacauucuguaauaaugaguuucauuuacaugucuuucucugagaagaugaaaugauuacauugag

SEQ ID NO: 4178709 - RNA, 79 nt, Human
cucuuguuccaggcauggcuugggucaaucagcacucaugacuuugcugugugccugagccgugccuggcuaacugggg

SEQ ID NO: 4178710 - RNA, 69 nt, Human
cucuuguucucuggcuuagguugagugcagcccaugaggugcugcagcaaaaggucagagggaggagag

SEQ ID NO: 4178711 - RNA, 68 nt, Human
cucuuguuuccuuucugcagucuucaaccccuuuguuuguccugaaacucagggagauagggcaagag

SEQ ID NO: 4178712 - RNA, 73 nt, Human
cucuuuaaagguuugacaagcgaaguaccauaaugucaugagagauaugguucuugucaccuuuccaaauggg

SEQ ID NO: 4178713 - RNA, 129 nt, Human
cucuuucucuggcugauccaguaucucaaauucugccuggugagggcuuguaaguggguggagcgggugacuguucacuaagucuggcagccugugcggcacagugcuggcuguggguggaggcaggag

SEQ ID NO: 4178714 - RNA, 61 nt, Human
cucuuugaggcaugguuauaucaucuggaaaacagaggucaauaauaugugcuuuauugag

SEQ ID NO: 4178715 - RNA, 86 nt, Human
cucuuugauguaaucauugucuguacuuuaaaaauguuuggcugaauuaaaaagauacaaaucagacagggaauuauagcagagag

SEQ ID NO: 4178716 - RNA, 65 nt, Human
cucaaccauguccuuaaucugaauguuagagaccuuuccuugacucucaggacgagguucuugag

SEQ ID NO: 4178717 - RNA, 73 nt, Human
cucaaccccacaggcagcccucucccugguucccaggacccagggucaggguuuguuuuaaaaggaaguugag

SEQ ID NO: 4178718 - RNA, 78 nt, Human
cucaaccguuccuuguauuucagacaugaucuuuuuggcucauuaccugaaaaacaagagagaaauuaacaguuugag

SEQ ID NO: 4178719 - RNA, 61 nt, Human
cucaagauauuccagcucucaaggacuuuaggcucucuuuggggagcuggaauugucuuag

SEQ ID NO: 4178720 - RNA, 75 nt, Human
cucaagaucuuccuuuauuccugcccacuuugucacaggcagaacaacguaggaguggagaugugaucuccagag

SEQ ID NO: 4178721 - RNA, 76 nt, Human
cucaagaugcuaagugaggcugaacagguucucaugacugcauggucaugaauagagggccuagccuguguuagag

SEQ ID NO: 4178722 - RNA, 69 nt, Human
cucaagcagggaaggggcaugcuggaguuuacuuuuaggauucuggaaggccucauccuugucaauggg

SEQ ID NO: 4178723 - RNA, 129 nt, Human
cucaaggaaaaacaaguugaguaggugagauuuugaucucuuauucuucuucucuugccaggugccauucuaagccccuucagugaugagaagaauaauucucgaagccucacuagagagaugugugag

SEQ ID NO: 4178724 - RNA, 56 nt, Human
cucaaggaacaaacuguucuucacaaguguuucuuggaaugacaaguuguucagag

SEQ ID NO: 4178725 - RNA, 81 nt, Human
cucaagucacaaguuaucuacuauagugccaugcaucacuuuuauaguugagguaggguuaauggagauauaggauuuuag

SEQ ID NO: 4178726 - RNA, 68 nt, Human
cucaauagaaagcaauaaucccaaagugcugagaaguaaugacucagcuaggagacuguugcucugag

SEQ ID NO: 4178727 - RNA, 65 nt, Human
cucaauggaauaauuguuauuauaucuauagagccagauggcacuugguguaaacagccauugag

SEQ ID NO: 4178728 - RNA, 55 nt, Human
cucaauggggcccacacacccaagcaucagaguuggcuggagagggucccaugag

SEQ ID NO: 4178729 - RNA, 98 nt, Human
cucaaugguauaggcuggcuccaccccaggaggaugagaagcaggcagaggaccucaaggaacguccccugggaguggaggaaggacuuauccuuggg

SEQ ID NO: 4178730 - RNA, 74 nt, Human
cucacaaaguugcagauaguaaguaaguuaucuaaauucuuagagaaucaauucacugcugcagccuuguaggg

SEQ ID NO: 4178731 - RNA, 104 nt, Human
cucacaaauggaugucgaugucauuuauucucuuauucuacagaccuucauuggcuacauggguaguaugggcaagagauaggugguccugacggaggaguggg

SEQ ID NO: 4178732 - RNA, 61 nt, Human
cucacagauacggcuauuccugguccaaaauucauucgcaaggaguaagagaaucugugag

SEQ ID NO: 4178733 - RNA, 78 nt, Human
cucacagaugaguguuuguacccgugcagaugucauuuucuaccaacauguguuaauuccacaaacauucauuauggg

SEQ ID NO: 4178734 - RNA, 62 nt, Human
cucacagcagccagucugccuuaaaaagcuuccaggcaaaaagggcagauuagcuguaagag

SEQ ID NO: 4178735 - RNA, 66 nt, Human
cucacagcaugguggccuuaggguagcccgauuuuucacaugguggcucagggcuccaagcaugag

SEQ ID NO: 4178736 - RNA, 61 nt, Human
cucacagcauucaugcgaaauggaauuuuuaucucuauuuuuauaguugaagugcugagag

SEQ ID NO: 4178737 - RNA, 74 nt, Human
cucacagcccugcugucuucagaguauaaacuggagacagauguacccagaauugaggacgggugggaaaugag

SEQ ID NO: 4178738 - RNA, 86 nt, Human
cucacagggcuucaggcauuccauuacagaucuuuuccuaaugugaggaaaagggaauaguggagaguccugaggacccuggugag

SEQ ID NO: 4178739 - RNA, 89 nt, Human
cucacagucacagccuggccucugcuccugugggccaguggccagacacccccugggauggcucaaaggagucaggacuuggaaguggg

SEQ ID NO: 4178740 - RNA, 130 nt, Human
cucacaguuuccaugggucuggaauucaggaguagcuuggccagcagcucuggcuuagggucuccugugacguuacagucauauguuggcggaaacugcagucaucugaaggccugaccagggcuggaag

SEQ ID NO: 4178741 - RNA, 64 nt, Human
cucacauuucuccccaggacacaugcgguagacaugcugcaacuuguuuggagagaaaggcaag

SEQ ID NO: 4178742 - RNA, 62 nt, Human
cucacccccaggaagcucguuugauugagguaccuuuuccaagcugcaguuugguugguggg

SEQ ID NO: 4178743 - RNA, 117 nt, Human
cucacccuacuucauaggaaagauauuuggauuauuuaauuagugauuguagaguguuacuaagacacacuauguaauuauuauugaacugguaucuccuccuauguauucagugag

SEQ ID NO: 4178744 - RNA, 92 nt, Human
cucacccuuugaagggcagaggcagggcccuccuccaccccuuccugcccaaagggcugguggcagcccagccucugcuuacauaaccugag

SEQ ID NO: 4178745 - RNA, 73 nt, Human
cucaccucggcugcacccugagaacucugccaucacccaagagacaucugcaggaggcuggcugcaggaagag

SEQ ID NO: 4178746 - RNA, 62 nt, Human
cucaccugcccccuugagauucugauucaacugagcugagcuaaggcacaggcaggcuugag

SEQ ID NO: 4178747 - RNA, 77 nt, Human
cucaccugggacuccaggcaucugcuucugcuucaucccaguaggaggcucuaguuuggaguuucuccacagguggg

SEQ ID NO: 4178748 - RNA, 66 nt, Human
cucacguuucagggaagcccucuccacaguuacaggcagaaagggugggccacugagcagcgugag

SEQ ID NO: 4178749 - RNA, 55 nt, Human
cucacucaguuuuuaguucaucugugacuaauuccaggugaaguuggcugguggg

SEQ ID NO: 4178750 - RNA, 80 nt, Human
cucacucuucguuuuguuccccuuacuuacauguuucucuuuuccuuauacugugaacucuggaacaaaacuagauuggg

SEQ ID NO: 4178751 - RNA, 59 nt, Human
cucacugaacuaaacacaugagauuccugccuuugggcagcuugugguuuaguagaggg

SEQ ID NO: 4178752 - RNA, 80 nt, Human
cucacugacaaugugucagacacagccagagacugaaauacgaguagaugccaguucuggacuugucugccuuaagugag

SEQ ID NO: 4178753 - RNA, 64 nt, Human
cucacugcccugaaguuggguuucuaauuuacucaaggggcuccagugucucagagcagauggg

SEQ ID NO: 4178754 - RNA, 56 nt, Human
cucacuggggccuuuggucaggaaaggcggccauuccaugacaagaaacccaggag

SEQ ID NO: 4178755 - RNA, 68 nt, Human
cucacuucuacuuuaaucagagcuccaacaugucgacagguuggagcucugauuaaauuggaacugag

SEQ ID NO: 4178756 - RNA, 62 nt, Human
cucacuucugucaccauuuacagcucaacguagcuguguccuuuggaggaucagcgggugag

SEQ ID NO: 4178757 - RNA, 96 nt, Human
cucagaaagaacaccuuggaaguauuguaaacuuccuaaggaguuguuaggaagcuuuuuagaauuuuuuggaguuuuccaaggugacuuuuggag

SEQ ID NO: 4178758 - RNA, 71 nt, Human
cucagaaaugccacacuuuuaacaggagaauucccuugggaagggaaauuucgguuguagggugcccugag

SEQ ID NO: 4178759 - RNA, 62 nt, Human
cucagaagaacaaaggcucuacaaccugacaggccagccaugggacccuggguucuucugag

SEQ ID NO: 4178760 - RNA, 59 nt, Human
cucagaagccuucagucuuggcuugcaaucccuuauccucagauuagagggcugcugag

SEQ ID NO: 4178761 - RNA, 78 nt, Human
cucagacaaaugauuaagguuaagcucaccaaugauagugcauguuggucucagguaccucuaauugauugucaugag

SEQ ID NO: 4178762 - RNA, 76 nt, Human
cucagacuguacucuuauagccaucugaaauacguuuucuagguauagauagauuguguaaggguacaguugugag

SEQ ID NO: 4178763 - RNA, 90 nt, Human
cucagagacgguaacacugauuugcucuuggucacacauccaauaagugucagggugccagaauaagaccaauccuguguaccuccugag

SEQ ID NO: 4178764 - RNA, 69 nt, Human
cucagagacuuuauuuccuuauuugugagaugcaggcuguaaucaaaguagccggauggaauuuuugag

SEQ ID NO: 4178765 - RNA, 84 nt, Human
cucagagcacagaaagcacauuugaaaugguaaugagaagcgagccccgugacaaagugcuagucggugaaauauuucucugag

SEQ ID NO: 4178766 - RNA, 61 nt, Human
cucagagcacuuuugaaagcuccuggcucuaccuggugcuuacagggugaguguauuugag

SEQ ID NO: 4178767 - RNA, 74 nt, Human
cucagagccuccacuuccucucaauaagaugagaauaaugagguucucagaauugacugggagcaggcuucaag

SEQ ID NO: 4178768 - RNA, 64 nt, Human
cucagaggguugaaggugcucuggaagcaaucuggaacaacucugugcaccuaaauuuucugag

SEQ ID NO: 4178769 - RNA, 76 nt, Human
cucagaguuuagcuucugacaaagcgggagguacaauaaaucuaaguuccagccuggguguuagaagacaucugag

SEQ ID NO: 4178770 - RNA, 60 nt, Human
cucagauaucuucauaaggcaguggcucuaaacccuggcuguacauuggaauuaucuggg

SEQ ID NO: 4178771 - RNA, 65 nt, Human
cucagcagcagggaagaggucaaccaugcugguucuugaaauguuuucuucccuuggcuucugag

SEQ ID NO: 4178772 - RNA, 68 nt, Human
cucagcaggcacugugccuuacagaugauaacugcucaccacgugcuugggcauauugccuggcugag

SEQ ID NO: 4178773 - RNA, 109 nt, Human
cucagcaggcucccccaauuugucuggauagagccuaggcccagugucccaggaagguggauacuugggagucuuuggcauucagggaaauuggggggacucuccuggg

SEQ ID NO: 4178774 - RNA, 80 nt, Human
cucagcagugucaaucuucuuacauaggcccaugagucuaugcccauaguaugaguguguguagaagguacacuacagag

SEQ ID NO: 4178775 - RNA, 62 nt, Human
cucagccaucuccguguagucugacagcgacaguggcagaaccugaacgugagguggagggg

SEQ ID NO: 4178776 - RNA, 62 nt, Human
cucagcccggugcucgugccacgccuuccccacuucugcgggcacgcggggccgcgggcggg

SEQ ID NO: 4178777 - RNA, 59 nt, Human
cucagcgcaggaacacgucugccuuacucacuucuguguuguugacaccuggcgcagag

SEQ ID NO: 4178778 - RNA, 65 nt, Human
cucagcucuccaacuuggcucucuggcuauccacaggacguggacaugagcccaguggggcuggg

SEQ ID NO: 4178779 - RNA, 75 nt, Human
cucagcucuccucuggcugguugucucaauccagggaccuuuucugggccugugacucccauccuuaggacugag

SEQ ID NO: 4178780 - RNA, 66 nt, Human
cucagcugcuuugucuguaaaauggaggugaugacaccaccuccagccuucucaaggcuggcugag

SEQ ID NO: 4178781 - RNA, 56 nt, Human
cucagcuggcaauucuggcucccucaguaagaguggcuacagcuagaacagcuggg

SEQ ID NO: 4178782 - RNA, 68 nt, Human
cucagcuucucuggucuucugccaagcuccuguugaagagggaguuggaggaggcuccagacagugag

SEQ ID NO: 4178783 - RNA, 55 nt, Human
cucagcuuggauccagcugacuucuguuagcugagcauuugauccaccuccugag

SEQ ID NO: 4178784 - RNA, 79 nt, Human
cucagcuuuaacagacauauauauuuguauguguauagaagccuucauauguaaauguauauguguguuauguacugag

SEQ ID NO: 4178785 - RNA, 80 nt, Human
cucagcuuugucauuuggugaguaaguuugaaaaauaucaauuuauuucauucuccuguuucacagaugggaaaacugag

SEQ ID NO: 4178786 - RNA, 66 nt, Human
cucaggaaauguuuuacaaggcauacuucagauuuaaagaaguaugauucuaaaaauauucuuggg

SEQ ID NO: 4178787 - RNA, 79 nt, Human
cucaggaagccagccaggcuggcuguggaggucccaagacccugggucauccuccaucuccagcuucugccuugcugag

SEQ ID NO: 4178788 - RNA, 56 nt, Human
cucaggagcaagugcagacuagagacuuauggaggucuccaguauccuucucugag

SEQ ID NO: 4178789 - RNA, 72 nt, Human
cucaggcaaaucauuagccucauguaccucaguuuucucaccugcgucacaggcuugugaacauugcaugag

SEQ ID NO: 4178790 - RNA, 75 nt, Human
cucaggcaggccgugucccuccucagccucacuuuccccuuguguaaaaugagggaagggacugcgccuucuaag

SEQ ID NO: 4178791 - RNA, 55 nt, Human
cucaggcuccagacuuccguccgucgggaguguggagggaggugcugggccugag

SEQ ID NO: 4178792 - RNA, 77 nt, Human
cucaggcuccugggaucuguggccuuuggcugugaguuccccauuaggccaggcagacaggucaucaggacgcagag

SEQ ID NO: 4178793 - RNA, 55 nt, Human
cucaggcugcaagaaaggcauucagcuuaagcaaagcugaaauugcauccaugag

SEQ ID NO: 4178794 - RNA, 55 nt, Human
cucaggcugguuuggguuguuuucugaagucagaggccaaacucaaggcucugag

SEQ ID NO: 4178795 - RNA, 56 nt, Human
cucagggaggccucugcugguuccuggugcugaaguagcacaacuccucccugcag

SEQ ID NO: 4178796 - RNA, 65 nt, Human
cucagggauuguagugggggaagaaggaccucccuuucugcguguccccucacuugucuucugag

SEQ ID NO: 4178797 - RNA, 87 nt, Human
cucagggcaagcgggaagacagccagcuccaugggauccacaucaugugcagucaccaucggcugagcuuucuuguucucuacugag

SEQ ID NO: 4178798 - RNA, 89 nt, Human
cucaggggggaacauccccaggggccugggcacaguggcguucaggacauaaaccacuguggccaaagccucugggacaggccucugag

SEQ ID NO: 4178799 - RNA, 72 nt, Human
cucagggucccaaugguacuggggucccggaguugaaucgaagcuccugaaaauccagacugggggggugag

SEQ ID NO: 4178800 - RNA, 81 nt, Human
cucagguacccuucccuggcaugaguguaagauuuuauaaagguccaguccaccuuaugccagggugguugguaacuuggg

SEQ ID NO: 4178801 - RNA, 66 nt, Human
cucagguauucuaagcuguguuuacuggcuuugugucagguaacacuacuuaguauacuaauggag

SEQ ID NO: 4178802 - RNA, 74 nt, Human
cucaggugaaacagcuuucuuuccauaagguuucacuuuacuggaagugagauucaagaaugcuguuuaauggg

SEQ ID NO: 4178803 - RNA, 64 nt, Human
cucaggugguauuauuuggagucugguauauaucagauuuagggugauuaccuuaaaaccuuag

SEQ ID NO: 4178804 - RNA, 79 nt, Human
cucagguggucugugggacagcuggagggucccugcugaucucagcugggguuacucaugcuuccucagguuggcuggg

SEQ ID NO: 4178805 - RNA, 64 nt, Human
cucagguuuuggucuggaaucuucaggguccuggggcuccggggguuccagaucauccacugag

SEQ ID NO: 4178806 - RNA, 68 nt, Human
cucagucugccugcuaacuccugcaccaucuuucugguguacuugaugugagagcaggugucucugag

SEQ ID NO: 4178807 - RNA, 78 nt, Human
cucaguggauggaguuagaaaagguauguauguauacucacauauauacaugcacauuuuuauacauuuucuuuugag

SEQ ID NO: 4178808 - RNA, 79 nt, Human
cucaguguccuuaaaugaacucugcaugacuggcuuuacccagaucaaugagcaagacauuugaguucuuaccgcugag

SEQ ID NO: 4178809 - RNA, 56 nt, Human
cucaguguguaguagcgguaguuuucaauccuacuauccguuagaaucaugcuggg

SEQ ID NO: 4178810 - RNA, 81 nt, Human
cucaguuauagcuuacuaacauuuguguaugucuugguggaaacaugagucacaaauaaugauuaguuuggaaagacugag

SEQ ID NO: 4178811 - RNA, 70 nt, Human
cucaguuaucaauucugugugccuuuagggcagaaguucaauaauucugcuggguaucagaaucacugag

SEQ ID NO: 4178812 - RNA, 69 nt, Human
cucaguugcacucaccacauuucaggugcucaguagucauauggucaccaugaugggagugcaaauaag

SEQ ID NO: 4178813 - RNA, 79 nt, Human
cucaguuggggcccagugcaugguguuuugauuaugaaaagaacaucccuaaaguccaugcaugccugaaauugcugag

SEQ ID NO: 4178814 - RNA, 68 nt, Human
cucaguuuccucagcuguguccuggcgaugauaaugcccaucucauggagucaugugggggauuugag

SEQ ID NO: 4178815 - RNA, 68 nt, Human
cucaguuucuauggcugggcucugaggucaggaauacuaaugguaggaucccugcucuggaaaguggg

SEQ ID NO: 4178816 - RNA, 77 nt, Human
cucaguuucugucuacauaacagauacucucugugagggaaagcccucauugaaauuuguuuguugagacagaggag

SEQ ID NO: 4178817 - RNA, 66 nt, Human
cucaguuucuuaucuucaaaauugggcaauaaucaugcugcacaguugucaagaggaugagaugag

SEQ ID NO: 4178818 - RNA, 88 nt, Human
cucaguuuucucauacguaacuagcaauuauuguauaagaacaauauccacuuauguuguuuacaguaauugugguuugggcucuggg

SEQ ID NO: 4178819 - RNA, 81 nt, Human
cucauaagaugcauugaguauuguaaauaaaacaaaccauuuuugauuuguuuaaauugcucguuacaguucucuuguggg

SEQ ID NO: 4178820 - RNA, 64 nt, Human
cucauauaaguggaauuauauaguacuuguccuuuuguaacuggcuuauuucacuuagcaugag

SEQ ID NO: 4178821 - RNA, 93 nt, Human
cucaucacugcauuggaguucucaucucuuugacucuuaaaauagaugaauauuuuuuuccauuuaucuuuaaagacaugugaacuugaugag

SEQ ID NO: 4178822 - RNA, 60 nt, Human
cucaucagaaauaccugacaaauggaucauucucgccuacuguuaugguguucugauggg

SEQ ID NO: 4178823 - RNA, 66 nt, Human
cucaucaggcuugcuagaggagccaaauccaggggugaguuugacucuucuagcaagugugaugag

SEQ ID NO: 4178824 - RNA, 77 nt, Human
cucaucccagaacgguugcgcuuauauuaaaauuuuauauaugaaauguacauaaaaacgcacacagaugggaugag

SEQ ID NO: 4178825 - RNA, 56 nt, Human
cucaucucaacaucccuauggagugcguccuaucaggaugcccauguguagaugag

SEQ ID NO: 4178826 - RNA, 56 nt, Human
cucaucuuguguguuauagguguguacauuuccaucugagacacucuugugauggg

SEQ ID NO: 4178827 - RNA, 56 nt, Human
cucaucuuuccacucuuuuuuuaacccuauaccuaagaaaggagugucccugugag

SEQ ID NO: 4178828 - RNA, 76 nt, Human
cucaugauucgacugagaauuuacauuuuuggugaaaaucccacugaagaguucugcucuucucagugagcaugag

SEQ ID NO: 4178829 - RNA, 70 nt, Human
cucaugcaacauacauucugaagcuuuuauugagcugaacuuagaauauauguauauuaaucugcagaag

SEQ ID NO: 4178830 - RNA, 77 nt, Human
cucaugcaauuuagaggacuguaggugggaauacaggaacucuuuauuuccauaaguguccacuaaaugauugugag

SEQ ID NO: 4178831 - RNA, 58 nt, Human
cucaugcagcuccccaugggaugguaccguaugcaucccuguguacagccugcaugag

SEQ ID NO: 4178832 - RNA, 112 nt, Human
cucaugccaggcagggagaaguucuguuucuccacacucuucccaagaccuggcacccaaccaggccugggaagggcugggcagagaaccucacucaucccuccuuguagag

SEQ ID NO: 4178833 - RNA, 102 nt, Human
cucauggaaucugggaaguguccuaaagguuauugcacuggaguuggacguggaagcaugggaaaauuuuguauaaggacaagggacauuccagguagggag

SEQ ID NO: 4178834 - RNA, 55 nt, Human
cucaugucagggaagagagucagugugugccuacugaugucccuuugaugaugag

SEQ ID NO: 4178835 - RNA, 78 nt, Human
cucauguuuugucuaaucuaaauucugucaagcaagcgaaaaaaagagagacagagacagagagagaaagagaaugag

SEQ ID NO: 4178836 - RNA, 90 nt, Human
cucauuaaaaugaaaauucucaggcucaccccggaacuacccaaucaaaaacucucuggguagagccuagcaguuuugaauuuuaacaag

SEQ ID NO: 4178837 - RNA, 64 nt, Human
cucauuaagauuacgugccagaaguuagacauaagcuuuuaaggccacugugguuuuaugugag

SEQ ID NO: 4178838 - RNA, 61 nt, Human
cucauuauuaccuuuucuugccuacucaaaggaugcuuucaggcagcugggguaguuggag

SEQ ID NO: 4178839 - RNA, 72 nt, Human
cucauucacuagcuguaagagggauguggcucaaacuucaacugagaagcaucagcaauggcuggaaaugag

SEQ ID NO: 4178840 - RNA, 65 nt, Human
cucauucagaagucacuuaggaaagggggcgacuuagauuuucucugcuuaguguuuucuaugag

SEQ ID NO: 4178841 - RNA, 68 nt, Human
cucauucauucagcgcaugguuacugagcaccuacugagugccaggcccugugcugggugauguugag

SEQ ID NO: 4178842 - RNA, 68 nt, Human
cucauucuccacacauccagaccuuacccagaccuagucagccaagggugaugguggagaaaucugag

SEQ ID NO: 4178843 - RNA, 79 nt, Human
cucauucucucaggcuucuuuucuuuccagacggggcccuguaucuugcaugguuagccuugagaguuaagagaauggg

SEQ ID NO: 4178844 - RNA, 66 nt, Human
cucauuguucagauuaguguuagguuacaggccaagaaccugcagcagacauaauguggauuagag

SEQ ID NO: 4178845 - RNA, 83 nt, Human
cucauuucacucagcuguaggguccucaucuauaaaaugggaauaauauugacuuugcaggccuguugugauaauuaaaugag

SEQ ID NO: 4178846 - RNA, 72 nt, Human
cucauuugccaagucggguugcagacacauccucuuucuggagaggcugucucagccugcuugcagaaugag

SEQ ID NO: 4178847 - RNA, 67 nt, Human
cuggggccaagccaaccaguuugcauccgaauacuguuccucacgaaggcagaugcuaggccuccag

SEQ ID NO: 4178848 - RNA, 60 nt, Human
cuggggcugggggaggagaccuucuaaugacccccccauaggccucccucauuuucccag

SEQ ID NO: 4178849 - RNA, 123 nt, Human
cuggggcugggucugcguugcucuuggaauccuuaauuuccugggccucagucacauucugcuguuggggaaacugaggcacagaaaaugguagggauuucauucacgagcgcccagucugag

SEQ ID NO: 4178850 - RNA, 81 nt, Human
cugggggaagggcagcuuaaauugguagcuuccgcacauaacaagcucaagaccagacaaagccugccgaacagcccccgg

SEQ ID NO: 4178851 - RNA, 75 nt, Human
cugggggaggcugggaaagaaacuggguccuggauacaucagguuccagguucgaaucccaucucuaucuccuag

SEQ ID NO: 4178852 - RNA, 56 nt, Human
cucuuugugcuauuaugauccucauuuuuuagaugaggacacuaaggcacugagag

SEQ ID NO: 4178853 - RNA, 60 nt, Human
cucuuuguguucaggagccacguaccugggaacaaagggaugggccagggauacagagag

SEQ ID NO: 4178854 - RNA, 78 nt, Human
cucuuuuccaaugugagugccaggugaaguauguagucuaggccuacaaaucauaagaauucacaaagaggaggagag

SEQ ID NO: 4178855 - RNA, 84 nt, Human
cucuuuuccauuauggugucagcuaauuugggagcucauuauuuauuuggcacuaauuuagccuggcaaauuaauuagaaaggg

SEQ ID NO: 4178856 - RNA, 55 nt, Human
cucuuuugagacagggaaagguccauguuggggucuuuuaccuucuugagagcag

SEQ ID NO: 4178857 - RNA, 87 nt, Human
cucuuuuggccuuuucagagaaagcagauuuacuccugcuuuaaggagcucagucucuacuuucauuugacuugaggcauuauagag

SEQ ID NO: 4178858 - RNA, 62 nt, Human
cugaaaaagacauuugggucacugagugacuaaaagcacucucuguuuacauguuucuucag

SEQ ID NO: 4178859 - RNA, 75 nt, Human
cugaaaacauaauacugcuagaugaaaauguaggggauaaucuccuuuacauuggccucagcaauaauauuuuag

SEQ ID NO: 4178860 - RNA, 127 nt, Human
cugaaaauauauaacauuuaaguaagucuaauguaaugauauguugaaugugcaucuaugaauaccaaugauuauuucugauucaauggauuuuuaccuuauuuugcaaguuguucuauauuuucag

SEQ ID NO: 4178861 - RNA, 84 nt, Human
cugaaacgugaagcuaaugauacaugcuccacacccuuugcgguugugguggugaauauuaauuagauaagcuucaaaaugcag

SEQ ID NO: 4178862 - RNA, 57 nt, Human
cugaaagaguguuuggucccucccaacuuuggguuacacugcaaaguacucuuucag

SEQ ID NO: 4178863 - RNA, 129 nt, Human
cugaaagcauaacauggcaaaaaauuaagggcaucauuuauauuguauucuguaggaacaacagccccuugaaauacacguuuuauaaaauacaaugucaaugguacuuuguagaguugugccaugcag

SEQ ID NO: 4178864 - RNA, 65 nt, Human
cugaaaggaaacaaguuuagaauaaugaauuguuccuauuggagcuguucuuuggacccuuuuag

SEQ ID NO: 4178865 - RNA, 92 nt, Human
cugaaaggccugauuugccucuguuuccuauguagaguagacaucugucuggccugcaucaguggauaugaugguggauggagguucuguag

SEQ ID NO: 4178866 - RNA, 96 nt, Human
cugaaaguacaauggugagcugauguuaagauuuucuucaguauuauuuaacaauaaugaaugcagaguuauuuuuaaaacaacuuagucacccag

SEQ ID NO: 4178867 - RNA, 71 nt, Human
cugaaagugugaugauacuaguugacauaauccauacauuuacuucaucaugagugucaucagcuacucag

SEQ ID NO: 4178868 - RNA, 130 nt, Human
cugaaaguucauauuucccuguuagaauauccaaaccgcagacucugaaaaacaccuccagcuaggaggcagggcuguaauuugagccugugaacuggauguucucgacuuuaaaagugaaucauucaug

SEQ ID NO: 4178869 - RNA, 81 nt, Human
cugaaauggaagacacguagggcuuuucuuugccugagcuuuugguuggggcaagaagugcccugaaguucgaauuuucag

SEQ ID NO: 4178870 - RNA, 80 nt, Human
cugaaaugucuguuggguccucagaacuuauaaggggcuugaccccuuucuuccauagggcccagucagugcagcuuuag

SEQ ID NO: 4178871 - RNA, 65 nt, Human
cugaaccccauguaucuguuuuuacagugucuuuuaaugaaagauauaauacggacacaguucag

SEQ ID NO: 4178872 - RNA, 77 nt, Human
cugaaccuuggauuugggcccuuaaauuuguaaugacagauaaugaucaaguuagggugcauaaaucuagguuuuag

SEQ ID NO: 4178873 - RNA, 81 nt, Human
cugaacgaucuguuucuccaacauugugagcauugacuauccauaaaaagcucaucauggucagaaacaauguucguucag

SEQ ID NO: 4178874 - RNA, 72 nt, Human
cugaacucaaaagacuuaaacauaagagggaaaucucuuuuucaaaaaguguuuuagcauuuuggacaucag

SEQ ID NO: 4178875 - RNA, 82 nt, Human
cugaacugcuggagagauguagcaaagaaccacaaagcaaggggucgugaguguuggcauuguucauuucgacaguaaucag

SEQ ID NO: 4178876 - RNA, 73 nt, Human
cugaacuuugccacuacauucaugcucguguuggccaagggcugaaguuucgagauggauguggaaagagcag

SEQ ID NO: 4178877 - RNA, 84 nt, Human
cugaagaaauaguuuugugacaauaaagcauucaaauauuuuuggaucuugaauguauuagagcaguagaauuauuucaaacag

SEQ ID NO: 4178878 - RNA, 84 nt, Human
cugaagaagaacugggcagugggcaacaagagcuggaaagaaccuuuccagccuuucuacucacugagaaacaggccucuucag

SEQ ID NO: 4178879 - RNA, 99 nt, Human
cugaagacccccggaugagggugcucagggccuggcuggggagacucuugccuuguucuccccaguguccaggccugggcugcccaggggacacuucag

SEQ ID NO: 4178880 - RNA, 79 nt, Human
cugaagaggucugaagcacagcauauaaauaaagggauucuaccaguucuuagcuccuuuguuguccucuccucuucag

SEQ ID NO: 4178881 - RNA, 59 nt, Human
cugaagaugucugagaugcucauagggcaguagccagcugguucuuagugcauuuuggg

SEQ ID NO: 4178882 - RNA, 65 nt, Human
cugaagcaauuccaccuguguuucuagggggaaccgaacccugagaaaccuggugcaauuaccag

SEQ ID NO: 4178883 - RNA, 62 nt, Human
cugaagcaucugugggguucccagggggugggaguguguccaggaagcagauggaaauucag

SEQ ID NO: 4178884 - RNA, 83 nt, Human
cugaagccagccuggcucaguaaucgagucuccuggagaaaucuacacuggggaggucgaggcugggccgcaggcucauucag

SEQ ID NO: 4178885 - RNA, 61 nt, Human
cugaagccuagccuggcacuucugaguugcacgucuucuuagauuucaggcuggcuugcgg

SEQ ID NO: 4178886 - RNA, 63 nt, Human
cugaaggcaccaggggugccagagagccaggagggcaaaaugcugcuucaccccugugcccag

SEQ ID NO: 4178887 - RNA, 62 nt, Human
cugaaggcgcauguuggcuagacaacaaagacaguggugggagcagccaacauggccuuugg

SEQ ID NO: 4178888 - RNA, 89 nt, Human
cugaaggcggccuuggguccagucugcuuuacaaguuauuucuaaaacccaagugugaggaagucugagagccacagguagaucuuuag

SEQ ID NO: 4178889 - RNA, 69 nt, Human
cugaaggugaggguggccuggcuggggccacagccucugaguuuggccuggcuuuugccucauguucag

SEQ ID NO: 4178890 - RNA, 59 nt, Human
cugaagucagauggcacaaggucagauucuauucuaccucuuaccagcccugacuucag

SEQ ID NO: 4178891 - RNA, 83 nt, Human
cugaagugauagcauuaagcuagcauagggguaaauuaaugaguauauuaauuuagaauucgcuagcuaaugucucauuucag

SEQ ID NO: 4178892 - RNA, 56 nt, Human
cugaaguggacaaauggagugggugcauagaaguuguaacucugaguccacuuaag

SEQ ID NO: 4178893 - RNA, 57 nt, Human
cugaaguggccucucucucugcuccucuguacaggggacaugcaguggucauuucag

SEQ ID NO: 4178894 - RNA, 72 nt, Human
cugaauaaggcuucuuuaguguccuaaugauuaaugaucacugaacacuuuugaaagauuagcauuuuucag

SEQ ID NO: 4178895 - RNA, 67 nt, Human
cugaauagauccuugcacuugacuuggcauuuaauggagugcaauugucaguguaagauuuauauag

SEQ ID NO: 4178896 - RNA, 84 nt, Human
cugaauaguaagugcugaauaacaguagaaauuuaauccacuagcuuuaggauaggguuucuguuaucugcauuagcuuuucag

SEQ ID NO: 4178897 - RNA, 81 nt, Human
cugaauaguuaggcaaguuaucuuaggguacaaaggacuuccaaguaaugacuuuguagguagcgaaucaauaacuauuag

SEQ ID NO: 4178898 - RNA, 66 nt, Human
cugaaugugcugguacagggaaauaaaggaaucuaggauaauuccuuguuuucuuguccaauuugg

SEQ ID NO: 4178899 - RNA, 62 nt, Human
cugaauguuucacucugaaaugggaguccuuggaggguuuugagcagaggagagacauucag

SEQ ID NO: 4178900 - RNA, 65 nt, Human
cugaauuacaaagugagacaagcuucuccaaagagagaacauucagucuggcucacuugugacag

SEQ ID NO: 4178901 - RNA, 90 nt, Human
cugaauuauugcagucccaguuugagacucuggagcccccagcagcuccagaaaacuuuauccaaauaaguguggacaaaaauguuucag

SEQ ID NO: 4178902 - RNA, 57 nt, Human
cugaauuauuuaaggugaagggcuauccugucugcaacuuaccgugaaaugguucag

SEQ ID NO: 4178903 - RNA, 89 nt, Human
cugaauugaauccugccuagaauuuacuuauuuuuucauuuuugcuauuggugagacaguuggugaaaucuaaauauaguucagacuag

SEQ ID NO: 4178904 - RNA, 55 nt, Human
cugaauuggggagaggaaaugagaaugaauuucucucuuccaguucccacuuugg

SEQ ID NO: 4178905 - RNA, 63 nt, Human
cugaauugugcuugcuagagccuuaaugagaugauuaaugaucugagcagagcaucauuucag

SEQ ID NO: 4178906 - RNA, 81 nt, Human
cugaauuucacuuccuucuguaagaccaguuguaccagucucagguucagagcuggcaggagcgggaggcuguggaaucag

SEQ ID NO: 4178907 - RNA, 66 nt, Human
cugacaagaggcuaaacugggcuauuccaugaccagggacaaaauaggcuuuuagccucuaagaag

SEQ ID NO: 4178908 - RNA, 67 nt, Human
cugacacccagcagaacugggagccuccuugcucugcucccuccaggcagcuggguacuguggucag

SEQ ID NO: 4178909 - RNA, 90 nt, Human
cugacacugagauguggaguuuguuugaaguuuuuguacauuuagugaccagagguauuuugauaaacgccauugccucaaaguauucag

SEQ ID NO: 4178910 - RNA, 68 nt, Human
cugacacuggcagcugggcacuuuuuaauuaguagaauuagaagagugcuuaaagcuggcuuugugag

SEQ ID NO: 4178911 - RNA, 62 nt, Human
cugacagauacuuaugacauaaaguugaccccaggggguccagugcagugaguguuugugag

SEQ ID NO: 4178912 - RNA, 69 nt, Human
cugacagcagaccccagugccauggaaggaucaagauucuggccgaggacauugggcuucuguucuugg

SEQ ID NO: 4178913 - RNA, 76 nt, Human
cugacagccucugugacccuuagugaacauuagaaggacacaucugggccuuuuaugauuuaucaagcggugucag

SEQ ID NO: 4178914 - RNA, 66 nt, Human
cugacagcugaaucgaauggcccagugguggcacauuccccagagggcuucagguucaggaugcag

SEQ ID NO: 4178915 - RNA, 55 nt, Human
cugacagcugcugccgccgcaucccggaucuccaaagugcggcgggagcggccag

SEQ ID NO: 4178916 - RNA, 55 nt, Human
cugacagugaugguacaggcuggaagaggcuguauaagauaccacacugaaucag

SEQ ID NO: 4178917 - RNA, 60 nt, Human
cugacaguuacauuugaauugcccuaaucaggaaugugcaccccagaugugauuaguuag

SEQ ID NO: 4178918 - RNA, 88 nt, Human
cugacauaccaagaauguuaguagccucaaauuguagagaugagugugcacucacaauuugaggcuacucaauugggaugguaguuag

SEQ ID NO: 4178919 - RNA, 85 nt, Human
cugacauccccucaccaggucuguacagccuggcucugagaggcucugucuggguccgggacuguggauguguguggggagucag

SEQ ID NO: 4178920 - RNA, 104 nt, Human
cugacauugaaacagugccuuugauuuggacagaaagaacaugguugaaaaauacagcuuugaaaauccaaauuacaagguaugggcuguuauuaggauguuag

SEQ ID NO: 4178921 - RNA, 67 nt, Human
cuggggugugcuugggcuucgcagggaagucagacagaaguuugcccacgugcuccggccgccugag

SEQ ID NO: 4178922 - RNA, 63 nt, Human
cuggguacauugacacauguaaaauaacagugcauacaugcuguccugucuuugucagcccag

SEQ ID NO: 4178923 - RNA, 64 nt, Human
cuggguauaggaaacaguuaagaauguguagguaucagugcaaacugugucuuccuguaccuag

SEQ ID NO: 4178924 - RNA, 60 nt, Human
cugggucagucugucccuagggcccucugaggccucuacccaaacaacaggacugcccag

SEQ ID NO: 4178925 - RNA, 57 nt, Human
cugggucuggcuacugcuuccuuagcccagcuggaggagguaaggauccagacucag

SEQ ID NO: 4178926 - RNA, 62 nt, Human
cugggucugucacuagauaaauaauaccagagaaguguugaagaccuagagacaggacucag

SEQ ID NO: 4178927 - RNA, 87 nt, Human
cugggucuugaucguccucucucaugacuacuucuuuuacucccaucaagguaaagugugagugaaaguaguuugauuaaagcccag

SEQ ID NO: 4178928 - RNA, 91 nt, Human
cugggugacccugggugaaucccuucccuucucugggacuccauccugagaucggagagcuggaggagaugacauccaagguuccacccag

SEQ ID NO: 4178929 - RNA, 84 nt, Human
cugggugauaggacguuuggguuacagcacuggacaugagaggccacucuauucaccacacugaaccucagugucuuagccugg

SEQ ID NO: 4178930 - RNA, 93 nt, Human
cugggugcucccauaugccggccagcccugccagagagagcuggcgcccacucccugccuggcgcggcugcgggccccuggcucagcacccag

SEQ ID NO: 4178931 - RNA, 75 nt, Human
cugggugucauguccagggcuauggugccacauugagaacaauauugaacuaaauaguuuugacagaacagccag

SEQ ID NO: 4178932 - RNA, 72 nt, Human
cuggguguuuuguguuguaaugucagcuauaccucaauaacugguguuagugcauauaacuagaauaccaag

SEQ ID NO: 4178933 - RNA, 89 nt, Human
cuggguuagcucuguguuuuuccaaacaugauucuauaacuccucuguagaauacaguaugcaaaaagauggaaauacuuguuauucag

SEQ ID NO: 4178934 - RNA, 81 nt, Human
cuggguuccccacuuggagaccauggagcaccucacagaggccugagggaccucugggugaugcccaggcuuggaacccag

SEQ ID NO: 4178935 - RNA, 78 nt, Human
cuggguugucuuccuggggucgaggguucucuggcaggcauaccauggugcccuugccccucuaccccgacaucccag

SEQ ID NO: 4178936 - RNA, 63 nt, Human
cuggguuuuggagcagcuugccuaccacgaucgugguagauucuagcuggcacuagaauccag

SEQ ID NO: 4178937 - RNA, 96 nt, Human
cugguaaccuuucacggcucuuagagcugggugacuuucuucucaauuuauacaaacaagguauguacacacagcucuaaaugacuugguuaacag

SEQ ID NO: 4178938 - RNA, 65 nt, Human
cugguaagggguggaaccagagcccaaaugggacucacauugaagcuuuuccaugcucuucccag

SEQ ID NO: 4178939 - RNA, 60 nt, Human
cugguacaguaguugggguccaaccaggaaaauggaaaccacucuaacucuuuacaacag

SEQ ID NO: 4178940 - RNA, 58 nt, Human
cugguagauuacugaucagacuuugacucucucagagcucugguucaugaucuauugg

SEQ ID NO: 4178941 - RNA, 66 nt, Human
cugguagcagugaagcuguugauuauguuugucguuguugcauuucaguuacacaaguguuaccag

SEQ ID NO: 4178942 - RNA, 71 nt, Human
cugguaugcaugugugugugugcacaugggcucauggaagagugugugugcacaugcauauacagccacag

SEQ ID NO: 4178943 - RNA, 57 nt, Human
cugguauggaauuugaugcuugacuuuucaauauguguccaugcaguuuccauacag

SEQ ID NO: 4178944 - RNA, 94 nt, Human
cuggucacugugggaccuaaguguggggucucagagcugagagggaaugaacccuugucuagcacuccagcuccacaguugggcacagagccag

SEQ ID NO: 4178945 - RNA, 61 nt, Human
cuggucaugcagaggccucaccagucauuuuauugcuauucccaggccucugugugcccag

SEQ ID NO: 4178946 - RNA, 68 nt, Human
cugguccagacuugggugcucagggaaagcuuccagaggagguuccuacugaagucccaaggggcuag

SEQ ID NO: 4178947 - RNA, 55 nt, Human
cuggucccagaggcaagagauggugggggauuucacucuuuggcuucuggaucag

SEQ ID NO: 4178948 - RNA, 96 nt, Human
cuggucccugucuaugagauguggcugcacccaccgcuccuguacacagcuuguucugagcguggcuggcagcccauguuuccugagcacuuccag

SEQ ID NO: 4178949 - RNA, 74 nt, Human
cuggugaggcuagauguuugcugggagcucagcuggggcucucgaccuucaacaacuacaugugccuuuuccag

SEQ ID NO: 4178950 - RNA, 57 nt, Human
cuggugcaaggcuuuggaauccaacaaauauaauuuggaaucuggucugacacucag

SEQ ID NO: 4178951 - RNA, 68 nt, Human
cuggugccaugugguuucauguugucaugugaaaauuugaugaucugcaagaacuacaugcccaucag

SEQ ID NO: 4178952 - RNA, 129 nt, Human
cuggugcucuguggcugucaugcagacugggguugggguucuguucccucuacuguacuggagcuccaggucaugggaggcagcagagcccagcccuggcccuucgagcuuccguccugcaagcaccgg

SEQ ID NO: 4178953 - RNA, 56 nt, Human
cugguggaauagcauaucaguuacagcauaugacuguaacugaucauuuucaccag

SEQ ID NO: 4178954 - RNA, 57 nt, Human
cugguggcuacaagguggcuauucuagauucccugugucuggaugguguggccgcag

SEQ ID NO: 4178955 - RNA, 58 nt, Human
cugguggcuucuaagggcuccccacaacuuuaaugugguggcuugugguggccaccag

SEQ ID NO: 4178956 - RNA, 69 nt, Human
cuggugggcgugucucuuagccugcuaaugcauuauaauuaguauauaaugagcagugaggaccaccag

SEQ ID NO: 4178957 - RNA, 56 nt, Human
cuggugggggaguugaagggguuuugggcaaggccagaguugaacugcuccacuag

SEQ ID NO: 4178958 - RNA, 77 nt, Human
cugguggucccggcgcacuuugcagauguuucucccacacaguggaaacauucccuaauguguccguagacuuccag

SEQ ID NO: 4178959 - RNA, 59 nt, Human
cuggugguucaugccuauaaucccaccacuuugggaggccgaggcaggcggaucacaag

SEQ ID NO: 4178960 - RNA, 127 nt, Human
cuggugucuuacgggcacaucuaaaaggugacaguccagagacugaauaacaagcaaauaaagcuaucaguuuuacuaauuauuauucagucuuaacuguuguuucaagguguguaagugauaucag

SEQ ID NO: 4178961 - RNA, 63 nt, Human
cuggugugguaaugagaauuauuuuaauugcuuuuugccaggccuuucucauaccucacuuag

SEQ ID NO: 4178962 - RNA, 90 nt, Human
cugguguuuuauugucuaugaacugcuugggggguggucagggagggagcucgccuaacaaauauaacauuuauagaauaguagaaccag

SEQ ID NO: 4178963 - RNA, 74 nt, Human
cugguuaauuuuagggagacaauacaaaaccugagugucauugugugcucccuuuugcuguguccuugagccgg

SEQ ID NO: 4178964 - RNA, 76 nt, Human
cugguuauaauguuuagguauguguauuguguguacauguauguauacauauguguaaucaaacacaugcuaccag

SEQ ID NO: 4178965 - RNA, 55 nt, Human
cugguucaaauucuaugaaauauguauucucaggaguacauggaauuacuaccag

SEQ ID NO: 4178966 - RNA, 65 nt, Human
cugguucacuaaggggucagcucaggccuaggcagcuacuucccuggcucaccccuuauguccag

SEQ ID NO: 4178967 - RNA, 55 nt, Human
cugguucugauuccuaguguuugcugguuaaagaugacacugaauguagaauugg

SEQ ID NO: 4178968 - RNA, 103 nt, Human
cugguugucuguccccucauuagacugugggcuccuugagggcagggaacuggaauugcuguucgucauugacccccagccuagugaaggaucugaugcucag

SEQ ID NO: 4178969 - RNA, 64 nt, Human
cugguuuaugagggaagggauguuggccccaugaaaucauuaacccuguccccacguaaggcag

SEQ ID NO: 4178970 - RNA, 104 nt, Human
cugguuucagaagaucucuuguccucagauaugucuacucucauuaaaacaaagcaugaagaguuccauggcuggggauacaggcagagaaaccuugauuacag

SEQ ID NO: 4178971 - RNA, 104 nt, Human
cugguuuugaaauguuaggacaugagauuuggaggggccaggggugaaaugauaugauuuggcuguguccccacccaaaucucaauuugaauuguagcuaccag

SEQ ID NO: 4178972 - RNA, 75 nt, Human
cuguaaagauaagaagauacugaguuugacugugucucugcucaccguacaaacucuuuauauuucauauuccag

SEQ ID NO: 4178973 - RNA, 61 nt, Human
cuguaaauauauuaguuugaacaagugagacuucacuaaauauaaugcaauguauuugcag

SEQ ID NO: 4178974 - RNA, 122 nt, Human
cuguaaauuuuuaacaauaugcacuaaaauguuuguauauuuuaccaguuuuguauauuuccugguuuggcaaacacugguaugauguauaguaauuguuguaguuugugucaaaucagcag

SEQ ID NO: 4178975 - RNA, 68 nt, Human
cuguaaucccagcuaccugggagacugagcugagagaaucacuuuaacccaggaggcggagguugcag

SEQ ID NO: 4178976 - RNA, 68 nt, Human
cuguaaucccagcuaccugggagacugaggcaugaaaaucucuugaacccgggagcuggagguugcag

SEQ ID NO: 4178977 - RNA, 68 nt, Human
cuguaaucccagcuaccugggaggcuagggcagcaaaauagcuugaacccaggaggcugagguugcag

SEQ ID NO: 4178978 - RNA, 68 nt, Human
cuguaaucccagcuacucgggaggcugaggcaggagaauugcuugauccugggaggcggagguugcag

SEQ ID NO: 4178979 - RNA, 68 nt, Human
cuguaauuaaggcugggaauugcugagcugcucuaucugcagcuggaagauccugguuuugugugcag

SEQ ID NO: 4178980 - RNA, 76 nt, Human
cuguacaacuuguguucaacucggagcuacuagucuggaaagaucagcagaaccugaauugaacauuguuucucag

SEQ ID NO: 4178981 - RNA, 60 nt, Human
cuguacaaguccuucaucagggaaaaacauugaguauucccugauuaaggacuuguacag

SEQ ID NO: 4178982 - RNA, 102 nt, Human
cuguacaccagcaauuuucaaucuuggugcgacaacaaacuauuguguuucaauauguuguggggugcaucaaaaagaguguguugcuaaugguaguugcag

SEQ ID NO: 4178983 - RNA, 65 nt, Human
cuguacaucccaagauauuucuacuucaaaauagaacagaauaucaucucuuuggggugguucag

SEQ ID NO: 4178984 - RNA, 71 nt, Human
cuguaccaagacaaaucagaaacuccccauauuauuuuuugguuguuguuuuuuguguuguuuugguuugg

SEQ ID NO: 4178985 - RNA, 60 nt, Human
cuguaccacaguagacuuuaaguuccaugcaagcaaggaaugugucuaugugguucacag

SEQ ID NO: 4178986 - RNA, 65 nt, Human
cugcugaguuuugcccaucauuuucuguguucugcuauauguggccacacugaucagaucagcag

SEQ ID NO: 4178987 - RNA, 59 nt, Human
cugcugcaauuaucugggugugagaggauaaguagucuggacuuggaugguggcaguag

SEQ ID NO: 4178988 - RNA, 79 nt, Human
cugcugcaccaucaggugagaggcagaggacagcuuccuccggagugaggcuucuucucuccaucauccaguccagcag

SEQ ID NO: 4178989 - RNA, 68 nt, Human
cugcugcauuacugugauggugguccuaaguaguuuccuuuccauaaaagcucaaagaaugcaugcag

SEQ ID NO: 4178990 - RNA, 86 nt, Human
cugcugccccucuucauuguaucguuacaucuuacugcuuuacacaagaaacagggacaaggauagagaaaaggggaacaaagcag

SEQ ID NO: 4178991 - RNA, 66 nt, Human
cugcugccuuccaaaggccaggaacugcugaaauuaaaccaaggcaggggccaggggagcagacag

SEQ ID NO: 4178992 - RNA, 63 nt, Human
cugcugcgggacccacugugggccuggcuugcugccagccagcaaggacggauucugcaggag

SEQ ID NO: 4178993 - RNA, 129 nt, Human
cugcugcucaugcucauacaagucccaauagagagguuucuuccauuguacucccucuccugcccgagcaagagugccguccaagaggucugaguauagggagcccugggaugggccugaagcaaugug

SEQ ID NO: 4178994 - RNA, 93 nt, Human
cugcugcugaaaaggcugugaccaagaaggaacuucagggcgaauggacugcuccagcuccugaguucacugcuacucagccugagguugcag

SEQ ID NO: 4178995 - RNA, 55 nt, Human
cugcugcuuagcauagcagaggcagcauccagauuguaagcuggucaagcagcag

SEQ ID NO: 4178996 - RNA, 75 nt, Human
cuccagugccagcucuagugcuggcuacuguaguacauggcaggcagcagcacauggggcuggcaacauguggag

SEQ ID NO: 4178997 - RNA, 57 nt, Human
cuccaguggugauggggaagaagcuacucuggcugacuuccucuaaucuaucaggag

SEQ ID NO: 4178998 - RNA, 128 nt, Human
cuccaguuuuauuauucugugaagacaguuugguguaaaugauuuaagagguuagucagaauggaguucucuguucaaaugaucuucuuaaauuucuguacugagcucuacucauaggaaacguggag

SEQ ID NO: 4178999 - RNA, 110 nt, Human
cuccaucaagguguaccagggccucaaggagcuggccugaccugaggcuggguuggagcagcccuccugugccugaggccagcucccaggcccuuggaucaccgcgggag

SEQ ID NO: 4179000 - RNA, 58 nt, Human
cuccauccagaaucaauagcaguuaucauucauuuugauguguuuguuucuggaggag

SEQ ID NO: 4179001 - RNA, 79 nt, Human
cuccaucgugaaguauggaaagucucuuuugacuguagcauucguugauuugaaagagaauuucucuguuacgauguag

SEQ ID NO: 4179002 - RNA, 72 nt, Human
cuccauuuuacauugaaguacuguaaaccugugagcuaauggucaccaguuacauaaaugauaaaaugagag

SEQ ID NO: 4179003 - RNA, 63 nt, Human
cucccaaagugcugggauuacaagugugagccaccgcgccccaucuacaguacuuuuuuagag

SEQ ID NO: 4179004 - RNA, 71 nt, Human
cucccaaauggagacccucccccugcuuccaccucuggauguggggcagguggaaggucuccauucaggag

SEQ ID NO: 4179005 - RNA, 73 nt, Human
cucccaacagggcaguuagagccuaccaaaguccccagcucuguguuccucuggauugcuggauuguugggag

SEQ ID NO: 4179006 - RNA, 56 nt, Human
cucccaagauaaauaaggcagugcuuguccuuaaauugcccagggucuggugggag

SEQ ID NO: 4179007 - RNA, 92 nt, Human
cucccagagcucugagcugcccuccuuggccucccaggguggagauuagaagacccuugggguguuggaggcagcccaguaggcuguggcag

SEQ ID NO: 4179008 - RNA, 57 nt, Human
cucccagauuccugcugugggaaccuuguuucacccacagacuaucagaccugggag

SEQ ID NO: 4179009 - RNA, 60 nt, Human
cucccaggacuggcucuaacuggcucaaauuggcuguugagcucugagaccuguguggag

SEQ ID NO: 4179010 - RNA, 60 nt, Human
cucccaggccaugcucuagccaccagaacuuggugacguggaagaagcauugccugggag

SEQ ID NO: 4179011 - RNA, 64 nt, Human
cucccaggccugcaucugcugcgcacacucccuccaugugucuguguggccacaguccuggggg

SEQ ID NO: 4179012 - RNA, 67 nt, Human
cucccaguccagcccccugcuaaaaggccauugauaaagccuugaggcagggucuuggaaguuugag

SEQ ID NO: 4179013 - RNA, 100 nt, Human
cucccaguuuuggcuaaaucucaccauggugcuugcuuaugacucucacuauaggugacaggaaaaauaaagcugcucuuauguugauuggcucuaggag

SEQ ID NO: 4179014 - RNA, 62 nt, Human
cucccauauucguaucuugaaguccuaacccucagggcuucagaaugggacuguguuuggag

SEQ ID NO: 4179015 - RNA, 55 nt, Human
cuccccaagccuuggcuucuccaugugaaauggggcagugggagguucuggggag

SEQ ID NO: 4179016 - RNA, 63 nt, Human
cuccccagcauuucugggcugcacuuguagcugggccagcagugcucccaggaccuggggcag

SEQ ID NO: 4179017 - RNA, 93 nt, Human
cuccccauucccugagagcagggucuuucucucccucucugaagacuaagccagaguaaugagacucaccuuugcucugcaguaggugaggag

SEQ ID NO: 4179018 - RNA, 88 nt, Human
cuccccucugcccugagauucuuggauucugccucaccucaucgguguuuugguagaauucaagauucaacaggcuuuuugaugggag

SEQ ID NO: 4179019 - RNA, 58 nt, Human
cucccgccuuggcuucaguagcucacccagcuuacaggggagcugcccugggcuggag

SEQ ID NO: 4179020 - RNA, 70 nt, Human
cucccuaaauuaaugccaauucucagcauuuucuuauaccugcuagagugauccuaauugauuuggguag

SEQ ID NO: 4179021 - RNA, 81 nt, Human
cucccuaccccacugccucugucuauccuccccagcaaggaucugcagagaagaggacaguucuaacaaaggggaagugag

SEQ ID NO: 4179022 - RNA, 56 nt, Human
cucccucaggccuuagcccugccuuggguggagggagggcaccuggucuguggggg

SEQ ID NO: 4179023 - RNA, 73 nt, Human
cucccucccuuggaaaguagccucacagcugucaggaaaaaacagcuguguggcuuccuuucaaagaagugag

SEQ ID NO: 4179024 - RNA, 65 nt, Human
cucccucuucccccuccugcuuugaaaugcuucauuggcaugggcugaggugggauagaagggag

SEQ ID NO: 4179025 - RNA, 68 nt, Human
cucccugccgacaggaggcauccucuccccaguaauacccaacugggcuggcuuucugugcagcggag

SEQ ID NO: 4179026 - RNA, 96 nt, Human
cucccuggucugcaaaaggugguucgcugguacccaggucccugugcgaaugagaggagcugacgucuaugaaagccacucccugcacccggggag

SEQ ID NO: 4179027 - RNA, 59 nt, Human
cucccugucuuuguguccccauucugcagacagacugguggcuuucagacagaaaggag

SEQ ID NO: 4179028 - RNA, 59 nt, Human
cucccuucaggagaggcucacaaaaugcugaugggcuucuuccaugaagaaugcaggag

SEQ ID NO: 4179029 - RNA, 55 nt, Human
cucccuugcuucuggcauuuugcuggccucagccaaugggaggccccagcaggag

SEQ ID NO: 4179030 - RNA, 81 nt, Human
cucccuugguggaacaacacgucucugacacuuucaauuuaaagacucacauguguuuucucaccaacaagcccuagggag

SEQ ID NO: 4179031 - RNA, 55 nt, Human
cuccgaacaguggcuccaaggcuccccugcgagcuguacaggaaccaguuuggag

SEQ ID NO: 4179032 - RNA, 58 nt, Human
cuccgcacagcccugagcgcaugucuaucuuuaggccguggaagaagggcugguggag

SEQ ID NO: 4179033 - RNA, 66 nt, Human
cuccgcauaugccuggcuagcuccuccacaaaugcguguggaggagcuagccaggcauaugcagag

SEQ ID NO: 4179034 - RNA, 58 nt, Human
cuccgcuggccaggcccagggcaggauaacgcuuccuggccuccuguggcgggugggg

SEQ ID NO: 4179035 - RNA, 71 nt, Human
cuccgggacauguggccccugaaaauggcagcugccauuagguagcagccuugcaggggucgcaccggcag

SEQ ID NO: 4179036 - RNA, 90 nt, Human
cuccggggccaggcuucccccauccuaggaugagucaauugccuuucuagucccaggguccugggggccaggccuucuugaaucauggag

SEQ ID NO: 4179037 - RNA, 113 nt, Human
cuccggguuuucuuuucgaauuaagcuagacacugcuacccagaugucuuuggaggugacuuuuaauugaacauuaaaauugggugggguaaacgagaagggaaaacaaggag

SEQ ID NO: 4179038 - RNA, 61 nt, Human
cuccgugaaggcagggagcuggaguguuggaugaauuuccuuuguuuccugucuuacgggg

SEQ ID NO: 4179039 - RNA, 65 nt, Human
cuccgugcccacguggguguuagaugaggugaugcgcaagcgccuuguguccauggagcauggag

SEQ ID NO: 4179040 - RNA, 66 nt, Human
cuccguuguucaggaggggaaugugaggcugagaggccaaguucuuaacucugagcagcacugggg

SEQ ID NO: 4179041 - RNA, 60 nt, Human
cuccuacugcauuacaauucugcucuauguuugcuagcacaugcauguuguguagggggg

SEQ ID NO: 4179042 - RNA, 64 nt, Human
cuccuacuuguaauuguuuccuccccaguauucuuucuggggacagaauacucauaagaagggg

SEQ ID NO: 4179043 - RNA, 55 nt, Human
cuccuagaggaugguaggaagcuugauagcauccaagcugcuaaauucuuaggag

SEQ ID NO: 4179044 - RNA, 75 nt, Human
cuccuagagguguagguugccuccuagagaagggcgcagaaugccuccuagaacagcccaccuggaagcugggag

SEQ ID NO: 4179045 - RNA, 120 nt, Human
cuccuagguacauuuguguaucuauucguauuuauuaguaauuaaacuucuauguuggucuauaagccauaauguugaugauugucuuuguaaaugaaugcaugcaaauacgcccaggag

SEQ ID NO: 4179046 - RNA, 64 nt, Human
cuccuauaaucccagauacucagguggcugcaacacaggaauugcuugagcccaggaaguggag

SEQ ID NO: 4179047 - RNA, 120 nt, Human
cuccuaucaaacaucuccuugccuaucuuguucaucacugaaaucuuugacucuggcuaacaauuugcuucacaagaauuuguagaugaaaggagaaaaaaggaaaaaaaaggagaggag

SEQ ID NO: 4179048 - RNA, 79 nt, Human
cuccuaucuguuucauauaacaaugugauugaagcuagaagagccuucuggagaauaaucagcauugaacagaaagaag

SEQ ID NO: 4179049 - RNA, 58 nt, Human
cuccuaugugccaggcacugggcugggugcuggguagagacacagucuggggcgggag

SEQ ID NO: 4179050 - RNA, 125 nt, Human
cuccuauucguugaaucauuuccuaaaauaaacaagcugcagacaagccauuauuucagagucugcuuuguguguguguguguguguguguguguguuggggggacuaagacagcuggaaaggag

SEQ ID NO: 4179051 - RNA, 74 nt, Human
cugaccacugaaacaagaaggaaagauugcuagaguguuucugggcaucuugcuugucuuuaguaaggaaacag

SEQ ID NO: 4179052 - RNA, 72 nt, Human
cugaccauccuggagcaaacauuuaauuugguggcagguuagucauauugaacauuguucuaggaggcacag

SEQ ID NO: 4179053 - RNA, 55 nt, Human
cugacccuggaggcauuucucucacgugugggaguaaggggcaucagggcaucag

SEQ ID NO: 4179054 - RNA, 60 nt, Human
cugaccugcccuuaggcuucucacaguaaaguggucucagcccagcaaagggagguucag

SEQ ID NO: 4179055 - RNA, 61 nt, Human
cugaccugggcugggcgucucaugggagacagacucacucaucagagcccagugcaguuag

SEQ ID NO: 4179056 - RNA, 57 nt, Human
cugaccuguggagggcugcuugcuguguauugaauaaaggaggcuucuuggggucgg

SEQ ID NO: 4179057 - RNA, 90 nt, Human
cugaccuuccugaaaugcuagaucuggcaggcacaaggucaagauuggcuucugugagugcagaugcugagguugccaggaggaaaucag

SEQ ID NO: 4179058 - RNA, 57 nt, Human
cugaccuugugauccacccaccuuggcuucucaaagugcugguauuacaggugucag

SEQ ID NO: 4179059 - RNA, 56 nt, Human
cugaccuugugauccgccuaccucggcuuccccaagugcuggauuacaggcgugag

SEQ ID NO: 4179060 - RNA, 57 nt, Human
cugaccuugugauccgccugccuuggccucccaaagugcugggauuacaggcgucag

SEQ ID NO: 4179061 - RNA, 57 nt, Human
cugaccuugugaucugcccaccuuggccucccaaagugcugggauuacaagcgucag

SEQ ID NO: 4179062 - RNA, 57 nt, Human
cugaccuugugaucugcccaccuuggccucccaaagugcugggauuacaagugugag

SEQ ID NO: 4179063 - RNA, 130 nt, Human
cugaccuuuucugaagaauaauuuaauuuaauauugaacaacagagagcuggaagcugcucuuagauugcaucucagguggcuacuaguuuauauguggucauuacuaaucuagagucccuuuucaccag

SEQ ID NO: 4179064 - RNA, 63 nt, Human
cugacuagagucagauucuuaguuggcacauccaggugcuccaacuuugugugaccuagauag

SEQ ID NO: 4179065 - RNA, 75 nt, Human
cugacucaaguaagaaacagaauuggaauuugagguaggauaucccagccccacauuuuguauuuuuugagucgg

SEQ ID NO: 4179066 - RNA, 128 nt, Human
cugacucauguuucucaucugaaguacuggggaggcuggauuaggauucgugguuucaaauuaaucucuguggugcccuggagauuucuucaagcuuucuuuacggaauaucugauggguagugaggg

SEQ ID NO: 4179067 - RNA, 89 nt, Human
cugacuccccguugaugugggugaugagguccccagcccgcaggcccgccuccugggcggggcuuccguccuccacacucugggggcag

SEQ ID NO: 4179068 - RNA, 64 nt, Human
cugacucccugauucuggguuuuaaguucuuaacuauuacagaaaagaagaacaggggaggcag

SEQ ID NO: 4179069 - RNA, 78 nt, Human
cugacucgaauguaguauuuggaaauguaaaaugacuucuauuacauuauuacauuuuugaaaacuacuugaaagcag

SEQ ID NO: 4179070 - RNA, 91 nt, Human
cugacucuaaggggguuggugaauuaccaaaggggcagaucagagccccagcucucuggcucuggaguccaccugccccauacaaugucag

SEQ ID NO: 4179071 - RNA, 80 nt, Human
cugccccuggggagcggcggcggugccacucagcgcugcgcagccagccugagcugccugccgccucgccucguacucag

SEQ ID NO: 4179072 - RNA, 91 nt, Human
cugcccuauccuuuguccacuuuuugaacuggaacaacugcaagaauuugcuaaggguugaaacagcaagaaacagagaaaggauaagcag

SEQ ID NO: 4179073 - RNA, 79 nt, Human
cugcccuccucucugacagccuucauuaugcaauucaggcagaguccacccugcaaagaagggcugaggagcagggcag

SEQ ID NO: 4179074 - RNA, 105 nt, Human
cugcccugcgcugugcucgagcuacugaaauauugauuuuuacagagccggcgcacacacacugaaaaaucaauauuccagugcacacaacagaacaggcagcag

SEQ ID NO: 4179075 - RNA, 79 nt, Human
cugcccugcuccucagcccuucuuugcaggguggacucugccugaauugcauaaugaaggcugucagagaggagggcag

SEQ ID NO: 4179076 - RNA, 90 nt, Human
cugcccuggcacucucagcuguagguauggaugucccuaaucuacauguuuagggucauccuguuucugagcugaucuugaccaaggcag

SEQ ID NO: 4179077 - RNA, 59 nt, Human
cugggugucagaaccaggcaguaugaaaauagaacagaacugugggucugaccaccugg

SEQ ID NO: 4179078 - RNA, 61 nt, Human
cuggguugcaacugccuacaguauucaguaccgucacauacuguaaagguuuguagcccag

SEQ ID NO: 4179079 - RNA, 69 nt, Human
cuggguuuagggucuccccuugagaaaagcgguugggugguuggugagggaagggggcuuauuccacag

SEQ ID NO: 4179080 - RNA, 67 nt, Human
cuggguuucagacacagcgcugggaaaugcuuugguauguaguugucacaaugucucugggaccuag

SEQ ID NO: 4179081 - RNA, 74 nt, Human
cuggguuuguuagugguaauagagcuccaaacuaggcuuuuucgcuuuauucuggcuguauauuauugacccag

SEQ ID NO: 4179082 - RNA, 61 nt, Human
cuggguuuuauuacagugagcugacacaacagaauauucagaaucacuuaaaguagcccag

SEQ ID NO: 4179083 - RNA, 75 nt, Human
cugguaaggagcagaccuaggauuugaauuuggccaauauggcuucagaaccugcaagucuaaccucugaauuag

SEQ ID NO: 4179084 - RNA, 74 nt, Human
cugguacagcuggccacagauccccagggagguagcaagcuccccaucccugcaggugugcaagcugagaccag

SEQ ID NO: 4179085 - RNA, 57 nt, Human
cugguacaguguuacaaaauggggagagugaccacaggguuggggcacuggacgcag

SEQ ID NO: 4179086 - RNA, 87 nt, Human
cugguagaggaagagggagaggcucugaggacuggggugaugggggugccuaucuuaguagagcagggccucuccccuccccaucag

SEQ ID NO: 4179087 - RNA, 61 nt, Human
cugguauguccugagucuuuuauauucuuucaaaagauaugcucuauuugggauaugacag

SEQ ID NO: 4179088 - RNA, 57 nt, Human
cugguauuuacuguucuccaaaccagcuccuugguugaugacagcaaaaaaugcuag

SEQ ID NO: 4179089 - RNA, 60 nt, Human
cuggucaaaaauuaugcuuacugaacgcaugacugguuaaguuaggcagaauuuugccag

SEQ ID NO: 4179090 - RNA, 83 nt, Human
cuggucaagcagagaccggcuaauggagaagggguuguuuccuccccucccuccuugccucggucgauuugcauugaucccag

SEQ ID NO: 4179091 - RNA, 55 nt, Human
cuggucaaugggaacugcccugaacccucaccugggcucagccccauugaaccag

SEQ ID NO: 4179092 - RNA, 93 nt, Human
cuggucauccacauuauuuuugugcuuuuauguuugcuucaaagaggaacuuugaagcacagaccugggcaucagugaugaacgaagggccgg

SEQ ID NO: 4179093 - RNA, 130 nt, Human
cuggucgucgcccacugcugcugcugcagcucccccgggccccgcagggaaagccccaggaaggugagccccuggaaggugagcccugccggccucugggaccugcacggaacuguacuggggguggagg

SEQ ID NO: 4179094 - RNA, 62 nt, Human
cuggucuaauugguuugaauaaauaaagaaccggaaucuuucucauccaaacuaguugccag

SEQ ID NO: 4179095 - RNA, 57 nt, Human
cuggucuagggucuaaacggccauucaguacuuugaacuuuggcuuuccugacacag

SEQ ID NO: 4179096 - RNA, 55 nt, Human
cuggucucuguucacaccgggugcuaauaacccacagcugaaagcagaggcucag

SEQ ID NO: 4179097 - RNA, 79 nt, Human
cuggucuguaacuggacacuggucuguacuggagucagaacucagaacagaaacguuguuccauucaugugaagagcag

SEQ ID NO: 4179098 - RNA, 57 nt, Human
cuggugaauggauaaacuguuguagauuaaugcaauagaauuauuauuucagcccag

SEQ ID NO: 4179099 - RNA, 68 nt, Human
cuggugacauucuagaagucuuugcaaugccuaaaacuuuaaagguaucaauagcuagaauguaccag

SEQ ID NO: 4179100 - RNA, 64 nt, Human
cuggugaccggaccucaguuuuacaugcucaauugcacauuguuuaauugccugucucugccag

SEQ ID NO: 4179101 - RNA, 111 nt, Human
cuggugagcaccccugggacccgagcagcauccucaggagccagugccggagccaucuggcauccagcagugcucuagagcgugccuccugcggucucagcugccccccag

SEQ ID NO: 4179102 - RNA, 79 nt, Human
cuggugcacaucagaauuacuuggggagcuuguuaaaacacaggauacuaagccaccccaauaguuccugauccacuag

SEQ ID NO: 4179103 - RNA, 69 nt, Human
cugguggccauccuuggcccuggccaggagcaggccacagaacugccggugggccaggaaggccgccag

SEQ ID NO: 4179104 - RNA, 94 nt, Human
cuggugggcagccgguggggagggcagggcuggccauagguacaaguccagugcuggcuuuuugguccuugcuuugucguauguccuuuacuag

SEQ ID NO: 4179105 - RNA, 58 nt, Human
cugguggggaguccuggucuccccacagccuuggguggagacaggagcccccauucag

SEQ ID NO: 4179106 - RNA, 61 nt, Human
cuggugucagaacugcugcagauacccuauaagcagagaggggcugcuccagucuggccag

SEQ ID NO: 4179107 - RNA, 97 nt, Human
cuggugucuccaugaggcuuuggggguagaggagucccaagcugcuugagcuauuuguguguuccaggcuucuucugccugucuuugggagacccag

SEQ ID NO: 4179108 - RNA, 94 nt, Human
cuggugugugaccggcacagccgggcaaggcuggaggcuuuguagguugcugcccuuaggaccccacuugcugggccugugcugacacguccag

SEQ ID NO: 4179109 - RNA, 80 nt, Human
cugguucaugacuuagacagugcuaucccaucugugagugagcauacucugucauggucagauugucaucaugaaaucag

SEQ ID NO: 4179110 - RNA, 62 nt, Human
cugguuccugaagggacuggugcagaggcugaccuuugucccaccacccccucaugaguugg

SEQ ID NO: 4179111 - RNA, 87 nt, Human
cugguuuaccugggccugauggcuuuccugggacaugggccaaucacugcccaaacugggaaagucauuggcaaaaggacaaauugg

SEQ ID NO: 4179112 - RNA, 58 nt, Human
cugguuucugcccucagagcucaccuuagguggucagugguggaagcagcaaacccag

SEQ ID NO: 4179113 - RNA, 65 nt, Human
cugguuucuuggcccccaguccuucuggaaaccccuccccugacuggagcccccaaggacaccag

SEQ ID NO: 4179114 - RNA, 60 nt, Human
cugguuugaguaacagggcccucuuugucagcuacaacaagggccucucauuugugccag

SEQ ID NO: 4179115 - RNA, 62 nt, Human
cugguuuucaggccuugggacccagacuggaacuauuccacuggcuuuuccuaggucuccag

SEQ ID NO: 4179116 - RNA, 58 nt, Human
cuguaaacccagggguggggcccgagguccagaaaagcccuuucucuggguugcacag

SEQ ID NO: 4179117 - RNA, 57 nt, Human
cuguaaacuucuggaggucaaguuuauacuuauuuugauuucuucucuuguuugcag

SEQ ID NO: 4179118 - RNA, 96 nt, Human
cuguaaaguucuauacagugugagguugggggagcaaagguuuuagaccggugacuuugcucuuuggauuccuuuacaaacugauugaagauacag

SEQ ID NO: 4179119 - RNA, 83 nt, Human
cuguaagguccucccuucuggggcuggaugauuauggcccaacagccaccaucuccagugcccaaaggaaaucucccuuaugg

SEQ ID NO: 4179120 - RNA, 80 nt, Human
cuguaauagcagagcagacguugagauuaagauaguauuuuuauaugcaaacuucuuuacucugcuucguccauuauuag

SEQ ID NO: 4179121 - RNA, 81 nt, Human
cuguaauagcauauggaggguaagaggguggauauaagugccuaacuaccugaguuaaaauuccaucucugccucuuacgg

SEQ ID NO: 4179122 - RNA, 68 nt, Human
cuguaaucccagcuacucaggaaguugaggcaagagaaucgcuugaaucugggaggcggagauugcag

SEQ ID NO: 4179123 - RNA, 68 nt, Human
cuguaaucccagcuacucgggaggcugagguaggagaaucgcuugaacccgggaggcggagauugugg

SEQ ID NO: 4179124 - RNA, 79 nt, Human
cuguaaucugaaacacuuucaauuacauauauaguuagaaaugcuagaauauguugacuagaaaguguaagaugugcag

SEQ ID NO: 4179125 - RNA, 68 nt, Human
cuguaauuccagcuacuugggaggcugaggcaggggaauugcuccagcccagguggcggagguugcag

SEQ ID NO: 4179126 - RNA, 60 nt, Human
cuguaauuguucuauguguucauaauggaacauccauuuaagaauacagauaauaagcag

SEQ ID NO: 4179127 - RNA, 62 nt, Human
cuguacagaccuauuagcccagaggucacaaauugcagccaagggcuggggucugccugcag

SEQ ID NO: 4179128 - RNA, 123 nt, Human
cuguacaguguaguaugcuccuuuaggcagguuguuacagugcauguggcuucuguagcacccaguuccagcagugcccaguggccaacaguguguagcaccuuccacggacaacuucuccag

SEQ ID NO: 4179129 - RNA, 114 nt, Human
cuguacauucaucauauagucagaauucaugauaguauuuuuugugacagauaguucagacuaucaagauuuucaagaaaaaucucuaaauugguuuugguauaaauguagcag

SEQ ID NO: 4179130 - RNA, 71 nt, Human
cuguaccccaucauuugcaagcccacacagauauguuucggugcugcuggcuuuagugauuggggugauag

SEQ ID NO: 4179131 - RNA, 81 nt, Human
cuguacccugaggcacuuaauaaggauucaauuuugguaaugaauaauauuaguuucuucauuaaguggcuuaaagaauag

SEQ ID NO: 4179132 - RNA, 78 nt, Human
cuguacuacccagcuuucgaagugucacaggugagaaaguuaaccagugaaggacaaccgagcagcugugggaaacag

SEQ ID NO: 4179133 - RNA, 79 nt, Human
cuguacuagccacauuucaaguucuguuccuaaacugggaacacacacaggaacagaacuugaaauguggcuaguacag

SEQ ID NO: 4179134 - RNA, 83 nt, Human
cuguacucuuuaaaguaaaauuugucucuauccaauaaagcuauuaggggcauuguugauuacuuucacuucaaagagguuag

SEQ ID NO: 4179135 - RNA, 84 nt, Human
cuguagaacaagugugggacucaguggcacccaggcucaauccugcugcugagcagaggugcuggagugaguccugcucugcag

SEQ ID NO: 4179136 - RNA, 67 nt, Human
cuguagaacgauccaggcauuuggcucaccagguggaccuacuuuuugucuagauuuguucuuauag

SEQ ID NO: 4179137 - RNA, 77 nt, Human
cuguagaagcagcuguacuggcagcauugugucuuccuucauccugacagagucugugaagucaguuacuacaacag

SEQ ID NO: 4179138 - RNA, 76 nt, Human
cuguagagcaaguuuuugguuugaaauuauuguguuguuugagcaccugucacaagcagaaggcauaacuuuacag

SEQ ID NO: 4179139 - RNA, 58 nt, Human
cuguagcaccaagccuagagugauguuugcuucugacuccugcugguuugguagccag

SEQ ID NO: 4179140 - RNA, 55 nt, Human
cuguagccugggucugugacucugacacucagcagaagcaacauucaggcuuuag

SEQ ID NO: 4179141 - RNA, 65 nt, Human
cuguaggacugagggcuucagcuccuugugguaucucugcuggaagcugcuuucagcuccuagag

SEQ ID NO: 4179142 - RNA, 78 nt, Human
cuguaguacauuuaauccucacaauaaaaucagccuaugaaguuauagguggaaaaacugaggauuagagagauucag

SEQ ID NO: 4179143 - RNA, 60 nt, Human
cuguagucccuuuagucuggagagcugccagcagggcuaagcucuacagaagggcugggg

SEQ ID NO: 4179144 - RNA, 58 nt, Human
cuguauacaugguccauguuauacaugagauaaguaggacauguacuaaugaauacag

SEQ ID NO: 4179145 - RNA, 89 nt, Human
cuguauagauaaaugagagugauuccuauuaguacaugcaaaugguuugcuguuuucaaugauuuuuagggaucaucucaaauuuacag

SEQ ID NO: 4179146 - RNA, 97 nt, Human
cucugcuccagggcacucagagauucaggcuguaacuuguaaacaguucugauuugcagccuucuacugaauccucugcaucugaccaggaaaagag

SEQ ID NO: 4179147 - RNA, 73 nt, Human
cucugcugaaaaccacuguacugaaaaguaagcaaguuaagaacuuguucugcuuuccagagcauucagagag

SEQ ID NO: 4179148 - RNA, 65 nt, Human
cucugcugacaaaauaaaaugcuccguugacuccugaaauuggggcaguagcuuuguuuguagag

SEQ ID NO: 4179149 - RNA, 58 nt, Human
cucugcugcaggaaggcgugcacuucuagcuggagcccacucccccucugcagcagag

SEQ ID NO: 4179150 - RNA, 56 nt, Human
cucugcuucauccaccacuggcgagagagaugccaucagugagugggaggccaggg

SEQ ID NO: 4179151 - RNA, 94 nt, Human
cucugcuucuucacucucuuccccgaugguguuugggauacuagugugugagacacagcugggaacucacacagcagggcugagaagagcagag

SEQ ID NO: 4179152 - RNA, 67 nt, Human
cucugcuuucuugcgcagaugugaguuaggagcugcucaggccacuauguggaaagaauugcaugag

SEQ ID NO: 4179153 - RNA, 68 nt, Human
cucuggacuuuaaaucuguugcuuagcuacugauccacaauagcucccaauugacuugaacuacagag

SEQ ID NO: 4179154 - RNA, 60 nt, Human
cucuggagggaggcugagcuggagaugggagggagucuuugcugccagcgcccugcaggg

SEQ ID NO: 4179155 - RNA, 67 nt, Human
cucuggagucacacacaccaaggucucuagccuagcucugccacuuacugguugugugaccccaggg

SEQ ID NO: 4179156 - RNA, 58 nt, Human
cucuggagucugagaucugaggagggggaagagguuuccuacuucaggagagacugag

SEQ ID NO: 4179157 - RNA, 55 nt, Human
cucuggauaugcacugggugaggagggccugcccccaccuccaggcauaucugag

SEQ ID NO: 4179158 - RNA, 84 nt, Human
cucuggauauuuuuaugaaggucucuaccuugcuaagcuguuuuguuaaugcagaugcagggagggccuuucaugacacuagag

SEQ ID NO: 4179159 - RNA, 57 nt, Human
cucuggccuggggccugcucccuaucuguggaacugggaguagggcccaggcuaggg

SEQ ID NO: 4179160 - RNA, 68 nt, Human
cucuggcuauggcacggcgcucagcuuccccauucaccaacacugagugcuggcugaaaggcacagag

SEQ ID NO: 4179161 - RNA, 59 nt, Human
cucuggcugaauccuagucucauaguuuauuuucauugcuauagugacaucggucaggg

SEQ ID NO: 4179162 - RNA, 81 nt, Human
cucuggcuggcaaguagaacacaagauaagccuugaggaaacuaagaauagaggaaauuugugucuacuuccuaucuaggg

SEQ ID NO: 4179163 - RNA, 125 nt, Human
cucugggagagccaguguaauuagacuaauuuuacaagggaaaggggaaaaaucaaggggauuaugcuauaggccacuuguagaguugggaauuguacuagucaggguucuccagaaaaacagag

SEQ ID NO: 4179164 - RNA, 82 nt, Human
cucugggagcugggaggugggcagugagaugggacagacucagcacccaccccauuuugccugcuuguucccugccucagag

SEQ ID NO: 4179165 - RNA, 63 nt, Human
cucugggcaaguuucuucaugagcuucagucuugucugcucuaagugaggauacugcucagag

SEQ ID NO: 4179166 - RNA, 129 nt, Human
cucugggcccaucccagcccuggccuguggccuuucuugugaccaucagggccuggagacccagcaaggaguugccugggugcuggcuggucacugccagaggccugggcugcaugaggaccuccaggg

SEQ ID NO: 4179167 - RNA, 57 nt, Human
cucugggcuuccuuuguggguucucucaagcacugcuacacaaagcgugguccagag

SEQ ID NO: 4179168 - RNA, 102 nt, Human
cucuggggugagcugagucagggagauagaggccaugagauuuggggauacagcacuccuccacccaucccgaaccucuacuucuuucagaacccccaagag

SEQ ID NO: 4179169 - RNA, 64 nt, Human
cucuggguccuggggcuacaagcuguuuucacccucagccaccagcagcaacaggaucccaggg

SEQ ID NO: 4179170 - RNA, 58 nt, Human
cucugggucuaccuguggccagcuguguccaagguaguuagggcccgcaggccuagag

SEQ ID NO: 4179171 - RNA, 74 nt, Human
cucugggugucauggccucagcugacggaaccaccugcuaaaacacguucauggcagaggcacggcaccaaggg

SEQ ID NO: 4179172 - RNA, 94 nt, Human
cucuggguucaagcaauucuccugccucaggcucuggaguagcugggauuacaggugccuaccaccaugccuggguaauuuuuuguaucuuuag

SEQ ID NO: 4179173 - RNA, 62 nt, Human
cucuggguuuucuuuucuaguaaggccuuccagagagggaagaagagaaagaggauccacag

SEQ ID NO: 4179174 - RNA, 83 nt, Human
cucugguccauucucucccugaagcaaagcagcccggggacuccucuuucaaauguccuuuagggagugggugugggccuaag

SEQ ID NO: 4179175 - RNA, 61 nt, Human
cucugguggggcaguguggagccgugucaagucuuggcacaggagcacugcccugguugag

SEQ ID NO: 4179176 - RNA, 56 nt, Human
cucugguugagugagaaccaagguaaagccccugggguuacaacaguuaaacagag

SEQ ID NO: 4179177 - RNA, 78 nt, Human
cucugguuuuaauguuauguuuaugauacccucagagggaacagggaauaauaaugaagaugauaaugauagccagag

SEQ ID NO: 4179178 - RNA, 63 nt, Human
cucugguuuucuugucaucacgugcauccauuuccucuggguguguuccuaaggaaaccagag

SEQ ID NO: 4179179 - RNA, 65 nt, Human
cucuguaaacuaggucauuuuuaaaaaucagacuuucuacuguuagaguaugucugguagcagag

SEQ ID NO: 4179180 - RNA, 64 nt, Human
cucugucagcaccaguuauccucagggguaucaccacuucugggaggcuuugguguugacagag

SEQ ID NO: 4179181 - RNA, 63 nt, Human
cucuguccuugcacaguuccuagauucuucauguacuccuggaugcugcugucagggauggag

SEQ ID NO: 4179182 - RNA, 73 nt, Human
cucugucugucugaauggacucauuaaggccccauaaaaugcagucacagugagccaugucagagaugaggag

SEQ ID NO: 4179183 - RNA, 56 nt, Human
cucugugccucaguuuucuucucuguaacaaagagaguaguaccgaccgcacaggg

SEQ ID NO: 4179184 - RNA, 92 nt, Human
cucugugcuggcgccaccgcacucuguagccuguaagagagcagcaaagaggaauguguugcucagguauagacgggggugggugcauagag

SEQ ID NO: 4179185 - RNA, 56 nt, Human
cucugugggccagagaggcccccugacaagucugcccuagacuggccucaucagag

SEQ ID NO: 4179186 - RNA, 129 nt, Human
cucuguggucccuucuagccuaaaauuucugucucugcaucagcuucauucuguucaaaaaagagaauggauggaucuguugcagcacagaguggagaguggccaauaugacuggggcccaagacagag

SEQ ID NO: 4179187 - RNA, 55 nt, Human
cucugugucugaagcccuauuucuggccuacaaguggggcguguggacacacgag

SEQ ID NO: 4179188 - RNA, 67 nt, Human
cucugugugggaucuuguuuugucugucagccuuggcuucagagccacuucaagucuaacagcagag

SEQ ID NO: 4179189 - RNA, 60 nt, Human
cucuguugaccagcagauguggaacauuugcagcuucacagaaaguucugcuggacagag

SEQ ID NO: 4179190 - RNA, 88 nt, Human
cucuguuggguggcaaagggcugaugugacauagcugugacauagaugugauguuaggcccuuggccucuccuccuucccauacagag

SEQ ID NO: 4179191 - RNA, 91 nt, Human
cucuguuucccaaugcuguggaaguuccugaagcaauuucucaaaaucagcauugacacacagggcucagggaguuucacaguguacagag

SEQ ID NO: 4179192 - RNA, 56 nt, Human
cucuguuucugcugcuagcucaguguagcgugcacuucagcuauucagaaggggag

SEQ ID NO: 4179193 - RNA, 55 nt, Human
cucuuaaguuucuccaccuuugcagagugcugugaaggcugagacaacucaggag

SEQ ID NO: 4179194 - RNA, 83 nt, Human
cucuuacacugcccggcuguucuucgggacuguccgaaagucacucggcaucccuagaauagccagguagguuaccaaaagag

SEQ ID NO: 4179195 - RNA, 99 nt, Human
cucuuacuguacuagugagacuaaagcucuuacuguacuagugagacuaaagcucuuacuguacuagugagacuaggagucucacuaucauucuggggg

SEQ ID NO: 4179196 - RNA, 72 nt, Human
cucuuagaaugucaacugauguuuauucagcaguucugugugcucagaacaauauuagaugccauuugagag

SEQ ID NO: 4179197 - RNA, 67 nt, Human
cucuuagauuucccucuuguauuugcaugcaggcgagcauagcaaauugacugggggaagggaagag

SEQ ID NO: 4179198 - RNA, 59 nt, Human
cucuuagcuagaggcaauuauguuggauuaauuaauauucauagccuaguggcuaagag

SEQ ID NO: 4179199 - RNA, 75 nt, Human
cucuuaucucaagaacuuguucaugcagaggagcucuuuugaagguucuuuccccauggaguucggaguugaggg

SEQ ID NO: 4179200 - RNA, 72 nt, Human
cucuucacacauccugaccaaguucagggcagugaaggcacugcccucaucguuuccagaauguggauggag

SEQ ID NO: 4179201 - RNA, 80 nt, Human
cucuucacaccugggagugcacagguuucguugauuccauuucaggaaugcucagccuacguguuucccagaauaaagag

SEQ ID NO: 4179202 - RNA, 58 nt, Human
cucuucaucucaguccccuaauccuucucccuuugagcagggcuucugggaucaagag

SEQ ID NO: 4179203 - RNA, 107 nt, Human
cucuuccaauuacauucucauuguccuuucucuuggauaccgauugcuaagauaaacagacacugauuaagugguagaaagagaaagguaaaaugcaacuggaaggg

SEQ ID NO: 4179204 - RNA, 59 nt, Human
cucuuccaccuccuucaggagaauuaaaugaaucaagacuuuggaaagacggggaagag

SEQ ID NO: 4179205 - RNA, 60 nt, Human
cucuucccuuagaagugauaagcauauuuaauuuuagcuuuccacuaucuuagggguuag

SEQ ID NO: 4179206 - RNA, 101 nt, Human
cucuuccuggggaucucagaggauugccucagcgagcaggggagcuggagaacaccccaggggcucaggcugaggcagcuucugugggggccaaggaggag

SEQ ID NO: 4179207 - RNA, 82 nt, Human
cucuucuaaucaaauugcacaugggugcuucuaguuacuuugagcugguaucuuugcauccaucagcagauugacuggagag

SEQ ID NO: 4179208 - RNA, 67 nt, Human
cucuucugcuucccuccuuucuaagauggagucuucuuuccuucuugagcauggguaguacucaggg

SEQ ID NO: 4179209 - RNA, 77 nt, Human
cucuucuguaccucggccuccaagcugccuagaaucuggcuguggcagugcccaaggggaggcgagcagcaggagag

SEQ ID NO: 4179210 - RNA, 100 nt, Human
cucuucuucagggucauucaggagcucaggcugauggaaauucugccaugucacacaguggcuuccacagucauccugggaauugaccucuggcuaggag

SEQ ID NO: 4179211 - RNA, 57 nt, Human
cucuucuuuaguccagaccaucaguuaucugcuuugauguuucugacgguaggagag

SEQ ID NO: 4179212 - RNA, 67 nt, Human
cucuucuuuuuugcauaaucucuguuagaaaagaaagggcccacggaaaaagugcaaaagugaggag

SEQ ID NO: 4179213 - RNA, 70 nt, Human
cuguauccauucauucauugaugaacauuuagguugaguccguaucauguuaucgugaauaaugcugcag

SEQ ID NO: 4179214 - RNA, 55 nt, Human
cuguaucucacauuuccuccuauccugcuaguggauucccuggaaggagaagcag

SEQ ID NO: 4179215 - RNA, 59 nt, Human
cuguaucuuugguauuuaauauggggaugcguagagaguauuagaagccauagguacag

SEQ ID NO: 4179216 - RNA, 68 nt, Human
cuguaugcagacaucaccucagugcuauauagucauacuguaagcucuauuuuagaugcuggguacag

SEQ ID NO: 4179217 - RNA, 71 nt, Human
cuguauuccuaaaugcuauucucuaaggcucaggaccuagaguuguccuugagaagcauuaagagguaggg

SEQ ID NO: 4179218 - RNA, 77 nt, Human
cuguauucuguauaugauugagggcugcaaggaaaucacuguucgacuuguguuuuuaaauaaugauagaaaaacag

SEQ ID NO: 4179219 - RNA, 56 nt, Human
cuguauuuuuuaagugaucuggauguccagauacacagcuacauugaacaauauag

SEQ ID NO: 4179220 - RNA, 88 nt, Human
cugucaagcuuccauaagaguuuuuucucuccucauuauugaaauauacgcucaagaguagaacuagaauucuucaaggguuugguag

SEQ ID NO: 4179221 - RNA, 59 nt, Human
cugucaaugacaguuauuuggguuaaguuuuuaugucuccaaauagccuccauuaacag

SEQ ID NO: 4179222 - RNA, 85 nt, Human
cugucacaucgucugucugaugugcuaggggagggccagggugggaacccuguucacccuccaugcacagaacagacggugacag

SEQ ID NO: 4179223 - RNA, 60 nt, Human
cugucacuaccucugagagaaucauagggucauauaaaccuguggaugagguaaggauag

SEQ ID NO: 4179224 - RNA, 74 nt, Human
cugucacugagccacuggaauguugaggagacaaugaguuagcauuggaaaacaauucagggugaaaggugcgg

SEQ ID NO: 4179225 - RNA, 58 nt, Human
cugucagagauggcaugaaagauuuuucuuagggagugagucaaacauauccugacag

SEQ ID NO: 4179226 - RNA, 59 nt, Human
cugucagaggagcugcagaacgcugggcugcuggagcacauccuggagcaccucaacag

SEQ ID NO: 4179227 - RNA, 78 nt, Human
cugucagauacugaggcaugcaaugacugcugacaguguccuuucugggacaaugugcaauugcagcuagucugaugg

SEQ ID NO: 4179228 - RNA, 66 nt, Human
cugucagcaugccugggcugccugccugauuagcagagcaaaggcaggaacccagggguguuucag

SEQ ID NO: 4179229 - RNA, 55 nt, Human
cugucaggggcggguggagcgggguggggcccuggcuuacucacauccuugagag

SEQ ID NO: 4179230 - RNA, 58 nt, Human
cugucagggggccuggccaucaggcugggaaggugaggggagucaggccugugugcag

SEQ ID NO: 4179231 - RNA, 62 nt, Human
cugucaguuauuuugagcaauugguaccuugggaaucaauucaguccaacaguaauugguag

SEQ ID NO: 4179232 - RNA, 81 nt, Human
cugucauuuaaauuccaggugcaggucuucugaacaaaugccuccugaggauuucugugccuggaaaauaucuguuaacag

SEQ ID NO: 4179233 - RNA, 73 nt, Human
cugucauuugugcaauguagaugaaccuagaggacacaauguuagguaaaauaaaccaggcacagaaagacag

SEQ ID NO: 4179234 - RNA, 80 nt, Human
cuguccaagcucccuggcacaugggcacacuucacacucacucuguggcuccgugccugugccaggggugugcuggaggg

SEQ ID NO: 4179235 - RNA, 55 nt, Human
cuguccacuguucucuguugucagccucacagcacccagaaggagcuaugggcag

SEQ ID NO: 4179236 - RNA, 70 nt, Human
cuguccaggguccugaccauuccuugucuccaggcugguuccagaugggaugaguuguuaggacugacgg

SEQ ID NO: 4179237 - RNA, 57 nt, Human
cuguccauuuugaauuuucaguccuuggccacacauaaaggaaguuuggaaugguag

SEQ ID NO: 4179238 - RNA, 59 nt, Human
cugucccacaagcagugugcacaguuaacguuuacucaacaccacagaauuggggacag

SEQ ID NO: 4179239 - RNA, 130 nt, Human
cugucccuaaauauuugucgaguauguuuugcaaauguuuucagccaugugauuaucuguacugugucuuccauaucagaugaacugugacugaaaaugcugggcagcuuuaugauuauuuagcaaucag

SEQ ID NO: 4179240 - RNA, 60 nt, Human
cugucccugccugcccacucuguaccccuggaggcccagacagcagggcuggcaugacag

SEQ ID NO: 4179241 - RNA, 64 nt, Human
cugucccuuguugaguacacugcuagccuugaacguaggcccugcccagugccacaaggagcag

SEQ ID NO: 4179242 - RNA, 77 nt, Human
cuguccuccugccauccccuuaucccaggcugagccaugucaugaguggcucuaaaggguuggacagguggggacag

SEQ ID NO: 4179243 - RNA, 106 nt, Human
cuguccucuggugagcuagggccaccuggauuccaugugugcuacacccuaggggaagaacgccaggaugucuacguggccuucaaggagaacccugagaagacag

SEQ ID NO: 4179244 - RNA, 69 nt, Human
cuguccuggggaaagccagcccugcuuccucucccaggugggggcucugggccuggcugcgcaggacgg

SEQ ID NO: 4179245 - RNA, 64 nt, Human
cuguccuggugcuggggaucccugaguuguaaucacaucccaaucagauucacuguggggacag

SEQ ID NO: 4179246 - RNA, 80 nt, Human
cuguccuugcaaaguauuuuugucuagcgucucuaguuggauacaacagugauaucaagacagacaguuacugaggaugg

SEQ ID NO: 4179247 - RNA, 98 nt, Human
cugucuaacuagucccagugagaugagccacguaccucagguggaaauguagaaaucacccgccuucugugcuaaucucacugggagcugcagaccag

SEQ ID NO: 4179248 - RNA, 129 nt, Human
cugucucaacacucuggcuuagaauggugcuuggcacauagacgcucaauaagucuuggaugaaugaaugagugaauguguuugugagaugugagguacguucacggaggccgugguagugagagacag

SEQ ID NO: 4179249 - RNA, 87 nt, Human
cugucucacuuagccugggagauucaggugaaguuugugcacagacuugaaagaaaugcagaauuuccuaggguaggcaggagaugg

SEQ ID NO: 4179250 - RNA, 58 nt, Human
cugucuccuccacugcaugggagacucaucacggaagcuugcacagagaaggaggcag

SEQ ID NO: 4179251 - RNA, 78 nt, Human
cugucucucuuauagggcauguagugugcauagagacucggugucauaugcacacuaggugucaggaauaggugucag

SEQ ID NO: 4179252 - RNA, 56 nt, Human
cugucucugcuagauacuaguagcaaaccauauauuauaauuuagcaaguagacag

SEQ ID NO: 4179253 - RNA, 90 nt, Human
cugucucuguucuggauucuugaaauaugcugcuaaagagaagaggcaaggccccugccuuguuggagccuauguccuaggcugagacag

SEQ ID NO: 4179254 - RNA, 55 nt, Human
cugucucuuccuucccuucccagccugccaaucagcagggaaaaggaugauacag

SEQ ID NO: 4179255 - RNA, 55 nt, Human
cugucugccaauaaucuauggccacucccuucagucuggcugagaggcagcacag

SEQ ID NO: 4179256 - RNA, 81 nt, Human
cugucugguuuggucuugaaacugggccagggagauaagacucugcuuccuggcuuagguuuccagaacacucugguaugg

SEQ ID NO: 4179257 - RNA, 56 nt, Human
cugucuuccuagugugcauuggcaggggacccuaugaccagugcaagguaagauag

SEQ ID NO: 4179258 - RNA, 81 nt, Human
cugucuuccucuaccaaaaagugagccccagagauuugggucuguuuauucauucugcaucccuuuuugggccaaggacag

SEQ ID NO: 4179259 - RNA, 86 nt, Human
cugucuucuacucuacaacguuugugcauuuuauccccaaagaccagagaugucuuuggaaugcacagagguguagugacacgcag

SEQ ID NO: 4179260 - RNA, 79 nt, Human
cugucuucuguauuaaaggaguguauaauuguaguaguuuacugaaauggggacaguccuuagugguuguuuggagcag

SEQ ID NO: 4179261 - RNA, 78 nt, Human
cugucuugggaggcugucuguuagccugggaggcugucuguuuucccuucccagagcucccaauagcccccagcccag

SEQ ID NO: 4179262 - RNA, 59 nt, Human
cugucuuguuuccugaaaguagaguagcagauauuuuugagcucucaggcaagaagcag

SEQ ID NO: 4179263 - RNA, 83 nt, Human
cugucuuuuaaagggagagugcaaccgaaacaagcagggcauuauugauacugaucuuuaaaagugcaaauccagcuuggcag

SEQ ID NO: 4179264 - RNA, 126 nt, Human
cugugaagcaaucucucaguacuuaaagugggcuucauucuuaagaugccuaaauguaauauugggucaaaacacuggggaauguugguuaauauuuauugagugcucagaaugaauguguuguag

SEQ ID NO: 4179265 - RNA, 93 nt, Human
cugugaaugugagggcaaagaacucugcugaaguuguuggucuuuugucagaagaaggcuuuaaguacuggcauucuuuccucaugagcacag

SEQ ID NO: 4179266 - RNA, 57 nt, Human
cugugaauuuaaagcacacaucuuuaaaucuggagcuggguggaauggaauucacgg

SEQ ID NO: 4179267 - RNA, 79 nt, Human
cugugacacaugccuuaauuucccuguuuuguuucacuccaugagcauaagaccuagaaauuacaggcuauguaagcag

SEQ ID NO: 4179268 - RNA, 105 nt, Human
cugugacacuccauguguuccuuguauguacuuugugggcagaugggcuucauauguauuucaggaaguaagugagcccucagaguauggcaguggguggggcag

SEQ ID NO: 4179269 - RNA, 56 nt, Human
cugugacugcagcaccaaguaacuaggagugggcuggggacuuggcacagugacag

SEQ ID NO: 4179270 - RNA, 56 nt, Human
cugugacugggugacaguccucauucuuggcugaacacugacauaccugguuacag

SEQ ID NO: 4179271 - RNA, 65 nt, Human
cugugacuuuugcccuguaccagccagaggaaguaaauggcuagaguagggggugaggguggcag

SEQ ID NO: 4179272 - RNA, 117 nt, Human
cugugagaaauaaguuucuguuguuuauagccacacaguuuaugguauucuguuauagcaguuauagcagcccaaacagacuaagacaggcauauauacaaauaauuuuacuuacag

SEQ ID NO: 4179273 - RNA, 56 nt, Human
cugugagauaugcauaugcucucccuuucugcaaaggaggacaucaguacuuacag

SEQ ID NO: 4179274 - RNA, 90 nt, Human
cugugagguacuggaggagccccaacuuguuaaagcuccugcaugauugcagcuuggguuugacagcuuggggcugucccagcuacgcag

SEQ ID NO: 4179275 - RNA, 59 nt, Human
cugugagucuucagcaaguguuggggguaacacacccaaaacagugaaugaggccagag

SEQ ID NO: 4179276 - RNA, 67 nt, Human
cugugaucacaguuaugggccuuggucagucauuugauuucagcacacccaaauuguccauuuacag

SEQ ID NO: 4179277 - RNA, 61 nt, Human
cugugaugaaaccugagacgccaagggcaagaauucuuuugaagucucaguuuucucauag

SEQ ID NO: 4179278 - RNA, 80 nt, Human
cugugaugucuaguacauacaagaggcagcagugggaccaucaucagaugaacucuguguuuacuggacaucauucacag

SEQ ID NO: 4179279 - RNA, 75 nt, Human
cugugaugucucuguuuuugugguacuucucccucuugggguagaaauaaucagcuuaggggcagagaccuacag

SEQ ID NO: 4179280 - RNA, 72 nt, Human
cugugauucagaacaaaguuucucucuguguuuucagguauccaagacaaacauuguuaugauaaauuacag

SEQ ID NO: 4179281 - RNA, 89 nt, Human
cugugauucuccacugaaggauucaaaauggcaggucugcugcagagcuugccuugaggcugagucagauuucauuguguggauggcag

SEQ ID NO: 4179282 - RNA, 75 nt, Human
cugugcagggugggggcagugcuggugcccgcggugcaugugguucacaugaaggcugucuccuccuugcaccag

SEQ ID NO: 4179283 - RNA, 73 nt, Human
cucuugaaaaguuucuuacaggucauggguuggucucaaaccaaacaugucuuuagagaaacauuuauaagag

SEQ ID NO: 4179284 - RNA, 72 nt, Human
cucuugaacccaaaaggcggaguuugcagugagccgagauugcgccacuguacuccagccugggaaacagag

SEQ ID NO: 4179285 - RNA, 65 nt, Human
cucuugagcuuagguucaggauuggaguggaacucaacauacauacaguccacaagagccaagag

SEQ ID NO: 4179286 - RNA, 80 nt, Human
cucuugagucugggcuggccugugacuuuaaucagugcaaugcagaagugguucagugccaguucuaagacuacaaagag

SEQ ID NO: 4179287 - RNA, 70 nt, Human
cucuugccaaugguacaaacgauucucaacaaucucagaaugagagucuuuggggauaauugguggagag

SEQ ID NO: 4179288 - RNA, 58 nt, Human
cucuugcugggucaagcuggauugacuucauugaacagccagcugggucuugcaggag

SEQ ID NO: 4179289 - RNA, 65 nt, Human
cucuuggagucaauaagaucuagacaugagauuaaacauguagauugcuaauauuacuuuaaggg

SEQ ID NO: 4179290 - RNA, 63 nt, Human
cucuuguucccuucaaucaguucuucacuuaauagccauagaacuggcugggaacaccuagag

SEQ ID NO: 4179291 - RNA, 73 nt, Human
cucuuguugcccuggcuggagugcaguggcgugaucccagcucacugcaaccucugccuccuggguucaaggg

SEQ ID NO: 4179292 - RNA, 68 nt, Human
cucuuuaacuuucuggcuuuggggagagguaggcaacucuucuuugcagaaauagaaaggccgaagag

SEQ ID NO: 4179293 - RNA, 109 nt, Human
cucuuuaguacauugaaagaaagugcaacucagagaggugaagcuacucgucugucagcuugccagggagagguugaaaccucagugaugucggcacuucuuuaaggag

SEQ ID NO: 4179294 - RNA, 67 nt, Human
cucuuucaggucuggggcugaaaccugucuuguuuccccaucagaggcagucccaggcccgaaagag

SEQ ID NO: 4179295 - RNA, 80 nt, Human
cucuuucauucauucagaagugcuuucacacucuguuuuccuauagaaugggaaaguauauuuguauaugguuuugaggg

SEQ ID NO: 4179296 - RNA, 62 nt, Human
cucuuucccgucagcuucucagaggucugcauuuaccacuguaaagcgucacagggaccgag

SEQ ID NO: 4179297 - RNA, 63 nt, Human
cugccuuggagucuuuccauucugaaaaugccauaguggaaaaaacccagacucuagaggcag

SEQ ID NO: 4179298 - RNA, 59 nt, Human
cugccuugguuucuagcagggcugcucacugaacugggcugccugccaggggccagcag

SEQ ID NO: 4179299 - RNA, 103 nt, Human
cugccuuuccaccuugcucugcagauccagccuccaucccaccacuucucccccgagcagguaagagucagagugcuggggugcagagagguggggagggcgg

SEQ ID NO: 4179300 - RNA, 60 nt, Human
cugccuuuguccugagagccugggcugggcuccggggacugcagacucucaggcaggcag

SEQ ID NO: 4179301 - RNA, 62 nt, Human
cugccuuuuggggguggagggggugcuccuguugaagaguccuuuuccacuccucaaaacag

SEQ ID NO: 4179302 - RNA, 59 nt, Human
cugcgauuuaucucuuaggaagaccgaauuuuguaaaccuuccugcagguggcuugcag

SEQ ID NO: 4179303 - RNA, 69 nt, Human
cugcgauuugaacccuggccaguaauucuaagccaagcgggaugcugcuaucaggcuucgagucagcag

SEQ ID NO: 4179304 - RNA, 56 nt, Human
cugcgcccugccaauauggcuaauacugguuuauagaugaggccagcagggcucag

SEQ ID NO: 4179305 - RNA, 76 nt, Human
cugcgcuggggucaccucugaccugcuccuccucuucuggagcuuuugaacaucucagaagugacccugagcccag

SEQ ID NO: 4179306 - RNA, 83 nt, Human
cugcggaaucagacugggugcaccaaggcggagggccaugccgggcuucgcccuuccugggugucccggaguccguuccggag

SEQ ID NO: 4179307 - RNA, 57 nt, Human
cugcggaggcacagcuuacaggaccguaauggcccuggggaaggugucuccaaugag

SEQ ID NO: 4179308 - RNA, 130 nt, Human
cugcggcgugcuggcggccgccuuccuccggggcucgaccgccggggugcgaggagcgucuuugaguccccaagcucgcugcugcgccccgccuggcgcccccucccagcgggcggccuagcgcacgcgg

SEQ ID NO: 4179309 - RNA, 64 nt, Human
cugcgggaugacaguggccaacagagauuaagcaagaacuucugcggguugguggcauaugcag

SEQ ID NO: 4179310 - RNA, 64 nt, Human
cugcguggagacaugcaugaaugcaggucucucaaacgaggguccacaugguaugucagcgcag

SEQ ID NO: 4179311 - RNA, 82 nt, Human
cugcuaacaacagugagugcugggaggagugaggaagggaugucuucuccccaaccauggcacucacauguggugugggcag

SEQ ID NO: 4179312 - RNA, 93 nt, Human
cugcuaauuuuaaauuuucacuuuuuuuguguugaaggggagugauuuucauauaaccuuucaaugacacaaaagagaaacuagaguuuucag

SEQ ID NO: 4179313 - RNA, 100 nt, Human
cugcuaccccuuaguggagaggcagcagaguuugggagaugguauuaccuguccuuaucaucucagacucugcagucauucuguuuguuuggguuugcag

SEQ ID NO: 4179314 - RNA, 80 nt, Human
cugcuacuauuauuauccuaauuucuguuuuauagaugaagaaauucagguacacagggguuaaguaauuaugggagcag

SEQ ID NO: 4179315 - RNA, 83 nt, Human
cugcuacuuaauccauuuuaacuguuagugcaaggccgucccucuaaaaccuugcaaacuauugguagagaugggaauggcag

SEQ ID NO: 4179316 - RNA, 61 nt, Human
cugcuauaauuuaucaugucacaguucuggaggcuagaaguccaugaucaagauguggcag

SEQ ID NO: 4179317 - RNA, 70 nt, Human
cugcuaucauguggacuaauccauccuggccacccuacuccuggcugugggacuggaacuacuggugcag

SEQ ID NO: 4179318 - RNA, 57 nt, Human
cugcuauugauaaauuuggucuaguaggagauuaaggugacuaaauaauaauagcag

SEQ ID NO: 4179319 - RNA, 63 nt, Human
cugcucagagcuguugcugccccaccagacacuuggccaaggggccugcaccggucugcgcgg

SEQ ID NO: 4179320 - RNA, 72 nt, Human
cugcuccagccccuggugcacagggugaugagcaauuaaacagguuugcuuugugcuacugaguuggggugg

SEQ ID NO: 4179321 - RNA, 78 nt, Human
cugcucccaaugaccccucuccuuaagacucaggcacaagcccaugggaccugggccagaggacagucuggaaaguag

SEQ ID NO: 4179322 - RNA, 114 nt, Human
cugcuccuauuacccauccccucacuucacgcucugcagacaugagaauaauaaucuucacaagacuuuuugcugaguugaaguuugagguugugccuaacuacauagugacag

SEQ ID NO: 4179323 - RNA, 67 nt, Human
cugcucugacccuuucaccuuccacaaggcgguuuguuuucuuagcugggagggucagggaucccag

SEQ ID NO: 4179324 - RNA, 94 nt, Human
cugcucugccuucugugcucagcaguuguuucggauugggagucaggaggccauucccacacuugaaacaaggcugcaagaggaggcugagcag

SEQ ID NO: 4179325 - RNA, 60 nt, Human
cugcucuucccacucacucccaccucugugcugaggcuggggccaggcagggagaaucag

SEQ ID NO: 4179326 - RNA, 62 nt, Human
cugcucuugagggacugcggucuccggcucugcggagaacuuugcgcaguucccgggggcgg

SEQ ID NO: 4179327 - RNA, 101 nt, Human
cugcugaagucccaugggggcagcucccuuaguccuugccgggagauaacagguguuuccaguugcaugagggugcugaggcccccagugagaaccagggg

SEQ ID NO: 4179328 - RNA, 65 nt, Human
cugcugagagcugaaggcuguaguucagacaaaaccaagcccuacccuuucaccacccucagcag

SEQ ID NO: 4179329 - RNA, 58 nt, Human
cugcugauuacacagaagaacauugcuauuuacaugcaaauaucuuuguaaucagcag

SEQ ID NO: 4179330 - RNA, 57 nt, Human
cugcugcaaucuggcuuccaugugaaucagccucugagaagaagauuagauugccag

SEQ ID NO: 4179331 - RNA, 64 nt, Human
cugcugccauucuugccgcaugaagucagccaaauaaaacaaagcugauguaagaagaaagcag

SEQ ID NO: 4179332 - RNA, 64 nt, Human
cugcugccuaguccaagacgugccuacacuaccaucauauuauacucuuguuccugggcugcag

SEQ ID NO: 4179333 - RNA, 79 nt, Human
cugcugccucaugacccggaccuggccuaucgccucgcgcugcgagcuaugaggugaggauagguggccaaggcagugg

SEQ ID NO: 4179334 - RNA, 130 nt, Human
cugcugccucugcacuugcaggggugauggugaugaucaaauaagauaauauaugugaaggccccaggaaaugggggauguuauucaauuugaauccaaccaacacucagugaggccuccugaggucaag

SEQ ID NO: 4179335 - RNA, 73 nt, Human
cugcugcuguaacucaguuggggaccucgccucaggggaggggaaggcucuggggauugagauaaaagggcag

SEQ ID NO: 4179336 - RNA, 90 nt, Human
cugcuggagcagagggcauggccauuuaagcuuuuggucaacacagugugaugggccugccugaaggcuguaccaguugacucccagcag

SEQ ID NO: 4179337 - RNA, 69 nt, Human
cugcuggaggauuaaacaagucagccucuccacuaauugagcuuugacuucauuggucuuuucuagcag

SEQ ID NO: 4179338 - RNA, 93 nt, Human
cugcuggaugaggaguucuuuccugcugccugauguucuggauccugagcccacacccaggcccuggcagggcugagucuccucucccugcag

SEQ ID NO: 4179339 - RNA, 68 nt, Human
cugcuggcaaauaaacagaucuucgggaaacuguacuugucuuccagagaaaagguuuauuucaguag

SEQ ID NO: 4179340 - RNA, 59 nt, Human
cugcuggccugaccagccacaggcugugaaaagccugcuggauguggccaggccauuag

SEQ ID NO: 4179341 - RNA, 67 nt, Human
cugcuggcgaggccaggccagggccuuagaaguggcuuucaagagguccucuccugccugccggcag

SEQ ID NO: 4179342 - RNA, 56 nt, Human
cugcuggcuagauaaaaccagccaaggccuccuuggcucaccugucuacccagaag

SEQ ID NO: 4179343 - RNA, 97 nt, Human
cugcugggccagcauccgauugccagccagaaacgucacacugcccaggauggccagguacuucaaggucuggaacauguugagcugaguccaguag

SEQ ID NO: 4179344 - RNA, 128 nt, Human
cugcuggggcacacuaaggccuuucuuccucuuucccuggaugucuuggcuugcucucugugacucagggaaggacagagaggcuaggccaggggacagaggcugcaggggccuguccagauaggcag

SEQ ID NO: 4179345 - RNA, 74 nt, Human
cugcuggggucauggggcgcccgaggcugaagucgggggauggguuggugggggccgcgugcacccuuagucgg

SEQ ID NO: 4179346 - RNA, 64 nt, Human
cugcugguccugagaauccuguccucuacugagagaggccacagugucugggggccaucagcag

SEQ ID NO: 4179347 - RNA, 111 nt, Human
cugcuguagaggaagaaggagccgucggaguccagcacgggaggcguggucuuguaguuguucuccggcugcccauugcucucccacuccacggcgaugucgcugggguag

SEQ ID NO: 4179348 - RNA, 69 nt, Human
cugugcaguaaauuuggauaauggauuacaguuguauuuucauuccuuaacauucauuugcuugcauag

SEQ ID NO: 4179349 - RNA, 67 nt, Human
cugugcaugucaauuauguucucuggccaaaagccuugcugcacaguaaacaugacuggaggcacag

SEQ ID NO: 4179350 - RNA, 57 nt, Human
cugugcauguguucucugguaaugacagccaccgucuucacagggaugcaggcauag

SEQ ID NO: 4179351 - RNA, 71 nt, Human
cugugcauugucuugucuguagugccaauuuuuaugguucgaugguguauuuacagacaugacaauaaugg

SEQ ID NO: 4179352 - RNA, 60 nt, Human
cugugccagagggugaccaagggauguucagggacugauuggcacccacuuuuggcucag

SEQ ID NO: 4179353 - RNA, 57 nt, Human
cugugccccuccuauauucauuauaaaguuuuacauugaagauggguagaggcacag

SEQ ID NO: 4179354 - RNA, 80 nt, Human
cugugccuccagccgcuugcuugggaguggggagggugcugguggggcugcccgcaccauccccgggcucuggcgcacag

SEQ ID NO: 4179355 - RNA, 67 nt, Human
cugugccuccagucauguuuacugugcagcaaggcuuuuggccagagaacauaauugacaugcacag

SEQ ID NO: 4179356 - RNA, 84 nt, Human
cugugccuuuuuguguuagagcacaauuauuuuauaaagaucaugaaauggcuacaagaugugcucugagaacuaagcguucgg

SEQ ID NO: 4179357 - RNA, 89 nt, Human
cugugcgacuuuggaagaguuguuuaaccucucugauuuucagcaucuucagggauaauaauaauaauaauacuucguaaaguuguuag

SEQ ID NO: 4179358 - RNA, 74 nt, Human
cugugcugacaauggaacuguuguagguaaagucauuuucagauuaaauacaacaauuuccacauuagaaucag

SEQ ID NO: 4179359 - RNA, 100 nt, Human
cugugcugagagagggugcugcugugaggacaggauguacuggauggcccugaguucagugcuccagucccuugccuccacagcccccacaccagcucag

SEQ ID NO: 4179360 - RNA, 62 nt, Human
cugugcugauuccauuuucucacugggaaaacaguagcgggaaagagaggaguugugcauag

SEQ ID NO: 4179361 - RNA, 60 nt, Human
cugugcugggcccugagacuaaaaagcucagcauuugagccccucauggugucuagacag

SEQ ID NO: 4179362 - RNA, 96 nt, Human
cugugcuuuuaauuuaugcauuuuuccuccuaaugcauguagauaauauauaccaaauucauagacuuaggaaugaagaaguaugauauaacacag

SEQ ID NO: 4179363 - RNA, 57 nt, Human
cuguggagaugcagaccaggccaguaacauuuuggccagcuuuggucugucuccuag

SEQ ID NO: 4179364 - RNA, 91 nt, Human
cuguggaggcaggaggccucucccucacacccuugcccagacuggggaccgucugcggcaguguccagggcuguggcucucaccucugcgg

SEQ ID NO: 4179365 - RNA, 55 nt, Human
cuguggagggaguacuagaaguuccuaccaggauuagugcuaaauacucccacag

SEQ ID NO: 4179366 - RNA, 95 nt, Human
cuguggaggugcagcuucauaaacaguguacuccuuuaccggaggcugaguuguuucaccucugcggggguagauugugagguucacucuaacag

SEQ ID NO: 4179367 - RNA, 76 nt, Human
cuguggcaccuaauauuuaccuuuguagugucccuuucucauuagcaacauggugaauauguguaggaguaaacag

SEQ ID NO: 4179368 - RNA, 61 nt, Human
cuguggcaggaagggacuagcaauugguuuuuuccaugagcaguccuuuguccugggacag

SEQ ID NO: 4179369 - RNA, 69 nt, Human
cuguggcagucagguauguugcucaaaucuucaggcuaaccuacugugaggagcauagcugacugacag

SEQ ID NO: 4179370 - RNA, 62 nt, Human
cuguggcucucagaggcugcuguuuacccucaggugcauucuuggccucugagaugccacgg

SEQ ID NO: 4179371 - RNA, 107 nt, Human
ccucagcucucagcugugaacaugcacagacccaaaggccauccaugugcgugugcuucuccacauauccaagaggccuugggaugugccacgggcagugacugagg

SEQ ID NO: 4179372 - RNA, 84 nt, Human
ccucaggaagucccugguuccuagcaaaaaguccauuagcucaggcuuaaugcuauccuaaagccaguggccuucuuuaugagg

SEQ ID NO: 4179373 - RNA, 56 nt, Human
ccucaggcuucuaguucagugaggcuuccauuaugccaaacugacugugcuuaagg

SEQ ID NO: 4179374 - RNA, 82 nt, Human
ccucagggaaagagaacuuucuguguuuuuaucuccacccccaguggaaggauauguugaguagaguuuuugcuuuuugagg

SEQ ID NO: 4179375 - RNA, 80 nt, Human
ccucagucucccaaguagcuagaaauacaggcacgugccaccacuccuggcuaauuuuuguauuuuuaguagagacgggg

SEQ ID NO: 4179376 - RNA, 63 nt, Human
ccucauacccugaagggaguugccauggugacugugggacugugaccuccaggguagcucagg

SEQ ID NO: 4179377 - RNA, 75 nt, Human
ccucauauugauuaccuuauuaccuuaucugguugaugauaacagguaaggcaauaguaaggagucccucagagg

SEQ ID NO: 4179378 - RNA, 57 nt, Human
ccucaucgccuucaucaucuacgaguuuguccugggagauuguauggaggugagagg

SEQ ID NO: 4179379 - RNA, 89 nt, Human
ccucaucuggcuuguauuuuggagaacuggcaggaaaauaagggaauagagcuauuuaaagauccaggagugcugguuagaguauaagg

SEQ ID NO: 4179380 - RNA, 81 nt, Human
ccucaugguauguugaucauagguaaaagacggccauguuaggaccaagucucagggaccaugaugaugacuccauguagg

SEQ ID NO: 4179381 - RNA, 100 nt, Human
ccucauguagcacugagugcagaggaacucaggaaauucuuuuuaacagaauggcugcaggcuauagaauuucagacuggggccagugcacuaaaugagg

SEQ ID NO: 4179382 - RNA, 78 nt, Human
ccucauguaugccuuauacuaccccauagguuuugacucuggcagaacaggacacagaauaaggcaguuuuauggagg

SEQ ID NO: 4179383 - RNA, 56 nt, Human
ccucauuguaguuaugguugagguuuucuucuaguccuagaaacuacaugaugagg

SEQ ID NO: 4179384 - RNA, 55 nt, Human
ccucauuuccagucuuucuggagcaccggaggcagacugugcgggaagagugagg

SEQ ID NO: 4179385 - RNA, 61 nt, Human
ccuccaaggccuaugcacaccuaggaacauccccuguccaggcuggacaugaggcgggagg

SEQ ID NO: 4179386 - RNA, 83 nt, Human
ccuccacaacuccgccucccagcaguaaccaguggaaauggggcagcacucucagcucugcuacucuguggggugcagugagg

SEQ ID NO: 4179387 - RNA, 55 nt, Human
ccuccacaggggaaacagugugaguuuuuguaauguugcuacucucccugggagg

SEQ ID NO: 4179388 - RNA, 83 nt, Human
ccuccacccucccugcacagccgagccaugcacacaauuacugcugacguacuucaggcugcugcuuggggagagaggggagg

SEQ ID NO: 4179389 - RNA, 89 nt, Human
ccuccacggauuuuguuuugacagaauguuacauauagagauacaaauauuuuuaaaaguuaucaucuguccaacaguuuuuuuggggg

SEQ ID NO: 4179390 - RNA, 79 nt, Human
ccuccacugcucugccaggagcuggaaagaugagcagcccggcuuugugccagcucuuuuggcugagugagaguggugg

SEQ ID NO: 4179391 - RNA, 86 nt, Human
ccuccagaaaggauucccuggugccauccagcaggaaacagaaccaagggcugcaggcuggcacccuuggggauaggaagcugagg

SEQ ID NO: 4179392 - RNA, 86 nt, Human
ccuccagguuucugucuuggguggcuggguggacagucgugccaucacugauccagagacccaaggacagaagugacuuugggagg

SEQ ID NO: 4179393 - RNA, 85 nt, Human
ccuccagugugugcucucgugugguuucaaguaggggcuacuuucaugcccauuuuguaaauacagaagcugagacacugagagg

SEQ ID NO: 4179394 - RNA, 79 nt, Human
ccuccauagaaagagcugguccauuggcacugcucagaaggccugagucagcagaaucggaaccaggucuugguagagg

SEQ ID NO: 4179395 - RNA, 66 nt, Human
ccuccaucaccaucugcccucaccccaagcgcauuccaaggugacggugcacucgguaauggcagg

SEQ ID NO: 4179396 - RNA, 70 nt, Human
ccuccaugucugauuaugaaaaaucccugaucucaucuuugauuccauuucuucaggucagaaauagagg

SEQ ID NO: 4179397 - RNA, 87 nt, Human
ccuccauuauuauauuaaacccucucuguagggccuaaguggacacuguaacugagcaccauugagaugguuaugaauucagggagg

SEQ ID NO: 4179398 - RNA, 115 nt, Human
ccucccaaaggguugggauaacagggcugagccacugcgccuggcugagguucucauuaaaagaaaauaggccaggugcgguggcucacaccuguaaucccagcacuuugggagg

SEQ ID NO: 4179399 - RNA, 69 nt, Human
ccucccacuucuugcugaggucaaaggccugcgucaguugcacuguagccucggcagugaaccgggagg

SEQ ID NO: 4179400 - RNA, 56 nt, Human
ccucccaugcuuucccaaccucugagucuacaaugagcagcugggcaacauggagg

SEQ ID NO: 4179401 - RNA, 55 nt, Human
ccuccccacaggccaaauaggcaagacugcagccauccguugcccugaggggagg

SEQ ID NO: 4179402 - RNA, 56 nt, Human
ccuccccagcuacagggcacggggcuuuccaggguccagaacccaggcuggggugg

SEQ ID NO: 4179403 - RNA, 72 nt, Human
ccuccccaguuuccugggucccacagccucuugcuuaaggcugccugaacuuuggggaaacagaggaggagg

SEQ ID NO: 4179404 - RNA, 110 nt, Human
ccuccccgacccaggaaauauaggggucuccccauucugggucuggcucagggacugugugucccugacugcccuccaugaaggaggccgcccuugggucugccgggagg

SEQ ID NO: 4179405 - RNA, 74 nt, Human
ccuccccggccccuguccucgugggcacugcaggaucucauuucugccccugcugggcacagaggcuugguggg

SEQ ID NO: 4179406 - RNA, 84 nt, Human
ccuccccugagucagggucagugaugagggagccccaguggcugagagcuaugcagaugggcucucgauuagacccuggggugg

SEQ ID NO: 4179407 - RNA, 74 nt, Human
ccucccgggucuggaucccaccgccacacacgggucccgucacaugccaguggggauccugcugcucgaggagg

SEQ ID NO: 4179408 - RNA, 82 nt, Human
ccucccugugcagaaggggugacaucaguaaccgugguugacaacggagccuaggguucugaugucacuucugcccgggugg

SEQ ID NO: 4179409 - RNA, 103 nt, Human
ccuccgcugucguugcaaauugcaagaguuggaucaucuguaaacuaaacagagaaggaauuuauuuucuuguacauuuuuaaacagucaaguauuaaggagg

SEQ ID NO: 4179410 - RNA, 62 nt, Human
ccuccuaucacugcccucacagcugggaccuacaagggcccacuucaugggcaggaaggagg

SEQ ID NO: 4179411 - RNA, 108 nt, Human
ccuccucauaaaagaguuaacaaagcuggccugagaaugcuacccuuugauaggccugcauggaagguuggccuuuggcuagaaucugggaacuuagauuuggggagg

SEQ ID NO: 4179412 - RNA, 95 nt, Human
ccuccuccacccaacuccagcaggugcgucucagagcuaaucccaugcacacgagucaccugagacggggcuuguugaacgcuugggggaggcgg

SEQ ID NO: 4179413 - RNA, 84 nt, Human
ccuccuccuguggccacaucuucacugguuucuggaauccaaccuggggccuuccugaagccaagugagaaacucaggacaagg

SEQ ID NO: 4179414 - RNA, 67 nt, Human
ccuccucuacuacugcaggaguuucuuguuugccaggacagggcuauauuccucagaguugaggagg

SEQ ID NO: 4179415 - RNA, 83 nt, Human
ccuccucugcagggcagugugucuguggggcaguuugcuucuguccuguuucugggaugggccuacacugcccuccagggagg

SEQ ID NO: 4179416 - RNA, 62 nt, Human
ccuccucugcuguuuuguauacaggcuucuauggaggucugcuaugugaacuguagggaagg

SEQ ID NO: 4179417 - RNA, 58 nt, Human
ccuccugcagcuuucgcuccaucagcagcagcuggggagggagaggcgcagguguagg

SEQ ID NO: 4179418 - RNA, 67 nt, Human
ccuccugcccuugcauagaucuuggcaaugguugcuguuucagugccaauuuaguaaaggcaguggg

SEQ ID NO: 4179419 - RNA, 56 nt, Human
ccuccuggaggcuccaagggagaauccauuuccuggccuuucccagcuucuagagg

SEQ ID NO: 4179420 - RNA, 64 nt, Human
ccuccuguugucaccaggcguggaugcccgcaucaugaaauucaugccugggaaggcguggagg

SEQ ID NO: 4179421 - RNA, 68 nt, Human
ccuccuucaguuagaguuuacaaaguugugugguuuugauucauuaauggcuugcuuuaugaaggggg

SEQ ID NO: 4179422 - RNA, 66 nt, Human
ccuccuucauuauaaagucugggccaggcaugguggcucacaccuguaaucccagacuuugggagg

SEQ ID NO: 4179423 - RNA, 118 nt, Human
ccuccuuccuacugcuggggcaguaccaggacuacuguccauggugcuggacggucucaccacuguccauggugcuggacggucucacccuggucccccagacucaggcggucggagg

SEQ ID NO: 4179424 - RNA, 61 nt, Human
ccuccuucucuuuuugcagagcauguguauaguuucaagcucuguggaagaagaaagaagg

SEQ ID NO: 4179425 - RNA, 80 nt, Human
ccuccuuucagacaggugacuugcauuuucacacucucugagcugaguguauaugcagcuuauaguaauugggaaagagg

SEQ ID NO: 4179426 - RNA, 59 nt, Human
ccuccuuuccuguuuuccugagugaucccuccccacuggggaagagaagagaaaggagg

SEQ ID NO: 4179427 - RNA, 62 nt, Human
ccuccuuucuuuacuggagacagaagggagauauauucuuccacuccaaguuaagagggagg

SEQ ID NO: 4179428 - RNA, 57 nt, Human
ccagucauucauuuggagcuuugagcuuggugcuccagagugacaaaugacugaugg

SEQ ID NO: 4179429 - RNA, 64 nt, Human
ccagucuggcaggagggggaaccaugcuggagugugcaugggagguuuucacagccaggccugg

SEQ ID NO: 4179430 - RNA, 56 nt, Human
ccagucugugugccagccugcgagccugcccaggggaugggauggccaaagacugg

SEQ ID NO: 4179431 - RNA, 94 nt, Human
ccagugaacaaggcucccuggcucugcacccucaucagucaaaugggggaaaccucauggcaguggggugaggauucagugagaggcacacugg

SEQ ID NO: 4179432 - RNA, 71 nt, Human
ccagugacagccccaagguggccagcagggacuugacccugagcucaggcccuuggggaaaaugcugcugg

SEQ ID NO: 4179433 - RNA, 87 nt, Human
ccagugauggcuagaucuguguggccagugugucucuguggaagccagggugaccaggccaacagcuaaguuaaugccaaucucugg

SEQ ID NO: 4179434 - RNA, 65 nt, Human
ccagugcagccugucgccaguggauccguggaaauuauauguucucuggcaagggcuguccaugg

SEQ ID NO: 4179435 - RNA, 90 nt, Human
ccagugcaggggcuucuaagugcaguuaaguuuagauuugguuuuaaagaagggacagacugccucuggacugcagcccugaaaaacugg

SEQ ID NO: 4179436 - RNA, 56 nt, Human
ccagugcagucccccugaacuggcacaaauugggcccuggcuucagggugcacugg

SEQ ID NO: 4179437 - RNA, 55 nt, Human
ccagugcuucuuugcuagcuggcuucuguuuaguuugguuaguaagcaucacugg

SEQ ID NO: 4179438 - RNA, 55 nt, Human
ccaguggaaauguggucaggaucuuugugugguuuucuccauacccauucacugg

SEQ ID NO: 4179439 - RNA, 56 nt, Human
ccaguggcagaucaccaacuggaggcaggaagaaacucuuagggagcuguaacugg

SEQ ID NO: 4179440 - RNA, 65 nt, Human
ccaguggccaugcacgagcagcaacuucuugagaugcuuaaagcgggugauggcaaagucgcugg

SEQ ID NO: 4179441 - RNA, 104 nt, Human
ccaguggccuccuuuaaauugcauuuguaucauauguaucuuagagaauuguggaucuuuugguaaauaaaguauaggaaauggaaucugaagggacacgcugg

SEQ ID NO: 4179442 - RNA, 91 nt, Human
ccaguggguaggggcuccucucugagaguagagaccaccagaccacaagucuacuuccagggguggggcucaggucagcugcuagcacugg

SEQ ID NO: 4179443 - RNA, 77 nt, Human
ccagugguuugcagccuuccuugcagacaaccaggcucccugaggggccucugcccagggcagggcuugcaggcugg

SEQ ID NO: 4179444 - RNA, 90 nt, Human
ccaguguaaauguuuuccaguucuucuguaagcacuuuauucuaugaauuagugaacaguuuggaacacauggcagaaucuguacacugg

SEQ ID NO: 4179445 - RNA, 60 nt, Human
cccagaaggcuaagcguggauuucugguuaucagcuuccgugugucagcuuucggcuggg

SEQ ID NO: 4179446 - RNA, 88 nt, Human
cccagaaguuauuaaaggaugaggcuggacacuucuugaugaggucccuuaaucucuaagagaccuucaguauucacuucauaacggg

SEQ ID NO: 4179447 - RNA, 74 nt, Human
cccagacacagcuugcucugccaaauuugccaguucccccaggaaaugggaaguaggacagugcaguugauggg

SEQ ID NO: 4179448 - RNA, 59 nt, Human
cccagagaauuccacauagaggcaaugguaauugacuucuuuuugccaaguuuacuggg

SEQ ID NO: 4179449 - RNA, 68 nt, Human
cccagagccuuuguguccacauuucagaaugaaccaugagaagcaggacagagaggacucuaaauggg

SEQ ID NO: 4179450 - RNA, 73 nt, Human
cccagagcuggucaauguuuucaacuccaaaaagguauuccauuuugguagaaucaacaauguacguuuaggg

SEQ ID NO: 4179451 - RNA, 56 nt, Human
cccagaguucaaacccugcgucaagggagcacuguagauggagucugaggucuggg

SEQ ID NO: 4179452 - RNA, 73 nt, Human
cccagaucugaggcccugcaggcagugugggacagugcagugagccaugugccuuugggucagagggucuggg

SEQ ID NO: 4179453 - RNA, 61 nt, Human
cccagaugagaauaugauuuacuauugcuuuucugguaauauuaucauauguuuauguggg

SEQ ID NO: 4179454 - RNA, 63 nt, Human
cccagaugucaacuuuaagaucuacucugccugacacagcuguggucuucaaguugccuuggg

SEQ ID NO: 4179455 - RNA, 129 nt, Human
cccagaugucagaugaugagugugauuguuuuaguggcucagacaugcccugugagaguuauuaugacuguacagcagacaaacagaaacaggcugcugagccauuugcugggucauccuuguccuggg

SEQ ID NO: 4179456 - RNA, 72 nt, Human
cccagccaaugaacuucagugauuucuggccauaaggcccaauggugagacuuucucugaagucgggauggg

SEQ ID NO: 4179457 - RNA, 73 nt, Human
cccagcccaaagggcucugagugccggacacugagccgcuguccuggggacaagaggcccuugggaagaaggg

SEQ ID NO: 4179458 - RNA, 59 nt, Human
cccagcccuuccuucuguuuauacauggugcaaaugacuaauguaagggagaggcaggg

SEQ ID NO: 4179459 - RNA, 59 nt, Human
cccagccgccaguuccuucccugggccacuguguucuggucccugagagcuggggaggg

SEQ ID NO: 4179460 - RNA, 77 nt, Human
cccagccuaccucaucuucugggauaaucagguggggguacacaugaaugaccuuugaggauggaaauugguuuggg

SEQ ID NO: 4179461 - RNA, 64 nt, Human
cccagccuccuccagcucugagucacaaagacccagggcugacagugaggagucaagcaaaggg

SEQ ID NO: 4179462 - RNA, 88 nt, Human
cccagccucgcccagccagaguggcgacccccucagcugcagcccuggggcugugggggugucgcuuccugggagcggaccggcuggg

SEQ ID NO: 4179463 - RNA, 63 nt, Human
cccagccucuggguucugccggccaggcucguggccccguccucggcaccccagguuccuggg

SEQ ID NO: 4179464 - RNA, 97 nt, Human
cccagccuuuagucacugaaaugggagggaaguguacaguggcguuuuggcccagcugggcucuuuaccccuguacgguguuuacugaacagcuggg

SEQ ID NO: 4179465 - RNA, 122 nt, Human
cccagcuccugccuaggaaagccuuaguguugggagggacccugaugacugaggagccugguagcuccaggucgcccacacuuucaggucucuugcaccagaagguggcaggauccauuggg

SEQ ID NO: 4179466 - RNA, 129 nt, Human
cccagcucugccaugcucuuccugugacaccuuuggaaaauguuacaucucucuagagcucaguuugagcauucauugcuagaauguaauauagguuaggggcauagacuuuagagccagauagcuggg

SEQ ID NO: 4179467 - RNA, 85 nt, Human
cccagcuggcagaugcacagggcugugguagcugugggcagcccgguugccaaaugccaccacagcugcgucacugagagcuggg

SEQ ID NO: 4179468 - RNA, 72 nt, Human
cccagcuggccagcccuccucccuggguucuucccugggaggcgaaauggagaggggagggcugguccuggg

SEQ ID NO: 4179469 - RNA, 106 nt, Human
cccagcuugcccuggcggccccagcagcccuuguagugaccguggcgugugcauggacggcaugaguggcagugggcagugucugugccguucagguuuugcuggg

SEQ ID NO: 4179470 - RNA, 61 nt, Human
cccaggaaaaagagaaacaugguguccguuuucacauguaccauauacuuucuuuccuggg

SEQ ID NO: 4179471 - RNA, 61 nt, Human
cccaggaaagaaaguauaugguacaugugaaaacggacaccauguuucucuuuuuccuggg

SEQ ID NO: 4179472 - RNA, 55 nt, Human
cccaggaaagugaaucuaauuggcuagauucagccaauggagugcaucuccuggg

SEQ ID NO: 4179473 - RNA, 66 nt, Human
cccaggaacgccugguguuggccuggcuaaacucuuggacgaaaaggucugcacaggcuccgaggg

SEQ ID NO: 4179474 - RNA, 130 nt, Human
cccaggacagcaccugccugcccaggauguuacugcccuucccaguggacccuagacuugcugcuggaaucuagcuggagaguuuccaggaaggagggugcucugcaagcaggcucaggcauggacuugg

SEQ ID NO: 4179475 - RNA, 103 nt, Human
cccaggacgguguuuuaggguuaccagucuuguugccaugucugugccccugugcagcgcugugggaacagggcuaugucuggucaccccagcaucccuaggg

SEQ ID NO: 4179476 - RNA, 65 nt, Human
cccaggagaaggcgugccuuccuauuccugcuacacugagagguuggcugagggcagccccuggg

SEQ ID NO: 4179477 - RNA, 55 nt, Human
cccaggagaugcacuccauuggcugaaucuagccaauuagauucacuuuccuggg

SEQ ID NO: 4179478 - RNA, 56 nt, Human
cccaggaggcagagguugcagugagccaagaucacgccacuucacuccugccuggg

SEQ ID NO: 4179479 - RNA, 76 nt, Human
cccaggaucauacauuacaggaaagauaaagaugaacaacaaauaucuugguuucugcugauuguaauuuucuggg

SEQ ID NO: 4179480 - RNA, 64 nt, Human
cccaggaucugcccaggccuuuggaggccagaccucccugauggcacaguggcaggcaucuggg

SEQ ID NO: 4179481 - RNA, 97 nt, Human
cccaggaugaggacccagcuauaucuuccugcaacaccuguguugccaguuuauuggcagccucugcaguucaggaggaccuagcuugucccuuggg

SEQ ID NO: 4179482 - RNA, 88 nt, Human
cccaggauuuuauugcugguaaacuugguuaucuaccuuccggucacgugguccaggaugguggcaugaucagaacuagguccugugg

SEQ ID NO: 4179483 - RNA, 61 nt, Human
cccaggcacucuuggucauuuuccugccauggaaucuuccgaccaaugagugaagccuggg

SEQ ID NO: 4179484 - RNA, 60 nt, Human
cccaggcaggcgauggugcaguggcaccaucucagcucacugcaaucucugccuccuggg

SEQ ID NO: 4179485 - RNA, 123 nt, Human
cccaggccaaugaaaaaauccagcuuuguauuccccauucacccucaagcccaaucaaacugaaucgagauguggcaggugugagcuguaaaggaacagacccuggugcccagcuggucuggg

SEQ ID NO: 4179486 - RNA, 65 nt, Human
cccaggccuugacauaaugaaggagcuuaauaaauagacaagagccaaguugucaaggcacuggg

SEQ ID NO: 4179487 - RNA, 77 nt, Human
cccaggcgaccucaaggcaguucacucacgcagccagcccucagagacgugggcugcgugucugcugcccgccuggg

SEQ ID NO: 4179488 - RNA, 56 nt, Human
cccaggcuagagugcaguggcgcgaucuugauucacugcaagcucugccuuccggg

SEQ ID NO: 4179489 - RNA, 56 nt, Human
cccaggcugaugggaugggccaucccacugcuggugguccugguggucaggcuggg

SEQ ID NO: 4179490 - RNA, 55 nt, Human
cccaggcuggagugcaauggugcgaucucggcucgcugcaaccuccgcgucuggg

SEQ ID NO: 4179491 - RNA, 56 nt, Human
cccaggcuggagugcaguggcacgaucucgccucacugcaagcucugccuuccggg

SEQ ID NO: 4179492 - RNA, 56 nt, Human
cccaggcuggagugcaguggcauggucucgguucacugcaaccuccaccucccggg

SEQ ID NO: 4179493 - RNA, 57 nt, Human
ccauccucccugcucccuaccugggccagcugucagagucaggaugcaaggggaugg

SEQ ID NO: 4179494 - RNA, 128 nt, Human
ccauccugagagagcugaguucaggcggagacagaccgcaagcucaaagcugaagcaggaaaggaugcgaauggcucugggaaugggaagaugcucugugugguggcauucggagguucucaggaggg

SEQ ID NO: 4179495 - RNA, 97 nt, Human
ccauccugaggggacggaaaugguuucaccugaaggaggccagcuuuuuaacuggccuuuuucccuggagggacagccagccaguccaggagggugg

SEQ ID NO: 4179496 - RNA, 65 nt, Human
ccauccuuagguggugcaucagggcauuuaugucccauaugcacugauguguccccaaagccugg

SEQ ID NO: 4179497 - RNA, 81 nt, Human
ccaucgaaggcuuuaggcaggugaaugauggacuaggauuguauuuuaggaagauuauucacaugagaagcugaacaaugg

SEQ ID NO: 4179498 - RNA, 62 nt, Human
ccaucucaucagaucuguauaagcagcuauaauuuaagccaggccagaguuaugaugagagg

SEQ ID NO: 4179499 - RNA, 129 nt, Human
ccaucuccaacaaugugcccaccugaccaccaaccaguucugcccccagcuccucagcccugccuugggugcuuugacccaggagguggaggggccagaggugucagcacauagugaccuagaagagag

SEQ ID NO: 4179500 - RNA, 68 nt, Human
ccaucuccaguuuauucuuccuuagcauuuggggcuccuucccccucaggacgggucccugggagugg

SEQ ID NO: 4179501 - RNA, 65 nt, Human
ccaucugcuggcccugggcuggaugagcgagcaggaagcagcagccagcucugggcaggucgagg

SEQ ID NO: 4179502 - RNA, 73 nt, Human
ccaucugcuuggcagaaaaggucggggguuugcaaagggaguagccucugguccuuuuuucccuuaggcgugg

SEQ ID NO: 4179503 - RNA, 78 nt, Human
ccaucugugggcuucaacacagucaguuccuggaucaacaaacauuuauucagcaccugcuguguuccaggcauaugg

SEQ ID NO: 4179504 - RNA, 76 nt, Human
ccaucuucccccaaaucaagagaccucuaugcaccaguuaaauaaaauuuggauucucucauuggggugaaggagg

SEQ ID NO: 4179505 - RNA, 64 nt, Human
ccaucuugcuggguuuuaucauaucaggguuguuaagauacaguauauaaagcccucaggaugg

SEQ ID NO: 4179506 - RNA, 61 nt, Human
ccaucuugugccuuuuaggagaaagggaccauuucccagguccugcaggaggccugagagg

SEQ ID NO: 4179507 - RNA, 55 nt, Human
ccaugaaaaaacaugcccuggguagcugcaguuccaggaugaugauaauucaugg

SEQ ID NO: 4179508 - RNA, 65 nt, Human
ccaugaacugcaguauaaacuugggcccagggagacuggcuccgauuuauucugacaguuuaugg

SEQ ID NO: 4179509 - RNA, 62 nt, Human
ccaugaagaauaggagaaaaguucuguaaaugaggacagaaauaacuuuuuauguuuuaugg

SEQ ID NO: 4179510 - RNA, 99 nt, Human
ccaugaauagcuguugaauggaugagugaaggagugaauguuuagucuuucccuaggcucugccaauuccuuccucuccacccacucaccucccaaagg

SEQ ID NO: 4179511 - RNA, 56 nt, Human
ccaugaauccuggcacuuaggaggaggauuagcaccucugguccaggucuucaugg

SEQ ID NO: 4179512 - RNA, 89 nt, Human
ccaugaggguaaguaccguuaaucccauaauauggaugaggaaacugauucauuuagagggauuaagcaauuugcccaauaccacaugg

SEQ ID NO: 4179513 - RNA, 79 nt, Human
ccaugaucagaugguggcaagagccaagucuucucacauaaagagaaaucacauugaaucugcuaccuacgaccacugg

SEQ ID NO: 4179514 - RNA, 65 nt, Human
ccaugauggaagggacagaagggcaagagaacucucucucuucaaccuugagcccuuuuauaagg

SEQ ID NO: 4179515 - RNA, 87 nt, Human
ccaugauuuuaaaaaugagggagcuuagggaaugaggaaagaccaaaacuauagucuaagcccuucauuuauaguuggaaucugagg

SEQ ID NO: 4179516 - RNA, 60 nt, Human
ccaugcagggugcuaacacugugacaucauuaacugauaucauuucagcucucugccugg

SEQ ID NO: 4179517 - RNA, 94 nt, Human
ccaugccuaucagguccaccauuauaucucccaugccuaacauagggccuggcauguggcuauauaauguugaaagaaaugaccuacuggaugg

SEQ ID NO: 4179518 - RNA, 63 nt, Human
ccaugccugcucugacauccaucccagaccaaagagucuaggggcuggcagaggcagcugugg

SEQ ID NO: 4179519 - RNA, 62 nt, Human
ccugagcuccccuagugcuuaugggauaccgaaaaaccuuucagcaaggcuggagcuuaugg

SEQ ID NO: 4179520 - RNA, 72 nt, Human
ccugagcugcagacaggcaggugcugcuuugcugucacuggugcaggcagcucgaugccuuguugaggcugg

SEQ ID NO: 4179521 - RNA, 76 nt, Human
ccugagcuuggucuauaggagagauuguaaugggugaagaaauaugucacaaugcucccuguagucaggauucagg

SEQ ID NO: 4179522 - RNA, 66 nt, Human
ccugaggaagaaggaaugaugauaaauauuuccacuggguaucauuauccuccuauuugccucggg

SEQ ID NO: 4179523 - RNA, 61 nt, Human
ccugaggcaugguccugagggagcucagccaaaaggggcuuagaaguacacaugccuuugg

SEQ ID NO: 4179524 - RNA, 73 nt, Human
ccugaggguaauuaagaaaaugucagaugucauugaugaaccauuugccauuaucuuaaggaaaucaugcagg

SEQ ID NO: 4179525 - RNA, 80 nt, Human
ccugaggucaugguccaguguuacugaagacugugguuaauguggagggagaggcagucacacuggugccugaugucagg

SEQ ID NO: 4179526 - RNA, 65 nt, Human
ccugagguuucucccccaguacccugggucaccucagcccagagcuggcggugagaagacaaugg

SEQ ID NO: 4179527 - RNA, 64 nt, Human
ccugagugcaagaugacgguggcagacacguacaaagacuuccccaccaggucuucugcucggg

SEQ ID NO: 4179528 - RNA, 75 nt, Human
ccugagugcauagauguucaaucagauauuugguggauaauugacuaaguaacaugggaacaucugaacaauagg

SEQ ID NO: 4179529 - RNA, 67 nt, Human
ccugaguggugcuaagcagauaacucgugguuauuccaagauagcaucugaguggagccacuucagg

SEQ ID NO: 4179530 - RNA, 57 nt, Human
ccugauaaacccuggaauuuguggccauaaucuaacccagaguuuaggucuaucagg

SEQ ID NO: 4179531 - RNA, 57 nt, Human
ccugauaacacagauacaagauggauacaaaugcuaucagcaaucucguguauuagg

SEQ ID NO: 4179532 - RNA, 95 nt, Human
ccugauacacauuuuucuggauuuuagauuuaagaauaagguauuugcacaaguauuuauuuccuuucugauaaguaaucuggagagauaccagg

SEQ ID NO: 4179533 - RNA, 72 nt, Human
ccugaucaaaacauuacuccaccaaucccaccaggucuuccagggcuguggggagaaaugucuuuguuccgg

SEQ ID NO: 4179534 - RNA, 58 nt, Human
ccugauggcuuugccugcugugaggcugcaucccucuggaccugcauggccaucuugg

SEQ ID NO: 4179535 - RNA, 66 nt, Human
ccugaugggcagcacagcuggccaauccugggacucagaggguaggucggcuggcugaccacuagg

SEQ ID NO: 4179536 - RNA, 57 nt, Human
ccugauguccauaauccuguaagcauuacaaugucauaguauuuuugggcuauuagg

SEQ ID NO: 4179537 - RNA, 59 nt, Human
ccugauguuaucuuuaugagugucuguacuugugggacaaucauacaaaacaugucagg

SEQ ID NO: 4179538 - RNA, 60 nt, Human
ccugauuagggucuuucaaaugcuaaccagccaccucuagaauguggauuccugauuagg

SEQ ID NO: 4179539 - RNA, 69 nt, Human
ccugauucauguagcuuagcagagaggcuggccugcagccucugugcaggaaauacaugugaauaaagg

SEQ ID NO: 4179540 - RNA, 80 nt, Human
ccugauuuaauucugaagugcuaauccugugcuuguggagacaugggcugagguaguagggcacugaagcuggaauuggg

SEQ ID NO: 4179541 - RNA, 70 nt, Human
ccugauuuagguagcugucuaaguguagcaugcugaaaugaacacuaaauacaguugcuguagacuuagg

SEQ ID NO: 4179542 - RNA, 72 nt, Human
ccugcaaaugacucugagauuggagguaccacaaucuauguuuuaucagcaacucagagcagucucuguagg

SEQ ID NO: 4179543 - RNA, 78 nt, Human
ccugcaacaugaaccagcgccaaguguguggaggaggcuuacacccugcucaacgaauauggcgaugacauguauggg

SEQ ID NO: 4179544 - RNA, 64 nt, Human
ccugcaauaaagaggauguauuuacagcaugagagcagagcuggugccuguuucuuuucgcagg

SEQ ID NO: 4179545 - RNA, 116 nt, Human
ccugcaaugaaccaugccuccugguauucaugcccaaauauagcuuccuccuuucaaaucuggacuggccaugggauuuauauuugguugauagaauacuguggaagugaugcagg

SEQ ID NO: 4179546 - RNA, 100 nt, Human
ccugcaauuacagauagaguuuuucucauaaacuguuuaauuguuugcuucuggaaacaauuagacugacgguauuauagagggagugucguauugcagg

SEQ ID NO: 4179547 - RNA, 56 nt, Human
ccugcacagauggacagguguuauauuauagauggcacugaaugccaaaguguagg

SEQ ID NO: 4179548 - RNA, 104 nt, Human
ccugcacagggugacucaccgccccgcuugccaggacuaaagcguccccaggauguugggaaggccgcaggcacaccuggaugugguggucaccugagcccagg

SEQ ID NO: 4179549 - RNA, 57 nt, Human
ccugcacagguugggacagguaagaucccuggaucugucuuuagaggccugugcugg

SEQ ID NO: 4179550 - RNA, 80 nt, Human
ccugcaccacaaggcuucagagcuugggagcugugaguccuuccauugcucugaaccaguuugcucuuguaggaagcagg

SEQ ID NO: 4179551 - RNA, 58 nt, Human
ccugcacccaggccgcaccucuguguaucagccgguccaugugugggugggugucugg

SEQ ID NO: 4179552 - RNA, 74 nt, Human
ccugcacuucuuucucuguguuauucauaagauaugagagucuugagucugagaugaugggauaagagggcagg

SEQ ID NO: 4179553 - RNA, 64 nt, Human
ccugcagacacuuguccagcaaguggccacuccaggauuuggaccaaggugaugugucuucagg

SEQ ID NO: 4179554 - RNA, 62 nt, Human
ccugcagacggcuggcagugagcggcuccaugacccgccgcacguccaggcugagcugccgg

SEQ ID NO: 4179555 - RNA, 72 nt, Human
ccugcagccccggggccagggcugagcggcuggagcaguucaguggggccuugggggacaacaccaggcagg

SEQ ID NO: 4179556 - RNA, 68 nt, Human
ccugcagccccuugggguccagcugccucugcaggaggcucuccaucagcugcuccagggagcucagg

SEQ ID NO: 4179557 - RNA, 71 nt, Human
ccugcagccuaggggcuguccccagcgagcaaggcgagcaaggccccgcuguggccaccccuagcuggagg

SEQ ID NO: 4179558 - RNA, 85 nt, Human
ccugcagcucuuggucuucagagaucugguggugaccaggccuucuguguccuccuccgaaucacugauaaccuuggugugcagg

SEQ ID NO: 4179559 - RNA, 55 nt, Human
ccugcagguaaggcuaacugccacaagguuggugguggggguuaggaccuauagg

SEQ ID NO: 4179560 - RNA, 62 nt, Human
ccugcauguugucucuaccuauguggagcucucucaguucucccagagugugggcaucaagg

SEQ ID NO: 4179561 - RNA, 122 nt, Human
ccugcauugccacaacucucuccuagaacuguccccgcccugccacacccaccccaggucucucuccaggcucccaugguguggcaggacggcccagccucuaugagcugucacaggccagg

SEQ ID NO: 4179562 - RNA, 59 nt, Human
ccugccaaagccauaucucaguaagcaaaggaagugcuucuugaauuguuuugaguagg

SEQ ID NO: 4179563 - RNA, 62 nt, Human
ccugccaacuguagaugggaaccauaguuccuaaaauuaccuaccaguuuaguugcggcagg

SEQ ID NO: 4179564 - RNA, 57 nt, Human
ccugcccacugcccggucagccucguugcuauggggacuggugggcggugagggggg

SEQ ID NO: 4179565 - RNA, 57 nt, Human
ccugcccagggcuugguggacccgagggacacugugggcauggcaccucugggcagg

SEQ ID NO: 4179566 - RNA, 74 nt, Human
ccugcccaugccaggacucuggaggcuuagcuccucccuuuguaccaggcacguccagagcccuggcuaccagg

SEQ ID NO: 4179567 - RNA, 92 nt, Human
ccugccccagucuuggaaucagccauuuuuccaaggagcccuggcuccuuuuauuggagaauggcuuuagaaacugagaucugggugccagg

SEQ ID NO: 4179568 - RNA, 58 nt, Human
ccugccccauggucccuggugggucacacuucccaucauuaacacccuggaggccagg

SEQ ID NO: 4179569 - RNA, 79 nt, Human
ccugcccuccaggagcucacaaucuagugggaaagucagaaagguaacucaauagacugugagcuccuugagggcaagg

SEQ ID NO: 4179570 - RNA, 71 nt, Human
ccugcccuuauugagcuuagucuaguagauuaacagaucagacuagucugcauuacaaaauagguaccagg

SEQ ID NO: 4179571 - RNA, 94 nt, Human
ccugccgcaccagucuccuucccuucaaguguuccuuccuguggcccuggaaaaucccuucauggggacagugagggaugggguagugcucagg

SEQ ID NO: 4179572 - RNA, 77 nt, Human
ccugccguacccacugcugcacucugcuccuuuaugggcagcaaugcugguggcagcuguguugcaguuuuggcagg

SEQ ID NO: 4179573 - RNA, 85 nt, Human
ccugccuagaccccccacuguugccucaaauaucaaaccaauguugucuuguggggcagacgguggcagguuuggggucugcagg

SEQ ID NO: 4179574 - RNA, 66 nt, Human
ccugccuagggucugguaccacacugugaugggcagccuagcugugggcccagauucugaggcugg

SEQ ID NO: 4179575 - RNA, 57 nt, Human
ccugccuauguaagugguuucucagggagggcagagguucuguuuguggugggcagg

SEQ ID NO: 4179576 - RNA, 55 nt, Human
ccugccucccagagguccucuauacccuuggcacuagucuccugcugggaguagg

SEQ ID NO: 4179577 - RNA, 57 nt, Human
ccugccuucagcccugaagucuccugggagcaggaggaucagguuacuggggacagg

SEQ ID NO: 4179578 - RNA, 60 nt, Human
ccugccuucuaaagcgcccgccaggacaggcuccugguggguuguaaggagaacggcagg

SEQ ID NO: 4179579 - RNA, 87 nt, Human
ccugccuuggccucccaaagugcugggauuccaggcgugagccaccacgcccggucuccauaguuuuuaagagcgccguuaggcugg

SEQ ID NO: 4179580 - RNA, 63 nt, Human
ccugccuuucucaguaaucuuuuauuacuuugugaucccgaugaaaaugaugggcagggcagg

SEQ ID NO: 4179581 - RNA, 67 nt, Human
ccugcuauaucuuccugagcuauggauuuuugcaacuagucagaacuuuauuccagaagaaagcagg

SEQ ID NO: 4179582 - RNA, 58 nt, Human
ccugcucaauuccggcacgcuggcccucgcucagacggcacugcgccugauugguagg

SEQ ID NO: 4179583 - RNA, 60 nt, Human
ccugcuccaugcucaccaucaggcagcuggugguccuucuugaagagugagugcagcagg

SEQ ID NO: 4179584 - RNA, 78 nt, Human
ccugcucuaugggagagucuaaaaccgagguaccauguaagaaaaauaaugcuuugaagacuuuuccaggguaaaagg

SEQ ID NO: 4179585 - RNA, 103 nt, Human
ccugcucugcucugcucugcccuggcugagggaccucggguaagucauguuaccucucucuaccucaguuuccccagccauuaaauagagucagcaaaguagg

SEQ ID NO: 4179586 - RNA, 58 nt, Human
ccugcugagaagcuaagcaggaaagacuaaaggaugaggcaugcuuggcuucuuuagg

SEQ ID NO: 4179587 - RNA, 105 nt, Human
ccugcugagacugcugggccaccccagcgcauauggucugcggggcuuacuugauucccuuagcuucccagccaaggugcugguguugccagcagugcuggcagg

SEQ ID NO: 4179588 - RNA, 59 nt, Human
ccuggauggucccaugagcagcuggagucccuaaauccagcauccuaguggucuccagg

SEQ ID NO: 4179589 - RNA, 60 nt, Human
ccuggaugguggagaaguucacuggguugcccaggccagagcugguccacaaucugcagg

SEQ ID NO: 4179590 - RNA, 78 nt, Human
ccuggauuauucuuaaugcagggauuauccacaugugcagaugugugaguaaucccugcauuuaauaauaauccgugg

SEQ ID NO: 4179591 - RNA, 66 nt, Human
ccuggauucaagucuuucuuucuaggcaaacccuugacucacugggaagagaugcuaugauucagg

SEQ ID NO: 4179592 - RNA, 58 nt, Human
ccuggauucaugccaggccacccuccacaauuugcugagggaggccccagaguccagg

SEQ ID NO: 4179593 - RNA, 79 nt, Human
ccuggauuuccacagaaguuuugcucucuugggucccucuugggucuccugugcucugagugcaugcuuuugggccagg

SEQ ID NO: 4179594 - RNA, 68 nt, Human
ccuggcaagggaagcccuggcugagaccccccggcuaaggaaggguccucagcggcuccccagccagg

SEQ ID NO: 4179595 - RNA, 59 nt, Human
ccuggcacagggagacagccguggccugagugcccaggcugguucaucccugggucagg

SEQ ID NO: 4179596 - RNA, 67 nt, Human
ccuggcacaugcaguacucaaggauuugauagauaaaugaguaauuugcuugcauucuugugccagg

SEQ ID NO: 4179597 - RNA, 88 nt, Human
cccugcucugagcucuauaaagcugcgucuucagaguccccugguucugcuaaguccaagggcuccaagagguagcugggcagcaggg

SEQ ID NO: 4179598 - RNA, 83 nt, Human
cccugcuucuguggucuucugucucagcaggcugucaagucggagacugagugccugagcaggcguggaccaugaaggagagg

SEQ ID NO: 4179599 - RNA, 75 nt, Human
cccugcuugcccauggcaggauuucugaaggccacagucagccugggaaguuaggaugccagggaguuggcaugg

SEQ ID NO: 4179600 - RNA, 91 nt, Human
cccuggaaagccacaccaccuccucuccuggcaaaauguggugucgucuuaguccaggaagguggggcagaggauugaggacauucuaggg

SEQ ID NO: 4179601 - RNA, 94 nt, Human
cccuggacccuuauuuucuugagugauguuuaagacuacgcugaccagucuuaaagcaugguguaguuaauucuuuaagaacaaggaaccaggg

SEQ ID NO: 4179602 - RNA, 63 nt, Human
cccuggaggagcuuagagcuugggaugagauagauauggaccauuaaucugagcuucccaagg

SEQ ID NO: 4179603 - RNA, 65 nt, Human
cccuggaggcggcacgcgucaagaagugacacgaugugcugcuucuggcagugcagccaccaggg

SEQ ID NO: 4179604 - RNA, 76 nt, Human
cccuggaucugcucagauuacagccccacaucaauuggccuauaauuagaauggggugaaaucaggcagaaugggg

SEQ ID NO: 4179605 - RNA, 66 nt, Human
cccuggcaccuacucccugucaguguguggguaaguaauugcauguggcuuaguuaggugccccgg

SEQ ID NO: 4179606 - RNA, 60 nt, Human
cccuggcagcuggaaguucuaucuuuagucugaccugaaucucuccaguugcuuucaggg

SEQ ID NO: 4179607 - RNA, 90 nt, Human
cccuggcauaaauauguaacugagagguaaucacacaaaauauauaguuguauuuuuguguguuugcuuuuaaacauuguauuuucaggg

SEQ ID NO: 4179608 - RNA, 73 nt, Human
cccuggcugggauauuuggauuggaguacaugguuuacgugggcugcuucucaaaugucuccauuggucaggg

SEQ ID NO: 4179609 - RNA, 86 nt, Human
cccugggacucgugacucucuggccuguuggccugggcucugcuuuucagagcugaaguucaguccagagaagugaugguccaggg

SEQ ID NO: 4179610 - RNA, 61 nt, Human
cccugggauaggaagguuuccagcaauacuccuacugccugcugcaucaaucuacccaggg

SEQ ID NO: 4179611 - RNA, 58 nt, Human
cccugggcuguauuuuugcaauagacugaauuuggauguucauucugugcagcaaggg

SEQ ID NO: 4179612 - RNA, 57 nt, Human
cccuggggagcaggcgaaggaggagcugcagccaccacguccucucuuuccccaggg

SEQ ID NO: 4179613 - RNA, 80 nt, Human
cccuggggcgcccuuguaggggcuggcggcuaugagcgugugucucuucccugccucagcuguugcaggggccccugggg

SEQ ID NO: 4179614 - RNA, 79 nt, Human
cccuggguucuguccaggcgcccagcuauggcgcccggccggucagcaguaugguuagcgucuaugcaggugcccgggg

SEQ ID NO: 4179615 - RNA, 61 nt, Human
cccuggugccauagccuggccuccgaagcuccuauagggucccagucccugagcaccaggg

SEQ ID NO: 4179616 - RNA, 60 nt, Human
cccugucaaauuggcauuggauuauucuuauggcuagaagagucugucaauuuacagugg

SEQ ID NO: 4179617 - RNA, 59 nt, Human
cccugucccugcuccacguuccugggcagaaaugccucugggugggaggccgggcgggg

SEQ ID NO: 4179618 - RNA, 68 nt, Human
cccuguccgccuccuggcauuguccccauuucagaaugugggugcaggcagcccaggcaggagcgggg

SEQ ID NO: 4179619 - RNA, 56 nt, Human
cccugucucauugaucacuuguccugugccuaucucaggggaggcaacagacaggg

SEQ ID NO: 4179620 - RNA, 68 nt, Human
cccugucugcacggggaggaugggcuugccaggggucgggagcaccaguuucgucgugacaaccaggg

SEQ ID NO: 4179621 - RNA, 74 nt, Human
cccugugcuuuucuugcguuucugagagugggccuggccucuccuccucccacucuugaaucaagagcucaggg

SEQ ID NO: 4179622 - RNA, 58 nt, Human
cccuguggaggcagcauccugcauccauccagggaaagacagguggcgcucuacaggg

SEQ ID NO: 4179623 - RNA, 65 nt, Human
cccuguguaguuaacuuuccacccagugacuuguagaugucuucagugaaagauaacauaggggg

SEQ ID NO: 4179624 - RNA, 88 nt, Human
cccugugucugcaggcugagcgccugccgggaugaagugccagcccagcgccggcuuaugcggcucagugccugcaauuugcacaggg

SEQ ID NO: 4179625 - RNA, 69 nt, Human
cccuguucccagaaacuuucuuuacugagcauucuuuauguuggguagugaaagauucuacacacaggg

SEQ ID NO: 4179626 - RNA, 66 nt, Human
cccuguugccugugaacgcugaguccuccaccacaccaugaggucagcugcacugguguaauuggg

SEQ ID NO: 4179627 - RNA, 115 nt, Human
cccuguuuccuguccuuguucauugggcaguuuccauggaucucuaaauagcuugaggaccaaagguccuaagaagcaugggucccaagaauucgcugcaggauggggcacgggg

SEQ ID NO: 4179628 - RNA, 73 nt, Human
cccuguuugggaaggccuugccugacagcaccagucugaguggggaggcuggucugaaggacuucugaggggg

SEQ ID NO: 4179629 - RNA, 62 nt, Human
cccuuaaguuacacauuuucauuguaauguacaaugcuguauguugaugugcuacucaaggg

SEQ ID NO: 4179630 - RNA, 68 nt, Human
cccuuacacuguagaccccuggaagaaaagaggaggugggauuccuuucagggaagugugcagaaggg

SEQ ID NO: 4179631 - RNA, 73 nt, Human
cccuuagcaaacucuguuagauucugcucauucacuugacacuaucucccaccagaguaugaguuauugaggg

SEQ ID NO: 4179632 - RNA, 55 nt, Human
cccuuagccaggaaaucgaccucucuaagaggucagagaguuccguggcuaaggg

SEQ ID NO: 4179633 - RNA, 80 nt, Human
cccuuagcuccaagggguuugggaucacugcguuuuacagcaacaaucuucaaccuuuuggucacucuuucagcuaaggg

SEQ ID NO: 4179634 - RNA, 71 nt, Human
cccuucacacagguagaagcagaggcucaucauaagccucaccucuuucugucuagcugagugauucaggg

SEQ ID NO: 4179635 - RNA, 64 nt, Human
cccuucauaccuaugauuuuuaauaucccaccaucaaaaaugaacaucuuuggguccugaaggg

SEQ ID NO: 4179636 - RNA, 60 nt, Human
cccuucauguagcuguguguccaaggggacagagacuuuggaauagcuuaaagugagggg

SEQ ID NO: 4179637 - RNA, 73 nt, Human
cccuuccagugucugaaccugcagugggagcacuggugcuggcccugcugggucagagcugaagagggaaggg

SEQ ID NO: 4179638 - RNA, 60 nt, Human
cccuuccccuuauaagucuggcuucuacuugaguuuggagugaauaaguagggggaaagg

SEQ ID NO: 4179639 - RNA, 81 nt, Human
cccuuccuggcgcaaggcuggucaccuccuucccagcuacugucuugucuuuggggcugagguugaaccugccaggaaggg

SEQ ID NO: 4179640 - RNA, 63 nt, Human
cccuuccugugagacagauugaccaucaggacucaguaaaugugucuguggcaccugggaggg

SEQ ID NO: 4179641 - RNA, 70 nt, Human
cccuucucauucugggccucccagucugugaaaugugggagcuggcucaagagguccagaggagcagggg

SEQ ID NO: 4179642 - RNA, 88 nt, Human
cccuugaacuuccugccugccugcuuucugcuuugcagcguugugccugcaccaaagccuggaggugugucagggaggcucgcagggg

SEQ ID NO: 4179643 - RNA, 56 nt, Human
cccuugagcaucuguggauuuguggaccaacagucagaaggaagaugcuuaaaggg

SEQ ID NO: 4179644 - RNA, 70 nt, Human
cccuugcuuuuuccaugccuagaacaggauucucagcccagagaaccagaggaaauggaaaaggggaggg

SEQ ID NO: 4179645 - RNA, 66 nt, Human
cccuugugcucccucccgucuggccagcaccaggcccacuggucagauguaaauggagacgcuggg

SEQ ID NO: 4179646 - RNA, 67 nt, Human
cccuuguuuuauucaauuuccaguagggaagcccugggagggagggaaguuuggaagaaagcaaggg

SEQ ID NO: 4179647 - RNA, 63 nt, Human
cccuuuaauuccaacacaggaaaggucugucacucccagucacuguggaagggaacuagaggg

SEQ ID NO: 4179648 - RNA, 64 nt, Human
cccuuuaucccccacgucugugaggcucaaugaugcaggcaggacaggcucuggggaugcuggg

SEQ ID NO: 4179649 - RNA, 71 nt, Human
cccuuucauuccauccugucccccaggugggaccccacgcccugagguggaacagaggugaagaggaaggg

SEQ ID NO: 4179650 - RNA, 91 nt, Human
cccuuuccccuuuucuucccaucacuagcaucugcaccacucaccagugagggcagcgagccagguagguggccggaggaguggggagggg

SEQ ID NO: 4179651 - RNA, 79 nt, Human
cccuuuccuuaucagguccucugggucccagccccugacccagggagcgggaccgaacaggaaaaagaggaggaagggg

SEQ ID NO: 4179652 - RNA, 55 nt, Human
cccuuucugaaggaagugcaguuuccuucgggcacugucaccugcucagagaggg

SEQ ID NO: 4179653 - RNA, 77 nt, Human
cccuuugccuugucugucccacagcuucccgagaacuauagaaauuucaaggaacagcagggaugacauggccaggg

SEQ ID NO: 4179654 - RNA, 73 nt, Human
cccuuuuuaccuuuuauggauaauaggcaagcuaucuucuaugagccuggguuucaucauugguaaaaagugg

SEQ ID NO: 4179655 - RNA, 58 nt, Human
ccgaagaaagggcuauuguucuccaggauccccuggcucuuaaccguuuuuucagcgg

SEQ ID NO: 4179656 - RNA, 62 nt, Human
ccugcugaggccagaguuuuuaauuccuauuucauuggugaagaaacuuagguucagagagg

SEQ ID NO: 4179657 - RNA, 72 nt, Human
ccugcugaggggcugcccugcucucugcucacugagugcuaagugcagagcauuucgguugcuuccagcagg

SEQ ID NO: 4179658 - RNA, 62 nt, Human
ccugcugcaggggcuggaguuggcuuccuggaagcccauucggcugcccugcacacaucagg

SEQ ID NO: 4179659 - RNA, 55 nt, Human
ccugcuggacagggguguucaucagcugacgcggggaugcuugugaccaggcggg

SEQ ID NO: 4179660 - RNA, 88 nt, Human
ccugcuggcccucuguaaugauucacugaaugaugaaauguccaucaguccucagguucugaaucuugugccuggagaaccagagagg

SEQ ID NO: 4179661 - RNA, 59 nt, Human
ccugcuggcgcuugucugggagaggcaggaucuccgagagguguggaagggccggcggg

SEQ ID NO: 4179662 - RNA, 56 nt, Human
ccugcuggcguggcuggcgcccacguuggcguccucugaaagccccgccagguagg

SEQ ID NO: 4179663 - RNA, 98 nt, Human
ccugcuguggucuuggugcuggaggaagcgccuuccuccucuuuguucggcaugagagaugaagggcauuccccaggccagagcaucccauagacugg

SEQ ID NO: 4179664 - RNA, 62 nt, Human
ccugcuugaggggauauuugugucugucccucauaccggccacacaaaccuccucagccugg

SEQ ID NO: 4179665 - RNA, 76 nt, Human
ccuggaaaauaggaaauaauucacucuggcuugaaaaggguggagauuucuuuguuucuuuuuauauuuauucagg

SEQ ID NO: 4179666 - RNA, 72 nt, Human
ccuggaaagugggaauuucagugcuaaaaccaggacaaguuggucccuccaaagugauucccauuuuccagg

SEQ ID NO: 4179667 - RNA, 57 nt, Human
ccuggaacauaguguuaggucgaacuguuauuauucugcugguaacuauguuucagg

SEQ ID NO: 4179668 - RNA, 71 nt, Human
ccuggaacccaggccuggaagccugugagcauugugucauguggugggcagagccugggccugggucgggg

SEQ ID NO: 4179669 - RNA, 88 nt, Human
ccuggaacugagcuggggucagcuccccugucaaagggucgaagcuguaaaauguagggcgaguauuuaaugaccugagcucagcagg

SEQ ID NO: 4179670 - RNA, 72 nt, Human
ccuggaagcggcagauugggguugcaacugaccuggcuuuggcuacccuagaccccaucuggcugccccagg

SEQ ID NO: 4179671 - RNA, 63 nt, Human
ccuggaaggcaggcauggauuggcuaaguuuaggucauauuguccacccccugcuuuacuagg

SEQ ID NO: 4179672 - RNA, 58 nt, Human
ccuggaauagucuguucucuucugucuuuguugucaguggcuggacagacuuuccugg

SEQ ID NO: 4179673 - RNA, 75 nt, Human
ccuggaauuuacuccagaacauuauaucucaauucuauguuaauggaaaggcuugguauuuuggaguuggccagg

SEQ ID NO: 4179674 - RNA, 76 nt, Human
ccuggacaguugucuacuuuuuaaucuuggcagacaggugaucaccccuagccagauuuaaagagagacuaccagg

SEQ ID NO: 4179675 - RNA, 55 nt, Human
ccccacaacucauguugaaacuuaauuuccaauguggcaauacugagaggugggg

SEQ ID NO: 4179676 - RNA, 60 nt, Human
ccccacaggccaaagaucccauugacacguaaguaguuagcacucggucugcucuggggg

SEQ ID NO: 4179677 - RNA, 129 nt, Human
ccccacauaguaagaaaaugcugauuguugauuuugaagagauuaaguugguuuugaauuaccaaaauuuauuuaaaacacauaaacucucuauuugaguacaaagucauuuuuuuuuauucuaagggg

SEQ ID NO: 4179678 - RNA, 84 nt, Human
ccccaccaccuguccccagcacaugccccaggaaucacucugggaagcugcgugccuguuccaggggagaggcaggccgugggg

SEQ ID NO: 4179679 - RNA, 67 nt, Human
ccccacccaccuaagagaaacuaaaaucuauuccuuugcaagggacaguuccucagguggggugagg

SEQ ID NO: 4179680 - RNA, 88 nt, Human
ccccaccccgccuccacgccccggcucugagacuuccugccuccccggcuccgggcagcucuggcugugggaagcuggcggggcgggg

SEQ ID NO: 4179681 - RNA, 75 nt, Human
ccccacccugugccaauacagcguaucagagguauguucucugggcugucuacagguuggcuugggguccugggg

SEQ ID NO: 4179682 - RNA, 57 nt, Human
ccccacucugggaucuugaaaagaguggaaugaaaguacuauucucagagcuguggg

SEQ ID NO: 4179683 - RNA, 63 nt, Human
ccccagacaggcugcaguguuccuaucugaccgaauaaguggaacucuggggcucauuagggg

SEQ ID NO: 4179684 - RNA, 91 nt, Human
ccccagcaagguuucucaccgugggaguggugggugcucagggauggcucugcagggcugagacuguaccacuuccuccaaccucgugggg

SEQ ID NO: 4179685 - RNA, 68 nt, Human
ccccagcacugcccaggaccugccaccccgaguguugcauggguggcuccuaugggcauagccagggg

SEQ ID NO: 4179686 - RNA, 123 nt, Human
ccccagcccgcgcaggugagccuugcugucuaccucuuccuccuccaucucgaaggcugaguggucuuggcugucgaaacaggaggcgcugaggaagacagggggagccggcggggacugggg

SEQ ID NO: 4179687 - RNA, 127 nt, Human
ccccagccugcuuccugccugauggcucagguguccccaugcuggucaugcuggcucaggcugcaggagcaagccugggagacuucccugccucugccacuuuguguggguaauugugcuuuagggg

SEQ ID NO: 4179688 - RNA, 63 nt, Human
ccccagcucccaaguugcuaugggacauaaaaugaaauaugaaccaggggaugggaacugggg

SEQ ID NO: 4179689 - RNA, 59 nt, Human
ccccaggaagccucagauuugccauguuagagucuguguggccaucugguuucgugggg

SEQ ID NO: 4179690 - RNA, 96 nt, Human
ccccaggccggggugggguaggagucagcgagagaguccagcgcuccaaaggggacuuucuggcccuccgugcccccuaacccagcacuucugggg

SEQ ID NO: 4179691 - RNA, 59 nt, Human
ccccaguccugcuggccuucccuggccccaugugccggcucaggggaccucaggagggg

SEQ ID NO: 4179692 - RNA, 93 nt, Human
ccccaguggcugggacagaagcugcucacaggucuguggcuauugauggucagagccagagaccugcugugcucauucugggacguggugggg

SEQ ID NO: 4179693 - RNA, 120 nt, Human
ccccaguggguguccaggggguggcucugagaugagguagcuuggcccaggggcugguggccucccccuggggcuagagacugcaaggccaggcccccuggacugcuuuagacacugggg

SEQ ID NO: 4179694 - RNA, 58 nt, Human
ccccagugguugcaacagcagaggcuuauugcuugcugugcugugugucuacuguggg

SEQ ID NO: 4179695 - RNA, 69 nt, Human
ccccaucuucccaggaggcucuugucccuggugccaccggugugcaccaugccucucugggcgugcggg

SEQ ID NO: 4179696 - RNA, 73 nt, Human
ccccaugaaguagggucucugauucuuguccccuccccgcuaguucauagagucagauaccagacucaagggg

SEQ ID NO: 4179697 - RNA, 74 nt, Human
ccccauuguggauuaguguuguggcuucauggcccuaauaggggugugucugccaggaacugcacugcaugggg

SEQ ID NO: 4179698 - RNA, 56 nt, Human
cccccacaggugucugaggcaggggauugucuccuuuauccacuguaccugggggg

SEQ ID NO: 4179699 - RNA, 112 nt, Human
cccccacuucaguuccuggcacagagcugggugcccccuggagggugccaaauagauuccucuaaacuccuuuacccagaccuuuuggccaagagcaagacaggaguguagg

SEQ ID NO: 4179700 - RNA, 62 nt, Human
cccccagggagaaaucuccaggagguuuggcaagaucucuaguuuaagauuucuccuggggg

SEQ ID NO: 4179701 - RNA, 67 nt, Human
ccccccagcaggaauacaggggucgacccucgaauuaaaguugaccugcuccuaaucuggggcuugg

SEQ ID NO: 4179702 - RNA, 123 nt, Human
ccccccuucacugucuuuauaaaauuuauauucuaguuguaagagacagauauaaagcaaaauaagcaaaauauguuuuauacugaaaugugcaaugaauggaaauaaagcaggagggguggg

SEQ ID NO: 4179703 - RNA, 72 nt, Human
cccccgauaucacugauguguaauuccgaagacccugagaccagggccugggcccacaaguggaaucguagg

SEQ ID NO: 4179704 - RNA, 55 nt, Human
cccccgggaagcucucguggcugggccucuucuccagcagagccuuccaggaggg

SEQ ID NO: 4179705 - RNA, 95 nt, Human
cccccucucagggaugaucugguccuaaccucuugggucauuuuggugaaaugagaguucauuccugcagaggucaggccagaaaagagaggggg

SEQ ID NO: 4179706 - RNA, 72 nt, Human
cccccugcuccaguagccccaugugguucgguccacaacugggccucuuccauuggcucugaagucaggggg

SEQ ID NO: 4179707 - RNA, 81 nt, Human
cccccuuuccccagaggcugaguugggagcauguuaggaacacuagcuaguugcuccugaacacagcccuaugaaauaggg

SEQ ID NO: 4179708 - RNA, 58 nt, Human
ccccgcaggugucggcagaugggguagcgaaugguccugugccuccaccugcuccggg

SEQ ID NO: 4179709 - RNA, 87 nt, Human
ccccgcgcccccggucuguuuggggucugcagagcggcgccaggguaaagcgcagaccuguugauccuagguucuggcgggucgggg

SEQ ID NO: 4179710 - RNA, 60 nt, Human
ccccgcucugcgcgggaggucgaggcaccccgcucacgcccuccugcccgcaagcuaggg

SEQ ID NO: 4179711 - RNA, 82 nt, Human
ccccggaugggagaaguugggaaagggguaggagucaugcaguccugaguucaaaucccagcucagccucucacaugcgggg

SEQ ID NO: 4179712 - RNA, 57 nt, Human
ccccggccucgccccucuugggggccuucaaggaacuggacagggagggcgcugggg

SEQ ID NO: 4179713 - RNA, 93 nt, Human
ccccggggcagcuccagguuucacuacaauuaaguuggcuuaugauacauucaagccacagcacauuguaagaaaguggaucauugaccgggg

SEQ ID NO: 4179714 - RNA, 66 nt, Human
ccccgugcuccccuagcccguugggagguggacagugagacaucuucccaggcuggggagaggagg

SEQ ID NO: 4179715 - RNA, 55 nt, Human
ccccguuucucaucccuaggaucucaguugaggauucaggacaggaaaaacaggg

SEQ ID NO: 4179716 - RNA, 89 nt, Human
ccccuagaauucggauggggaaacugaggcuggggggcuucucaaggucacagaguaaguucaaggaagccuccaguuuccccaggggg

SEQ ID NO: 4179717 - RNA, 76 nt, Human
ccccuaggcugcugcuaccacccugaaagugccagccugucugcagggaggccccgcagcccucaagccccagggg

SEQ ID NO: 4179718 - RNA, 85 nt, Human
ccccuauggagccagcccccuaaguccccuaucuucccaggucuuccucugucccuucuggaggcugcuggucuuucauaguggg

SEQ ID NO: 4179719 - RNA, 129 nt, Human
ccccucauucuguguugaacccaaacaugccuagaauauuuagaguaucccugauuuagcugcuggguaauuugaggauaguuggguacucugggaugaaaaggcuugauacaauaugggaaaaaaagg

SEQ ID NO: 4179720 - RNA, 89 nt, Human
ccuguccugcugcaccccugccccacaggcuugguagggccaaggcccucagccgcccugccggggccccugguguagggcgggguggg

SEQ ID NO: 4179721 - RNA, 94 nt, Human
ccuguccugugacaaagcaugcuggucagccaguggaugcccccaucgguuccaugccaguggcugcaccgggaccccugcuugcaggcacagg

SEQ ID NO: 4179722 - RNA, 84 nt, Human
ccugucggacgagggccagcugcagcgagacauagaggaugaccugggggucacugggcgccagcugcugagcccugugugggg

SEQ ID NO: 4179723 - RNA, 57 nt, Human
ccugucuauuuccauugcauuuuaauccauaaugaauguagaauggugauuggcagg

SEQ ID NO: 4179724 - RNA, 73 nt, Human
ccugucucaguaagaaaggcuccuguucuagauguuggggucugaguuuacauuuuugcuuggauguaaaagg

SEQ ID NO: 4179725 - RNA, 115 nt, Human
ccugucugacugauuccuccuccagugcuuucuccauuucuccuuuuacucucuucagugcugccgaaguuuaagguggaagugguggaacccaaggaguuaucaacggugcagg

SEQ ID NO: 4179726 - RNA, 81 nt, Human
ccugucugcucaagccagguuccauggaggagcagaacuucauccugcucugcauuuagggccugccucggagacaguagg

SEQ ID NO: 4179727 - RNA, 57 nt, Human
ccugucuggccuuccacggggggcauucaggauggaccugucuggaagagcugcagg

SEQ ID NO: 4179728 - RNA, 77 nt, Human
ccugucuggcuguguccacagaguaagcugggaccauggcgauuauccagcuuauuugaaucuuacaggcagccagg

SEQ ID NO: 4179729 - RNA, 64 nt, Human
ccugucuugcuuccagaagguucuucucaugccuugugaagugugucuugggaagggagggagg

SEQ ID NO: 4179730 - RNA, 79 nt, Human
ccugugagaguucugaggggguguuuauaagcugcugaauuucaggagcucaguuggccacucuuucagacuagacagg

SEQ ID NO: 4179731 - RNA, 58 nt, Human
ccugugaugaagaguccaagaacagccugagauaaggaugucauucuucuuucacagg

SEQ ID NO: 4179732 - RNA, 110 nt, Human
ccugugauucucuccugagggcugccucugacaaugcucugcccaccccaggcagggcaggcugggugucauggagugaugaugcccucaggacaaaagagaaucacagg

SEQ ID NO: 4179733 - RNA, 75 nt, Human
ccugugcagcccuugccaguuuccacgaggcaggauacuccacuagcugauucagacaggcagaggcugcagagg

SEQ ID NO: 4179734 - RNA, 90 nt, Human
ccugugcaggagucagucgcagucaggacacagcaugaacaugaggauccccgcucagcuccuggccuuccugcugcucugucucccagg

SEQ ID NO: 4179735 - RNA, 75 nt, Human
ccugugccaggcacugcucuaagcccugauggugcacagaggugccagggggccuggaugguggcuggcuccggg

SEQ ID NO: 4179736 - RNA, 58 nt, Human
ccugugcccucugcauagcagccacuccccugcugaaagccugcagauggcucccagg

SEQ ID NO: 4179737 - RNA, 61 nt, Human
ccugugcuccaggcugcugaagaucuaccgccaggcgcagaagcagcuucuggaguaucgg

SEQ ID NO: 4179738 - RNA, 59 nt, Human
ccugugcuggcagaccuggaguuguugccacagagggccgauaagauugugaguacagg

SEQ ID NO: 4179739 - RNA, 87 nt, Human
ccugugcugggaaccugcaugggggaaggaggaggagacgugaccagcccugcuccugcuggcccucgugccugguccugccacugg

SEQ ID NO: 4179740 - RNA, 71 nt, Human
ccuguggagcugaguucuucagccggguucugaggacauccugcucuuggcaggaggggcucagccauggg

SEQ ID NO: 4179741 - RNA, 87 nt, Human
ccuguggcuccaaguuccaaauuccaauccccugaagacaccagggugucucaagcugcccugggauuugggguaaugggucacggg

SEQ ID NO: 4179742 - RNA, 60 nt, Human
ccuguggcuccagugaaccaauguagaagcccuccuuccccauggcugugagcccacagg

SEQ ID NO: 4179743 - RNA, 62 nt, Human
ccugugggcgcagcuggagucaaggcuuggggucuugggguaugcuuccagcagccagcagg

SEQ ID NO: 4179744 - RNA, 80 nt, Human
ccuguguaugugugcagcugugugagagcuccagaauuucugcagggaacuuggacagcuagggguuacaucugcauagg

SEQ ID NO: 4179745 - RNA, 106 nt, Human
ccugugugauucuggugugcagccaaguuugagaacacugcccuaagucauuguuacaggcuaguacaguggcauucaaacuuugguguacaauagaaucaccugg

SEQ ID NO: 4179746 - RNA, 55 nt, Human
ccugugugcagggccauccacaccuccgagacuggugcacaguccugcacacagg

SEQ ID NO: 4179747 - RNA, 59 nt, Human
ccugugugccuggccgcgggaggacccagagucgggcuggccugcgccaggcagacggg

SEQ ID NO: 4179748 - RNA, 107 nt, Human
ccugugugcgucuucaggggguguacuuuuauaaauguaugugcacacacagaggugccaaugcauuuguaaaauauaaucgaaauauuagacauaaagcauagagg

SEQ ID NO: 4179749 - RNA, 87 nt, Human
ccugugugcugugcauuuggccccacugcagcugcuggaugcaguccgcuagcagcuguggaggggcuguggcuucagggacauggg

SEQ ID NO: 4179750 - RNA, 62 nt, Human
ccugugugucugucacugcacaauauucucaugacucucuucuuguagugacaggauacagg

SEQ ID NO: 4179751 - RNA, 69 nt, Human
ccuguguugugacccagaccaagaagaaccuccuccaaggagcuugcuacauguggguggcagcacggg

SEQ ID NO: 4179752 - RNA, 66 nt, Human
ccuguucaaugcccuggcuucacucacuauuagcuucaugagaguuggggcaggagcaagaauagg

SEQ ID NO: 4179753 - RNA, 86 nt, Human
ccuguucccgagccccaggccaugauucgcuucacucuggacuucaguuccagagagagaggucaauggcagggcaugggaacagg

SEQ ID NO: 4179754 - RNA, 66 nt, Human
ccuguucuugucucauuggcuaaaguugugucacaugaccauuccugaaccaauggagggaauggg

SEQ ID NO: 4179755 - RNA, 76 nt, Human
ccuguugauaaaaugaaacuaguagaaucuuugugucaaguauuacagucugcuggcuuuuucagcauugaccagg

SEQ ID NO: 4179756 - RNA, 59 nt, Human
ccuguugcgucuaguccaugagcucuuuagcccaaaugcacucagaugcucacaacagg

SEQ ID NO: 4179757 - RNA, 81 nt, Human
ccuguuguaagcaagauuuauugaauuuucucaucauagucuuaaaagagcaguacuccaauaggucuuguuuacuaaagg

SEQ ID NO: 4179758 - RNA, 66 nt, Human
ccuguuuccauucugagucuuaugucuuuuggaaaagaguucuaauauuucagaugguaaauaugg

SEQ ID NO: 4179759 - RNA, 79 nt, Human
ccuguuucucugaggcuggccucccuacggggcugcagcagcaaagggaagccaagccuuagagaagccucauggaagg

SEQ ID NO: 4179760 - RNA, 75 nt, Human
ccuuaaaaugucuacuccuguguuuauuuaugguuuaguguugagagcaugggcucgggagucagauugccuggg

SEQ ID NO: 4179761 - RNA, 98 nt, Human
ccuuaaacacauuuucagcccaguuuuaucaucuguaaaguggccccagagaacuuguaauagaggugaaauaggguguauggaaguguguggaaagg

SEQ ID NO: 4179762 - RNA, 73 nt, Human
ccuuaacaguguauucggaggcuagguacgaaaccaauuuuaucugcuucagugauaugugaacuguaugagg

SEQ ID NO: 4179763 - RNA, 76 nt, Human
ccuuaagagcaaaaacugagguuuccugaagaagaaagaauucugcuucuaggcagccugaguuucuugccuuugg

SEQ ID NO: 4179764 - RNA, 73 nt, Human
ccuuaagaggcagguguuaccucugguuucuguuuaaacugauggccagcaagguagggcaauuugccuaagg

SEQ ID NO: 4179765 - RNA, 71 nt, Human
ccuuaaguauaucugcaaagacccuuuuuccaaagucacauuuacagguucuggguagauguaucuuuugg

SEQ ID NO: 4179766 - RNA, 79 nt, Human
ccuuaaucaccauuuguucaaccauucucgcuugggugacauuccucuuagugaaagaaguuggaagcaaauauaaagg

SEQ ID NO: 4179767 - RNA, 61 nt, Human
ccuuacaagaaauuucugcauauaugcacaaagcaucauguucaagaauauuuuguagagg

SEQ ID NO: 4179768 - RNA, 89 nt, Human
ccuuacaguggccguggucgcugacucucgugucuccccuguucacaugccagccaucgagggugaguacagcggacccaagcuugagg

SEQ ID NO: 4179769 - RNA, 71 nt, Human
ccuuaccugaugauauacuuccuagaacaguuuauguuuuuaugcuuucuuaguguguuaauugggucugg

SEQ ID NO: 4179770 - RNA, 73 nt, Human
ccuuagaaagggggcuguaagcaagcagggggagaagcugagauuuugauuuguauugcaggccccuuuaagg

SEQ ID NO: 4179771 - RNA, 82 nt, Human
ccuuagacauuuauugagcaccuacuuugugccaggcacacucugcuugaugccuuaaugguugguguucuaugucuuaagg

SEQ ID NO: 4179772 - RNA, 75 nt, Human
ccuuagacuuggguggauugugacucuggccaguggcaaugaccaauacacauuaucucuaucuacacuuuaagg

SEQ ID NO: 4179773 - RNA, 79 nt, Human
ccuuagagaauaagcagaacccuucuguaacuagcaugccugggucuucuuuacuuuggguccugcuuauaauuuaggg

SEQ ID NO: 4179774 - RNA, 60 nt, Human
ccuuagccaggcuaaaugagccaugauaauuuuaucacuccuguuaaugacuggcuuagg

SEQ ID NO: 4179775 - RNA, 59 nt, Human
ccuuaggaguucacuugaauagucauuuuuauauuugugacugcaagucacuuuuaggg

SEQ ID NO: 4179776 - RNA, 59 nt, Human
ccuuaggaguucacuugaauagucguuuuuauauuugugacugcaagucacuuuuaggg

SEQ ID NO: 4179777 - RNA, 81 nt, Human
ccuuaggaugaagguguuugagucuucuuuugaccacaaggaagcuaaaaggcucagacagauuuugacacuugccuaggg

SEQ ID NO: 4179778 - RNA, 91 nt, Human
ccuuagggcagugccacaguaaucugggaacuuguuagaaauacacauucucaggccccaucccagacuuauugaaucacagacucugggg

SEQ ID NO: 4179779 - RNA, 105 nt, Human
ccuuaggugccuggucccaucaauuggccaaggagcagucccugugcucucaaggguggcuguuucucuugagucaaaaugaaaauggagugggaaccuuuuagg

SEQ ID NO: 4179780 - RNA, 57 nt, Human
ccuuagucuuucaucagagguuauuuaguuuuucugaauuuugaaggaagauuaagg

SEQ ID NO: 4179781 - RNA, 58 nt, Human
ccuuauaacaguugguauuauuugggugaauggcucauuaaaugcuauuguuauaggg

SEQ ID NO: 4179782 - RNA, 69 nt, Human
ccuuaucauccacuggggaucccauguggccaagaucuccagaugguguuuccccagguggaccagagg

SEQ ID NO: 4179783 - RNA, 81 nt, Human
ccuuaugcuuguguucccaguaaauccuagagcccucaucgcucagccugugcgaggaguaggauuagcacaggcagccgg

SEQ ID NO: 4179784 - RNA, 64 nt, Human
ccuuauggagccuuagacaucugauccuuucauuucaaagguuaggggcugaggcccagggagg

SEQ ID NO: 4179785 - RNA, 64 nt, Human
ccuuaugggaacauuuuuuaaggcagaaaaagaaaguuuuuuuguccugauguucuuuaauagg

SEQ ID NO: 4179786 - RNA, 118 nt, Human
ccuuauguaacagaaacaaucauuuaagccuucuaauuuugucaccaggccuugggaaaaauauggguugguaaaauauuacaaggcacuugaaccuauuggguccgaaauauaaagg

SEQ ID NO: 4179787 - RNA, 55 nt, Human
ccuuauguuccuuggucucaggcaacuagacagccugaaggccagcagcauaggg

SEQ ID NO: 4179788 - RNA, 83 nt, Human
ccuuauucccaggccuggcauggggacuaagggaggaccccauuuuagcuuucccuuacagucugggccagcucugggaaggg

SEQ ID NO: 4179789 - RNA, 74 nt, Human
ccgaagugcguauguccgagcgcgugugcaugugugugcgcgugugugcguguguguauauacacaggcuucgg

SEQ ID NO: 4179790 - RNA, 79 nt, Human
ccgaauguuucugucucccuaaaauucauguuaaagcuguaacccccaaugugauguuuuuggaaaugggaacauuugg

SEQ ID NO: 4179791 - RNA, 107 nt, Human
ccgaauuauugccaugcaaaugucaaguagccaaugcuuccuguuuuaguagaggcaguguccgagaagcagguagaggcuugagggugcaaugauggugauuuugg

SEQ ID NO: 4179792 - RNA, 111 nt, Human
ccgaccgcggucagugccugaggcuggggaacgcgcuggcccgcgccgaccgccucccgguggcccugggcgcguucugugucgcccugcggcucgaggcgcugcggccgg

SEQ ID NO: 4179793 - RNA, 73 nt, Human
ccgagaaauaagaauguguguccagguccaauuuauguaauuacacaauagauacugggcacauaucgacugg

SEQ ID NO: 4179794 - RNA, 84 nt, Human
ccgagaccguggcaacccuguggcugcccguccaagcaugcccaguguuugcugccaccaccgccacagcaucuauggucuugg

SEQ ID NO: 4179795 - RNA, 67 nt, Human
ccgagcuguggucucuuuuacggcuucaugaaaggaccgugcccucacggaggggaccacggcuugg

SEQ ID NO: 4179796 - RNA, 56 nt, Human
ccgaggcuggagugcaguggcgugaucucuacucacugcaaccuccgccucccggg

SEQ ID NO: 4179797 - RNA, 98 nt, Human
ccgagggcgcugggagucugcaaccugagaaugggggcaugugucccuggggcaguaucccccaucuuucauccaacaggcuuggccgggcugcuugg

SEQ ID NO: 4179798 - RNA, 60 nt, Human
ccgaguggcagguauccaggaagcuugauucgacagcucccagggacacuggccacuagg

SEQ ID NO: 4179799 - RNA, 89 nt, Human
ccgaguguucuguaaacugcugauuuuaggacuguuaccagaugucuucacaguuuaacaguuaagagcagauaguaaagaagucuugg

SEQ ID NO: 4179800 - RNA, 62 nt, Human
ccgaugaaaagggagugauauuuguugaaaaggaacaaaaagaagaacucccuuuucacugg

SEQ ID NO: 4179801 - RNA, 71 nt, Human
ccgauucagaauuccacugaucgcaggcggcgggcccuuuaccgcacuucugcuucaaggaaaugaaucgg

SEQ ID NO: 4179802 - RNA, 109 nt, Human
ccgauucccugugaugaguugugcuccuggaaagcugcccugugacauuucuucccuuuugugucccugacaguagcauuucccuggaggcucuuaaaggagaaggagg

SEQ ID NO: 4179803 - RNA, 66 nt, Human
ccgauuuaugucucugacuugauuuauggaaauaauacuaguuguugcaucagcaggcauaauugg

SEQ ID NO: 4179804 - RNA, 56 nt, Human
ccgauuuggcaggguucuugcugaaacuagauuuuacaaggaagugcacagauggg

SEQ ID NO: 4179805 - RNA, 122 nt, Human
ccgauuuuucuucugguucuuagcaggaagcacgaaaacauuuuaauuguccaguucuggagggaauggaacuugaaaaucaaggugguaagugcacugagcucaaccauugggaaaaaagg

SEQ ID NO: 4179806 - RNA, 63 nt, Human
ccgcaaugcaguugcaauggaggacucagccaaucuuacugggagcucuggagcugcaauggg

SEQ ID NO: 4179807 - RNA, 58 nt, Human
ccgcagcuggccacucaggaaggcagcucuuccaucuggcucugaggauuagcugugg

SEQ ID NO: 4179808 - RNA, 96 nt, Human
ccgcagggagaagagcugugugcugugaugugguuuauaaauuaccauuuggaaggagcugcacagcacagcagccugcaacuacucuuccugagg

SEQ ID NO: 4179809 - RNA, 56 nt, Human
ccgcagggccgcgagcgggaccagcaccgccugcagcugccgcucgaggcucuggg

SEQ ID NO: 4179810 - RNA, 77 nt, Human
ccgccacuugaaauaucuuuguucucacccuaucuuuaaacuucaauuuggugauaauaauaugguuuuuagugugg

SEQ ID NO: 4179811 - RNA, 66 nt, Human
ccgccauucccuaaugagagcaaucaaucccuuuaaugauuucucuccccaaguggaauugucagg

SEQ ID NO: 4179812 - RNA, 55 nt, Human
ccgcccagucuucccucuuuagcuuccuccaggcugagggguuauaacagggugg

SEQ ID NO: 4179813 - RNA, 72 nt, Human
ccgcccccaccgcugcucgugccaggacgcgcaguuugcaguugcagcucuggcacuggcgcgggauggcgg

SEQ ID NO: 4179814 - RNA, 90 nt, Human
ccgcccgccccucggccgcccgugcgcgcucgccucccgggcugcaacuuugggggaacuguugcgcgcgggcgucgcgggggcgggcgg

SEQ ID NO: 4179815 - RNA, 68 nt, Human
ccgcccgcgccagccucuccaucucgcaaguuuuaauuaacgcugagggggaggcggcugacgggcgg

SEQ ID NO: 4179816 - RNA, 65 nt, Human
ccgccucgggaagugcccucuucaggagaaaguccuauuucucuguaagcugccuucucgugugg

SEQ ID NO: 4179817 - RNA, 57 nt, Human
ccgccugcggcagagggugggagcgggugccggagccugugcuucagcuggaggagg

SEQ ID NO: 4179818 - RNA, 62 nt, Human
ccgccugcucaagugcgcacccaggggcaagaacggcuucaccccucugcacauggcugugg

SEQ ID NO: 4179819 - RNA, 130 nt, Human
ccgccuguccgguggagcaggcccggcccaagucuccaugccuggagggcagcccauucuggacauagcgcaugcccagaacugccuccacagccggcuuccucugcggcucucucuucacaagacacgg

SEQ ID NO: 4179820 - RNA, 64 nt, Human
ccgccuuucagucucgaugcgaugugcauuugacacaaauugcaagagagucugaaaaaugugg

SEQ ID NO: 4179821 - RNA, 72 nt, Human
cggaguucccugucucaggaaggguggcgaggggagauuuuguggcccuuugggugcaggggcaaggcucug

SEQ ID NO: 4179822 - RNA, 73 nt, Human
cggauuuguggaagcaacaggagggccuuccuuccuuccuaggaagcaccucuaugauugcuuuuuauguuug

SEQ ID NO: 4179823 - RNA, 81 nt, Human
cggcagcaagucuggagggcgaugaggggcaugaggaaguagcuucagcccagaccaccucauugccuccugugcgggcug

SEQ ID NO: 4179824 - RNA, 76 nt, Human
cggcagucccagcccagaggcgccggccuggcggcuggaagauugcacugugggcacaucuggggagcagcugccg

SEQ ID NO: 4179825 - RNA, 57 nt, Human
cggcagugaccaccucaccggacccagagagugggaaccaguaacuggucauugcug

SEQ ID NO: 4179826 - RNA, 67 nt, Human
cggcauuguugcaaguccuuaggaagcagucguuggauucagcgggggcucuggggcuacaaugcug

SEQ ID NO: 4179827 - RNA, 63 nt, Human
cggccagugccgcucucgccucgcggucuccguggggcgccccgagggugcgcacguggcgcg

SEQ ID NO: 4179828 - RNA, 70 nt, Human
cggccauuaggauuugaaaaggggcagaccagaggagauugagguuugcugucaaguccaugaguugcug

SEQ ID NO: 4179829 - RNA, 77 nt, Human
cggccccaccgagggugcaguccugcuagagaaaugcaagggaagcagggcagccaugagccuucaggaggaggccg

SEQ ID NO: 4179830 - RNA, 86 nt, Human
cggccccgcugccccucaccugggccuccagcucugccagccgggccuggcuaugcagcagcucggccuggagcucagcggggcug

SEQ ID NO: 4179831 - RNA, 86 nt, Human
cggcgcgggcggaggcagcaggcggcccgcgggcccggcucccccagucccggccccggcagccccgccagcuccgcucgccgccg

SEQ ID NO: 4179832 - RNA, 64 nt, Human
cggcgugcguuccuaguaaacacgcaccgagagcacggugugcguuccuaguaaacgugcaccg

SEQ ID NO: 4179833 - RNA, 55 nt, Human
cggcucccgcgcgccgccucgcgcuccuccccagcccggcugugcguggaggcug

SEQ ID NO: 4179834 - RNA, 102 nt, Human
cggcuccucugggcgacucuuccagaacagucugggacugagcuccaccacagauccuggguguggcugguucacaggcuuggacugcccagagcacagcug

SEQ ID NO: 4179835 - RNA, 88 nt, Human
cggcucuccagccuccaucugauccaugucuccuggacuugugagcggcgugcucaggagacaaagggugcggagaggcugggggccg

SEQ ID NO: 4179836 - RNA, 75 nt, Human
cggcugcgagaaccuggcgccgcacucggugcagccguagggccggucucccgugugugugcgcucgugcagccg

SEQ ID NO: 4179837 - RNA, 75 nt, Human
cggcugucggcgccuccugcguguccauuggcuccggaaacgggugcucaccgucgggggucgcugucucggccg

SEQ ID NO: 4179838 - RNA, 61 nt, Human
cggcuucucgggucggauuccgcggucccaacccuuccccauggccgacccugaggaguug

SEQ ID NO: 4179839 - RNA, 93 nt, Human
cgggaaaggaauguggaaugaacaaaggaggcgucugaggugcagucuaccugaaagcuagccuucuauuggucaccauuauucccugccccg

SEQ ID NO: 4179840 - RNA, 59 nt, Human
cgggaaguauuuucaguuuuaaaacccagucauuauugacuggcuggcugaguuuccug

SEQ ID NO: 4179841 - RNA, 57 nt, Human
cgggacaggcuucagauguauuaacuaagagaguuuugucuuuguggcuuguuuucg

SEQ ID NO: 4179842 - RNA, 78 nt, Human
cgggaccuaugagcaucgcugagaucccagaccuugaaagaugaggacuguggggaagcagaugccaccaaagccccg

SEQ ID NO: 4179843 - RNA, 130 nt, Human
cgggagaagcacagguuguuuguuuguuuaauccauuuacucuuuacaagaacccuuuuuacaaaugaggagaccaagucuucagagauguaacauauggaagacacagagcaaauagauggcucagcug

SEQ ID NO: 4179844 - RNA, 62 nt, Human
cgggagcuuguacuucucagagugccuuguuuaauaaagcucuccugaaggacaagcugccg

SEQ ID NO: 4179845 - RNA, 86 nt, Human
cgggauagggauguaguccuguauuguggaugaggcaaagaagaauuaaauuuauccagaaucaggauuuuucgucugguauccug

SEQ ID NO: 4179846 - RNA, 87 nt, Human
cgggaucguaaauguuaugacagugaaaaaaaucagacugagaucucuugucugacucagcacuguugaacauauauuuagaucuug

SEQ ID NO: 4179847 - RNA, 130 nt, Human
cgggcacagcucucugggggcucugaaagccucccucucagggccucuucagcagaugggccaguaucccuggccuugauaacuggggagagcagcugacaggaagagggggacucccuggaguggccug

SEQ ID NO: 4179848 - RNA, 74 nt, Human
cgggcagugcccagcggggcagcugugccuggacccuggcaccaacgacucggccacccuggacgcacuguucg

SEQ ID NO: 4179849 - RNA, 55 nt, Human
cgggccaucuaucuccuaguucagggcuucguguugugaggggaggagaggccug

SEQ ID NO: 4179850 - RNA, 55 nt, Human
cgggcccagagucugcaauggagucuuuucuagacucagccaggcucggagcucg

SEQ ID NO: 4179851 - RNA, 74 nt, Human
cgggccccugggggccggucuagggcuggggaggcucaggcccccucuccuugcacccgucccgcaggagucug

SEQ ID NO: 4179852 - RNA, 78 nt, Human
cgggcccucggcugcccaggcccugccuuggcaugugugucuccagagcgugcccggccaggccaucccagccgccug

SEQ ID NO: 4179853 - RNA, 81 nt, Human
cgggccugacccgcaggacccugaggagagcgcuucccgacagcgcuucggggaggcucuucaggagcgggaaaaggccug

SEQ ID NO: 4179854 - RNA, 56 nt, Human
cgggcgagggccugggccgagggacccccaauacccagguagcccucuagagccug

SEQ ID NO: 4179855 - RNA, 60 nt, Human
cgggcgcacuccgggcagcuguagcccuugcgagggccgggcucuccugggggcgccucg

SEQ ID NO: 4179856 - RNA, 100 nt, Human
cgggcggaggggacccggggcgagucaucaagggcgcgugguucggcgugccaggcgcgcugcucugccugcucucuuggcuucugucucccuucgaccg

SEQ ID NO: 4179857 - RNA, 62 nt, Human
cgggcuagcggccuggguugggcuuuguagcugcuccgcaggcccagcccgggccgcgcucg

SEQ ID NO: 4179858 - RNA, 65 nt, Human
cggggaaaaugauccuuguuguuuaaccagugggggugcuggaaaaucaggggacauugauacug

SEQ ID NO: 4179859 - RNA, 79 nt, Human
cggggaauauggaccuggcucuaagugucagcuccccagagcugugguggcugugucacuggaguuaauucugucccug

SEQ ID NO: 4179860 - RNA, 55 nt, Human
cggggaaugcuggaggcuggucccgguuauccgaggccuuccccugcagucuccg

SEQ ID NO: 4179861 - RNA, 83 nt, Human
cggggagagacgagcagaagccugguggucuggggaaguuuaaccagugucuugaugaauggggcuucuguaucugaucuuug

SEQ ID NO: 4179862 - RNA, 57 nt, Human
cggggcaggcugcaggaugcccagccguguccccaggaugcccugcacgcuguccug

SEQ ID NO: 4179863 - RNA, 56 nt, Human
cgggggaugcggggcugggcuguccuccucuagaagcguggcucugccacucaccg

SEQ ID NO: 4179864 - RNA, 58 nt, Human
cgggggccggccacaggcugcugauccaugcggcccuugucuguguggcuggcuccug

SEQ ID NO: 4179865 - RNA, 80 nt, Human
cgggggcuuggaggaaggggcucuucugaugggaucugcaguacccccuggaagugcccacugccuagugagagccccug

SEQ ID NO: 4179866 - RNA, 62 nt, Human
cgggguagcagagggcccagguaacuccagcacuggagucacagggggccccugcaacuccg

SEQ ID NO: 4179867 - RNA, 85 nt, Human
cgggguagcagcugcagggcacaggcuccggguccaggcccagguuuaaacccucauccuggcccuuacaagcuguaucaccucg

SEQ ID NO: 4179868 - RNA, 99 nt, Human
cggggucgcagggcgggagggggagcugagccggcagagaaaaugcccaggaaggggucgaugcuggccugggcugcaccuuggugccuugccaccccg

SEQ ID NO: 4179869 - RNA, 74 nt, Human
cggggucggccauggguugcugggggccaugguccugugccuaugggccaggcucagcagucaaccuggcccug

SEQ ID NO: 4179870 - RNA, 64 nt, Human
cggggucuugcuguguugcccaggcuaacgugcaguggcacgaucagggcacacugcagccucg

SEQ ID NO: 4179871 - RNA, 85 nt, Human
cggguccgagcagcuugaggcuggauuccaagugacacuucccucaggcagcuugggaugcagcuuggaggacugagugggcucg

SEQ ID NO: 4179872 - RNA, 65 nt, Human
cgggucgagugggcacagcuggguggcucuugcucuacuugcuaccagcugggcuuacucacucg

SEQ ID NO: 4179873 - RNA, 76 nt, Human
cgguaccuaguaaacaguaggaacugagaaaugauaacaauuacuuacuuuagaucauacugugugccaggcauug

SEQ ID NO: 4179874 - RNA, 59 nt, Human
cgguauuuaccaaucuucuguaacgagguagacuccauuuagaaucuggugauguaucg

SEQ ID NO: 4179875 - RNA, 55 nt, Human
cggucaggugcagcguuggcacaggguccucaaugccagagcugauggcugcccg

SEQ ID NO: 4179876 - RNA, 104 nt, Human
cgguccacuaaaauccacacucccuuuccuugguauaaaguugccacugagaaguuacauuuucuagcuuuuugcaccaaggugagaccaggugacuaguacug

SEQ ID NO: 4179877 - RNA, 75 nt, Human
cgguccucgcccccgcgcacgcgcagugcgcccuccucugcaaaaggggcugcggucacugcgggggcuggaccg

SEQ ID NO: 4179878 - RNA, 86 nt, Human
cgguccucggcgacccggccggccgguggcugcaccacgccgggucccgcgcuggagccagcggccugcugaggagccggggaccg

SEQ ID NO: 4179879 - RNA, 86 nt, Human
cggugaaaugagaccagagugggcuuccugagaagugucuuugaauacuugagaaucuugaugucuaccccugguucucuuccccg

SEQ ID NO: 4179880 - RNA, 95 nt, Human
ccuuaaugcacauauaccuguuuguaaauugugguuucuucuaauuuuacugaaaaagcugagcacauucaaacaggucuguguaauauugacgg

SEQ ID NO: 4179881 - RNA, 65 nt, Human
ccuuagaucaggcugucuagggaaggacugcuagcucccauccccagacggaucuuauccugagg

SEQ ID NO: 4179882 - RNA, 82 nt, Human
ccuuagcuugcugccuugaaaaugaagcuuuagaugcaguggaaauauuagggcuuugcugguuucaaggcuuccaaagagg

SEQ ID NO: 4179883 - RNA, 61 nt, Human
ccuuaguuaacuagaacuucgauuugcccauuccccaagugcauacacuaguuaauugagg

SEQ ID NO: 4179884 - RNA, 80 nt, Human
ccuuauacuuugugggguggguggauguucucuuuucuuuccugaacuugagcuguccugcccacccugcagggacuugg

SEQ ID NO: 4179885 - RNA, 59 nt, Human
ccuuauaggggugcuguggggacugaugugagaauauguuauacacauuccuggugagg

SEQ ID NO: 4179886 - RNA, 59 nt, Human
ccuuaucagccuuuuacuccuguguugucauauaacgcaacagagcagguuugaugagg

SEQ ID NO: 4179887 - RNA, 55 nt, Human
ccuuaugggaaugagggucaggacauauaauccuuucucucuccuuccucugagg

SEQ ID NO: 4179888 - RNA, 80 nt, Human
ccuuauuagggaaacugacuugucuccaaggcaguuccguuugcuacauuacaaugagacaguaaguuacuuugacaggg

SEQ ID NO: 4179889 - RNA, 82 nt, Human
ccuuauuuaaauguuauguuaauguuauaaauucuugguuuuauauaugaaaccuggacuuguaaugauaacugacuugggg

SEQ ID NO: 4179890 - RNA, 86 nt, Human
ccuucaagaucacaguuugggaaccugagaacucaaagagccccagcucuccugcaggccuguucccaguaucgguggucucaagg

SEQ ID NO: 4179891 - RNA, 73 nt, Human
ccuucaagaucuggguuuucagcuuucugcagccuuuguuuucacugaaauguugaaacuacucgucugaggg

SEQ ID NO: 4179892 - RNA, 60 nt, Human
ccuucaaggcaaggagggcuggcuggccagggcuuacagccucaacuucugccauggagg

SEQ ID NO: 4179893 - RNA, 55 nt, Human
ccuucaaugaaagcugcucccaucgccugagcgguccagagcuaguucauugcgg

SEQ ID NO: 4179894 - RNA, 73 nt, Human
ccuucaccugcccagcaccugggaucugguuaaaaggccuguucggauucaggaggucugggcagggcugagg

SEQ ID NO: 4179895 - RNA, 81 nt, Human
ccuucaccuuuguauuuucuaauuggcugucagggaggucauuuccauggcucuagagauugaaaagcauauggggcuggg

SEQ ID NO: 4179896 - RNA, 78 nt, Human
cccucuggucagaggccggccgagcccaugggcggugagguuggugccuggggucguggcuggucugguacagguggg

SEQ ID NO: 4179897 - RNA, 77 nt, Human
cccucuguuucucuuuuguaucacaguguuguuuggaucuugcuucagcccuacacuguaugaaaacaggaaauggg

SEQ ID NO: 4179898 - RNA, 60 nt, Human
cccucuucuuucccaugcucuuuucuugugagaaaagcauccaacaggagggaagggugg

SEQ ID NO: 4179899 - RNA, 77 nt, Human
cccucuuucuacagccaggggucucugggguucagguagcugaucccaaucuuuccugcuccuggccuggaaguggg

SEQ ID NO: 4179900 - RNA, 127 nt, Human
cccugaaaaacuaucauagaggcuuuuuggacguacacauuagugagguauuuugauauaucuucaaauacuuuauauacuucaaaacuuuaaugugguauagcugagauucuauauugauauaggg

SEQ ID NO: 4179901 - RNA, 88 nt, Human
cccugaauaguuugaaaaauuauguagccauaugaaacaagagcauaagccaugugugauagggcuacguaggaucagcuuucagagg

SEQ ID NO: 4179902 - RNA, 57 nt, Human
cccugacuugaucuuugacuuggcucuuuacugauccagccaaagcugaagccaggg

SEQ ID NO: 4179903 - RNA, 78 nt, Human
cccugacuuuuuucucaucccagaauaggagaauggggccaagccccuccugaaggcagauggggaucaagguugggg

SEQ ID NO: 4179904 - RNA, 63 nt, Human
cccugagaacaacuuaggggucuccuauaaagggaugaccaaguucuagguuuuucucuaggg

SEQ ID NO: 4179905 - RNA, 60 nt, Human
cccugagcucugacugcugggugacacagacguguguuuacagcugaucaggcaucaggg

SEQ ID NO: 4179906 - RNA, 81 nt, Human
cccugaggauagguuuguuuauguaucauuggucucucucagaaacagacuguaugauauccaaauugauaaccuccuggg

SEQ ID NO: 4179907 - RNA, 61 nt, Human
cccugaggcuucucuaguucagcucuccccuguucauagcugcugcuuucaagccucaagg

SEQ ID NO: 4179908 - RNA, 66 nt, Human
cccugauggccuaucuggcagucaucguccugaauaaagacuggaaagaaaaacaggccaugaggg

SEQ ID NO: 4179909 - RNA, 84 nt, Human
cccugcacagccauaacaguguuuugcucuuugcccaguaugcucuuugucggcaggcggaaaagacugcauugucuaguaggg

SEQ ID NO: 4179910 - RNA, 89 nt, Human
cccugcacuccaccccacggcaguggggagcgagucccagagugaaccccaccucagaggaggcuccuggcuccgagugggcuguaggg

SEQ ID NO: 4179911 - RNA, 66 nt, Human
cccugcacuggaaccagccuucugugauuccggcugccacacgcaggagcucguuuccaggcuggg

SEQ ID NO: 4179912 - RNA, 74 nt, Human
cccugcagagauggcagggagagugauugaauuggaguuaugggcucaagcucucccuggccagcugugcaggg

SEQ ID NO: 4179913 - RNA, 129 nt, Human
cccugcagaugggcuacgcgcagggcgccaaccagagcggccaggucuuuggccugggccggcagauauacgaccccaaguacugcccgcaaggcccaguggccgauggggcucccucgggugcaggcg

SEQ ID NO: 4179914 - RNA, 62 nt, Human
cccugcauaauuagagcagcucuuugcugaggaagcagagggcagagucuaaugaugcaugg

SEQ ID NO: 4179915 - RNA, 88 nt, Human
cccugcgccaggacgcucacccaagaccaucggaagugaagcaucagcugcaccacugcauggguggucgugaggugacugagcaggg

SEQ ID NO: 4179916 - RNA, 56 nt, Human
cccugcgccucagaccucaccaguguuuccaucagacacaguaacugggcgcaggg

SEQ ID NO: 4179917 - RNA, 79 nt, Human
cccugcugaaugcaagccauggggggaacugcugaggucuggcucagagccaaucauggugcauuuggacucagcuggg

SEQ ID NO: 4179918 - RNA, 66 nt, Human
cccugcugugucagaguccagggguggguguucucugcccuguucugaggacgugacauugccggg

SEQ ID NO: 4179919 - RNA, 55 nt, Human
cccuggaggaccccaauguggcuguuaaugucuagccaaacguggcacucuaggg

SEQ ID NO: 4179920 - RNA, 79 nt, Human
cccuggcaagacagagggaagcaaugaugcaagcaaucaaguauuuauuaaagcaucuacucugcuuggcccagugggg

SEQ ID NO: 4179921 - RNA, 63 nt, Human
cccuggcagcugcccgagaugcccuguaaacacuacggcuagcagaaagcaggcugcucaggg

SEQ ID NO: 4179922 - RNA, 57 nt, Human
cccuggccagggcacagggaggggagcuguuaccuuuccuuagccugccuuccaggg

SEQ ID NO: 4179923 - RNA, 66 nt, Human
cccuggccuuuuguuucuggagaacggagcuaagguacuuuuucucccagaccaaaggcagcaggg

SEQ ID NO: 4179924 - RNA, 79 nt, Human
cccuggcgccuucagagagagucugucccugaagaugucuugacauuugacuucuggguugcaggucuuggcggcgggg

SEQ ID NO: 4179925 - RNA, 84 nt, Human
cccuggcuggucucccaauccgggacagccuggccugcuccacagaacuggggguucagaggguguucugauugggggacaggg

SEQ ID NO: 4179926 - RNA, 60 nt, Human
cccuggcuuucccaucaauguggcaguggaggcacuuggagagcauugcuggggaauggg

SEQ ID NO: 4179927 - RNA, 55 nt, Human
cccugggaaguauuccagcuauuccuggcugagcccguugugaauauucccaggg

SEQ ID NO: 4179928 - RNA, 56 nt, Human
cccugggaggcuuccaggcagaccuuccacagcggugugugugaggagucccaggg

SEQ ID NO: 4179929 - RNA, 61 nt, Human
cccugggauucaauuucacucuuauagugaugccuaauauacuucaauuugugucucaggg

SEQ ID NO: 4179930 - RNA, 89 nt, Human
cccugggcauuuucuuggagggacagauggcuaggcugaugguuccugcaagcccagacauagaguccuucaaagccgcaaucccaggg

SEQ ID NO: 4179931 - RNA, 63 nt, Human
cccuguacagcucauuuguaaaacggaggcgucuacaucuguccuguuggguuguugcaaggg

SEQ ID NO: 4179932 - RNA, 104 nt, Human
cccuguccaguccccugucccaggauccugacuccaugugacccugggaagccugugccggggcuggguugaggcaucuugggcagggcugacugggaacaagg

SEQ ID NO: 4179933 - RNA, 68 nt, Human
cccugugcuaauucaaggaaacaaggcagccaaggagucuaacuugaggucuucauucuugggcaggg

SEQ ID NO: 4179934 - RNA, 55 nt, Human
cccugugggucuucggaggccccugcaggaccaaggggcuuggaggacucgaggg

SEQ ID NO: 4179935 - RNA, 81 nt, Human
cccuguguugaaacucucagggaucucaaauagacggucuaggcaguuggcucagagccuugagagcugaucggggcaggg

SEQ ID NO: 4179936 - RNA, 55 nt, Human
cccuguugggaagagagauggccagagugucccuggccacugggcaccagcaggg

SEQ ID NO: 4179937 - RNA, 95 nt, Human
cccuuaacaccugccacauagaggaggauauuaaggauuuucuuugccuuuaguucuuuccucuguuugccauucuucacaguagggauuggggg

SEQ ID NO: 4179938 - RNA, 58 nt, Human
cccuuagauaauuuccuuuucucuaugguaaagaagacaaggaggauauguuuaaggg

SEQ ID NO: 4179939 - RNA, 116 nt, Human
cccuuaguucaacuuauuucuuggcuucugaacaauagugguaacaaagcccacaggaaaauuuggccuuccagacacauuguugugaugauuaggaaauaugcuagaacugaugg

SEQ ID NO: 4179940 - RNA, 76 nt, Human
cccuuauacuucgaaaguucaguugaaaagaucuugaagucaauguccagcaugacacauucucaccaguagaggg

SEQ ID NO: 4179941 - RNA, 58 nt, Human
cccuuauggauccucuucucuucucuggaugugaagggaaaggauaugauccuagggg

SEQ ID NO: 4179942 - RNA, 76 nt, Human
cccuuauugagcucucuaccuucaaaacguauccggagugucucugcuccucacaugaauguaagcuccaugaggg

SEQ ID NO: 4179943 - RNA, 108 nt, Human
cccuucaauauguuagugaugaauagcuuuauagugcauaauuaacauggaauaauauccagucuuuuaagcacugugauacuaagguaagacacugaagugaagugg

SEQ ID NO: 4179944 - RNA, 61 nt, Human
cccuucaucagcuggcuuacuguucacuucaaggucaagacauuggcugucugaugcaggg

SEQ ID NO: 4179945 - RNA, 57 nt, Human
cccuuccccaaguagagaggggagcaucccccgugccccacucacugugggggaggg

SEQ ID NO: 4179946 - RNA, 83 nt, Human
cggugaggagcuggguauaggcauagcugagcugaaauuauagaaccuuuguucagaaauaaaauaucccaacuucaucauug

SEQ ID NO: 4179947 - RNA, 78 nt, Human
cggugauagauuuucauaacuuguaguagcuggaaacaggacugggaaaagcuauggcaaaucuccuguaggucaccg

SEQ ID NO: 4179948 - RNA, 87 nt, Human
cggugcgguacuugugacgggagcuugugaagugagccgccucccugaugugucuuggcggccagcaggcccugugauccugcgccg

SEQ ID NO: 4179949 - RNA, 63 nt, Human
cggugggcgggagcaaguaggggcacugggcggcccagagccagcccacuguucccgacaccg

SEQ ID NO: 4179950 - RNA, 70 nt, Human
cgguggucccaagaggguggcaagaacccccacuaauuuuuucucucucuagcuucuugaggcuuggccg

SEQ ID NO: 4179951 - RNA, 85 nt, Human
cgguggugaggaaaggugccuggagcuaauguguauagauaggaguaucauugugccaccgggccaggcauuccccacccagcug

SEQ ID NO: 4179952 - RNA, 73 nt, Human
cgguguccuggagugucagaaacaguguccuggcugggugcaggaccuguaaucccagcacuuugggaggcug

SEQ ID NO: 4179953 - RNA, 58 nt, Human
cgguuccaggacccuggccucugagagaaccugugcuuuccaggagaacugggagccg

SEQ ID NO: 4179954 - RNA, 63 nt, Human
cgguugcuuguggugagaguugcccaucauucugcucuggacuggcagccaccgcggcggccg

SEQ ID NO: 4179955 - RNA, 66 nt, Human
cgguuuaugucauugccaagaugcuaaucuaaggacaaagaacgcuaucuguagugacagucccug

SEQ ID NO: 4179956 - RNA, 129 nt, Human
cguaacuuccuccauaaguuuuuuuuaggaucuuccuccuugccuccucgcuggggcucaucaaaagggauaccaccccagggaaggcagauggaggaugucgaagaggcccccaaguagaggaaggcg

SEQ ID NO: 4179957 - RNA, 90 nt, Human
cguagauggaugcucccaggcugccacgauuacugcucucaaacauccacaucccagaggcacagagucacuagcuaagcaucauccccg

SEQ ID NO: 4179958 - RNA, 82 nt, Human
cguaguacagggcaaugcugaggcucaagggcaggugggagucagcuccuaggcugucagggcuccguuuguucucacuacg

SEQ ID NO: 4179959 - RNA, 86 nt, Human
cguaugaaaaaguuaccugcugacuuacacuguuuauuacuaauuaagaaaugcagacaguacuguuagaacuggcuuuuugggcg

SEQ ID NO: 4179960 - RNA, 65 nt, Human
cguauuguguuccuccuccauuguaagucaucucaggcuguccuuggggaggggaccugauuaug

SEQ ID NO: 4179961 - RNA, 68 nt, Human
cgucaaguaauaguucuaacuuuguugagcguguuaagugcuuaacacagugucuaccauuauugaug

SEQ ID NO: 4179962 - RNA, 129 nt, Human
cgucaccgucagccuucgguacuugaagagugguuaucccugcuguguucgcuuaauuuaugacgaaucauacagggacauccaguuuuucaguaucaaauacugcuuuggaaggcuucccggacagcg

SEQ ID NO: 4179963 - RNA, 80 nt, Human
cgucagucagcagcuguuuacggaacaccagcugcaggccaggcaccgugcugcaaggcguagauauguugcugaacacg

SEQ ID NO: 4179964 - RNA, 111 nt, Human
cgucagugaacuagugguagaaaggagcaaaugccaagugggaggcacagaaucaccucccuuugcuuccagcuuguggcgcuuuccuucugucugucuacaaugcuggcg

SEQ ID NO: 4179965 - RNA, 64 nt, Human
cgucaucuuucuucagcccuguaagaucacccaugaaggaugauugggagaagaugagauaaug

SEQ ID NO: 4179966 - RNA, 60 nt, Human
cguccugagaccauggccuuaguaaauacucauugcuuucagccacuguguuucugggug

SEQ ID NO: 4179967 - RNA, 66 nt, Human
cgucuagagcagagucuauuuccacacuccuuggaucugggguuggucacuugacuugcuuuagug

SEQ ID NO: 4179968 - RNA, 129 nt, Human
cgucucccaggcuguagcucucacugucugucuguuccugcuggcucuucuggguucugugucuggggcaagagaagagagaagggagggccagagagaugaaggggaggggagagucacagagagggg

SEQ ID NO: 4179969 - RNA, 64 nt, Human
ccugcuucagggaugauggcacugugucaaaaaugucaugauuugcauuguugcugagagcagg

SEQ ID NO: 4179970 - RNA, 55 nt, Human
ccugcuuccucacauguaagcaacacacucaaguguauuugcaaaggaaguaugg

SEQ ID NO: 4179971 - RNA, 95 nt, Human
ccugcuucugugugauccuggggaagucacuucucuuugggucucugcaaaauuaaagaguuggacuuucucaggcauuuguagggaaagaaagg

SEQ ID NO: 4179972 - RNA, 55 nt, Human
ccugcuugauauuuguaguagggaaaggugaucuuuacuaaacaaaacaugcagg

SEQ ID NO: 4179973 - RNA, 65 nt, Human
ccuggaaggcauuuauuccacaagcaggucagaagacauguuuuaagggucaacugucaccuagg

SEQ ID NO: 4179974 - RNA, 58 nt, Human
ccuggacagagggcagcggccagguuggagccuccagccacaugcagccucuucuagg

SEQ ID NO: 4179975 - RNA, 80 nt, Human
ccuggacauuuggucacaccaguccacauuaacguggaccagacaauauuaauguggacuggugugaccaaaaguccagg

SEQ ID NO: 4179976 - RNA, 75 nt, Human
ccuggacugucuuguuccaagacuaaaauuuuccaaagaccuucaaauuuacagugcucuucaagacuucccagg

SEQ ID NO: 4179977 - RNA, 61 nt, Human
ccuggagaccaggucuuggugcacacaacuugcuuuaucacucuucacacuugucuccagg

SEQ ID NO: 4179978 - RNA, 83 nt, Human
ccuggagaucuuguuaaagugcagauucugaucuaccaggucugggcuaggcgggagagucugcauuucuacaagcucccagg

SEQ ID NO: 4179979 - RNA, 57 nt, Human
ccuggagauugccacuuggaaggucauugugaccuuugacagcgugguuucuguggg

SEQ ID NO: 4179980 - RNA, 67 nt, Human
ccuggagcacagaggagccugggucuccuuuucaucaugcucuucuguggcucucaccacccacagg

SEQ ID NO: 4179981 - RNA, 83 nt, Human
ccuggagcucugccugccucucuccccgccucugccuccccccggagaggcggcuucugaggaggcugcuguuggcggccagg

SEQ ID NO: 4179982 - RNA, 60 nt, Human
ccuggagcuuuuccaguugacauguuccuccccuccauuucccacugccacagcuucagg

SEQ ID NO: 4179983 - RNA, 80 nt, Human
ccuggagggaaacaugggcagaauugugguaguuaaagucuuuguuuggaauuaacuuuuauuucugcucgcccaccagg

SEQ ID NO: 4179984 - RNA, 75 nt, Human
ccuggaggguugggggucucgggggccacccgcguuuuaugcacagugguccugagcaccagccugaccucuggg

SEQ ID NO: 4179985 - RNA, 67 nt, Human
ccuggauaauagauccuguucuuguugacuggaugaaguuaauaaagcuucugagucuagauccagg

SEQ ID NO: 4179986 - RNA, 57 nt, Human
ccuggaucacacugugaagaauugcugugagagaaauucaaauucagugugacuagg

SEQ ID NO: 4179987 - RNA, 80 nt, Human
ccuggauccaggcccaggaagugacucagauguggcaaagaagccauguuguugaagaacaucccggggcuggauuuggg

SEQ ID NO: 4179988 - RNA, 56 nt, Human
ccuggaucccgauggcugugaggagcuagaguuuccacuuccuaauggauucaagg

SEQ ID NO: 4179989 - RNA, 73 nt, Human
ccuggaugucuaguacuugcucuugaacaggcuuagacacagcuccucaggaagcucuugcugauucuccagg

SEQ ID NO: 4179990 - RNA, 87 nt, Human
ccuggcaagguuggcuuuguagcugugaggggauguucaugugagggaaacaugaaagcucagugcacugacagcccccaugccggg

SEQ ID NO: 4179991 - RNA, 96 nt, Human
ccuggcaauccaacugcugcuguuugccgucauugccuugaugucauuguucaggugggaggcaggaaggguaaggagaaaguagugaaugucagg

SEQ ID NO: 4179992 - RNA, 60 nt, Human
ccuggcacaagagcagcauugguuuaaucaucagcagcccuucugcucucuguagucagg

SEQ ID NO: 4179993 - RNA, 68 nt, Human
ccuggcacaucacuccuaguuuacagcugaagaaauugacugucagaaagguugagucaugugccagg

SEQ ID NO: 4179994 - RNA, 61 nt, Human
ccuggcacaugugagccacaucaucaacauuuccuggaugagggcauuauucugggccagg

SEQ ID NO: 4179995 - RNA, 59 nt, Human
ccuggcaccuccagcucauggcccugagcgggcagaguuggccagcuggaggcgccggg

SEQ ID NO: 4179996 - RNA, 65 nt, Human
ccuggcagcauugguagagauuuuuauuuaaaaucugaacaccacucucugcaaucuguccaugg

SEQ ID NO: 4179997 - RNA, 85 nt, Human
ccuggccaccgagcccccuggaacccauggccaguguagagcagcuacagcuugucugguuucagguccaccucagggugucagg

SEQ ID NO: 4179998 - RNA, 65 nt, Human
ccuggccagcuaauugcccaucuagggcauucucauacugccucuugggcugugucugguccagg

SEQ ID NO: 4179999 - RNA, 55 nt, Human
ccuggccaggcggccccugcaugcucaggugggcagugcugagagccuggccagg

SEQ ID NO: 4180000 - RNA, 55 nt, Human
ccuggccaggcucucagcacugcccaccugagcaugcaggggccgccuggccagg

SEQ ID NO: 4180001 - RNA, 76 nt, Human
ccuggcccagggaguucaugguguguccuaagccacaucagucacaccuagaaccuuaucccugaccaaggccugg

SEQ ID NO: 4180002 - RNA, 79 nt, Human
ccuggccgcaucugccccugggcuggucuggcuuagucaggagggcagcccuuggcccagggcacagacacaugccugg

SEQ ID NO: 4180003 - RNA, 78 nt, Human
ccuggccgggcaagguggcucaugccuguaaucccagcacuucgagaggccgaggcgggcagaucaccugaggucagg

SEQ ID NO: 4180004 - RNA, 93 nt, Human
ccuggccucggccuuuguccagcgaccaggcucuguccccgagaagcuacggccgaccugggucugguguugggacgcauggaccgggcuggg

SEQ ID NO: 4180005 - RNA, 78 nt, Human
ccuggcgugggaggguugggcugggcaugggccacggcugcccccacagagcccacccagcugagccgcucacccagg

SEQ ID NO: 4180006 - RNA, 58 nt, Human
ccuugguccaacccugcacagccucuaaguggcaaagggcaaugcgggagggccaggg

SEQ ID NO: 4180007 - RNA, 56 nt, Human
ccuuggugcuauuucauuucaugguguuaccaagaccugugaaaucagcacccagg

SEQ ID NO: 4180008 - RNA, 61 nt, Human
ccuuguaaguacauugaaacaucuuguuauuaaguacaaggauaguuuuauauuuaugagg

SEQ ID NO: 4180009 - RNA, 58 nt, Human
ccuugucaccaggugcaagacacaacaggaccacugggggcacgcuggcuugauaggg

SEQ ID NO: 4180010 - RNA, 71 nt, Human
ccuugucuuggguaguugugaggaagugaggagagaggagagcuugugucucacagcgaucuaggaagagg

SEQ ID NO: 4180011 - RNA, 76 nt, Human
ccuugugguaggaagugagcuaaggaguuuuuaguuuuaaaguggaaggcugugauuacugugccugcucauaagg

SEQ ID NO: 4180012 - RNA, 74 nt, Human
ccuuguugcaaacauucacuccaccauuccaguacaaaagcaaccauggaugagauguaaaugaaugagcaggg

SEQ ID NO: 4180013 - RNA, 65 nt, Human
ccuuguuguuugacaugcaaagcacuuuagacuauauuuaguaccuaauugauguggcagcaggg

SEQ ID NO: 4180014 - RNA, 66 nt, Human
ccuuuaaauuguuuuacacucucacuucacuuggagaaaguugacagggagguggaauaaguaagg

SEQ ID NO: 4180015 - RNA, 82 nt, Human
ccuuuaaauuugcauuuucaccagagacacuuaaaacuaagauagagagaagucaaugaugagagugcuuuguuauagaagg

SEQ ID NO: 4180016 - RNA, 69 nt, Human
ccuuuaacugggagcaguauuuuguuuugcucaguuucauaauggagaacagcuguucgcagauguagg

SEQ ID NO: 4180017 - RNA, 58 nt, Human
ccuuuaauugucugaagaaaaugauugagaagcagcaaucuucaaaaacaauugaggg

SEQ ID NO: 4180018 - RNA, 56 nt, Human
ccuuuagaaagucaguaguugccccaaauuggcacuucauggcacugucuuagagg

SEQ ID NO: 4180019 - RNA, 102 nt, Human
ccuuuaucuucugauuauuuccccagaaaggcuguuaauuuuguaggcacugcagaguuccacguacagcuuuuguguauuacagaaagucugagaagaagg

SEQ ID NO: 4180020 - RNA, 69 nt, Human
ccuuuauguacuguguauuugaacugcucauagaaucccuuguucuuuaaauacgcugugcauucaugg

SEQ ID NO: 4180021 - RNA, 72 nt, Human
ccuuuauuaaguucuugcugugugucagaugccaugguagguauuggaaauacaguagaaaaauaauauagg

SEQ ID NO: 4180022 - RNA, 69 nt, Human
ccuuucaaauaccauaaaccuaaugaagcagaugauugacauaaggucagaugguguuugauauuuagg

SEQ ID NO: 4180023 - RNA, 59 nt, Human
ccuuucaauaacaaagcucauuuugacucagcuuggucaagaagcaauuuauuggaagg

SEQ ID NO: 4180024 - RNA, 72 nt, Human
ccuuucacacuuuuguucuaauccgguucuuuuaaccgaggacuucaaauggaaacaaaacaaauugaaagg

SEQ ID NO: 4180025 - RNA, 89 nt, Human
ccuuucacugagggugcacuacauguacucacugugcuagauauugggaauacagggcugagugagacaugggcagacucccugagagg

SEQ ID NO: 4180026 - RNA, 57 nt, Human
ccuuucaggcagaauguagacugagcgcuccugcuacugcugccuguugcugagagg

SEQ ID NO: 4180027 - RNA, 78 nt, Human
ccuuucauaaaggaaaugaugagacuuggaauaauuccugaaauggaaaaaccuagacuuaacauuuuaaaugaaagg

SEQ ID NO: 4180028 - RNA, 80 nt, Human
ccuuuccccacugcccaggaaccagaggggcagauaaguaugacucagcugccccguggugcuuguagacuggcaagagg

SEQ ID NO: 4180029 - RNA, 121 nt, Human
ccuuucccucuaguaguacucaacacacuuguaauuacauguucaaauuugucuuucuuauuucuacuuagguucaugaaggcaagggacaugccuguguugcuuacuuucucuuggcagg

SEQ ID NO: 4180030 - RNA, 75 nt, Human
ccuuuccuagagcuuccacucuagaaggagucucagguuaacauuaggacucacuuugggcugggagcugagagg

SEQ ID NO: 4180031 - RNA, 68 nt, Human
ccuuucuacuuccagcagccugcuugcugguaauuucuucagugcccggacaacuggacagagaaugg

SEQ ID NO: 4180032 - RNA, 78 nt, Human
ccuuucucuugaccaugauagacacuugugccgaaaaauagucuggcacacauagaucugcacuggcuuagagggugg

SEQ ID NO: 4180033 - RNA, 69 nt, Human
ccuuucugaggccauuaccaauaaaauggagaucacaaugucuacuuuauaugacgguuucagaauugg

SEQ ID NO: 4180034 - RNA, 71 nt, Human
ccuuugacaacucuucuaucaguccucuugggaacucuaagaggaugauuuuaaggacacugucaacuggg

SEQ ID NO: 4180035 - RNA, 84 nt, Human
ccuuugcguuuuaggucaucuuaauucucaguaucugacggaaugucagcuauugauaaauguuggggaaauuuggaguaaggg

SEQ ID NO: 4180036 - RNA, 55 nt, Human
ccuuuggaagcuggaaauggaaaggaaacagauccucuuucacaaccuccagagg

SEQ ID NO: 4180037 - RNA, 66 nt, Human
ccuuuggccuggcugcccugucuggagugaggagucuuuguggaaggaggccaggcccagcagagg

SEQ ID NO: 4180038 - RNA, 81 nt, Human
ccuuuggcugugcucccaacuucaacucccuuccccaugggcccauccugaaguuagucuugaaguuagucagucuuuagg

SEQ ID NO: 4180039 - RNA, 129 nt, Human
ccuuuggggccuggucagagcugcacggugcugccuuuggggccuggucagagcugcacggugcugccuuuggggccuggucagagcugcacggugcugccuuuggggccuggucagagcugcacggug

SEQ ID NO: 4180040 - RNA, 72 nt, Human
ccuuugggguccucaacacccggcuguccccagacuuguguccagggaagauaguguugagggcccucaagg

SEQ ID NO: 4180041 - RNA, 67 nt, Human
ccuuugguguuuuacaaagguauuuuacauaugauuuuauaugaagaaaucuuugaaaauccauugg

SEQ ID NO: 4180042 - RNA, 81 nt, Human
ccuuuguaaucuucgcugagaugaugaauucauuuucauacuuuaagagggucacucgucaacuguagugacuuagaaagg

SEQ ID NO: 4180043 - RNA, 57 nt, Human
ccuuugucuugggccaagcuugcucagcaugagucauugcauuguuugaggcagagg

SEQ ID NO: 4180044 - RNA, 82 nt, Human
ccuuugucuuuucuucccaagcaguuucagagucuuggauaugacuugagcugccucaguuggguugagcugaagacacggg

SEQ ID NO: 4180045 - RNA, 60 nt, Human
ccuuugugucuugaugguagaugugaauauaaaagaauauucaugcaagauucauaaagg

SEQ ID NO: 4180046 - RNA, 57 nt, Human
ccuuugcugugguuuuagucaacaccuuggagagcagagguuaaaccauaaagaagg

SEQ ID NO: 4180047 - RNA, 55 nt, Human
ccuuuggagcaacugagagcuacucuuggaagauuaaggcuccagucuucagugg

SEQ ID NO: 4180048 - RNA, 78 nt, Human
ccuuuggauacugucucuugcuccugcccuccaggccuaacgccgguauagugcagcagggggaagacaguguggggg

SEQ ID NO: 4180049 - RNA, 58 nt, Human
ccuuuggcugcauagggaaggggugcccacaugcccccgcccgcauucaguucgaagg

SEQ ID NO: 4180050 - RNA, 72 nt, Human
ccuuugggcuccucaacacccggcuguccccagacuuguguccagggaagauaguguugagggcccucaagg

SEQ ID NO: 4180051 - RNA, 72 nt, Human
ccuuugggguccacaacacccggcuguccccagacuuguguccagggaagauaguguugagggcccucaagg

SEQ ID NO: 4180052 - RNA, 80 nt, Human
ccuuuguagguuucauaguuuauagugauacugcugauguugucucagagaauuagucacaauuauaggaacucagaagg

SEQ ID NO: 4180053 - RNA, 126 nt, Human
ccuuuuaccaagcccaugcgccuucuccugggcugcuucaggcaagggaaaaaaaucucccagugucacagugaggcaguucuuguacucagaagaggccauggaaaauuuuugcuuaagaaaagg

SEQ ID NO: 4180054 - RNA, 107 nt, Human
ccuuuuaucacauauaaaacccuucucaugcauaguuauagagacagucuaaaucugaccaucagggucuuuacaaucuaagcauaguuuuggcauauguugaaagg

SEQ ID NO: 4180055 - RNA, 74 nt, Human
ccuuuuccaacccaaaagcguuuccauuuuuuuaaugcuggaagugucuuaacuccuuuuggggucuuagaagg

SEQ ID NO: 4180056 - RNA, 85 nt, Human
ccuuuucccacugugggccugauguucuucucuauuucgcugggauauuuuggggacaauauucaggcccacucuuuugaguugg

SEQ ID NO: 4180057 - RNA, 92 nt, Human
ccuuuuccccagagccccuggaggucagaggccugggaaggcgguggccuaggguugcaggccucagacuuagccaugcucuggguuucugg

SEQ ID NO: 4180058 - RNA, 59 nt, Human
ccuuuucuagaaagggaggcaacacacauguuggguaaaucucaguuucuagagucagg

SEQ ID NO: 4180059 - RNA, 60 nt, Human
ccuuuucuguguggguaauuuaucuaccuagaaagauuacaaacucacagcagaagaagg

SEQ ID NO: 4180060 - RNA, 57 nt, Human
ccuuuucuguuuccugucacuguuguggcaaaaacauggcugaccuagcagagaggg

SEQ ID NO: 4180061 - RNA, 70 nt, Human
ccuuuugaggcuugggcucagaucuaguauaacaacaucuuugccacaaaacaaguccaaaaucagaagg

SEQ ID NO: 4180062 - RNA, 68 nt, Human
ccuuuuucuagagauuuugugaaguaucagaggccaucauaugcuucuaauuuuuuacagaauaaagg

SEQ ID NO: 4180063 - RNA, 98 nt, Human
ccuuuuuuagauggguugggugguacaacugggccauguuuuauguugucauaaaaauuauucauggcuuuuggaucaaaguugccuauaaaaaaagg

SEQ ID NO: 4180064 - RNA, 57 nt, Human
ccuuuuuucuaugccaacucugcuucccagucaagcggaaggagccaagagaaaagg

SEQ ID NO: 4180065 - RNA, 76 nt, Human
cgaaagcucaauugugaugauugcacaaguguauaaauuuacuacaacuuaugaaugucauuauaaugugguauug

SEQ ID NO: 4180066 - RNA, 79 nt, Human
cgaagauuaaggcauuggaagauucugugucuggugagguccugcuccucaaagacagcaacuuccaccuguguguuug

SEQ ID NO: 4180067 - RNA, 63 nt, Human
cgaaggaaucacuuaacacuuucaaagcuauaaaugguuuacaaagugguaaggauuauuuug

SEQ ID NO: 4180068 - RNA, 74 nt, Human
cgaagguaaagccuuaguuaaaagaaguagaauccugacacucgggauacugaauuagguaaagcauacuuuug

SEQ ID NO: 4180069 - RNA, 64 nt, Human
cgaagguaguagggacuugggaguggugacugaaccuggucuggcuccuccuuacuuccucuug

SEQ ID NO: 4180070 - RNA, 56 nt, Human
cgaaucacuguuauugaccauaagccacaaaguugucuggucagcauuaggauuug

SEQ ID NO: 4180071 - RNA, 68 nt, Human
cgaaucugccagguguccgggagucgcucggggacgcgcgagcuccuugaagggcucugggagaugcg

SEQ ID NO: 4180072 - RNA, 84 nt, Human
cgaauuaauguuggagagccaguuaagcacuuacagcugugugguaggcauuugggggcucacaagacaaauauuaaucuaucg

SEQ ID NO: 4180073 - RNA, 76 nt, Human
cgaccaagacagacugcagggcggucaucagccauuauugccucuugggccgggacuguccucugugucugugucg

SEQ ID NO: 4180074 - RNA, 94 nt, Human
cgacgccccuguuucuggaaacggguucaagcuugauccaggauccuucuugaccaggcaagcuugaccuuugauccaggcucagugggcguug

SEQ ID NO: 4180075 - RNA, 69 nt, Human
cgagaaaguuuucuaacaucuaguaauuuguaacuuagaaguggaguugccuuguggaugucuuuuuug

SEQ ID NO: 4180076 - RNA, 66 nt, Human
cgagaagaggugauucauauugagacugccuaggucaaggaaucuaaagugagucauuucgacuug

SEQ ID NO: 4180077 - RNA, 73 nt, Human
cgagaagucgaucaccucguccuccgugccguggaugaugagcacgggagacgugaucuuggacaccuucucg

SEQ ID NO: 4180078 - RNA, 73 nt, Human
cgagaagucgaucaccucguccuccgugccguggaugaugagcacgggcgacgugaucuaggacaccuucucg

SEQ ID NO: 4180079 - RNA, 88 nt, Human
cgagagcucuuuaacaaguauuuacugagcagcuaccaugugccaccaucaggcauggguguaauagugggugagagcaauggucucg

SEQ ID NO: 4180080 - RNA, 66 nt, Human
cgagaugccgaggcggcaggaagccggaacccaucccccgccugcucuggcguacucggcaucccg

SEQ ID NO: 4180081 - RNA, 61 nt, Human
cgagcggugcgcgcuccgaguggccgggacgcgcgccaguccugggagcuugcacugcucg

SEQ ID NO: 4180082 - RNA, 64 nt, Human
cgagcuuaugacucagaagauauuuuccaguuaguaguugguaaauaugucuuuugaguuuuug

SEQ ID NO: 4180083 - RNA, 68 nt, Human
cgaggaagcugaggcccauggcaagguagucuuuaaaagacacuuuguuuucacgcuucauuucuuug

SEQ ID NO: 4180084 - RNA, 66 nt, Human
cgaggagaccaggcuggaguucuguagaguguaaaauccuggauguccucucagccugucuccuug

SEQ ID NO: 4180085 - RNA, 69 nt, Human
cgaggcagacaaaaguuggaaggccgguuaauuuuccccuccuucuccugcuucagcuuugucuccucg

SEQ ID NO: 4180086 - RNA, 55 nt, Human
cgagggcuucacugauguucuuugggaguggagauucaucaaguggaguaucucg

SEQ ID NO: 4180087 - RNA, 57 nt, Human
cgagguaguggcggccgcggcccaccaccaacugcucgccaccgaccccacuacucg

SEQ ID NO: 4180088 - RNA, 69 nt, Human
cgaggugguggucuuggauguugcuaaccaaaguguuguuccccagcccagcagacuguuaccacuucg

SEQ ID NO: 4180089 - RNA, 89 nt, Human
cgaguauacguuagcaugucagucgccacacgucucagugacgugcgcuucagggcacgugggcgaaauggcauccugacuccaacuug

SEQ ID NO: 4180090 - RNA, 60 nt, Human
cgauggcagcagcagccagggaugcaacaagagucacauucgcuuugaaggcugcccuug

SEQ ID NO: 4180091 - RNA, 73 nt, Human
cgauucugcaguucuuuggcuuuuagaauuucugcuucagaauuccguaaggcugaagaugcugcacacuuug

SEQ ID NO: 4180092 - RNA, 66 nt, Human
cgcaagcuggucaccaccucggagaccuacgucaagaccaugucccugcagcaggugaucaaugcg

SEQ ID NO: 4180093 - RNA, 62 nt, Human
cgcagagagagaugaaggguguggaggcugaguccucuaggaaccugacaucucucaaugug

SEQ ID NO: 4180094 - RNA, 58 nt, Human
cgcaggccgcugcuacggaggcgcccgcucgcugucucgcucucuggcggugucugcg

SEQ ID NO: 4180095 - RNA, 71 nt, Human
cgcaggccgugggcgcgcacggccgcugccgccguuuguucugguggaggcugcgagugccugggccugug

SEQ ID NO: 4180096 - RNA, 95 nt, Human
cgcaguaacccaucaauucagugaaacaacuacuauugauuucuggggguuuuccaccccacugguuguuuaacugaauugauggguguucugug

SEQ ID NO: 4180097 - RNA, 81 nt, Human
cggaguuugcaggucuugggagaguccaugaaacacugauacauacauuuauguucuuccaaaucuguaacaaagcacacg

SEQ ID NO: 4180098 - RNA, 73 nt, Human
cggaguuuggagaaugaaggagagcccucugcaggauugcaaugccaguggcacuugucauuucugagcuucg

SEQ ID NO: 4180099 - RNA, 75 nt, Human
cggcaauccuguuaacccagggugaggggagucuagccgggcugcuuuucucacucccuggaaaacuuuuugcug

SEQ ID NO: 4180100 - RNA, 84 nt, Human
cggcacacccucaaagccuuucucauuuuaagcauuagaucacuuuguaucagagccacuuggagaugagaaagugggaguccg

SEQ ID NO: 4180101 - RNA, 57 nt, Human
cggcacaggguaaacguuacccgccucaguuucuguuugucuguccacccugugcug

SEQ ID NO: 4180102 - RNA, 99 nt, Human
cggcacauccgcccuuuggcacguggugugugugaauuacgcguguccugaugcagcacacagugacucgcaccucagugugaccagguuucuguguug

SEQ ID NO: 4180103 - RNA, 57 nt, Human
cggcaggugugcucacucugcccgggagcgucuccccgccgaggagcgcccaugcug

SEQ ID NO: 4180104 - RNA, 68 nt, Human
cggcaguccauuggugacacugggaccaugcuggccucagcaggugcccuucagacagugggcagcug

SEQ ID NO: 4180105 - RNA, 79 nt, Human
cggccgcugugcugcgggaggauuccgauccgggucagguuucgcuggaacgguucccugagcaagugcacgugggccg

SEQ ID NO: 4180106 - RNA, 63 nt, Human
cggcgccgccugcugaugagcggaucuccggaccccccgccagcagcgauagggugagugccg

SEQ ID NO: 4180107 - RNA, 89 nt, Human
cggcggcgguggcggugguggcaguagcacugggccugcgggcgguccgggauccaggccggggcggcgccaucuugugcccggggccg

SEQ ID NO: 4180108 - RNA, 64 nt, Human
cggcuccaggaccagggcuccuggagcugucgccuccgaaaggguccugcguccuucggagccg

SEQ ID NO: 4180109 - RNA, 60 nt, Human
cggcucugaccggauuggagagagcuuuucuuuguguucucuccucccggggagaggccg

SEQ ID NO: 4180110 - RNA, 87 nt, Human
cggcugcaccugucuucugugccucucuccucucuuccccuccaucuggggaaagagggacaggcgcagacacagagcaagcggcug

SEQ ID NO: 4180111 - RNA, 65 nt, Human
cggcuguggcggcagcagcuggugccugucaguaaucacgcauaaugcugccgccgccgccgccg

SEQ ID NO: 4180112 - RNA, 56 nt, Human
cggcuuccaacaagcuuugcugaaacccagaaccagccaagagugucugggggccg

SEQ ID NO: 4180113 - RNA, 61 nt, Human
cggcuucuuuuaagguugcugaagcaaacacuuugcuuaauauuugaaccuagagaaguug

SEQ ID NO: 4180114 - RNA, 57 nt, Human
cgggaaaguuccacagauggaugggggagaugauugcccaacagugugaacauccug

SEQ ID NO: 4180115 - RNA, 79 nt, Human
cgggaagcugugccuauucguggcaaguucaagauaaaaugcauauguccuugcaaugaaggcacacuuauuuaucccg

SEQ ID NO: 4180116 - RNA, 117 nt, Human
cgggacguggccacaggugggcuccgggcgcgggaaggagcccgagaaggcggagcuugcaggggcccugaacucuugcccuccaggucucggcccagccccacuguggucccccug

SEQ ID NO: 4180117 - RNA, 64 nt, Human
cgggagaugaguggagccaggaguugggaugggaacuuugcucuguggcuccuucaggcugcug

SEQ ID NO: 4180118 - RNA, 103 nt, Human
cgggcauggcuguuuaggggcagcccccucauucucugagcuaguuuugcaaaacuugguggggggugaggguaguugcccacaggagcagugaaaugagcug

SEQ ID NO: 4180119 - RNA, 58 nt, Human
cgggcgccuguagucccagcuacucgggaggcugaggcaggagaauggcgggaacccg

SEQ ID NO: 4180120 - RNA, 70 nt, Human
cgggcguguucagcaagaauguuucuauuuugcucuaugucaugauaaauuacgcuugcuggcugcaucg

SEQ ID NO: 4180121 - RNA, 66 nt, Human
cgggcugcagggcuguggucuggagugcggacaguaccagcucccacugcuguccugccaugcuug

SEQ ID NO: 4180122 - RNA, 67 nt, Human
cucaaggguguguuauacauccucacucucauagagaaagaucugaauguaacacaugagcuuugag

SEQ ID NO: 4180123 - RNA, 56 nt, Human
cucaagucaauacauuucuacgaguggaaagacaaaguugagaaaguugauuuggg

SEQ ID NO: 4180124 - RNA, 57 nt, Human
cucaauaaauuguaguuguuaugcuacuaguauuagcaccauuacaguuugauuggg

SEQ ID NO: 4180125 - RNA, 73 nt, Human
cucaaucauuuugcuuuugcaucauugaugaaacuuccuuccuuucuuucuugcaagagcagaaagaacugag

SEQ ID NO: 4180126 - RNA, 59 nt, Human
cucacaagaacugcucagucuuccgcaggauuauucugcuggagaagcaaaguucugag

SEQ ID NO: 4180127 - RNA, 85 nt, Human
cucacacacucaaggggaaucagagaagacuuccugaaggaagugaugucuaacuugaucccugagggaugaguaaaaaguggag

SEQ ID NO: 4180128 - RNA, 89 nt, Human
cucacacauuggccacagcagaugcuucagauggauuguaucaaauggaaguaaggaucaggguauuucgcugggccgagauuggugag

SEQ ID NO: 4180129 - RNA, 69 nt, Human
cucacagcaggguaacaggaagacccccuccuccagccaaaagagucccacugagccccugcuggugag

SEQ ID NO: 4180130 - RNA, 61 nt, Human
cucacaggaaguggucagugccaguaggaaaaaaaaguccucuuugguauauuuccuuggg

SEQ ID NO: 4180131 - RNA, 58 nt, Human
cucacaggcgcagcaccaggugaaggguggacucuuucuggauguucuagucugagag

SEQ ID NO: 4180132 - RNA, 56 nt, Human
cucacagucucucccuaauuuuuaauacaaaagauggagauggggaagagugugag

SEQ ID NO: 4180133 - RNA, 71 nt, Human
cucacaguuucuauaggucagaauuugauagcagcuuaguugagugauucuggcuuaaggugucugaugag

SEQ ID NO: 4180134 - RNA, 61 nt, Human
cucacauagcagagagcagagagagaagaagcaagcucucccaugucucuucuuauguggg

SEQ ID NO: 4180135 - RNA, 55 nt, Human
cucacaugauggccuuuuucauuagaauucuuuuggaacguaggaagucugugag

SEQ ID NO: 4180136 - RNA, 70 nt, Human
cucacauguaaaaggaacaugcaugcuaccuguagcuacggccagacuguguguguguuucugcauguag

SEQ ID NO: 4180137 - RNA, 65 nt, Human
cucacauuccacuugugccaaccuuucccaaggaaugaguuccucuacaagugaaauguucagag

SEQ ID NO: 4180138 - RNA, 57 nt, Human
cucaccaaggccugaacugcccaagacucugcaugagugggcaguggcacuagggag

SEQ ID NO: 4180139 - RNA, 87 nt, Human
cucaccagcccagccaccacaucuagauugcagcccugggacacacucugcaaaagagggugugggaagcggggucauggcuauggg

SEQ ID NO: 4180140 - RNA, 108 nt, Human
cucaccaggcuucaagcugcugccuggauggcucugagcagggcuggcuguuucaccccaagcugagcaccaucugaucaccuagaggcagugcuggggcaggcugag

SEQ ID NO: 4180141 - RNA, 85 nt, Human
cucacccauuggcuguuuuauaggucaguuaagugugcuuagcuaauguacugagacuuaaaagcaagcccaagaauaggguggg

SEQ ID NO: 4180142 - RNA, 130 nt, Human
cucacccccgaagcuuaauuaaaaugaagaugaaguacucuccaugacgggucacacucaguggcagccaccgugccagggacccugucggcccucugaugccgagaauucuucuccagcuucuacucug

SEQ ID NO: 4180143 - RNA, 57 nt, Human
cucaccuagugauccgcccaccuuggccucccaaagugcugugauuacaggcaugag

SEQ ID NO: 4180144 - RNA, 77 nt, Human
cucaccuuagugaggggcagcugagugggcagggugaugccuucuuuagccagcagcuucuucucauccucggugag

SEQ ID NO: 4180145 - RNA, 61 nt, Human
cucacgccuuccccuguauaguauagcaccccuaacuguauguguaaggagaaggagugag

SEQ ID NO: 4180146 - RNA, 76 nt, Human
cucacuaagugcucaauucauauuggucuauuuuaaucaucauuauguuacaguugaguaaauuaaacuuggagag

SEQ ID NO: 4180147 - RNA, 60 nt, Human
cucacuaugcuauggcugccuucuuuuauagucuaggaaaaggcagaagcauggaaugag

SEQ ID NO: 4180148 - RNA, 58 nt, Human
cucacucacugcugugucucuugcacccagcauggugcugggcagagcuggugcugag

SEQ ID NO: 4180149 - RNA, 62 nt, Human
cucacucaggcugugucaggaggaaggaagaguaaaccuccagcugacaucuccugagggag

SEQ ID NO: 4180150 - RNA, 77 nt, Human
cucacugaaucaagauguaucgacucuauucaugucugcggacaucuuugaauccuuuacaucugagacucaguggg

SEQ ID NO: 4180151 - RNA, 57 nt, Human
cucacugcaaaaaaccaaggccaaugucucaaacacugguguaguuuucugcagggg

SEQ ID NO: 4180152 - RNA, 55 nt, Human
cucacugcucuucccaagcugccauguuagaggccacuggaaaguuggcagugag

SEQ ID NO: 4180153 - RNA, 80 nt, Human
cucacuuaaggcagacaaguccagaacuggcaucuacucguauuucagucucuggcugugucugacacauugucagugag

SEQ ID NO: 4180154 - RNA, 65 nt, Human
cucagaaaccauguugucuugaauaggcauguucugcgucaucuguucauacacaugcguuugag

SEQ ID NO: 4180155 - RNA, 130 nt, Human
cucagaagaauaggcuuguuguuuuacaguguuagugauccauucccuuugacgaucccuagguggagauggggcaugaggauccuccaggggaaaagcucacuaccacugggcaacaacccuaggucag

SEQ ID NO: 4180156 - RNA, 76 nt, Human
cucagacuguacucuucuagccaucugaaauacguuuucuagguagagauagauuguguaaggguacaguugugag

SEQ ID NO: 4180157 - RNA, 59 nt, Human
cucagagaagucuuugcuaaacccccuaucgaugaggaggccauggcguggcuuuugag

SEQ ID NO: 4180158 - RNA, 68 nt, Human
cgugaaacagugguuaaguggacuggguucaugaagauuuagcuauggauaacaaccaccgugacaug

SEQ ID NO: 4180159 - RNA, 96 nt, Human
cgugacaaacccuuggcugagcaugagaugagcaauaagugagugguagcuccuuuccagccucaccucagcugcagaaacaagaggcucuucacg

SEQ ID NO: 4180160 - RNA, 63 nt, Human
cgugauagauuucugcucaagcuuaguuccaggaaacguuugguuucugcagauguuuacaug

SEQ ID NO: 4180161 - RNA, 102 nt, Human
cgugauguuuagcauaauauuuguaaaggaacuagcaugauguguaguacaugacaguuuagaaauuuuguuacuucuuuuaguuaaugccaaacacuuacg

SEQ ID NO: 4180162 - RNA, 78 nt, Human
cgugauucugccugugccaaugcuccuuugucccuguuuaaguuggagagaagccugacacuggccaucaggaacaug

SEQ ID NO: 4180163 - RNA, 73 nt, Human
cgugauuuuaucuuacuugcagauguagaaguuaauuucuaaauugaucaaaugcauagaaagaugaaacaug

SEQ ID NO: 4180164 - RNA, 77 nt, Human
cgugcagucagucuggagagguaagucagccggaacauggguuuugguucauuuucucaucuagaugugacugccug

SEQ ID NO: 4180165 - RNA, 113 nt, Human
cgugcgugucagauuuaggccaggaagcggaagucgccagcagcgagaguuuaaccucugugggcgcagaggguugcggggauucagcgcccgggaccguggaucugugcagg

SEQ ID NO: 4180166 - RNA, 64 nt, Human
cguggagggcuccugcaugcugccagccuuggguuguccccuggccuggcaggggaccucuaug

SEQ ID NO: 4180167 - RNA, 68 nt, Human
cguggauggcaguggccaccuccuuggagcacuuaacacccagaccgauguggccauuguaguccacg

SEQ ID NO: 4180168 - RNA, 65 nt, Human
cguggcaguagagcuggaacuugaaucuggaauuaucuggcuagugaucuagcucuucuuccaug

SEQ ID NO: 4180169 - RNA, 130 nt, Human
cguggcggccccgguggagcgggcgcagcuaggcgggcccgagcugcagcggcugacgcaacggcugguccaggugaugcggcggcggcgcugcgugggccuaagcgcgccgcagcugggggugccgcgg

SEQ ID NO: 4180170 - RNA, 107 nt, Human
cguggcuccccgccaggcacggccuuucacagagauuuaaaaagaauaaacuguuggugucaguguuuuuaaguuuaggaggggaguauuuaggggaaggagccaug

SEQ ID NO: 4180171 - RNA, 66 nt, Human
cgugggacgaugcccugcucucgggaagggacccgcggucccugcugaagcggggcaugcaccacg

SEQ ID NO: 4180172 - RNA, 58 nt, Human
cgugggccaggacccgcuguccgcccgccgcccgaggucggguggacgcuuggccccg

SEQ ID NO: 4180173 - RNA, 59 nt, Human
cguggggacuacggccauguccgcugacugugcagaugcggaagcgguagucacccucg

SEQ ID NO: 4180174 - RNA, 102 nt, Human
cguggggugggugggguaggggcagggaugggaucuguggccaggcggauagggaugaagcauagcucccagauuucagccuugugccccacucagcccaug

SEQ ID NO: 4180175 - RNA, 62 nt, Human
cguggguauaggauauuuccgccauuguaaaaaguucaauuggaaaauuccauacacccacg

SEQ ID NO: 4180176 - RNA, 85 nt, Human
cgugguagcacauagaauguuggagugggguuaggggaguggggauacucauccagccccggcuuccuuacaguuugauauuacg

SEQ ID NO: 4180177 - RNA, 75 nt, Human
cgugguuuuguuagaauguagugcuucaagauuuauuuccacuaaaaucuuaaagaauauucuaccagagucuug

SEQ ID NO: 4180178 - RNA, 86 nt, Human
cgugucuuccucaugagacuuagagcuccuugaggguggggaaaauaucugaucuauuucucuaaugucuaauaugaggcagaccg

SEQ ID NO: 4180179 - RNA, 60 nt, Human
cgugugccauuuugcauagcagaagcuugagcaucuucuucaaacaaaaguggcaugaug

SEQ ID NO: 4180180 - RNA, 74 nt, Human
cguguggcuagugcaaccgaggaauugaauuuuaaauuuuauuucauuuuaauuuauauguaauuaggcacaug

SEQ ID NO: 4180181 - RNA, 58 nt, Human
cguguguaugcauggcagugagagaguaaaucucugcaggaugcaaaguguacaucug

SEQ ID NO: 4180182 - RNA, 62 nt, Human
cgugugugugucuguguguguguguguacaugcgcacauacacaugaauauauuuuuauaug

SEQ ID NO: 4180183 - RNA, 69 nt, Human
cguguuggaccaggacacaguggcaaggugagccagguuggccuucugugcuccuggccuuuccucacg

SEQ ID NO: 4180184 - RNA, 68 nt, Human
cguuacucccgaucccugagccauggaagauugucccaggcagauggcucagucauggaugaguaaug

SEQ ID NO: 4180185 - RNA, 130 nt, Human
cguuagaaucacccugggagauguaaaaauaccaauguucugguucuaccccugaccaauuaaauugggauuucugguggugggccacaagcauacauauuuuuuaaaagcucucuaggugauucuaaug

SEQ ID NO: 4180186 - RNA, 80 nt, Human
cguuagugguggcuuagaucuauuacugaaugagcccuguauucagaaauagaaaauuugauuaaacgcuucaucuaacg

SEQ ID NO: 4180187 - RNA, 61 nt, Human
cguucaccuggagaucguuggggccaggagcucugcugccugggcucaccgccucuuuacg

SEQ ID NO: 4180188 - RNA, 71 nt, Human
cguucauucaguauuuaccaagcaccuacaauaugccaccgugagaggugcuagguguguaguggagagcg

SEQ ID NO: 4180189 - RNA, 70 nt, Human
cguuccugcuaacauugcuguaaaccugaaaacaacuguuauacguuuaugagcaaugcugaggggaaug

SEQ ID NO: 4180190 - RNA, 62 nt, Human
cguucuccugcuggugccuccuucuugccgagagcaagggagcaugggugaagcaggccacg

SEQ ID NO: 4180191 - RNA, 64 nt, Human
cguugucaauggugggaugaaagucaggcgaggggucugcagccagcccagcccauugacagug

SEQ ID NO: 4180192 - RNA, 67 nt, Human
cguugucuaucuguucacacggauuaugggccauggaauacuccuucccuggaacagagagacaacg

SEQ ID NO: 4180193 - RNA, 72 nt, Human
cguugucuucuuagccagcuaacuuaagcaccuuccaggggcucugagcucugacuaguauugaggcaaacg

SEQ ID NO: 4180194 - RNA, 86 nt, Human
cguuuaaugaagcucacucuugccugugguuucugaacaccaucaaauagugguaacugaggcagaaggguaaguggauguggacg

SEQ ID NO: 4180195 - RNA, 59 nt, Human
cguuucagcacccagagccacacggaaggguuagugguggguaaacugggucuggagag

SEQ ID NO: 4180196 - RNA, 75 nt, Human
cguuucucauugcccugugcuggaaucuucccccaggauuggggaacagggccugagcuggggaaaggagaggcg

SEQ ID NO: 4180197 - RNA, 89 nt, Human
cguuugcuuccaaucuuucguuucuccugucugcuucccacaugccacaagagaaggggacucagcaagggaacaaagaugaguuaaug

SEQ ID NO: 4180198 - RNA, 84 nt, Human
cguuuggaaaucucaguuacaucuugccucuguucucuaaaugcuugaaagaaaggaagacaagcaguggcugagcauccaccg

SEQ ID NO: 4180199 - RNA, 56 nt, Human
cguuuuucuaauaaagcggugcucuguguugcgccaaagcuggagguggaggugcg

SEQ ID NO: 4180200 - RNA, 71 nt, Human
cuaaaaauuaaauaauuucuuagagcuguuuguaaaaauuuggggacaaagccuaagaaguauuuauuuag

SEQ ID NO: 4180201 - RNA, 63 nt, Human
cuaaacagcuguauuguauugugccccgacgaauaccuguuuggaagccagacagcugugcag

SEQ ID NO: 4180202 - RNA, 92 nt, Human
cuaaacuaguaggauuaggauuagagcaaggagaguuagugaggaaguguaacuuucacugaauacuugucucauccagaauucugcuguag

SEQ ID NO: 4180203 - RNA, 130 nt, Human
cuaaagaaacgaaagacuggucagggggccauuacaauagcccaggacaaguguggccauggccuguggaagagcuagauggcaauacauugucucugaugugaaaucucuggugucaaagcccuggugg

SEQ ID NO: 4180204 - RNA, 62 nt, Human
cuaaagagcacgcuuuucucucucauugcuauacacagaggucagagaugaguguucuucag

SEQ ID NO: 4180205 - RNA, 60 nt, Human
cuaaagccacagagguuuaugcuauagauaaaauuuaaccccaaaucucaguggcuuaag

SEQ ID NO: 4180206 - RNA, 63 nt, Human
cuaaaggcucagcauucuuuucugcucauucauuuacauuugcaaagucuccugagccuuuag

SEQ ID NO: 4180207 - RNA, 82 nt, Human
cuaaagucagaguguuggcagggcugauuccuucuggaggcucuaggacaggauuccuugccuugccuuuucugacuuccag

SEQ ID NO: 4180208 - RNA, 129 nt, Human
cuaaagugccaggaagacauagggacaauucaaauuugaguuugugaugaguggcuaugaucaaauuuugcauuauuccuuagauuuaauuuaucaucucuguaagcaacaaucuucagggcaagggag

SEQ ID NO: 4180209 - RNA, 77 nt, Human
cuaaaguguuugccaugcaacagaauccagauuucagucuuuuaaaaucuaauucuguucuguggagccuccuuugg

SEQ ID NO: 4180210 - RNA, 64 nt, Human
cuaaauaaucccucuggucuuaguaaagcaaaagcucugaguagggcuggaggugaagauuuag

SEQ ID NO: 4180211 - RNA, 71 nt, Human
cuaaauggaaggcaugaaagcgaaaugagauuccaguuucucagugagcuuuucuauguucuaacgugugg

SEQ ID NO: 4180212 - RNA, 75 nt, Human
cuaaauuugaccucuaucucgcacaucuugauccaucaaaauuaucaauacugugaguagggguagaaaguuuag

SEQ ID NO: 4180213 - RNA, 56 nt, Human
cuaacuacaauauguauguauguauguauguauguacauguguauguauguauuag

SEQ ID NO: 4180214 - RNA, 93 nt, Human
cuaacuccauuucagauuuguauacugacuuuuuuguaggcccauucccuugugcuuucaaaaguaaucaguauuagauucccauggcauuag

SEQ ID NO: 4180215 - RNA, 87 nt, Human
cuaagaaacugaucagacauuauuuucaagauaaucgugggcagcaccuugcucuugaaaauugaugcuggcucacaaguuuucuag

SEQ ID NO: 4180216 - RNA, 129 nt, Human
cuaagacugcacauguguuuugcagacuuucuuccugaccauuugccacaugggucucugauaagauucuguugguuuaauagucaaaauaaucuuugcaguuugugagcacugaguagcagguucugg

SEQ ID NO: 4180217 - RNA, 93 nt, Human
cuaagauccuuccugggguguacaaggagagcacacauggggauggcugcugccucacucugcucaucuuugucucacccuugugcuucuugg

SEQ ID NO: 4180218 - RNA, 76 nt, Human
cuaagcacuaaguagcaaacacagagggccuaaucacauggaccaauaucccuucugauguucucuuaugcuguag

SEQ ID NO: 4180219 - RNA, 65 nt, Human
cuaagcaugaagcccucaucagucugagaguuucuccucaucagucugagaguuucuugcuguag

SEQ ID NO: 4180220 - RNA, 76 nt, Human
cuaagcccugauggcuggugauacuggagugaggagaauguccugauacccagagauacuaguuucuagggaagag

SEQ ID NO: 4180221 - RNA, 77 nt, Human
cuaagcuaguaauagaguagaccuggagccagauguccugaaauucuagcccagugcuaugccuauuacauccuuag

SEQ ID NO: 4180222 - RNA, 79 nt, Human
cuaagcuccuuccugcaagggcuggaauaucucuuagaaauuuuucugacaguaauuuuagcuuuaggagaaagacuag

SEQ ID NO: 4180223 - RNA, 80 nt, Human
cuaagcugucaagucugccuaaccuucauguucuguacaaguaggaggagaaggcuaaggcagaguuguaaacuguuugg

SEQ ID NO: 4180224 - RNA, 64 nt, Human
cuaaggacuuuuauggaaaccuaacuugggaugauuuaauuccagguaucuuuaugaaacuuag

SEQ ID NO: 4180225 - RNA, 84 nt, Human
cucagagagaugaaugugguggaaucugaguggugucaccagccaugacuuacacagaaacacuguucagaagccuucucugag

SEQ ID NO: 4180226 - RNA, 59 nt, Human
cucagagagggcaccagggccauccugaguugggguccugggcugugugccacucuggg

SEQ ID NO: 4180227 - RNA, 56 nt, Human
cucagagcaaugaacaugcaaauguaugcaaagcaguuucaggacuugcucuguag

SEQ ID NO: 4180228 - RNA, 80 nt, Human
cucagagggcaaggagcaugccugucuccuuugcacuguagccccagcagcuaggacagugucugcuucaggcccaugag

SEQ ID NO: 4180229 - RNA, 62 nt, Human
cucagaggguacaggugaacccagguuugacauuuggccucauuuccgccucucucuuugag

SEQ ID NO: 4180230 - RNA, 90 nt, Human
cucagagguuggcaucugcuguuccuuggacucaggacucacuagaagaggcucagugccaugggcagacaggccacuaaagccucuggg

SEQ ID NO: 4180231 - RNA, 77 nt, Human
cucagagugugguccacaggcagcaaaaucagccucaccagugagcuugaagugcugaaucugagaacccaccugag

SEQ ID NO: 4180232 - RNA, 59 nt, Human
cucagauucccacgugguucaggaacccagugaacccuggaacauuuggccauacugag

SEQ ID NO: 4180233 - RNA, 55 nt, Human
cucagcaacagcgacuuaagggccugcuaggagcggggagaaguugguugcuggg

SEQ ID NO: 4180234 - RNA, 79 nt, Human
cucagcaguggagauacaagaggccugacguguauugauugcccacgacauggcaggaaucauguguuuuggcugcuag

SEQ ID NO: 4180235 - RNA, 60 nt, Human
cucagcaguugcccccucccagcucuggggacaggcgcugggggaggacugauugcugag

SEQ ID NO: 4180236 - RNA, 61 nt, Human
cucagccccacagcaagccccagggucacagccagggcccagcucugccucuggggcugag

SEQ ID NO: 4180237 - RNA, 57 nt, Human
cucagccuaaaguuucugauaaaccuguuaccuagcacuguuauuuuuugggcugag

SEQ ID NO: 4180238 - RNA, 130 nt, Human
cucagccucacaaagugcugugauuacagguaugagccucugcacccagcucuuuccuccuuuuaaaaacaagaaaccuggccaggcacgguggcucaugccuauaaucucaauaccuugggaagcugag

SEQ ID NO: 4180239 - RNA, 117 nt, Human
cucagccuccugcuugacuuugauguucagcagggccuggcacuccugggccuggagcugccccucugcccaggucuaugccagcucugacuccaggugaagcaggaucccguugag

SEQ ID NO: 4180240 - RNA, 126 nt, Human
cucagccucugcaggaggcccggcugcagccccuggcagucccucugguagcaccgagagcugagcucagguaccugaggacacugucacugggagcugggggaggggcuggccugggagguuuag

SEQ ID NO: 4180241 - RNA, 61 nt, Human
cucagccuggaggccaggagacaguuuggaagcuguuauaauauucuguuuguagggugag

SEQ ID NO: 4180242 - RNA, 129 nt, Human
cucagccuuccugccuccaagcgugugcucugaacuggcaggcuggaggcuguucuggggaggacgcacugugucccaugacucuccagucuccucggagcugcugagcuuccuggcaggaagcccaug

SEQ ID NO: 4180243 - RNA, 63 nt, Human
cucagcgccccuccacccccagcugcccgccugccugugggcuccugauuugagggggcugag

SEQ ID NO: 4180244 - RNA, 71 nt, Human
cucagcuguugagacacagacacaagccuaguguaucauaaaagguaagaguaagucuuucaauagcuggg

SEQ ID NO: 4180245 - RNA, 130 nt, Human
cucagcuuacacuccauguguuuccaacagagagggauacgcacuugauagaaacagaaaauuauaaucaaauagaauucuucuguuggcagagcauacauauuuauacauucuucuguguuuagcucag

SEQ ID NO: 4180246 - RNA, 86 nt, Human
cucagcuuaucucacacuggguuugagggucacuuagcaaagaguguguggcuccaccaaacucagggugggaguaaagggcuggg

SEQ ID NO: 4180247 - RNA, 119 nt, Human
cucaggcaggagcauguuuuuaccugcucaauucaggaguuuggccuacagaggcugguaccacccucugaagaggucacaccugucucugaagcaagaaacacuaaucacuguacaag

SEQ ID NO: 4180248 - RNA, 60 nt, Human
cucaggcaguucuguagccuccauucccuguuuauggagcugcaagacucccugucugag

SEQ ID NO: 4180249 - RNA, 57 nt, Human
cucaggccauucuuccagcugccauugagggugggggcuggagcuuauuggccugag

SEQ ID NO: 4180250 - RNA, 91 nt, Human
cucaggcuaaggguugugagcaggcugcacaaaccgaccaauucucucugguaggagguuacaguagccugucaucaaacccuagugggag

SEQ ID NO: 4180251 - RNA, 71 nt, Human
cucaggcugcuggccagcaggcuguagccccauugcauuggcuucuaagccucauggcucaugucccugag

SEQ ID NO: 4180252 - RNA, 64 nt, Human
cucaggcugucuaauggauuagcaaauguggcuaacacauggauacccauuaguagaaccuggg

SEQ ID NO: 4180253 - RNA, 60 nt, Human
cucagggacaguaucauuuaggagaauauguuuuuauugcccuaaauugcuucaccugag

SEQ ID NO: 4180254 - RNA, 57 nt, Human
cucagggagagccaagaguuccguggacagucuugaagcuugaugggcucuucugag

SEQ ID NO: 4180255 - RNA, 60 nt, Human
cucagggaugggcagauguuaaggauauucuccccacuuacccuacugcuccccucuggg

SEQ ID NO: 4180256 - RNA, 72 nt, Human
cucagggggcagagguguagcccccuccauggugccccugggcccaugucgggggcugcagcugccaugggg

SEQ ID NO: 4180257 - RNA, 68 nt, Human
cucaggguuucucacaaggcugcaauccagcugucaggcaggggugcagucauuggaggaugacugag

SEQ ID NO: 4180258 - RNA, 63 nt, Human
cucagguccccaggguaccuaccuauuucaaguugcuugaaggugugcuucugggcaccuggg

SEQ ID NO: 4180259 - RNA, 83 nt, Human
cucagguccucuuugggaagugggagcaaggugaugaaggaggaaugcacaugcccagaacuucucauuagcaggucucugag

SEQ ID NO: 4180260 - RNA, 98 nt, Human
cucaggucuuccuccaccagggcucugagcucugaagauacaggacauccugacacugcacucccagggcucuagagugcuggcuggaagauucuggg

SEQ ID NO: 4180261 - RNA, 57 nt, Human
cucaggugcagcauuuguaagcagcucccuggcugguucugauuuugcugcauugag

SEQ ID NO: 4180262 - RNA, 81 nt, Human
cucaggugcagccaggagcucccccugcuccagagcuggcagaaggacuggggcuccggggcugcagcccguucuucugag

SEQ ID NO: 4180263 - RNA, 65 nt, Human
cucaggugugaacuauuuggaaagaaauaaacauuuucuguaccaaaaaugugucagacucugag

SEQ ID NO: 4180264 - RNA, 90 nt, Human
cucagguugcagcagaaccugguccucaugaaggaggcgcugagggccaccaucauggacgucaccaugguccugcccagcaagcuggag

SEQ ID NO: 4180265 - RNA, 81 nt, Human
cucaguaaguaaaaaguccgagucuccucccagaguggugcauacacagucaaaggguauuuggauugauuacuuggggag

SEQ ID NO: 4180266 - RNA, 71 nt, Human
cucaguacuagugucaauaauuucuuuuuggccaauuauggaccagaucagggaaugacagaagcccugag

SEQ ID NO: 4180267 - RNA, 69 nt, Human
cucaguaucucccugugugaggugagauaaguauucugucaucuucuauuaauagggagaaauucugag

SEQ ID NO: 4180268 - RNA, 80 nt, Human
cucagucaaucugagacuugacuuguugggguuccuagaugaggguugugucugacaagucaagucuugacucuucugag

SEQ ID NO: 4180269 - RNA, 63 nt, Human
ccuggaguuuguggcuugcucaagcucuggcuguucaguucucgagccagcaccaauuccagg

SEQ ID NO: 4180270 - RNA, 65 nt, Human
ccuggaucuguuugugcuuguggcaugcuguacaucugcggucaggguacauuuuggauacaugg

SEQ ID NO: 4180271 - RNA, 56 nt, Human
ccuggaucuuaggccaagacucaggucacugaauuucugaucuggaaggaaccagg

SEQ ID NO: 4180272 - RNA, 68 nt, Human
ccuggaugucugggaggcuucccugcuugggugaaguugggagggcuuggacccagaugucugugagg

SEQ ID NO: 4180273 - RNA, 110 nt, Human
ccuggauuugggguugucaccgcugcucuauguccucacccagggguagcuccaggcuggagaccccuugggaggggucaugugggcucugguccacccccaccucgagg

SEQ ID NO: 4180274 - RNA, 84 nt, Human
ccuggauuuugaaguguaugggaaagcagaagacuuaugauugaaauauucuacauugcuuucuaauacaucuuacugauaugg

SEQ ID NO: 4180275 - RNA, 59 nt, Human
ccuggcaacauuucaaggucuuuacucaaacaccugucaggugccuuguaugugccagg

SEQ ID NO: 4180276 - RNA, 73 nt, Human
ccuggcaauuccucagcugccccauaaaucacagugccuggcugcugugcuuuaggggugccggggagccagg

SEQ ID NO: 4180277 - RNA, 74 nt, Human
ccuggcacacaggaugaaaucaguguuuauucuguauugugcaauuauuacuguuacuucacacuguguccagg

SEQ ID NO: 4180278 - RNA, 58 nt, Human
ccuggcacagauccuucauacaguaggcugacuggauggauagguggaugguggcagg

SEQ ID NO: 4180279 - RNA, 99 nt, Human
ccuggcacaggguaccccaugugauguggcaguuuaagaggcugggcagacacaagaaucccagcacugccauuggucaaaugagugacuugugcaagg

SEQ ID NO: 4180280 - RNA, 106 nt, Human
ccuggcagccacccagcaucuguacuuuaguuauuugguuuuucucaggaggagauccugagaugaagacucaggagcagguuguugauuuugaggugguccuggg

SEQ ID NO: 4180281 - RNA, 72 nt, Human
ccuggcagccacccuggagggcagacagaugccuucacaagccauuuugucuuucuccagcuuggugccagg

SEQ ID NO: 4180282 - RNA, 75 nt, Human
ccuggcaucccuucccuaagcacuagcucugugcaaacccuuuucucaggcucugcuuucuggggggaucccagg

SEQ ID NO: 4180283 - RNA, 77 nt, Human
ccuggcaugguacgcucugcuuacauccucuccucuguuuggagagagacauguaaacgcggugagccaaguccagg

SEQ ID NO: 4180284 - RNA, 60 nt, Human
ccuggcauuggcuaacauguuaaacuucagcuucucauugcucauuguugguuugucggg

SEQ ID NO: 4180285 - RNA, 63 nt, Human
cuagccuuccuuuuaccaccagccacuagccuuugcugauugggguggagacagggaggaugg

SEQ ID NO: 4180286 - RNA, 56 nt, Human
cuagcucagugggguugagucagggaagguuuucaggaggagccaccuugagcugg

SEQ ID NO: 4180287 - RNA, 66 nt, Human
cuagcuucaaguccuggcugugccacuaauuccauuagugaacauaacagcuauggauugaguugg

SEQ ID NO: 4180288 - RNA, 74 nt, Human
cuagcuuuaugcaaaccugguacuuauaguaccuauuauucacuuuaagugcuuagaaguugcauuagggcuag

SEQ ID NO: 4180289 - RNA, 62 nt, Human
cuaggaagcagcuucccuggcuccuggugcaucgcaugaggaguggcagggcugcucccuag

SEQ ID NO: 4180290 - RNA, 64 nt, Human
cuaggaaucccugucucaccucagucuggcuugaccagcugagaaauggggaaagggcugcuag

SEQ ID NO: 4180291 - RNA, 57 nt, Human
cuaggaccuuuacaauuguccugucagccaucuggacuuaggaauguagaauccuag

SEQ ID NO: 4180292 - RNA, 83 nt, Human
cuaggagaaauuagaaccuguuauuucugauccuucgauccuugagaggccaauaguagguggcauguuuguauuucuccugg

SEQ ID NO: 4180293 - RNA, 55 nt, Human
cuaggcaguagggacaucaguugcaugggcuuugcaaugucugcucucugccuag

SEQ ID NO: 4180294 - RNA, 60 nt, Human
cuaggcaguggcccuucaucaugacagccacgcaagcugaaggagaaggccacuguucag

SEQ ID NO: 4180295 - RNA, 97 nt, Human
cuaggcauggccaauauuaaaaugcaaacauuguaggagauguaacagagcaaccuuauguuucauuuagauaucaggcuuauauuucuaugaauag

SEQ ID NO: 4180296 - RNA, 56 nt, Human
cuaggcuagauaguauauugguucaauuaauggucauauauuuuaauuuagccugg

SEQ ID NO: 4180297 - RNA, 56 nt, Human
cuaggcucugccagcacugucgcugcccacagugagggugcagguguggagucuag

SEQ ID NO: 4180298 - RNA, 73 nt, Human
cuaggcuuuccuagcacaaucugaggucacccgagaugcgguuucagauggagguuuaggacagugagccugg

SEQ ID NO: 4180299 - RNA, 64 nt, Human
cuagggaagucuguauuuugugugaaaccuuucaagcacagugcaccacuuugaaaaacccuag

SEQ ID NO: 4180300 - RNA, 57 nt, Human
cuagggaaugagagacuggaucaaaacauucuauagauaaaguaugccguuuccuag

SEQ ID NO: 4180301 - RNA, 55 nt, Human
cuagggacugggaccuuaguuaaggcccuuuacucucugagccucaguuuccuag

SEQ ID NO: 4180302 - RNA, 99 nt, Human
cuagggaggagggcaggcuccccagcuggggcaacgcaccagcuccuugaagcuguucuguggcucggccagcugcugaagccucuccuccugcucugg

SEQ ID NO: 4180303 - RNA, 130 nt, Human
cuaggggagaggagaccccugcaagcgaagccgcuuuccucauuccugaggcucaucggagucggaaggacccuacucucaugcuacaggggccagagaguggcuugccagcggucucaccgcaccuugg

SEQ ID NO: 4180304 - RNA, 59 nt, Human
cuaggggguucuaugcauuuauuaugaguaggucauucauuucacagugagcuuccuag

SEQ ID NO: 4180305 - RNA, 60 nt, Human
cuagguuaguguuugauugaauaccuggggacuguaacccagucaaguugacacaccaag

SEQ ID NO: 4180306 - RNA, 60 nt, Human
cuaguagacagaaauguccaguguauucauuuugcccacuggauuuagcuauuucacugg

SEQ ID NO: 4180307 - RNA, 89 nt, Human
cuagucagaguggaagucuaggcuccccacucagccuucauuggcaugaggguggcuggggccacaguuuuccugugcuguuugacugg

SEQ ID NO: 4180308 - RNA, 58 nt, Human
cuagucuuuuugaucugguggauauuuuauccacauagcacgucucaauuuggacuag

SEQ ID NO: 4180309 - RNA, 75 nt, Human
cuagugagguaagaaaggagagggauugauuugagaggcucaaaaugcugcucaguccuuauuugccucuaccag

SEQ ID NO: 4180310 - RNA, 90 nt, Human
cuaguggucugaacuucaguuuaucccaucauccagaugaaccuguaauugauauuuuggcauugggauagcuggagauuauauugcuag

SEQ ID NO: 4180311 - RNA, 91 nt, Human
cuagugucuccugagcuuuguauuguacgccugucaacuucaaauugcaguugaggccaccaggcuggcaaugcgucaagcagagaaccag

SEQ ID NO: 4180312 - RNA, 93 nt, Human
cuagugucucuggcugaguucucacccauucuucuuccuccuuggcgucaaaauaaaaggaugggaagagugauaacuuagucacaucacugg

SEQ ID NO: 4180313 - RNA, 68 nt, Human
cuaguguuuguuuggguagcuagacuggaugaaauauaaaauuaugucuaguaugcgaacaagacuag

SEQ ID NO: 4180314 - RNA, 59 nt, Human
cuaguuagauuacuuggauuauauggauuccagucucaggucugccaagaacuaauuag

SEQ ID NO: 4180315 - RNA, 55 nt, Human
cuaguucuagaucccugaggaaucgcaacacugacuuccacagugguugaacuag

SEQ ID NO: 4180316 - RNA, 55 nt, Human
cuaguucuagaucccugaggaaucgccacacugacuuccacagugguugaacuag

SEQ ID NO: 4180317 - RNA, 60 nt, Human
cuaguuggaugcagggcccagagaggagggaacauguuccuggcucaagcauccagguag

SEQ ID NO: 4180318 - RNA, 71 nt, Human
cuaguuguuuaaucucaagaaauuuuuuuuacaauguguaagugauuauuguuuucagguuaaaugauugg

SEQ ID NO: 4180319 - RNA, 59 nt, Human
cuaguuucauacuguguagcccagcuagcugagggucugggcugcugagaaugagagag

SEQ ID NO: 4180320 - RNA, 83 nt, Human
cuauaaccaggcuguucuggcugaaaauacaucuuuaaaacauuuuaacaguguguccagucaguuucauccacuggauaugg

SEQ ID NO: 4180321 - RNA, 72 nt, Human
cuauaauauguggccuuuuaugucugacuucuaucacauagcaacauauuuucaaggucauucguguuguag

SEQ ID NO: 4180322 - RNA, 84 nt, Human
cuauacacaucacuguaucuuucagugacucaguggcaagaaccuugcugggaugguuggauggauacauagguggaugaaugg

SEQ ID NO: 4180323 - RNA, 60 nt, Human
cuauacugauugauauucccaugacuuuagaguauaagguacagggaauagagucaauag

SEQ ID NO: 4180324 - RNA, 58 nt, Human
cuauagaccaggagaaauggugaguuucuguuucauucucauuguuucuucucugugg

SEQ ID NO: 4180325 - RNA, 59 nt, Human
cuauagcuguuuuggugccaguaccaugcuguuuugguuacuguagccuugcacuguag

SEQ ID NO: 4180326 - RNA, 129 nt, Human
cuauauagacguuguacaugccggauuuauuuugaggcgaacgcaaucauuuugaaaugccuaguuuucaaaguaaaaauguguucacguuacaaaaccacuguagcaagacauuucuauuaaaaauag

SEQ ID NO: 4180327 - RNA, 57 nt, Human
cuauaucaucauuaccugcaccaaccaaggccaggcacuagguuuugagugauguag

SEQ ID NO: 4180328 - RNA, 90 nt, Human
cuauauccucauguuucucuuacagcagcucugugugggauucagcaaaaacauagcugcaccuuauaagcaggaaagugaggaauauag

SEQ ID NO: 4180329 - RNA, 95 nt, Human
cuauauggugguugagaaauaugcuauugcuguaauuuaacucacuguaugugggcuucaagaugcacaguggcauuccaaaccaacuuuuaaag

SEQ ID NO: 4180330 - RNA, 75 nt, Human
cuaucagccaagggcugcuaucagcuacugugggcuucucccauuaacuggcacguagcccucuguacaacaugg

SEQ ID NO: 4180331 - RNA, 91 nt, Human
cuaucaguugagcagugguguuuuucuauccccagguauugaucauauaacuaaaccuuaaaggauuaaagaucuauuucucaaaauguag

SEQ ID NO: 4180332 - RNA, 89 nt, Human
cuaucaucuccuuucauuccacgucgucguuuccagcauaagugauugauuaaugcacagaauugacauggguagaaaggauccgauag

SEQ ID NO: 4180333 - RNA, 107 nt, Human
cuaucauuaauuugguaaugcccucaaacaaguucccauuccaacaguuccuacuuggaugcuuuggcaacggagaacuuacucuuucauauaucauauaaugaugg

SEQ ID NO: 4180334 - RNA, 75 nt, Human
cuaucccagucccacuagugccaauaccuugaccuucccaugagacguuaggaaucuuuguggcugcugggauag

SEQ ID NO: 4180335 - RNA, 83 nt, Human
cuauccuuuuacgagcugccaaggagucucuccagcagccugaaccagucuggacagaucccuuguagcuugugaaaguguag

SEQ ID NO: 4180336 - RNA, 82 nt, Human
cuaucgcuuccuggccuggggaauagagucaagggggccacccucagucaccuuccuuugacucuccccacagaaacaauag

SEQ ID NO: 4180337 - RNA, 55 nt, Human
cuaucucuuugcuuucagcaguguauuucaacacucagcuugaaucuagagauag

SEQ ID NO: 4180338 - RNA, 71 nt, Human
cuaucugcaugcuaagucuugguuuugccaaacuucagggcugagccagagaguguuggagauguggguag

SEQ ID NO: 4180339 - RNA, 55 nt, Human
cuaucugugagccaguccccuuauuuuacaaauggggaaacugaggcacagacag

SEQ ID NO: 4180340 - RNA, 73 nt, Human
cuaucuuuuccucagcagcagucacggccgccgcugccucggcaggaugccaucugcugcugcugcuggauag

SEQ ID NO: 4180341 - RNA, 81 nt, Human
cuaugacaaaacauaucuacggauacgauuaaaccacauuuucaauuguaugaucguugaugugauguuggguguacaugg

SEQ ID NO: 4180342 - RNA, 71 nt, Human
cuaugagggagugugaggcuucaaggaacaggaaacuuacugcuccucagagacugcaucuucccucaugg

SEQ ID NO: 4180343 - RNA, 71 nt, Human
cuaugagguggcuauuccgguccuuauagaacaacaaacaaccugugagguauauauucugguccuuauag

SEQ ID NO: 4180344 - RNA, 82 nt, Human
cuaugagucauaaaccaaugggguugguugggaauuuccaagaaguucaguaugacagacgcauuggagguguggcuuggag

SEQ ID NO: 4180345 - RNA, 72 nt, Human
cagcuaaugcauugugugguauaugguuggcaauuaaauaauugcuaaauaacuuacauaguggcugagcug

SEQ ID NO: 4180346 - RNA, 85 nt, Human
cagcuaccaguuagccacuuugggggugaguuuauccuacacaguuuauccuugcucuccccagagugagggauugagugggcug

SEQ ID NO: 4180347 - RNA, 66 nt, Human
cagcuaccgguuggcccagccuggccuaguauacgcuugcgauugggcccuggagucgccagucug

SEQ ID NO: 4180348 - RNA, 71 nt, Human
cagcuaggaaguggcagagagcaagugucugacuccaaaguccacgcucuuucuacuuuucauaaugguug

SEQ ID NO: 4180349 - RNA, 63 nt, Human
cagcuauuauuuucucuaaauuaaaccaacacugagggauuauuuaggggaaaggauagacug

SEQ ID NO: 4180350 - RNA, 60 nt, Human
cagcucaauagccuaccuuaaucuggugauuaaauuccaaggaugggugaucuugagcug

SEQ ID NO: 4180351 - RNA, 74 nt, Human
cagcucacuggaccaaggaaacucuucaacacguaucugauagguagaacaucuuuuuugggauccagaggcug

SEQ ID NO: 4180352 - RNA, 79 nt, Human
cagcucagacuaaguucugcugacggccagcccagcuaugcuuggcugagcacaccaggacuuaacaaggucugaauug

SEQ ID NO: 4180353 - RNA, 57 nt, Human
cagcucagucuggagagaugcaggaucauccucuccuugcauuccaaucugagacug

SEQ ID NO: 4180354 - RNA, 57 nt, Human
cagcuccaaagccccacuguccugucucuguguccugggacaggggacaaggggcug

SEQ ID NO: 4180355 - RNA, 64 nt, Human
cagcuccagcucugggcgccucugcaggaagcgggaggcuggcggcccaugaggacugcagcug

SEQ ID NO: 4180356 - RNA, 75 nt, Human
cagcuccuccugugccaggccagcagcccacagcacggccaggugaggccugggcacauaaccucgagugagcug

SEQ ID NO: 4180357 - RNA, 68 nt, Human
cagcuccuguuuuucugugagcuuaaagggcugucacuuuuaugucacuuugaaagagaguaaagcug

SEQ ID NO: 4180358 - RNA, 95 nt, Human
cagcucguauuguagcaugcgcggcucagucaucuccaggggcugcccguucaccuugaugagaccauugccgcgucugcagugcgccacagcug

SEQ ID NO: 4180359 - RNA, 77 nt, Human
cagcucuaagucugcggccgugugcuugugcuccccuccaggcagggaggacaugcacugcucaggguuccgagcug

SEQ ID NO: 4180360 - RNA, 74 nt, Human
cagcucugcccucgcacaucugccaccugcuuucuguggcucugucuggcgcuuguggggaauggcagagacug

SEQ ID NO: 4180361 - RNA, 130 nt, Human
cagcucuguuuugugaauuaauguuugaacccauguccaugcuuggggcaaccaugacagagagaucaaaaguugucugcagagguugguucuaagauggccagagguaaauuguagaagagugcaguug

SEQ ID NO: 4180362 - RNA, 57 nt, Human
cagcucuucagugccugagauaaugaugagauugagggccaaaaagaugaagagcug

SEQ ID NO: 4180363 - RNA, 60 nt, Human
cagcugaccuggcuaagggagcucaggcccugccaucuccccuguuacacuaggucacug

SEQ ID NO: 4180364 - RNA, 60 nt, Human
cagcugaguggacccuagaggccuccuuguuuaaggcuccugggcugggaacucagccug

SEQ ID NO: 4180365 - RNA, 106 nt, Human
cagcugauaagcucaucuguuaucuucugcauaauguacaaucuguaucuaaaugccaguuuuuauuaggcauuauggggauaaggacuagcagagagaaaaguug

SEQ ID NO: 4180366 - RNA, 56 nt, Human
cagcugcaucaggacccucggcugcaggaagcgagccagggcacugguggagauug

SEQ ID NO: 4180367 - RNA, 55 nt, Human
cagcugcugccucacuggucuguguugaaaacaagacaguggguggggagcacug

SEQ ID NO: 4180368 - RNA, 104 nt, Human
cagcugcuggaucuaaguucuuauagcuccaucagagucagagcucuuucuguuuccaguagaaagggacuuauccucugaauauaagauagaucauuuagcug

SEQ ID NO: 4180369 - RNA, 57 nt, Human
cagcugcugugacaucuggaagcauuaacacuuuguugccagcauguaggcuaguug

SEQ ID NO: 4180370 - RNA, 90 nt, Human
cagcugcuuguagagagcucaggagaugacagaagguauccuguguccccaaggauguaccucugcauuccugccucuaucagcaggcug

SEQ ID NO: 4180371 - RNA, 75 nt, Human
cagcuggaccugagaugugcacuuuucgcuugcuuuucauugcagaggagcagggacauggcaucucuccggcug

SEQ ID NO: 4180372 - RNA, 58 nt, Human
cagcuggacuuuugauagaaguuggauagcugacaacucacaauuaagaugccagcug

SEQ ID NO: 4180373 - RNA, 59 nt, Human
cagcuggcagaaccugcauccaugucuccaggugagacugccucggagcugccaggcug

SEQ ID NO: 4180374 - RNA, 76 nt, Human
cagcuggcagcaaggccucgggugagcuggccuuguaccuccaggguuugcugcuaucuggccuugcucucagcug

SEQ ID NO: 4180375 - RNA, 66 nt, Human
cagcuggcccucguccgacagguggguuguccguguuccuaacccccggguccucgggggcugcug

SEQ ID NO: 4180376 - RNA, 82 nt, Human
cagcuggcugaaaagaaaauguaagcuaaguuuuucuaagcauuuaucaaaugcucuuagcugcuguucuuugagagaguug

SEQ ID NO: 4180377 - RNA, 75 nt, Human
cagcuggcuuugcagggcagaaguacagacacuuaucugcugaugagaugucuuucuucucccccagaacaggug

SEQ ID NO: 4180378 - RNA, 57 nt, Human
cagcugggugaucuugggcagguuauugaaccuuucuuggcuuugaucacccaucug

SEQ ID NO: 4180379 - RNA, 70 nt, Human
cagcuggucaguggugagacagaaauuugaaucgacaccauucacugcuuugagccacugagccauccug

SEQ ID NO: 4180380 - RNA, 89 nt, Human
cagcuguggguucauacaggcaggagcuccccauuccagcuagaagcccuggaaucucagcuucugcccugaugcucccagguaagcug

SEQ ID NO: 4180381 - RNA, 58 nt, Human
cagcuuacagcucuuucccaugggagagucaacagcuuaaugggauggagaguaacug

SEQ ID NO: 4180382 - RNA, 67 nt, Human
cagcuucagcugccugucugcugacccaggucucugagggccugggugucaugggcagcugggggug

SEQ ID NO: 4180383 - RNA, 71 nt, Human
cagcuucaucagaaaauacccaguguuuaaaagucuccucuucuuuaagucaguguuuuuucuggaaguug

SEQ ID NO: 4180384 - RNA, 89 nt, Human
cagcuucucaggugauuacaaaaaaucuaugaugcugccaguuauuaagcagcuucaaagucuaucuguaauuacucccuuaggggcug

SEQ ID NO: 4180385 - RNA, 61 nt, Human
cagcuugaaguuuugaggagaauuacagucacuuccucucaguauugaacuuuauaagcug

SEQ ID NO: 4180386 - RNA, 74 nt, Human
cagcuugcaagacucugccuugccuacagagggugcucaaugccugucuguuagagagguaguucuugauucug

SEQ ID NO: 4180387 - RNA, 87 nt, Human
cagcuuggacaacauggugaaaccccgucucuacuaaaaauacaaaaaauuagccgggaugguggcuugcaucuguagucacagcug

SEQ ID NO: 4180388 - RNA, 70 nt, Human
cagcuugguuugcauguggacacuugaagccacuaaaugggagucaguccuauccaaacuauauagauug

SEQ ID NO: 4180389 - RNA, 107 nt, Human
cagcuuguuuuauaagucagcagcuuggauuuuggcacguguuuucucauaggaacacuguuuugaauaguggucagguuuccaagcuagcccacaaaagcauacug

SEQ ID NO: 4180390 - RNA, 65 nt, Human
cagcuuucagagacuagagauguaagcacaaagcauuucccugagcuucucugaaaugggagcug

SEQ ID NO: 4180391 - RNA, 63 nt, Human
cagcuuucugguuacagucuucagauaauuauugcauuuccugagauaauaacugcaaggcug

SEQ ID NO: 4180392 - RNA, 56 nt, Human
cagcuuuuggcaggaugaccagaccauguacuacuuuuggaagccugcagaaguug

SEQ ID NO: 4180393 - RNA, 66 nt, Human
caggaaaauugauuaaaguccgugcuucaagggcccugaaagcacuuuaugucaauguccuuccug

SEQ ID NO: 4180394 - RNA, 127 nt, Human
caggaaaccacgagcuuaacugcuguguuauucacuacuaaugcuuagcugaaacuuccauauggggaacgcuaggucagcugaaucagugaguggaaauacaaaagauugaaguuaugauuuccug

SEQ ID NO: 4180395 - RNA, 64 nt, Human
caggaaacugugggcuuaaaucucagcucuuccauuuguugugugagcucguguggguuuccug

SEQ ID NO: 4180396 - RNA, 69 nt, Human
caggaaaggcuuuauaauaguuaauguguuguuuuuaguugugccaucacugugauaaugcuuuuucug

SEQ ID NO: 4180397 - RNA, 86 nt, Human
caggaaaggucucaaagggaaacgcagugucaagugucaggcuggccucccuguguuucucuuuccucugggaucuuggcauucug

SEQ ID NO: 4180398 - RNA, 71 nt, Human
caggaaaugguggugguguccaaucugauguuaagacuugacacauugcagacaucucauuaguaauucug

SEQ ID NO: 4180399 - RNA, 59 nt, Human
caggaacaccugcagcuaguggaacaaauuauagggaauacuggcuucagucaaaccug

SEQ ID NO: 4180400 - RNA, 92 nt, Human
caggaacagacaacaguccuggggucuaguggaagcaccucucuaucaaaacuggagcaggguuccuuaaggccauacuuuugcugggccug

SEQ ID NO: 4180401 - RNA, 62 nt, Human
caggaacuccugcuccaagcagcuuagcccaaagucaagcugcaguggcagcagggcaccug

SEQ ID NO: 4180402 - RNA, 74 nt, Human
caggaagaugagcagagcuggccugagaucaucugucuucauuacaccguccccaccagcccugucacuucuug

SEQ ID NO: 4180403 - RNA, 58 nt, Human
caggcagcugacugucagauaugugacugaagcggcuucucugaccaucagcuguuug

SEQ ID NO: 4180404 - RNA, 59 nt, Human
caggcaggagccagggauuccaggaauuuguaaccuucuguguguccuggccugcucug

SEQ ID NO: 4180405 - RNA, 70 nt, Human
caggcaguggaaacuaugcugcuggauugucauacugcaccacuguccagcaggcauguuuccuugcaug

SEQ ID NO: 4180406 - RNA, 62 nt, Human
caggcaugaugggaagugccuggaccauuaugauacuggucuagcacuuggcgccaugucug

SEQ ID NO: 4180407 - RNA, 55 nt, Human
caggcauggaaaagcccagaggagaaggccucuggagccaaacaucacaugccug

SEQ ID NO: 4180408 - RNA, 57 nt, Human
caggccaagucccaagugcggggcaagggagcaagcuucgugcuguccuugguccug

SEQ ID NO: 4180409 - RNA, 77 nt, Human
caggccaggcagagccccugcuggguguagcucagacagacccuacacucacccagcuuggggcccaggccugucug

SEQ ID NO: 4180410 - RNA, 65 nt, Human
caggccagguggcaggcaaaacagucaaguagaucaggguuguuuguagugccaccugcccccug

SEQ ID NO: 4180411 - RNA, 92 nt, Human
caggcccaccaucucccagacaugugccuccuugcucugcuucucuggccucucgcauggccgggcugcauguuugggguuggcaaugccug

SEQ ID NO: 4180412 - RNA, 69 nt, Human
caggcccacgaggcacacagaggcccaugagguggccuuugaugaacucaugcuucuguguagggccug

SEQ ID NO: 4180413 - RNA, 76 nt, Human
caggcccagcagggagaccaucucuuccuuaggacuugccuuaggucccauguccucccugaccacugauggccug

SEQ ID NO: 4180414 - RNA, 60 nt, Human
caggcccagugaucagggcucuggagccagcaguucugggagucuaggguccugggccug

SEQ ID NO: 4180415 - RNA, 75 nt, Human
caggccccacgauguuuugggagaguguuuagcacaggaaaaugcgcagaauacaugcacgacacgggggcacug

SEQ ID NO: 4180416 - RNA, 63 nt, Human
caggcccuuuccugggcauaggcucccagaagcuaccagacaugccaagggagggacagccug

SEQ ID NO: 4180417 - RNA, 77 nt, Human
caggccuaguaguuucuaaagcuuccuaggugaucaugguguauacagaaauaacucuagggaguuuagaaggccug

SEQ ID NO: 4180418 - RNA, 69 nt, Human
caggccugcccugggaguaccuguccuuaugcgagaauagaggauaauagguccucagggcugggugug

SEQ ID NO: 4180419 - RNA, 57 nt, Human
caggccuggagugggguccgugcauggccagcuggcucugccccacggccaguccug

SEQ ID NO: 4180420 - RNA, 88 nt, Human
caggccuggguuuccucaucuguaaaguaggaauauugauaauaauaucuacuucauagaguuucaugagaauacauguaaaggccug

SEQ ID NO: 4180421 - RNA, 76 nt, Human
caggccuucacuccuucaccugccagccuguuucccucuuccaggcaggcauguggcccaggggugagaagaauug

SEQ ID NO: 4180422 - RNA, 61 nt, Human
caggacuucuccgauaagucagagcccucuaucuacuguaggcuacuggaagagaguccug

SEQ ID NO: 4180423 - RNA, 68 nt, Human
caggagaaacauaauuuucuggggggagaauccaggaaggcaucccagaggaagugauguuuuaucug

SEQ ID NO: 4180424 - RNA, 81 nt, Human
caggagaaucacucuuaacaaaaucuucaccugaagcuauauuuauugcuuuuggaagccuaguuaagaugaaaacuucug

SEQ ID NO: 4180425 - RNA, 80 nt, Human
caggagagaauguuccaggcuugagagguugauuugcaguugcacuucucacacgggcaaguugauggagcacuuuccug

SEQ ID NO: 4180426 - RNA, 67 nt, Human
caggagagagaaggccugugggugugggguccuuugcaccucaccucaacagaucugcucuccccug

SEQ ID NO: 4180427 - RNA, 66 nt, Human
caggagagauccuucaaucuaguuuuguggcuaaaagcaguaaggagaaguugaggaaucuacuug

SEQ ID NO: 4180428 - RNA, 75 nt, Human
caggagaggcuccauggaggaguauggacuugggagaaggcuccaucuugaugggcccauggggaucuacuccug

SEQ ID NO: 4180429 - RNA, 101 nt, Human
caggagagggguccgggcgggagcccugggcuguagauaagcaaaacgcacccauuuucucuccuauuuacuccagaggcaccucuccucccccacuccug

SEQ ID NO: 4180430 - RNA, 76 nt, Human
caggagauacaggaaucgcacagucaugcugacuuaaaauacacauguaaacacucacugugccccugguguccug

SEQ ID NO: 4180431 - RNA, 80 nt, Human
caggagcagccaguucucugugguaggaaaaucugaggacucccuggacuggguuacccacagcagagcuggguucacug

SEQ ID NO: 4180432 - RNA, 56 nt, Human
caggagccacauuccaccuugaccuuauauugucaagggugagaccauggccccug

SEQ ID NO: 4180433 - RNA, 77 nt, Human
caggagccagccccccaaacuugggcacuuggauagcaucaggugucuggacuugugaagcagggggcuggguucug

SEQ ID NO: 4180434 - RNA, 111 nt, Human
caggagccgugaagggauucccagagaagauugucaucuaacggagucauucguccgcccaggacuucucugucacaggguuacguuugggagaauuuucacaggccacug

SEQ ID NO: 4180435 - RNA, 59 nt, Human
caggagcucaagaccacccugggucuuccuauguugcccaggcuggucuugaacuccug

SEQ ID NO: 4180436 - RNA, 63 nt, Human
caggagcuggcagugguagacaugggacaccauccuccaucccaacucucuccuccagcccug

SEQ ID NO: 4180437 - RNA, 61 nt, Human
caggagcuucugcccauggccaagaacagaccagcuuggaucacgaaggacugagcaccug

SEQ ID NO: 4180438 - RNA, 70 nt, Human
caggaggaaggaaaacuacuauccauaccaaugaccuugauauuccuguaggaauuuucacuuccucuug

SEQ ID NO: 4180439 - RNA, 59 nt, Human
caggaggacaagauuuuuggauucaggcuugccugaccccaaaggcuauguaucuucug

SEQ ID NO: 4180440 - RNA, 58 nt, Human
caggaggacauacuggcucacacauaaaaagaaaguuuuggaacagaugauccuucug

SEQ ID NO: 4180441 - RNA, 56 nt, Human
caggaggacggaguuagucacaucuuccugcuucugagacagacuuucguccccug

SEQ ID NO: 4180442 - RNA, 62 nt, Human
caggaggcaucauggagcggacuggcuuggcuagcauacauuuggcuucauaaugguuucug

SEQ ID NO: 4180443 - RNA, 61 nt, Human
caggaggucacuaccaggaggucacuaucacuugaccuccugggaucaagugauccuccug

SEQ ID NO: 4180444 - RNA, 64 nt, Human
caggaggucaggagcuccauggugagcacaggaagucugucuuuggauaucgcuagaccguaug

SEQ ID NO: 4180445 - RNA, 64 nt, Human
caggaggugacuuccagggguuguuagcaucucuaaagcucuacccuugggggucacgcuuuug

SEQ ID NO: 4180446 - RNA, 70 nt, Human
caggagugagagagcuagauucacaugggaugaauacaccaguccccuggcuuaaaaaccucauauccug

SEQ ID NO: 4180447 - RNA, 67 nt, Human
caggagugcucgggccucugccugcaccauccgugggaccccagcaggaagaggcucgaagccccug

SEQ ID NO: 4180448 - RNA, 72 nt, Human
caggaguuugaguggggccucaguaauuucuuaggcacugcagucuauuacugagguuuuauggaguuucug

SEQ ID NO: 4180449 - RNA, 67 nt, Human
caggauaacagaaaauagcugaauucaaauauaccugagauuuucuugcuauuuugcuuuuguucug

SEQ ID NO: 4180450 - RNA, 69 nt, Human
caggauaacucuguacaggagacaucucuagguaauugcuggaagaaugcuccacagggaagaagccug

SEQ ID NO: 4180451 - RNA, 61 nt, Human
caggauauaggguaucuuauccaggacucacaaucauccaaguccucccuuugguguccug

SEQ ID NO: 4180452 - RNA, 75 nt, Human
caggauccaugccggugcccaccucuuguccccucccacagugggaagggagcuggguauuuagcacagauccug

SEQ ID NO: 4180453 - RNA, 90 nt, Human
caggaucuuuucccugucccuggcagcuguccuuucaguggagauucucuuucugggacauggugcugucuuuauagguaggaagaacug

SEQ ID NO: 4180454 - RNA, 68 nt, Human
caggaugccaugccccaauccaggccaccuugcacaggccucggugggucuuguggggcagcuucuug

SEQ ID NO: 4180455 - RNA, 60 nt, Human
caggaugcccugagcaggccuucaagcugauggauuuaaaggagaggcuagggcuucaug

SEQ ID NO: 4180456 - RNA, 60 nt, Human
caggaugcuucuggggccaggcuccuauaaguuuggaauuucuaccucugaacuuuccug

SEQ ID NO: 4180457 - RNA, 62 nt, Human
caggcaacguccuuagagaugcugcccuaaugagguuuauuucuuccuggguauguugccug

SEQ ID NO: 4180458 - RNA, 69 nt, Human
caggcaagcacacugauuaacugaacugaauuuacugcccaaguauaaucagcaguuaacucaugucug

SEQ ID NO: 4180459 - RNA, 55 nt, Human
caggcaagcacggugaaccuggaaggucucacccacaggacucgaguuugaccug

SEQ ID NO: 4180460 - RNA, 124 nt, Human
caggcaagcaucuuaguauuccugagucuuguauuucacaucuaugaagugaggauaguuuaacucuaccuuauaguaugauguugagaauuaaauuaaacaauauaguugagaagcuuguuug

SEQ ID NO: 4180461 - RNA, 87 nt, Human
caggcaauuauaugguccugugaugaguaccaggugggaaaagguucaaccuaggccaucauggggaaaccccauagaugaugugug

SEQ ID NO: 4180462 - RNA, 59 nt, Human
caggcacacagcacauggccugggauauaaagauaaguaagggucaaucuguguccuug

SEQ ID NO: 4180463 - RNA, 58 nt, Human
caggcacacccacuggugcagaaggccauuuccuccugugaaccguggggugagccug

SEQ ID NO: 4180464 - RNA, 84 nt, Human
caggcacagcagacacaggcacgcuguugugcuagcaaaucguuugcagaagggugaugugccugagcuuguccucugcuccug

SEQ ID NO: 4180465 - RNA, 67 nt, Human
cagggcuguuuagucugggccuuugggaguucggugcagcuaaugccuuccagaggcccagccccug

SEQ ID NO: 4180466 - RNA, 58 nt, Human
cagggcuuccccuagcggaggugggaagcaggaacuucccugugggaugaggacucug

SEQ ID NO: 4180467 - RNA, 94 nt, Human
cagggcuuucaucugguguucagggcccugucugucugcccagcuggacaucucuccucccagcaccuggauagacaugggcucuccagcccug

SEQ ID NO: 4180468 - RNA, 61 nt, Human
cagggcuuugugugccuggggagaaguugggauuuuaugcuuaggugauaggaagccgcug

SEQ ID NO: 4180469 - RNA, 130 nt, Human
caggggacacugcuucuccaggggacauggcuucuccaggggacacggcuucuccaggggacauggcuucuccaggggacacuguuucuccaggggacacuguuucuccaggggauggcagcuucuccag

SEQ ID NO: 4180470 - RNA, 101 nt, Human
caggggaccacaaagugggggcugucagggcaaaguugccaggaagcuacagaaucccgaguuaucugaaaugucuacagcaaaccccacaugucacucug

SEQ ID NO: 4180471 - RNA, 92 nt, Human
caggggagaggcacacaggcuaggggcagugccagcaugggcagagcguggccgugacuggccucacugcccugcugcugccgucucuccug

SEQ ID NO: 4180472 - RNA, 106 nt, Human
caggggagcuuguuaaacacgcagcucccugggcuucuccagacuugcuguaucagagcuucuggggauggagcccagaaauuugcaugcuugacaaguuucccug

SEQ ID NO: 4180473 - RNA, 112 nt, Human
caggggaggcggcacugugggggcugccggcagccggggcuggggagagacauguggacacguggccucuauggcucccgccugccagauccuccgcugggcccucgcccug

SEQ ID NO: 4180474 - RNA, 58 nt, Human
caggggagguggcagaaaugugcuucuauaaagaggggccagccuccauccucccuug

SEQ ID NO: 4180475 - RNA, 70 nt, Human
caggggccugccagggcucuccguggugauggguguggccugcaaggagggccacugggaaggauuacug

SEQ ID NO: 4180476 - RNA, 62 nt, Human
caggggcugugggcggagccuccugugaugaugacuguugggggcugugccccugccgcuug

SEQ ID NO: 4180477 - RNA, 72 nt, Human
cagggggaacucagaguuuuacccagagacuucagaaaugaugucuggaggggagauuuggguucgauccug

SEQ ID NO: 4180478 - RNA, 76 nt, Human
cagggguaguaggauaacaaauucagccuuucauuguagguuucuaugaauuuaguuucuuuuucuuaccaaccug

SEQ ID NO: 4180479 - RNA, 68 nt, Human
cagggguugcuugcuucuauuuuauacaucauauaauaagguugguuauauuguuuccaagcccccug

SEQ ID NO: 4180480 - RNA, 100 nt, Human
cagggguuucgugcacuccgaccgugccaucuccugccacgacauguuugauuuucugcauuugacaggagguggcuacucaaaggucugcaaacccuug

SEQ ID NO: 4180481 - RNA, 90 nt, Human
caggguacacacuggacauuucgcacccuuccaaagaagcaagucuuacuaugcugggaguacuuguggagugggggcuguguugcccug

SEQ ID NO: 4180482 - RNA, 63 nt, Human
cagggugcagugucgcugcuagccacugguggaucaagggcagaaaugacaguaagcacccug

SEQ ID NO: 4180483 - RNA, 75 nt, Human
caggguggcauuucaguauuuucauaaccuauuugaauaggucauaacauuuuagaauguugaauauaagcccug

SEQ ID NO: 4180484 - RNA, 130 nt, Human
cagggugggauguguugaaugagucuucguggagcaugucacgguccccuucccaucucauuuuggugaugugucuagauugcuguaccgcgugggcuccauugagguagugcuuagggcaggagcucug

SEQ ID NO: 4180485 - RNA, 57 nt, Human
cagggugggcacccagccuccaggggccaauaucuggcuggcgccugccucacccug

SEQ ID NO: 4180486 - RNA, 73 nt, Human
cagggugggguuaggaaacaucauuuuugcugucauuugugaccuggguaaggucuuuccugguuucacugug

SEQ ID NO: 4180487 - RNA, 59 nt, Human
caggguguggucugcauucggaaucauaaaaauuaauuuuggcuaugugguacacucug

SEQ ID NO: 4180488 - RNA, 57 nt, Human
caggguuggccccugaggaagagagcaucuccuugccucccucaguuuccagcccug

SEQ ID NO: 4180489 - RNA, 55 nt, Human
caggguugggguagauaagaaaugauaaauaggucugucuugcaugccagcgcug

SEQ ID NO: 4180490 - RNA, 58 nt, Human
caggguuuuucacaagucaaggauggcuugaccgaccugagaucuguaagggaccuug

SEQ ID NO: 4180491 - RNA, 56 nt, Human
cagguaacuccaggcgcuuggaggauggaaaguuuccuuuuggcuggagugaucug

SEQ ID NO: 4180492 - RNA, 77 nt, Human
cagguaagacugaguuggguccucagcuucagggucuuaagguguagacugggcuguggacacccagcguuugacug

SEQ ID NO: 4180493 - RNA, 96 nt, Human
cagguaaguaacuuuauuaaggccauauagcuugaaugggggacauucacaaaaccacaugccauguggcuuuaaauaguucaaugaauuuaucug

SEQ ID NO: 4180494 - RNA, 73 nt, Human
caggucacaggcugugcgugugcaugccgaacacccacaugcacacaguugguggcucagucugauguaccug

SEQ ID NO: 4180495 - RNA, 92 nt, Human
caggucagggacacccagcugggccaccuccagagccacaccaggcccugagcuauuucuggaggccucccagacgcuggugcccuggccug

SEQ ID NO: 4180496 - RNA, 73 nt, Human
cagguccagcaugacuaguuccccauguccuaggucucccacugccaagauggccacuuguccugcugcacug

SEQ ID NO: 4180497 - RNA, 69 nt, Human
cauuccuggugagauuucguucuguccaguuccagcucccacaggacccuugaucucacuugagguuug

SEQ ID NO: 4180498 - RNA, 59 nt, Human
cauuccuuaacguggggagucuuggacugggugagcucaugacuccaacuuuaagcaug

SEQ ID NO: 4180499 - RNA, 78 nt, Human
cauuccuuaauuucacaguucaacgcacaacguaacuggaucuacaugugugcacaugcgcugaggauagaaggaaug

SEQ ID NO: 4180500 - RNA, 60 nt, Human
cauuccuuccuuucuaaauuccaggcucuugauggagcaggaccaagaaggggaaaagug

SEQ ID NO: 4180501 - RNA, 100 nt, Human
cauucgaauaucgugagcuaguuuguuuuccagucuggaauuuggacguggucuguuagagggccagcuggacagcgagcagcucagcguaguugcugug

SEQ ID NO: 4180502 - RNA, 69 nt, Human
cauucuagcucugacuagaagccucucucugcugccagguguucccagcuguuucuugugaguugagug

SEQ ID NO: 4180503 - RNA, 59 nt, Human
cauucucuccugugucucaccuucugccuuccuggcagugcugggcagaggagagcgug

SEQ ID NO: 4180504 - RNA, 68 nt, Human
cauucuuagcugacacauggauaucuggaauaaagauccuuuuccagguucccuugcagcuaagugug

SEQ ID NO: 4180505 - RNA, 77 nt, Human
cauucuucaaguguuuccgggagacuugguuucuuugcucagagccgugucccauuuaggaaaguacuaggaguuug

SEQ ID NO: 4180506 - RNA, 59 nt, Human
cauucuugcuccugauucccuuacacaccuacucauaguaaggcagcaggccagggaug

SEQ ID NO: 4180507 - RNA, 85 nt, Human
cauucuugugguaagcagagcccucuuuauuagugaccuaggcuaacaggugucuggaggguuugcuugaaauauccacauaaug

SEQ ID NO: 4180508 - RNA, 74 nt, Human
cauucuuuaauuuguauuucuagagggugucuacauuucuuacuuuccuaguaguuacagaaugauaaagaaug

SEQ ID NO: 4180509 - RNA, 62 nt, Human
cauucuuuguguaggugccucuggcuuugagaaacgaggccagagucuauaugcagacagug

SEQ ID NO: 4180510 - RNA, 86 nt, Human
cauugaagcuucagaggguacucuugcaucaguaggucuaaacacuacaaaaugccacuuugcaagauauucagagccuuuuagug

SEQ ID NO: 4180511 - RNA, 73 nt, Human
cauugacacuggaaauauugaauuggauguuggugauaggagccaucaguucuuuauuucacagugaucagug

SEQ ID NO: 4180512 - RNA, 109 nt, Human
cauugacggccucagcauucuuucaguauauaaaauaauuucucuguugugggguauuuucucaccagucuuuauuuuguuauuagucgccauagagguaaaaucgaug

SEQ ID NO: 4180513 - RNA, 76 nt, Human
cauugacuggugcagagucacccagauaauuaggccaaagccauagaaacaaaaucugaugacuccaugucuaaug

SEQ ID NO: 4180514 - RNA, 62 nt, Human
cauugagcaggauggcuaugcacagaccuugagggauguggguggcaucguccuggccaaug

SEQ ID NO: 4180515 - RNA, 76 nt, Human
cauugauagggaugccuuucuuuggugcagguucuucugaaccucaggccaagaaagagcuccauucccucagaug

SEQ ID NO: 4180516 - RNA, 59 nt, Human
cauugaucaucugcaguuuaagcuggacacagcccugaggcaaugcagauagaugaaug

SEQ ID NO: 4180517 - RNA, 67 nt, Human
cauugauuuccauuuucaacuccugcccuagaucugagugucugcagggugaagauggcaguuuaug

SEQ ID NO: 4180518 - RNA, 80 nt, Human
cauugcaacaugccacauaauuacaaauagagacugccuuuuaaaagcauucuauuaaacuguugugugguaccgcaaug

SEQ ID NO: 4180519 - RNA, 109 nt, Human
cauugcacuccauugagaaaauuuagaaguugaugugguucucucugucacgagccugcauggcaaagauuaccacaucuacagaauauuucuccuuuggaacacaaug

SEQ ID NO: 4180520 - RNA, 108 nt, Human
cauugcauaguuugcauuuugaccacagcauuuaucuuguagcaggacuaauaauuuaaggcucuuguccugaaucaacuaaguguucagagaaugaacuaugucuug

SEQ ID NO: 4180521 - RNA, 98 nt, Human
cauugcguagaacugagguuagcagguuaccauugauuuccucuacuuaugcuuuaagagguuggcauugguaagccgcuacacuuucuuggucaaug

SEQ ID NO: 4180522 - RNA, 109 nt, Human
cauugcuccaggugucuccuacucaccaauugcugauaugcagaagacucaugugacacagaacgugucugugcuuauucagcaggggcugugggcaggacaggcaaug

SEQ ID NO: 4180523 - RNA, 58 nt, Human
cauugcuguuaauugucucuagguguguuauuuagauccuuuggagacugcagcaaug

SEQ ID NO: 4180524 - RNA, 58 nt, Human
cauugcuuccuaugucccuucugauugaagugaaaagagggguggguaggaggugaug

SEQ ID NO: 4180525 - RNA, 69 nt, Human
cauuggaauaucaugcagaauaaaggugaucuauauguauugggcccuauguguagugugaucccaaug

SEQ ID NO: 4180526 - RNA, 130 nt, Human
cauuggaaucaccuggggagauuuguaagcuucugcugucugggcugaacccccagagguucggauugaauugguguggggugugguccaggcaucgagauguguaaagaccuccccaggugaugauaug

SEQ ID NO: 4180527 - RNA, 58 nt, Human
caguuucauuucuuaguaccagugacuagucuuacugguacaaugggaugugagaaug

SEQ ID NO: 4180528 - RNA, 66 nt, Human
caguuuccagcagcaccuauuauaguguuuuccacagaguaggcacucaauaaauguugccaacug

SEQ ID NO: 4180529 - RNA, 86 nt, Human
caguuucuugaaucacuuuagagauaccuguuggcuaaauccaagagaaaggaguuauugcugaaaugcugaguucaagauggcug

SEQ ID NO: 4180530 - RNA, 69 nt, Human
caguuugccaugguuaugugauauccuggcaagaaaaugccucauguuauaucacaaacauauggucug

SEQ ID NO: 4180531 - RNA, 104 nt, Human
caguuuguucuuguuucucuaaugccuugaggugugacauuagguugucaaucugugcgugaucuuucagacuuucugauguaaacauuuagugguauaaacug

SEQ ID NO: 4180532 - RNA, 57 nt, Human
caguuuuaaauuguuagauaaucuccaagggagaugagcuagaaggauauaagacug

SEQ ID NO: 4180533 - RNA, 66 nt, Human
caguuuuguuuucuaaguagguagcaccagguacugacugacuugccucuuacuuggaagggacug

SEQ ID NO: 4180534 - RNA, 129 nt, Human
caguuuuuuagcaaugugaucucacaccuggaaggcuucccaccugauauuucaauagacucauuaugagaaucaggacuguugaaguuucucucuaguagugacacuacaugccugaaagaacaucug

SEQ ID NO: 4180535 - RNA, 75 nt, Human
cauaaaagccucaauggucaccugaaauagacucaaggcccguuggugccgacaugagcaggugcugcuuuuaug

SEQ ID NO: 4180536 - RNA, 101 nt, Human
cauaaaauauuagcauauuagacaagaucagauguauuauauguaauuaauguuaucauauaaugauuuucuggugagugaugacaguuaauagcuuucug

SEQ ID NO: 4180537 - RNA, 87 nt, Human
cauaaagccaguuaugagccagaggcccaaggacagcuguugauccugaaaaugguuuuaauuugucucugucucauuagcuuaaug

SEQ ID NO: 4180538 - RNA, 116 nt, Human
cauaaauuaaauacaucugugcucauuccaaguaugcuauuacagugucaucuaaaucuaauggugaacaaaauagcacauauuaagaugauauuaauguuaaacuucaauuuaug

SEQ ID NO: 4180539 - RNA, 81 nt, Human
cauaacaaauuagagucagcuauccauucuccuaugaacgaucagcaaaucucacaggagucaaggaauaguacuguugug

SEQ ID NO: 4180540 - RNA, 62 nt, Human
cauaacauuaagccucuauuucacuuauguaucugcauuuguuucuagagugcuuuguugug

SEQ ID NO: 4180541 - RNA, 72 nt, Human
cauaaccuagagugcuagaauucugugccugauucucuugggccucaugcaacaacacauucuggcaggaug

SEQ ID NO: 4180542 - RNA, 56 nt, Human
cauaaguuggguaauauaaugaaaucuuagaaugguucacuuauucucaacuugug

SEQ ID NO: 4180543 - RNA, 88 nt, Human
cauaauaaucaccaaauacguaguuguugaucacaugcauaucugaacucuguuagauagauagugagguaauagcgugaugaaaaug

SEQ ID NO: 4180544 - RNA, 55 nt, Human
cauaauccauuaauuaaugaccaugauuuaauuacaugucaugcuauggguuaug

SEQ ID NO: 4180545 - RNA, 86 nt, Human
cauaaugagcacgagcaaguauuaauagcauuuuuauauaagauggaaaugcuacacuuguuaaugacuugagagugguuauucug

SEQ ID NO: 4180546 - RNA, 100 nt, Human
cauaauuaagaaaggggagugaacaaguucuacugggacaucagugaggaacaggcccaguugacugauuucuuagaacugcuucaauugcuaaauuaug

SEQ ID NO: 4180547 - RNA, 75 nt, Human
cauaauuccuaccuauguauuuauuccuaguauauucuagacaccaccaggaagggauacauaggauaguuuaug

SEQ ID NO: 4180548 - RNA, 89 nt, Human
cauaauugccuuuguauuuuucuccccuuauccccaacugacaguguuuuaauuaaaaguugaggggagagaacauaaggaagucugug

SEQ ID NO: 4180549 - RNA, 56 nt, Human
cauacacauacaccaauguggucauauaucuguaugaauauauguguguguguaug

SEQ ID NO: 4180550 - RNA, 66 nt, Human
cauacagaagauaaugcugccuuggcuccuggcauuggggguugggcuggcccuugucucuggaug

SEQ ID NO: 4180551 - RNA, 68 nt, Human
cauacaguuuuuaaggaguaagaaagucagaugcuacuuauuugucuuguguccuuaggaccugcuug

SEQ ID NO: 4180552 - RNA, 77 nt, Human
cauacauacacacauaugugaguuuugggguucuuuucaguuuuaggcaucagaaauugugugugugugugugugug

SEQ ID NO: 4180553 - RNA, 69 nt, Human
cauacaucaugaaagcauacaucaugaaauauuugugagacagaguugaugcugcuuucuugaaguaug

SEQ ID NO: 4180554 - RNA, 97 nt, Human
cauacauguacacauauacagauggaaagauacacagguagauagcuguaaaaaauauaguauguguguguuuguguguguauguaguaugugugug

SEQ ID NO: 4180555 - RNA, 61 nt, Human
cauacauugcucauucaguaucucaaacccagaaagaugaguuacugacauugaaugugug

SEQ ID NO: 4180556 - RNA, 98 nt, Human
cauacccagaaacuuccagauugcuuaacuccauauauuuuuagcagcccaacuuggugccuauggauuggagaaggagcugcuguuuccugggugug

SEQ ID NO: 4180557 - RNA, 61 nt, Human
cauacuaguuugaaaauaucugauucuaaaagagaaucaguuuuccuuucaagugguaaug

SEQ ID NO: 4180558 - RNA, 116 nt, Human
cauacucuucccuaguuaagagucugauaagaaugcagcuugccaguaucuuaauugcagaccgagcaguggacccuguaaagucguguccagacucuuggccugcggaaacugug

SEQ ID NO: 4180559 - RNA, 81 nt, Human
cauacuggugggacaggagggacaccuuccugcugagggcccagaucucagcaccucucuucucccuuccuccaccauaug

SEQ ID NO: 4180560 - RNA, 55 nt, Human
cauacuuaaugucaguuugauguucuguuagaacucggacuggcauaagguaaug

SEQ ID NO: 4180561 - RNA, 71 nt, Human
cauagaaaaagguucucuuguucauuauuuuugaauaaacuaaucugcaacauagagggcuuuuuccugug

SEQ ID NO: 4180562 - RNA, 95 nt, Human
cauagaauuuauucacauuucgcaucaguccgauaaacuuccauugaguacuagugugggccagucacugugcuaggugcugaauauaaucugug

SEQ ID NO: 4180563 - RNA, 68 nt, Human
cauagacgcggccgcugaugcagcacuuguugaaggucaagauguucugcgugagcgugcccgucuug

SEQ ID NO: 4180564 - RNA, 64 nt, Human
cauagagcucucaguuccaaaggguccuucuuagaagcaagaauuggaauuugggagcuaugug

SEQ ID NO: 4180565 - RNA, 75 nt, Human
cauagagcuugcugcucugccgguacagcugcacggugcugaagaggcugggcuccgggagcaugcggcucugug

SEQ ID NO: 4180566 - RNA, 63 nt, Human
cauagaugggaggaaccugggucccugacuuaaaguaucauggauuuggauguucccuuagug

SEQ ID NO: 4180567 - RNA, 97 nt, Human
cauagauuguccucuuggaguuuauauucuaauaugagagagaaacaauaaacucuuaaguaaauuuauaaugugauuuugggagguaagugcuaug

SEQ ID NO: 4180568 - RNA, 81 nt, Human
cauagccacagaaaauaaagcacgauucauauucacuaaccacuuuugaaauugugaauucauuuucuggcaagagcugug

SEQ ID NO: 4180569 - RNA, 90 nt, Human
ccacagggcagcccugggauggcuucugaaucagggccugcccgccuccugcaggucccucucaguaagucagaagguacagcucugugg

SEQ ID NO: 4180570 - RNA, 89 nt, Human
ccacaggggaaaauggaagagugaaguugaugcuuccucugguuuuagacugugacugaaggcuuaacucuuucauuuucagcuugugg

SEQ ID NO: 4180571 - RNA, 61 nt, Human
ccacagguucugguaagcuguugcuucugaaaggagguaugcauguuggcuagugcuaugg

SEQ ID NO: 4180572 - RNA, 65 nt, Human
ccacagugcacuuuugggggauguuaguaugaucuaacauucucaaaagagguguaauucagugg

SEQ ID NO: 4180573 - RNA, 57 nt, Human
ccacaguuaagggaugucauguugaacuugagggucagcauucagucacuuaugugg

SEQ ID NO: 4180574 - RNA, 62 nt, Human
ccacaguuucuucaucuauaaagugggacucaugagggugccuccuuauaaugaugaugugg

SEQ ID NO: 4180575 - RNA, 62 nt, Human
ccacaguuugccagccaggaauugaguuugggguaguguuuuucuguguugguagggugugg

SEQ ID NO: 4180576 - RNA, 70 nt, Human
ccacauacaaucaaguucuuuauuagagacaaagacuguuacaugaauugaaaggacugguuguaaaugg

SEQ ID NO: 4180577 - RNA, 68 nt, Human
ccacaucagagcaggauuuauauuccauucaccaacccucagaggaauuuccccugucucugauuugg

SEQ ID NO: 4180578 - RNA, 78 nt, Human
ccacaucaucucucaggggacaagggagagaacuagagggauaguuaugacucagaguucuccugggaggugaaaugg

SEQ ID NO: 4180579 - RNA, 60 nt, Human
ccacaucucccuauugcucuuucauuuguaauucugaaaggaguagaagaaugauguagg

SEQ ID NO: 4180580 - RNA, 80 nt, Human
ccacaucuuagagaucacgccuccuaucugugugccauuugcagcucaggguggcccuguggucucauggagggaugugg

SEQ ID NO: 4180581 - RNA, 63 nt, Human
ccacaugauugucuggcuuggccacguuccacacaaagcuggcuuccccggagugacaugugg

SEQ ID NO: 4180582 - RNA, 60 nt, Human
ccacaugcagcuaguagcuaugguaucagacagugcugaguuauauauacuggcucuggg

SEQ ID NO: 4180583 - RNA, 68 nt, Human
ccacauggagagauggcagaggggagcagucacccuuuauucuggucccagcuggucacugucagugg

SEQ ID NO: 4180584 - RNA, 56 nt, Human
ccacaugguguagcuguggauggcugggaagagccaagcaggcuguaaucaugugg

SEQ ID NO: 4180585 - RNA, 82 nt, Human
ccacauucaaaaagcaucugucaccaguagccauggcaacagccaucccugaacaaauguggagagauguuuuuggaauagg

SEQ ID NO: 4180586 - RNA, 68 nt, Human
ccacauuguagagauuagaaagagaguuguuacuggccuuuuauuucucuuuucauuucugaaugugg

SEQ ID NO: 4180587 - RNA, 78 nt, Human
ccacauuuacugagcgccugguuuaugccagauccugugcuuuguaugauuugugcugaacacaggguuguaaugugg

SEQ ID NO: 4180588 - RNA, 119 nt, Human
ccacauuugaggcagcccgggagaggaauaauuauauucuagugucagcacauccucuuuccacaauggccauacacauagaaaauaaauaguuauuuugggcuguuuuacagcugugg

SEQ ID NO: 4180589 - RNA, 96 nt, Human
ccacauuugucuguguagagcuuuuacugcuguauugaaugagacaaucuuuuuuaauaagaaaaguucaucuuacugcuggugacgaguaagugg

SEQ ID NO: 4180590 - RNA, 64 nt, Human
ccaccacacugugggguuuaccaugcuguguuacacauagaaaaacugaggcccgcagaggugg

SEQ ID NO: 4180591 - RNA, 78 nt, Human
ccaccacuacaagucaaucuagagauuaaaauaggcaaaacugugaucuacguuaggaugggguuguuugaguggugg

SEQ ID NO: 4180592 - RNA, 89 nt, Human
ccaccacucucauuuugcauuuccagaguagcagacuguugugccagaggguuuguugauguugaaaauauagucagaaucaguggcgg

SEQ ID NO: 4180593 - RNA, 65 nt, Human
ccaccagaaguggcuuucucagggauacugccauuuguuuuccuguuccuguucgcuccugcugg

SEQ ID NO: 4180594 - RNA, 68 nt, Human
ccaccaggugcugaagagaggaugacacaaaugagaaauccuugaacuuagacacuaggaagacaugg

SEQ ID NO: 4180595 - RNA, 67 nt, Human
ccaccagugcccuggacggcggccccagcaacuuuggagcuggccgcaguguaccagguaugugugg

SEQ ID NO: 4180596 - RNA, 77 nt, Human
ccaccaguggaugaaugcuggaccgagagcccuagcuucuggauccaggucuaggcccuucaucugcugcucugugg

SEQ ID NO: 4180597 - RNA, 62 nt, Human
ccaccaucuauagagguauuugguugcauuucuugccuuuauuagcccacauggaauggugg

SEQ ID NO: 4180598 - RNA, 82 nt, Human
ccacccaggcucccacaagcucccagcccggugcccacgcuggccaggccugugcuggcuggagcucugggaccuggauugg

SEQ ID NO: 4180599 - RNA, 126 nt, Human
ccacccucccacuuuggacuauuuugcaccagauucuagacaucauaucauuugcuuauaaaucuuuuggcaugaaucucuaaaagaaagggaaugcuauguagauaagguagucaaggaaggugg

SEQ ID NO: 4180600 - RNA, 57 nt, Human
ccaccuccucggccaugugacggagcgaggguucucuccagcgggcugagcaggugg

SEQ ID NO: 4180601 - RNA, 86 nt, Human
ccaccucucugcaccccagcacucugacucuuaccugcucgggggagaaguggugggauggaggcuggaucugcagagcaaggugg

SEQ ID NO: 4180602 - RNA, 90 nt, Human
ccaccucuuccccaccaccuucaagauugugggucaaugggauaaucagguccugcauccguucucugaaggucaggaauauggacgugg

SEQ ID NO: 4180603 - RNA, 66 nt, Human
ccaccugcagccgccugccgucuugcaccucccagaggcgcugccacagcuggccgcgcgggucgg

SEQ ID NO: 4180604 - RNA, 57 nt, Human
ccaccuggaugccacaaagccaccuucuaugaggggcuuccguagcuuccagggcug

SEQ ID NO: 4180605 - RNA, 59 nt, Human
ccaccuggggcuguggccccuucacagggaaugaagcuggccagcagcguccacugugg

SEQ ID NO: 4180606 - RNA, 130 nt, Human
ccaccuuacacuuuuuccucuaccuuucuccagggaagaauaggugugguuuccaguggcacaguucaagcauggcagcaccuuucuuaccccagaaagcagcaguacccggggaaagaauauggggagg

SEQ ID NO: 4180607 - RNA, 62 nt, Human
ccaccuuguguggcaagauauguuacugucugaaccucaguuuuaucuuuaugcaguggugg

SEQ ID NO: 4180608 - RNA, 92 nt, Human
ccacgcuggcccagccccgcccugcucucagucugugcccagggccuacaguuggcugagggccucuugugggugggugagggcccaggugg

SEQ ID NO: 4180609 - RNA, 56 nt, Human
ccacgcuuugcgacugacuugcgagcaaagcagcgggcucagucugcggcgcgcgg

SEQ ID NO: 4180610 - RNA, 78 nt, Human
ccacggacauggcagccugcgugaaggagcuuguuuuccaucuccuggcagagcuccugcgcacggugcacacccugg

SEQ ID NO: 4180611 - RNA, 55 nt, Human
ccacggagcauguuugaaagggagaguccuaccugcauucaucaugacucugugg

SEQ ID NO: 4180612 - RNA, 76 nt, Human
ccacgggugaucacuuugucugaggcaacuuuguuaauaaggcagcuguuguguaucaggcagagaaccugacugg

SEQ ID NO: 4180613 - RNA, 81 nt, Human
ccacgugaggagccugugccuggcacuccagacagacugcauacguuaggugggccacaggcaggcacaucccacacgugg

SEQ ID NO: 4180614 - RNA, 75 nt, Human
ccacgugccaagauggagguguggagucaaagggaaaggcgccucccugcugcacucacaccuacacuugugugg

SEQ ID NO: 4180615 - RNA, 55 nt, Human
caggugcauuuuccuguccuuguucccaccaugggcucagacagugagugccuug

SEQ ID NO: 4180616 - RNA, 79 nt, Human
caggugcccgccaccaugccuggcuaauuuuuuguacuuuuaguagagacggguuagccaggauggucucgaucgccug

SEQ ID NO: 4180617 - RNA, 57 nt, Human
caggugcucugauauggggcuggccagcagacuggcuucuguggcagguggcgcuug

SEQ ID NO: 4180618 - RNA, 59 nt, Human
caggugcugcagggcuggcgucagccuccccaacagccgcuccagcugugcagcaucug

SEQ ID NO: 4180619 - RNA, 83 nt, Human
cagguggaaauagagggucaguucccuacugagcccuacugacaucaaggcccaguggggagcugagguucaacucccaccug

SEQ ID NO: 4180620 - RNA, 72 nt, Human
cagguggaaauguaaaucaguccauguuacucaccucggagaagcagaaguacgauuuacuauuguugcuug

SEQ ID NO: 4180621 - RNA, 57 nt, Human
cagguggcagaggucucuggaaccucacucccuguucccucaaucucuccccaccug

SEQ ID NO: 4180622 - RNA, 70 nt, Human
cagguggcagguaggccagaccuccaagcccagaggccuccccagguugccuggcccaucuaccgcucug

SEQ ID NO: 4180623 - RNA, 97 nt, Human
cagguggcggggggugagggggggauggguaaucugcuuaagcaauuauuuuguuuugaagaagcugaccuauuuuuaccuccucuaugcaaaucug

SEQ ID NO: 4180624 - RNA, 61 nt, Human
cagguggcuuagucccauuuuauagccaugagcaccaaggcuuggaaggcuaagacacuug

SEQ ID NO: 4180625 - RNA, 67 nt, Human
cagguggcuucucccuaggccaaaacuauagcacuuugagcugaaccaccuaggagagaaucaucug

SEQ ID NO: 4180626 - RNA, 68 nt, Human
caggugggcuugggagaacacuggggcaggcuaagucacacagccuaauuucuuucuaaguccacuug

SEQ ID NO: 4180627 - RNA, 63 nt, Human
cagguggguggaugauugacucuguagaccagacuagcuggacuaaucagugauccccagcug

SEQ ID NO: 4180628 - RNA, 71 nt, Human
caggugguguuugguuacaugaguaaguuccuugguggugauuugugagauucucgugcacccaucaccug

SEQ ID NO: 4180629 - RNA, 56 nt, Human
caggugguuccauguuucaugacaccucuaggguuucuggacuugcugcucaccug

SEQ ID NO: 4180630 - RNA, 80 nt, Human
caggugucucaggacucaggugagcaauuugccauagaauaguccagguaggugcccaucaccucacagucucucaccug

SEQ ID NO: 4180631 - RNA, 90 nt, Human
cagguguucauagcagcuuuauucauaguaaacaaaaguggaaacaguucaaauguccaccagcugaugaauggcuaaauguaauaccug

SEQ ID NO: 4180632 - RNA, 98 nt, Human
cagguuagaagguuaaggauaugaauauuuguggggggccauucuguuaacuaccuucaugaaauucucguguaccucauugugccaucuguuuccug

SEQ ID NO: 4180633 - RNA, 57 nt, Human
cagguuagcaacaugguuagagaagugcagcccucuggaucacuuguggcuacccug

SEQ ID NO: 4180634 - RNA, 61 nt, Human
cagguuaguuaaucuuuguuuccuucucuucuuuggaaauuauguagauuggucuaaccug

SEQ ID NO: 4180635 - RNA, 91 nt, Human
cagguuaucuggggaaaaaaaucagaaugugguggguuacauuugcacaagugaaacuucacauuuugauagauuucuccuuaauaauuug

SEQ ID NO: 4180636 - RNA, 89 nt, Human
cagguuccacucaaugccuuauaggcugaaaauugcucugucuucucagagcuagaaaggguguucagauaaggcagggugggacccug

SEQ ID NO: 4180637 - RNA, 56 nt, Human
cagguugaaaguggaggagcuagaaaagcccacaagaaauuccucacuguagccug

SEQ ID NO: 4180638 - RNA, 76 nt, Human
cagguugaacaauguuccuguagcugagccaggauuugaacccagguaguugguugcagggauggaguucaaaaug

SEQ ID NO: 4180639 - RNA, 96 nt, Human
cagguugcaguguguacauuaaggguguggucagaugcugagagaugacaucuguggcugcagaccuuaaacaaagucagcauaucugcaagacug

SEQ ID NO: 4180640 - RNA, 75 nt, Human
cagguugugugaaacaaugguucugucaguugucaaaauuauuuucuuacaaucauuggcuucauuacaacacug

SEQ ID NO: 4180641 - RNA, 58 nt, Human
cagguuuacaaaguaaaguguggguccaacucccggauauuauuagccaugugaccug

SEQ ID NO: 4180642 - RNA, 68 nt, Human
cagguuucaaagagaggcagaaggaacaggucagugggcuguuuguuaggcaaucuuugagaaacuug

SEQ ID NO: 4180643 - RNA, 70 nt, Human
cagguuuccaggaguuugaccugugggcugcuucccuuucagccccauagcugcccaccuccucaaccug

SEQ ID NO: 4180644 - RNA, 85 nt, Human
cagguuuuagucuaggaauuuuuguaaugguacuuuaacccuccaaaagaguauuuacauaaagaaauucaauggauagagccug

SEQ ID NO: 4180645 - RNA, 74 nt, Human
cauccagcuuuuucauacacauucuuauuacuuuugugucaucaaaagacuugggagcaguaugcugcuggaug

SEQ ID NO: 4180646 - RNA, 63 nt, Human
cauccauagccucaauaaauagcuaaaaucugauucuuugcuguuauuccaggcugaugggug

SEQ ID NO: 4180647 - RNA, 57 nt, Human
cauccauuuaauugaggggaaggagaguauuagccucauccuuuuuucuaaguggug

SEQ ID NO: 4180648 - RNA, 71 nt, Human
cauccauuucugauuacagaauacuagguuagucugucugcccuuguuucuagcuaaucacaaguaggaug

SEQ ID NO: 4180649 - RNA, 75 nt, Human
cauccccaugcauauaauagugccuggcauguaacauagccaguguucaauacauauuugugaaaugacuggaug

SEQ ID NO: 4180650 - RNA, 71 nt, Human
cauccguuuugcccaggauauugagucagcaaaggaaaugauggcuucagucuccuuggguccccuagaug

SEQ ID NO: 4180651 - RNA, 66 nt, Human
cauccuaauggccacuguugcuuggaccagggaugggugucuggucugagcggggccauucagaug

SEQ ID NO: 4180652 - RNA, 93 nt, Human
cauccuaguguuauuguuuacacauaacuccuaucaagaguuuggucaggacaauggauuuucuugaggggugugauaggcaugcuauggaug

SEQ ID NO: 4180653 - RNA, 74 nt, Human
cauccuauuccuuguacagaucuugcaaggacgcugugugaaacagcguuguugcaacucugaacaagaggaug

SEQ ID NO: 4180654 - RNA, 66 nt, Human
cauccuggcccucaugaccccuuccagguguggaggaccugugugaagggggcagaggggcaggug

SEQ ID NO: 4180655 - RNA, 72 nt, Human
cauccuggcuccuggagaccugcugauacagcugccuuguggcuacugcugagugggucaccagccagggug

SEQ ID NO: 4180656 - RNA, 78 nt, Human
cauccuugguuccuccugccucaguauccgcaucugugaucugggcugcuaugaggcagagaaaggaccccaugggug

SEQ ID NO: 4180657 - RNA, 89 nt, Human
caucgaaauugcaguaucauagaaacagaugcacuucucuaauuauagagauggugacuuuguuuauaggcaaaugcaguuuucaaaug

SEQ ID NO: 4180658 - RNA, 58 nt, Human
caucgcucauuccucugaugcuggguuucuuuuucaagccacagaggacagggcugug

SEQ ID NO: 4180659 - RNA, 97 nt, Human
caucgugcaccaguugcugaaaaauggcaacaugguauagugagaagaacguggcuuccagaccagagaucugccacucagcacuggugcaauggug

SEQ ID NO: 4180660 - RNA, 82 nt, Human
caucgugcuguaaaggaucugcuguguuucacaccucugggaauuucacaucuguugauacagcaucaccauucagacgaug

SEQ ID NO: 4180661 - RNA, 62 nt, Human
caucguuuuucuccuggccugauucuuauuugcugaggacucagagucugagauaaaucuug

SEQ ID NO: 4180662 - RNA, 70 nt, Human
caucuacguuguggcauguuucaggugcuuaauuccuuuuuaucacugaauauauuccauugcauggaug

SEQ ID NO: 4180663 - RNA, 71 nt, Human
caucuagaaggcgguuucccaagugugguaggcagguuugccacugaacauaugcaagaccauuuuaggug

SEQ ID NO: 4180664 - RNA, 66 nt, Human
caucuagagaaugucagugaucagguguccacuccaucauguggcucagagguuuuucucuggaug

SEQ ID NO: 4180665 - RNA, 94 nt, Human
caucuaucugcagaguuaaauagcuacaugaucucuaggaauuuauccacacuuccugaguguuucuguguuauucaguaaaaugcagauaaug

SEQ ID NO: 4180666 - RNA, 68 nt, Human
caucuauguucauagaaaucaugaccuucacaucuuugaggagugucagugaaacuaugaauaugaug

SEQ ID NO: 4180667 - RNA, 67 nt, Human
caucucacagcaaacugcugaaagggaccaggccuccuaugucugugcagcaguaugguguggcgug

SEQ ID NO: 4180668 - RNA, 67 nt, Human
caucucacugagggguuuacaaaagggccugacuuagugccuggccuuggggacuccucagugaaug

SEQ ID NO: 4180669 - RNA, 65 nt, Human
caucucagaaacauaucuaauccuuaaaaauaaaugaagagaggagaucugaaaugacugagaug

SEQ ID NO: 4180670 - RNA, 65 nt, Human
caucucauuuccuggauuaucuuuccugugccaacucacagugugggacauuaggaaaugguaug

SEQ ID NO: 4180671 - RNA, 92 nt, Human
cagucugaguccacuuuaaaaugucagccugaacucucagacuuaauuguuacagacauuuuauaagcagggcauuuaaaauccucaggcug

SEQ ID NO: 4180672 - RNA, 63 nt, Human
cagucugccaggggccagcccuagaaccaccuuccccucucuaagcugcacacccagcaacug

SEQ ID NO: 4180673 - RNA, 58 nt, Human
cagucuggcacagcacacugaacacuauucuuaguccacguguguagaugcugaacug

SEQ ID NO: 4180674 - RNA, 86 nt, Human
cagucugguggaggaagacagaguuaaauaagcauuaacuuuaaaguaggggaagugcauuaagcuaugggucaccuagcaggcug

SEQ ID NO: 4180675 - RNA, 86 nt, Human
cagucugguugggacaugcaguggcagcuccugguguauaacaucuuucacacaccuugagucuaucugcuugcugccuuugacug

SEQ ID NO: 4180676 - RNA, 64 nt, Human
cagucuucauagaaauaucacgucuuuucugauucaugaaaaggaaauuuucugugugagauug

SEQ ID NO: 4180677 - RNA, 70 nt, Human
cagucuuucaacucaugcuaaaggaaggagcauucagcccugacugagaacucaugaguuagaaaaacug

SEQ ID NO: 4180678 - RNA, 56 nt, Human
cagucuuuuguauauuagcagaccauugggaaacuugucaauauauaugaaggcug

SEQ ID NO: 4180679 - RNA, 65 nt, Human
cagugaaauaguggacaucaaauaacuuuauggguuguauugguuccuuuacuauguucuagcug

SEQ ID NO: 4180680 - RNA, 89 nt, Human
cagugaccuuggcaauucaaacugaggagaggauggccaguuaucuuauuggguacgauuuucagucuugaagaaaagggguuucacug

SEQ ID NO: 4180681 - RNA, 129 nt, Human
cagugagacccauuggcaggcagugggggugucaggagagggagcagcagccacaggaugaaugugggagcccacgggugucucuugcuccuccccucugggcgucaugcugcuggcgcugguccucug

SEQ ID NO: 4180682 - RNA, 124 nt, Human
cagugagacugcucugugcccauucauuucccuccugccauuugcugguuuucugaucugguuuauuuagguuugacaucagccaaaugguguagcgcgaugucucugacagauauucuuacug

SEQ ID NO: 4180683 - RNA, 71 nt, Human
cagugagaggcugcuguuagcccugggcauguggucagccacggccacaggacccacaacagcccugccug

SEQ ID NO: 4180684 - RNA, 129 nt, Human
cagugagcuaugauugcaccacugcacuccagccugggugacagagcaagacccuauuuuauguuuuuugagucaaagucucgcucugucgcccaggcugcagugcaguggcaugaucuuggcucacug

SEQ ID NO: 4180685 - RNA, 55 nt, Human
cagugagggcccccuuccagguagccagacacgcaccaguuuggggggcuuccug

SEQ ID NO: 4180686 - RNA, 61 nt, Human
cagugaguccaagauggcugaaugagagcagguguucugacuucaggugugggcugcaaug

SEQ ID NO: 4180687 - RNA, 72 nt, Human
cagugagugaagcauugcagcaaaugaaauucuggcuuucuuuucauuuugaacaagagcuucacauuauug

SEQ ID NO: 4180688 - RNA, 84 nt, Human
cagugauacuugguuuucuuuagaggugagagauuuuuagcucaccacuggcuucaucaaccucuggagaaaucaggaauccug

SEQ ID NO: 4180689 - RNA, 130 nt, Human
cagugaucuauuaucccaucauugcccuccagccugggcaacagagcgagggccugucuuuuuuuccuuugagauggaguugagcucuguuguccaggcuggagugcaguggugugaucuuggcucacug

SEQ ID NO: 4180690 - RNA, 90 nt, Human
cagugaugcaccuaaucuguguuucugccaguaugaccuuaagagggacauggcuugcaagcauaggagaaucugaugggugcuuuccug

SEQ ID NO: 4180691 - RNA, 62 nt, Human
cagugauggggaaagugagucagagaguuuucaaguuuagaauucauuuugcccagucccug

SEQ ID NO: 4180692 - RNA, 81 nt, Human
cagugauggugaaaggagaguagcauaucaaaaucaccugaaauugagggugauuuuuaaaauucuccuugcuucacauug

SEQ ID NO: 4180693 - RNA, 56 nt, Human
cagugauuuucucagaacuugagaagagaaagaucaaguuugagaggaagucagug

SEQ ID NO: 4180694 - RNA, 68 nt, Human
cagugcacaucaugcuauaaaaauuugaaaaaccuaaugagcccaaguguuagcaaagauguggauug

SEQ ID NO: 4180695 - RNA, 59 nt, Human
cagugcagcugccccgcugguaauacacaagauucugccaaggcuggaagcuguugcug

SEQ ID NO: 4180696 - RNA, 59 nt, Human
cagugcaggcuuguggccgcaggaagcucucuugucuggcauacucccugcucucacug

SEQ ID NO: 4180697 - RNA, 70 nt, Human
cagugcagguucgaccggguucagcaagagagccucugcuucccauaguggaauucggggaccuggacug

SEQ ID NO: 4180698 - RNA, 76 nt, Human
cagugcuaccuucucaaaguugugaaucaggcauuaccaacacuuugaaccugagcuuacaauuuaagaaccacug

SEQ ID NO: 4180699 - RNA, 66 nt, Human
cagugcuguagacaaacgguuuguuugaaaacauuuugugaaagccugcuuuguuccacagcauug

SEQ ID NO: 4180700 - RNA, 81 nt, Human
cagugcugucauucucuuaguauugcuaguuuagcuuauucucuuacaugugcugguucaggccacuaagaagacccacug

SEQ ID NO: 4180701 - RNA, 60 nt, Human
cagugcuuaacccagagcgaacguuagcgacuauuaauacuucugccuaggguuagccug

SEQ ID NO: 4180702 - RNA, 55 nt, Human
cagugcuugguccaugucugucuuuccguuuagacugagaacuugccaaggacug

SEQ ID NO: 4180703 - RNA, 111 nt, Human
cagugcuuuaaggucuaugaaguguguuuacaauaguuccuucuuuuguuuuacucuggggggaagcagagaggauauuauuguccaccugcuuuauggauaaagacacug

SEQ ID NO: 4180704 - RNA, 59 nt, Human
cagugcuuucaacccuguggcuaaaggucauccccgugucccaggugucugaagcucug

SEQ ID NO: 4180705 - RNA, 76 nt, Human
caguggaacacaggacuaucagcuguccucuggcauauuucauguaggccuuuaguuaauauucuguguaucucug

SEQ ID NO: 4180706 - RNA, 60 nt, Human
caguggaauacgagcagaugucuugaauaugcugugagcuuggucuuuuguguuccagug

SEQ ID NO: 4180707 - RNA, 83 nt, Human
caguggauaagaacauuugucagaaaaaaacagccaggcucaaaauauguuugacaagagcaaauguucuugaaauuccauug

SEQ ID NO: 4180708 - RNA, 76 nt, Human
caguggcaggagucagcccuaccuugaggcucagccggggcuugcccuggaggaagcggcugacgaucugccgcug

SEQ ID NO: 4180709 - RNA, 57 nt, Human
caguggcauacuuggcugauauaucuggucacaguagaaugggcuguuaugucauug

SEQ ID NO: 4180710 - RNA, 57 nt, Human
caguggccuuuccugcugcucagcaugaaaugagccaugagcagcaugaaaucacug

SEQ ID NO: 4180711 - RNA, 58 nt, Human
caguggcucaugccuauaaucccagcacuuugggaggccaaggaaggugggucaccug

SEQ ID NO: 4180712 - RNA, 63 nt, Human
caguggcugccucugccauccaggagcacucagaggggugaguggagaacagaggcucuccug

SEQ ID NO: 4180713 - RNA, 61 nt, Human
caguggcuuacaaugaacuagagaggggccuuguccuggucuacuccaccugugagcccug

SEQ ID NO: 4180714 - RNA, 129 nt, Human
caguggcuucucccaggucucugaggguguuuggagcucauacccucuucucuuuaacaagcgugacaguuaaaagaguaagggcugguauggacaaaagcaggaaggugccugggguaguagucauug

SEQ ID NO: 4180715 - RNA, 84 nt, Human
cagugggaagcugguugggagcuggaagcaaggccugaacaggacaguugggcuuaaacacagcucucagacggaaucccugug

SEQ ID NO: 4180716 - RNA, 71 nt, Human
cagugggaccugcucuuggaaugaggccgcccaugggaggccacaugccugugaugccugggugcccaaug

SEQ ID NO: 4180717 - RNA, 55 nt, Human
cagugggggugaggccgagguaccuggauugucaguggccucccacaccgcccug

SEQ ID NO: 4180718 - RNA, 57 nt, Human
caguggguccuaaguacaguucuuaugcucaucuugcugcuagacuuggggcuucug

SEQ ID NO: 4180719 - RNA, 81 nt, Human
cagugguacucucagauaguucuuugggaaguuuaaauuggcacaagcacuuugaagagcuuuuugacacauguauuacug

SEQ ID NO: 4180720 - RNA, 69 nt, Human
ccagcuuuccaggguugacuggggggcuuaaacaauagaaauuuacuuucucacaauucuggaggcugg

SEQ ID NO: 4180721 - RNA, 75 nt, Human
ccagcuuugucucuuaaauguuuacuuuuuuugagaucacaaagaugaaagauuuuuauagagagaaaagucugg

SEQ ID NO: 4180722 - RNA, 81 nt, Human
ccaggaaaaugagauguucaggagucugaguguauguguucacaugugugugugcucaggccuugaagucuuuucuuuugg

SEQ ID NO: 4180723 - RNA, 88 nt, Human
ccaggaagaaacggaucgcauggcucauuuaucuugcagccauuaauuaauggugguuaauuguaguuaugagcuguugaauuccagg

SEQ ID NO: 4180724 - RNA, 58 nt, Human
ccaggaaggcaggccuccccgcggcgccuuccagggcuccccggggccuccucccugg

SEQ ID NO: 4180725 - RNA, 61 nt, Human
ccaggaagguaugggaagaaaacugauuuuaaugugagugucucccuuuuaaccuuacugg

SEQ ID NO: 4180726 - RNA, 78 nt, Human
ccaggaaugaugcuggagcgugauccuugaucuugaggaguccacagggcaugcuucaaguccuuaaaucucuccugg

SEQ ID NO: 4180727 - RNA, 55 nt, Human
ccaggacaagccagagggacaggacaaaccaaggguccacagggguuuguccugg

SEQ ID NO: 4180728 - RNA, 57 nt, Human
ccaggacucaauuaaccucacuuaaacaauuuuuuggugggaccagugaagucuugg

SEQ ID NO: 4180729 - RNA, 63 nt, Human
ccaggagaugauguuggggauuguaaauauccacaagacagcccccccgcacccaacuccugg

SEQ ID NO: 4180730 - RNA, 90 nt, Human
ccaggagccgggauagugaggaguaaguucuggcuaccugcucaucaggcauccugucuugcuucugcugcacuauccugauuuuuuugg

SEQ ID NO: 4180731 - RNA, 60 nt, Human
caguuaugagcuauauuagagaagaggugcuaaucaacagucucuuuuagcuuacagcug

SEQ ID NO: 4180732 - RNA, 55 nt, Human
caguucauggaagauucaauggacauguacaugauccccugagcacccagaacug

SEQ ID NO: 4180733 - RNA, 64 nt, Human
caguuccacagagucucacuaugacagcaucauugcccucacagugagaaauuuguuggcauug

SEQ ID NO: 4180734 - RNA, 66 nt, Human
caguuccccuugaagacuagaaugaggaaucacaagcgugguuuucauuugcugccuucugaacug

SEQ ID NO: 4180735 - RNA, 69 nt, Human
caguuccugagagucaagaaugcagggagagcuuagcuagacuucuacuuuuagacucucacaagacug

SEQ ID NO: 4180736 - RNA, 64 nt, Human
caguuccuggcacacaguaggcaccaauaugugauagcuauugcugcugcuguugcugcugcug

SEQ ID NO: 4180737 - RNA, 90 nt, Human
caguucgucucgguuauuccucauuuaacacugguucaguuaauggaaaagaaagcacuuaagagaaggaaugaccuagcuagugagcug

SEQ ID NO: 4180738 - RNA, 59 nt, Human
caguucuacccagguauaaaugcauuauccucauaucugcaccacccgugggaggacug

SEQ ID NO: 4180739 - RNA, 70 nt, Human
caguucuauugaucuaacauuuguguuugaacuagaacaugcacugaaaauguuggauuccauauuacug

SEQ ID NO: 4180740 - RNA, 71 nt, Human
caguucugggugcaucaguuuuuuagaaguaacuguucaguuaacggcagaucugauguuaccaagaauug

SEQ ID NO: 4180741 - RNA, 57 nt, Human
caguucuggugacacgaaguuugcuaucucaaugggguagcccguucaucauagcug

SEQ ID NO: 4180742 - RNA, 74 nt, Human
caguucuguaccucagcuuugcucccaaccaaccacuuccacauguuuugcugguagagcugaggacagcucug

SEQ ID NO: 4180743 - RNA, 69 nt, Human
caguugaauggaagagaaguguccugugcaucaacguguucuucaggacacuuguucuucucugcacug

SEQ ID NO: 4180744 - RNA, 77 nt, Human
caguugagagugucagaaaacuucccuuugaguucucaaguuucauggcucaaggcgaauuuucuguuucuuuucug

SEQ ID NO: 4180745 - RNA, 57 nt, Human
caguugaggucagguauaaucaauguuccaaugggauaauuuuguccugucucacug

SEQ ID NO: 4180746 - RNA, 72 nt, Human
caguugcagaggcagagugcuaagcuuggcagaauauguaaauguggaagaagcaugugccucugacgacug

SEQ ID NO: 4180747 - RNA, 62 nt, Human
caguugcaguuguguccacagccauuuacauagagaggcucaccuagggagcacugcaacug

SEQ ID NO: 4180748 - RNA, 96 nt, Human
caguugcuggcucuaacucugccuuggugucacaagaagaggaccuuaauuccucuguuuugcauccccaagaauagagaauagaugucaaaacug

SEQ ID NO: 4180749 - RNA, 129 nt, Human
caguuggauaagccacaggugauaucagagguaaaaugccccagcugucaaugaaaugugagauuagagcaaccuagaacucucugugacagcuggguauguccccucugaaucugguuggccagcagg

SEQ ID NO: 4180750 - RNA, 72 nt, Human
caguuggauucaaaauaucagucccggccuaugugguuuaccuccaaaggucuaacugauagaauucaucug

SEQ ID NO: 4180751 - RNA, 97 nt, Human
caguuggggucgguggaugugcuggucugaggagagggaguucccugugugcuuccuaacgccaguauuuucaucaaaugaguuugaccugagagug

SEQ ID NO: 4180752 - RNA, 58 nt, Human
caguugugcccuuugccucagcaguccauuaaaaacuguuuugcagagaaggcgacug

SEQ ID NO: 4180753 - RNA, 64 nt, Human
caguuguggccauaggaggucagaugagcuguagcucaggcugguggucagauggcuaugauug

SEQ ID NO: 4180754 - RNA, 61 nt, Human
caguuguuccuaagucaucaacuuaauagacucauuucuagaagacaaaugggaauagcug

SEQ ID NO: 4180755 - RNA, 84 nt, Human
caguuguuucaggccagguuuucuuuucacuuuauuucuaagggcuccuucaaggcugaaaacgagauggcaauaagauagcug

SEQ ID NO: 4180756 - RNA, 125 nt, Human
caguuuacaagcauuuccuguauauuugccugucuucauccucaucauaacccugugaggauaauuuuuucuuauucucauuuuuauagaugagagaagaggagggagcuaauguuuguuuucug

SEQ ID NO: 4180757 - RNA, 61 nt, Human
caguuuacagaugcuacaggagcacuaacucaugggugugaucaucauggcucuggagcug

SEQ ID NO: 4180758 - RNA, 66 nt, Human
caguuuagccaguggucacugaggaagaauauaaguuagccucguagugaccauguggaaguccug

SEQ ID NO: 4180759 - RNA, 65 nt, Human
caguuucgucuccugggucuucucuaagcugcuccacccacagaacccaggggaagcagaaacug

SEQ ID NO: 4180760 - RNA, 58 nt, Human
caguuucugagcccugucauuugguagguucuuuggauccuugggucucuggaaauug

SEQ ID NO: 4180761 - RNA, 55 nt, Human
caguuucugggaggaaaggaagaaaaaagccauacuucacaacucuuagaagcug

SEQ ID NO: 4180762 - RNA, 58 nt, Human
caguuucuguuaccauauuugacaguguuaaagcugauauauaaggcgauagaaguug

SEQ ID NO: 4180763 - RNA, 97 nt, Human
caguuucuugagauacagcuuggcuguuuuaucuccugguggcccggcguuaaugucacuacugguauuaggaugaggccaggcuuuggagaagcug

SEQ ID NO: 4180764 - RNA, 73 nt, Human
caguuuggauccugcuaaaccagaauaaaaagucuagaacauggauguccucuugauuuagcagaucuagcug

SEQ ID NO: 4180765 - RNA, 96 nt, Human
caguuugggaaggcaaguaggugguagaguugggaugugaaugcgugcauucacuauaauccacagucuuagccaucaaaccagugucccaaaaug

SEQ ID NO: 4180766 - RNA, 70 nt, Human
caguuuguaauaccuuccaacaucaagacauuuuagaacuaaaauugacuaugaaggguaguacuugcug

SEQ ID NO: 4180767 - RNA, 62 nt, Human
caguuuuauacacugcagcuccuggcuuuaccauucauccagcagcucaggauauagacuug

SEQ ID NO: 4180768 - RNA, 103 nt, Human
caguuuucccagcaggagauggggcgugaugucuuuuauagugaccacagagcagauggcgcacaauacaucauccccauugggcuccuuuggaaaugaacug

SEQ ID NO: 4180769 - RNA, 130 nt, Human
caguuuugaggggcaggaaucuggaaguggcuuagcugaguggugcuggcucagggugucucaagacaagcuguuggccaaagccacagucaucuggagcuagacaauuccgugcucacucauacgguug

SEQ ID NO: 4180770 - RNA, 91 nt, Human
caguuuugccuauuacaaucgagagaaacaaauaguuuacacuugggagauucauaguauuuguuuaucgucgauuguaguaaaaauuuug

SEQ ID NO: 4180771 - RNA, 58 nt, Human
caguuuugucuccaugugaucuagaauguuuaugugagaacagaugugggcagaccug

SEQ ID NO: 4180772 - RNA, 101 nt, Human
caguuuuuacucccaagacuuuguuagugcucacguguuagaaaggcacccaaaguuuuccacgcuuuucagaaaggugagacuaccaaaagugaggauug

SEQ ID NO: 4180773 - RNA, 77 nt, Human
cauaaaaacaaguagaaaaccgcacuggacuaguguaaguuaugaguucccuguuuuuuuccacuguacauuuugug

SEQ ID NO: 4180774 - RNA, 64 nt, Human
cauaaaaacagcagagcugugccccuucacaaugggaauaaggccuggcucuguguuuauuaug

SEQ ID NO: 4180775 - RNA, 84 nt, Human
cauaaaagagaaagaaaagguauaucugauccaugagggagaacuugcuuuuuuaugucucugauguucuaaucugauuuuaug

SEQ ID NO: 4180776 - RNA, 87 nt, Human
cauaaaagcuagaaggaaaggcaguacagcugagccucaaggacaacuagaacuacugucacugucucucaucucugcuucuuugug

SEQ ID NO: 4180777 - RNA, 120 nt, Human
cauaaacuggacuaaauaaucaggacucccucaauucaucuacggauucaaugaaaucucuaucgaauuucaagcuggcuucuuuguagaaauugaaaaguugauccuaaaauucauaug

SEQ ID NO: 4180778 - RNA, 71 nt, Human
cauaaagcugcuguuuguauguggacugauuuaagccauaggaagucuauuuucagaagcaguuuucuaug

SEQ ID NO: 4180779 - RNA, 66 nt, Human
cauaaaguaaagaugucuuccaggacaauuuuaauuccuggaaaggaagaaacucuuuucuuugug

SEQ ID NO: 4180780 - RNA, 79 nt, Human
cauaaauauuauuauaaauuauuaggcugcuaaaugggcuguugauuaugcaguauguguaauuuaagguaauauuaug

SEQ ID NO: 4180781 - RNA, 76 nt, Human
cauaaaucuaucugagagauguguaggaagcugaaucuuuaaaaccuggcuucccucuuauuuuauggcauuugug

SEQ ID NO: 4180782 - RNA, 78 nt, Human
cauaaauggaaaccaccgauguuuacccaggguggcauugagcaccuuuccaaguaucaggugguguuuucaacugug

SEQ ID NO: 4180783 - RNA, 106 nt, Human
cauaacauauauagaaaauggaaguaccucugcauuugcuuaggaaaaaagguuaagauccuuguuuuuaagagauguuuacuccaggucaaugaucccuguuaug

SEQ ID NO: 4180784 - RNA, 64 nt, Human
cauaacauccuugcuacuuugacuuuguaucugacaacaucucagucuuugcaaggaugcugug

SEQ ID NO: 4180785 - RNA, 84 nt, Human
cauaacugcaguuucuuuucaggaugacaccauguccagcuuaaaauguguagcuggauguuuuaagucuccuuugcagcuaug

SEQ ID NO: 4180786 - RNA, 75 nt, Human
cauaacuguugucaugguauauuucacucuuuaggaagucccugaggaauagugauuaaacuauuauuacugaug

SEQ ID NO: 4180787 - RNA, 59 nt, Human
cauaagaaauuuaacagaacuucacccugugggaacaaguucuuuuagaugucuucgug

SEQ ID NO: 4180788 - RNA, 69 nt, Human
cauaauacuguacgucccagauaggagcuccuucuucaauuuggcucccaggaugaagacaguguugug

SEQ ID NO: 4180789 - RNA, 69 nt, Human
cauaaugagcugugggauuccagaggauguagaucuccacgaacccucugacuccacacuugaacugug

SEQ ID NO: 4180790 - RNA, 81 nt, Human
cauaauggacagugcuccacauugcacuauucggggguggaaggagucuggaauagugcaauggggaguaaaguuuauaug

SEQ ID NO: 4180791 - RNA, 90 nt, Human
cauaauuguuggcuauucuguuugucuuuauuuucuuggauuagguguucaaguugguaggagacagaaggugaagaauugcaauuuaug

SEQ ID NO: 4180792 - RNA, 56 nt, Human
cauacaagcgugcaugugcuugugaguguguguacaugcaugugugugcuugugug

SEQ ID NO: 4180793 - RNA, 121 nt, Human
cauacacacgaguucaaaccucuaggacugguauuugguauaauucgauucucauauuauuaugagggguauauuaaaugaccaguuuuaauacauggugcacuuugaauugguugucaug

SEQ ID NO: 4180794 - RNA, 60 nt, Human
cauuuugaucucccagacuaaggaguugcugcaucuccuuagcucagggaguucacugug

SEQ ID NO: 4180795 - RNA, 60 nt, Human
cauuuugcuaguucugugguuuugagcaucuuucagcuuagauucauaaucuguaaaaug

SEQ ID NO: 4180796 - RNA, 82 nt, Human
cauuuuguguguauuuauuuugcugcuaugccuugcaacugauuuugcuugcagacuuagcaaauugaaguuauuuaaaaug

SEQ ID NO: 4180797 - RNA, 114 nt, Human
cauuuuuaaauuuaaguuaaugcuaaaauguauuuguuaaucuuaagccucauaguucccuuaaagaggcuugaguaaagaaguauuuuagguucuggcuuaaauaugaaaaug

SEQ ID NO: 4180798 - RNA, 80 nt, Human
cauuuuuauaugagucauuauuguaauuuuugaaacuuacauguuuguugaguuacagagaugaaagaaaugugaaaaug

SEQ ID NO: 4180799 - RNA, 58 nt, Human
cauuuuucgucauuggauuuuagccugggaggaggcuaggucuggcagaagaaaaaug

SEQ ID NO: 4180800 - RNA, 103 nt, Human
cauuuuucuccucgcaaacuugagauaguaauucuuacaggcuaaguacaagcuuaacacuguccaaagaauuccacacugucuaggaaagaggucugaagug

SEQ ID NO: 4180801 - RNA, 78 nt, Human
cauuuuugaaggcucucuuccuuuucugggcuuguuucauuaucucuuccagaaaggucuuccggucuuccagaaaug

SEQ ID NO: 4180802 - RNA, 73 nt, Human
cauuuuuggagaacuuccacucauuuucacuuugaccaugcaaaugaacagugggugagguacccucaaaaug

SEQ ID NO: 4180803 - RNA, 58 nt, Human
cauuuuuuaaacaucucacugccugggcccugaaccaggcauugaguauagacagaug

SEQ ID NO: 4180804 - RNA, 81 nt, Human
cauuuuuuaggaagaaggaggcaguauuaauuuuuaguuacacaagugauauauaaguacagucugcuuuuuuaaaaagug

SEQ ID NO: 4180805 - RNA, 62 nt, Human
ccaaaaagcuguuuuuagguggagguaguggguguuacuauuugagcgaagcaguguuuugg

SEQ ID NO: 4180806 - RNA, 78 nt, Human
ccaaaagggcuugcaaggauucauaggaaacugccccaaauaauuuaaguuucuguucaguugauguaguuuucuugg

SEQ ID NO: 4180807 - RNA, 66 nt, Human
ccaaaaggugauacagaauaacgcugccauugacaaaguaugugugcauauucugccaccucgugg

SEQ ID NO: 4180808 - RNA, 90 nt, Human
ccaaaagucauuucaugaaugcugcuguugaggcauguuuuucucucccgacucucacccaguucugcauuugagagguugacauuuugg

SEQ ID NO: 4180809 - RNA, 97 nt, Human
ccaaaauauaggaaaguuagaacaauauucucccuacaaacagugcauaguccagcugaaauguggggaauuauauaguaaugguuccugugaaugg

SEQ ID NO: 4180810 - RNA, 69 nt, Human
ccaaacaaaagggcagaugaaaagcaguguaauccgugggaaagcaugugucaucugccuuucguuagg

SEQ ID NO: 4180811 - RNA, 96 nt, Human
ccaaacuucacaguagcaauguugaacacugcgugaugcucaguaaccauuuuaaagucauaacacaguaguuugucauugcuaaaccuuuuaugg

SEQ ID NO: 4180812 - RNA, 83 nt, Human
ccaaagaaaguuguuggaggaaaugacugucaacacuuuauuugacuuacucaauuuacuuuuagcaauaauaaagcauuugg

SEQ ID NO: 4180813 - RNA, 63 nt, Human
ccaaagacagacuugacuagagccucguguccccagagggccucacuggaaguuagucuuugg

SEQ ID NO: 4180814 - RNA, 60 nt, Human
ccaaagcauaucauuauaaugggagcaucuagcaauucccaguggugggugcacauuugg

SEQ ID NO: 4180815 - RNA, 83 nt, Human
ccaaagcaucuuggacgugagcgugcaguaguguugguaggaugguaacuccuacaacauuguguugcuucauagugcucugg

SEQ ID NO: 4180816 - RNA, 72 nt, Human
ccaaagcccagugauggugaucagauguuaccuaaguauguagacuacugccuaccacgcuguacuuguugg

SEQ ID NO: 4180817 - RNA, 60 nt, Human
ccaaagccugggcggacuggagagggggccuaccugccaggagucaggccaggcaguugg

SEQ ID NO: 4180818 - RNA, 60 nt, Human
ccaaagcucugaggaacugcauguuacuugggcaaaauaugcaagcaaucugagcuuugg

SEQ ID NO: 4180819 - RNA, 57 nt, Human
ccagccugguucagaauuggcuccauaacuggauaaugcuggaucugaaggugcugg

SEQ ID NO: 4180820 - RNA, 64 nt, Human
ccagccuucugggacucucaucuagggcucuguuuuggaugaucugagagucccaggggcuugg

SEQ ID NO: 4180821 - RNA, 60 nt, Human
ccagccuuuucucuuugccuuucagggcacauugucaugaacaaaggcaggagaaggcgg

SEQ ID NO: 4180822 - RNA, 68 nt, Human
ccagcuacagacugagcauggcucuacugaggaauaaggaagagcuuuagcugcuggucuggaccugg

SEQ ID NO: 4180823 - RNA, 87 nt, Human
ccagcuacauuugugauacuuucagugcuaagaaaaucuauauucuguagcuuugaaguuauuuaacaguuaaguacuauuugcugg

SEQ ID NO: 4180824 - RNA, 56 nt, Human
ccagcuauccugaccagccucgucgcuucccagaggcaccagggaaggaaggcugg

SEQ ID NO: 4180825 - RNA, 72 nt, Human
ccagcuauuuguaggaaaacuguacuuuggagaucuacccagacuuuucacagccuccuacaaaaugccugg

SEQ ID NO: 4180826 - RNA, 72 nt, Human
ccagcuccaggacugggagcugauugguuuaaguuagucaguguaacccaagccccuggccauggaguaugg

SEQ ID NO: 4180827 - RNA, 74 nt, Human
ccagcuccgcaggcuugagggcaggcccagucaccugcaggcagcugggucuggcugugagccgggagagcugg

SEQ ID NO: 4180828 - RNA, 57 nt, Human
ccagcuccugggucuuagucagagguucacauccaccaacuaucuucccaggguugg

SEQ ID NO: 4180829 - RNA, 64 nt, Human
ccagcucugugcauugcccauuaggcagugcuuccuucuguccucugggcuuugagcagucugg

SEQ ID NO: 4180830 - RNA, 69 nt, Human
ccagcuggacugggcuuugguacugugauuagcauagcugggauuuaccaagcgcuuccucuagccagg

SEQ ID NO: 4180831 - RNA, 64 nt, Human
ccagcugggauuaagggaaaauuagaaugaaaugaaaaaagaauuuucauuuaaaauuggcugg

SEQ ID NO: 4180832 - RNA, 85 nt, Human
ccagcuggucccuucugaucucagcugccucucccuggaagauguagaucuucuugugcugggccagcuucaguggggcuacugg

SEQ ID NO: 4180833 - RNA, 55 nt, Human
ccagcuggugacauccccaaccagccccaccuggugucugguguccccaggcugg

SEQ ID NO: 4180834 - RNA, 62 nt, Human
ccagcugguuuauauuccccacccuuucuucauggggcaugggaggauucagaacuauuugg

SEQ ID NO: 4180835 - RNA, 57 nt, Human
ccagcugucagugugaaaauaaagccaaauagcuuaacauuucuaaagacuagcugg

SEQ ID NO: 4180836 - RNA, 56 nt, Human
ccagcuuaaaaccauuuauuuagcuuaugauuuugcuggaugucaaauuaggcugg

SEQ ID NO: 4180837 - RNA, 66 nt, Human
ccagcuuauuaagcagguaagacccgucuuuuugauauaaaaacaauaggcuauaugcuaggcugg

SEQ ID NO: 4180838 - RNA, 58 nt, Human
ccagcuugugucauucaucuuguaaaauaauuuacaagauguguuuauacaagcuagg

SEQ ID NO: 4180839 - RNA, 55 nt, Human
ccagcuuucauaucaugagguaacccuagggagaggccuacaugaguaagcuugg

SEQ ID NO: 4180840 - RNA, 64 nt, Human
ccagcuuuuggggugacaauuuuugcccuguaaacuucacgaaaaauuagucaaagaaaguugg

SEQ ID NO: 4180841 - RNA, 69 nt, Human
ccaggaaagaaaggaggugcauuuacaagagccagagaauccugaaaaaacacaacugucuuucucugg

SEQ ID NO: 4180842 - RNA, 65 nt, Human
ccaggacagugcauuuccuggcaugggagcucacucuuaugcccagacaaugccacugagccugg

SEQ ID NO: 4180843 - RNA, 111 nt, Human
ccaggacccuccauucuccccaccccacuuccaccuuugggggugucggauuugaacaaaucucagaaguggccucagagggagucggcaagaauggagagcaggguccgg

SEQ ID NO: 4180844 - RNA, 112 nt, Human
ccaggagagcacagcagggcuucuggugggaaaacacccugugucaagguaguagaugcacagggcucagcuggcaggguucucacugaaaucuagacugcaccuuuccagg

SEQ ID NO: 4180845 - RNA, 94 nt, Human
ccaggagauaaccaaaauguagcucuauacaaucaucuuucauaguuguuauggcaggugaaguuguuagggacauuugaauguuauuuuucgg

SEQ ID NO: 4180846 - RNA, 65 nt, Human
ccaggagcagggcuggcugcacuggucugcaaaagcaaagugucagccagacgcccugcaccugg

SEQ ID NO: 4180847 - RNA, 94 nt, Human
ccaggagccaucguuuucuaguaaacaggggugaacuucauuguagcauaaacuauagaagauagcuuuuguuucuguaaaugaaaacaccugg

SEQ ID NO: 4180848 - RNA, 81 nt, Human
ccaggaggccuggccuuugcuggcccucaggcugagggcugcuccagcuggucugagugggcaggggccgggggcugcugg

SEQ ID NO: 4180849 - RNA, 67 nt, Human
ccaggagggaccgcggcaucccccuuugcuucuccucaccugggccccuugcucuggucucacuugg

SEQ ID NO: 4180850 - RNA, 69 nt, Human
ccaggagggagaagagggcagagcucagguccgucugacaccagagcccugcccacuugucugagcugg

SEQ ID NO: 4180851 - RNA, 85 nt, Human
ccaggaggucacgggauggguguggcuggggaucugaugcucacagagccuccucuucugccuauaucugccugucuucagcugg

SEQ ID NO: 4180852 - RNA, 72 nt, Human
ccaggcacaguggcucacaccuguaaucccagcacuuugggaggccaaggcagguggaucacugaggccagg

SEQ ID NO: 4180853 - RNA, 129 nt, Human
ccaggcaccuaagggcucugccaauugggacaguaccucagaucagcaucauuuguacccagugugcaaaucccugauaauguaggucugagaucauaacuucccagggcagccuccucaguugucagg

SEQ ID NO: 4180854 - RNA, 71 nt, Human
ccaggcaccugugugucucagggcccagaagagcuuguggccuccuugcagacaucaguaguggccccugg

SEQ ID NO: 4180855 - RNA, 104 nt, Human
ccaggcacgcucccucucccgcuccuccagcccgccguagcugcacuaaccccgaguccagcuagcggugcuggcggcuccgggacggaacuuggcggcccugg

SEQ ID NO: 4180856 - RNA, 80 nt, Human
ccaggccagcagcugccccgacugugaguccaguggccacccacaccggcagccaggagggguagagcagcugcgucugg

SEQ ID NO: 4180857 - RNA, 74 nt, Human
ccaggcccaccccagcuggcucauguugccuuuccccaccagagagccuaggcugggcaugucuuugggucugg

SEQ ID NO: 4180858 - RNA, 67 nt, Human
ccaggcccagugguucacguguaaccaggugugauuucugaggaaccuggaccaaacacuggccugg

SEQ ID NO: 4180859 - RNA, 65 nt, Human
ccaggcccugcaggaguggggacagagggaacccggccgguggcccgacccugcagggaagaagg

SEQ ID NO: 4180860 - RNA, 57 nt, Human
ccaggccuagccccugaggguaaaggaucuugccgaccgaagggggcugaggguugg

SEQ ID NO: 4180861 - RNA, 71 nt, Human
ccaggccucccggugcacacugacacaccgccguccgcgggcugagcuucagugacaccgaagggcacugg

SEQ ID NO: 4180862 - RNA, 56 nt, Human
ccaggccugcauucccucucagaguucugauuuucaaagguuagaaugaggucugg

SEQ ID NO: 4180863 - RNA, 107 nt, Human
ccaggccuuguucuggaaguagcagugccaggcuuuagcccgggcccucggacaccaggaugcuugcucuuuagccauggccacucucguuccagguauaaggcugg

SEQ ID NO: 4180864 - RNA, 59 nt, Human
ccaggcucaauggccacuugggcccuuggaugagggcuagcugcauuuaugagaccugg

SEQ ID NO: 4180865 - RNA, 88 nt, Human
ccaggcucccugaagaguuauggcugugugacugaguucuagucaauggaaugugaacauacaagguauauacuacuuucaggccugg

SEQ ID NO: 4180866 - RNA, 56 nt, Human
ccaggcuccggcggauaccuaaugccccuggugggcacaucugcuggcaggucugg

SEQ ID NO: 4180867 - RNA, 70 nt, Human
ccaggcugagugcuccuggaggacagggacugucuucuucaucucugugucagcagcacucagcccaugg

SEQ ID NO: 4180868 - RNA, 101 nt, Human
ccaggcugcaccgcagguaggugagcagugggugagcaaagcuucaucuguauuuacagccagcugcuucccauagcucgcauuaccugggaccagccugg

SEQ ID NO: 4180869 - RNA, 66 nt, Human
ccaugagacugccucaccaagaguaugacaaaagaaaccugugauuucuaaggcuaggucuuaagg

SEQ ID NO: 4180870 - RNA, 130 nt, Human
ccaugagcucccagauucgucagaauuauuccacugagguggaggcagccgugaaccaccugcucaauuugcaccugcaggccuccucaucugccucucucugggcuucuacuuacacugugacgaugug

SEQ ID NO: 4180871 - RNA, 85 nt, Human
ccaugaggaaauguugaccucagaggcaugguuagaauagcaguuauaggcucccuggccauuccucuaggccuuccuacauugg

SEQ ID NO: 4180872 - RNA, 56 nt, Human
ccaugagguuuagguuccuccucuacaaaaugaagaugaagauaccuaccugaugg

SEQ ID NO: 4180873 - RNA, 82 nt, Human
ccaugauaaguugaaauuugugauaauuuagagaaugauaucaagcaacugcuuuaaaaucauagacuucaguaacuaaugg

SEQ ID NO: 4180874 - RNA, 71 nt, Human
ccaugaucuaucaccuuuagguuuguuguuuuuugccaugacaacugcuuaucuuugguagauguuuuugg

SEQ ID NO: 4180875 - RNA, 59 nt, Human
ccaugaucucaguaguguccugaagccaagaggaacaggcuccacucccugggaugugg

SEQ ID NO: 4180876 - RNA, 81 nt, Human
ccaugaucugaaauugguccaugucauaccccauuagggucagugggcagugacaaaggggaugaacguuguaaucagugg

SEQ ID NO: 4180877 - RNA, 61 nt, Human
ccaugcaaggagaacucucacuucugcgcuagagaagagcaguuauggauucuccugcagg

SEQ ID NO: 4180878 - RNA, 63 nt, Human
ccaugcaggaagucggggagcgggggcccaggggugccuuguggcccauggcuuccugccugg

SEQ ID NO: 4180879 - RNA, 84 nt, Human
ccaugcaguauaauaaccaggaagcugucugauaugaaagccaucaauagcauuuucaaucaaaaccuuucaguuaauugcugg

SEQ ID NO: 4180880 - RNA, 55 nt, Human
ccaugcauaugccguagaauaagucaacugacuuaaaugauggcuucauguuugg

SEQ ID NO: 4180881 - RNA, 65 nt, Human
ccaugcccggcuaauauuuuuguauuuucaguagagacaggauuucaccauguuggccaggcugg

SEQ ID NO: 4180882 - RNA, 66 nt, Human
ccaugcccugaugauguguuucuuccagagagaaguggggaaggaccuauauugucagaggaaagg

SEQ ID NO: 4180883 - RNA, 59 nt, Human
ccaugccgucaucaaaaccugccugcuggaugagcagcgcaggcgugugaaggcgcugg

SEQ ID NO: 4180884 - RNA, 72 nt, Human
ccaugcucaucugagucaaauauuucauuugugcagcucaacauaacauagaauaaaugaguuaggggcugg

SEQ ID NO: 4180885 - RNA, 85 nt, Human
ccaugcugcucuagggcucugugagguugggcaaaucauaucacccuccuaagccauagcucucacaccccuaaaaugggcaugg

SEQ ID NO: 4180886 - RNA, 68 nt, Human
ccaugcuuggcacucaacugucguuguuggaugaaacaauucagaaauugccagaaugucaggcuugg

SEQ ID NO: 4180887 - RNA, 55 nt, Human
ccauggcuaacuuugaagugugcgugccucuuugagcacaucagcagggcugugg

SEQ ID NO: 4180888 - RNA, 57 nt, Human
ccauggcuaaguaucuguagaaucauuuccuuucuacaaugcaaacuuggcccaugg

SEQ ID NO: 4180889 - RNA, 67 nt, Human
ccauggcugccaggagggaggccagucgcgggacuggggaacuggcaggcugcuggccggcgcgugg

SEQ ID NO: 4180890 - RNA, 74 nt, Human
ccaugguggcucaugacuguaagcucagggcuuugggaggauugcuuaaggccagcaguuugagaccagcaugg

SEQ ID NO: 4180891 - RNA, 115 nt, Human
ccauguaaaaaauaacaucugcuguacauguaaauucuugccaaucuggagggucaaacagaacucaagacaguucucucagagaugucaagagucuauaugcagcuuuaugugg

SEQ ID NO: 4180892 - RNA, 70 nt, Human
ccauguauaggcagaaagcaaagacuggauuugaacccagacuuuugauucaauguuuauauaaaaaugg

SEQ ID NO: 4180893 - RNA, 76 nt, Human
ccauguauguacaguaccugccacguuguuggcacuaaguaaauguuaaguaacaaugggaaggacugaugaaugg

SEQ ID NO: 4180894 - RNA, 97 nt, Human
ccaugucacccucauggagcuuucguuagccuuguuugggauacaaagggguaaguguccccucauuuuagagaaagaucaagagccagugaacagg

SEQ ID NO: 4180895 - RNA, 111 nt, Human
ccaugucuauccagggggcuuuuaacucuucauuguugaaccucagcuagaguccuacaugcugaggauauagcaggaacaaagcaaagucccuguuuucauagaacaugg

SEQ ID NO: 4180896 - RNA, 61 nt, Human
ccaugucuuauuaaauugaacccucacuuacuggagugauaaaaggugauaagaucuaugg

SEQ ID NO: 4180897 - RNA, 63 nt, Human
ccauguggugggaaggagaaugacucucagccauguccuuucucccaucucagucuuacaugg

SEQ ID NO: 4180898 - RNA, 79 nt, Human
ccauguguccaucagaagagcaaagaacuguuguaguauuaacaugcuauuacaacagaaguguuuauuuaggaauugg

SEQ ID NO: 4180899 - RNA, 57 nt, Human
ccauguugcaucuccccugcuccucauuaucccucugugaaaaugcaggcgacaugg

SEQ ID NO: 4180900 - RNA, 64 nt, Human
ccauguuuuccacccaagauagguagaugaguccucuacuauucuugugugguggaagauaugg

SEQ ID NO: 4180901 - RNA, 88 nt, Human
ccauuaaaguuauuuugcuuucucugaccagagugagaucaucaauuacuuuccuucucugaagaacugaguaaacaugacucuaagg

SEQ ID NO: 4180902 - RNA, 80 nt, Human
ccauuaccacccccuuuugcagaugagaaaacuguggcuuagagagaucaaguaauuugccuguagcugguaagugaugg

SEQ ID NO: 4180903 - RNA, 65 nt, Human
ccauuagaaacccauguuuauucagugugaugcccugcacugaaaguggugguuuucucucgugg

SEQ ID NO: 4180904 - RNA, 60 nt, Human
ccauuaguaggcucuuggcaggaguccagaugagcaacuguggggccucgugcuagcugg

SEQ ID NO: 4180905 - RNA, 83 nt, Human
ccauuauaaguuucuugaagacugauguuuauugccucuucuuaaguaauuauaggcauauaguguuuaaaaaaauauauugg

SEQ ID NO: 4180906 - RNA, 88 nt, Human
ccauuauucauauauaugcacuacguacccuccuagauuuaguuucuguuccuguuccuguguauguagguauguauguguuuggugg

SEQ ID NO: 4180907 - RNA, 88 nt, Human
ccauuauucauucauuguuuauugaaaguuucaggcaccguacugggcaccagaagaauaaagaugacaaugacauggacagugaugg

SEQ ID NO: 4180908 - RNA, 76 nt, Human
ccauuauugcaaagcguagacucuaaacauauuauuagcaucaaaaaauguuuguuuuguaucuuuguauuaaugg

SEQ ID NO: 4180909 - RNA, 74 nt, Human
ccauucauagcauaugcuuuuagcucugaugagaacagugcuguucuucagauccuacaagucugcaagauugg

SEQ ID NO: 4180910 - RNA, 68 nt, Human
ccauucauuguugagugcuucagcuguacaagccauuuuaaugucaguuugagaccaacagagacugg

SEQ ID NO: 4180911 - RNA, 99 nt, Human
ccauucauuuuaggcgcuucauuauucaguugucuacuacugccuggcacacaguagaugcucaauaaguggagaacagaugaauaagugaaugaaugg

SEQ ID NO: 4180912 - RNA, 81 nt, Human
ccauuccuguacagagacccacaagagacugaaaaaugguguuggucaaguugucuuggguucugugccuucugggaccgg

SEQ ID NO: 4180913 - RNA, 56 nt, Human
ccauucgcuggcucgucuuuucuccugugaucagggguguuuuuggccaggagugg

SEQ ID NO: 4180914 - RNA, 91 nt, Human
ccauucggcaggcaguggaagcugucugaggcuucagggcccccuccucacuaggggcuauaauucaugcaguuucuuaucugccagaugg

SEQ ID NO: 4180915 - RNA, 57 nt, Human
ccauucucuucugaugucuugccauauucccaauggcugaaauaaagaagggaaugg

SEQ ID NO: 4180916 - RNA, 130 nt, Human
ccauugaauguggggugcuggacuguuuuauuugaccacuuuugccuauauccagaagaauuuguuuguuguguaugcaauugagucauagaaaagaaacguccuguuguuaaaguucucauaguuuugg

SEQ ID NO: 4180917 - RNA, 88 nt, Human
ccauugagcuagggcugagcuccucuccaggauucauuccuuuugugcuucagagcauccuggaggcuggaggcuugcuccucagugg

SEQ ID NO: 4180918 - RNA, 106 nt, Human
ccauuguaaugucuuguguaugccuuaauuuaugucuaacauaaugguuuuguauugugagacaauugcaucagggcacuuacacgauuaaaaagagauuuaaugg

SEQ ID NO: 4180919 - RNA, 92 nt, Human
ccauuguuaucuuuuuaguauuuggccucuacagucucccaaagucaugguagagacagauuucacauacacacuaaggugacuucagaugg

SEQ ID NO: 4180920 - RNA, 61 nt, Human
ccauuuauuauguucauggauucucugagucaggaauuuagacagggcauaaagaggaugg

SEQ ID NO: 4180921 - RNA, 65 nt, Human
ccauuuccaaucucugcauauggggaccugcgucauguuuuuaagugccaagaugacuggaaagg

SEQ ID NO: 4180922 - RNA, 64 nt, Human
ccauuuccucucccccaaggacuugcagccaaucuccgauagcccuguccaggagaggcaaugg

SEQ ID NO: 4180923 - RNA, 79 nt, Human
ccauuugaacaucuuuccguggacuuuacuggcugcuccuaggccuaggauucgggcauaaagccauuaagauucaugg

SEQ ID NO: 4180924 - RNA, 85 nt, Human
ccauuugcaaguaaagaaucacauuucuugcggcuaggaagcacuugguuagacaagagaggugauuuauuuacuucuucuaugg

SEQ ID NO: 4180925 - RNA, 57 nt, Human
ccauuugcauaggauggacauuuuaacaauguuauuuuuuccaaucuaugcgcaugg

SEQ ID NO: 4180926 - RNA, 56 nt, Human
ccauuugugcucccucagagagagugaggccccugucucuggaagaguuuaaaugg

SEQ ID NO: 4180927 - RNA, 76 nt, Human
ccauuugugguuaagucacugucaaagccacacacuccuugggggaguggggguugcacugugacugcuccagugg

SEQ ID NO: 4180928 - RNA, 62 nt, Human
ccauuugugugucugaaaaggaggcuacgaugugcuuucucaaguacugcacaugaaagugg

SEQ ID NO: 4180929 - RNA, 81 nt, Human
ccauuuuacagagguucugacaguucucugcuuauuuuuagaaucaaugauuuaggaagcuuccagaacuuaaguaauugg

SEQ ID NO: 4180930 - RNA, 56 nt, Human
ccauuuugagguguuugugcaccaucugugacacacacagcaaacacuguaaaugg

SEQ ID NO: 4180931 - RNA, 62 nt, Human
ccauuuugcauagagaugaggcaagauuagcucagaucaugcaauaugucagugcaaagugg

SEQ ID NO: 4180932 - RNA, 55 nt, Human
ccauuuugucaauauauaagugagaaucaugcucaguuauuggugauaaagcugg

SEQ ID NO: 4180933 - RNA, 55 nt, Human
ccauuuugucugacuucuugcuacuucugcucuuuaggaaaggucgauaaggugg

SEQ ID NO: 4180934 - RNA, 66 nt, Human
ccauuuuuaaaagauggaauaagcuggaagaucuucuguagcauuauuuccucuuuuuguuagugg

SEQ ID NO: 4180935 - RNA, 75 nt, Human
cccaaaagaugauuccagaacaauguggacguauagcgacagagauauacacauguuauuguggaagcugcuggg

SEQ ID NO: 4180936 - RNA, 65 nt, Human
cccaaaauucauauguugaaaugcuagcuccaaaugggaugguauuaggagguggagccuuuggg

SEQ ID NO: 4180937 - RNA, 71 nt, Human
cccaaacucucccacucacucugaggaacaaggguucacacugggagaugaagugggcaguggagucaggg

SEQ ID NO: 4180938 - RNA, 71 nt, Human
cccaaagaagcuggccuguauggugagguguggccgcagaugguggugccacacauugucagguuaguggg

SEQ ID NO: 4180939 - RNA, 71 nt, Human
cccaaagggcuuccuguucucaaauccacugcuccuuccauuacguggugucuagaaggaggcucuuuugg

SEQ ID NO: 4180940 - RNA, 91 nt, Human
cccaaagguuugagaagcaauucaaagccuucugucugucaccuugugcacaagaagagacagacugguuugaauugguaagaucuuuggg

SEQ ID NO: 4180941 - RNA, 65 nt, Human
cccaaaguccuuuccaguccugugauucucacacuaaugaauugaaacagaaaaggauuauuggg

SEQ ID NO: 4180942 - RNA, 58 nt, Human
cccaaaugcuuuguuacagcuggaugcuuagaggucccugcugugggaagaguuuggg

SEQ ID NO: 4180943 - RNA, 83 nt, Human
cccaaauuaauuguuuaaaccauagagucuuaauuauuguugagagugacuuucaaguuaaugauucugguuuggaauuuggg

SEQ ID NO: 4180944 - RNA, 55 nt, Human
cccccacuguguucagucacuggcuguaagcaacccugagugaaggccguggugg

SEQ ID NO: 4180945 - RNA, 60 nt, Human
cccccagaauguccagcuucguggagccaccugacaccaugaagaaacuguucugggugg

SEQ ID NO: 4180946 - RNA, 60 nt, Human
cccccagaugcgagccauagccuaccauguccuggcggccuacuacucgcacuuggaggg

SEQ ID NO: 4180947 - RNA, 80 nt, Human
cccccagcaugcaauccacuauucuaaagccccucaucuucccuuuagggaguuuuacgcuguggguuguuuucuagggg

SEQ ID NO: 4180948 - RNA, 129 nt, Human
cccccagccgauugcggucaggagcacuuuaucuuacagacugaauguugguuuuaggaugagagggcuuaucagaagcucggaauguuuauguguguggagaaguuuauggcaggguuggaaggaggg

SEQ ID NO: 4180949 - RNA, 55 nt, Human
cccccagggcugccuccugccgacaggcugguccccagugaggaggugcuggggg

SEQ ID NO: 4180950 - RNA, 55 nt, Human
cccccauucuggccagcccagcugacaucccagcuaacagcagccacauggaggg

SEQ ID NO: 4180951 - RNA, 57 nt, Human
ccccccauguaauuauugugaacaccuugcuuuguggucacuguaacauuugggggg

SEQ ID NO: 4180952 - RNA, 56 nt, Human
cccccuagucucaccuguccaccugccugggcugcacaggugagacucaggaaggg

SEQ ID NO: 4180953 - RNA, 77 nt, Human
cccccucaaacgcauucuuacaugcuuccaccucuaaacaggagaggggaagcuguugugagugcagcaggaggggg

SEQ ID NO: 4180954 - RNA, 122 nt, Human
cccccucccagacacccagacuggcugccucaggaagaacaaggcuaucuggccuccuugccucagacuugggugcagggagcccagaaggucccagguggcacugggauggccgcaggggg

SEQ ID NO: 4180955 - RNA, 98 nt, Human
cccccuccccccucaugcauccccuaggggcuggaggcuccacuucccuggagggccagaucccaggaggaacugugggguggaaaaaacggaggggg

SEQ ID NO: 4180956 - RNA, 67 nt, Human
cccccuccuacacuucuaagguuggggugcgagucacuugaggauccuggcccagguguggaggggg

SEQ ID NO: 4180957 - RNA, 64 nt, Human
cccccuucucuucuccucccggcuccuuccuccucccuccuaaggcccaagguccagaaggggg

SEQ ID NO: 4180958 - RNA, 85 nt, Human
ccccgagucuccagcccccuccgccaagucuucgucucuggguggauucuucagccccagggaaacuuuggaguggagaccgggg

SEQ ID NO: 4180959 - RNA, 58 nt, Human
ccccgcaggugccggcagaugggguagcgaaugguccugugccuccaccugcuccggg

SEQ ID NO: 4180960 - RNA, 89 nt, Human
ccccgccagccggaccugagggauuccuuugauggcgggcucucuuugugugagcggaacaaggagcccucuguuugggcugagcgggg

SEQ ID NO: 4180961 - RNA, 96 nt, Human
ccccgcccucuggcucgguggaaggccuccgccaauggcagagcucccaucgcagagccugcggguuagguugugaggcccgggccgggggcgggg

SEQ ID NO: 4180962 - RNA, 116 nt, Human
ccccgcucuaagggucagugcaggaggcggcgauggcccugggcaagguucuggccauggcacugguuuuggccuuggccgugcuggggucgcuguccccuggggcccgggcgggg

SEQ ID NO: 4180963 - RNA, 58 nt, Human
ccagaugugagcagagccuugacacacagccgcuuccaggagcucgugcucagccugg

SEQ ID NO: 4180964 - RNA, 73 nt, Human
ccagauucccuugacacaaagccugacuuucuccagggaaauaagggaaagccagguugugugcaggaauugg

SEQ ID NO: 4180965 - RNA, 86 nt, Human
ccagauugaauuucacgagcaggacagacaggcaccaccaaacuggguccaguguccuggcuauggcuucuaauucccuaaucugg

SEQ ID NO: 4180966 - RNA, 60 nt, Human
ccagauuggguacugugugagaucacugcccaacagagggaacauggcucuccagucugg

SEQ ID NO: 4180967 - RNA, 60 nt, Human
ccagauuuaggucacuagaauuuuccuuaaggauggaaaaacucagagaaccagaucugg

SEQ ID NO: 4180968 - RNA, 102 nt, Human
ccagauuuuaggauuuccauaauucagcucauucuauuuguccaaucgacauauacccagaguggguagaguuagaauagaaaaucauuuuuuaaaaucugg

SEQ ID NO: 4180969 - RNA, 64 nt, Human
ccagauuuucaucccucuucucaugcccacgaagaugacuggggcuggagggguuugaaugugg

SEQ ID NO: 4180970 - RNA, 83 nt, Human
ccagcaacacagauaguccaucuguuuacuauaaagauuugccaaaaagguuuggaguucauggguguguauguguguguugg

SEQ ID NO: 4180971 - RNA, 58 nt, Human
ccagcaacugguguaauuucugacgugugucauaaaucauacuccauuugcacuuugg

SEQ ID NO: 4180972 - RNA, 66 nt, Human
ccagcaagccaggugugcccaggauccugaccacuuccuucuggugccuggacacuuggcaaaugg

SEQ ID NO: 4180973 - RNA, 68 nt, Human
ccagcaaguccuuccggcagauuucacucaucccggggaagugauugaucuucuggaagggaagccgg

SEQ ID NO: 4180974 - RNA, 60 nt, Human
ccagcacacagucugcaccaggccaccaacaggugggaucaaugcacagcugugggcugg

SEQ ID NO: 4180975 - RNA, 55 nt, Human
ccagcacagggcgguaaucagaguucauggcuauggccucaaauccucugucugg

SEQ ID NO: 4180976 - RNA, 86 nt, Human
ccagcacagguaggauaaagcagguaggagaagauggaaaagcagacuugcuuagucuucuggccuuuaucuuucuccugugcugg

SEQ ID NO: 4180977 - RNA, 76 nt, Human
ccagcacauucacaacugagcauuguugccugacaauucauuuauucaacaaugaauguuugagugccaugcaugg

SEQ ID NO: 4180978 - RNA, 83 nt, Human
ccagcacuggccuggcuccagcagcgaggucccuggagagugacacuucuucaauaccugcguugcuagucccguaguccugg

SEQ ID NO: 4180979 - RNA, 57 nt, Human
ccagcagacacacaggcgugggcagccuugauuauccagccugaggccaacugcugg

SEQ ID NO: 4180980 - RNA, 85 nt, Human
ccagcagacaccuuguuaaaaugaggauucugauucaguaggucugggcagggccuaggagucugcauuucuaacaagcuguugg

SEQ ID NO: 4180981 - RNA, 84 nt, Human
ccagcagcaaacauuuuucagaggggcauuaccuagggccuugcuccauccugugugccaccacugacaggauucuguggcugg

SEQ ID NO: 4180982 - RNA, 83 nt, Human
ccagcagcaccuccuggcucccugcacagggcucccaggagccuggagagccgugagggugggaggcggguggcaggcugcgg

SEQ ID NO: 4180983 - RNA, 62 nt, Human
ccagcagcauaucagagaaagucauccucuagggauggcugugaagagaguguagguguugg

SEQ ID NO: 4180984 - RNA, 56 nt, Human
ccagcagcauccugcagcacuuuaaagaagugugcauugaucgaggagcuagcugg

SEQ ID NO: 4180985 - RNA, 70 nt, Human
ccagcagccaccuucucgaaauccucaggguugcagaauuccuugauugugaccgucaggagguugcugg

SEQ ID NO: 4180986 - RNA, 62 nt, Human
ccagcagccccucaaugaucuguuguguuccgucuggcuuccguuguccgcgggcuugcugg

SEQ ID NO: 4180987 - RNA, 74 nt, Human
ccagcagcccucuuccaagacuaucuuugggcuacaaauugcuuuacccagcagcugggaggcaggguugcugg

SEQ ID NO: 4180988 - RNA, 80 nt, Human
ccagcagcuaagugcugacacaucauucccagcauccaccccggaugggaaagccagcagugucaccgcacgcaugcugg

SEQ ID NO: 4180989 - RNA, 64 nt, Human
ccagcagcucuaguuucugggcacgucugauuuacagauuuccuagacauggggcagauacugg

SEQ ID NO: 4180990 - RNA, 81 nt, Human
ccagcagcuggccugguucagaggguucacucaguaguuaagaaaacaggagggggucuaugagguagagccaguuuaugg

SEQ ID NO: 4180991 - RNA, 77 nt, Human
ccagcagcuucuuuccuucccaggugucgccgccugcuuucugcagccgcugccugggagggguuccgagguucugg

SEQ ID NO: 4180992 - RNA, 55 nt, Human
ccagcagcuuuauuggcucuccaguguuuuggacccuugcucauacaggcugugg

SEQ ID NO: 4180993 - RNA, 93 nt, Human
ccagcaguugaggugacagcacacugggcuuguuacguugcaggaauaguaagggacuguguggccagagcccaguguguccggggaggaugg

SEQ ID NO: 4180994 - RNA, 83 nt, Human
ccagcaguuugucucagucugucuugucuguguucuuuggguaaucucugaaugugacaagcacagacugugggugcuuuugg

SEQ ID NO: 4180995 - RNA, 59 nt, Human
ccagcaugaccaucuggcagcaggacucuugaggagcccugugcuuggauggcagaugg

SEQ ID NO: 4180996 - RNA, 80 nt, Human
ccagccacagccagggaggagggagcccaggcagauggcccugccugccugugagucaaccccuccuuggcacuggcugg

SEQ ID NO: 4180997 - RNA, 59 nt, Human
ccagccagaagugagggaauggccgucagcccugugcugagucccuucacuccugcugg

SEQ ID NO: 4180998 - RNA, 71 nt, Human
ccagccagauccccuguaggucuaacccaagguuuuucuguaggacaccuuggccuaccugggaaugcugg

SEQ ID NO: 4180999 - RNA, 55 nt, Human
ccagccagcugcccuuggggccuuugcagcuggcccacaggugugagcuugcugg

SEQ ID NO: 4181000 - RNA, 99 nt, Human
ccagcccauaucacagucccuuguauagagucuauugcuggggaaacaaacacauaguuuguuuacuagccaacauggagagucaaggggcugugcugg

SEQ ID NO: 4181001 - RNA, 57 nt, Human
ccagcccucacugaggccucucccaaaucugaacguggaggccccaaggugggcugg

SEQ ID NO: 4181002 - RNA, 130 nt, Human
ccagccgcugagcaucacccccggagccucggucagggccccauugucuccagugaaucacaggacacgcugcuggggagcaagaguagugaggguuucuggguuccucggguggagccgcaacuccugg

SEQ ID NO: 4181003 - RNA, 82 nt, Human
ccagccuccugagaaaggagauaaagggcccuucagcagcggcugggggcuuugcaguccuuaaucuccgcucgggggcugg

SEQ ID NO: 4181004 - RNA, 56 nt, Human
ccagccugccauguuggcccuggguuugccuuuggucacagguguggaggugcugg

SEQ ID NO: 4181005 - RNA, 77 nt, Human
ccagccugccuggaucagccauccugagcuggaaccucccacagcugcaucccacaggagggcccgggcaagcaugg

SEQ ID NO: 4181006 - RNA, 62 nt, Human
ccagccugccuugcaccggcucucuggguugugcucacauguuaggucgggcaaggugcugg

SEQ ID NO: 4181007 - RNA, 74 nt, Human
ccagccuggcugcugcagacagacaggaagcacgucugacgcuccuccacccucggucagcacagcggggcugg

SEQ ID NO: 4181008 - RNA, 81 nt, Human
ccagcgucagcaugcguguggugucugcagucugccucugacaagcagggcagaggagugauuaugccguguggaaaaugg

SEQ ID NO: 4181009 - RNA, 89 nt, Human
ccagcgugacauuacuggaagcgccgaggagcuucgcgcaggcucagaaucgcucagcugguugacguuauccaggagaaucgcguugg

SEQ ID NO: 4181010 - RNA, 94 nt, Human
ccagcuaagugaacgguuagcuuaugcuaaaaacacgugugagugugaucauuugugugcaacgcauggagucgaaccgcuaccauuugguagg

SEQ ID NO: 4181011 - RNA, 55 nt, Human
ccagcuacacuuuccccaucugugaaaugaggugucuggauucgacugugguugg

SEQ ID NO: 4181012 - RNA, 117 nt, Human
ccagcuagagcucgucauggucgucuucggugggugcuucaggcgguggcuccgggcaggcggcuggcgucaucagcuccaugagguacucgcagcgacugggcucuguggugcugg

SEQ ID NO: 4181013 - RNA, 61 nt, Human
ccagcuaggcuugcacucuuguacuucugccauuuccacaagaaggacaugcuugggcugg

SEQ ID NO: 4181014 - RNA, 59 nt, Human
ccagcuagugagggguggaggcgggauuugaauccagcucaucugucuccauuaccugg

SEQ ID NO: 4181015 - RNA, 65 nt, Human
ccagcuauggcuauucaaggucucuaucugguucaaggggccaugacucuccauaccaaagcugg

SEQ ID NO: 4181016 - RNA, 94 nt, Human
ccagcucaauuggaagaaaaagcagaugaaggccugaaugucuacugaguuuucagugacuuccucaaacuucucacuuaccuuucagugcugg

SEQ ID NO: 4181017 - RNA, 61 nt, Human
ccagcuccagcauagccaccauauggagauggcauuuaauggcccggugcaggagggcugg

SEQ ID NO: 4181018 - RNA, 65 nt, Human
ccagcuccagccgcugauggguuucggcgggucccccaggagacccuucagacggcuagagccgg

SEQ ID NO: 4181019 - RNA, 62 nt, Human
ccacagggauaggaauggggcuugggcugggaggugccaggguccauauuccuguuccuggg

SEQ ID NO: 4181020 - RNA, 58 nt, Human
ccacaguaaauggauucagaccugcauaaaggcaagucauaagauauuauuucugugg

SEQ ID NO: 4181021 - RNA, 60 nt, Human
ccacagucauuacauucauaggguuucuccccugugugaacucucugauguacacugagg

SEQ ID NO: 4181022 - RNA, 59 nt, Human
ccacaguccuggcuucugucugcuggcugccucccccagcagauaagaguugacugugg

SEQ ID NO: 4181023 - RNA, 67 nt, Human
ccacaguggaaagaacauggauuuuggagacugguugaccugggaucagauccugucuccaccuugg

SEQ ID NO: 4181024 - RNA, 75 nt, Human
ccacagugucucaguguuaaauauaagguauucuaauaauauagaggaagaacaccuaauuuagacugaacuggg

SEQ ID NO: 4181025 - RNA, 67 nt, Human
ccacaguucuuaaaacuugaauuacuuuucucugugaaauaagacagguaguaagaacauuuugugg

SEQ ID NO: 4181026 - RNA, 66 nt, Human
ccacauagccuggugucucagcauggagcuuggugccaaguccugugcuagagacaccugaucugg

SEQ ID NO: 4181027 - RNA, 66 nt, Human
ccacauccuucagcugagcccagagaucaugaaugggguugagcugggcacauguggagguugugg

SEQ ID NO: 4181028 - RNA, 73 nt, Human
ccacaucuggacucagggccucccucagccucacgcaucugccaaggccagagggcccuggucucagcugagg

SEQ ID NO: 4181029 - RNA, 64 nt, Human
ccacaugaaucuuggaagcaggcccagaaucaccugggcagggacuucggggaugugcauuugg

SEQ ID NO: 4181030 - RNA, 67 nt, Human
ccacauguccacccugcaacuguaccuggcuugugucccacaaggaggaagaugcaggggacuccgg

SEQ ID NO: 4181031 - RNA, 56 nt, Human
ccacauuguaggcccuauaaggggucagcccccuucacagucacccugcugugugg

SEQ ID NO: 4181032 - RNA, 89 nt, Human
ccaccacagacucagcacaugaccuccuuuggaaagugggucuuugagauguaauuaugaccagaugaggucaugcuggguuaaggugg

SEQ ID NO: 4181033 - RNA, 65 nt, Human
ccaccagaaguggcuuucucagggacacugccauuuguuuuccuguuccuguucgcuccugcugg

SEQ ID NO: 4181034 - RNA, 60 nt, Human
ccaccagccagagugacagcuccgaaggaggccguuugugcuuuuaacguggcugguugg

SEQ ID NO: 4181035 - RNA, 81 nt, Human
ccaccagcucccuccugcucagguccuguuuucuuuugaagggaaagaaaccuagucuggagcagcagugggaggaagugg

SEQ ID NO: 4181036 - RNA, 65 nt, Human
ccaccagcugccugccucaggccgagugcugaaggucaaccagcauugcagagggggcacggugg

SEQ ID NO: 4181037 - RNA, 60 nt, Human
ccaccagcuugcagucuuaacccaagaugaccugggguggggugucuguguguucggugg

SEQ ID NO: 4181038 - RNA, 60 nt, Human
ccaccauuucugugacacuuccaucugggaauccagauggaagaauuucaggaagucugg

SEQ ID NO: 4181039 - RNA, 75 nt, Human
ccacccaaagggcuuguugaaacacagauugucgggcuccacccccagaguaucugauucaguaggucagggugg

SEQ ID NO: 4181040 - RNA, 82 nt, Human
ccacccaagaugcuaggagaagucaccagugauuggggugauucuagcagaggcuacugcuccuuggcacugaagugggugg

SEQ ID NO: 4181041 - RNA, 78 nt, Human
ccacccaauuagcaguaacagaauauccuuugcauauaaaaagugcaaaaaaugcuuguugcuuaguuggcugggugg

SEQ ID NO: 4181042 - RNA, 76 nt, Human
ccacccagaaagccacagucccaggcagagucaggagggccagauuuuaaagaaguugccugggcuguccuggggg

SEQ ID NO: 4181043 - RNA, 76 nt, Human
ccacccagagauuaaaagcagcaguccuuuguguaauuuaaaauacugaauaauauuggagcuguaagucuugugg

SEQ ID NO: 4181044 - RNA, 56 nt, Human
ccacccagccuuccacccuggacuacacccuguguuguaccagaaaggccuggggg

SEQ ID NO: 4181045 - RNA, 74 nt, Human
ccacccccagcaacaguugauuagacuagagauggguaucucacccaaacugggccagucagcuguaguggugg

SEQ ID NO: 4181046 - RNA, 99 nt, Human
ccaccccccggcacacauccugggccuugaucacacaggugcauuggagaccaaaucccagcccugaugacacgggcaucaggugcaguggcccccugg

SEQ ID NO: 4181047 - RNA, 79 nt, Human
ccaccccugucaugaagccugcuggaucaagcuuaugcuguuuucagugaaagugaauccagaggcuuugcagaaaagg

SEQ ID NO: 4181048 - RNA, 56 nt, Human
ccacccgcugcgcuaccacguccuugugaccccggggcugugccuccagcuggugg

SEQ ID NO: 4181049 - RNA, 84 nt, Human
ccacccgugccuguugcaugugagaaacagugaugucgucugucuugugugacauguauguuguuggcauguggguuugggagg

SEQ ID NO: 4181050 - RNA, 71 nt, Human
ccacccuauguuucaguucuaaaguuagaagguccucucauccuuuuaagaagaacagagacagaaaaugg

SEQ ID NO: 4181051 - RNA, 59 nt, Human
ccacccucucuccaagggaaauccuaguucccuaauuuccaaauugguggagguggugg

SEQ ID NO: 4181052 - RNA, 56 nt, Human
ccacccuggacaggccucugagggccaugucuccucccggggcuauuccagggugg

SEQ ID NO: 4181053 - RNA, 94 nt, Human
ccacccuuugcgccucugcgucagccacagcugccccgggagcgaguucuccugaggcccuggcugugcugacucuagggcagcgugagggugg

SEQ ID NO: 4181054 - RNA, 84 nt, Human
ccaccgaagggcagagcugggccucagaacacaguccaggagcccaagcccagcguucuuuuaagugcccagugcugccugugg

SEQ ID NO: 4181055 - RNA, 62 nt, Human
ccaccuacccuuagaucacaaggguccucucugaggccacccuuuggaggaagggcuagugg

SEQ ID NO: 4181056 - RNA, 67 nt, Human
ccaccuaguguuuuuaagaggagaauaacauuacuaaguugaaaugaucacucugaugcuagggugg

SEQ ID NO: 4181057 - RNA, 62 nt, Human
ccaccucccuccaaauaagacucgggcucagggaaagccuggccuuaagggcagggagcugg

SEQ ID NO: 4181058 - RNA, 76 nt, Human
ccaccuccugggauccaagcaugggguucaguaggaaucugcauuccuaacacaagcugaugcugccaggaggagg

SEQ ID NO: 4181059 - RNA, 58 nt, Human
ccaccucggcuuccacuugguuuuguuucugaaccaacauaggaaugcagagaagugg

SEQ ID NO: 4181060 - RNA, 65 nt, Human
ccaccucucaggguuuccuaaugcaaauccucgaacccugcagaagugagcauccagagaggugg

SEQ ID NO: 4181061 - RNA, 61 nt, Human
ccaccucuuaggggaacuugcugagaaugaaaccagcucagagguaagggcugagaggagg

SEQ ID NO: 4181062 - RNA, 89 nt, Human
ccaccugauuuuguaaguaaaauuguauuggaaaacacuccugcuuggguguugucuauagcaguguuugcacuauaaugguagagugg

SEQ ID NO: 4181063 - RNA, 62 nt, Human
ccaccuggcagcaggcucggcacagcuuucaucuucugcaccugagucagcugcaugggugg

SEQ ID NO: 4181064 - RNA, 85 nt, Human
ccaccuguaaacaaacacaggcaaggccagugagaaaucagaaaccaaguugcuuauuauuucaugguguugcuguguguugugg

SEQ ID NO: 4181065 - RNA, 116 nt, Human
ccaccugucaggagcgagaggcugucacacuucaggaaauacaagugacaucauucaaguaguggggacauuuguuuccugaaggcugcauucauuucuuagcccgagacaggugg

SEQ ID NO: 4181066 - RNA, 62 nt, Human
ccaccugucuguaaucaacugaguuucuagguaguuucuagcucaauugucugcaguggcgg

SEQ ID NO: 4181067 - RNA, 68 nt, Human
ccaccuuagggagggaugcuccccucagcucuguccucugagggagagacauuuccuucuugacuugg

SEQ ID NO: 4181068 - RNA, 69 nt, Human
ccaccuucuuggccacacccaccuagaggagagcuucuuuccugagccgagggugggcaugggagcugg

SEQ ID NO: 4181069 - RNA, 85 nt, Human
ccaccuuucccuuccugaaucuguagggacucagcucaaaaauggagauaaccacagcugcccugguaagauugaugggcggugg

SEQ ID NO: 4181070 - RNA, 58 nt, Human
ccacgaauuaauauccauuaguggucauccauauggugacaauggauauuaguugugg

SEQ ID NO: 4181071 - RNA, 129 nt, Human
ccacgacagcccuguuuuuccugugcugcguagcugagcucugggucacggcugccgagugcaggcaacacucgggcagucccagggcugaccgacugcgcaucuggacacuggcaaucacagggaagg

SEQ ID NO: 4181072 - RNA, 77 nt, Human
ccacgacucagcauucuuuccuucgcuuguuucuauuucugucaaggugaggagaccuuuugagugugagacgcugg

SEQ ID NO: 4181073 - RNA, 128 nt, Human
ccacgagagguaagacccaugacucccaaauuccacucuacacacugcuggcaacucagucuuuauugaugguuucauuuuuggggucaccagugcuaagagguggaaggugggggggcaccuuuaug

SEQ ID NO: 4181074 - RNA, 83 nt, Human
ccacgcagaccaccaagcuggggacucagaccccaucgggguucacccacugugcucuggccucaguuucucuuucugugugg

SEQ ID NO: 4181075 - RNA, 84 nt, Human
ccacgcagcgcugccugcuggcugccuuccugccgggaauucaacuugcaggugcaaaucagcccaguaccaagcaguuggugg

SEQ ID NO: 4181076 - RNA, 62 nt, Human
ccacggaggaauucuggaauguggugaugaccaacaggaauuuuaugagugucccucugugg

SEQ ID NO: 4181077 - RNA, 80 nt, Human
ccacgguauauauauaaacacauuuuauauauccauucaucaaccgauggaugcuuagguuguuuuauuauauaugaugg

SEQ ID NO: 4181078 - RNA, 127 nt, Human
ccacguccuccagccugcaggguccugcagggccaugggucucacacaggccgagcuggacaggagaggaacagcuggccuuagugagcaccugcuaugugccaggcgagggcaugagaggaggugg

SEQ ID NO: 4181079 - RNA, 56 nt, Human
ccacgugcauuugauacacauaaaagucauacugugugugcacaaagaguacaugg

SEQ ID NO: 4181080 - RNA, 56 nt, Human
ccacguguggcagcuuggucucugaucccuccagaggugcagcugacaccaugugg

SEQ ID NO: 4181081 - RNA, 94 nt, Human
ccacuaacaacgaaagugagcccaccuuccuggggcuucgggucccagugucacuguguucccagguggguuggccucugucgugaaguuuugg

SEQ ID NO: 4181082 - RNA, 57 nt, Human
ccacuacauugagugcuuucucuggcuccuugcaaagaaagauacuuuuuguaaugg

SEQ ID NO: 4181083 - RNA, 61 nt, Human
ccacucagacacagcaauucuguguuggcaucucaggaaugauacagauugugugugaugg

SEQ ID NO: 4181084 - RNA, 69 nt, Human
ccacuccaaggagugcaugacucagaguaagcuccuuacccugcuagcuagcaucucuauuggaagugg

SEQ ID NO: 4181085 - RNA, 78 nt, Human
ccacuccaguaaaccaaguguuuacuagaagugguggaucaaacuuuacuuguggaacauauuuugguuugcugcugg

SEQ ID NO: 4181086 - RNA, 70 nt, Human
ccacucuccaaguuaucaagaugaagacccaagaugguggcauucacucugaagguagccuggaaagugg

SEQ ID NO: 4181087 - RNA, 67 nt, Human
ccacucucucccucuguaggggccucucucugagaucggguccuccuccugcagggcagcagagugg

SEQ ID NO: 4181088 - RNA, 85 nt, Human
ccacucugaguagacccgcuggcugccuuacuuuguggagucugaggccaguuuuauagagaaaggggccagccacucugagugg

SEQ ID NO: 4181089 - RNA, 65 nt, Human
ccccugcuccagccaagguaucaugagaggcacuagugugucccucacuuccccuuggccagggg

SEQ ID NO: 4181090 - RNA, 113 nt, Human
ccccuggagagcuugugaaaauacaaauugccgggcccugaccucagaguuucugauucaguagcucugggguggggccugggaauuuccauuucuaacaaguuuccaggugg

SEQ ID NO: 4181091 - RNA, 55 nt, Human
ccccuggagguacacaagacaguacuugucugugccaucagucuccagaguuggg

SEQ ID NO: 4181092 - RNA, 62 nt, Human
ccccuggcuucaucacucgggcugccaucuuuaugacaguggcaggugggaaggccacgggg

SEQ ID NO: 4181093 - RNA, 60 nt, Human
ccccugggcagcagccagcagcauccccaaccacagauuggggggcugcaguccaggagg

SEQ ID NO: 4181094 - RNA, 73 nt, Human
ccccuggguguugcagggucugauggaguaaggggggccucuccgaggcuucugggcaccugaacaggagggg

SEQ ID NO: 4181095 - RNA, 68 nt, Human
ggagaacaagaaggcucagcugguggugaucgcacaugacauggaucccauugagccaguugucuucc

SEQ ID NO: 4181096 - RNA, 108 nt, Human
ggagaacacuugauuuaucugguacagaguggaguucaguaaauauuuguuaaaugaaugacugauuuauuuugcauuuaggaaaagagaagaaucaggcauaccucu

SEQ ID NO: 4181097 - RNA, 64 nt, Human
ggagaacaggaugucauuucucauguccugaaauggacaaaggagaaaaaacauaccuagcuuc

SEQ ID NO: 4181098 - RNA, 100 nt, Human
ggagaacauagagcaaagaacaugaaaacuaccugugauuuuacaacccaguguaaucgcuugguaauuuuaaaaguguuuuuuuaaccuauuuaucucc

SEQ ID NO: 4181099 - RNA, 81 nt, Human
ggagaaccuucagcuugcaacaaguccuggccguuggagaaaccaugagacuagaccuuguguaaagcagcugauucugcc

SEQ ID NO: 4181100 - RNA, 56 nt, Human
ggagaagacaauucuggguggaggaaacuggauguucuaagccuggaaucuuguuc

SEQ ID NO: 4181101 - RNA, 85 nt, Human
ggagaagagaaaacagcuggucucaaauguuccuucuucuaaaaauagggauuagagcagauguaggcacaguugcuacuucucc

SEQ ID NO: 4181102 - RNA, 94 nt, Human
ggagaagagaaggcagacaggcuggagaccucagagaacccaaagaagggcauggcagugaguucccugggucuccuuucuucuucuuuucucu

SEQ ID NO: 4181103 - RNA, 55 nt, Human
ggagaagaggggugucccuguggcccagcacacuggagccacccuccucgucucc

SEQ ID NO: 4181104 - RNA, 89 nt, Human
ggagaagcucaugguugaguuauuuugagguauuuuugagcugcuuauuagcagguucucauuaguagcuucuuauuaugagcuuuccc

SEQ ID NO: 4181105 - RNA, 56 nt, Human
ggagaaguucagucgugaucacaggaaacacaguccuugcucauggggacuucucc

SEQ ID NO: 4181106 - RNA, 72 nt, Human
ggagaauauaaaacagguugaggucaaaugcaaguccaauuugcucagagcucuaucuguugggaguucucu

SEQ ID NO: 4181107 - RNA, 88 nt, Human
ggagaaucacuugaaccaaggaggcugagguugcagugagcugagaucaugccacugcacuccagccugggugacagagugagacucc

SEQ ID NO: 4181108 - RNA, 60 nt, Human
gcgucuuggcggcaguugguggaaccggagcuucgaguccguccccggugcugccugcgc

SEQ ID NO: 4181109 - RNA, 58 nt, Human
gcgucuuuggaucccaacuggcugggaaaaggggcccaucgggaggaaccaaagaggc

SEQ ID NO: 4181110 - RNA, 76 nt, Human
gcgugacacauccuuguggcaugugagaacuagaaggugcuuaggaaucuucuaguuuugccacaggauaccaugc

SEQ ID NO: 4181111 - RNA, 96 nt, Human
gcgugcucucagagcagguggcggcggcgcuuuucuccucguccgugguguucugcuccugcacggaggugcuggcggccagcucugagagcuugc

SEQ ID NO: 4181112 - RNA, 55 nt, Human
gcguggaccuggaaggcccaaagacugaagccuccgggggcuuacaggugccagc

SEQ ID NO: 4181113 - RNA, 78 nt, Human
gcguggccaagcggcccugaccagaccuuaguugcugucaccaaacaaacaaaggugggcuagggcugguugccuggc

SEQ ID NO: 4181114 - RNA, 91 nt, Human
gcguggccuucaauggcccuaaugaguugguguuccauugaugugcagccucacggaacacccacccauugugggccuaugagacgucugc

SEQ ID NO: 4181115 - RNA, 91 nt, Human
gcguggucgucguccaggauggugacgguggccagcagcggcgccaccagccgccccuugggccgcccgccgccguccggcucgaacaugc

SEQ ID NO: 4181116 - RNA, 57 nt, Human
gcguggugcugcccugcacacaggagaugcucccaggugcugaugggcaacacuggc

SEQ ID NO: 4181117 - RNA, 59 nt, Human
gcguguaucuggcaugucgagugugcacauggcauauacggaucaaaucgggugugugu

SEQ ID NO: 4181118 - RNA, 95 nt, Human
gcgugucccccggacagaggggcagagugugccaggaaaugggaagaaacaggaacugacacagcacuuugccccuccuuuggcaggggagacgu

SEQ ID NO: 4181119 - RNA, 67 nt, Human
gcguguugcguacuguuuauacauguguguagauacacugacagaugagagacaaugugcuacaggc

SEQ ID NO: 4181120 - RNA, 88 nt, Human
gcguuaucuuaucaaaguaaccauucuguugccauuuugcagaugaggaaaccuauuuggaaaagcgguaacuugcucaaaguaaugc

SEQ ID NO: 4181121 - RNA, 99 nt, Human
gcguuauggucagucagggaagacccaggagccacucaggcccacacagaccucucugugugccacuggccucuugcaccccuccuuugacugugacgu

SEQ ID NO: 4181122 - RNA, 64 nt, Human
gcguucuggcucccguuguccuugaaguugcaucucaggcuucugggcauggcagagccugcgu

SEQ ID NO: 4181123 - RNA, 83 nt, Human
gcguugcucugccaugacccagucaaagggaaugggugcagcucuggcucuguuccccuuucuggguucuggagagucccugu

SEQ ID NO: 4181124 - RNA, 58 nt, Human
gcguuggggaccccgaagcugguggaucgcugcacggcugcgcgggguccgccagggc

SEQ ID NO: 4181125 - RNA, 68 nt, Human
gcguuguugggcaauggccccagccagcaccauccccaccucccugggccuugccuugcccacagggu

SEQ ID NO: 4181126 - RNA, 87 nt, Human
gcguuuauuuuuuaauuugcuacuuagacuaacuguagggacuagaagauucugucucuuucccuguguuagccuguagcuaaaugc

SEQ ID NO: 4181127 - RNA, 77 nt, Human
gcguuucugauaucuaagaaauucuaccacugcuucugcuuuuuggguuuugguaguucuuggauguuuacauuugc

SEQ ID NO: 4181128 - RNA, 82 nt, Human
gcguuugcuugucccagauuuuucaugagaugagauuuuucaugagaugaagucucuuuuucaugagaugaagucuaaaugc

SEQ ID NO: 4181129 - RNA, 73 nt, Human
gcuaaaagguagaagugauggaacuuggagaguaaggaaaaguaaguuucuaaucugggcuucugcaguuagc

SEQ ID NO: 4181130 - RNA, 81 nt, Human
gcuaaaauggacauucucaaacaagugguuugauaagaagugcucuugggaccagugucugugagaaaagcacguuugggu

SEQ ID NO: 4181131 - RNA, 63 nt, Human
gcuaaacaucugucauguguuuaucgcagugccaagcucagagcaaacauucagcagauuggc

SEQ ID NO: 4181132 - RNA, 88 nt, Human
gcuaaaccgaggagugcagggcuggcaccggaggcaugauuugaaacgccguuggcccuuugucccugcuuccuucucugggauuggc

SEQ ID NO: 4181133 - RNA, 78 nt, Human
gcuaaagauaauccaugaagugaacaaucuggaugaaaguaauccaucauguuacucuuccauggguggguauauggc

SEQ ID NO: 4181134 - RNA, 65 nt, Human
gcuaaaggcucaggagacuuugcaaauguaaaugaaugagcagaaaagaaugcugagccuuuagu

SEQ ID NO: 4181135 - RNA, 97 nt, Human
gcuaaauaccagauggagaagggugcugcagauaugaugcuccacauuuuccuuuuaugcuucgucuccaaggcccuacucuauuuauugcuguggc

SEQ ID NO: 4181136 - RNA, 67 nt, Human
gcuaacagcuuagauggauacaaagguuuuuauaaaacaccauuaguauucauuuaguauagguagc

SEQ ID NO: 4181137 - RNA, 89 nt, Human
gcuaaggaaagcuuuuaaaaguggccuugauuaagccaggaaggaggaucucccuuggaccaaggucugcucuuucucacuuuucuugc

SEQ ID NO: 4181138 - RNA, 103 nt, Human
gcuaagggaaaggcuggaaguauaggggagaugauuuuaugcucaauauuuuuccuuuucugaguuaucuuuuccugauauaaguuuuuaccuuuuccugggc

SEQ ID NO: 4181139 - RNA, 68 nt, Human
gcuaaguucuauggcuugcaggcagcagucagcaaagaacaucagcugaggcaggccuagaacuuggu

SEQ ID NO: 4181140 - RNA, 61 nt, Human
gcuaaguuguaauuuguauaccuccuugaaaucuaauuugguaugauaauuacaaaauagu

SEQ ID NO: 4181141 - RNA, 96 nt, Human
gcuaaugauccauaguaagaucccauuaucaaucagguuugucgguaucgaacuucauaaacaacugaugguaaucuuugcuaugaaaaguguggu

SEQ ID NO: 4181142 - RNA, 61 nt, Human
gcuaaugcuauuuuucucuguuaaauggcuccauaacaacugaggaagaggcagaauaggc

SEQ ID NO: 4181143 - RNA, 80 nt, Human
gcuaaugguuuuuggcucuggcgagcuuuaguacaggaacacucauuguauugugggugucagagugcaagaauaacagc

SEQ ID NO: 4181144 - RNA, 85 nt, Human
gcuaauguguuggaaaaauuugcuuuuacuauguuaaaacacugagauuuuaggauuagaguagcaaguauuuaccuucauuagu

SEQ ID NO: 4181145 - RNA, 70 nt, Human
gcuaauuuccgauucucauagguguuucugaaaauacagagacugugccacacaugggagugggaagagu

SEQ ID NO: 4181146 - RNA, 62 nt, Human
gcuaauuuuuaaaaauguguuggcauagucuuaaacuauccaaggaguuuuugaaauauagc

SEQ ID NO: 4181147 - RNA, 60 nt, Human
gcuacaaagugguaggaggucacaugaaauuccaaagcguggccuuuucccaccaugugc

SEQ ID NO: 4181148 - RNA, 61 nt, Human
gcuacaagcacauuaaggaacauugaaguugagugugcuuuauauuccuaaugucuugagc

SEQ ID NO: 4181149 - RNA, 65 nt, Human
gcuacagaauauuucugcccugagcucauuaugaacagaguuuuggacugacuugucuuuguggc

SEQ ID NO: 4181150 - RNA, 65 nt, Human
gcuacagagccagcaguggggacagggaggagcacacacccuuccacacuuguaugguucuaggc

SEQ ID NO: 4181151 - RNA, 85 nt, Human
gcuacagccagcucacaccagcuuacaagacuugguuguuaaauacucaggaguuuugcaagcugguuguugaaccauugguagc

SEQ ID NO: 4181152 - RNA, 55 nt, Human
gcuacaggugacagccucugcagugucucauggagaggccuuuaucuccuguagc

SEQ ID NO: 4181153 - RNA, 55 nt, Human
gcuacagugauaggaaacacauuucuaacuaagucuucguguucccucacugggc

SEQ ID NO: 4181154 - RNA, 56 nt, Human
gcuacaguuucuuuaaucagcuggagguaguuuccuccaauuuuuaagacuauggc

SEQ ID NO: 4181155 - RNA, 80 nt, Human
gcuaccaaucuuguuuucuacauccaugaguaacaggauucaccaaugaauuggauugugagaaccaagauaauguaugc

SEQ ID NO: 4181156 - RNA, 56 nt, Human
gcuaccaccucaaccucaucugacagcccagagucugcaggagcgggaggggcagc

SEQ ID NO: 4181157 - RNA, 69 nt, Human
gcuaccucucggcaggaacccagacaaccagggugccugcaucacucugugugguuuucuguaggaagc

SEQ ID NO: 4181158 - RNA, 55 nt, Human
gcuaccuggagaaugugacuuugucuuuaggagaaaaucacuuuguacaggaagc

SEQ ID NO: 4181159 - RNA, 68 nt, Human
gcuaccugggaagugggaccugagggcugaaggauugugaugaacucuggccugcuuccucagguagu

SEQ ID NO: 4181160 - RNA, 59 nt, Human
gcuaccuugaaccccaagcuuugcagcaauaagagggcuggccugggaaguaaggaagu

SEQ ID NO: 4181161 - RNA, 61 nt, Human
gcuacggaaaacccugagcaaacuuguuuuaaaguuuguaccauggggucuuucccuuagc

SEQ ID NO: 4181162 - RNA, 70 nt, Human
gcuacucaggaggcugagucgggaggaucacuuaagcccauaaguucaagaccagccugggcaaucuagc

SEQ ID NO: 4181163 - RNA, 79 nt, Human
gcuacugcaaaucaccauucuuaccccaucuccuagauucugggacuggguguauuagugguguuucuuucucaguggc

SEQ ID NO: 4181164 - RNA, 58 nt, Human
gcuacuggcaggcaaauuggugggagccgcccggcccagccugccuugccgagucagc

SEQ ID NO: 4181165 - RNA, 61 nt, Human
gcuacuggcugaaaaaguccuuuuccuucucagcuccacagcuacuuuuucaggacagagu

SEQ ID NO: 4181166 - RNA, 78 nt, Human
gcuacuuugucaucucaccuuucucucagcacuggcaagucagguucugcagcugaaaggacugaaugacucuugagu

SEQ ID NO: 4181167 - RNA, 69 nt, Human
gcuagaaaaugaggauaccgcagggggcagaggcacaugucccugaccucuuggaguuucuagucuagc

SEQ ID NO: 4181168 - RNA, 60 nt, Human
gcuagaaucuucagucuaauuccuaggagaugcagucugggagaagagacagaugcuugc

SEQ ID NO: 4181169 - RNA, 63 nt, Human
gcuagaauuuccaguggugauucaaagcaaguaauucagguaaucauucuggaaaauucaagc

SEQ ID NO: 4181170 - RNA, 80 nt, Human
gcuagacaaccucuggaguaacucuguuucuggucauggauauguaaaugcgaguuacaguuauuccauuagguaucugc

SEQ ID NO: 4181171 - RNA, 67 nt, Human
gcuagaccuguuuuugagucacagggaauuuuagcuagugucccugugaaucagaagcaggucuagc

SEQ ID NO: 4181172 - RNA, 59 nt, Human
gcuagagagcauguggucuaguuuuagucccuccacuaaccuagugauaugccucaggc

SEQ ID NO: 4181173 - RNA, 66 nt, Human
gcuagauggaacccguugaagaaaccacauauuucuuuuguguggcagucggacuucuaucucagc

SEQ ID NO: 4181174 - RNA, 129 nt, Human
gcuagcaaauagucguugaugcucacugagacagaguccuggcccaggaguacacauuaauacauguggacaagacuccugggccccugaaggggacucuauguccugggcacugccaugugugccugc

SEQ ID NO: 4181175 - RNA, 76 nt, Human
gcuagcaauauacuuucuggcagugaaauaaauuacuugauauuuaaggucagcugcauaagucaccuugcauggc

SEQ ID NO: 4181176 - RNA, 56 nt, Human
gcuagcaccauacagugugauuccagagcagugguaaucaagaguacugguguggc

SEQ ID NO: 4181177 - RNA, 78 nt, Human
gcuagcagcauucuucuaguuaggaaauuguugcaguuuauugccacuuuugcauuuaaauggaaguaguuuguuagc

SEQ ID NO: 4181178 - RNA, 72 nt, Human
gcuagcaguauaguuuguacuccaugccauuauucacagauacuauauugaaguuugaacuguguugcuggc

SEQ ID NO: 4181179 - RNA, 89 nt, Human
gcuguaguuuaaacagcauaaggaggucauggaggcacaacuauauucucaggucuacaugcacacugaaugcuuacuuugagcuaggc

SEQ ID NO: 4181180 - RNA, 60 nt, Human
gcuguauaaaucccuagauuggcuaagaaggcaggacuaacagucuguggauuugugggu

SEQ ID NO: 4181181 - RNA, 65 nt, Human
gcuguauaucuuucuucuaguuuggagaagccaguggggucaucuagaaaaugaaagaaugcagu

SEQ ID NO: 4181182 - RNA, 66 nt, Human
gcuguauuggaacacauccaugcucauucauguauguauuguucauggcuguuuucacacuacagc

SEQ ID NO: 4181183 - RNA, 69 nt, Human
gcuguauuucaucuuucuucaauuacuuaguauuuugguaaggguaggggaagacaagugaaaauaagu

SEQ ID NO: 4181184 - RNA, 69 nt, Human
gcugucaaagguuuuucagcagggagaugauguaaucagaucuguguguuggagaaaagcuuuggcagc

SEQ ID NO: 4181185 - RNA, 55 nt, Human
gcugucacauuuggagcacuggugugaaagcaagagggcucuaggauuuggcagc

SEQ ID NO: 4181186 - RNA, 55 nt, Human
gcugucagcgcccaaggagcuccaggcgaggccaagccguccuggcacuggcugc

SEQ ID NO: 4181187 - RNA, 65 nt, Human
gcuguccagagcaugggagcaaccaguagaaaacuggacuuuucuucuuagcucucagggcuggc

SEQ ID NO: 4181188 - RNA, 106 nt, Human
gcuguccagcagaaccugacacaaccuccugaacaccccuguggacaucaugaugcggacacacgugcugcagguguguucagugaggcugcagggggcggacggc

SEQ ID NO: 4181189 - RNA, 66 nt, Human
gcuguccagcagggaguuagaaauccaggauaagaauauugaagacaagcuaauucccaugucagc

SEQ ID NO: 4181190 - RNA, 59 nt, Human
gcugucccuggaacuauggcuccaguaacacauacuuuagcuggaauccagggaucugc

SEQ ID NO: 4181191 - RNA, 55 nt, Human
gcuguccgcacgucuccgguggcauuuucuguaucuucguggggaggugggcagc

SEQ ID NO: 4181192 - RNA, 82 nt, Human
gcuguccuagaagagcugcucagaacaugaugcuuuuguuccuaaugacugaauaaucauuuuuaagagacucuucuauagc

SEQ ID NO: 4181193 - RNA, 56 nt, Human
gcuguccucugaucucuggaggggagaauggccccaccaagcagcagaugggcagc

SEQ ID NO: 4181194 - RNA, 70 nt, Human
gcugucgcccaggcuggagugcaggggugugauaauggcucacugcugccuugaccuccugggcucaagc

SEQ ID NO: 4181195 - RNA, 65 nt, Human
gcugucgcuggaaauauuucuguagaguaaguugcuaaacuuucagagagaaaccagugggaagc

SEQ ID NO: 4181196 - RNA, 69 nt, Human
gcugucugcaagccaggaaaugaggccucaccgaccuuaccggcaucuuaaucuuggacuugcagucgc

SEQ ID NO: 4181197 - RNA, 90 nt, Human
gcugucuggcagucgaccuuaggugcagaugcaggcaggcaggugagugggcauguggcauguggcccaaggaggcugucacuaggcagc

SEQ ID NO: 4181198 - RNA, 60 nt, Human
gcugucugggagacugaucacccgauaggcauuccuguuccagucggauaacuagacggu

SEQ ID NO: 4181199 - RNA, 56 nt, Human
gcugucugggugcccaaaagaaggcugcacguuggccucuuaacacccagggcagu

SEQ ID NO: 4181200 - RNA, 104 nt, Human
gcugugaagaggggaagccuagccuuuggugaggcuggagacugagaguggaggauucagacaggccucuccagccucagcuugcaggcugacuguccaacagc

SEQ ID NO: 4181201 - RNA, 107 nt, Human
gcugugaauaaugaaugccucuuuccuuucagaucacuuucaggaaagaucaccuugaggccugccuccuuucccuggguugugaugugauggcaagagaaugcagc

SEQ ID NO: 4181202 - RNA, 76 nt, Human
gcugugaccaaaucuuuuguguauuuuaccuuuacggcacauuuccagguaaacugcacaugaggcuggugcacgc

SEQ ID NO: 4181203 - RNA, 56 nt, Human
gcugugaccuuagcaagggaaauuuggaaacggagucuuguguuuucaggcagagc

SEQ ID NO: 4181204 - RNA, 61 nt, Human
gcugugacuuaagcauaggccuucuuucuccccauggcccugugugcccuuaauucacagc

SEQ ID NO: 4181205 - RNA, 58 nt, Human
gcugugagaaacagggagugucucuccucugcuaucugagaccugucaacaucacagc

SEQ ID NO: 4181206 - RNA, 64 nt, Human
gcugugagcacugcuggguggauuagcuggcauuccuucuccuccauugagcggagucgcaagc

SEQ ID NO: 4181207 - RNA, 63 nt, Human
gcugugagugaaugggucugaaguguguggcauccguguacuugggauguaguuacccagagc

SEQ ID NO: 4181208 - RNA, 70 nt, Human
gcugugagugagcugccuaggcacgagccucaggccaccccaugccugagccugggcguuuauauacagc

SEQ ID NO: 4181209 - RNA, 67 nt, Human
gcugugauguaguuucuuuuguucagggaucagcuguggggauugcaugaagugcuacgucuacagc

SEQ ID NO: 4181210 - RNA, 85 nt, Human
gcugugcaggcccuccaggcacacagggaauuuggcuggagagugccggaagucgaguucucccugcugugucuccuguaccagc

SEQ ID NO: 4181211 - RNA, 55 nt, Human
gcugugcauugagccugagaguggauuuuuaaaccauucacagcucugugucagu

SEQ ID NO: 4181212 - RNA, 90 nt, Human
gcugugcccacaguuccuggccuggaacagcccaccccucaccuccgaguuuguggcgcuccucccggcccugguggacgcuggcacagc

SEQ ID NO: 4181213 - RNA, 128 nt, Human
gcugugcuaauuuguggguaugaagacaauuccuagacucugagcugcaagggugagccugggauggagucuggguggccugaauuagcucagggugggaaaggaaaugucccuugccccuagcuagu

SEQ ID NO: 4181214 - RNA, 71 nt, Human
gcugugcucccuccagaggcuguaggggagaauccauuccuugccucucccaaccucuggugggugcuggc

SEQ ID NO: 4181215 - RNA, 67 nt, Human
gcuguggcccuuggcaucugcgguuauauucaacaggagcaccaacgguggccaagaagucacuagu

SEQ ID NO: 4181216 - RNA, 66 nt, Human
gcuguggcugcuguccucucugguugggcuacuuuucauaagagaaauaaagcagccagucaccgu

SEQ ID NO: 4181217 - RNA, 60 nt, Human
gcugugggcaguugccgggagacuggccucaggcaucagucuccgccagcuccucacagc

SEQ ID NO: 4181218 - RNA, 65 nt, Human
gcuguggggaagucauaaaaaggauacugucugcacuuuguagauucauucuugguaugaacagc

SEQ ID NO: 4181219 - RNA, 56 nt, Human
gcuguggguacaaauacacaaugaggaggaauucuuuccuguauuuguaccacagc

SEQ ID NO: 4181220 - RNA, 56 nt, Human
gcuguggguccggaccccacgggaccccuaugggacccccacaggacccccacggc

SEQ ID NO: 4181221 - RNA, 57 nt, Human
gcuguggguuccuggcauuugagugaauaauguucagaugauuaaguggcccaaggc

SEQ ID NO: 4181222 - RNA, 67 nt, Human
gcuguguaauacuccauuguauggauggaccacauuuuguuuauccuuucaucugguaauauauagc

SEQ ID NO: 4181223 - RNA, 69 nt, Human
gcuguguccucaucauccuuuuuugaagaguuuggcaaacuguugagggaagcagaugaaauggacagc

SEQ ID NO: 4181224 - RNA, 70 nt, Human
gcugugugaaaugugcuguggcauucacugaaggacccugcugaagagcuugcucauucuaucacacagc

SEQ ID NO: 4181225 - RNA, 91 nt, Human
gcugugugacauugaacaaguuuccugaccugagcagcuucccuuucugguugugagaaugaaguuagguaauguguguaauguccacagc

SEQ ID NO: 4181226 - RNA, 80 nt, Human
gcuguguuccauuguuguaggugaagaugauaauaaugaugauauuagcucuuugcaaaauacaacaaugguaacccugu

SEQ ID NO: 4181227 - RNA, 61 nt, Human
gcuguguugcuggugugcaaaugcaucaugcccuuccacauuuccacaucuuugcacaugc

SEQ ID NO: 4181228 - RNA, 55 nt, Human
gcuguguuuuagauauuuuaacccuugugaccuggcagaauaucuagcacauagu

SEQ ID NO: 4181229 - RNA, 71 nt, Human
gcuguuacagaacacugaagaccagguaauuuguaaggaacagaaaucuauuauuucagaguucugguggc

SEQ ID NO: 4181230 - RNA, 60 nt, Human
gcuguucucccuugaacuuggcuucacuucuauccccaccauuuaguaaggaagaacagc

SEQ ID NO: 4181231 - RNA, 87 nt, Human
gcuguugcuucaagacacuaagcuuucaggauacuuuaugugcgcauagauaucugugacaaauuuugguaucuagaaguaggaugc

SEQ ID NO: 4181232 - RNA, 64 nt, Human
gcuguuggcagggcugcauuccuucuggaugcuccagggaggaucugcuccuugucuuuuaugc

SEQ ID NO: 4181233 - RNA, 62 nt, Human
gcuguugggauucugccuuuccccucccaggaagugagggaggaagggguccucccaacagu

SEQ ID NO: 4181234 - RNA, 65 nt, Human
gcuguugucagagaguuuguguuuuagaaacaagcuauuuuaaaucacaaauuuucucauuuagc

SEQ ID NO: 4181235 - RNA, 75 nt, Human
gcuguuguccuucuguaauggacugucccuggugcgcucucagacgcagcaggacacgaugcggcaggacccagu

SEQ ID NO: 4181236 - RNA, 91 nt, Human
gcuguugucugggugaggcaucccugucgugggagcagccacagcucugccuggucucccagagcagggacgcuuuguccgcauuuacagc

SEQ ID NO: 4181237 - RNA, 59 nt, Human
gcuguuucuaagcugguuccuaaccucaagacuaagggaaugacucagcuggaaucagu

SEQ ID NO: 4181238 - RNA, 63 nt, Human
gcuguuucuaauaaaaaugaaagauuacauucacaauaguaauuuuucaacuuuggaaauggc

SEQ ID NO: 4181239 - RNA, 78 nt, Human
gcuguuugaugcaucuuuggggcauccaggaaaauaaguuucuuauuccuaucucaggguacccagauacuagacagc

SEQ ID NO: 4181240 - RNA, 103 nt, Human
gcuguuuuccaacucugauauggugacuaagcagguaugacauagauauguccuguuuaggagugucaguguccuuaucugaaaacccagguuuggugauagc

SEQ ID NO: 4181241 - RNA, 88 nt, Human
gcuguuuuccugggcuguuuccuaccguuuuucauucaagggaaucagaggagugggaaaccauguggaagcaggaucuggaagaugc

SEQ ID NO: 4181242 - RNA, 63 nt, Human
gcuguuuuggagaaccaugaaauaugggcuuguagcccauuuacauuguacucugugacaugu

SEQ ID NO: 4181243 - RNA, 89 nt, Human
gcuuaaaggguggauuucugagcucuauccagggucauaaaaaagguuuccaggaagagauagagcuaaguaaguagagcuaaguaagu

SEQ ID NO: 4181244 - RNA, 95 nt, Human
gcuuaagagauagguuggugcaaaaguaauugagguuuuugccaucacuuuccauggcaaaaccgcaauuacuuuugcaccaacccaauacuugc

SEQ ID NO: 4181245 - RNA, 83 nt, Human
gcuuaagagcuuggauuccaugaaaggggauuuucucucacccuuaacaaaagauuuccauucauacaauuuuguucuaaagc

SEQ ID NO: 4181246 - RNA, 78 nt, Human
gcuuaaggugguaagauauuuugugugauguuucauggaaucuauggaaauguaaccaaggcuaucagcucuaugagc

SEQ ID NO: 4181247 - RNA, 74 nt, Human
gcuuaaucuuuaaaugcaucuuuuaauggggcuuuugacacucaaauagccaaagugcauuuaugaauuaaugc

SEQ ID NO: 4181248 - RNA, 83 nt, Human
gcuuagaagcuugaugagggggaacagagauuuuaauuguaauugcagaaauuauagaauucgcuucacugugcugucuaggc

SEQ ID NO: 4181249 - RNA, 77 nt, Human
gcuuagacauucagacucacauggaggcagccuuuauugcugugauuuaugaccaaguuagaauugauggugaaagc

SEQ ID NO: 4181250 - RNA, 64 nt, Human
gcuuagacuaaggugaugguaucucagcugcauaguaaucugugaccaggaaucuuuucugagc

SEQ ID NO: 4181251 - RNA, 55 nt, Human
gcuuagcaaacaucuguaguccaauuacugucaacaguuuacagguguugagagc

SEQ ID NO: 4181252 - RNA, 102 nt, Human
gcuuagcacauuuccuccucccguggauguucuucagucagaggguggggaagacuaaggacagaaggcaucuagggcacgaggugagagaaacgacugagc

SEQ ID NO: 4181253 - RNA, 78 nt, Human
gcuuagcagucacacauuguucucuguauugagauaaauaacugcccuuccuuacugaccauuguguaacugcuaagc

SEQ ID NO: 4181254 - RNA, 95 nt, Human
gcuuagcccacguuguuggaauuaauaggggauauacaggaaaagagcuucuuaaacuaauauauaccuuuguuaggaaauauuggguugcaagc

SEQ ID NO: 4181255 - RNA, 56 nt, Human
gcuuagcucuccuucgcaugggugucucaaugccagggugucaggagagcuacagu

SEQ ID NO: 4181256 - RNA, 68 nt, Human
gcuuagggguauguggguagugcauaugugcauagauuccugucagcacugccaugugcucugcaggc

SEQ ID NO: 4181257 - RNA, 84 nt, Human
gcuuagugguuaaauuucugcguuugugagucaaucaaguuuaaauuuaaauccuguccauuuaccagaugcuugaccuuaagc

SEQ ID NO: 4181258 - RNA, 98 nt, Human
gcuuaguuagaaucucggccgcugcccaggggagugcugucgggaaagaucaaccaccaccgcaaagcggcccucugggcacacugccugagcugggc

SEQ ID NO: 4181259 - RNA, 74 nt, Human
gcuuauggucuuaggguaggcagcuggaauauaauuuuaauagaacuuagcuugauggcuuugaaaccacaggc

SEQ ID NO: 4181260 - RNA, 111 nt, Human
gcuuauguacuaucauuaguaauaaaacacauaugucauugaaaaaucucuauuuguccaaugaaccugauguuagugacugugugcuaguaguagucacauauaaaaagc

SEQ ID NO: 4181261 - RNA, 89 nt, Human
gcuuaugugguaagugagggagcugggacuugaaccaggcaguaaagcuccaaauuccauucaugcucccuuaccacucucuacauggc

SEQ ID NO: 4181262 - RNA, 78 nt, Human
gcuuauguuuauuuguugacuugcuuuucacacucaucuacuuagcaagucagaaaacagagcaauuaagcaucaagc

SEQ ID NO: 4181263 - RNA, 88 nt, Human
gcuuauuaggaagccagaaugggugaauaauucacauaacaaguuugugagccugguuaacuuccccaugucugcauuucaaaucagu

SEQ ID NO: 4181264 - RNA, 110 nt, Human
gcuuauuaguaaauccaccagaauguuucauuuggcauuuuuuuguaaacaucuagauuuguucauaaagaaaucagaaaagcauucguccuuuggggaguauuaauugu

SEQ ID NO: 4181265 - RNA, 55 nt, Human
gcuuauuauagagaguggguuuaguagucccuaauauucaugucuuuauaaaagc

SEQ ID NO: 4181266 - RNA, 122 nt, Human
gcuuauucagucucuuuaaacuguaguuucuuuuccuugcaguaugccuuuuaauuuuguguugaaaggugaacaugaugcacuggguaaaagaaacuauguuuuguuuuuuuuuaauaagc

SEQ ID NO: 4181267 - RNA, 63 nt, Human
gcuuauucucaucuagaggcuguggcagcuugcccaugaaacgaugucucugugggaauuggc

SEQ ID NO: 4181268 - RNA, 87 nt, Human
gcuucaaguuaggagaguaaagugguauuuauaagaacaccuguuccuuggguugcaucauguacuauuuucacuguuaacuugagu

SEQ ID NO: 4181269 - RNA, 66 nt, Human
gcuucaccacuuuuucagugugcaugcaugcacgugcaugugugugugugagaaagaguguggggu

SEQ ID NO: 4181270 - RNA, 87 nt, Human
gcuucaccucuugggacaucaguuucuucaucaguuaagcagggacaacacugccugccuaggaagcugugaaaucaggcaugaggu

SEQ ID NO: 4181271 - RNA, 57 nt, Human
gcuucacuacuugaaauacuaauauugaaguuuguucaguacuucaguagauggagc

SEQ ID NO: 4181272 - RNA, 74 nt, Human
gcuucagaaguugggcucugaccaccagggucuaaaucuugguccugccauucuuuagaugccuaacucugggc

SEQ ID NO: 4181273 - RNA, 81 nt, Human
gcuucagagagagcccagggcaggcaaggcaguccccauuggagcugacuuccaaccccaugcauggcugcuucucugugc

SEQ ID NO: 4181274 - RNA, 57 nt, Human
gcuucagcccauauggacucacugaagagucaccaaagaguccuuaugggcugaggu

SEQ ID NO: 4181275 - RNA, 71 nt, Human
gcuucagcccaucccaguacaucgcauggugaccaaaagauguagucguccuggcacaguggguguggggc

SEQ ID NO: 4181276 - RNA, 75 nt, Human
gcuucagcuccuugucacgagaccugccuucuccauagggcuccuugaaagugucuucaugauguggcagcuagc

SEQ ID NO: 4181277 - RNA, 75 nt, Human
gcuucaguucaucuugcuuuucaaacuccugcuucacagaaccagcuuugaccuaaaguaggaaacagcagaagc

SEQ ID NO: 4181278 - RNA, 79 nt, Human
gcuucauagacaaagcagcaggucaguggccaggacccuggauucuggcccaguucugcguuuugcucucuaugugagu

SEQ ID NO: 4181279 - RNA, 67 nt, Human
gcuucauaucucuguagaguuuuacaguguuuauuaccaaaagauucucccugagauauuuagaagc

SEQ ID NO: 4181280 - RNA, 61 nt, Human
gcuucaugcuugcuccaaagcugagcucugauuucacaaccagcuuggagaagcaggaggc

SEQ ID NO: 4181281 - RNA, 59 nt, Human
gcuuccagaucccaugcucuuacuacugcccuguauugaauaugugaccuucugggagc

SEQ ID NO: 4181282 - RNA, 122 nt, Human
gcuuccaugagaacuucuucccagaacuucuacagagccugggggcgcagaaaccggguccuggacgcugguccuccuugccuucagauccugauggggguuggaggggguugcacuggagc

SEQ ID NO: 4181283 - RNA, 75 nt, Human
gcuucccaaagugcugggauuacaagugugaggcacugcacccaggcuggaucccugcauuuuuacagauuuagc

SEQ ID NO: 4181284 - RNA, 82 nt, Human
gcuucccagcagcccugcagaggagucagccugggcagaggcugccucugcccucucgcugcuuggcagugccaggggaggc

SEQ ID NO: 4181285 - RNA, 61 nt, Human
gcuucccaggcacguaccccuuuaagaggaucuuucucaaaagccacguggccuggggagc

SEQ ID NO: 4181286 - RNA, 71 nt, Human
gcuuccccaccuccagagauaggagcgcgccaccuccuggcacagccuccaccccuggggaguggaaaagc

SEQ ID NO: 4181287 - RNA, 55 nt, Human
gcuuccccgugggcuguggcucauuuacaguccuguaaacagccccauggagagc

SEQ ID NO: 4181288 - RNA, 70 nt, Human
gcuucccguggccucuaaugggauuaugugcuucccauggggagaaaaaccauugagaccauggaggagu

SEQ ID NO: 4181289 - RNA, 113 nt, Human
gcuucccuccugcaaaagggugaugggugugugugugugagugugugugugucacaugucugugcucuugggcucauguuuauacauaucuguauauuacuuagaagggaagc

SEQ ID NO: 4181290 - RNA, 68 nt, Human
gcuucccuguccagucucaucugcaugggcacaccaucaggcugagaaaaucuggaccccugggaggu

SEQ ID NO: 4181291 - RNA, 70 nt, Human
gcuuccugauaauugccagugucacccuugccaggucacucaggcacgggucagugagcgcucaggaagc

SEQ ID NO: 4181292 - RNA, 57 nt, Human
gcuuccuggaacaacuguugcugagcaaaugaagcagcauggaauguuccgggaagc

SEQ ID NO: 4181293 - RNA, 72 nt, Human
gcuuccugggcucacaggcggggcuggcgcugggagcccuggggccucaggccgcccugcugcucagucagc

SEQ ID NO: 4181294 - RNA, 90 nt, Human
gcuuccugugguaauaagacuguguuacaccaaaggggaauguaugaagcaacagaucuucuugggugugaccagucugagccuugaagc

SEQ ID NO: 4181295 - RNA, 81 nt, Human
gcuuccuguuggguaguaugcgacuugaggugacaaacacuugcauuguguuugagaacccuguauuuuaagcaacagagc

SEQ ID NO: 4181296 - RNA, 59 nt, Human
gcuuccuuauuguugccauaguaacugucuacugaugguguauuuauaggggaagaagc

SEQ ID NO: 4181297 - RNA, 67 nt, Human
gcuuccuucaguaggcaggagugaguguaggagcagccugccauuuccagccaacugccuagggagc

SEQ ID NO: 4181298 - RNA, 57 nt, Human
gcuuccuuccuguguaacugucuguggugugcuucaucagauaaacgggaaagaagc

SEQ ID NO: 4181299 - RNA, 58 nt, Human
gcuuccuuuugcuucucuaccuuuacaaaaauuaauuuugggugagggagcuggaagc

SEQ ID NO: 4181300 - RNA, 81 nt, Human
gcuucggauguccuuggccuggccuucugccuuucagcaaugcccguggcauaggcagggugggcuggccuggccugaggc

SEQ ID NO: 4181301 - RNA, 63 nt, Human
gcuucggucauugcagucucagucagguccccacuuaacugaccacagacccaaugacuacgc

SEQ ID NO: 4181302 - RNA, 60 nt, Human
gcuucguugcucucucugguaagccuccuccagggguacuagaugagacagcgugggagc

SEQ ID NO: 4181303 - RNA, 75 nt, Human
gcuucuaaauauuuaucuggauuucuagaacuggaauuuaaguucuacuugaaaguccuagcgauccacagaagc

SEQ ID NO: 4181304 - RNA, 56 nt, Human
gcuucuauugucauauuuggacagauagauacugugcagauacaguauguggaagc

SEQ ID NO: 4181305 - RNA, 83 nt, Human
gcuucuauuuuguuggcaucucuguggucuauucauaguucaccuguuuuagcugacacauggagccaguuagagaugggcgc

SEQ ID NO: 4181306 - RNA, 64 nt, Human
gcuucuccagaccuucaucccccgugcacaccugucaggaacaaugaagcucuggguaugaagc

SEQ ID NO: 4181307 - RNA, 56 nt, Human
gcuucucgggccugaugucguccucgaugaugaguucgaugccagccucagaacgc

SEQ ID NO: 4181308 - RNA, 79 nt, Human
gcuucucugagaagcugaggcuggguggguguuacauaaagcuuuccuagcaacuuagcuuuaucacagaaugggaggc

SEQ ID NO: 4181309 - RNA, 56 nt, Human
gcuucucugcagcuccuggcugggccccuucaucuuguaaacgcugcaaugagagc

SEQ ID NO: 4181310 - RNA, 58 nt, Human
gcucagagcagaugguacucagaguaagauggagcugggagugacuggggcucugagc

SEQ ID NO: 4181311 - RNA, 78 nt, Human
gcucagagcuggcugcaggggugucugacauagguccccacauguccuugagacccuccucgguaccugcuuccuagc

SEQ ID NO: 4181312 - RNA, 99 nt, Human
gcucagaggaggaggaggaggagcaggaggagagccuggcgguggcggagcagguagccgacuuugccagcucccugcuggccgcccuccacugcuggc

SEQ ID NO: 4181313 - RNA, 94 nt, Human
gcucagaggaucccaggcccacugcuugucuagucaggucaccagauuggggagggcuugacaggcuagggggcuggcagucugccuuaggagc

SEQ ID NO: 4181314 - RNA, 63 nt, Human
gcucagaggccagcucccugcacugggaaguggauauuguucccaggcagagagcuggugagc

SEQ ID NO: 4181315 - RNA, 56 nt, Human
gcucagagggaacaaggggcugaguuggcucugggagggucuugcauuuucugagu

SEQ ID NO: 4181316 - RNA, 87 nt, Human
gcucagaguccuuuuguuuugagaugaggucucacuuauuuugcccaguccagucucaaagucccagaugcaaggaauuguuugugc

SEQ ID NO: 4181317 - RNA, 56 nt, Human
gcucagaugcccacacuggaaaugucacucuucauguaucagcuggguuucugggu

SEQ ID NO: 4181318 - RNA, 77 nt, Human
gcucagcacaguccaggcucagucaagcacuucgaguacaaaacaacuugagugcguggagaucucacugugugagc

SEQ ID NO: 4181319 - RNA, 69 nt, Human
gcucagcauguuucucagccguuggagaauacauagauguucuccuggagcaggaaggugggccugagc

SEQ ID NO: 4181320 - RNA, 83 nt, Human
gcucagccauuagcuaaacuuagucucaguauagauacaguagugaaucuguacuaauuaauuaauguagauauagugggggc

SEQ ID NO: 4181321 - RNA, 57 nt, Human
gcucagcccaugguuuguggccagugucuguacaaggcuccgugacuggggcugagc

SEQ ID NO: 4181322 - RNA, 57 nt, Human
gcucagcucauucugcgggggaagugcauuaacucccacuccagaguagaagcuggc

SEQ ID NO: 4181323 - RNA, 73 nt, Human
ggaacauauuuuugauauuucugauauuguuaauggagugguucaguccauaaaccagaaaaucaagacuucc

SEQ ID NO: 4181324 - RNA, 84 nt, Human
ggaacaucugauuacaugagaauauuccugggguuacacauuaaggugacauaaauguauugcuuaugaaaacaggucaguacc

SEQ ID NO: 4181325 - RNA, 65 nt, Human
ggaggaagagguucagagaaggcgaucuugggcaagaugcucccugucugggccucaguuucacc

SEQ ID NO: 4181326 - RNA, 77 nt, Human
ggaggaagcugguaggaagugcuccugccucucucucuuccaagcugguaggaagugccccugccucucucucuucc

SEQ ID NO: 4181327 - RNA, 71 nt, Human
ggaggaaggugacaaguuuagguuaccauaaugaguaaugauggugaucagucaacugucuucccucuucc

SEQ ID NO: 4181328 - RNA, 58 nt, Human
ggaggaagugcguuaugccuuuuaagggcacaaccugaaauugccacacauuucuucc

SEQ ID NO: 4181329 - RNA, 64 nt, Human
ggaggacaagcugugagugggguugcagaacaagucuggagaacccugcuuuaugccguccucu

SEQ ID NO: 4181330 - RNA, 84 nt, Human
ggaggaccagaaacugaagcaauucugcuuacuaaagaaauaauuuucaagugagguaauuagagcugcugcuacaguuccucc

SEQ ID NO: 4181331 - RNA, 57 nt, Human
ggaggaccugcuggcccugcaaggcguuucaguuuguguaaccugccagguuccucc

SEQ ID NO: 4181332 - RNA, 61 nt, Human
ggaggacgcagaucugggcaggcggcaucuggccgggugagccuguggagcugccuccucc

SEQ ID NO: 4181333 - RNA, 85 nt, Human
ggaggacucuggggagagagggaggagcuuugaggggggucacccuucacaguuccugacuuuaacuccacuacuaauguucucc

SEQ ID NO: 4181334 - RNA, 64 nt, Human
ggaggacugagaaucauagaaggcaacugacuugcccaguucagcuuucucguucuaguucucc

SEQ ID NO: 4181335 - RNA, 59 nt, Human
ggaggacugagacacuccuggccaacaucccucucggccaaggcugagugucucccucc

SEQ ID NO: 4181336 - RNA, 83 nt, Human
ggaggacuuagugaguuaaguguccugagcggcaccugcacucaggugacacucagugcugcuggcuccugucacaauucucc

SEQ ID NO: 4181337 - RNA, 60 nt, Human
ggaggagauggaugggggacguuuagcgaagaaaggcaucucccagauccuuuagccucc

SEQ ID NO: 4181338 - RNA, 60 nt, Human
ggaggagcacuucugagcucagugaaugacuaggcugaagcuccguacuaugacuuuucc

SEQ ID NO: 4181339 - RNA, 58 nt, Human
ggaggagccagaauccagacucgggcuccagcuccagagucuguauucuuggcuagcu

SEQ ID NO: 4181340 - RNA, 85 nt, Human
ggaggagccuucuuggggcagcccaggcugagccucuaccccugugacccgcuccuggccgggcugcucuuggaugagguacucc

SEQ ID NO: 4181341 - RNA, 64 nt, Human
ggaggagcugcugugggggcccagcccucccagcgggcagggucccugaucagaggcauccccc

SEQ ID NO: 4181342 - RNA, 70 nt, Human
ggaggaggcacugagaggcucuuccuaaggcuuuguuuuagggacaaagagcuccagucugagcugcucu

SEQ ID NO: 4181343 - RNA, 57 nt, Human
ggaggaguuggcuccucaguguccccuuuguugccccaaaacacagccagguucucc

SEQ ID NO: 4181344 - RNA, 113 nt, Human
ggaggaguuucacggguagugcuacagagggggagggcaagagaccagagaucuaggucaaccauccggcuuauccugcuuuguucagagcagauccuuguugaaaugacuuu

SEQ ID NO: 4181345 - RNA, 86 nt, Human
ggaggauaaaaguucugugaggauaaaaaggaaggagacauaagcuuaugcuuuuucuguaauaucuuauaccuuuguuauucucu

SEQ ID NO: 4181346 - RNA, 60 nt, Human
ggaggauggcggccacgcccccuauucugcgcuguaguaggcccugguuacgccuccucu

SEQ ID NO: 4181347 - RNA, 115 nt, Human
ggaggcaaguggaagcugccugggugucuggacauuggggcccuuucaguguugcugagcugcugggccucaccucuccaccgccugccuccaggcccuuggcuacccuucuucc

SEQ ID NO: 4181348 - RNA, 94 nt, Human
ggaggcaccucauuuuaaaaauagguuuuguaccagcagauucaccagagugaaauuucuagguagagaagcuuagugacuagugcaguguccc

SEQ ID NO: 4181349 - RNA, 70 nt, Human
ggaggcagcuuggggcuguggguaggcuuugggaccagagacccaguuugaaucccagcgucgugccucu

SEQ ID NO: 4181350 - RNA, 60 nt, Human
ggaggcaggcaaguucauaugaggaagguaauuaaguucccauugauugugccugucuuc

SEQ ID NO: 4181351 - RNA, 108 nt, Human
ggaggcaggggcgagacaggauugcuugagccaggaguuugaggcuguagugagcuauggucacaccacuguacuccagccugggcaacauaguaagacccugccucu

SEQ ID NO: 4181352 - RNA, 70 nt, Human
ggaggcagugccuggaccccagcugcccaggagaggugaggggcuagauggggccugaggacacugugcc

SEQ ID NO: 4181353 - RNA, 61 nt, Human
ggaggcagugcugauggaagagaccugaagaaggaaucuccauggaaccggggcugcuucu

SEQ ID NO: 4181354 - RNA, 62 nt, Human
ggaggcaguggcagagcuuggucuaaagcuggaugucuuuagcagucuaugucccugccucu

SEQ ID NO: 4181355 - RNA, 63 nt, Human
ggaggcauuauguuaaaauuuugucuuggaaaccaggucaaagaaccuagcuauagucuuucc

SEQ ID NO: 4181356 - RNA, 93 nt, Human
ggaggcauuugguaaauacuguugaaugaaguaagaaaugaaugaagauuaccagacucauacaagcguucaauagauguuagcuauccuucc

SEQ ID NO: 4181357 - RNA, 55 nt, Human
ggaggccaaggaggagcuugccaagaaguguggcaucaccgugucucaggucucc

SEQ ID NO: 4181358 - RNA, 56 nt, Human
ggaggccggggccgggaggagcacccagacggagugacuucuggcccugagccacc

SEQ ID NO: 4181359 - RNA, 63 nt, Human
ggaggccuagccagcuccaguuucagagauuuuuagaaagugccucuguuuggcuugguuucc

SEQ ID NO: 4181360 - RNA, 57 nt, Human
ggaggccuggacuuccugauggucuuggugggggucaggaggagagcuuggccuacc

SEQ ID NO: 4181361 - RNA, 100 nt, Human
ggaggcgguccugguagggagugcguagcaggguggagucgcuguccggucgcgcuucacuucugcuccgcccucccugcuccccauaacagaccccucc

SEQ ID NO: 4181362 - RNA, 75 nt, Human
ggaggcguggcccucgccguugaccauguacagcacguagugcuccaugcgcucggccggcggcagcggcgcccc

SEQ ID NO: 4181363 - RNA, 114 nt, Human
ggaggcuaauuuugcaaguagucagcucgaacuuccuguuaugugugccucuuauaaaaugacgcgaagaggauuauaugacaggaacaguugaauagcuacagcaaaguuucc

SEQ ID NO: 4181364 - RNA, 76 nt, Human
ggaggcuacuugguggacaggauugagagcugccuuggagaggccugagucagaucuguuugccagaucagccucc

SEQ ID NO: 4181365 - RNA, 93 nt, Human
ggaggcuagaaaucugaaaugaagguaauggcagagucaugcuuucugauagcucuaugggaagagaaucuuuccuugccuucucuggcuucc

SEQ ID NO: 4181366 - RNA, 58 nt, Human
ggaggcuccacugcucuuccugggaucaacuguuccuagaagagaagcaggacccucu

SEQ ID NO: 4181367 - RNA, 55 nt, Human
ggaggcucugcuccguguguucuuuacucaaggacccacacugacaagaguuucu

SEQ ID NO: 4181368 - RNA, 60 nt, Human
ggaggcugagggggaggccaccugggacuaagcaagaccccauuggacccuugggccucc

SEQ ID NO: 4181369 - RNA, 108 nt, Human
ggaggcugaggugggacaaguuccuugagcccaggcauuggaggcugcaguguacugugauugcaccauuguacuccagccugggugacagagggagacucagucucu

SEQ ID NO: 4181370 - RNA, 77 nt, Human
ggaggcuggaagccugagaucaaggggucggcaggguugguuccuucugaugccucucuucuuggcuugucauuucc

SEQ ID NO: 4181371 - RNA, 61 nt, Human
ggaggcuggaaguccaagaucaagaugucagcagguuugguuucuucuggggcuccucucc

SEQ ID NO: 4181372 - RNA, 84 nt, Human
ggaggcuggaaguccaagauuagggugacagcaugaucaguuucuggugaaggcugucuuccuggcuugcagauggccaccucc

SEQ ID NO: 4181373 - RNA, 61 nt, Human
ggaggcuggaggucaaagaugaagugcuggcagucugggguucuucugaggccucuccucc

SEQ ID NO: 4181374 - RNA, 101 nt, Human
ggaggcuggccugucuucuguagguaccaguugaaauagauguauccauuacugugaagggggcugugacuagaccugcaggagauggaggcuggcucucc

SEQ ID NO: 4181375 - RNA, 70 nt, Human
ggaggcugggcuuugagcucggucaccuuugcacccagcuugggagugagagaguuuaaggucauccucc

SEQ ID NO: 4181376 - RNA, 58 nt, Human
ggaggcuggggcagcuggcgugcccagaggacguguucgaacagcucugcagacuucc

SEQ ID NO: 4181377 - RNA, 62 nt, Human
ggaggcugguuuguccuccucauaccccaccagacagggcagagccccucaagccagccucc

SEQ ID NO: 4181378 - RNA, 74 nt, Human
ggaggcuugaugaucuuggauaaauguggaaauuugcacuucuaaauaacuaguuuaaguaucauuaagccuuu

SEQ ID NO: 4181379 - RNA, 109 nt, Human
ggaggcuuguuuuuccuuuuguugguggaggaagggcuggcuuugauauccucagcagcacaauuuggggguguccuucguccgcuggcauugaggcugccccgccucc

SEQ ID NO: 4181380 - RNA, 78 nt, Human
ggaggcuuucguuugcuuauauaauagaucaauuucaaggucucaaacuguguauuauaauuagcaaugcaaaccucc

SEQ ID NO: 4181381 - RNA, 86 nt, Human
ggagggaagacagugcugagcacagccuguguccucacuguguguuuaguguguggacaagugugccucuucccgccucucccucc

SEQ ID NO: 4181382 - RNA, 55 nt, Human
ggagggaaggacccauuuuaaguuccagggaccacuggacuauuccauucccuuu

SEQ ID NO: 4181383 - RNA, 86 nt, Human
ggagggaagggagcugggaggagccagguggggccuguuuaugggggagccuugccucauugugcuucucccaguaccugcacccc

SEQ ID NO: 4181384 - RNA, 67 nt, Human
ggagggaccagcgugagucugaggcuuggguuuugccaucugugucaaggacagggcugguccaucu

SEQ ID NO: 4181385 - RNA, 59 nt, Human
ggagggacccacugcggugaccggaaguuaagaggauacagacgcaguugagguucucc

SEQ ID NO: 4181386 - RNA, 130 nt, Human
ggagggaccugacccuauagaucuuuccagaauagagggagacacccuaggacucugagcccauagacauauggcuuccagggugggggauguuuuuaauuuaucucuggaaagcauuuagaguccagcu

SEQ ID NO: 4181387 - RNA, 90 nt, Human
ggagggagagggauugaaggcaggaacacaaguucagggaugucugcagacaucagccugucccugguuuacucuucagccccuccuucc

SEQ ID NO: 4181388 - RNA, 73 nt, Human
ggagggaggcuugggccaccuggagggacugggcacucugaguaguacccucugggaggcuguacccccuuuc

SEQ ID NO: 4181389 - RNA, 62 nt, Human
ggagggagggggcgacucuuaaaggcacagggugcuuggaagaggaggcccugcucccgucc

SEQ ID NO: 4181390 - RNA, 67 nt, Human
ggagggagguuguccguggugaguucgcauuauuuaaugaugcccaauacacggucgaccucuuuuc

SEQ ID NO: 4181391 - RNA, 63 nt, Human
ggagggagucuccuuagagagagugcagcucugcucacaucuuaguuugggacucuggccucc

SEQ ID NO: 4181392 - RNA, 81 nt, Human
ggagggcaagcuccccagcuggggcaacgcaccagcuccuugaagcuguucuguggcucggccagcugcugaagccucucc

SEQ ID NO: 4181393 - RNA, 74 nt, Human
ggagggcauccacaggaaagcaccucccaugccaagccaggaaaguggggcuuuccagugggaauugguccucc

SEQ ID NO: 4181394 - RNA, 96 nt, Human
ggagggccucagguucuggagaagggccagguauuuccaugucaacccugcuuuuuauaaccagagagaacauaugagguagcaccaaugaccucc

SEQ ID NO: 4181395 - RNA, 96 nt, Human
gcugacuuccuucaaaacauuguccaugaugguucuuacaaaggugcuauuuccugccuagagcauuugugugggaacccaucagugaaggucugc

SEQ ID NO: 4181396 - RNA, 57 nt, Human
gcugacuuugacuuggucauugauaucccuagaauucaaugacugguccaagguggc

SEQ ID NO: 4181397 - RNA, 67 nt, Human
gcugacuuuucauguauguggguuuuacagggcugacugugaaacuugaguauauauggauuuuggc

SEQ ID NO: 4181398 - RNA, 66 nt, Human
ggaaccuagaauccaucugcuuauuauaaucucuguaauuugcacacaguggcauucuuggcagcc

SEQ ID NO: 4181399 - RNA, 66 nt, Human
ggaaccuccuccuggagaaugagcagcagcauuuguccuggcugccuucuggaggaagugaaaucc

SEQ ID NO: 4181400 - RNA, 121 nt, Human
ggaaccugaguguuaaguaacuugccugcaguuguagaauuuggaucucggcagucuggcucuagggaucugugcucugaaccaugauucuauucugccuguuacacugccauuggguucu

SEQ ID NO: 4181401 - RNA, 108 nt, Human
ggaaccugcauccccucauuuacuccucagagcagcucugugccuggagacuugaaagaugagggaagccaggcccagagaugcuagugagugggguggcagggaucc

SEQ ID NO: 4181402 - RNA, 99 nt, Human
ggaaccuggcacccaccguggggguugggcugggugggaggcggggcuccgucaucuucucucagcccaggcuccuccucguuugcucgugcuuuuucc

SEQ ID NO: 4181403 - RNA, 81 nt, Human
ggaacgccucugugacagagcuugagugagaaaaaggaauuguccuucuacaucucagccaaugcuccuucaccguguucu

SEQ ID NO: 4181404 - RNA, 62 nt, Human
ggaacggcuguggcuggcggcagcggcagcgggcggcugcuguggccuggcgcagagcugcc

SEQ ID NO: 4181405 - RNA, 108 nt, Human
ggaacuaagucuucuaagccuccuacccuuucucuugccuuucucagaaggcagagguauucagaaaagggcaagagagagggcaagaggcccaggagacuuaguucc

SEQ ID NO: 4181406 - RNA, 85 nt, Human
ggaacuaagugaugaaaucuuuuccaauuguuuagggaaagugucucauucccauaaacguggaagaauuugcacacuugcugcc

SEQ ID NO: 4181407 - RNA, 86 nt, Human
ggaacuccuuuccacggaauggaauucuccgcuggggcugcaggaacuccuuuccacagaauggaauucuccgcugggguaguucc

SEQ ID NO: 4181408 - RNA, 107 nt, Human
ggaacugacagacuguuuuccaagguagcugaaccauuuuacauucccaccggcaauguaugaagguuccaguuucuccacauccuugucaacacuuguuauuuucc

SEQ ID NO: 4181409 - RNA, 67 nt, Human
ggaacugcagggagaggggacagccugguuugcaaggccccauuugggcuagccucuucccugcucc

SEQ ID NO: 4181410 - RNA, 58 nt, Human
ggaacugggaccuccguguaggacuggugguucucuaguucucgagcgucccuguuuc

SEQ ID NO: 4181411 - RNA, 130 nt, Human
ggaacugggccagucuuaggcuuaccuagaaauauacaccugaucccaugagaccacguuggcugugauaugauagcacuucucaugggaucagguguauauuucuagauagcagcaggcuuccaugcuc

SEQ ID NO: 4181412 - RNA, 69 nt, Human
ggaacuggguuagggucucuucccccguccacagauauugggguaugugggucccugagucuucggucc

SEQ ID NO: 4181413 - RNA, 59 nt, Human
ggaacugugggaccuuuaucaggggaccucugcuagacaaggcucuguucugcaguuuc

SEQ ID NO: 4181414 - RNA, 65 nt, Human
ggaacuguuacagauacauuucuuuuguugaaguuaccuucaacaaaguaauuuguuacggcacc

SEQ ID NO: 4181415 - RNA, 65 nt, Human
ggaacuuagaauauguucaagauuucauuccuguuuucaucugagacuuggcguuuuuaaguacc

SEQ ID NO: 4181416 - RNA, 70 nt, Human
ggaacuuccauacuguuuucuauaauggcuguacuaauuuacauuuccaccaguagcguguauggguucc

SEQ ID NO: 4181417 - RNA, 63 nt, Human
ggaacuugagcaacacugagugacacuccagagaggcucaugugaguguguguucaggugucc

SEQ ID NO: 4181418 - RNA, 67 nt, Human
ggaacuugaggauugccuugucagcuccugucucuaccuaggcaacugacagcauauccuguuuucc

SEQ ID NO: 4181419 - RNA, 70 nt, Human
ggaacuugcaaccucuggucacgcugaacacuuugcccuugcugguguggccaugagaaugugcaggucc

SEQ ID NO: 4181420 - RNA, 56 nt, Human
ggaagaaaaugggcaacagguggcuaucaguggucuccuugugguuauuuuguucu

SEQ ID NO: 4181421 - RNA, 64 nt, Human
ggaagaagcagcugccaggccaguuaagagcuacaccugggacuggcauagcauuacuucuacc

SEQ ID NO: 4181422 - RNA, 87 nt, Human
ggaagaaugaauggucuuuauggaaaaugaauggcagaauaagugauuugucaaguucauugaacuauaaauuccauuuuuacuguc

SEQ ID NO: 4181423 - RNA, 108 nt, Human
ggaagacaaaggaugacuucuugagucggcaccuugacacuagaugggcagaggagccuccuguucauuccggggagggcuaacuugggagaaguuuaagagcuggcc

SEQ ID NO: 4181424 - RNA, 57 nt, Human
ggaagacaucugcuugcaccagaucuagcacauagugggugcucugcaaaugucucc

SEQ ID NO: 4181425 - RNA, 98 nt, Human
ggaagaccaaacuacaacuuuccagaccuccuuguagcugggauggccccgugaugccagcugcugaaagggguucugggaaaguguuugcuuucucc

SEQ ID NO: 4181426 - RNA, 69 nt, Human
ggaagacgcaagauuugccaguggccaacuucuguuugaagacuccgugacagauuugcacaacuuucc

SEQ ID NO: 4181427 - RNA, 121 nt, Human
ggaagacggcugccccugcucuuugcacaaucccacguccuccagcucgugcucuuucugucuugagagucugggcauuuaggauguuggagucagaggagacuggggacaccagccaucc

SEQ ID NO: 4181428 - RNA, 85 nt, Human
ggaagacuaaagaguaugucuuuugaugaauaauaaguucuccccugaguaacugaacauaaugaaagccaaauucuuguuuucu

SEQ ID NO: 4181429 - RNA, 76 nt, Human
ggaagacucuaauuaaucuugccuugaucacauccugauaccagaaucaguuauucuggcuagauugaugaguccc

SEQ ID NO: 4181430 - RNA, 89 nt, Human
ggaagaggaaacacccuggcuguuuauuucggggcuguaggaucuguugugaaugagccccaggaugggccgcaggaugucuuucuucc

SEQ ID NO: 4181431 - RNA, 71 nt, Human
ggaagaggaaacugaggccugggagguccaggggcuugcccaaaucccagcaggaguccaguucccucucu

SEQ ID NO: 4181432 - RNA, 69 nt, Human
ggaagaggagaggagaccuucucugaagggugaggccuuuucagagcugggugcuucuuccugcucucc

SEQ ID NO: 4181433 - RNA, 56 nt, Human
ggaagaggagaguguugcauuuccugauuagaguccaaggagaagacucucucccc

SEQ ID NO: 4181434 - RNA, 63 nt, Human
ggaagaggucacuucuagccaagggaauuuggagaagcuaucuggcugcagugcaccucaucu

SEQ ID NO: 4181435 - RNA, 73 nt, Human
ggaagaguaauaguuugaagagguaagaucuaaacugcagaggaucuuaaucuucagggacucuugcuucucu

SEQ ID NO: 4181436 - RNA, 86 nt, Human
ggaagagugacacacuuguccuggucuuccugggacuuuccugguugcuucuguucugggaaagccaggacaauucgucacuuucu

SEQ ID NO: 4181437 - RNA, 124 nt, Human
ggaagaguguuagaggagaaaacugcugcugagaguauuggcaggcuuggccucaguuuggacucuguaauuuucuuuggacccaagucuguaaccucugcguacuucuucucucuuaccuucu

SEQ ID NO: 4181438 - RNA, 90 nt, Human
ggaagauucagaucuuauauuacucuuuguuuuacaguuuuauuguuuacaggaaauugggacacagagaaaaauagagaggaaucuacc

SEQ ID NO: 4181439 - RNA, 59 nt, Human
ggaagauucaguuaucucaugaaagccugaaaugcuaguaugaggucuaugagauuucu

SEQ ID NO: 4181440 - RNA, 69 nt, Human
ggaagauucggaaguuguuuuauagauagaauagucaaaggcuuuuucagucuuggcuucugauuuucc

SEQ ID NO: 4181441 - RNA, 108 nt, Human
ggaagcagaacuaaugugauauauagauacaugucaagagacuuaucguagggaauuuacuaacccaauuauaagggcuggcuaugaagucuucacaugacuguuucc

SEQ ID NO: 4181442 - RNA, 57 nt, Human
ggaagcagacuuuugcuuauuuggccuauuuauuuggcccaguugcugaguugcucc

SEQ ID NO: 4181443 - RNA, 58 nt, Human
ggaagcaggaggcugggguaaagauggagccgccuucccuucccuccugccugcuucc

SEQ ID NO: 4181444 - RNA, 72 nt, Human
ggaagcaggagucccucuggccagcauguucucucuuccugacaccuggcccuugggaccccugggcauucc

SEQ ID NO: 4181445 - RNA, 66 nt, Human
ggaagcagucugccagccaacucugcaaaacaaagagaagagaacuggcugcaagcagcugccucc

SEQ ID NO: 4181446 - RNA, 84 nt, Human
ggaagcauagccaagggaguaugaagaugugcauaagacuuuugucugauacacacugcuauccuuuuuugugcuaaugaauuc

SEQ ID NO: 4181447 - RNA, 102 nt, Human
ggaagccagggaccucccucacggugaaggccgagugaccagugggagucaggguaaaccuucacugugagucaggaacaagcuccccuggauauauuuucc

SEQ ID NO: 4181448 - RNA, 69 nt, Human
ggaagccaggguccggcugccuggcugugccuuuagugcugaccgcaguggcugcugggccuccccucc

SEQ ID NO: 4181449 - RNA, 78 nt, Human
ggaagccgugaaaggaaaguacagugaugcucgguguuaaucaauugccugcauuucugcuuuugccuuucacuuucc

SEQ ID NO: 4181450 - RNA, 81 nt, Human
ggaagcuaugaggagagagaacacuuggguccauuuguuucuggcuuuuguuaucuucuuucugaccacuucaaagcuuuc

SEQ ID NO: 4181451 - RNA, 66 nt, Human
ggaagcucagcagcugauggggaagugauuuauaauccuaaacacaguucuuucacuguugguucu

SEQ ID NO: 4181452 - RNA, 57 nt, Human
ggacagacagcauggaaccauagcucuacacacacuagcauggcuccagugucuucc

SEQ ID NO: 4181453 - RNA, 57 nt, Human
ggacagacuaaauggcuguaggaugacuccaauuauucuaccccugguggucugccc

SEQ ID NO: 4181454 - RNA, 69 nt, Human
ggacagaguggggaguaggaggggaacagagaggacauccucucuggcucuccagugcucuuagugucu

SEQ ID NO: 4181455 - RNA, 62 nt, Human
ggacagauaaguuggagccucauuguugagaguauugauaauaaggccaaacuaucuggucu

SEQ ID NO: 4181456 - RNA, 82 nt, Human
ggacagauggaccugucuucaggggaggaaucuggcugccucugcucgcugaauucugccuugaggccuuccuuucauguuc

SEQ ID NO: 4181457 - RNA, 65 nt, Human
ggacagcaugcuuuauaguuaggacauucuucuuuauauccagccugacuucuucaugcuguacu

SEQ ID NO: 4181458 - RNA, 124 nt, Human
ggacagccagaugaagguccaguucuggugucgggucccugaggagggagcucuguggacuggcuccguagcacaugcuccuggggcuugccuggcaccggugcagggaucaaggucggagucc

SEQ ID NO: 4181459 - RNA, 59 nt, Human
ggacagccuucccugagagaaguguccuguucuuuucuucaaggguaaaggcaacgucu

SEQ ID NO: 4181460 - RNA, 56 nt, Human
ggacagcucugccaggagcucacauuggggccuggcaacuccuugcagauuugucc

SEQ ID NO: 4181461 - RNA, 101 nt, Human
ggacagcugacacagcagccugucugugcuugcagcccacaaugggauguagcccaagaggcugaaagguaguaguaggcugccagguccugugccugucu

SEQ ID NO: 4181462 - RNA, 66 nt, Human
ggacaggacgggcaaacaggauggucucagcccaaaagagauuuccugcagagccccuccgaggcc

SEQ ID NO: 4181463 - RNA, 60 nt, Human
ggacaggauggccagcugauauugacucagagucuuaucuacacuuggcuugucuugacc

SEQ ID NO: 4181464 - RNA, 88 nt, Human
ggacaggcacacgcaggcucuugguaaaugcgcggugaauuaaauugaacuggaucaugguauaaagagucuaucugguggcaagucc

SEQ ID NO: 4181465 - RNA, 68 nt, Human
ggacaggcagagcauccccugcaguacaacuacacuuucugguacuccaggagaaccccugucugucc

SEQ ID NO: 4181466 - RNA, 83 nt, Human
ggacaggcagcauuuacucugaugaacauagaggcuauuuuccucuucuauccaauaauucucagaguacauguuuuuuuuuc

SEQ ID NO: 4181467 - RNA, 58 nt, Human
ggacaggcaggugauuuccagagaauuuuccacagcucuguaagcaaccugaaugucc

SEQ ID NO: 4181468 - RNA, 71 nt, Human
ggacaggcccggggagccuggauggcaaggggugcaggaaggcgcccauuccgggacugccugggccugcc

SEQ ID NO: 4181469 - RNA, 62 nt, Human
ggacaggcgccagcuccuguuggucuugaggaggcgagggucucuggggcuggcauuugucc

SEQ ID NO: 4181470 - RNA, 56 nt, Human
ggacagggaucauuaucugagcacaucuggccauggauaguacuguuucccugucc

SEQ ID NO: 4181471 - RNA, 61 nt, Human
gcuuccaucagaagcugcaguggaaacaaucaccuuuuccggcagcagcucugaaggaggc

SEQ ID NO: 4181472 - RNA, 83 nt, Human
gcuuccauucuggaguucuccagagacccauucacuaaaagagaaacaggcugcucugggguuaagcuuccauggaugcuggc

SEQ ID NO: 4181473 - RNA, 55 nt, Human
gcuuccauuugcuaggggauuuacaugugaaaccucccccagugcuaaugggagu

SEQ ID NO: 4181474 - RNA, 61 nt, Human
gcuucccacagagauuacauugaaagaaucucuuuccugugugugaucucuuguggauggc

SEQ ID NO: 4181475 - RNA, 59 nt, Human
gcuucccaucaaccuuccugcagcucacccgagugucugagguggagagugagguaagu

SEQ ID NO: 4181476 - RNA, 67 nt, Human
gcuucccccuugaccaccuccuccccaucauuggauugggaugaggaucaaucagggaggaaaaugc

SEQ ID NO: 4181477 - RNA, 63 nt, Human
gcuuccccuccaagcacugccugauuccuuuuagccccuugcggcuccuuggaggcuuggagc

SEQ ID NO: 4181478 - RNA, 60 nt, Human
gcuuccgacagagaucacauugaaagggucugucuccugugugugaccuccuguggaugc

SEQ ID NO: 4181479 - RNA, 56 nt, Human
gcuuccggagccaaaaggccccggaaguggucggccgcuugcgacgcuccggaagu

SEQ ID NO: 4181480 - RNA, 60 nt, Human
gcuuccuagaguggaggagguuucacugcacuuacacauacauuuucuguuuuaggaagu

SEQ ID NO: 4181481 - RNA, 70 nt, Human
gcuuccuagcauuagccauugccagggggccaaauacaguaaauggaucaauggccugaugcuauuaagc

SEQ ID NO: 4181482 - RNA, 59 nt, Human
gcuuccucacagcacugcugcaggcggcacuguugcugcaggagauuuugagagucagc

SEQ ID NO: 4181483 - RNA, 73 nt, Human
gcuuccucaucuguucuucaaaauauuacauaaauuaauucauagauguaaagguuuuagagcagagauuggc

SEQ ID NO: 4181484 - RNA, 72 nt, Human
gcuuccucccugcuuggaaugacccuuacuuaccacguggcacuuagaucagguugggucccaacaggaagc

SEQ ID NO: 4181485 - RNA, 69 nt, Human
gcuuccugagaaacaaucugauguggaacucaggccaccaaaucacacgauuguuuuuuagguuguugc

SEQ ID NO: 4181486 - RNA, 58 nt, Human
gcuuccugaguacacccucaucuuagaacugaggcucaaggugucugcucaagggagc

SEQ ID NO: 4181487 - RNA, 60 nt, Human
gcuuccugaucccccacaucccagcaggccuucccacugccaucgaggggagcaguaggc

SEQ ID NO: 4181488 - RNA, 74 nt, Human
gcuuccugcuguauuacuuuuacaaacugcuucucacaggcuaggcagagacagaggcaauauagcuuacaagu

SEQ ID NO: 4181489 - RNA, 88 nt, Human
gcuuccugguuugcuaucaguuagaguugcugauacuaccaguguauguucagcucagcacugacaagauaaaacaaaacaaaaaagc

SEQ ID NO: 4181490 - RNA, 63 nt, Human
gcuuccugucccucagccaugaagucuuuccuuccuugugacucuguuugagugauggggagu

SEQ ID NO: 4181491 - RNA, 59 nt, Human
gcuuccuuccuuacauugguggucucugggcagcauaccaagguaguggagacagaagu

SEQ ID NO: 4181492 - RNA, 86 nt, Human
gcuuccuugucuguguucaacucgauggguggagaaaauaauuagaauugauuucucugcacccacucaggaauagaauaggaggc

SEQ ID NO: 4181493 - RNA, 61 nt, Human
gcuuccuuucuccaagaauaguuucaggggccaagaaggcugggaaacuggggucaggagc

SEQ ID NO: 4181494 - RNA, 64 nt, Human
gcuuccuuuuggccaggucagugcagggaaccaacaaagacagggaccuguggccagaagaagc

SEQ ID NO: 4181495 - RNA, 81 nt, Human
gcuucuaauauucuuguuuauuaagauauaaagauuguccuaaaaagcuuugaauuuguuagugaagaagaguaguaaagu

SEQ ID NO: 4181496 - RNA, 68 nt, Human
gcuucuacacaugagugagaacaugcaguguucaacugucagccucucaguucauuguucuuagaugc

SEQ ID NO: 4181497 - RNA, 62 nt, Human
gcuucuacagaggcguugccuugacgccaucuaguggcaauauaggcacaauucugagaagc

SEQ ID NO: 4181498 - RNA, 79 nt, Human
gcuucuaccuccucacagaugagcaucgccagcucuucucugcaaggaaagagcuggauugugcugcagaggagagagc

SEQ ID NO: 4181499 - RNA, 65 nt, Human
gcuucuagguuccuaggugaauaauucagacuuuacuuauuuauuuauaccaggugaucggaggu

SEQ ID NO: 4181500 - RNA, 55 nt, Human
gcuucucccauuucgcugcugagggcucacuugcaggacaacagagugggaaggc

SEQ ID NO: 4181501 - RNA, 55 nt, Human
gcuucucccuacagaugucagugucuuuauauugaagaggauggguagggggagc

SEQ ID NO: 4181502 - RNA, 61 nt, Human
gcuucucccuucuucugauugagauggggagucacuagaggaauugaagcagaggagaggc

SEQ ID NO: 4181503 - RNA, 68 nt, Human
gcuucuccugggagcuguggcagagcgcucucugcugcucaccccaugcuccgcaggccugcaggagc

SEQ ID NO: 4181504 - RNA, 70 nt, Human
gcuucucugccagcccugugagucuugaacauucaugcuuuuuaacucauuucuggcaguuuugagaggc

SEQ ID NO: 4181505 - RNA, 57 nt, Human
gcuucugaaggcucuaggagauaauccauuuccuugucuuaucuagcuucuagaggc

SEQ ID NO: 4181506 - RNA, 76 nt, Human
gcuucugacacuggauuucuagaaaugugugugcuuuaaauucauauuuaaauuuguuuaguugucgcccagaagc

SEQ ID NO: 4181507 - RNA, 63 nt, Human
gcuucugacagcaccugaacuucucuguccaaucagugcgcaagagcaggcugucaauggggc

SEQ ID NO: 4181508 - RNA, 60 nt, Human
gcuucugcaggagucaacucugggcgaacuacaugccagggaguauugccugcagagagc

SEQ ID NO: 4181509 - RNA, 61 nt, Human
gcuucugcagguucauuguuuauuccaaguucccagagaaacaaauguaaaaugcagaugc

SEQ ID NO: 4181510 - RNA, 87 nt, Human
gcuucugcugaguagagauagcuaagaaggugauuuuucuucucaggaaaaguacaucaaauguuuggcuauaaauggucaggaagc

SEQ ID NO: 4181511 - RNA, 58 nt, Human
gcuucuggaagcauaugcaagaaacuguucacagugcacaguguugccuuccaggagu

SEQ ID NO: 4181512 - RNA, 59 nt, Human
gcuucuggaagcugcuucugccugccucuguguucauggcaguagcaauaauuagaagc

SEQ ID NO: 4181513 - RNA, 80 nt, Human
gcuucuggagcugggggcuuaguauuagcaucaaacuuuuacuaauggaugcccgacacucugcucugagcuucaggugc

SEQ ID NO: 4181514 - RNA, 68 nt, Human
gcuucuggcagguuaugcgggccacaucuuccagaaaauguguucccuauuucuuguccucagauagc

SEQ ID NO: 4181515 - RNA, 70 nt, Human
gcuucuguagguacuggcuggggccaagguaucugugugcuuugaaagcucccaggacuuacuaagaagc

SEQ ID NO: 4181516 - RNA, 66 nt, Human
gcuucuguauuuauuguccuuuugacucugcugaagauuugaguacuuaaaggcauauauagaagu

SEQ ID NO: 4181517 - RNA, 58 nt, Human
gcuucuguccugcugugccaagugcuggggcagacgcaggcacagaguggacagcggc

SEQ ID NO: 4181518 - RNA, 80 nt, Human
gcuucugugggacuguugccuggggaagcucugaugacagacaccaagcucccacagggcaacccuguccuaguugaagc

SEQ ID NO: 4181519 - RNA, 55 nt, Human
gcuucuguggugaggucaccuuuucuggaaaucccugugauuucuuuccacaagc

SEQ ID NO: 4181520 - RNA, 59 nt, Human
gcuucuguucaaggauauaaggcccaauucacccacuguguaucuucaugaauggaggc

SEQ ID NO: 4181521 - RNA, 72 nt, Human
gcuucuuagccacagagguugaugugguuaggugccaaauuuagccacuuaaccuuucgugcuuugacuggc

SEQ ID NO: 4181522 - RNA, 63 nt, Human
gcuucuuuccuugggcuggaaccauucaacugcacagauaaauguuuacucaaggaagaaugc

SEQ ID NO: 4181523 - RNA, 64 nt, Human
gcuucuuugcagccucccuggcagaagcaucaauugcuuugcugauagagaggcuguccagagc

SEQ ID NO: 4181524 - RNA, 68 nt, Human
gcuugaacccaggaggcagaaguuguagugagccgagacugugccauugcacuccugccugggcaagc

SEQ ID NO: 4181525 - RNA, 72 nt, Human
gcuugaacccaggaggcagagauagcagugagccgagaucgcgccacugcacuccagccugggugacagagc

SEQ ID NO: 4181526 - RNA, 76 nt, Human
gcuugaacccgggaaguggagguugguuacagugagccaagauggcaucacugcacuccagccugggugacaaagc

SEQ ID NO: 4181527 - RNA, 87 nt, Human
gcuugaacuucucacagcauguugccuggauucugaagggccauuucaaaagacccagaaagcagcugcauuuggaaguuacacagc

SEQ ID NO: 4181528 - RNA, 72 nt, Human
gcuugaacuucuuagaagugggcuauaauuaggaagguuuugauucugggcucauuucuuuaaguuucuagc

SEQ ID NO: 4181529 - RNA, 74 nt, Human
gcuugacuacagaagcucucuauggauucuagcccagccagcuugaauuccacuuuggcuuuuggggucaaagc

SEQ ID NO: 4181530 - RNA, 56 nt, Human
gcuugagacccagggagaagaacuucuggugccaaaguucuuucuggaaggucugc

SEQ ID NO: 4181531 - RNA, 70 nt, Human
gcuugagccagggaugcagagguugcagugagcggagaucaagccacugcacuccagccugggcuccagc

SEQ ID NO: 4181532 - RNA, 82 nt, Human
gcuugagccaucccuggcuuccuggagcucacaaccugagagagaagguggugcugcgggaacccaggguugggcugugggc

SEQ ID NO: 4181533 - RNA, 72 nt, Human
gcuugagcccgggagguggagacugcagugagccgugaucacgccacuguacuccagccuuggugacagagu

SEQ ID NO: 4181534 - RNA, 63 nt, Human
gcuugaggcugcacaguacaggcugccuaagggaccgguaagcuauuuacugugcagcucagc

SEQ ID NO: 4181535 - RNA, 72 nt, Human
gcuugaguccaggagguugagacugcagugaacugugaucacaucacugcacuccagccugggcaaaagagc

SEQ ID NO: 4181536 - RNA, 60 nt, Human
gcuugagucccaugaugauagccacaguccuugcugaaggauaucgaugguggcucuugc

SEQ ID NO: 4181537 - RNA, 66 nt, Human
gcuugaucucuggauucagacaguuccuggcuccuccacuuaugagcugugugaccuagggcaagc

SEQ ID NO: 4181538 - RNA, 57 nt, Human
gcuugauggcuucaaaugauagaaauguauucucucucaguuccagaggcuacaagu

SEQ ID NO: 4181539 - RNA, 60 nt, Human
gcuugauugaacuccugaauguuugaaucucuucaugauuuuaggaaguuuaaggcaggu

SEQ ID NO: 4181540 - RNA, 72 nt, Human
ggagcaggagaacaaagcaagcugccccagaccacccggcuuucgcagaacccagaugaugcuccugucucc

SEQ ID NO: 4181541 - RNA, 56 nt, Human
ggagcaggagacacuagcugaccuauauguggucagcucagaguguguccuguuuc

SEQ ID NO: 4181542 - RNA, 103 nt, Human
ggagcaguaagagaugugcagaugagggaugaaaaugaaggcaagaccuuuuauucuacacauuuuuauaacuugauucugcauucaaauuuuuugaucaucu

SEQ ID NO: 4181543 - RNA, 56 nt, Human
ggagcauaaucagcagcucuaccuuaagggcaguggugggauuguuuuuuagcuuc

SEQ ID NO: 4181544 - RNA, 88 nt, Human
ggagcaucgcucugucgcccaggcuggagugcaguggcacgaucucggcucacuacaaccuccgccuuccagguucaagcgauucucc

SEQ ID NO: 4181545 - RNA, 80 nt, Human
ggagcaugauucauagaaagcaucaauucucccuuauauagaaugagcccagggaauuccuuucaaauuaucauggcuuc

SEQ ID NO: 4181546 - RNA, 69 nt, Human
ggagcaugcgcucugugaccgagugagaauuuacccaaccccgcaaaauugaccaagggugcgugcucc

SEQ ID NO: 4181547 - RNA, 56 nt, Human
ggagcauguggacaguuguggcugcuccugagcugacacuaacugcucaugacucc

SEQ ID NO: 4181548 - RNA, 58 nt, Human
ggagcauucucagcuacaagacccaaagcccagcuuugcuuucaucaugagaugcucc

SEQ ID NO: 4181549 - RNA, 73 nt, Human
ggagccagcgcuguagccaugaacgcuuucaggaaggaaaggaagagcagucaggccucagagccguggcucu

SEQ ID NO: 4181550 - RNA, 58 nt, Human
ggagccauauuugcauugaauugugucaauucucagcacauuuaagcagauguggacc

SEQ ID NO: 4181551 - RNA, 67 nt, Human
gcuugucagguguuuauugaagcuagcuuggguuguucugugagagugucuaaacacagggacaagc

SEQ ID NO: 4181552 - RNA, 57 nt, Human
gcuugucaguuugucccuggguaaggcauuuucauacccagagauggaccuggcugc

SEQ ID NO: 4181553 - RNA, 62 nt, Human
gcuugucugcugagccaccuguuucauauccaagacacaguaagcauauuucaguagaaagu

SEQ ID NO: 4181554 - RNA, 57 nt, Human
gcuugucuugccugcucauccucauugccuggaaaugaaugaauaaggcaggaaagc

SEQ ID NO: 4181555 - RNA, 84 nt, Human
gcuugugagcuugaaacguaccaacauugcucuuucaaauaugcaucaauugaauaugcaguuugguacuuuucuagcaaaagu

SEQ ID NO: 4181556 - RNA, 106 nt, Human
gcuuguguacauaaaauggcauaucaacucauccuuuauagaugcgagguauauuuuacuuccagcauauauagagaaugagcgguucuuauuuaugcaaauaagc

SEQ ID NO: 4181557 - RNA, 64 nt, Human
gcuugugugucucuugagcugccugaugcuuguuuuucaaguggucuguaaagagcacgugagu

SEQ ID NO: 4181558 - RNA, 68 nt, Human
gcuuguuucugcaucagcuagcaauuaaaguuuaaacuguugaacaugcagcuugcuguaggcuaagu

SEQ ID NO: 4181559 - RNA, 100 nt, Human
gcuuguuuuaaauguuaagaguauaauuagugucuucuaaagaaacuaaauuuacuuuuucuuguagaagcaaguuuugcucuucacgcacacaaaaagc

SEQ ID NO: 4181560 - RNA, 86 nt, Human
gcuuuaaaaaucuuuuucagaugagcccuggauauuauuguaccuguagagagauauuuauucauacugucagauaaauguagagc

SEQ ID NO: 4181561 - RNA, 79 nt, Human
gcuuuaagagaaguacauucugauagggaagggaagcuaucugccuuuguccuccugaggauuacuuuacucuuggagu

SEQ ID NO: 4181562 - RNA, 117 nt, Human
gcuuuaagauaauauuuuugaugaaaucuccaauguguuaaugagcaaugaccuaaauuuuaggucccugguaauugacacacaugggguuuauuuuaugcaauagcacauugaggc

SEQ ID NO: 4181563 - RNA, 67 nt, Human
gcuuuaaggugaugagagaugcuucuggaugguccugggagccuguguccuucucacauucaggagu

SEQ ID NO: 4181564 - RNA, 60 nt, Human
gcuuuacaaguggugcagauuagaaugucaaguccaauguguuuuauucacuuguagagc

SEQ ID NO: 4181565 - RNA, 56 nt, Human
gcuuuacgggagguuugucccauguuacuggagauaaauuacuaucucccuagagc

SEQ ID NO: 4181566 - RNA, 64 nt, Human
gcuuuaggcuuuuguagcuuuccauuccucauguucaguugauagcugcagucaagccagaggu

SEQ ID NO: 4181567 - RNA, 56 nt, Human
gcuuuaguuguaaguuucuuuggguuauggacccuuuugagaagcugauugaaugc

SEQ ID NO: 4181568 - RNA, 60 nt, Human
gcuuuaugggccaugcggugucugguauaacauucaagucugccguugcagcucaaaagc

SEQ ID NO: 4181569 - RNA, 63 nt, Human
gcuuuauuaauaacaauuguaggacaugacagucucugucaguguuuaccguauguuguuggc

SEQ ID NO: 4181570 - RNA, 59 nt, Human
gcuuucaacccuguaccuguuuacugcguugaucucaccaccaggugcagaggcagagc

SEQ ID NO: 4181571 - RNA, 82 nt, Human
gcuuucaagaacuucccugagacuggguaauuuauaaacaaaagagguuuaauugauucacagucuguagggcuggggaggc

SEQ ID NO: 4181572 - RNA, 72 nt, Human
gcuuucagaugguguagcaugugauaugaccaguggauccuguggucaugggaccaugcuuaccucuuuugc

SEQ ID NO: 4181573 - RNA, 61 nt, Human
gcuuucagccuacaggguugucuguaacaacuucucaacaaugcugucuuagcaugaaagc

SEQ ID NO: 4181574 - RNA, 65 nt, Human
gcuuuccucuggggccaccucuucagcucuuguccuagcugagugaggaagcgguggaggauggc

SEQ ID NO: 4181575 - RNA, 91 nt, Human
gcuuuccuugugcuuacucugugggugugauuuggguuuccuccaacauauuuuccaagagugaagguucucagaggacacaggagaaugu

SEQ ID NO: 4181576 - RNA, 73 nt, Human
gcuuucuaaguucugcuuuuauugccagaguuguugccuuauaccuuugaaauauagugaagucauggagagc

SEQ ID NO: 4181577 - RNA, 78 nt, Human
gcuuucucaugcauguaggaacucacagauauucucaaagaagacauuggagaagaagagcuccucagcagagugagc

SEQ ID NO: 4181578 - RNA, 125 nt, Human
gcuuucucuaggaucucaacaaucuuguucacuuugggucuguuuagcugagaaggggagugaagauccaccuuucauugaccuggaagacccuaaggcgaggccaaccugaccuuguggcuggc

SEQ ID NO: 4181579 - RNA, 62 nt, Human
gcuuucugccugggcuccauuucccugcacuggaauuuggaaauuucccacaggcagaaagc

SEQ ID NO: 4181580 - RNA, 58 nt, Human
gcuuucugcucuguaaaauggggauuacgaaucccauuagucuuacaaagaagagggu

SEQ ID NO: 4181581 - RNA, 71 nt, Human
gcuuucuucuuguucucuggaaauccccuuuccugaggugcacugauuucuagcagggcaggaaagaaugu

SEQ ID NO: 4181582 - RNA, 85 nt, Human
gcuuugaacugcugagguauacuaugugacggugaugaaugaacacguggaaagucgacggcaguguagcuuagugguugggagc

SEQ ID NO: 4181583 - RNA, 80 nt, Human
gcuuugacauucuaugaaaacuaggcaauauacauuuaaucaacauucgucuauugacuguucauagaaugaugccaggc

SEQ ID NO: 4181584 - RNA, 75 nt, Human
gcuuugagguaguuccauuacaaacauguuaagauuuuuaaaaauucagucagguuggugaggaccacacaaagc

SEQ ID NO: 4181585 - RNA, 58 nt, Human
gcuuugaggugcugaagauaucaugacagugaucgaguuuguccacagcccucacagc

SEQ ID NO: 4181586 - RNA, 95 nt, Human
gcuuugagugcacccagcagggggcauccuugcccuuccacugcccacccuggaggggugagacuggcccacugcaggguugcccucuacccagc

SEQ ID NO: 4181587 - RNA, 77 nt, Human
gcuuugcaaggacgggcuccagguagugacggcaaccagcccccuccacguguccuggcucuguccucgcgcaaagc

SEQ ID NO: 4181588 - RNA, 57 nt, Human
gcuuugcaggaaaccagugcauccguguucgagcgguuuugggauccucugccaagu

SEQ ID NO: 4181589 - RNA, 91 nt, Human
gcuuugcauuuaaauuggcucagcaucuuggugccaguggaauuuaccaggcuggugagagcucagcucagauuucucaaugcuucacagc

SEQ ID NO: 4181590 - RNA, 71 nt, Human
gcuuugcugggugcuucauguauguuaucucaucaaaucuccaacaaccuugugaggcagcuaguauuagc

SEQ ID NO: 4181591 - RNA, 92 nt, Human
gcuuuggaaagcuagacuuuuacaaauccccagucucuaaaaguuuucccacgaugaauuuuggggcaggaggaagaguuagcacccagggc

SEQ ID NO: 4181592 - RNA, 108 nt, Human
gcuuuggaaaugugaaaaugcuguguaaauguuaagaaauacuaaguauagggccagaagcuauacaguguuucacuuaaccguuugccauucuguauuuaccaaggu

SEQ ID NO: 4181593 - RNA, 80 nt, Human
ggauguacuacauuuguucuauagcuuuugggaaacauauuuaccaaacagcuugaagggaauaauuugucaaggcaucc

SEQ ID NO: 4181594 - RNA, 70 nt, Human
ggauguagugcaaggagugaauuucaucaguucuauauaaaaagagauuucaccuugaucacugcugucu

SEQ ID NO: 4181595 - RNA, 57 nt, Human
ggaugucaaucaguagaauuaacuugaggguccaaggccauuuuuauugugacagcc

SEQ ID NO: 4181596 - RNA, 81 nt, Human
ggaugucagcaaagcucuuugaccugggccuggcagucaucacucuggucccaucuggucaggguggcugagcugaccucc

SEQ ID NO: 4181597 - RNA, 55 nt, Human
ggaugucuaggguuuaugugccuccagggaagaaucagaaagcccaagacaaucc

SEQ ID NO: 4181598 - RNA, 124 nt, Human
ggaugucuccucccuccccaugauuuucauuuguugugacauucucuucaguugguuuauuugagaggugguaucaggaagcuaaccagggagugagaagugagacaaggaagggaaggaagcc

SEQ ID NO: 4181599 - RNA, 62 nt, Human
ggaugugaaagaagauuuagaugcccagaaauuucagcaucuaaaauucaucauuuacguuc

SEQ ID NO: 4181600 - RNA, 71 nt, Human
ggaugugacaugccugggccguggagcacucugagaucucaucgcggacaccacugcccacaccuccaucc

SEQ ID NO: 4181601 - RNA, 87 nt, Human
ggaugugccugauauaaaugugugucuuucauuucaugaggcauuguauuauauauguccauuagaacacguuucuuagucauguuc

SEQ ID NO: 4181602 - RNA, 74 nt, Human
ggaugugggugguuuuggaggccacuguuuggcccacuauaggauauaaauaaaggucuuuagugcaaacaucc

SEQ ID NO: 4181603 - RNA, 74 nt, Human
ggaugugucuuggcuacuuugcugcccagcagugccugcucucaggcacaugugagaguagaggccuagcaucc

SEQ ID NO: 4181604 - RNA, 83 nt, Human
ggauguuaggccagccuugauggaugaggaaguuucauuuaggggcuccugucacuucccaucuucaggccaagcugacaucc

SEQ ID NO: 4181605 - RNA, 63 nt, Human
ggauguuccugagaaauaaagagagagcaaaagaaccagagcucuuuuaacaccaggaauucc

SEQ ID NO: 4181606 - RNA, 56 nt, Human
ggauguugggggcggcugcaugcauucccugcaccugggcugccuucugcucaucu

SEQ ID NO: 4181607 - RNA, 62 nt, Human
ggauguuguuuuugucccagaaggugucauuacagccccuuaggggugacagaaauaccacc

SEQ ID NO: 4181608 - RNA, 64 nt, Human
ggauguuuucuggccacuuuuccagugaaauaaaaugaaugggaauuuaguggcagauaauacc

SEQ ID NO: 4181609 - RNA, 78 nt, Human
ggauuaacaaagcaaugaaucgaguugcuuguuuugugaauucaagcucacuaucacagguacacuugauugcaaucc

SEQ ID NO: 4181610 - RNA, 84 nt, Human
ggauuaagugcauuuuauagugagguacagauuugauaguaaauuuacauagacuuugcacuucaauauaacuugguuuagucc

SEQ ID NO: 4181611 - RNA, 100 nt, Human
ggauuagaugaguuaaugcauguaaugggcugauagugccuggcucauagcaagcacauaaccaaugucagcuauuaguauuauuaaaaaauuuugaucu

SEQ ID NO: 4181612 - RNA, 70 nt, Human
ggauuaggcagccauucaguagacucaagcugcuacucugcuacuacuagaucaguaugccucaaaaucu

SEQ ID NO: 4181613 - RNA, 99 nt, Human
ggauuauaucuuucuaauguggcaugugaaauauuaagccgaggaaguaucaacugaaauauuuacuuuauuuuauaggucauuaaagaaaaagaaucc

SEQ ID NO: 4181614 - RNA, 74 nt, Human
ggauuaugcagacuuuccagguccugggcuaugaugaaauuauagcuggaggcuuguaaagucgugcacuguuu

SEQ ID NO: 4181615 - RNA, 92 nt, Human
ggauucaaaauauagauuauuuaaauuuguuuauaggucuuuaucaguuuaugcuuauucagcaaguuuggguacuucuguugcuaugaucc

SEQ ID NO: 4181616 - RNA, 62 nt, Human
ggauucaagaucgaguuuaaagugaucuucaaaaugauuaaagccaucuagauuuugaguuu

SEQ ID NO: 4181617 - RNA, 90 nt, Human
ggauucagaaaaauguaaauaugcguguuugucuagagaaagagagaaugauaaaguaaaugugcuaaaguauuaacauuuggagaaucu

SEQ ID NO: 4181618 - RNA, 96 nt, Human
ggauucagaucucuagaaaaguuuccagucuagugugggaaaugugaaaugaaguguauuucuccaacugcacuguucuuuucuacaaucucaucc

SEQ ID NO: 4181619 - RNA, 70 nt, Human
ggauucaguuugccaguauuuuauugaugauuuuugcaucaauguucaucagguauauuggccugaauuu

SEQ ID NO: 4181620 - RNA, 59 nt, Human
ggauuccauuagcugagauaucuugugauagggagagguaucacaguagaauaggaucu

SEQ ID NO: 4181621 - RNA, 92 nt, Human
ggauucgcaguugaaugauuuaugugugacuuaggaaaggagauaauugcaaaacuauuucuaaucuuuaguuacaaaaugaacuguauucc

SEQ ID NO: 4181622 - RNA, 76 nt, Human
ggauucuugaggaaagagugcaaagaggaacguccccacccacuuucccucuaccuggcaucauucccaguaaucc

SEQ ID NO: 4181623 - RNA, 68 nt, Human
ggauugaagagaagcuaaauagagaagauaauucuucaauuuaguuuugcuuuucaaaauuaaguucc

SEQ ID NO: 4181624 - RNA, 60 nt, Human
ggauugacagguuguguagguggccaguaaacagacuuuugguuucuaagcugucagucu

SEQ ID NO: 4181625 - RNA, 75 nt, Human
ggcaguaaggggugagggugugucagccugaguuaaagaccaggaugugaguggacacaguccuuccaagcugcc

SEQ ID NO: 4181626 - RNA, 74 nt, Human
ggcaguauaacuuccacuguugccauaaguguguucugaaagaggaaggacagcuaugacagauggauaaugcc

SEQ ID NO: 4181627 - RNA, 91 nt, Human
ggcaguauccaugauuuucaauauccgaguagccuaagacaguucauuuuugaacucuagugcuccuuggaggaaaacaaaugaauuugcu

SEQ ID NO: 4181628 - RNA, 86 nt, Human
ggcagucacauaaguugcagagggugcauuggacaccaggcccuccagaugccaacucucucugcagcucucugacuauccaugcc

SEQ ID NO: 4181629 - RNA, 96 nt, Human
ggcagucacguguauauuucacauuccgcggcuauuuucauggccuuacugggaaaugugccugggaauuagauuuucuuauacacgugucaagcc

SEQ ID NO: 4181630 - RNA, 57 nt, Human
ggcaguccaaaguggcucucaccaaaauuauuuggguaguguggucucugggcuggc

SEQ ID NO: 4181631 - RNA, 73 nt, Human
ggcaguccaggcggguauagaggcucagagaaauccuuaaggauugaagcucuuuuuaucuuccugaucugcu

SEQ ID NO: 4181632 - RNA, 73 nt, Human
ggcaguccugcuccaccgugggcuggacgaagacaucaucuacuccagggcauccacgcguggggugggagcc

SEQ ID NO: 4181633 - RNA, 83 nt, Human
ggcagucuggccccagcaucagugcucuuaugacucaacacaccaccugucugggacugcucuugcugggguccaagccugcu

SEQ ID NO: 4181634 - RNA, 55 nt, Human
ggcagugacuggggacccccaaaaaggauaagcuuguggguauccagaacugguc

SEQ ID NO: 4181635 - RNA, 68 nt, Human
ggcagugagaugaacauauuccucuccagauugcauauuugcaggauacuauguuccucuauuuugcc

SEQ ID NO: 4181636 - RNA, 104 nt, Human
ggcagugagcacaaaggaguaggggagcaucugugaugguuaauuuuaugugucaacuugacuugguuaccagaugcccagauauuuguuucaacguuauugcu

SEQ ID NO: 4181637 - RNA, 63 nt, Human
ggcagugaggucauguaauuugaugucuuauaauaggaguucccaaauuacaggccacagacc

SEQ ID NO: 4181638 - RNA, 89 nt, Human
ggcagugaguacccagugucuggcgauaagggagccuccgcagaugugucuguugcuggucugcaggcucaccugccagggccacuucc

SEQ ID NO: 4181639 - RNA, 58 nt, Human
ggcagugcuuucauuaagcuuugugaauucccccauaaagcaaagucaagugcacucc

SEQ ID NO: 4181640 - RNA, 67 nt, Human
ggcaguggaaauaguuugguuauagagguguugaaaaucucugucaaaaacuucuuucucacuagcc

SEQ ID NO: 4181641 - RNA, 78 nt, Human
ggcagugggccuggagcccuggagaguuggugccagugagagagacguggugcauuagcagaggcugggccugaggcc

SEQ ID NO: 4181642 - RNA, 63 nt, Human
ggcagugguacuuagcguggcaucauggacauaaaaguguacauguauguguuaauaucugcc

SEQ ID NO: 4181643 - RNA, 62 nt, Human
ggcaguguggcauaacauguaggaagcaugacaagcuguggacuuacucaggccacacugcc

SEQ ID NO: 4181644 - RNA, 67 nt, Human
ggcaguguuaagaaauauuauuuuugucauguucuaaugcaguagauaggcacuuuuaugcacugcc

SEQ ID NO: 4181645 - RNA, 65 nt, Human
ggcaguguuuauggguaacacaugugcacacuuggcauugauaacccuguuucccaaauacuccc

SEQ ID NO: 4181646 - RNA, 58 nt, Human
ggcaguuauguuuuaaguucuuugggaagucuccaaacugcuuuccacaguggcuacc

SEQ ID NO: 4181647 - RNA, 59 nt, Human
ggcaguucucauccucgaucuucuuguucagagaacaaucaaguuuugaugaggaagcc

SEQ ID NO: 4181648 - RNA, 100 nt, Human
ggcaguucucgggagugcuucugcgugugugauaugccucugcacacaugucuugugcaugugggagugucacaugcugcacgaggcucaccugucugcc

SEQ ID NO: 4181649 - RNA, 60 nt, Human
ggcaguugcgugcaucagugguugguuccucucgguugcguggacguacugcagcuugcu

SEQ ID NO: 4181650 - RNA, 84 nt, Human
ggcaguuuauuugcugauuucaguuucagaauuaagauaaaauugugaaaacaaauaccugaaaucugcaaguugaaacuugcc

SEQ ID NO: 4181651 - RNA, 71 nt, Human
ggcaguuucugagguuccagguuuugagauuugugaccccauagagagaacucgaauuucagaggacugcc

SEQ ID NO: 4181652 - RNA, 76 nt, Human
ggcauaaggaaggcagccaugugcuuugggucauguuaguaaaaagacucagagcuuggcuccuugcugacaugcc

SEQ ID NO: 4181653 - RNA, 55 nt, Human
ggcauacgguuuguucacugaagagaaaaaaguucucugaacaaaauguaauguc

SEQ ID NO: 4181654 - RNA, 61 nt, Human
ggcauagcagggaugucagcaaguagaaaagcuaggucuacuaugguuauuaucccucucc

SEQ ID NO: 4181655 - RNA, 65 nt, Human
ggcauauuauaaguuauuucaaguugcaucuuauuuuaaaugaacuuggaucagcuuuaaaugcc

SEQ ID NO: 4181656 - RNA, 61 nt, Human
ggcaucaccaggucagagaauggcugggguguaauugagaaguucuuuggugguggugacc

SEQ ID NO: 4181657 - RNA, 61 nt, Human
ggcaucaguauggccauaggguuguuggagcuggcuuccaugcuaggccauauugguugcu

SEQ ID NO: 4181658 - RNA, 56 nt, Human
ggcauccaacucaccuggguaugagucccagcucugccuuuuacuagcuggauguc

SEQ ID NO: 4181659 - RNA, 56 nt, Human
ggcauccugggacuggcuucuuugugaaagacaaucagagagcagaacugggugcc

SEQ ID NO: 4181660 - RNA, 60 nt, Human
ggcaucggaggcugaaguuucccggguugaccaacccuggcuccuuaucucuccuaugcc

SEQ ID NO: 4181661 - RNA, 117 nt, Human
ggcaucugcugcucccuuugcauaagacgggaggguauacguuuccugagcugaucugacucugagagccagggugggugaaugcuauuuuguugcugguagagggaucugugggcc

SEQ ID NO: 4181662 - RNA, 70 nt, Human
ggcaucuugggaacugccuugccuuuggaaggccaaauguaauaaggaguuucccagucagaagaaugcc

SEQ ID NO: 4181663 - RNA, 56 nt, Human
ggcaucuuguggggcuucaggaaaccuuuccgugugagcagcccacuaggaaugcc

SEQ ID NO: 4181664 - RNA, 59 nt, Human
ggcaucuuugcacccucaaaaccugagcaccgccccggcacagagugggugcagagacc

SEQ ID NO: 4181665 - RNA, 67 nt, Human
ggcaugaaggcccagcgugaccucagugagcauguccuccaacuucugaaucagcuggugccugacc

SEQ ID NO: 4181666 - RNA, 69 nt, Human
ggcaugagcuggggcggauacucagcucuucauccgaggcugcaggcugguucugcccacagcaauccc

SEQ ID NO: 4181667 - RNA, 113 nt, Human
ggcaugaguuaccaagggaugauugcauugccaucugcuguaacaguuuuacaauguuaauauauuguuugcaacaacuagauggaggucaagucuuucuugaugauuuuguc

SEQ ID NO: 4181668 - RNA, 60 nt, Human
ggcaugauggcugaggcuucugcagcuauuuugugaucuugaggcuucaggccacaugcu

SEQ ID NO: 4181669 - RNA, 70 nt, Human
ggcaugcauacguagugauuuucuaacaauggguaucaugaaacagaaucacucauguaggcaguuugcc

SEQ ID NO: 4181670 - RNA, 56 nt, Human
ggcaugcauguuguuuuagguguguuugagaugccugaagaacaucaguguauccc

SEQ ID NO: 4181671 - RNA, 60 nt, Human
ggcaugcauuacaugggauaugcccuagcagggggugggcguuaacauguguuguaugcu

SEQ ID NO: 4181672 - RNA, 70 nt, Human
ggcauggcccaggcaggcugguacuagauaaugugugggggccauauggugauagucccuggcccguguc

SEQ ID NO: 4181673 - RNA, 73 nt, Human
ggcauggcuucugguuuauccuuauauucccuuuugggaaauacugucacagggauaccauggggcccaaacc

SEQ ID NO: 4181674 - RNA, 55 nt, Human
ggcaugggagugagcaaccuuauacuaaaucaauaaguugcuaagacuccuagcu

SEQ ID NO: 4181675 - RNA, 68 nt, Human
ggcaugguaaucaggacacuucuggggauuucagaguaagcuuacucuccuguccuaauuaccacccc

SEQ ID NO: 4181676 - RNA, 86 nt, Human
ggcauguauggucauuauccuaguaucuugaaugggcagagcauguaauucauacccuguagaauagaauggugaccaaacagacc

SEQ ID NO: 4181677 - RNA, 79 nt, Human
ggcaugucagagaccuggaccagagugggugcuggggucuggagcaccucagcccagcucaggucuuucuguccauccc

SEQ ID NO: 4181678 - RNA, 74 nt, Human
ggaagucugguuauugggucaaaggauaugaacguuuuuuuaugucucuuguuaaugauuacuaaauugcuucc

SEQ ID NO: 4181679 - RNA, 64 nt, Human
ggaagugaagcccauuuuuagcugugacagucucacaguugacaaaggaaugguauucauuucc

SEQ ID NO: 4181680 - RNA, 78 nt, Human
ggaagugacguuugagcugaaauguuaauaauuacaauaaaaauaaugauuaaaauuuaacuuaguuaacgugcuucc

SEQ ID NO: 4181681 - RNA, 91 nt, Human
ggaaguggauuccacccaggaaggagcuguguauuucaucaagugaguaagacgcaguuuccuuucugaugucgcuguugguucuacuuuc

SEQ ID NO: 4181682 - RNA, 68 nt, Human
ggaagugguuugagcacagugcugagcuaagcaaguuuuagaagcacugaaucagaccacgugcagcc

SEQ ID NO: 4181683 - RNA, 117 nt, Human
ggaagugugucccucuagcugcugagcuugcuacauagaucagaucugacuggaggaagcgggguuucuggaugugaagaugaguuagguagcuagagcugggauuguacaccuucc

SEQ ID NO: 4181684 - RNA, 65 nt, Human
ggaaguuaacauuugagcuaaaaggcagaaaugaaucaggcuuucuggcugaagugaugaauucc

SEQ ID NO: 4181685 - RNA, 117 nt, Human
ggaaguuaagaaacuauaguuuuccagccuuuggacucccagagcugcucuccuguuuuuucuccgcaguacucagccuggagagcauucuuagucuguuuggagaauauuaacucc

SEQ ID NO: 4181686 - RNA, 83 nt, Human
ggaaguuauugguggagagcacugguguuccuggcuaauguggggucugugauucaguguucucccaggucagugcugcuucc

SEQ ID NO: 4181687 - RNA, 64 nt, Human
ggaaguuguaugaucggggaaucuaaagcccggaguagaauccccagagagaaguacagcuucu

SEQ ID NO: 4181688 - RNA, 84 nt, Human
ggaaguuguggguugugcagaagugccucaguaaugagaacuugguccuucaaugcugcugcuucuguacagccuuucgccucc

SEQ ID NO: 4181689 - RNA, 83 nt, Human
ggaaguuuuaaaaaaaucugucauuuuccaaacccuuagcaauauaagguaucugguaagaggcagacaguuuagaagcaucc

SEQ ID NO: 4181690 - RNA, 76 nt, Human
ggaauaaaacugaauuuuaaauacaggccccaucccuuguuagauagaaggccuugggaaaauuaguuaauauucc

SEQ ID NO: 4181691 - RNA, 80 nt, Human
ggaauaaggaaagacuggggccccagaagacaaacccagcacccaggccccugcuggcagccccagcuuuaacuuagucc

SEQ ID NO: 4181692 - RNA, 68 nt, Human
ggaauaaucaugagagccaccaugcuucuguguccucauagucacacaguggcuuucauuauuauuuu

SEQ ID NO: 4181693 - RNA, 66 nt, Human
ggaauaaugucagucuuuugcugcugggcacagcacacagagcgaugcagcugaaaguaugacacc

SEQ ID NO: 4181694 - RNA, 90 nt, Human
ggaauaauuauuuucuguuuucucuaggauuggguucaaggauaggaugggaaagaacccagaacugggcaacagaaaguaaaagcuucc

SEQ ID NO: 4181695 - RNA, 57 nt, Human
ggaauaauugucaacuaugcuacacagaaguuuagaaaugaaggagauaauuguucc

SEQ ID NO: 4181696 - RNA, 97 nt, Human
ggaauacagcaaugagcaaaacagaugagaucucugccuauauggauguuacuauccaauggggagugaguucuugaacaagucauugcuaaagucc

SEQ ID NO: 4181697 - RNA, 81 nt, Human
ggaauacgguguucgaggugugaccugaguggugcaggaaucaugcugcugucaccucccuccaucuggacacuauauuuc

SEQ ID NO: 4181698 - RNA, 83 nt, Human
ggaauacuucuggcaguggaggaagaaaacucacacacgugaguugggacuuuaucuccaaguugugcuaaguuuaguguuuc

SEQ ID NO: 4181699 - RNA, 66 nt, Human
ggaauaggauuuaccucuguaaccaacaggauacuguggaaaugacagagcguggcuuccaggucu

SEQ ID NO: 4181700 - RNA, 98 nt, Human
ggaauaguaaagucauguuaauauagacagugagcuaugagugguuugauucucaucccaagcugucuugguucgcuguuugaaugacugugaugucc

SEQ ID NO: 4181701 - RNA, 65 nt, Human
ggagugugggauggagcucaggagacacuugauucugucuauggugagcuuaccagcucuuaccc

SEQ ID NO: 4181702 - RNA, 56 nt, Human
ggaguguguuaaggauagggcuugacacaaacacgagguccuaacuuagauacucc

SEQ ID NO: 4181703 - RNA, 74 nt, Human
ggaguguucaguuuuuuuaaaaaaguauaauggaaagccauuggagaguuuuaagaagggaaacaccaugaucc

SEQ ID NO: 4181704 - RNA, 63 nt, Human
ggaguguugaagauaaaguucucauuuugcaagucccaaaaugaugcuuuuuuucagugcacc

SEQ ID NO: 4181705 - RNA, 116 nt, Human
ggaguuaagggagugggggugaguaggggugaaaggagaagguuccagguccuucaccuacagugaagggcucugcugucucuccccuccucugcuucucucccucuuuuuccucc

SEQ ID NO: 4181706 - RNA, 129 nt, Human
ggaguuacuugguuaguuuuuguguuuagccauuuaguagcaacguguuaaaugagacagaauggaaucuggaauuuaaagaucauuucauguuuucuuaaauggcauaugaaagccuaucauaacuuu

SEQ ID NO: 4181707 - RNA, 65 nt, Human
ggaguuagacauccccaguuagcauccucgcuucacuagcuguguaacuuugggcauguugcuuc

SEQ ID NO: 4181708 - RNA, 58 nt, Human
ggaguuagauuuuauccugagggcguugacaauuuucugcaggaguguaaugugaccc

SEQ ID NO: 4181709 - RNA, 77 nt, Human
ggaguuagguacucaaaucgcccucagaggacugacaaggcagccagucauuguagggcauuuagagagcuaauucc

SEQ ID NO: 4181710 - RNA, 57 nt, Human
ggaguuagugaagccuacgaggaugccgccaauugucucugguuauuaacuaacucc

SEQ ID NO: 4181711 - RNA, 90 nt, Human
ggaguucaaacuggaugucuaauuuuucagccuaaggaacucaugaaaaacucuuaucagaaguggcuagaauaauugacuucauucucc

SEQ ID NO: 4181712 - RNA, 60 nt, Human
ggaguucaaaggccuguggaaaggggagaaugcaugccucuccuaaagucauugaauuuc

SEQ ID NO: 4181713 - RNA, 61 nt, Human
ggaguuccaggugagaacaagaaauuuuuauaaugauggccaauuuucaucugggaccacc

SEQ ID NO: 4181714 - RNA, 71 nt, Human
ggaguucugacgggaggugugggagagauucuuuccugugugaggcaggaaacuccccuacaucucaaucc

SEQ ID NO: 4181715 - RNA, 97 nt, Human
ggaguucuguuguguuugaugcugacacgcacccaggcauaauucuuucugcuagacugcccccugcugucugcaacaguacuacaacuagaauucu

SEQ ID NO: 4181716 - RNA, 69 nt, Human
ggaguucuucaacuugcacaugcaucagaaucuccuagagggcucguugaagugcagauugcggagccc

SEQ ID NO: 4181717 - RNA, 77 nt, Human
ggaguugaguuuucguaugcauugcauuugaggaguagacuuguuccaaaggcaguggguauguggaucuuaaguuc

SEQ ID NO: 4181718 - RNA, 130 nt, Human
ggaguuggaacaguucuaggugauguuauaggguauuuacaacagaccuagaugaaugagauauuauaaauuucaauaucuugugucuuugagaauaacccuggaacauuuuuaaaguuguuuuuauuuc

SEQ ID NO: 4181719 - RNA, 56 nt, Human
ggaguugguggagaaguuaggguuucuguccugucuguccuguacccagcaucucc

SEQ ID NO: 4181720 - RNA, 63 nt, Human
ggaguugucuucacgcaacuuuccggcuccuaggcccgcgggggaagcaguggcggcaacucc

SEQ ID NO: 4181721 - RNA, 72 nt, Human
ggaguuucagagacugagugaccuuucugauauugcacagcacaucagagacaaaaccagcacuugaacucc

SEQ ID NO: 4181722 - RNA, 76 nt, Human
ggaguuuccuuagcaggacaugugcagagaagcuaaaggaaggcuguuugcuuguccuguuauucccuggaauucu

SEQ ID NO: 4181723 - RNA, 76 nt, Human
ggaguuucucugagguacaugauuccccauaaaaagaaaggccuucuuguugauggugucagguaacugaagcucu

SEQ ID NO: 4181724 - RNA, 64 nt, Human
ggaguuucuggagaucugccuaugggaggguuaugcgaaaugcucugugucuuugguagacucu

SEQ ID NO: 4181725 - RNA, 57 nt, Human
ggaguuucugucauccuguccccguggcaacgccccccgggaaugauggaagacuuc

SEQ ID NO: 4181726 - RNA, 78 nt, Human
ggaguuugggcccugaauugagacugcucuugacuguucuuggucuugugagagcucucuucauaacggccugaaucc

SEQ ID NO: 4181727 - RNA, 89 nt, Human
ggaguuuugcucuuguugcccaggcuagagugcaauggcaugaucucagcucacugcaacuucugccucccagguucaagcaauucucc

SEQ ID NO: 4181728 - RNA, 109 nt, Human
ggauaaaaggauugguggauucagguucguugcuugguuuccucuaaucaaacaugauuauggaggaauaacagcaaccuuagggcuucuucugaauaucuuuuugacc

SEQ ID NO: 4181729 - RNA, 76 nt, Human
ggauaaacuugcugaugcuguagaucuuagccucuacaugagaucauguggaaaaucugaaagcauuuuagguucc

SEQ ID NO: 4181730 - RNA, 76 nt, Human
ggauaacauucuuuuauggugaaguuacuauaugcauugucaaauggaaugucauaccauaaaagaaaguguuucc

SEQ ID NO: 4181731 - RNA, 56 nt, Human
ggauaacggagagaaaaaggaaagcauucuugcuuuacauccuguuucccguuucc

SEQ ID NO: 4181732 - RNA, 62 nt, Human
ggauaagccaacuucaaacaucugucacccggagacagagcaguucuggagcuggcuaauuc

SEQ ID NO: 4181733 - RNA, 111 nt, Human
ggauaaggguggcauugugaggaucuaaggagauaccaccuaccaaacugcauugaucuaacuuggcauguauuaucuucauagauuuuuacaccaaugccauucuaaucc

SEQ ID NO: 4181734 - RNA, 107 nt, Human
ggauaaguucuggugaaggcacuauuccagguuucuuguuguauccucacauggaggaaagagggugagggaacucugugggauuucuuuuauaaggacgcuaaucc

SEQ ID NO: 4181735 - RNA, 98 nt, Human
ggauaauguccguaagaaucuuuccaguuuugauguaggauucugugaugucaaaaauaagagagauuguauuauugcggauugaaaaauaauuaucu

SEQ ID NO: 4181736 - RNA, 71 nt, Human
ggauaccaguuagccucuuuccccagcccuguucugacagagguggcuggaauagagacugacugguuucc

SEQ ID NO: 4181737 - RNA, 69 nt, Human
ggauaccaugucaagacugaagauccagacuugaggacuuccuccuggauuaaacaguuugauacuucc

SEQ ID NO: 4181738 - RNA, 75 nt, Human
ggauagagacauucauuaagccuuucuguaacuugaaugaaauaucacacagagagauauaauuuguuuugaucu

SEQ ID NO: 4181739 - RNA, 105 nt, Human
ggauagaguggagaugagaacuuaggucuccuggcuuuugucccagugcuuuuaacuccaggacuugucacagugccaggcuucucucaucguccaucaaagucc

SEQ ID NO: 4181740 - RNA, 61 nt, Human
ggauagauauucugcaggucuaauuugggucagcaaauucccauuugcagaaaaucauuuc

SEQ ID NO: 4181741 - RNA, 58 nt, Human
ggauagcuggaaagcccuaccuuggaaauuaguccugggguugaauuguagcugugcc

SEQ ID NO: 4181742 - RNA, 66 nt, Human
ggauaggaaugucuaugcagugagggacaggaggcuuccguguguuucacuagaacguucuuguuu

SEQ ID NO: 4181743 - RNA, 77 nt, Human
ggauaggauaguggguaagaacaugggcuauagaguuaaguagacuuggguucaaauuuuggcuguacugcuuauuc

SEQ ID NO: 4181744 - RNA, 78 nt, Human
ggauagggcccaaguaacuugauuaagguaagaugaaaugagaaauguuugcuccuugaaaauugcuaacaucugucc

SEQ ID NO: 4181745 - RNA, 57 nt, Human
ggauagugggagaaugcuaugugcugagaggguuaaacuagcaaaagccuauuaucc

SEQ ID NO: 4181746 - RNA, 69 nt, Human
ggauaguggguaggagugaagacuuaagauugugcuaagacauuaucagcccguuucugccuucuauuc

SEQ ID NO: 4181747 - RNA, 60 nt, Human
ggauaguuucccugcccucccacuuuuuaaaaauaguuugaugguucaggccagcugucu

SEQ ID NO: 4181748 - RNA, 68 nt, Human
ggauauaaaaagaguucagcaguaucaugauacuggcauacccugcugaaugucucuuugguuuguuu

SEQ ID NO: 4181749 - RNA, 71 nt, Human
ggauauaaccggaagauuguauacucugagaaauguugcuccuucauuucucaaaucuuugcguuguaucu

SEQ ID NO: 4181750 - RNA, 123 nt, Human
ggauauagcacuagccaggacauaacucuacucagcagcauuuaaguuucuucuacuucuaaggaugagguacaaguugcagaaaguuguuuugauuuggucugaauuccuauuguuguauuc

SEQ ID NO: 4181751 - RNA, 61 nt, Human
ggauauauauucguuugggaggccuugucuuucugauugaccuacagauggauauauauuc

SEQ ID NO: 4181752 - RNA, 90 nt, Human
ggauauauggguuuuggaagcagucuauaaaucagcuuugcuuacaguaagcagccauggcuguagaacucuacuuaaaacucuuacucc

SEQ ID NO: 4181753 - RNA, 75 nt, Human
ggauaugaaaccuauuuuuacagcauaaguucuucagugaagauuuaugacuggugaauagaacccaaugugucc

SEQ ID NO: 4181754 - RNA, 115 nt, Human
ggauaugaaggaaguuugaagaagguuuauuuguagaauggauuaagggauugaggucaaucuuuccccuuguauuuucauucauaaaagucaccucagccuucaacaaguauuc

SEQ ID NO: 4181755 - RNA, 79 nt, Human
ggauauguauguucuguuuuguugcuuguuugcuuuuucagaaauagaagcaaguacaauagcaaguaccagcauuucc

SEQ ID NO: 4181756 - RNA, 63 nt, Human
ggauauguugaauuuggggguuugcagagccuucuguccugcagccuuuagaaguucagaucc

SEQ ID NO: 4181757 - RNA, 85 nt, Human
ggauauugaauuauaugguacaaaauuagguagucauauaggucgcugugaugacuuuaagcuaucugauucuaauuuaaaaucc

SEQ ID NO: 4181758 - RNA, 71 nt, Human
ggauauuguacaaugcugagguuugggguaugaauaaucccgucacccaggcacugagcauuguacauucc

SEQ ID NO: 4181759 - RNA, 73 nt, Human
ggauauuuauguuuguuuaguuuaaggaccuaugugcuauugaagguuauauggagcaaauauaauaguguuc

SEQ ID NO: 4181760 - RNA, 97 nt, Human
ggaucaaaggcucucugugguggcugucccauuuuaucuucccguccacauuguuuuagggugggaaggccucugccacugacuugcugaaugaccc

SEQ ID NO: 4181761 - RNA, 92 nt, Human
ggaucacuggucacugcagcuucauaaugagguccuagaggcucuccagagucauuagaggccuuugugaccaugccucuggagacugggcc

SEQ ID NO: 4181762 - RNA, 73 nt, Human
ggaucauggaaucagugaguggcagaggcaggacucaacuugagaaagccuggcucugcagccacuccagacc

SEQ ID NO: 4181763 - RNA, 61 nt, Human
ggaucauggagcugguucuggggaagcuggccaccaccaccacugacaccagcucgguucc

SEQ ID NO: 4181764 - RNA, 66 nt, Human
ggauccuuccagaguuauucucaagcacuuauuuuuaaaaguugauuguuuagauuuggaaggacc

SEQ ID NO: 4181765 - RNA, 78 nt, Human
ggauccuucuccaguuucucuguguccccuguccaccuacacugggccuguacagagaaaacugaucaauaaggauuu

SEQ ID NO: 4181766 - RNA, 64 nt, Human
ggaucuauuuguugugucuaguucaauacuauagaguuggguuggucagaugcugaguggaucu

SEQ ID NO: 4181767 - RNA, 64 nt, Human
ggaucucacagggcugaaaucaagguguagacuggguuguguucucaucuggagccugaggucc

SEQ ID NO: 4181768 - RNA, 81 nt, Human
ggaucucgagccuguguucaagccuguagugugcuaugaucauaccuauaugcauucuagccuggacaacauagugagacc

SEQ ID NO: 4181769 - RNA, 129 nt, Human
ggaucugcauucacagagauaaggagauaagacagauuagucagcaagccagugugcaacuuggcuaaguucaugcacaugaggcugucuuugucuucuggucuccagucucucugcaucuacagauuc

SEQ ID NO: 4181770 - RNA, 92 nt, Human
ggaucugcucaggccccucuguggugggaaccccccggccccccucucccugcugugggucucugucacugaguggccccgugagcaucucu

SEQ ID NO: 4181771 - RNA, 64 nt, Human
ggaucugggcagcccaugcuggccugcaggugcgucacugcaucucaugggcaugccaagcucc

SEQ ID NO: 4181772 - RNA, 130 nt, Human
ggaucuguggagagggaaggacuucauaugcuuccguaaucaucuuuaaaggggagacacccauaauuaggcuagcucuaagggugucuucucuaaggauguggcuauguaaaucucuccccacaauucc

SEQ ID NO: 4181773 - RNA, 62 nt, Human
ggccccuggcagucugccucuucacuguagcuggcugcaaguguagagaagaguugcuggcc

SEQ ID NO: 4181774 - RNA, 112 nt, Human
ggcccggcggcccgggcccagcgaccccggcgaggccccgaagcucucugaaagcuggacagccagucggggccaugcugggccugcccucgcccugcccggacgccgcgcc

SEQ ID NO: 4181775 - RNA, 64 nt, Human
ggcccgggcgaggggagcccagcuagguccacggcggccgccggaggggcuccuguucgccccc

SEQ ID NO: 4181776 - RNA, 105 nt, Human
ggcccuaaaggaguuuaucugacuuggaguggguggaggcgucgagggcaggaagccccuagucccacccgaugccucgccuguccagugugagcuuggaggguc

SEQ ID NO: 4181777 - RNA, 60 nt, Human
ggcccuacaguguggagauuuuagaauuacugccuucucaguucuauagucuucacagcc

SEQ ID NO: 4181778 - RNA, 62 nt, Human
ggcccucagguuggggcugaggaaaggguggagccccaguagcccagccccuaccuguugcc

SEQ ID NO: 4181779 - RNA, 60 nt, Human
ggcccucccugagccaggugggacagauuccugcuguguccaucuggugagugaggagcc

SEQ ID NO: 4181780 - RNA, 65 nt, Human
ggcccucccugggaaaugucaguuucagaggauuuugaagucuaucagaucccagggccugagcc

SEQ ID NO: 4181781 - RNA, 79 nt, Human
ggcccucgugccucaccugcugccccugccccagcguggggaugcaucccaggacacagacagaggcuccaugaggacc

SEQ ID NO: 4181782 - RNA, 56 nt, Human
ggcccucuggggcacacagaggacacuguccaccagccaagucuucccuaagggcc

SEQ ID NO: 4181783 - RNA, 130 nt, Human
ggcccucuguccagccugaucuugcguggaccaugcugagacacccaugcugagacaccugcugcuuuuucuuucucuuuacugugggucccagcugugucugcccagguucagccuggaaaaaauagcc

SEQ ID NO: 4181784 - RNA, 85 nt, Human
ggcccugauccagcagaggagaccacagcugccaaaugcaucgccagcugcaggcccuggcuggguuucuuuaggggaaaaggcc

SEQ ID NO: 4181785 - RNA, 72 nt, Human
ggcccugcagcaggagccaggccuggugcaucccugcauuccacacugcgccugccugaccugugcaaaguc

SEQ ID NO: 4181786 - RNA, 63 nt, Human
ggcccugccuggcaccuucacagacuacugcuucagugugucgagggaggguccagaaggguc

SEQ ID NO: 4181787 - RNA, 68 nt, Human
ggcccugcugggcccugggugcccuagcuccaguggggcucggcggcucccagugccgcagcggggcc

SEQ ID NO: 4181788 - RNA, 123 nt, Human
ggcccuggccacucaccggaagcaguggcgaugguacagccugccgucagccagguagcgcugcaccaagugcacaugcugcuggcaggcugcgcacgugcugcugggggucuggccggugcc

SEQ ID NO: 4181789 - RNA, 62 nt, Human
ggcccuggugaagguguugagugaauggaugugugagcugugggcagcaucuucauuaggcc

SEQ ID NO: 4181790 - RNA, 70 nt, Human
ggcccuucaggagcuggcugcgaaggacacaggagcuuugaaaauguagacgaggccagcccuggcugcc

SEQ ID NO: 4181791 - RNA, 84 nt, Human
ggcccuuccaaacugugucgucugcauagcaacaugcagcccauucgccugucuuuaugcugacgaauauauuucugaaaggcu

SEQ ID NO: 4181792 - RNA, 101 nt, Human
ggauuagagaaugaugcccucaucaacagugucagaugaugcacaugaaagacccgugcaggcccuccccaguuguggaugaggccacucguucugggucc

SEQ ID NO: 4181793 - RNA, 66 nt, Human
ggauuaucaugccugauuauguuacucagcacucuuaagugugaauuuauucucagacaaugaucc

SEQ ID NO: 4181794 - RNA, 117 nt, Human
ggauuaugaagguggaacauuuaccccagacaaagcggaaacuguuuagaaaaggcuucuaucacuguguugucucaugagcauuucuucuuuguuuuuguguccauuuuacacucc

SEQ ID NO: 4181795 - RNA, 57 nt, Human
ggauuauguuuuuagacuugaggauuacauucugucccuuagucuuccacauagucc

SEQ ID NO: 4181796 - RNA, 60 nt, Human
ggauuauuuauuuugcacccaucgccugaccccaagagaugagugcuuagagaguaaucc

SEQ ID NO: 4181797 - RNA, 86 nt, Human
ggauuauuuggauuuguacagugaaagcgagguuauuccaucccugaacuaaccuguaaaaagacuggcagcuuccacuuugaucu

SEQ ID NO: 4181798 - RNA, 76 nt, Human
ggauucaaauccaggcagugugacgcuaggguuuacacuuuguguugaucagugaacuauacugccucuucagucc

SEQ ID NO: 4181799 - RNA, 68 nt, Human
ggauucacgugagggaccugugucugucuaucccacuagcuuaggggcaggauccuuugagccuaucc

SEQ ID NO: 4181800 - RNA, 74 nt, Human
ggauucagaaugguuauucaggguuauguuuuuuaacaaaguuauucauaacaccugauggcaaugaugaauuu

SEQ ID NO: 4181801 - RNA, 57 nt, Human
ggauucagugucuguuaauaguccauuccucauggacugugccuucuuauugggucc

SEQ ID NO: 4181802 - RNA, 63 nt, Human
ggauucccagcugucugcaugaggagggggagucagcugcccuggcaggcagcugggguaucc

SEQ ID NO: 4181803 - RNA, 75 nt, Human
ggauucuauguuuaucuguauuucuguaccuucaguuuuauaucugauagagaauuacagaagaaugucaaaucc

SEQ ID NO: 4181804 - RNA, 57 nt, Human
ggauucugaccugcaaucuaguuaaggaguccuggcugagggggcaguucaggagcc

SEQ ID NO: 4181805 - RNA, 104 nt, Human
ggauucuggccuccugcaggcaucuuucuguccauucagcaggugccacguccccccacauaugcaggguguccggaggaucacugacacgggggccaaugucc

SEQ ID NO: 4181806 - RNA, 64 nt, Human
ggauucugguggucuuggcucuccacagggagaccaggaaagagcuuagucuacucagacaucc

SEQ ID NO: 4181807 - RNA, 59 nt, Human
ggauucuuagggagcagacaucuggguuucccugcuagcugugacucccugggcaaucc

SEQ ID NO: 4181808 - RNA, 80 nt, Human
ggauugacuggagaacuagacccauuuuugugcacagaaauaucugaguaucuagauaguuuagccaucuuucguuuucc

SEQ ID NO: 4181809 - RNA, 71 nt, Human
ggauugaugaaguaucucuucuuuugcaaauauguuauuaccuuugcaaggcagcaggugcaguaucaacc

SEQ ID NO: 4181810 - RNA, 83 nt, Human
ggauugccugagccugggaggcagagguuguagugagccgagauugugccacugcacuucagccugggugacagagcaaggcc

SEQ ID NO: 4181811 - RNA, 72 nt, Human
ggauugcugaaucauaugguaauucuuuuuuaauuuuuugaagagcugccauauguuuuuaaauugugaucu

SEQ ID NO: 4181812 - RNA, 83 nt, Human
ggauugcuugagcacaggagguuggggcugcagugagcugugaucaugccacugcucuccagccuggaugacagagcaagacc

SEQ ID NO: 4181813 - RNA, 70 nt, Human
ggauuggcugugagucaagcugguugaugaagcuucauuuugcuaaaucuccagaauggcuuguuaaucc

SEQ ID NO: 4181814 - RNA, 88 nt, Human
ggauugggauguagacaucuuuagggaccauuauucugccuagcagaguugucuucugaucccaaaagauucacacaugucccaagcc

SEQ ID NO: 4181815 - RNA, 76 nt, Human
ggauugguaucuuuggagaaaguaaugucuaaauucuuugcuucugacugcuuuaccuucccagaaaccacuuucc

SEQ ID NO: 4181816 - RNA, 85 nt, Human
ggauuguucagaggaauuugcuuuucauguuagcagacuaaucacucucuguccuccaucaaauaaagaaauuccuuggauuucc

SEQ ID NO: 4181817 - RNA, 84 nt, Human
ggauuguugugagguugaaaugagauaauucauguggaaugcucagaagagugucugcacauuaucuuauauuauagcaaugcc

SEQ ID NO: 4181818 - RNA, 73 nt, Human
ggauuguuucagcaugaaacaauugagcccauugccuuugcccugggucuuguguuuccuguggaagccaucu

SEQ ID NO: 4181819 - RNA, 59 nt, Human
ggauuuagagcaggaaugcauggugaaaauacucccacaucagcguucuucucuaaacu

SEQ ID NO: 4181820 - RNA, 78 nt, Human
ggauuuagcuugcagaauacuuauucuguauuuugcauuauaaaaauacaauuguaauauuccugagggcugauaucc

SEQ ID NO: 4181821 - RNA, 98 nt, Human
ggauuuauuaaaggguuugagaaaauauuuaauaggcuaagauguuacccugacaagcagagauuaaauguuuuuaauauugaucuuuuauaaagucc

SEQ ID NO: 4181822 - RNA, 59 nt, Human
ggauuugcagagauggcagagccacgucagggcugggcucgagcagcuguguaggaucc

SEQ ID NO: 4181823 - RNA, 59 nt, Human
ggauuugcugcuuuggaacuccacagggugaacugccugggaagcccauagcagcuucc

SEQ ID NO: 4181824 - RNA, 82 nt, Human
ggauuuggggcccagaaucuguuauagcuguuuguauucuccuaggcuggaggccagacagcuagaaacagggccgagaucc

SEQ ID NO: 4181825 - RNA, 76 nt, Human
ggauuugggggcagugaaacuacucucuaugauacaauaauuauagacacauguuauuauacuuucaaccaaaucc

SEQ ID NO: 4181826 - RNA, 73 nt, Human
ggauuuggguggaaggcaggcugggcgacccuugaggagaguugcuguaaguaucuuucuacccccaaaaucc

SEQ ID NO: 4181827 - RNA, 61 nt, Human
ggauuuuaggugauggaguuuagauuuuacuccaggaaaucuaacuucauagcugauuucc

SEQ ID NO: 4181828 - RNA, 78 nt, Human
ggauuuucugagccuucaaauuuuuuuaaaggacuucucagucuggaaagaugaaauuugaauagggauagaaaguuu

SEQ ID NO: 4181829 - RNA, 55 nt, Human
ggcaaaaaguucccaucaguguaucuggaugaaggcuauacuagagcucuuugcc

SEQ ID NO: 4181830 - RNA, 86 nt, Human
ggcaaaaauuuaccuucugcuguaaccuucagagguauuuuauucaauacuuugaugaagcuuauggugaacugacaugauuugcc

SEQ ID NO: 4181831 - RNA, 98 nt, Human
ggcaaaagcugucaaaugcaauucaggaagacaaguguaaugaauauguagcauaauauggguagauuucuuaccggaugcauuuugaauauauugcu

SEQ ID NO: 4181832 - RNA, 59 nt, Human
ggcaaacacaccucggugagaaacugguccuucacagcaugggcacccaggugugugcu

SEQ ID NO: 4181833 - RNA, 83 nt, Human
ggcaaacacuccguggaggcaugcaggcuaggaucaaggcagcaggaggggagccuguaugguugccaugaggggugaguucc

SEQ ID NO: 4181834 - RNA, 82 nt, Human
ggcaaacagcauuggaacucguguuacuuguaugacuucuugagugucguagugucaagcuagaugauuuucaacguuugcc

SEQ ID NO: 4181835 - RNA, 91 nt, Human
ggcaaaccucuuuagugcuuuagaccuuuugggguucuguuaacauaagucuaggccaagaaguaagucuaaacaucaccugaggucugcc

SEQ ID NO: 4181836 - RNA, 89 nt, Human
ggcaaacgugaucuuucuuuccuuugcccaauacaugucaggcucuguguggcaagggcgagggagaggcaugacuaugugucucugcc

SEQ ID NO: 4181837 - RNA, 87 nt, Human
ggcaaacuggagcauguaggcugauguugauacuggagaaagcauuaccaggccuccagguuacuuagccuagcucuccaauuuguu

SEQ ID NO: 4181838 - RNA, 127 nt, Human
ggcaaagacucaaaucuaauaucacugaggcuucugccaggcagagagcaguggccgucugcucaccgcaguggccagugugucuuugugaagagcaauggaggccaggauugaggugaguauuguc

SEQ ID NO: 4181839 - RNA, 60 nt, Human
ggcaaagauaugucuccaaagagauuugugcaucaaauuucuagguucacauguguuucu

SEQ ID NO: 4181840 - RNA, 73 nt, Human
ggcaaaggacuacaaagucagaauaacagguguaauuaacacuucugugugcuggcuuuuugcuccacacgcc

SEQ ID NO: 4181841 - RNA, 127 nt, Human
ggcaaaugugaccugaguucauuuuggauccuuugagaaccuagcacaaugcuguauccguaauagguacucugcugauagguccucagauaugugauuuaaaugcaugaauauauuggacacuguc

SEQ ID NO: 4181842 - RNA, 60 nt, Human
ggcaaauguuaucacuuguaaaagcaauuaagaaaauuguuaggcuguggugacaguguc

SEQ ID NO: 4181843 - RNA, 69 nt, Human
ggcaaauucaaugaucacuggcucaaaacacccccaaguggcauccugagcaggaugguuuaauuuucu

SEQ ID NO: 4181844 - RNA, 77 nt, Human
ggcaacaaggacgucacuuccacggugcaaacaugcuugccaagcugaaguguggagugacaguuuuuggcugagcc

SEQ ID NO: 4181845 - RNA, 130 nt, Human
ggcaacaugacaacgugccuaccuucaccagagagacugcugucaaaaaucacuccauccaugcaaggaggaacgaugcagacacagaaauucucugcugugagggccagcacuguaguauuuacugacc

SEQ ID NO: 4181846 - RNA, 85 nt, Human
ggguccccgaagcccaggcuuccuuggcuuuuagguaaccucaccucugaaucagggcagggaagccugaggugcucggggguuu

SEQ ID NO: 4181847 - RNA, 81 nt, Human
gggucccugccaccaugccccagcagagagugucugggaaaccccugggcugcccugguuggugccacaugguggccaccu

SEQ ID NO: 4181848 - RNA, 61 nt, Human
ggguccugugcccuggguggcgcugaggcucacgcuguacacggggcacggggacaguucc

SEQ ID NO: 4181849 - RNA, 76 nt, Human
ggguccugugggagcauugcuuuguguaucuauuauuccuucauuuuacagagcucucuuugcuacuacaguguuu

SEQ ID NO: 4181850 - RNA, 67 nt, Human
ggguccuucccuuccuuagccucgaagcgggaauaaccacuagacagaaggcugugagggaggacuc

SEQ ID NO: 4181851 - RNA, 67 nt, Human
ggguccuucccuuccuuagccuugaagcgggaauaaccacuagacagaaggcugugagggaggacuc

SEQ ID NO: 4181852 - RNA, 88 nt, Human
gggucgcgccgcgcaggcgcaacagcguggcgcccagcugcguggcgaggcagcggcccagcagcgcuuugcccgcgccccgcggccc

SEQ ID NO: 4181853 - RNA, 118 nt, Human
gggucgucuaguccugguguuccaguucucuaccuucuccagugugguuggcaggugggcguccuggcugauggggguguacacuggacaggaguaggaagaggaaggggcuauuccc

SEQ ID NO: 4181854 - RNA, 58 nt, Human
gggucuaaggcagacagaauauuuggaaucauuuaauugcuuucugcauuagucaccc

SEQ ID NO: 4181855 - RNA, 65 nt, Human
gggucuaugucuaccaagcucacuguagagucacuuuuaccuuuugcuaugguggaaugggaucu

SEQ ID NO: 4181856 - RNA, 55 nt, Human
gggucucaguuuccuccucuguaaaauggaggcaaaugaggauggaaggagaugc

SEQ ID NO: 4181857 - RNA, 110 nt, Human
gggucucauaagauaacccauguguguuaugugggccagggcaagagccagugaaaucugaguccuuccuuuuuacauaaucacauuuguaccugcagcucaugaagccc

SEQ ID NO: 4181858 - RNA, 90 nt, Human
gggucucccuuuugguaucuaauuuccuguauccugauacaauaagagucuuuccuuuuggaguuaggagacaggaugaugucaucaccc

SEQ ID NO: 4181859 - RNA, 77 nt, Human
gggucucuucuguguuuauggcaugcucccucucaaccuucccauccaagugugguugugucuaaauaaggagaccu

SEQ ID NO: 4181860 - RNA, 108 nt, Human
gggucugugcaaguuauggagauuuugccugauucuaagagcucauccaaguacucaauuuaagggugagagcaggguagggcaaagugucauuacucaaacaggccc

SEQ ID NO: 4181861 - RNA, 81 nt, Human
gggucuuaggguagguagguaaacaggacuaauacacuauauuguguaucuuuaggcaaguuacuuaaccucucugggccc

SEQ ID NO: 4181862 - RNA, 101 nt, Human
gggucuucgccgggacuugggacaguguggcuggucuccgagcgucgcccugcggcggagcgcagaauugcagaucaggcacccgagccuugggaggaccc

SEQ ID NO: 4181863 - RNA, 55 nt, Human
gggucuucugauauagguccagcucagcuugcuucuagaccggcuucagaaaccu

SEQ ID NO: 4181864 - RNA, 62 nt, Human
gggucuugcaggcaccucacaauucaguaagccuaguugugcugugaugcaggauagcaccu

SEQ ID NO: 4181865 - RNA, 88 nt, Human
gggucuugcucuguugccuaggcuggagugcaguggcgcaaucucagcucacugcaaccuccaccuccuggguucaagcgauucuccc

SEQ ID NO: 4181866 - RNA, 55 nt, Human
gggugaacacacucuguguguguaugugugaauguauaugcauguguuuucacuu

SEQ ID NO: 4181867 - RNA, 59 nt, Human
gggugaaccagagcuguuuucuccucccagcguagagcugacagcuuggggugucaccu

SEQ ID NO: 4181868 - RNA, 83 nt, Human
gggugaaggaaaucguggcggugccuggcccuggguuaggcgcucucuuucccggcgaggccaccgugguuuccgagcugccc

SEQ ID NO: 4181869 - RNA, 62 nt, Human
gggugaaggaucccucuuggccuggaggcgacuggccugaggcaagaacggguuguucaccc

SEQ ID NO: 4181870 - RNA, 55 nt, Human
gggugaauggauucagaaaauguguuauauagacacaauagaguacuauucagcc

SEQ ID NO: 4181871 - RNA, 72 nt, Human
gggugacagagugagacccugucucaaaauauaaacaaauaggcggggggcaguggcucacgccuguaaucc

SEQ ID NO: 4181872 - RNA, 120 nt, Human
gggugacucugucuugcuauuuauucacuucugcauucgacaaguacuguggacaccugcugugugccaggcacugcucgaggugcuagggggagaucaggaagcaagaaaaaguuuccc

SEQ ID NO: 4181873 - RNA, 73 nt, Human
gggugagaacuguagcacagagcuuugacacuacgaugcuaauggagugucugaaggauuuggcuucuuauuu

SEQ ID NO: 4181874 - RNA, 59 nt, Human
gggugagaagaccuccuggaagguguuuuccauggcauuuaguccuugacuucucuccc

SEQ ID NO: 4181875 - RNA, 68 nt, Human
gggugagacagaaagagcaaaagagcaaagagaaauugaauauauuuugauugcuuuuucuuucaccu

SEQ ID NO: 4181876 - RNA, 55 nt, Human
gggugagagacuugggccaggugccuuacauccgggagccucaguuuccucaccu

SEQ ID NO: 4181877 - RNA, 55 nt, Human
gggugagggcagagugggggcagauagaacucaaaaaccagcucugcaucuuccu

SEQ ID NO: 4181878 - RNA, 75 nt, Human
gggugagugaggucugagcuugagcccaugcucugguugccaaguagggcacauggcacagagcuguguugaccu

SEQ ID NO: 4181879 - RNA, 88 nt, Human
gggugauaagagaugcugacguuuacauuucucuuucuucuucaguuucacaagauaagugaucaacucuguauucucauaucacacu

SEQ ID NO: 4181880 - RNA, 63 nt, Human
gggugauuaaaaacuccggaaacuuacaacugucugaguguaagccuggaauuuuugacuucc

SEQ ID NO: 4181881 - RNA, 59 nt, Human
gggugauucacccaguuucauuguuuaaaaagaugaaauaacuuuugggugaguuauuu

SEQ ID NO: 4181882 - RNA, 60 nt, Human
gggugauucaguugcuuguuaaguuugagaugcacugacuaugcagcuuuugauucaccc

SEQ ID NO: 4181883 - RNA, 71 nt, Human
gggugauuggaauuaauauuuguauacagucaucacuguguaguuauaacagagauaaauuuuaaaagccu

SEQ ID NO: 4181884 - RNA, 64 nt, Human
gggugcagcagggcauccgugcuccaugcugcgcguccagcauggcuggacugcccuugcaccc

SEQ ID NO: 4181885 - RNA, 93 nt, Human
gggugcauucaauauccacucugcacuugacaugcucucagagucuagaccauggcuagcuuugagaauuucaaguugcauugaaaugugccc

SEQ ID NO: 4181886 - RNA, 58 nt, Human
gggugcccgggcgugaugauaucuguguugcgacagccaggugucaugcgugugaccc

SEQ ID NO: 4181887 - RNA, 74 nt, Human
gggugccugccaggacauugcuugaaguagucugccacaaacaagacuuuucagugaagucucagguuucaccc

SEQ ID NO: 4181888 - RNA, 129 nt, Human
gggugccuggcuccacagugcucacaggccuauucuggaccaggagagcaggcgugcagcugcagcauugagcaugggggugccuacaccugccugucugcaggguugucauuagcauggaguccaccu

SEQ ID NO: 4181889 - RNA, 76 nt, Human
gggugcuaacuggggcucccacugcagaacaugaggaucucaguuagugagcucuugggaccucaguuccccaccc

SEQ ID NO: 4181890 - RNA, 81 nt, Human
gggugcugggcugcaagugccaccaucacgucugcccacagggcacaccuugucugagcacaggcagguucugagcugccc

SEQ ID NO: 4181891 - RNA, 67 nt, Human
ggguggaagccagagaggucauucagggcccggccggcuucccgggccagccucccuggcuacacuu

SEQ ID NO: 4181892 - RNA, 61 nt, Human
ggguggacguuaggauuguguagagucacuguugaaucauuuuaucacuaaugucacauuc

SEQ ID NO: 4181893 - RNA, 62 nt, Human
ggguggagaguggcucuaugugggaaagcagaagauauccaccuagcauucaccuccuaccu

SEQ ID NO: 4181894 - RNA, 84 nt, Human
ggguggaggagaugacguguggaaguccuuggagugagcugccacguuagcaccaaaucaccagcacgaucauuccuuccauuu

SEQ ID NO: 4181895 - RNA, 68 nt, Human
ggguggaggcugggggcugccuuccucccuguaaaggggcuggaagucugacagcuucccaaaggccc

SEQ ID NO: 4181896 - RNA, 108 nt, Human
ggguggaggggaaguagaccagaacaggaggccccagaaaguucaaggcacaggaucugucucuguggaaggcuucccugggguccucugguuucauugccacugccc

SEQ ID NO: 4181897 - RNA, 69 nt, Human
ggguggagguggguuuugagauaauugcaaucuuuaucguuugaagccucaagacaccugccuuucccc

SEQ ID NO: 4181898 - RNA, 63 nt, Human
ggguggaugugcaggauccaggcuccuaggcccuagcuuggguccugucuccuuguucugccu

SEQ ID NO: 4181899 - RNA, 59 nt, Human
ggguggauuggaaguuggcugagucuuaaucaaacuacagcccagcugggaucacacuc

SEQ ID NO: 4181900 - RNA, 96 nt, Human
ggguggcaggugguauuggagagugggaggagcacuagcuuuguggccaggccaggcagacaugggaucuauucacagcuuuaccacuucccagcc

SEQ ID NO: 4181901 - RNA, 70 nt, Human
ggguggcauggggagcagcuagaacaaugcagauuuauccacaaucccuuucugcuguucaccaccaccc

SEQ ID NO: 4181902 - RNA, 68 nt, Human
ggguggccgagagggccccagcugaucugagcugcugagucucgggcaggagggcccucucccuuccc

SEQ ID NO: 4181903 - RNA, 75 nt, Human
ggguggcuaagcccucagguaaacaaagacacucucaucaggcgggacucuucaagggccuagaggugaccgccc

SEQ ID NO: 4181904 - RNA, 85 nt, Human
ggguggcucucgggguucuggaacccgguuuuaugguggcacaccaugaggaagggcacacggacccugcuuaguaagcacgccc

SEQ ID NO: 4181905 - RNA, 55 nt, Human
ggguggcugcacuaggcagccagugcacgcaagcagcugcucgcugcagucacuc

SEQ ID NO: 4181906 - RNA, 109 nt, Human
ggguggcuguccccaugggucgccggccuccagcaaacagucacccucccagccucgcgaggagcagggaaggagccugcuugcuagagcccuggucccggcagccccc

SEQ ID NO: 4181907 - RNA, 124 nt, Human
ggguggcuuaaagcaacagagauuuauuugcucacaguuuugggaaccagaaguucaaaaucaagguuuuggcaggguugguuccuucuggaggcucugagggaaaaucuguuccaugccucuc

SEQ ID NO: 4181908 - RNA, 65 nt, Human
gggugggaacaggaugccaggaggugcaaaaauuucugucagucuggcacucuguucccccuccc

SEQ ID NO: 4181909 - RNA, 60 nt, Human
gggugggaaggcuaagggauuggcagcuuguaaggccugggccccuuagccuuuccucuc

SEQ ID NO: 4181910 - RNA, 64 nt, Human
gggugggagaaaugaguaucuauuuucuauucugguucaccaagauccuuaauuucuacuaccc

SEQ ID NO: 4181911 - RNA, 98 nt, Human
gggugggauuugaucuccaccuucugcucccuggccagggcccccugcuucccagggccuugguuggccagcaggucccggggcaucaaucaccgucc

SEQ ID NO: 4181912 - RNA, 77 nt, Human
ggguggggaagcacuuugaacuuaaacugucuuuguguuugcgccuucaguugagcuuuaauugcaguucuccaccu

SEQ ID NO: 4181913 - RNA, 55 nt, Human
ggguggggcaguguggcccguccucuggggcccuggccugagcaccuguccaccu

SEQ ID NO: 4181914 - RNA, 58 nt, Human
gggcucucaaugaagcaugaaucccccuguccuggggugaggaugcagaugagggccu

SEQ ID NO: 4181915 - RNA, 66 nt, Human
gggcucucccacugcaagcccaggcugcugucccagcugcuuauaagauuugggagauaccugccc

SEQ ID NO: 4181916 - RNA, 79 nt, Human
gggcucuccugauuccuggcccagucugccuucccugauguguccacuagcagggaagaagcugguaguaggugagccc

SEQ ID NO: 4181917 - RNA, 70 nt, Human
gggcucuggccuuuaaaaugaccuuauaauuuugagaugauaagucauucuuacaggcuucuaagguccc

SEQ ID NO: 4181918 - RNA, 57 nt, Human
gggcucuguaguuggucauggggccacugggccucagcuugauuucugcagagaccc

SEQ ID NO: 4181919 - RNA, 121 nt, Human
gggcucugucccgagcaacuuuucccccaauaaugcaugcagagcuuccaguggccugggcagcucuccgguggcagccacuggggcccugucacacggggagugcuuucagcaugagccc

SEQ ID NO: 4181920 - RNA, 71 nt, Human
ggguggcagcuguugccaagguguugcugauacaguucugcguauaauuuauuggaaacaggugcuggcuc

SEQ ID NO: 4181921 - RNA, 59 nt, Human
ggguggcaggcccugagcaucccugggggccuggaggcuggggccagggcuugccuucu

SEQ ID NO: 4181922 - RNA, 64 nt, Human
ggguggccggcuacuccaagguaucaauuuaaaucuccaacuaccuugaaggcagaggacaccu

SEQ ID NO: 4181923 - RNA, 98 nt, Human
ggguggcguggacugggcuggaggcugguaacaggcgaugaggacagguccugggcgggcucugagcugccuuuugagcuuccagcucagugcucccc

SEQ ID NO: 4181924 - RNA, 116 nt, Human
ggguggcucagcuucuuggggcuauguagcugagcucgucagcuugggguuccuucuuugcugcccuugcugcgugcuagcacagacuuaccccagcaagacagaacuguucacuc

SEQ ID NO: 4181925 - RNA, 77 nt, Human
ggguggcuggaccagcuucugcaugugauggauacagacucagaccaaggccccaggcagagcuggaaccaggaccc

SEQ ID NO: 4181926 - RNA, 62 nt, Human
ggguggcugggauuaguagcccauguggggaaccuguuggaaugcuuguuccuagcuggccc

SEQ ID NO: 4181927 - RNA, 60 nt, Human
ggguggcugugagcauuaugugagguggcucauuugacaguugcguuuacugccgaaccc

SEQ ID NO: 4181928 - RNA, 56 nt, Human
ggguggcuucuugucauuguccagccuuuagauagaaacacagugagaagucaucu

SEQ ID NO: 4181929 - RNA, 77 nt, Human
gggugggaggcagggagacuaucagccagggucacucccaccauccuggucaccccucucucugcagcccagucccc

SEQ ID NO: 4181930 - RNA, 67 nt, Human
gggugggaugggaggaaggaggcccuugaagacauuuugcaagacuaaaccuuccccucagcuaucc

SEQ ID NO: 4181931 - RNA, 80 nt, Human
gggugggcaccugaggaguaaacucucuaugggaauucuggaagccaguggagaguguagacuucagaguuaucucaccc

SEQ ID NO: 4181932 - RNA, 75 nt, Human
gggugggcauucguugugccgcuuuugagcuuugugggccagagcuggguguagggcuggacaaugagccuccuc

SEQ ID NO: 4181933 - RNA, 88 nt, Human
gggugggcugauauaguuagggaaguguauaggggucaugcaggggcuaucaccucuccuacucccugggaucagcucucagucaccc

SEQ ID NO: 4181934 - RNA, 68 nt, Human
ggguggggagaagagaacagaagagacucguuucugcagaugaggcagcccuucccuucuccccaucu

SEQ ID NO: 4181935 - RNA, 59 nt, Human
ggguggggcuaucucagcuuuugugugggaagccacugcagcuggugguggcucugccu

SEQ ID NO: 4181936 - RNA, 101 nt, Human
ggguggggcucaggcacgaccgucagugggguucagggcuuggucugggaagggcgaggcaggagcaagcccuacaagacaggaguggcuuagcugcacuc

SEQ ID NO: 4181937 - RNA, 66 nt, Human
ggguggggcugauuguguccugcugguagucauggcuuaugaccaguuuauagcgaucugucaccc

SEQ ID NO: 4181938 - RNA, 96 nt, Human
ggguggggcuggggugaggggucagcuccuagcaccccccaaacccacaggguugggcuuggggucaggggucagcucccagcauuccccccaccu

SEQ ID NO: 4181939 - RNA, 65 nt, Human
gggugggggagaugcuuagguccggggaaucucugagauucucggcuuccccucuccccucaccc

SEQ ID NO: 4181940 - RNA, 88 nt, Human
ggguggggguaggucuggaugcugagguucccagggaggugagugggguggcuuucuggcccucagcacugagaccuuguccccaccc

SEQ ID NO: 4181941 - RNA, 97 nt, Human
ggguggggucgcugagucagcaggcaggcugcggucggcucuggucuccgcuggggagccgaggccucucccgcagccgccgcuguggccccagccc

SEQ ID NO: 4181942 - RNA, 62 nt, Human
ggguggggugaggcagccacauuuaacuccagcuaagaaguuaguggaaaauucccccgccc

SEQ ID NO: 4181943 - RNA, 58 nt, Human
gggugggucugggguccucuuggccgcgacgguggcucgcgggcccuggcguccgccc

SEQ ID NO: 4181944 - RNA, 82 nt, Human
gggugggugggagagcuaccugugcauuauaggauguuuugcaacaucccuggcugcuaccagguagcuccccuccccacuc

SEQ ID NO: 4181945 - RNA, 67 nt, Human
gggugggugucacagccuccgucuugcugaaaauaggagcauggucaguggagcugggccccacucc

SEQ ID NO: 4181946 - RNA, 117 nt, Human
gggugguagauauggauucuacacuacagggccgggauggaagcaaagggcuccucuccuuaccaccucccacucccaggcuccaguccagagucuguaaggauuuucugcccaccc

SEQ ID NO: 4181947 - RNA, 69 nt, Human
gggugguggaugucuccacugugggcuucucaaagucugcaggagguaguggggagguccaggccaccc

SEQ ID NO: 4181948 - RNA, 67 nt, Human
gggugguggcugcucaagggaggaggcugcaauuuaaggcacccucugccuugagcagugcccaccc

SEQ ID NO: 4181949 - RNA, 70 nt, Human
gggugguggggaaccccaccauauuuggaucaaacugacacucacauaugcugggauuuccgaacuaccu

SEQ ID NO: 4181950 - RNA, 78 nt, Human
gggugguuccaucauaggugcucaauuaaagucugcugaauggacuggaauaaagugcuuugaucagaggaaucuucc

SEQ ID NO: 4181951 - RNA, 62 nt, Human
gggugguucuggauucuggcagaucugggccccagcacugccacauaaucucagcaugaccu

SEQ ID NO: 4181952 - RNA, 57 nt, Human
ggguguaguguaauaauaacugaacauauuuaucagucacuuuugccugcuacaucc

SEQ ID NO: 4181953 - RNA, 114 nt, Human
gggugucaggcagagggagggaggugucaaccacagagcagagccaggcaagagcacugucagccccacccucagcucugccuguggaggcacacccuacagcugcuuaaccuc

SEQ ID NO: 4181954 - RNA, 72 nt, Human
gggugugacucacacaggccugggcuucaugaugucucuugggagcaggaaggucugugugagucugugucu

SEQ ID NO: 4181955 - RNA, 76 nt, Human
gggugugagcucagccuugggagaccugucagcuucaaccccucaacaucucccuccugugcucagcuacaugccc

SEQ ID NO: 4181956 - RNA, 91 nt, Human
gggugugauugaggcuuauauaauuuguaaaagcaccuaguauguggccuagcaugccagaggugcucaaguaauauccuuaaccucaccc

SEQ ID NO: 4181957 - RNA, 121 nt, Human
ggguguggggugggaguguguuuuuugcuggggaggggauugcaggcuaguuuagggcucacaaagaggccagagagggagcaguagucucucccaucauugguuccucccuccccacccu

SEQ ID NO: 4181958 - RNA, 56 nt, Human
gggugugguggucauggcccagugagaggaugccaggcuguggccgugccagacuc

SEQ ID NO: 4181959 - RNA, 74 nt, Human
ggguguguacuucuuuauuauccauuauaagucagacaaugauuuucagaugcauuguaacgaugugcacauuu

SEQ ID NO: 4181960 - RNA, 79 nt, Human
ggguguguaugugugugugcauauauacauauauaauuuguguauauacauacacacaugaaaauagugggaaacaccc

SEQ ID NO: 4181961 - RNA, 67 nt, Human
gggugugucucuguguccagauuuuuccuuuucuuaggacacauucauacuggauuagggcucaccc

SEQ ID NO: 4181962 - RNA, 96 nt, Human
gggugugugugggggugcugucugccugagaaguggggugccugacaugcaguagauggccucuagauucuaggccagccaucaccuguuugaucc

SEQ ID NO: 4181963 - RNA, 90 nt, Human
ggguguuccugggcggggagguccagccaagcggcaagggucugcgcugugccuuuaguuuuuagguugggccccuccuggggagcaccc

SEQ ID NO: 4181964 - RNA, 66 nt, Human
ggguguucuggucccaggauuucaggugaauaaacugagauucagggaugcagagcaaauuucccc

SEQ ID NO: 4181965 - RNA, 78 nt, Human
ggguguugcuucacuacuucuaggcuccugcagaguccugccucauaggccgcacuggugagugaggccagcaaaccc

SEQ ID NO: 4181966 - RNA, 70 nt, Human
ggguuaaaacaggaagaucagcuaaacaucucuuuuccauggcuggaaaauccuguccuguccugacacc

SEQ ID NO: 4181967 - RNA, 70 nt, Human
ggguuaaauaaacaugagcaucucuucaagcuuugaaauucugugguuuggggauguguauguauuaucc

SEQ ID NO: 4181968 - RNA, 86 nt, Human
ggguuaagccaguccucccucaccucagucugggccucaucaugccccucgcacaugacccagacccagagggaggcagguugccc

SEQ ID NO: 4181969 - RNA, 59 nt, Human
ggguuaaucccauccgugucucaaggccucagcagucuaggggugcagaagggaucccc

SEQ ID NO: 4181970 - RNA, 55 nt, Human
ggguuacaauuuuuaucuguguacuaaaaaguauacaggaaagaaauuugaacuc

SEQ ID NO: 4181971 - RNA, 98 nt, Human
ggguuacugguagcaccucucugguuucagcgaaggggcuucgguuuaugaauuuccuuggaguuaagacccugggaaugagugcaaucuuaaagucc

SEQ ID NO: 4181972 - RNA, 72 nt, Human
ggggaauaauuuaaggaguggcaggccacagugcuggcuguuucuguuagguacuuccugcccacucacccc

SEQ ID NO: 4181973 - RNA, 84 nt, Human
ggggaaugacuuagaucacugucuuccuuuggcuccucaccauguuguguggaggaaacgaaaagcagcucaaguucacuccuc

SEQ ID NO: 4181974 - RNA, 90 nt, Human
ggggaauuuuuaaggugaccaaauaucagauagauuuaucuagaguuuuauauauagguauuucuguguauuugugaccuguaugucucc

SEQ ID NO: 4181975 - RNA, 85 nt, Human
ggggacacagagagguuugcccagagcugccuguuacaggcaauuacugcuguaaauggcccccuuugcgucgacccucuucccc

SEQ ID NO: 4181976 - RNA, 64 nt, Human
ggggacaggaugagaggcccagggaagacuaggcccucuucuuucuccuucucuccucugcccc

SEQ ID NO: 4181977 - RNA, 126 nt, Human
ggggacaguguccuccuuuuacuagauuauggacacagugcuuugugcucucacugcaugagguuaucucugacagugaaugacaagguucuuuggcuuaauucacuaguggaggacagagucccu

SEQ ID NO: 4181978 - RNA, 58 nt, Human
ggggaccaggacuggugguaucucccggaugggggaugagagcuagugcuggcuuccc

SEQ ID NO: 4181979 - RNA, 67 nt, Human
ggggaccuucccuugugccugccuuugcuagcucuuugcuaugccuggggugcucaggccaggccuc

SEQ ID NO: 4181980 - RNA, 60 nt, Human
ggggaccuuuccauuucugagauucuguauauuauuuucaacugcucugggaaggucccc

SEQ ID NO: 4181981 - RNA, 124 nt, Human
ggggacgcugggggcucaggauccagcaaggggcggcaggaguaaaggaggaaggaaugacaggugcaaauaccuucccaccaaagcccuuguugcccucuggcuccuccccagagcugucccc

SEQ ID NO: 4181982 - RNA, 59 nt, Human
ggggacggggccgugggcggggcaucacaguagguguggccugucucacguuccgcccc

SEQ ID NO: 4181983 - RNA, 96 nt, Human
ggggacucgcgucaggacugcgauuccuuucgccugccgagcuguagcggcagugucugcgggcagaggagcggcggccguggcagcagcaucccc

SEQ ID NO: 4181984 - RNA, 76 nt, Human
ggggacugaccugugcaguguaguauguuuagcagcaucccugucuccaacucacuguauacuaauagcaauuccc

SEQ ID NO: 4181985 - RNA, 90 nt, Human
ggggacuggguagguggaaacagcugggagguagaggcggggcccugaggccuguccuguccauaucccacuguguagccccaguccacc

SEQ ID NO: 4181986 - RNA, 75 nt, Human
ggggacugggucccucuagccucagugugagcucauucaaagcacgucugagaguuaagagauggggcugugccc

SEQ ID NO: 4181987 - RNA, 97 nt, Human
ggggacuuauuauaaaugcaaauucuagggcccuauuccagaccuacuguaucagcaacucggguagggccuugcaaucuguguuuugacaagcccc

SEQ ID NO: 4181988 - RNA, 59 nt, Human
ggggagaaucaugugcauguuucaggucuuguucaaaagcagcuuagggaauucucccu

SEQ ID NO: 4181989 - RNA, 105 nt, Human
ggggagaccauugaaguagaagccucaaagcagacuuuucccuuuacuguguguacuccaggacgaagaaggaagaucaugcuugauacuuagauugguuuuccc

SEQ ID NO: 4181990 - RNA, 78 nt, Human
ggggagaguggaggccgaggggcccagguuccugguaggggcuuggcgggagauggggccguucagaguuauuccccu

SEQ ID NO: 4181991 - RNA, 94 nt, Human
ggggagaguuucaucucugcuuccuggagggagagagcugagccccagugacagcuguugugauuuccaggaggcacagggcuggggacucccc

SEQ ID NO: 4181992 - RNA, 82 nt, Human
ggguugugggaggaaugaaugggccuagcuagugacuugaaauggcaaccagucucugccugcuuccuagccuuccaagccc

SEQ ID NO: 4181993 - RNA, 74 nt, Human
ggguuguucaaagacuuuugacuugaguucugcagcaaucaagcacucaaggcucacaguucaagaugaacccc

SEQ ID NO: 4181994 - RNA, 61 nt, Human
ggguuuaagcguguuagccacagcucaugcuaaugagccagauaagggcucacgcuaaccc

SEQ ID NO: 4181995 - RNA, 85 nt, Human
ggguuuccaagaauacuuaaauaauugcugcuauuccggcccucagauuggcgguuuguuugaguaauagcucuggcaugaaccc

SEQ ID NO: 4181996 - RNA, 59 nt, Human
ggguuuccuggguucaacuguggggaccccacuccauacaagaucacuccagaaaaucc

SEQ ID NO: 4181997 - RNA, 98 nt, Human
ggguuugauccuuggacuucgaguaacccaggcugggaauuccaaggcuucaaauggggccaggaaaaaccggcccugcuagccgacuccacaagccc

SEQ ID NO: 4181998 - RNA, 67 nt, Human
ggguuuuacaagguuaaucagcagguucugggaaagcuugcaccugcucagacuugaucuggaacuc

SEQ ID NO: 4181999 - RNA, 82 nt, Human
ggguuuuauuaucuuguaaauuagaauaauuauuugucaugggcaaugaaaauuucuaauugcaaguuuuaguauuaggccc

SEQ ID NO: 4182000 - RNA, 60 nt, Human
ggguuuucagcugacagcagggccuaguggcaacaguccugagauaggaguugaaggccc

SEQ ID NO: 4182001 - RNA, 83 nt, Human
ggguuuugucauguuuuauuuuauuuugagacagggucuugcucugucauccaggcuggaauauaguggcaugaucauagcuc

SEQ ID NO: 4182002 - RNA, 56 nt, Human
gguaaaaugacuuccuccaacauccaaauacucuggaugucuguggucauuuuacc

SEQ ID NO: 4182003 - RNA, 61 nt, Human
gguaaaauuugguaguaugucaacuucccuaacugggaucgaugacacagcuagguuugcu

SEQ ID NO: 4182004 - RNA, 89 nt, Human
gguaaacugugauuugauucuucuuggaguaagaaccaaacagaaaucuuguugcucccgaggagaaaugaagcuaauggaaacagucc

SEQ ID NO: 4182005 - RNA, 84 nt, Human
gguaaagaaacaguggucucuggcuugagcuucgaccaguauaauuacugggauucagucuucagaagacccuucgucugugcc

SEQ ID NO: 4182006 - RNA, 84 nt, Human
gguaaagaguggugaggggcaugugugauuugagaaagucccaucaaugcgucaaauacacacagaauccaccauacccaugcc

SEQ ID NO: 4182007 - RNA, 69 nt, Human
gguaaaggacugaggacaugugaggcauguaaaauuaauaugaucuuuuagucacuuagaaaaaauacc

SEQ ID NO: 4182008 - RNA, 65 nt, Human
gguaaaucaggugcauuagauuaauuaccuaaucugugguagaugaaggcugagcaccuguuucc

SEQ ID NO: 4182009 - RNA, 72 nt, Human
gguaaauccccaaagccaaagugggcaugccucaguguccccacugugcucagucuuuggcugggagcagcc

SEQ ID NO: 4182010 - RNA, 62 nt, Human
gguaaaugcugaguacuggagaggaggaaaggggugccugcugcugccuguggguguuuacc

SEQ ID NO: 4182011 - RNA, 63 nt, Human
gguaaauucacaccuccgguuuuucuuuagagcacugagagggauuguagguguagaaaugcu

SEQ ID NO: 4182012 - RNA, 72 nt, Human
gguaacaguggcaguggaaagcacacgggguaggcauagagcugccugggugcuggcacugucccugacacu

SEQ ID NO: 4182013 - RNA, 68 nt, Human
gguaacauauacuaucaaccuuugccaaccuaauauggagauuggaaaaugcaugguaaaugauugcc

SEQ ID NO: 4182014 - RNA, 92 nt, Human
gguaacgggcugaagaggauggguggagggugacacggaucgccccgagguuauuuauuuucccuuccacucaaucucuuccuccccaaauc

SEQ ID NO: 4182015 - RNA, 67 nt, Human
gguaagagcaggacgcagcacaccagugacauuggagcuacacuggcccagugcuuaugcucugacc

SEQ ID NO: 4182016 - RNA, 56 nt, Human
gguaagagcccuggcugacacaucugaaaugccuuggugugcaugcaugcucugcc

SEQ ID NO: 4182017 - RNA, 69 nt, Human
gguaaggagagagaaauuaugcauuauauaguuaaacacuggcaaaacauuauuucucauucuccuacu

SEQ ID NO: 4182018 - RNA, 77 nt, Human
gguaaguaaauguauccuacuuccugaguuggcuaauuguggauguuaaucucuggaaaaggaucaccuuucuuauc

SEQ ID NO: 4182019 - RNA, 79 nt, Human
gguaaguguacaguacccugaugaacuaaagccaaaaguuagggcugauuucgggcuucaucacggugaacaccucacc

SEQ ID NO: 4182020 - RNA, 68 nt, Human
gguaauaaacgcacccagaucccuugccagcaguggucugucugcugcuuggaggccugggugcuacc

SEQ ID NO: 4182021 - RNA, 83 nt, Human
gguaaucucaugguggagguguauucuggaucgacucacuuuugaaauguuuaugaaagaaauuccuucaccucgggacuucc

SEQ ID NO: 4182022 - RNA, 85 nt, Human
gguaaucuugaauauagcgugccuugaaaaauuauagaaacaagcuguauaaauuuucgagggccuuaaguauuccauaauaacc

SEQ ID NO: 4182023 - RNA, 78 nt, Human
gguaaugcaaacauucucauugggauaugugauaaauauaauauuauguagcuaguuccugauaaugccuguuuuacc

SEQ ID NO: 4182024 - RNA, 75 nt, Human
gguaauguauuuaaaguuacucacagaaauaugcuggauguguugacugguaacuuuaaacauguuuauauugcu

SEQ ID NO: 4182025 - RNA, 78 nt, Human
gguaauugcacaacugcuucacuucgguugcauagauaguuaacugcgcacauuuggugugguaauuggguaguggcc

SEQ ID NO: 4182026 - RNA, 61 nt, Human
gguaauugcaucauuuccuggccgugucuaguauauaacgcggagaagugaagcaauugcc

SEQ ID NO: 4182027 - RNA, 70 nt, Human
gguaauuuguguuuaugaaguuauucugccacaaagaugaacaggcaagaugauaaagaaccaguuuacc

SEQ ID NO: 4182028 - RNA, 63 nt, Human
gguacacggcagaguugauucagauaaacaauuugcuuuguugaagucagcaugcaugugacu

SEQ ID NO: 4182029 - RNA, 82 nt, Human
gguacagacggcaucugcucugcaaggcacagugaucgggcucagcauugucacuggagcucuugcgguucuguuugcugcu

SEQ ID NO: 4182030 - RNA, 61 nt, Human
gguacagccccuccccugacagaugaggcagcugcaaccucuacaggguaaggggcuugcc

SEQ ID NO: 4182031 - RNA, 59 nt, Human
gguacagcugaccccuucucaccauguuguaaauauuuacugagacugggugcaguacu

SEQ ID NO: 4182032 - RNA, 83 nt, Human
gguacauaguuaagaaacaguuucuaaucauggagaauuagugaacucucucugaagagaagcuuuacacucuuauuaugucc

SEQ ID NO: 4182033 - RNA, 93 nt, Human
gguacauuggaaacuauaacgacuucaugacauucaggucagacuuuuuuggcaagaauccauuauaggugauguuauauguuucagauuacc

SEQ ID NO: 4182034 - RNA, 63 nt, Human
gguacauuuuucugucacuuugauuuguaucguuaugaugccuaaguuuuuagaguaugugcc

SEQ ID NO: 4182035 - RNA, 76 nt, Human
gguacccagccagccuuugugaacaucaggugcuuugcaugagguacgaauuguuguuccgagguuugcugcagcc

SEQ ID NO: 4182036 - RNA, 130 nt, Human
gggugggggugggggguuaggccuuaccuuuauuuucugccugagggagaagucacgggcaguuuccacaccaggugcggccccuuccucagcagggugaggguaggugguggccccucccugcccaccc

SEQ ID NO: 4182037 - RNA, 57 nt, Human
ggguggggugucuuuguggucugugagccuuccuucaucuccagaggcaccuggcuc

SEQ ID NO: 4182038 - RNA, 72 nt, Human
gggugggugacguggaguggggagaaguuggggaagcuugacaucuuaauaaaucuccucccugucacacuc

SEQ ID NO: 4182039 - RNA, 107 nt, Human
gggugggugcaaauggagauuuagagacuaugaagauucuuaacuuugccaaaguuuuaaucaaauguaugagaaagucguaugucucccgaccuccauccccaccc

SEQ ID NO: 4182040 - RNA, 55 nt, Human
gggugggugggcaccugcccagagccaagcagccugggagagggcucagcuaccc

SEQ ID NO: 4182041 - RNA, 85 nt, Human
ggguggugugucuuggguuuccaugguguuucuuggguuucuggagcuggaauccagaggguagcaggauuaggagucacucccc

SEQ ID NO: 4182042 - RNA, 86 nt, Human
gggugguucauuauaauaaaugcagccuagcucaguuuucccaguaaggucaucagaucugaguggcugcauguaaauugcuaccc

SEQ ID NO: 4182043 - RNA, 76 nt, Human
ggguguauacucaucuccaagcucaccaaguuguauauauuaaaguugugcagcuuuuuggaugucaguuauaccu

SEQ ID NO: 4182044 - RNA, 97 nt, Human
gggugucuuucagagcaguugugggcaggcagcccuugaauggcuggucaugaggccuuuucaugacaaugguagccuguuaacuugagagacucuc

SEQ ID NO: 4182045 - RNA, 92 nt, Human
gggugugagugcuccccuggcugugggugcuccucaccaacagcuaacgugcggggccuuccugugccccagccaaggugacacgaacaccc

SEQ ID NO: 4182046 - RNA, 68 nt, Human
gggugugggcagagucguggggaauagaggcaagcaagcaguuaauucuuccggacugugaaauaccc

SEQ ID NO: 4182047 - RNA, 65 nt, Human
ggguguuccugucauucacagcaauuccguguuuacagggggcugugggaugcauaggagcuccc

SEQ ID NO: 4182048 - RNA, 88 nt, Human
ggguguugucagcugccucccgccuuggcuucaguagcucacccagcuuacaggggagcugcccugggcuggagaugggcacgcaccc

SEQ ID NO: 4182049 - RNA, 119 nt, Human
ggguuaaaaucuacugaauuugagguuguagccagagcucuucuuuccuuucucuguaauugaugaggaaacuucagaguuuuggucuuuucaaacuucucacaguacauguaggaccc

SEQ ID NO: 4182050 - RNA, 130 nt, Human
ggguuaaauaaggagcucaaguuuccucagaauuggaaaucagaucugauuccauuguguuaauacuauagacagaugagauucauugaccacugacaggaugcucugucuccuaccuauuuguuaaccu

SEQ ID NO: 4182051 - RNA, 69 nt, Human
ggguuaagucaagagaagugcuccacaguaguuuacugcuugagggauauuuuucuuggacauuugcuc

SEQ ID NO: 4182052 - RNA, 71 nt, Human
ggguuaauauuuugagagcuuucuauaaucccuucccuaaagauaaguagagcuuucuaaaauguaaaucu

SEQ ID NO: 4182053 - RNA, 73 nt, Human
ggguuaauggcaaauuaugacugaauggguuugcucucccaggagagaugcauucagcauggaugccuggccu

SEQ ID NO: 4182054 - RNA, 60 nt, Human
ggguuagcccagacuaaaaccucagucuaucuggcuccaggcaaagugcugggcugcucc

SEQ ID NO: 4182055 - RNA, 65 nt, Human
ggguuaggggaugaggguacaaauccuccacacugcucccagucuggaauccucccccuugguuc

SEQ ID NO: 4182056 - RNA, 70 nt, Human
ggguuaguccauaauuuucauaucugaaaaccaguuucagugcaaaaaaugggcuagaucauuccuaccc

SEQ ID NO: 4182057 - RNA, 111 nt, Human
ggguuauauagggaaaucuuucacauuacucgcaguaagaaagucaagcaguugaucuuucacaauggcauguaauucuggcugaaagaaaugagggccuauuuuuugccu

SEQ ID NO: 4182058 - RNA, 56 nt, Human
ggguucagucccucuugcuacuccaucuuacaaggagcugugaagguguugagccc

SEQ ID NO: 4182059 - RNA, 78 nt, Human
ggguucauuguaacuuguuacuuugcaguguuguuaaucguucagcaucaguaaggcaacauagcuuggagugguucc

SEQ ID NO: 4182060 - RNA, 76 nt, Human
ggguuccaagaguaagugucccgagagagagccaggcggaagccacugcaucucuucugaccuagccuuggaaguc

SEQ ID NO: 4182061 - RNA, 65 nt, Human
ggguuccaucugaagugaucaucauuucucuuccucuggggaucugagaaacuucaggcaagccc

SEQ ID NO: 4182062 - RNA, 85 nt, Human
ggguuccgagaugccaauggccuuggcugcagagacauggcugcuguaaguccagccggugccacagggccaggaaucucaaccc

SEQ ID NO: 4182063 - RNA, 77 nt, Human
ggguucuggggcuuggggugguggaggagaggcgccuugcggaaagcccucuucaggcacucgaaggccucuugcuc

SEQ ID NO: 4182064 - RNA, 63 nt, Human
ggguugaauuccugguucugugacuaccuuauguuggguggacuuagauaaggcauuuaaucu

SEQ ID NO: 4182065 - RNA, 78 nt, Human
ggguugauuucuuguugccacugccuggccugaagacagugcuuggcucagcgguggcagcagacgaagcagcagcuc

SEQ ID NO: 4182066 - RNA, 63 nt, Human
gggaguuuacuggaagauacuauuuuuguugguuaacaaagggcuguaagccaaguaaagccu

SEQ ID NO: 4182067 - RNA, 64 nt, Human
gggaguuuugguauugcugguggugguauggggauauucaaaguaauaaccagaacugcauccc

SEQ ID NO: 4182068 - RNA, 70 nt, Human
gggaguuuuuccaaggucacaugacugcuuaguggggauggcagaauucaaacucaacuuuggaaagccc

SEQ ID NO: 4182069 - RNA, 79 nt, Human
gggauaaaauugggggugacgauggcagcugguauuuaauauugccuuuguuuucuuccccccauggcaauauuauucc

SEQ ID NO: 4182070 - RNA, 72 nt, Human
gggauaaguuucuggaccuuaccugcuuaggcagccuguugucuuuagcucuuaguccaagagacuuaaucc

SEQ ID NO: 4182071 - RNA, 76 nt, Human
gggauacacagcugguagguagcagauuuggaauuaaaaucuaggucugccuaacugccaacugccuguuuauccc

SEQ ID NO: 4182072 - RNA, 63 nt, Human
gggauacaguccuguuccuggaguaguucacagcugugaagggcagagacagggcaggacccc

SEQ ID NO: 4182073 - RNA, 64 nt, Human
gggauagaagagcuaaucacugauuugaugucuacaccugcaucucugagagccugcuuguccc

SEQ ID NO: 4182074 - RNA, 96 nt, Human
gggauagagaagacuacagucaacauugaugaugaugauuauuauauagauaguuugaaaaaaguuacagaaaucuugacugucuuuuuuccuccc

SEQ ID NO: 4182075 - RNA, 76 nt, Human
gggauagauauuucaggccaaagaaacagcaugaacaaaagucuuaugcugaaugaagcacuguaauucucauucc

SEQ ID NO: 4182076 - RNA, 85 nt, Human
gggauauguaacaagugcuuacuuugggcuagguguuguaaaugcuuuagcucagcaaauccucaaacaagcacguuaaugaccc

SEQ ID NO: 4182077 - RNA, 97 nt, Human
gggauauuuggcacugucuguagacauuuuugguugucacaacugggugggaggcaaggugcuacagacagugaguguguaagaggccaggaauccu

SEQ ID NO: 4182078 - RNA, 79 nt, Human
gggaucaaagcccccacuggguugggggagccacugcccucucauggcaggcuucccccacaccuacggggaaggcccc

SEQ ID NO: 4182079 - RNA, 76 nt, Human
gggaucaccacuaaggcuggggagcacgguagggaaauggugaccagaucacaguacagcuucccauaggggaccc

SEQ ID NO: 4182080 - RNA, 65 nt, Human
gggaucagcugcugaugagcucaagacacugagcaugugacuuagcuucucugcaucugugucuu

SEQ ID NO: 4182081 - RNA, 90 nt, Human
gggaucaggcgucagcugugcuguggucaucugggggcucagcuacacuggaugcucuagguggcucacagauggcaggcacuggaugcc

SEQ ID NO: 4182082 - RNA, 57 nt, Human
gggaucauugaguaguaggaaaauaacugaauuauucagguccuagucaaugguucu

SEQ ID NO: 4182083 - RNA, 74 nt, Human
gggaucucaagccugccuguggacacccuggagggacccccaauccucccauaccuaugggccaggcaugaccc

SEQ ID NO: 4182084 - RNA, 55 nt, Human
gggaucucacuacauugcccaggcuggucuagauguccugggcucgagagauccu

SEQ ID NO: 4182085 - RNA, 56 nt, Human
gggaucugauuaauaagguggacugucucccucccaggccaccugcuucagacccc

SEQ ID NO: 4182086 - RNA, 81 nt, Human
gggaucugggaaggggauuugugacaacuggguuauuuaaauggaauuuuccaaauauacagaaucuccuccucagauccc

SEQ ID NO: 4182087 - RNA, 59 nt, Human
gggaucuugggaacacccuuacagaacccaagauuugguucaagggcuaccaaggucuc

SEQ ID NO: 4182088 - RNA, 79 nt, Human
gggaucuuguuaaaaugcagauuuggauucucauggucuggaguggagccugaaaagucugcauuucucacaagcuccc

SEQ ID NO: 4182089 - RNA, 56 nt, Human
gggaugaaagagagccaauuacuaacaggcagguuucacaggcuuuaauuuauccc

SEQ ID NO: 4182090 - RNA, 116 nt, Human
gggaugaagcccugaccagguucagaggcagcgggucaggaccgugccugggcucagucccgcccuggcuccuucgcuucucgccgcugugagccugggcaguggcuucgcugcuc

SEQ ID NO: 4182091 - RNA, 64 nt, Human
gggaugaagccugaagaaccccaaucucaagaacugacgagguagacuuucaagguuacguucc

SEQ ID NO: 4182092 - RNA, 55 nt, Human
gggaugaaggucugcauguuaaggaagucugaaagauaaaaugggccuugguccu

SEQ ID NO: 4182093 - RNA, 57 nt, Human
gggaugacaaagugucugucccccacacuggucaaagggacaggucauuguuaugcu

SEQ ID NO: 4182094 - RNA, 99 nt, Human
gggaugauaguagcaaucuauauuuugaaagguauuuaggacauacauauaugcauuugucuaaacucugcaaauguggauuuaaugcuuuugcauuuu

SEQ ID NO: 4182095 - RNA, 72 nt, Human
gggaugcacgcuguggaagggacacuggacuggagucacaucucagcccugcccuuucccauugugcgaccu

SEQ ID NO: 4182096 - RNA, 84 nt, Human
gggaugcagacaggaaugugaccacuagacucucagccccgggagggcgaggcuuuuugcugguuuuguucauugcuguauccc

SEQ ID NO: 4182097 - RNA, 110 nt, Human
gggaugccuccgcacaagggcagcagcggcccaggccuaccccuggaacucgggcugagguuucugaaggcugggcaccguuuugaucccgugugggcgcaggcacuccc

SEQ ID NO: 4182098 - RNA, 59 nt, Human
gggaugcugugucaauggugggauccuacacagggcuacuggcauuaugauagcguccu

SEQ ID NO: 4182099 - RNA, 68 nt, Human
gggauggaacuaggcugucgcucacuugcuccauaauguugggaaaguuauucagccucucugauccu

SEQ ID NO: 4182100 - RNA, 55 nt, Human
gggauggagcuguguacccugggcagggaauggccucagaccacagcucacaccc

SEQ ID NO: 4182101 - RNA, 105 nt, Human
gggauggaggaaugaguccgcuuacauuccuggagguuuuucggcauaggagagguuuauguccuggucuagcuuccgggagagaagugccucauucuauccccc

SEQ ID NO: 4182102 - RNA, 56 nt, Human
gggauggaggguagagcaaguggauguggcuuuguuugcucauuuaacuucaucuc

SEQ ID NO: 4182103 - RNA, 64 nt, Human
gggauggaguauuuuuauuugcuugauauuuuuucccuaagaaaauagauuuaacauccauccc

SEQ ID NO: 4182104 - RNA, 60 nt, Human
gggaugggccuccaauuccagcgggaugagugugccguuguggaggacucccagcauccc

SEQ ID NO: 4182105 - RNA, 65 nt, Human
gggauggggaugaauugagucagaagggcuuccacugagucgcccuuucucccuucaccgcaccc

SEQ ID NO: 4182106 - RNA, 69 nt, Human
gggaugguggcuguuggaccacaggguauguugugcuugcacuguggaaauaaacaaugcuaacaucuc

SEQ ID NO: 4182107 - RNA, 112 nt, Human
gggaugguuaaaacauuacgguacagguugaauaucccguaucuuaaaugcuugggaccagaaguguuuuggauugugggauauugcauauuacuugguggcugagcauccc

SEQ ID NO: 4182108 - RNA, 64 nt, Human
gggaugugcuuucuuuccaaggggcugcugaagcgugccucuguaggagugagagcaucuuuuc

SEQ ID NO: 4182109 - RNA, 57 nt, Human
gggauguggaacucagcugguucacugcagaaccaggagcagcuguguuuucauccu

SEQ ID NO: 4182110 - RNA, 80 nt, Human
gggauguuuuaacaagucacagaacccauuguaacuagugcacaucuggugauacagguguucuggauauaaaacauccc

SEQ ID NO: 4182111 - RNA, 80 nt, Human
gggauguuuuauauccagaacaccuguaucaccagaugugcacuaguuacaauggguucugugacuuguuaaaacauccc

SEQ ID NO: 4182112 - RNA, 65 nt, Human
gggauuaagcacuuggggaaaggauccagaccagcccucaggauccccugccuugggugaguccc

SEQ ID NO: 4182113 - RNA, 80 nt, Human
gggauuauugacaugcaacaauuuggcauuuuuuugagggaaagaagcaagucucaaauaguuacaugcuguaugauucc

SEQ ID NO: 4182114 - RNA, 88 nt, Human
gggauucacauugcuggggcuaaguacaaauugacaucaccuuuuaggaaugaaaugcuucucuuugacccuuuagcuccaguguccc

SEQ ID NO: 4182115 - RNA, 67 nt, Human
gggauucaccugggauagucugacauuacuuaaccccaacuuguccuucagaucucaggagagucuu

SEQ ID NO: 4182116 - RNA, 80 nt, Human
gggauucggauuuggugauugacccuggcuguguugccuacugcuuacugcugagagcaaucccaaaccccgcagguccc

SEQ ID NO: 4182117 - RNA, 85 nt, Human
gggauucuaauauuugcugacagcagcaaauggagauaagcgauuuuacuuuauuaucuguugucuugguuuuuauugcucucuc

SEQ ID NO: 4182118 - RNA, 81 nt, Human
gggauucucuagaggagggaugugguuguugggugaugcucucagggcacagacauauccauauuuaccucagucgaucuc

SEQ ID NO: 4182119 - RNA, 71 nt, Human
gggauugaguuaggugaaagcuaguguuugggaagauggcucgggaaacugcuuacacuagagggaaucuu

SEQ ID NO: 4182120 - RNA, 119 nt, Human
gggauugauuuagcacaugaaugauaaggguaagauauuauauaggggugccaaaacuuucuaucuuccaggcacuucuggugucauacugcauuuaggucuuacuauuuuuuucuccc

SEQ ID NO: 4182121 - RNA, 88 nt, Human
gggauuggggguagaaguggaaauuugauuacuugaguuauugaaaugauucagaauggcaaacuucuagaaguacucccaauuuccc

SEQ ID NO: 4182122 - RNA, 69 nt, Human
gggauuguguaaaggaagggaaccuaauggaagguaagggccuucauucucuuuagauuuacauuacuc

SEQ ID NO: 4182123 - RNA, 79 nt, Human
ggucagaggugagaucguaugcgcggccuaggggcgucuggcaugagcaggcccugcggaaaugaucauucuccugacc

SEQ ID NO: 4182124 - RNA, 59 nt, Human
ggucagcagugcagggcagagcuggaugcagcuuugccagcuugaacugugggcuggcc

SEQ ID NO: 4182125 - RNA, 59 nt, Human
ggucagccccugcucaaggccggcccucauccugccuucugaccagcagggacaugacc

SEQ ID NO: 4182126 - RNA, 95 nt, Human
ggucagcccuuguaccucccugccuucccuguuggucugugauugggaccucugccugcucccagacagaaggcuccuugagguagcagcugguc

SEQ ID NO: 4182127 - RNA, 57 nt, Human
ggucagccuacuuaaucuugcugauauuccaguuuuucaucaggaacaaggcugauc

SEQ ID NO: 4182128 - RNA, 79 nt, Human
ggucagcuuggugaaggugggcugagcaagccucagugccugcaccugagguagccauggcccaaguaccauaccuacc

SEQ ID NO: 4182129 - RNA, 64 nt, Human
ggucaggaagcugaagugcaaggcuuggcccuuguucagcccccccaguuccagcuucuugacc

SEQ ID NO: 4182130 - RNA, 91 nt, Human
ggucagggcauuugaacuaauaacugugcuggcaccuauuacuggugcuuguauuaucuuaggcaaguugcuauucuuuaaugccuugauu

SEQ ID NO: 4182131 - RNA, 57 nt, Human
ggucagguaucccaauccugagcccuugcuagaggcugagcggacuggggucccucc

SEQ ID NO: 4182132 - RNA, 88 nt, Human
ggucaggugcucuuugcaguuuucugccucauuuccaagguaaccuaggauuugucacgguugagagccaagaagcaggcacgcugcc

SEQ ID NO: 4182133 - RNA, 89 nt, Human
ggucaguaaagugucuccagcuggugaggacuccuccagggugggccagcucacucagaggaaacccuccuaggcaucucguaauggcu

SEQ ID NO: 4182134 - RNA, 72 nt, Human
ggucaguccuggaagugcuuggugagggcuucuagcagcuccugcuucuucagccaguacuccaggcaggcc

SEQ ID NO: 4182135 - RNA, 101 nt, Human
ggucagugauuaauuaugcuaagauaaacagaguuaauuuucuuccuggauaaaacuaauuacaacuguguuuguuuugguaggacauggaauuacugucc

SEQ ID NO: 4182136 - RNA, 55 nt, Human
ggucagugcugccagagugaccucauacaauugggagaauucaaagccacugacc

SEQ ID NO: 4182137 - RNA, 62 nt, Human
ggucaguggcaggggguacuucaguauuauacaacugcugugaccagacuuguauacuggcc

SEQ ID NO: 4182138 - RNA, 61 nt, Human
ggucaguucccuuucguauggacugggcaacugaaacccagacagggaagggaauuagacc

SEQ ID NO: 4182139 - RNA, 61 nt, Human
ggucaucacuuuuggugccuggccucaauucuuauuuggcuuagcuucauuauugguggcc

SEQ ID NO: 4182140 - RNA, 56 nt, Human
ggucaucaggaaaagcuccacugagaaggugauuucugagcugccuuuugaagacc

SEQ ID NO: 4182141 - RNA, 60 nt, Human
gggcacaugccuuugcuauugugaauagugcugcagugaucaauacaggugcaugugucu

SEQ ID NO: 4182142 - RNA, 61 nt, Human
gggcacaugcuuagggaggaaagcuuggaaaggcacaggcagaguguuuaaggaugugccc

SEQ ID NO: 4182143 - RNA, 74 nt, Human
gggcacauuucagaccagaacuggauggacucaccuggcuggguaauuuagacauuugugguuugcaauguucc

SEQ ID NO: 4182144 - RNA, 61 nt, Human
gggcaccauggguagguggcccuaaggcuccauguccugcuugccacuccugaugcugccc

SEQ ID NO: 4182145 - RNA, 78 nt, Human
gggcacccaaggagagagagcaggccgggcgcaaggacuguugaccgcuggccagcccucuuccuccacacggagccc

SEQ ID NO: 4182146 - RNA, 78 nt, Human
gggcaccgauucuaccaggcccuccagcugcguggucuccgcagaccaggcucugugugggcuagaggaaugucgccc

SEQ ID NO: 4182147 - RNA, 107 nt, Human
gggcaccugcaugaugaccucccacaccugcauguuuauugggccugguuuaugcauccaaggaucaggaagugugagggugguguaggggaucauaagagugcacc

SEQ ID NO: 4182148 - RNA, 62 nt, Human
gggcacugcuggaggcucccuguucugccaacugcuggauugcggggaguuccagagugucu

SEQ ID NO: 4182149 - RNA, 60 nt, Human
gggcacuggcuucagggggaaaguccuaaauuggggcuggaucuccugcaggcaggaccc

SEQ ID NO: 4182150 - RNA, 55 nt, Human
gggcacugugcuaggugcugaggucacaagggaaacagauuuagucgcaguccuc

SEQ ID NO: 4182151 - RNA, 72 nt, Human
gggcacuuaacugcaaagccagauauuaucauguucuucacuaugagucuguuuugcuugguuuuaugcauc

SEQ ID NO: 4182152 - RNA, 82 nt, Human
gggcagacacacuucuccuagcucuggccagccuggcacugccagucccagccaggcagcugggagggugccugaacugccc

SEQ ID NO: 4182153 - RNA, 95 nt, Human
gggcagagaaggaccgguaaugccagacaggggcuuugcaugcuuuaguuauuaagauucaaaagcagauaaccuuuguuggcuaugccuugccc

SEQ ID NO: 4182154 - RNA, 83 nt, Human
gggcagaggccuuggcccagugcaagcucuuucugcccacauucuccugguagcggcucugcagcugggcgcuguuucugccc

SEQ ID NO: 4182155 - RNA, 66 nt, Human
gggcagagguaccaggaauggggucaccgucuaacacaggcaaagguaagcucccuggauaagucc

SEQ ID NO: 4182156 - RNA, 62 nt, Human
gggcagagguggaaaaacaaccagagaaaauuccacucucaggcuguuagccaccuccuccc

SEQ ID NO: 4182157 - RNA, 59 nt, Human
gggcagaguggagugcggccuccugcaauguccaggaguaggugcuccucacucugccc

SEQ ID NO: 4182158 - RNA, 59 nt, Human
gggcagaguucugcagccggggacuaaguguacagcccacacagcagauccuuuggccc

SEQ ID NO: 4182159 - RNA, 99 nt, Human
gggcagaguuggcccuggggucugccuggaggcagcugcugcagcuuccaugccuauucagagcagccuccagggggagcccucagccauaccgugccc

SEQ ID NO: 4182160 - RNA, 111 nt, Human
gggcagaucuaaggacagcuucuuguuaccuuuccuagguuuacagauacucucauuauauuuugaaaguuuggagaugggaaaaaggagguagugucaauagagcuggcc

SEQ ID NO: 4182161 - RNA, 71 nt, Human
gggcagcaaccuccuggaccaccuuguggccaggcaguugucuucacaagaggcccaggggagcaaggccc

SEQ ID NO: 4182162 - RNA, 84 nt, Human
gggcagcaaguaccagugguuucaguccccugucaccaggcauccugcagcaggcacaggacggaaguacauguccucacuccc

SEQ ID NO: 4182163 - RNA, 56 nt, Human
gggcagcaucaggaggggcuuucugggcacacccaguacccgucucugagcuuucc

SEQ ID NO: 4182164 - RNA, 63 nt, Human
gggcagcaucucauucauucauguucagcaccagcaugaaccuggcacagaggagaugcuccu

SEQ ID NO: 4182165 - RNA, 65 nt, Human
gggcagcauggagugggggaagcacuugaaccuuuuucuacuguguggcucuccuccugcugccc

SEQ ID NO: 4182166 - RNA, 65 nt, Human
gggcagccaacccacagguugcccaaugauguauguguggcuagaccugaaaugggggccugucc

SEQ ID NO: 4182167 - RNA, 59 nt, Human
gggcagccccagcgcguuggcuccaggagcccgggugggggccgaccguuggggugccc

SEQ ID NO: 4182168 - RNA, 61 nt, Human
gggcagccggacugccgcugcacccgccaaaccacgcgggaaccagccgcuuccgccuccc

SEQ ID NO: 4182169 - RNA, 69 nt, Human
gggcagccugcuggcugguagaguuccgugucuucccuucuagcuggagccuggcagcugcaaaugucc

SEQ ID NO: 4182170 - RNA, 57 nt, Human
gggcagcucagccaccaugcaggaauagaaucagcuccaguguugcugcagcugccc

SEQ ID NO: 4182171 - RNA, 57 nt, Human
gggcagcucucacagcagccaagccaaauuuguuuaguauacaugaguuagcugcuu

SEQ ID NO: 4182172 - RNA, 59 nt, Human
gggcaggagagaacagucaugguauuuauuucaucacugucaccaucuuuccucacccc

SEQ ID NO: 4182173 - RNA, 77 nt, Human
gggcaggccaggcacgggggcauggccucuuuuuuccugggagagcagucaccccucugucaccugaccagcugccc

SEQ ID NO: 4182174 - RNA, 55 nt, Human
gggcaggcugagcaugucaccugcagcaggugcagcugcagcucaagccuagccc

SEQ ID NO: 4182175 - RNA, 79 nt, Human
gggcagggcagaggcugccucugggucuccugauuccaggcagucuggggcaggaggcccacaggccccugcacuggcc

SEQ ID NO: 4182176 - RNA, 78 nt, Human
gggcaggugccucccuccugucuccuuauucuacacuuggcacagguguaucugacaguggagcggaggacacagccc

SEQ ID NO: 4182177 - RNA, 98 nt, Human
gggcaggugcgcauguugcauuagugucauaagguggcaugagacuguaccaggccauuaguccugauucugauccagcagcaucacugccuugcucc

SEQ ID NO: 4182178 - RNA, 55 nt, Human
gggcaggugggcugggguggugccaucacuggcagcaugugugguccgcuggccc

SEQ ID NO: 4182179 - RNA, 68 nt, Human
gggcagguggggcuacugagcuggaacuggguuugucugcuccagagaaucauagacuccaucaaccc

SEQ ID NO: 4182180 - RNA, 82 nt, Human
gggcaggugugagggcucccaaucagccucuggcuccugguuugucugggcugugcugucuugggagccuuaaccaccgccu

SEQ ID NO: 4182181 - RNA, 62 nt, Human
gggcagguguuuccaaggugagccuuggcacaggucucaccucauuugaggagucucugccc

SEQ ID NO: 4182182 - RNA, 55 nt, Human
gggcagguuauuggaguagggagaacagaaacucgucccauguccauaucagccc

SEQ ID NO: 4182183 - RNA, 65 nt, Human
gggcaguaugcauaccucaguccuaccaaccaagaacugaaguaggaagcuguguccaugcuccu

SEQ ID NO: 4182184 - RNA, 68 nt, Human
gggcagugacaggcuccacaggggaauccgggguccacccuggucccagcagagcucugagcacaccc

SEQ ID NO: 4182185 - RNA, 69 nt, Human
ggugaagcucaugguuuucucuaaaauuguaacugggauuuuauuuuagaaguucacuuggguuucacc

SEQ ID NO: 4182186 - RNA, 55 nt, Human
ggugaaggcacaagagggcaaguggacauguacaaggccuuuuaaagccuacacu

SEQ ID NO: 4182187 - RNA, 74 nt, Human
ggugaagggauuuaccucaaguuccaggaaagcgguggcgauugcucucaaauaccugguaccuccccgucacc

SEQ ID NO: 4182188 - RNA, 75 nt, Human
ggugaaguauaguuuuuucaacaaauggugcuagaacaacugcgguaucuuuugguggaaaaauaaaucuuuacu

SEQ ID NO: 4182189 - RNA, 77 nt, Human
ggugaaucauuucaucugaggcaccagagcauacaugguuuccucugugccugucacccucagagagcugauucauc

SEQ ID NO: 4182190 - RNA, 68 nt, Human
ggugacaaggaagaugcuggccuggggaguccucucuccuccgugccuguaacuucuacucuggcacu

SEQ ID NO: 4182191 - RNA, 59 nt, Human
ggugacaggcuaccacugaaguucugaagaacccuuugcuauugugacagcuuuucgcc

SEQ ID NO: 4182192 - RNA, 58 nt, Human
ggugacagggcuuuuaaucaguaguuguaaauuggcaaauauuguuuagcucugugcc

SEQ ID NO: 4182193 - RNA, 56 nt, Human
ggugacaguuccggagguacagaugaauacauaacgucagcuuccugccugucccc

SEQ ID NO: 4182194 - RNA, 73 nt, Human
ggugacaugaauaguaaaagauacagcuaaugagaagcauuggccacaaguuauuauacuaaggacaguuacc

SEQ ID NO: 4182195 - RNA, 86 nt, Human
ggugaccaugacuaugcacauccaggcuacuuccugacuaggcccuguucaggaagcauccugagguguccauuccucguggagcc

SEQ ID NO: 4182196 - RNA, 125 nt, Human
ggugaccaugguuauguuuugcacauugauuuccauuuguuucauguuagaaacaguacuaaacuguucugugaccauaauuuguaaauaaagugguguucuguuuaaaaacaagcccuguuauc

SEQ ID NO: 4182197 - RNA, 57 nt, Human
ggugaccucaccuggucccacccuuucaggugaacggccaggcccggugacgucacu

SEQ ID NO: 4182198 - RNA, 56 nt, Human
ggugacgugucuguuagacuuccgacucaaccuugccucuaacagaagugucgucc

SEQ ID NO: 4182199 - RNA, 112 nt, Human
ggugacguuguugccuuuucugcaaucuuuugcgucuaugugugagccuuacauggcaggcugggaaggcauaagaauagggguaggggcgguugaaagggugcagguugcu

SEQ ID NO: 4182200 - RNA, 58 nt, Human
ggugacuaaauguaguaggauuuacuacauaguaaguucucaauacauuguagcuauu

SEQ ID NO: 4182201 - RNA, 93 nt, Human
ggugacugugucuuugaauaucccagauggaggcuggucacccuuuugucuuugggugaauagacuacucgggaaggcaaggaugcaugcacc

SEQ ID NO: 4182202 - RNA, 78 nt, Human
ggugagaauauguuuaauuaucuggguuuugccaugacaggcagggccaggcucagcuauuaagaaacgguugucucc

SEQ ID NO: 4182203 - RNA, 65 nt, Human
ggugagaaucgugcauuauugcuuugagaagucccacaaccaauaucaauuuggcagauucuccc

SEQ ID NO: 4182204 - RNA, 92 nt, Human
ggugagagagccaggcccugggcaggcacagagcuaugcagguggcccccucucagugccugcccuaggcucugcuugugacucucuucucc

SEQ ID NO: 4182205 - RNA, 60 nt, Human
ggugagaggacaaagaucagccaccaggaaggggccuccauccuggcucuguccucagcu

SEQ ID NO: 4182206 - RNA, 56 nt, Human
ggugagaguuaugauuccaauugagguaguuaagccacagaguccgugacuucacc

SEQ ID NO: 4182207 - RNA, 105 nt, Human
ggugagaucuuaaaaggccaaugaaagucauagaugcuacaauuuuguacucucuuuaaggggucgauguaaguauuuacgaaugccacugugggaugacucacu

SEQ ID NO: 4182208 - RNA, 58 nt, Human
ggugagauguuagagaaauuucugcccucaaauuuguggguggcaggugacagacacc

SEQ ID NO: 4182209 - RNA, 89 nt, Human
ggugagauuguggcaaauaaugcuuaugcucucaugauugcuaagacccagagcaagaauauuucugccacugaaugaugaucuuuacc

SEQ ID NO: 4182210 - RNA, 60 nt, Human
ggugagcacugcccugggucucuuagggcauaaccuugggauucagggaguugcuaugcc

SEQ ID NO: 4182211 - RNA, 60 nt, Human
ggugagcaguuguauaaagacuuugauagucuacaaugucugaaauauuuacuguuuguc

SEQ ID NO: 4182212 - RNA, 112 nt, Human
ggugagccacggagcacgcucacuaggcuuguccugaggaauucugggagcuguaguccuggcugguucuguggggcugugugggccugggagcgugcucuguggguucccc

SEQ ID NO: 4182213 - RNA, 66 nt, Human
ggugagccugaugaaacaggcagacucauuccuuuucaagauuuguuugcaguuuuacaggcuccc

SEQ ID NO: 4182214 - RNA, 74 nt, Human
ggugaggaaaguggugggaaaucaggugggauuuaaauauuuccccugcccauacugaccucuaauucacuacc

SEQ ID NO: 4182215 - RNA, 77 nt, Human
ggugaggaacuuuuucuuuccaaagguggcaggaacaagucuguacugacuuuucucccgccuucgggauccucucu

SEQ ID NO: 4182216 - RNA, 63 nt, Human
ggugaggaagacuuggcauugcugaguucccuucuacauuuaugcaauguuccuuucuucacc

SEQ ID NO: 4182217 - RNA, 64 nt, Human
ggugaggccauggcaagacgaccuguaagcccaggccuugcgucccauggccugugaucccgcc

SEQ ID NO: 4182218 - RNA, 59 nt, Human
ggugaacauugaugugguuacagcccacauguggucugucauagaauacagugauuacc

SEQ ID NO: 4182219 - RNA, 70 nt, Human
ggugaagacugaaaacauugugugcuaauuucuuuguuuuaggggagguuaucauaguuguuaucaggcc

SEQ ID NO: 4182220 - RNA, 72 nt, Human
ggugaagagaagaaacucacuuugggaggcagcaagguaguucuuccccucuggagaguuucccucgcuccc

SEQ ID NO: 4182221 - RNA, 129 nt, Human
ggugaagagaagggguagggaaccaccugagggacuuggaguguuaaugacaaguggcauagaaugucuacaacuuaguugucugggucacaugucacaaaacacugccaucaggacacucugccugcc

SEQ ID NO: 4182222 - RNA, 88 nt, Human
ggugaaggagaggcaugucagcagaugccuaaggcuuuagaacuugcuugguccagguccugugacagcaguugcugauuccaucacu

SEQ ID NO: 4182223 - RNA, 95 nt, Human
ggugaaguuacuggguaagaggcuuuguguguguuuaacuucagugguguaguacaaacuguuucaaaguagcuguauccaugugcacuuucacc

SEQ ID NO: 4182224 - RNA, 79 nt, Human
ggugaaugcucagagucuuguuaacuugcuaagcaucuggucagcaggguaguugaguuccagcaaggcucuugacacc

SEQ ID NO: 4182225 - RNA, 55 nt, Human
ggugaaugguguccugacucuagcuuucuaggaucuugggaagcccauuuccacc

SEQ ID NO: 4182226 - RNA, 110 nt, Human
ggugaauguaaccuaaaauguacucccugguguguuaugauacugauaaacuucuguuuaggguaacaugauuuuaguaucauaauaugguauuaugggugacguuuucc

SEQ ID NO: 4182227 - RNA, 75 nt, Human
ggugaauuaaagcuauccagucaugaacugcuuucacucuugcucagaguucaucuugauggcuuccuaauuccc

SEQ ID NO: 4182228 - RNA, 68 nt, Human
ggugaauuugccucccgacugacucuugcacuucccgugaggaccacagacguuggaggaaauauacc

SEQ ID NO: 4182229 - RNA, 66 nt, Human
ggugacaaugaaagucuucaaagucuguuccagugaugguucaauauugcuagcuuuugugucacu

SEQ ID NO: 4182230 - RNA, 57 nt, Human
ggugacacagggaccagagucugaauccagcagcauuccugaggcuccuuaugcacc

SEQ ID NO: 4182231 - RNA, 57 nt, Human
ggugacagcaucgagggaacacaggaaaguccucacucuucccucccugcuguggcc

SEQ ID NO: 4182232 - RNA, 58 nt, Human
ggugacaguaagguggcuucuucuuguggguagguugacaagggccucugcugucuuc

SEQ ID NO: 4182233 - RNA, 70 nt, Human
ggugacauucugguggccaaacgcaugcgaacacuguccucccgcauucagugaguguuuaccggaagcc

SEQ ID NO: 4182234 - RNA, 59 nt, Human
ggugacauugcaugugacuucuggagccugccacgcucccugggcucacacaggucauc

SEQ ID NO: 4182235 - RNA, 57 nt, Human
ggugaccaagcaucuguccccugagcucccagggcagagccagggaugcaugguccc

SEQ ID NO: 4182236 - RNA, 71 nt, Human
ggugaccaugacgucagccugcaggacaggugagcuggaucccuggggacugaaggauguugcuggucacc

SEQ ID NO: 4182237 - RNA, 64 nt, Human
ggugaccauuucuaggaaucagacuccagccuaacuacagucaagaaauccugaaggagucauc

SEQ ID NO: 4182238 - RNA, 78 nt, Human
ggugacgcccuuuguguguguauaggaaaggacgguguacacauuugguuaguuccuucuuuuacaccauaaauuauc

SEQ ID NO: 4182239 - RNA, 56 nt, Human
ggugacuagauaagccccaugggacagcacaucugucacagggcuguggggucacu

SEQ ID NO: 4182240 - RNA, 68 nt, Human
ggugacuauguuagaggcagaggcuauuuugcuguucccugucccucugcccaugagcagaagucacc

SEQ ID NO: 4182241 - RNA, 69 nt, Human
ggugacuauugguucuugcugcugacaaaaaauauuccucagcucaaaccagccagaacuaguguuucu

SEQ ID NO: 4182242 - RNA, 75 nt, Human
ggugacugagggaagaggguuugaauucaggucauugaaaccugcaauccagcaucuuuuucacaaccucaugcc

SEQ ID NO: 4182243 - RNA, 68 nt, Human
ggugacuggcaugguguugcugugagaggugcagcguaaccucagaggugaacaucagugcugggacc

SEQ ID NO: 4182244 - RNA, 68 nt, Human
ggugacuggcccugccucacucaaccuggggugggacuagcguguguguagaaagggcccugguggcc

SEQ ID NO: 4182245 - RNA, 76 nt, Human
gggucagacugccuguggguacaaguggaaucgccuuacaguaauauucuacagauacuggcaggcccucaagccc

SEQ ID NO: 4182246 - RNA, 60 nt, Human
gggucagagucccgccugcagagguaccacgugcguccuucuguggcggacucuaggccc

SEQ ID NO: 4182247 - RNA, 69 nt, Human
gggucagcggcgggggcaggagaugucuggaggaggagaggcccagcauccaugcucccucggggaccc

SEQ ID NO: 4182248 - RNA, 58 nt, Human
gggucagggcuggcugucgucaccuggggugcccugcggucgcaggcagcacugaccc

SEQ ID NO: 4182249 - RNA, 56 nt, Human
gggucaggggccugcaagguagaauuugugugguaucaguaagcaucccugaaccc

SEQ ID NO: 4182250 - RNA, 82 nt, Human
gggucaucaccguggggccuaggacagaggacucuggcaggcgggacccacagagccucugcccugggcacugauaggcucc

SEQ ID NO: 4182251 - RNA, 64 nt, Human
gggucaugaacaguuucccuguagaaaauggaccugaacacucugcaguaaggaauuguuuccc

SEQ ID NO: 4182252 - RNA, 90 nt, Human
ggguccauaggagaggagaggcaccgucugcagcgugcagaggcaucugugcgacagguaggcacggcaagacggggccuccugccaccc

SEQ ID NO: 4182253 - RNA, 76 nt, Human
gggucccagcuucccacuagcagccucagaagacagagagugggugcugcugcagcugugggguggccuggggucc

SEQ ID NO: 4182254 - RNA, 71 nt, Human
ggguccgggcgggggcccuccucggcccucccaacaugggggccaggaggucagccccucaaccuggaccc

SEQ ID NO: 4182255 - RNA, 63 nt, Human
ggguccucagcacccgugucuccccuuuccuugcaggccagaggaggcaggugcagagguccc

SEQ ID NO: 4182256 - RNA, 84 nt, Human
ggguccugagaggcacagggaugcggagccagguauguauucaggccagucgcuucucucugugccucaauauucuggguaccc

SEQ ID NO: 4182257 - RNA, 74 nt, Human
ggguccuggucaauaaauacugugaauaaagguuuuuaaaaggagaaaggaauucuacaguguauucaggaucu

SEQ ID NO: 4182258 - RNA, 86 nt, Human
ggguccuugcagucccugaggggucauuccugaaaagaccgacgccauggccugaguauaggaggccccuccuggguugcuggccc

SEQ ID NO: 4182259 - RNA, 61 nt, Human
ggguccuugggucuccuguguuuggacuagccuguccauaccccaggagcccagguggccu

SEQ ID NO: 4182260 - RNA, 67 nt, Human
gggucgggcaggcgcccucgucucccuggaaacagaugcggacgaggaagcgacccuugcccgggcc

SEQ ID NO: 4182261 - RNA, 127 nt, Human
gggucuagauaacuaaaacagaaacaacagucauauugaagaagacuggcaagaggucagcaucccaugaucgcgcugcacuguugcuuuauaugauuguguuugauggcacgauuguuuacaaccc

SEQ ID NO: 4182262 - RNA, 78 nt, Human
gggucuagugggaagaggccaggaugcugcucaacacccuauaauguacaggacagcagccucuuacaugaaagacuc

SEQ ID NO: 4182263 - RNA, 64 nt, Human
gggucuauuuuaagucugauuaauggagauacuaaucuucauuagcaaggucuucaagugacuu

SEQ ID NO: 4182264 - RNA, 72 nt, Human
gggucucaaacuguggcauguugaauuuguuggccuauuuaccaacaaacagcuaacauauguuaaugacuc

SEQ ID NO: 4182265 - RNA, 63 nt, Human
gggucucaggacaguucccugcaaauucccucuucucggacuuuguccaaacuguccuauccc

SEQ ID NO: 4182266 - RNA, 78 nt, Human
gggucuccagcugggucaugggacagaugcucauuuaugaugcucugggcuuguugaccugcacuuaguggaguuccc

SEQ ID NO: 4182267 - RNA, 97 nt, Human
gggucucgccaugccaccuugcuugcccugcagcggugaguggugaggagcacugaaggcccagggcagguggaaggggcagcccgagcacuuaccc

SEQ ID NO: 4182268 - RNA, 88 nt, Human
gggucucgcucugucgcccaggcuggagugcaguggccugaugucagcucacugcacccucaaacuccugggcucaagugauccuccc

SEQ ID NO: 4182269 - RNA, 102 nt, Human
gggucucgugccccgcugacugcugagcuucuccagggcagagagcgacggcaucaucucugcaucccagggcucagcacacggcuggcacauaugaggccc

SEQ ID NO: 4182270 - RNA, 59 nt, Human
gggucugaccugggcacaccauauugaauagugguuaaggcuuuacagucaaacgaccu

SEQ ID NO: 4182271 - RNA, 61 nt, Human
gggucugagcagggcaguguccauggagcagugugcucuaggggacuucacugcucagccu

SEQ ID NO: 4182272 - RNA, 55 nt, Human
gggucugagucuccgugccaggacauccucccuggacaggacccccuucggaccc

SEQ ID NO: 4182273 - RNA, 91 nt, Human
gggucugcagauuaggacauggacagcuuuggugacuauuauucugucagccacagcauguguguauguaagcgcuuggucugccuuuccc

SEQ ID NO: 4182274 - RNA, 71 nt, Human
gggucuggcaucccagcucugccugcugaaggcugagagcaucagugguaugcgugggagcugccuucccc

SEQ ID NO: 4182275 - RNA, 64 nt, Human
gggucuggccuggcauucuaugggcacagugguuauguggccacggcugugagagucaguacuc

SEQ ID NO: 4182276 - RNA, 83 nt, Human
gggucuggcuccucaggaaguagcaugugucaagggaagaugugugacauggggaagaacuuucuagaggaguuaccaggucc

SEQ ID NO: 4182277 - RNA, 68 nt, Human
gggucuguuaaaugagaaagcagacuagaagauucugcuaauuugcuuucucaauuuaauaguaaccc

SEQ ID NO: 4182278 - RNA, 65 nt, Human
gggucuuacuuaaauauucacacaauuccuuaagucaauauggcuugugaauguuuucuggaccc

SEQ ID NO: 4182279 - RNA, 76 nt, Human
gggucuuauuaaaaugcaguuucugguucaguuggccuaggaugggaccugagauacugcacuucuaguaaguucc

SEQ ID NO: 4182280 - RNA, 72 nt, Human
gggucuuccuggugaggcuagaaguguccauacacauggugcagcuuccuggucucagccaacaaggacacc

SEQ ID NO: 4182281 - RNA, 67 nt, Human
gggucuucgccgccgccauaacugcuccagaggaagaaaagaaagcgacgcggcacgcggagagccc

SEQ ID NO: 4182282 - RNA, 86 nt, Human
gggucuugacucuuuucuggaaggcagggagaacccaggacuaguuucccagggacccuguaccugccagaggagcgucauagccc

SEQ ID NO: 4182283 - RNA, 84 nt, Human
gggucuugcucuguugcccaggcuggagggcagugucaugaucauggcucacugcaaucucagcuuccuaggcuuaagugaucc

SEQ ID NO: 4182284 - RNA, 88 nt, Human
gggucuugcucuguugcucaggcaggaguacaguggugcaauuagagcucacugcagcuucgaccucggguguucaaguaauccuccc

SEQ ID NO: 4182285 - RNA, 86 nt, Human
gggucuugcucuuuugcccaggcuggaguucaguggugcaaauacagcucagugcacccuagaccuccugggcucaagcagucccc

SEQ ID NO: 4182286 - RNA, 63 nt, Human
gggucuuggggaguuggucaauccaugucuuaucuuagacaugagauuagcucacccacuccc

SEQ ID NO: 4182287 - RNA, 86 nt, Human
gggugaaggacugaggccuggguuccgaguggggcggcuaggaaaggaaaaggcuaggugcucccugacccaggucuucucuaccc

SEQ ID NO: 4182288 - RNA, 75 nt, Human
gggugaaggaugggaccuuugagcucagcugaaacucagugaacccagacacggccagauccugcuuccucaccc

SEQ ID NO: 4182289 - RNA, 61 nt, Human
gggugaagggucuaucucucugccuuugucuugcauuacaggggcucugagaauuccaccc

SEQ ID NO: 4182290 - RNA, 56 nt, Human
gggugaauucacagaccuggccagucuccuccuggcuucaaggugauaauuuaccc

SEQ ID NO: 4182291 - RNA, 60 nt, Human
gggugacagugaguuuggugcuuucaaaaugucagggcucucacagacaggcugucaccc

SEQ ID NO: 4182292 - RNA, 95 nt, Human
gggugacgauuguuuaaccaccaccaaaauggguucugaguccaacuauuaauaugaagaugacauccauuguggucuuguacauuuuguugccu

SEQ ID NO: 4182293 - RNA, 59 nt, Human
gggugacuggagggacccaggccuucagugagggcauuuguccaaccuccuagaucccc

SEQ ID NO: 4182294 - RNA, 71 nt, Human
gggugagaaaucugggagcagcucggccagguacuucuggcucacaaucucccaugaaguucucauugccc

SEQ ID NO: 4182295 - RNA, 95 nt, Human
gggugagaaucucaagugggaggugaaaacucaggagaaugguuucuaaaaauucuuguucaguugccucuccugcuuggguggauucuucuucc

SEQ ID NO: 4182296 - RNA, 62 nt, Human
gggugagcaggggccucgucucccuucucuaaucgcuggugaagauuggggccucugcaccc

SEQ ID NO: 4182297 - RNA, 99 nt, Human
gggugaggaaauugaagcuuagagcgcuuaagucaauuaccuaugaucauacagcuguggcuuaagcgcaacucugucuccaauucugaauucuuaccc

SEQ ID NO: 4182298 - RNA, 88 nt, Human
gggugaggcacgcaucugucuauuaggaugguuggaaugcaugaauuugauaagcccuauauuuggugagggaugucuguccucaccc

SEQ ID NO: 4182299 - RNA, 67 nt, Human
gggugaggcugaagguggcguacaggaaacauggugggcacacuucuguggccccuucgccccacuc

SEQ ID NO: 4182300 - RNA, 63 nt, Human
gggugaguccaggcucagaaacccgucguccaugggggcaccacggcuugccuggccucggcc

SEQ ID NO: 4182301 - RNA, 61 nt, Human
gggugauccaaauuggucuggggucaggauuuggcccacagucuaucaguuugcgucaucu

SEQ ID NO: 4182302 - RNA, 81 nt, Human
gggugauuuguacugacuuuggaauauuucuaggcuauguuucuuuaugcuagaaaaaguucagacaguuuuauuuacacc

SEQ ID NO: 4182303 - RNA, 71 nt, Human
gggugcaaaggaucauguggucauuccugagaaggauauccucagaugauacugcauggguccgugugccc

SEQ ID NO: 4182304 - RNA, 72 nt, Human
gggugcaaugggaugaucaccugagcucaggaagccaagucuucagugagccaagaucaugccguugugcuc

SEQ ID NO: 4182305 - RNA, 129 nt, Human
gggugcagcccgggggguguccgggcugagcgggcucacccgguuguuguggcgcgccugcuccagaguggcggugaagaggaagcagcggcaggggacgcccgcggcucgggcacacuggacguaccu

SEQ ID NO: 4182306 - RNA, 61 nt, Human
gggugcagcuggacagagaagcccacaagagaguuuaaguguggccucugcaggccgcccc

SEQ ID NO: 4182307 - RNA, 85 nt, Human
gggugcagggcugagggagagaauggggcaaacaccaaugcaugcuggucuuccuuucuucagucuccuuucccaccugcuacuc

SEQ ID NO: 4182308 - RNA, 90 nt, Human
gggugcauguaugugugcauuuguguguguguauuuuauaaccaugcagguauauagcacacaguuuauaaaagccaucaugcaguuccc

SEQ ID NO: 4182309 - RNA, 56 nt, Human
gggugcauuggcaauccaaucucuccuugaucgggauugaucaggaucaaucaccc

SEQ ID NO: 4182310 - RNA, 57 nt, Human
gggugccccauagccugcugcccucaaggaguaugggcugcagggcccagggcaccc

SEQ ID NO: 4182311 - RNA, 57 nt, Human
gggugcccugggcccugcagcccauacuccuugagggcagcaggcuauggggcaccc

SEQ ID NO: 4182312 - RNA, 83 nt, Human
gggugccguggaagaggccagcacgugugggguggggagggcugccacagcccccaggcacuacaugugaaacuccggcuccu

SEQ ID NO: 4182313 - RNA, 86 nt, Human
gggugccugggaaucacauuuuaucugagauugacacguucaauaugcacauggcaaucucccugaaaucaauugaaaccgcaccc

SEQ ID NO: 4182314 - RNA, 62 nt, Human
gggcagugaguuucugugagccacagucucccccucuuucugugcuccuaccacuucugccc

SEQ ID NO: 4182315 - RNA, 68 nt, Human
gggcaguggccacugcucucaagcucaggaaaagcccaaguccuggccuggcgcaguggcucacgccu

SEQ ID NO: 4182316 - RNA, 105 nt, Human
gggcaguggguggucaggagccacaccugauggagggugucagagagcgaaggugucuuuuugccaucuccuuggucuucaccagagugggcggccccgcugccc

SEQ ID NO: 4182317 - RNA, 97 nt, Human
gggcagugguugggcaaggcugacaggauuagcaaguaaucaggaaggaucagaugucuucuuucucuuucaauuuuguagccucccucuagugccc

SEQ ID NO: 4182318 - RNA, 64 nt, Human
gggcagugucugcaaaugaacaauccauacccuuucagaauccuugaucauuuuugcacugcuu

SEQ ID NO: 4182319 - RNA, 61 nt, Human
gggcaguuuauucuagaugguuuuuuaaaacagcauaccaauuuaugauccaugacugccc

SEQ ID NO: 4182320 - RNA, 70 nt, Human
gggcaguuuugcacagaggaugcuagagacucugucauuggcaaagugacuccuuggggcaagauuggcc

SEQ ID NO: 4182321 - RNA, 83 nt, Human
gggcauaaggaucgcacaccuagugacuagaaggaggagauuugaaacucagucuuucuucuuucauagugugagaguugccc

SEQ ID NO: 4182322 - RNA, 86 nt, Human
gggcauaugccaggcacaguguugcuguucaauaaauaaauaaucuccauccauauugacuuuaauuuuugccuaacgcaaugccc

SEQ ID NO: 4182323 - RNA, 72 nt, Human
gggcauccccagcuccgaaugggacacguuuucccgagauaaaagaucccuucugagcucacacgggagccc

SEQ ID NO: 4182324 - RNA, 90 nt, Human
gggcaucugacauacacaguguggcaaauuucaacuuuucuuaaaguuuaacauuauugucacucuguaggucuuaaaugucagcuguuu

SEQ ID NO: 4182325 - RNA, 76 nt, Human
gggcaucugggagcuagauucaauaaagcuguucugaccaugaacuuggaacuggccccuuucauucuggaagccc

SEQ ID NO: 4182326 - RNA, 71 nt, Human
gggcaugaguagacagauccuaugcaggcacuuucuuugugaucuucaggaucauuuguuuuaucuugccu

SEQ ID NO: 4182327 - RNA, 81 nt, Human
gggcaugcagaauuccuucuaccagcuggauaccucucauacacugagacacuggauucuuguagugaaguccacaugccc

SEQ ID NO: 4182328 - RNA, 103 nt, Human
gggcauggagcucagggggucauacgugcacugaaauugcguacaaauuuguaagugcaaauguguguauuucuaggcgaggaccccuagauuucuucagccu

SEQ ID NO: 4182329 - RNA, 68 nt, Human
gggcauggaugggaagggaaaaggggaugugccagagagaauuuccccugccagcuaucccugaaccc

SEQ ID NO: 4182330 - RNA, 63 nt, Human
gggcauggcagaguaugagauguuuaauuuucuggaauagcauccuguaucucuuccaccucc

SEQ ID NO: 4182331 - RNA, 70 nt, Human
gggcaugguggaccuggcauugaaccuacauggaccauucaguuuuaguguggcagguuccaaaaugucc

SEQ ID NO: 4182332 - RNA, 72 nt, Human
gggcauguaggaauccauggagagggucaucauuauaauaauccacucaagaugauuugauuucuauagcuc

SEQ ID NO: 4182333 - RNA, 76 nt, Human
gggcauguccgguugcacaucccagaaguauauaucuuccccauucuguggcaugguugcaaggacaacauugaac

SEQ ID NO: 4182334 - RNA, 65 nt, Human
gggcauguggcaggagagacacagccaucccugagggaggggcgguucccugcugucugaugccc

SEQ ID NO: 4182335 - RNA, 55 nt, Human
gggcauguucaaauaaguaguuucuauggcaacacguggagugagccaggugccc

SEQ ID NO: 4182336 - RNA, 87 nt, Human
gggcauuuagcccauuuacauuuaagguuaauauugucauguuugaauuugauccugucauuauaauguuagcugguuauuuugccc

SEQ ID NO: 4182337 - RNA, 101 nt, Human
gggcauuuguuuggugucucacguugaugcaaaugcagccauugcagagugagccccgcucuguuacuggaucuccauuugcucaaaagagagcagugucc

SEQ ID NO: 4182338 - RNA, 59 nt, Human
gggccacagagccagcgguagucaagggaggaaccaucugcagcuccucucugugcccc

SEQ ID NO: 4182339 - RNA, 71 nt, Human
gggccaccuugacugugaaggccguggcagaagcccuguucaccagggcugggcaggucugcacagggccc

SEQ ID NO: 4182340 - RNA, 57 nt, Human
gggccagaggauacaucuugauuacacuaaucagcauguacuucuccuccaugaccc

SEQ ID NO: 4182341 - RNA, 55 nt, Human
gggccagccuucugagcugccuggaaggaucugugggaauucagaaggcuguucc

SEQ ID NO: 4182342 - RNA, 58 nt, Human
gggccaggcaguacagcagugugugacaccccugcagcugcugggccugccguggccu

SEQ ID NO: 4182343 - RNA, 73 nt, Human
gggccaggcggcggcggucauugagcauggcuuccacucuggccaugugugucuccaccagcugcugucucuc

SEQ ID NO: 4182344 - RNA, 130 nt, Human
gggccagggaacgcgcccacgcccgcccgucccgcggccucucccgggugccgcugggcccgcuacucacagcgcuguggcguccgcggggaugcgcagcgcgggaccgagcguccgcagcccgcggccc

SEQ ID NO: 4182345 - RNA, 60 nt, Human
gggccagguggaccccagccucuuagccucccccagggcugcagccacauucccuggccc

SEQ ID NO: 4182346 - RNA, 73 nt, Human
gggccaugagagaucacaguggcaacucccuuccuaacaaagaaaggucagagugagcuguggcccaaggccc

SEQ ID NO: 4182347 - RNA, 57 nt, Human
gggccaugcacuuugcugggugcuggggacacagcaaagaucaaguaggcauggccu

SEQ ID NO: 4182348 - RNA, 88 nt, Human
gggccaugcucucugagccgccaggauauuguggcuuuugcuaauuaaggagcggauguguccugccagcgcaauuagaggcuggccc

SEQ ID NO: 4182349 - RNA, 59 nt, Human
gggccauuguaaguuuggaaagcucuugaaucagaguauagucucaaaaauaauggcuu

SEQ ID NO: 4182350 - RNA, 73 nt, Human
gggcccagguggcgggaggggcggggcacagccagggcucugccuggcggacucccggaacaucacuuggccc

SEQ ID NO: 4182351 - RNA, 67 nt, Human
gggcccaugugugcaccaacccuaugugacuuacagaacaagggaaacugaugcaaacauuaagccc

SEQ ID NO: 4182352 - RNA, 75 nt, Human
gggcccggcaugcagcagagugggccuggguggcccccacaguccccgcccucaccugcugcugggccuggaucc

SEQ ID NO: 4182353 - RNA, 71 nt, Human
gggcccggucuguguacuugcuggccguccugcucacaaggcgcuguagggcuggcgacauggcugggcuc

SEQ ID NO: 4182354 - RNA, 59 nt, Human
gggcccguuucuucuccgcaugcaauccgguaagccguggagcagcucuagcgggcgcc

SEQ ID NO: 4182355 - RNA, 56 nt, Human
gggcccucuggugguuucuuccuagacuuacuucauggggacuuccaggggagccc

SEQ ID NO: 4182356 - RNA, 55 nt, Human
gggcccugccuaaggaacacacucugcagagugcugggccaaagcaggguuuucc

SEQ ID NO: 4182357 - RNA, 56 nt, Human
gggcccugcugccaccauggcugggaccuugcccgccuugggcacaggcagggccc

SEQ ID NO: 4182358 - RNA, 57 nt, Human
gggcccugugauuucuugaggauuguuccaggaaacacacuuaagacaccugggcuc

SEQ ID NO: 4182359 - RNA, 87 nt, Human
gggcccugugcuggaaucuaucuaagucuagcuguuuaauaaucacucagacagcuaauuagaaauagauuauuggauacuagcucc

SEQ ID NO: 4182360 - RNA, 71 nt, Human
gggccgcuggaaggugagugacgugcgggucuucuuuuuuauguggcuguggacaccuuucaacgcugccu

SEQ ID NO: 4182361 - RNA, 80 nt, Human
gggccggaagauggcaccagaggaaacuacguuagcaagcuuugcaaaccagccuuucucugccaguuauuuuccuuccc

SEQ ID NO: 4182362 - RNA, 62 nt, Human
gggccggcugcgcuguccugaggaugcccuaccgggcuggccacagugacacgggcuggccc

SEQ ID NO: 4182363 - RNA, 67 nt, Human
gggccgguggugggcagggguggggcagcacuuugauguucuucccuucauuccaccaccacugcuu

SEQ ID NO: 4182364 - RNA, 66 nt, Human
gggccgugugugccaacuuuaugugcaagugcaaugaccugucuuagggauggcugcauaugaacc

SEQ ID NO: 4182365 - RNA, 68 nt, Human
gggccuagcaggguccaaugugaggcagcauuacccugugcuugcaacacauugccccugcucugccc

SEQ ID NO: 4182366 - RNA, 78 nt, Human
gggccucaguuuucucaucuguaauuugccuugcacaaucuuggcaaagauuagauaagauagauuugugaaggcacc

SEQ ID NO: 4182367 - RNA, 93 nt, Human
gggccucguguacaagacugcgcaugaccgccauccugacgggacucucaccaugagucaggaaauggcuucaugguuucuggucuggggcuc

SEQ ID NO: 4182368 - RNA, 57 nt, Human
gguaucuacaggcugggugugguggcccacaccuguaaucccagcacuuugggagcc

SEQ ID NO: 4182369 - RNA, 60 nt, Human
gguaucuccucuaucaauuugguacuccacacaggagagcaacaaauuagggggauuucc

SEQ ID NO: 4182370 - RNA, 81 nt, Human
gguaugauaguauugauuacaaauguugguuauucgugguaacggggaugguggcauuuguaaaaacguugcugggauauc

SEQ ID NO: 4182371 - RNA, 82 nt, Human
gguaugauggcacuauaacugauuucccuguuacccaccagcaugaagggcaugaagacagggaacuucauuagcugucccc

SEQ ID NO: 4182372 - RNA, 73 nt, Human
gguaugcagcuagaaaaugaaagauaauuugaauagucuuuucagauaaucuugaauauucuucuuugauacu

SEQ ID NO: 4182373 - RNA, 63 nt, Human
gguaugccuggcugaugaagauucaacagaugauucuugaguucuuuccguuagguauguacc

SEQ ID NO: 4182374 - RNA, 87 nt, Human
gguaugcugagaaaugugcuuggcuuggugugaccugguuuggcuuguccuccucacugucacaugaagccaacauagccagaaucc

SEQ ID NO: 4182375 - RNA, 56 nt, Human
gguauggcaguuuucaagaguucuguggugcugccaggguugagaauuguugagcu

SEQ ID NO: 4182376 - RNA, 62 nt, Human
gguauggugcuaggucagguagcuguaguuuccaacuggcucucuuaacuggccauccuacc

SEQ ID NO: 4182377 - RNA, 81 nt, Human
gguaugguuuaguggguuuauacaauuuaaauggcuuauauaauuauuugaaaugaaaagaaaaccuagucagccagaacc

SEQ ID NO: 4182378 - RNA, 74 nt, Human
gguauguauuuaggguuuucaaaagagauaauaagcaauugcuaauaauuauuugaagacauuagaguuggacc

SEQ ID NO: 4182379 - RNA, 80 nt, Human
gguaugugcucuaugaagggcucuucuauuuauggcccugugaugggcacauuagacaauagccuagauagaccacuacc

SEQ ID NO: 4182380 - RNA, 75 nt, Human
gguauguguguauuuauauaugaaauguaaauauauuuuacaugcauguguguaaauauacaugaaaagcaugcc

SEQ ID NO: 4182381 - RNA, 56 nt, Human
gguauuagcugugacgaggcauuguucauugcugccucucgguuacguuuaaagcc

SEQ ID NO: 4182382 - RNA, 70 nt, Human
gguauucagguaaaauagauaguauuucugaaguuaucauuaggaacuuuacucuauuuuauagugagcc

SEQ ID NO: 4182383 - RNA, 65 nt, Human
gguauugccacuuuugaacaguugguggcuccaaugcuuugcaacugucuugcaagugugauacc

SEQ ID NO: 4182384 - RNA, 65 nt, Human
gguauuggcuugcaugauauggcaucugggaagucucacaaucugccaucugcaagcuggagacc

SEQ ID NO: 4182385 - RNA, 87 nt, Human
gguauuucuauguuuuaucuggacugugauauaaauuagcuuuaccauuuuaagugauuuucauguuguauucagggaagcaaugcc

SEQ ID NO: 4182386 - RNA, 80 nt, Human
gguauuuuaauggcauuugggcuggcuuuucugcauuauaguauuguuuagagaagggcuuaaaaugcucuugaauugcc

SEQ ID NO: 4182387 - RNA, 76 nt, Human
ggucaaggcaggcaguucacuugaggucaggaguucgagaccaggcugaccaacauagugaaagccugucuuuacu

SEQ ID NO: 4182388 - RNA, 73 nt, Human
ggucaagguaaggcaggcuuucauccagagccaugccaugcacagcucaggugagcacugccuuacccagacc

SEQ ID NO: 4182389 - RNA, 56 nt, Human
ggucaaguguggugucaggcugucucacagguagugcaaagauauaccacauggcu

SEQ ID NO: 4182390 - RNA, 128 nt, Human
ggucaaguuccuuagcaauaccugccuuguugacuuuacucugugccucaguuuucccaucuguaaaauggcgauaauaagaaugggcaauucacaggguuguuaugaggacuaaaugaggaugugcc

SEQ ID NO: 4182391 - RNA, 72 nt, Human
ggucacacaacaaagacgggauaagguuuggauuccaauccaugccuuaaccuugcucuuaaccacuguacc

SEQ ID NO: 4182392 - RNA, 63 nt, Human
ggucacacaccaggaccugcagacaaccugggcuccuacagcaccugagcuccuguguggacc

SEQ ID NO: 4182393 - RNA, 70 nt, Human
ggucacacagcugcuuguuagaauagcagucccccugugcuacugcucccugcacucugcagcccugacc

SEQ ID NO: 4182394 - RNA, 72 nt, Human
ggucacagagcaugauggaagaucgaguuugcuuuucgguuuuagucucuucuauucagcucucauuucacc

SEQ ID NO: 4182395 - RNA, 66 nt, Human
ggucacaggcugggaagccuaggccucgcgguucugcagaguccgggcgcggcccagccuguggcc

SEQ ID NO: 4182396 - RNA, 77 nt, Human
ggucacagggaaaucaccuuucuugcugaagagauuccagggaagacaggaagauuguggaggugguuucaauggcc

SEQ ID NO: 4182397 - RNA, 60 nt, Human
ggucacaucuaaauggagcauugaggaguauuucuccuugaguguagcacagauguuacc

SEQ ID NO: 4182398 - RNA, 65 nt, Human
ggucacaugugauuugagccaauucugugaaugacagaugcuggucaccacgcaaaaaugugauu

SEQ ID NO: 4182399 - RNA, 79 nt, Human
ggucaccgcuggacagcccucacugugugccaggccuguccuuagcgcugugagggagggcuguccucaccaggugacc

SEQ ID NO: 4182400 - RNA, 60 nt, Human
ggucacgucacccaucagccuacuggguaugauuucaggugcugaacuggugaggucucc

SEQ ID NO: 4182401 - RNA, 91 nt, Human
ggucagaaaauuagauuucaugaauuccagaagcuugccuuuaaauaguaaggccugaagccugggagauucagagcauagaauuuggacc

SEQ ID NO: 4182402 - RNA, 74 nt, Human
ggucagagagcaugggaggcccgagcuaccaaugguggcuuuucucaacugggccuugauuccagcuucugccc

SEQ ID NO: 4182403 - RNA, 88 nt, Human
ggucagagauggaaucugucugggugcagcaguccgagcuugcacacaggagggacagcugcuuucaggccacagcgccauccugucu

SEQ ID NO: 4182404 - RNA, 90 nt, Human
gguucauaugaagaaggcaggcagggcucacugucuccuagaacucaucaggggauuggcaccugcagccuggguguuuauauuugaauu

SEQ ID NO: 4182405 - RNA, 77 nt, Human
gguucauccaugucagcguauauagcaguacuucauuccuuucauugcugaaucauauucgacuccauggauauucc

SEQ ID NO: 4182406 - RNA, 64 nt, Human
gguucaugaaaugcugcaguuaaggugcuggucuaucugaggggggccacaccuucugcagacc

SEQ ID NO: 4182407 - RNA, 76 nt, Human
gguucaugcgaugguuggagggaugguaaaagcaguuagcucuugucagcugcuucccucugcuagugcuugagcu

SEQ ID NO: 4182408 - RNA, 91 nt, Human
gguucaugcguuggucagggacuuggcuuucuuggggagacacaauuauuuccuagggcagccuuauagcucccagacagcuagugaggcc

SEQ ID NO: 4182409 - RNA, 101 nt, Human
gguucauuguaucaucacuuuaauuuuaaaauaagaauuagcuucccuuauaaaacacauggagguaggcuaguuaguauuuacaaaagaaacaguguccc

SEQ ID NO: 4182410 - RNA, 56 nt, Human
gguuccaagagauuaaguuacuugcccagggucaagaguuacuaagugcuggaacc

SEQ ID NO: 4182411 - RNA, 82 nt, Human
gguuccaagucuuugcuacugugaauagugccacaauaaacauacgugugcaugugucuuuauaguagcaugauuuauaauc

SEQ ID NO: 4182412 - RNA, 82 nt, Human
gguuccaagucuuugcuauugugaauagugccgcaauaaacauuugugugcaugugucuuuauagcagcaugauuuagaauc

SEQ ID NO: 4182413 - RNA, 70 nt, Human
gguuccaaucuucuuucuuaacaguacaugaaacaauugauggugcauuagaggaaaaagauuugguccc

SEQ ID NO: 4182414 - RNA, 124 nt, Human
gguuccagcagcggcugacaaagccuccaucagauaggugcaagagaaagcuugucucagagucuuccuguugucacagucugcggugcuguccuaagcccugaaauacaguugcucggcuucc

SEQ ID NO: 4182415 - RNA, 84 nt, Human
gguuccagcagcucaggcuccuucccauugguucucacaaagugugccucucuggguggagcaggcuggcgcuuuaguugaacc

SEQ ID NO: 4182416 - RNA, 72 nt, Human
gguuccaggccucuccuuagucuggcagugggugucucaacccgaugcccugagcagagguggggccuggcc

SEQ ID NO: 4182417 - RNA, 108 nt, Human
gguuccauggcuuuguggguacaguuacucauagaagcacuuuaucugaugacugcacuuccccaaagaaaagcuuucuguuaacuguacaaauuuugaaauagaacc

SEQ ID NO: 4182418 - RNA, 70 nt, Human
gguucccccaagggccggcauucaccaccagacacgugagugagaggccccagcucuuggccuuggagcc

SEQ ID NO: 4182419 - RNA, 66 nt, Human
gguucccggaaacaggugacaaucucauuuucuuucuugagaggauccuuuguucuggguggugcc

SEQ ID NO: 4182420 - RNA, 92 nt, Human
gguucccuauugggacagcuuuguuuucccugcugaacacaaaauccccuguucacugggagagcugacaaggagaccccauggggcuggcc

SEQ ID NO: 4182421 - RNA, 79 nt, Human
gguuccggcaggaaggcauaacugagcagccugggcauuuucaaccaaggugcagagaccacugugccuuccugcuacc

SEQ ID NO: 4182422 - RNA, 56 nt, Human
gguuccucccagcaauaaaacgcuaucucuaccugcuguuuaugagcugugggacc

SEQ ID NO: 4182423 - RNA, 63 nt, Human
gguuccugucuggggacucccuggguaacccuguccugcccauggcuucccuaggcacauuuc

SEQ ID NO: 4182424 - RNA, 56 nt, Human
gguucuaggauuaggaggcccaguauuccauuuugggugaacugcuaugaagaacc

SEQ ID NO: 4182425 - RNA, 61 nt, Human
gguucuauuaauuuuggguaguaaauccuuuccuuuuagacuccaaaaguuugguggaacc

SEQ ID NO: 4182426 - RNA, 61 nt, Human
gguucucaaauaccauguaucaucagucauuguuuugucugcauguuugugucugagaacu

SEQ ID NO: 4182427 - RNA, 89 nt, Human
gguucucaauuuccugugcagcagcuugauccuagaaauguguguuacaacuuuuuauuucuuaguuugccacagaggaauagaggacu

SEQ ID NO: 4182428 - RNA, 71 nt, Human
gguucucuccugugccucucuaagcuuucuacaacuauaaauuaauagauaaaguuuggagucaggagacc

SEQ ID NO: 4182429 - RNA, 85 nt, Human
gguucucuuggacuuagccuggguugucugcaucugggaaggacuuggacaggaaagagcuaggcauaggagcugaaagggaacc

SEQ ID NO: 4182430 - RNA, 77 nt, Human
gguucugaucagaugacuaugaccaacacuuuguuacaagacagaaaugauggaaauauguaaucugguuacugacc

SEQ ID NO: 4182431 - RNA, 69 nt, Human
gguucuggaggagcugaucccacuacugauguuucuggacaaaguuagugaagcucaucacagcgaacc

SEQ ID NO: 4182432 - RNA, 58 nt, Human
gguucuguccauucagugcagucauaauuugcauacugcuuccuggauggccagcauu

SEQ ID NO: 4182433 - RNA, 55 nt, Human
gguucugugugaaugguauuuaaaacagaagcagauaccauuugccaaaaggauc

SEQ ID NO: 4182434 - RNA, 59 nt, Human
gguucuucaaucagcuguacuuauguaaauaagaauucaggagucaguugauggggacc

SEQ ID NO: 4182435 - RNA, 93 nt, Human
gguucuucccagagagaccagccuugccaauuuugcaguauuguugaaauaagaaagaauuucuggaagauugcaaggcauuuggaaagaacc

SEQ ID NO: 4182436 - RNA, 59 nt, Human
gguucuugggccgucugcuacauuuccgugauggagguggcagagcuggcccagcgacc

SEQ ID NO: 4182437 - RNA, 90 nt, Human
gguucuuuccccuccuccccgcuggcgugucaaagaugggagguuaucuuuccuguguuacccuugcagugagggggaggccugaggacu

SEQ ID NO: 4182438 - RNA, 71 nt, Human
gguucuuucuguuacuuuuaccuuagauauucuggucccaugaauguaccugaaauagccuagaaagcacc

SEQ ID NO: 4182439 - RNA, 58 nt, Human
gguucuuuuuccuuucaguccuuccuuaauuaucaguaggcugaaaguagaaaguauu

SEQ ID NO: 4182440 - RNA, 86 nt, Human
gguugaauagaaugagggagaugauguagaaagcuguuuugauauguaacucuucaugcucccauuuccuacauucuuauuagucc

SEQ ID NO: 4182441 - RNA, 58 nt, Human
gguugaaucauucuuugcaccguccaguuaagguccugguucgagggcugaaucaacc

SEQ ID NO: 4182442 - RNA, 68 nt, Human
gguugaauuuuaugacaauauuccaccauuuuugacccauagaaauggcagugucauaaggcucaacc

SEQ ID NO: 4182443 - RNA, 73 nt, Human
ggucccuccugggagagcacggaggggucaucucccuuaggagccacccucacagcuucccggggcuggggcu

SEQ ID NO: 4182444 - RNA, 71 nt, Human
ggucccugcucagcuguccucacgcugcaucaugcuggaugaucacagcuggggcucagcugcucagggcc

SEQ ID NO: 4182445 - RNA, 84 nt, Human
ggucccuguugcccugcccagcuucccgagugcacauacguguggauuacaggugggcuggggacccaggggacggcugggauu

SEQ ID NO: 4182446 - RNA, 60 nt, Human
gguccggcugaggaucuccaggccuguucaugcugccugggccaugcccagucccagacc

SEQ ID NO: 4182447 - RNA, 123 nt, Human
gguccguccugucuugaugucuugaugugacuguaugugcccugggggcucacugugguuuacaaguggcuugugaagcuccugggagcaggugguacacccagugcugaagacagggucgcc

SEQ ID NO: 4182448 - RNA, 73 nt, Human
gguccuaagcagucaggcagguacaacccuggcaguaggucccaagggugcaucugucugagugcuuaggacc

SEQ ID NO: 4182449 - RNA, 105 nt, Human
gguccucagccucuccccugccuugggguccacaccgcaggacagggcagcuucuuaccuucccgggugggcugcgaggccagggacaaggaguacugaguggcc

SEQ ID NO: 4182450 - RNA, 58 nt, Human
gguccucuggugaaagcauucccccuuuuggaaaugggaucuguaaaccuggagaacc

SEQ ID NO: 4182451 - RNA, 58 nt, Human
gguccugaguaccuauguuuauugcaucaauaaaugaauaagaaggcauuacgggacu

SEQ ID NO: 4182452 - RNA, 57 nt, Human
gguccugcuggcucagcugagcuugugcagagaaagggcugggucaugcagcuggcc

SEQ ID NO: 4182453 - RNA, 55 nt, Human
gguccuggaaguguaaguggcaaggggauuuucucugggacuucuuucuaggauc

SEQ ID NO: 4182454 - RNA, 74 nt, Human
gguccuggccugauaggcgguuugaggaagcugagugggagcugaccuccucugcgcccuugaucagccagacc

SEQ ID NO: 4182455 - RNA, 98 nt, Human
gguccugguggacagcaaacuugagccaagggcuugggacacccucugaccagaccaugacacccagcaaggccagcucagggcuauccagcagggcc

SEQ ID NO: 4182456 - RNA, 82 nt, Human
gguccuguaucuuagagagucguguuuuguuucaugcuugauugugucuaacacacaugccuuuccuaaguauaucaagacu

SEQ ID NO: 4182457 - RNA, 59 nt, Human
gguccuucaguagguuccagacgugggugugugauagugucaggaacaccugaaugauu

SEQ ID NO: 4182458 - RNA, 84 nt, Human
gguccuugaagagaaucagaagguugaugacugagcagccucugcaaaauacauuaauuucuauuuuuaccuucagaugggacc

SEQ ID NO: 4182459 - RNA, 62 nt, Human
gguccuugcuucgguccaguacagugacauuucuuucauguuugggcugacugccaagggcc

SEQ ID NO: 4182460 - RNA, 106 nt, Human
gguccuuggguggcugaaccuuccagcuggggcaguggcuggggagccugcucugagcucaccccuugcccaggcuccagcugggaugacgugagcaccuuuggcc

SEQ ID NO: 4182461 - RNA, 74 nt, Human
gguccuugucucuaaaacaauucaagguugaaggacuaacccuccucucaacaguggcaaagaggcacggggcu

SEQ ID NO: 4182462 - RNA, 69 nt, Human
gguugauuugaaguaaauacuuuuuguuagcaauaaauacuuugcuugaaacauugcuucaauguaacc

SEQ ID NO: 4182463 - RNA, 57 nt, Human
gguugcaaacuccugggaucaagugauccucccaccuugguccccauccuugcgauu

SEQ ID NO: 4182464 - RNA, 82 nt, Human
gguugcaaauggaggccuggcagccucguccagugccaagaacugcucugagcaucagucaccagcagccuuccauucaacc

SEQ ID NO: 4182465 - RNA, 68 nt, Human
gguugcaacuucucccaucacucuucucuaaaacugaauggggaaaggagggacuggagugugcuacc

SEQ ID NO: 4182466 - RNA, 63 nt, Human
gguugcagagugcugauuucucauuguauacucacaugguugaaagagagagagcaugccacc

SEQ ID NO: 4182467 - RNA, 62 nt, Human
gguugcaggguugaccaauaggcuuaauaacaucaaggccccuggacagcagcuuugcaauc

SEQ ID NO: 4182468 - RNA, 81 nt, Human
gguugcccagcuaggaagggaaaggcuucaacucuagguuagacucccagccucuucucuuucuccucugcugggcagacc

SEQ ID NO: 4182469 - RNA, 55 nt, Human
gguugccggggcaggacuggaaaucaguuucuuuccucucacacccaaggcagcu

SEQ ID NO: 4182470 - RNA, 83 nt, Human
gguugcuagagggcuggcccugggcagaggcaacaugaaaaggggccuuuucaugcccccauagucaccccauugaggcagcu

SEQ ID NO: 4182471 - RNA, 119 nt, Human
gguugcuuccaagaauaaaaugguuguuuuaagaauguuuucccuuuuuucucuuuuauuuacuggugggcagaggagagaacauuauauaaacagaacaucaguuaauuaauugcacc

SEQ ID NO: 4182472 - RNA, 96 nt, Human
gguugcuuucucuguguccuaugcuuucugaaugcuugggcucaccacaauucuaaaauagggacccaggaaaacauggugcagagaaggucagcc

SEQ ID NO: 4182473 - RNA, 94 nt, Human
gguuggaagcugagggaccuugccggcucugagcucagcgucagaguuuagcaaacagugaagcgugcucggugcaggguucggcuugcugacu

SEQ ID NO: 4182474 - RNA, 58 nt, Human
gguuggaggugggaauagcuaguuauccaugacccaauuuauagcucuauuucuagcc

SEQ ID NO: 4182475 - RNA, 59 nt, Human
gguuggauuugaaguuauuacugcaggagauuaggucagaguaugcuacaaagccagcc

SEQ ID NO: 4182476 - RNA, 58 nt, Human
gguuggcaaggccagucucucaaggugauugagaauacacagcugguccuugguaacu

SEQ ID NO: 4182477 - RNA, 79 nt, Human
gguugggacagaccauguagcaccuuccacuuaauuccuauuacuuauuuggagguagcagcacauggugguuuuauuc

SEQ ID NO: 4182478 - RNA, 85 nt, Human
gguugggaggggcagggcacuuuacccauagcuugguaaggugacucuccagcccuggugccaagguuccccuccacuccccacc

SEQ ID NO: 4182479 - RNA, 69 nt, Human
gguugggcgaaagcaauugugguuuuugccauuaaauggcaaaaaaacacaauuacuuucgcgccaacc

SEQ ID NO: 4182480 - RNA, 90 nt, Human
gguugggcugaaggaaaccccggugaaacccacaccuguaaagaugcuucucacagugggacuuuuaucgcuuggguccuggucacaauc

SEQ ID NO: 4182481 - RNA, 130 nt, Human
gguugggggcggcuggaggccucgggguggcggccacgcucgggcagggcaggagaucugcgcucaguccuggagcccuucuuggccuuuguggcccugucacucuuuucaccccuggcuggcccuagcc

SEQ ID NO: 4182482 - RNA, 68 nt, Human
gguugggggugagaaggcaggggcacuccagggacuggcaucacccgagugucuacucacucccaggc

SEQ ID NO: 4182483 - RNA, 111 nt, Human
gguugguaaugaccgugagccuuuucucccaacucuggaagccaguguccccgcaauuggcuuguacgguugggagaaaacuuugagaccaggagucaccucuaucugauc

SEQ ID NO: 4182484 - RNA, 74 nt, Human
gguugguacaaaaguaaucguggcuuuugcuauugaaaguaauggcaaaaaccacaauuacuuuugcacugacc

SEQ ID NO: 4182485 - RNA, 65 nt, Human
gguugguagcagguucucugcuccuuaguuccugaguacuucugagcagacacuugugaccuucc

SEQ ID NO: 4182486 - RNA, 74 nt, Human
gguuggugcaaaaguaaccaugguuuuugcaauuaaaauuaauggcaaaaacugcaauuacuuuuacaccaacc

SEQ ID NO: 4182487 - RNA, 74 nt, Human
gguuggugcaaguguaauugugaucuuuucccuuacuuucaaugccaaaaaucacaguuacuuuugcaucaacc

SEQ ID NO: 4182488 - RNA, 58 nt, Human
gguuggugcugcucacaucuggagguaaacaagaauugcuugugagcacguaucaucc

SEQ ID NO: 4182489 - RNA, 75 nt, Human
gguuguaagcagaucuggguagugcaagacaugaacucugccagauccaaacuaugcaucuccccagauacaauc

SEQ ID NO: 4182490 - RNA, 64 nt, Human
gguuguacacugaagugucuugguauaauaguuuauaaugaaaauaucuucagugaaugcaacc

SEQ ID NO: 4182491 - RNA, 66 nt, Human
gguuguagcuuaugggaaacuccagaggcuggacaagaucucugagguucccugggucccacagcc

SEQ ID NO: 4182492 - RNA, 126 nt, Human
gguugugcucaaaguccuguuugcauguuaagcacaauguuuuuguucaaagaguacauuuauauggaugacuugggaggcugaaggacauuguguuaggaggcaaguaggguuugaagcauaccc

SEQ ID NO: 4182493 - RNA, 64 nt, Human
gguuguggaagugaacaaccaaggcaggugguacugccauuuccugauagaacacuuuccaauc

SEQ ID NO: 4182494 - RNA, 57 nt, Human
gguuguguccuuacaugauagaaaaggcaagacauuucuucuguaaggacauuaauc

SEQ ID NO: 4182495 - RNA, 79 nt, Human
gguuguuggccagcuuucucagaggcuucuaggcagaugugucuucaugucuccuugggaaggcuucagucguguggcu

SEQ ID NO: 4182496 - RNA, 69 nt, Human
gguuguuuugucuuuuuuuguacugaucucagaugagaccacugaugaguaggcagacaaggcccugcc

SEQ ID NO: 4182497 - RNA, 55 nt, Human
gguuguuuuucuggaagguuuguggucuagccauugaacagagagaaaaacaucc

SEQ ID NO: 4182498 - RNA, 112 nt, Human
gguuuaagucccauuaccauugaugugagcuaaguacucucaucaagaggcuugggagcccuugaguuauuuagauucuuuuuguaacauuacaggagaggggaaaaaagcc

SEQ ID NO: 4182499 - RNA, 66 nt, Human
gguuuaaugagcucagcccaaagagcaguguuccuaaacggggcauggcagcaagagcucauggcc

SEQ ID NO: 4182500 - RNA, 72 nt, Human
gguuuacaaagcaguuauaguaucuuauuuuuccucaagagccuugugagguaagagcuauuauugcaaacc

SEQ ID NO: 4182501 - RNA, 58 nt, Human
gguuuagaugauuuucagucaaagcaauucuauugucaccuggaaaucacucuaauuc

SEQ ID NO: 4182502 - RNA, 108 nt, Human
gguuuagaugggggaguuaauuagggucugaggguugugcuggaggacaugggguacuugcccauaagguccuuguauagaugcagacacuuggcuccauugccugcc

SEQ ID NO: 4182503 - RNA, 92 nt, Human
gguuuauccuguucuuuacuagcagaguagugccuccagauuauuuauauagucaggauuuacaaacuucaguuuggcuggaaugggaagcc

SEQ ID NO: 4182504 - RNA, 83 nt, Human
gguuuauuuucaugugcauuuagguucauguguauguuugucccuguguacuuuuguguaucugugugcauaugaugugagcu

SEQ ID NO: 4182505 - RNA, 58 nt, Human
gguuucaacuucaaccucuccauuuuauacuuuguuuugugaggcugggguuggaacu

SEQ ID NO: 4182506 - RNA, 124 nt, Human
gguuucauggaaaauagagaauugcguguuagaagugccagguaggcauacagagcugagaauguucuucuucaucuaucuggccccuuuuauauaagcucuuaauauggugaccaugagaacc

SEQ ID NO: 4182507 - RNA, 93 nt, Human
gguuucauucacuuuuguucaacaucacuuccaccuucccuugugcuucaauaagauaaugggugaggugauagagcaaaaaugucccuggcc

SEQ ID NO: 4182508 - RNA, 82 nt, Human
gguuuccaagguuauggcagauucugguugauacuugcaaacaacugacaagaugaaucaguauguguccuagcaggaggcu

SEQ ID NO: 4182509 - RNA, 56 nt, Human
gguuuccaccuugcuaugagaagagugugaagcaguucucucuagggguggaagcu

SEQ ID NO: 4182510 - RNA, 130 nt, Human
gguuuccauagcauuuaguuuagccaaaaguaaccuuagcugaggcaaauaguuuuaagugaaaauuuauuuaucaaauacuacuuuggaauuuuaggaaagguuuuuuuuaaauuauaauaugguuacu

SEQ ID NO: 4182511 - RNA, 72 nt, Human
gguuuccucucacugggacauauugcuaguguuggcugacaaucaguugccauguguaccugagauaaagcc

SEQ ID NO: 4182512 - RNA, 63 nt, Human
gguuuccugucaaggauuguuuguugaaaucaucuuacagccccauucuucagcagugagacc

SEQ ID NO: 4182513 - RNA, 65 nt, Human
gguuucuagaugcggggcuugugcugaagccucucccauuggacuagaccuugcuucuggauguc

SEQ ID NO: 4182514 - RNA, 114 nt, Human
gguuucuaggaaaugaauuccauguacaguagagccagguucaguugaccucacuggagaccuugaacccagcuugcugcaccgugggguccuuuaaucaucucccugcugacc

SEQ ID NO: 4182515 - RNA, 59 nt, Human
guagggacuguucucaccugagcuucuccagggcugaagcugggugugaccaucucugc

SEQ ID NO: 4182516 - RNA, 60 nt, Human
guagggaugacucuuggcugauuccuaaugugggggguaggguguuggggucaucucuau

SEQ ID NO: 4182517 - RNA, 55 nt, Human
guagguacuuaggauuaguucucaguuuuuacuguuagaucucugcagugccuac

SEQ ID NO: 4182518 - RNA, 66 nt, Human
guagguauuaaagauguguuguugguuuccaaaaaggaacacuggaaauaaauuuugaauguuugc

SEQ ID NO: 4182519 - RNA, 68 nt, Human
guaggucaucagauugacaagggaggcaaagcaauuuggaauuagucucucuggcaaaggaugccuau

SEQ ID NO: 4182520 - RNA, 94 nt, Human
guaggucucaggcacuucggcagcgugguagaggugacaauuccaaaggaggcagccacaguggugcuagcugcccgaaggucucagagaaagc

SEQ ID NO: 4182521 - RNA, 82 nt, Human
guagguggggagagggcccauguugggcugcugggaccuccagaccagcgggagaagggccuuagacuccagauucacuuac

SEQ ID NO: 4182522 - RNA, 69 nt, Human
guaggugucaguacaaauguccauugcacccuaccuuuuuagugaugggcucuguaaagugacaccugc

SEQ ID NO: 4182523 - RNA, 72 nt, Human
guagguuacugccaugggcaucugaggcucagucuuccugggaucuuuugagauacuguggaccacaccuac

SEQ ID NO: 4182524 - RNA, 67 nt, Human
guaguaagcauucaauaaguuccaucauuuguugaaaguggugcugacaguucugagugcaaacugc

SEQ ID NO: 4182525 - RNA, 93 nt, Human
guaguacuugcuucauagggcuauucugaguaauaauggguugauuuuucuauaaugcauuuagaauaauucaugacauuuaguaaguauuau

SEQ ID NO: 4182526 - RNA, 72 nt, Human
guaguagaaagugcauuagauagaaugaugcuuguuuggaaguguuuuucuaauuguaaugcaaucuacuau

SEQ ID NO: 4182527 - RNA, 75 nt, Human
guaguagaauucauucugggcaaacacugaaaaaagugccuuacaguauuucugcucaugaaagaguuucacuau

SEQ ID NO: 4182528 - RNA, 105 nt, Human
guagucuaccauauuagauucuuauuccaguuggguucuaauacauaguuccuguguauuugucuuauagggaacagcauguaauuaggaaauuugguaauuuau

SEQ ID NO: 4182529 - RNA, 64 nt, Human
guagucucagcuacuugggaggcugaggcaggaagauugcuugagcccaggaguuagaggcugc

SEQ ID NO: 4182530 - RNA, 73 nt, Human
guagucuccacuguagaaguuaauugaugaguaguagccuacaaucaggcucuagcuucuccaggaacacuac

SEQ ID NO: 4182531 - RNA, 88 nt, Human
guagugaaaauuaaauuacucaaugcacauaaagagcuuggaacagugcugggcacuuuguuaguguuugauagguuuuagucauuac

SEQ ID NO: 4182532 - RNA, 74 nt, Human
guagugaaguucucaggaggagaauaaauacauuagugucauuuuagagguguucauucucuccauucagcugc

SEQ ID NO: 4182533 - RNA, 93 nt, Human
guagugccaggggcaggaauggccugcugcagugugacaguucugucauaggagagcugcuuugcugggcaggcccuugacucaggauaauac

SEQ ID NO: 4182534 - RNA, 68 nt, Human
guagugcgcauggccuguuugucaccuguaaaugaaggguuagcucaccaacaggcucugcccacugc

SEQ ID NO: 4182535 - RNA, 77 nt, Human
guaguggggccauccugggcacugcaggguguugagccucauccccgggcuccacucaccagaugccaggaccacac

SEQ ID NO: 4182536 - RNA, 61 nt, Human
guaguggguacugggcaggcagagagagaaauuucuugguacaaaccucaugucccaaggc

SEQ ID NO: 4182537 - RNA, 91 nt, Human
guagugucuuagaagacuggauaaauggaugauuugucucccagagcuugaauucauccauuuaugcaagauguuuuaagagaauggcugc

SEQ ID NO: 4182538 - RNA, 56 nt, Human
guaguguguaggcacugugcucugaugugugucaggugucagugagagcacaguac

SEQ ID NO: 4182539 - RNA, 100 nt, Human
guaguguuguucacgaagaauuuuguuuuauuuucuucuguaauuccuuuuuuccccccggaguauaaugacagccagauucuucucuaucaucuacugc

SEQ ID NO: 4182540 - RNA, 85 nt, Human
guaguguuuaauguaacaggaagaacagaauccuagcugaucgguggacuacugggaguucuccaugucccuauauuaaaauugc

SEQ ID NO: 4182541 - RNA, 59 nt, Human
guaguguuuggaugauagagaugaacuucuaaaauguucucagugucaguagccacuac

SEQ ID NO: 4182542 - RNA, 87 nt, Human
guaguucuggaguuggugcaggaaucugcaauugaaaaaguauuuugaguauuguaauucaaguaguucuugcauuuugagaaauac

SEQ ID NO: 4182543 - RNA, 55 nt, Human
guaguuguaaauuggccacagucguucauacgagugcucaugagcccacagcugc

SEQ ID NO: 4182544 - RNA, 78 nt, Human
guaguugucucuuggucuacauuugugucuuuuggugcacaaaugaaaagacacaaauguagaccaaaagacaacuac

SEQ ID NO: 4182545 - RNA, 69 nt, Human
guaguuuagcuuucaugaaccuggucguccacaauggacugccaggauuuuguaaagucccuaaauugc

SEQ ID NO: 4182546 - RNA, 90 nt, Human
ggugcucagaacuuguuucauuggcucccugaugaauccaaaaauggcaagaggaguccccaggacucaguuagugauaaggugagugcc

SEQ ID NO: 4182547 - RNA, 58 nt, Human
ggugcuccacauugucuuuguguaugugcagaaauuauaaacagaacucaggggcacc

SEQ ID NO: 4182548 - RNA, 72 nt, Human
ggugcugacaaacaagguggugucaguuauggcacuggccaucuuucugagacccuuagucuuugucauacc

SEQ ID NO: 4182549 - RNA, 73 nt, Human
ggugcugacauucagagucuggcaggcaguccagagaggugggaaacagcuggacucuggggucagcucaacc

SEQ ID NO: 4182550 - RNA, 61 nt, Human
ggugcugaggaaaaaugugacucuaauuuugcuacaagaagagauacaucuuucccacacc

SEQ ID NO: 4182551 - RNA, 55 nt, Human
ggugcugccuauagucugaaacacugcccuucuguuucaugagcugugaagcacc

SEQ ID NO: 4182552 - RNA, 83 nt, Human
ggugcugcugcuuuuuagcauauggaauaaggcuuguuaguuccaugucaguccuuauuccuauauuccuaugcauagcuucc

SEQ ID NO: 4182553 - RNA, 58 nt, Human
ggugcuggacacguggcacuccuuguucuccugcaggaagcucacguaguccugcacu

SEQ ID NO: 4182554 - RNA, 97 nt, Human
ggugcugggagguccagggcacgggcagugagcacagccugcaccaggugaacgggcacagguggugccuccucccuuccuggcugccccaugcgcu

SEQ ID NO: 4182555 - RNA, 69 nt, Human
ggugcuguguuaggcuuuuucucaugucaucacaucaaccucucagugagccagcuaucacacagcauu

SEQ ID NO: 4182556 - RNA, 79 nt, Human
ggugcuuaaagaauggcuguccguaguauggucucuauauuuaugaugauuaauaucggacaaccauuguuuuaguauc

SEQ ID NO: 4182557 - RNA, 103 nt, Human
ggugcuuagagacaguaguauagauauggaauuuuauucuaagcacguauaaaguuauuauaguguugauagcaguggagugccauagucugauuuaagcauu

SEQ ID NO: 4182558 - RNA, 109 nt, Human
ggugcuucaagaagggccucucugagagagcugagggcaggauggggugaccagcuauccugguuugcccagaacugucccaguuuuagcacugaaaguccugggcacu

SEQ ID NO: 4182559 - RNA, 75 nt, Human
gguggaacuggaggggaaaaugguaguauaaccauauugguauaaaaugccuaccuuuacuucaccacuuccacc

SEQ ID NO: 4182560 - RNA, 78 nt, Human
gguggaaugaguuacagagaggauuaugguggggcguagccucauucagugauucauuuguacaacucaauucccauc

SEQ ID NO: 4182561 - RNA, 77 nt, Human
gguggaaugaguuucccaaugucuuaaagaguugcuaaacaucagauguaggauaugguagaaaucauucccaaacc

SEQ ID NO: 4182562 - RNA, 65 nt, Human
gguggacagucugucugucaaguucaucuccauguucuuggagguuggcagaugcauuggccucc

SEQ ID NO: 4182563 - RNA, 59 nt, Human
gguggacccuuggauuucugaagacauuaauugucuuaauaguauccagguuccuugcc

SEQ ID NO: 4182564 - RNA, 79 nt, Human
gguggagaagggagugaggucaggaucucagggaaagaacacuuuaccuacugcauccaggccucuugcugcucacacu

SEQ ID NO: 4182565 - RNA, 79 nt, Human
gguggagcuggacgcccuugcaaccgccaccccuccugcucauuaacagugaccacuggcgcugcgagacccacucccc

SEQ ID NO: 4182566 - RNA, 69 nt, Human
gguggaggaugugccaccagcuuugcaacucccaaggggccuuagcagucuggugggcagauuccuacc

SEQ ID NO: 4182567 - RNA, 68 nt, Human
gguggaggcacaccucagacugggagcaccaguuucaauauuguuuccaugaggcaugccgcucagcc

SEQ ID NO: 4182568 - RNA, 118 nt, Human
gguggagguagagguugagguuauguauggcaggauacccaguccggcuuccaguuggaucaaggcaucuggguuucuugacccaucccacuugacucuuucauuuagcccuuccauc

SEQ ID NO: 4182569 - RNA, 55 nt, Human
gguggaggugggauuugaaccaaggucagccugacuccaaagcucacguuccauc

SEQ ID NO: 4182570 - RNA, 57 nt, Human
gguggagguguccaacucgugggugugccugggcgucaccuacccccgcagcucccc

SEQ ID NO: 4182571 - RNA, 65 nt, Human
gguggagugauuagaaaguacacuuggguguugauucaagcuacagucuucaguuuagcuccacc

SEQ ID NO: 4182572 - RNA, 56 nt, Human
gguggauaugcaaguagcuuucacacuaggaauugugaagccugaggcauagcccc

SEQ ID NO: 4182573 - RNA, 62 nt, Human
gguggaucuggcuguguccuggccugggucagcuuugccaguaaaacaaaggccauguuccc

SEQ ID NO: 4182574 - RNA, 108 nt, Human
gguggauuaaaaauauaaucuggaggaagaauguuuuggcugggacccacacacuuuuuuucaaaaagcuuuaugaucucucagcuacaauuccucuugauuuucacc

SEQ ID NO: 4182575 - RNA, 79 nt, Human
gguggauuauauuucuaaggacaaggucuuggagagaugaggucucccagcgaugaggucacuugaaggccccuccacc

SEQ ID NO: 4182576 - RNA, 61 nt, Human
gguggcagcauaaagcauuuagcugcaaaugaauuuuccagugugagugcucauguccauc

SEQ ID NO: 4182577 - RNA, 125 nt, Human
gguggcaggaaaaauggugggcacauuuccagaaugacaaaugggagaagcaaucgugacaucuccaggugggggaagcauaggaggaagagguuguucucucaggaaguugccuccuagccucc

SEQ ID NO: 4182578 - RNA, 59 nt, Human
gguggcaucucaguucaugggcacagugugauuguuuccauuuagcaugcgaugucauu

SEQ ID NO: 4182579 - RNA, 70 nt, Human
gguggcccagcugcagaugguggauuagccccaaugcugucugccauugaugagcuggcauuaugccacc

SEQ ID NO: 4182580 - RNA, 98 nt, Human
gguggcccauuuccuguaaucccagcuacucaggaggcugaggcagaaucgcuugaaccugggaggcggagguugcagggagcugagauggcgccacu

SEQ ID NO: 4182581 - RNA, 66 nt, Human
gguggccucagcuuuuuguuuacauaguuuuaguccuugcuuuguaaaacaaaauuuguggagacc

SEQ ID NO: 4182582 - RNA, 81 nt, Human
gguggccuucugcaaaccaaggagggaggccacagaggacaccaacccuucuggcuucuugaucuuggacuugcaggcucc

SEQ ID NO: 4182583 - RNA, 73 nt, Human
gguggcgccguaguguagucggaguggcacagcugaaacucuuagaggccucugcaauuacauugugcccauc

SEQ ID NO: 4182584 - RNA, 58 nt, Human
gguggcggccugggaauaaccuuggcacuuguuaccuuggaaaucaccaggcuccacc

SEQ ID NO: 4182585 - RNA, 74 nt, Human
gguggcuacaggccuggggucccggcuuagaggaccucugagagcucuggggccccuucuuggucgugguugcc

SEQ ID NO: 4182586 - RNA, 55 nt, Human
gguggcucacaccuguaaucccagcacuuugggaggccgaggcagguggaucacu

SEQ ID NO: 4182587 - RNA, 55 nt, Human
gguggcucacaccuguuauccuaacacuuugggaggccgaggcagguggaucacu

SEQ ID NO: 4182588 - RNA, 55 nt, Human
gguggcucacgccuguaaucccagcacuuagggaggccgaggcagguggaucacu

SEQ ID NO: 4182589 - RNA, 55 nt, Human
gguggcucacgccuguaaucccagcacuuugggaggccaaggugggcggaucacu

SEQ ID NO: 4182590 - RNA, 55 nt, Human
gguggcucacgccuguaaucccagcacuuugguaggcugaggcagguggaucacc

SEQ ID NO: 4182591 - RNA, 66 nt, Human
gguggcucaguagcaguguggucagaaggagaaccaaggccuccuggcuuccagagcugcuccacc

SEQ ID NO: 4182592 - RNA, 55 nt, Human
gguggcucaugccuauaaucccagcacucugggaggccaaggugggcggaucacc

SEQ ID NO: 4182593 - RNA, 55 nt, Human
gguggcucaugccuguaaucucagcacuuugggaggccgagauggguggaucacc

SEQ ID NO: 4182594 - RNA, 55 nt, Human
gguggcucaugccuguaaucucagcauguugggaguccgaggcaggcagaccacc

SEQ ID NO: 4182595 - RNA, 58 nt, Human
gguggcucugagcuggccuuuccauggcaugcacugcccagagccccucagcgucacc

SEQ ID NO: 4182596 - RNA, 69 nt, Human
gguggcuggagggacuggcagggagguggggcuugcccugagccuuagcagggagucuguccagccacu

SEQ ID NO: 4182597 - RNA, 68 nt, Human
gguggcuggcagguaaagccccggggcaguaggauccggaacgucccgguggccuccugccugccucc

SEQ ID NO: 4182598 - RNA, 88 nt, Human
gguggcugggauggcccaggugcacccagaggccccagcccuuuggcugccuuuggguugugacuuggguugucucugaggcccugcc

SEQ ID NO: 4182599 - RNA, 60 nt, Human
gguggcuuagugaccucauuuacaguguuucauacacucugaaacuaccuacaagcuacc

SEQ ID NO: 4182600 - RNA, 67 nt, Human
ggugggaaaacagaaugcaggggaugcugcccaagccugggcgcuccugaggguucugcaucucacc

SEQ ID NO: 4182601 - RNA, 66 nt, Human
ggugggagcaguucagguguggcugauuuggguuugacagaagccguacggaugcuguuucuuucc

SEQ ID NO: 4182602 - RNA, 84 nt, Human
ggugggagguggcagaggugggaaguccaauguucuagaaucuaaauuggugacucggagcccuagcugugcaucagaaucacc

SEQ ID NO: 4182603 - RNA, 68 nt, Human
ggugggagugggcacaguuacggucuuugaaccccagcauggacauuuaacaaucucuacuucucauu

SEQ ID NO: 4182604 - RNA, 60 nt, Human
ggugggaguggggaagcagagugcuggccaagccaagaccauuuaugcccccauuccccc

SEQ ID NO: 4182605 - RNA, 75 nt, Human
ggugggagugucugcugggccuggucucugaggcaggcaugugucugcccagcaaggcagcagcagcuucugacc

SEQ ID NO: 4182606 - RNA, 84 nt, Human
ggugggcaauugcuguguccucacuguaugcaaggugcuuuuuauguuucucugcauaauuuugaggcagggauuauugucccc

SEQ ID NO: 4182607 - RNA, 56 nt, Human
ggugggcagagccaguucaugaaggauuuaccauuucugggcugcugcugcccauc

SEQ ID NO: 4182608 - RNA, 96 nt, Human
ggugggcagggaagcgacaggcaggguuuugagauggggaaaucggagccuguggcaagucugccugucacuggauguagcugcucugugcccacc

SEQ ID NO: 4182609 - RNA, 83 nt, Human
ggugggcagggaauuugaacugcauguauguuggauagguagccucucgguggcuucaucugcagcacugccuccugcccauc

SEQ ID NO: 4182610 - RNA, 58 nt, Human
ggugggcggcccccgcuaggcuuccugggaaagcggaagccaggcaagcacccccacu

SEQ ID NO: 4182611 - RNA, 83 nt, Human
ggugggcgugggagccccguuugcgcaaggcaggcgcgggggacuaaauggcugcuggugcagaguggggcugccccggcacc

SEQ ID NO: 4182612 - RNA, 58 nt, Human
ggugggcucugcaucagugcccauucacacagugaccacagagaagcagagcgcugcc

SEQ ID NO: 4182613 - RNA, 55 nt, Human
gguggggaggagcagauguuuugccucuagugagacaauaauuuacuucccuauu

SEQ ID NO: 4182614 - RNA, 110 nt, Human
gguggggaggguuaguuguuggcaauggaccagccacuggggaggugaguggggugagagcccccaagucgguggggguccguccagaaacuccaugccccugccucacc

SEQ ID NO: 4182615 - RNA, 65 nt, Human
gguggggccagcaguaugcgaggcaucaccaccaucacgguaaaccagagccugcugagcccccu

SEQ ID NO: 4182616 - RNA, 57 nt, Human
gguggggccaggauuugaaccucagcauuuugggcuucaaaauuggcacucuuaacc

SEQ ID NO: 4182617 - RNA, 60 nt, Human
gguggggccccgucaccgucgaggcugccuggcuuggucucaggguggcugggcccaucc

SEQ ID NO: 4182618 - RNA, 65 nt, Human
guacuaaguguuucuccagugucuuucauuguaaaauuagagaaagugggauaagcgcuuuguac

SEQ ID NO: 4182619 - RNA, 62 nt, Human
guacuacagcauggcaaagccaagaaaauuccaauuugaugcuggugccuuguuguuguuac

SEQ ID NO: 4182620 - RNA, 89 nt, Human
guacucaggcagagcucugccuugacaccuucucaaccuucuccacagaaucugggggacauagucaggggcaguauuugccaugaguc

SEQ ID NO: 4182621 - RNA, 57 nt, Human
guacucuguugauuucaaguuucucuuucucugaaauuugagaauuggucagagugc

SEQ ID NO: 4182622 - RNA, 72 nt, Human
guacucuuucucugugggcuuuaugcaucuuuugucuuauaaaauguaugaugucuacagagucagauguau

SEQ ID NO: 4182623 - RNA, 57 nt, Human
guacugcacccagucucaguaaauauuuacaacauggugagaaggggucagcuguac

SEQ ID NO: 4182624 - RNA, 72 nt, Human
guacuggauccugcacugaguggagucaguccugcucuucccugcucacuccuucugaggcaggucuugagc

SEQ ID NO: 4182625 - RNA, 95 nt, Human
guacuuaggcccugauucugguagggcauagagauguuggcauuuauucaagaugacuucugauugcuucuauuuaauucaggaaguuugggugc

SEQ ID NO: 4182626 - RNA, 67 nt, Human
guacuucccugggaggcaagcacagccuuuaggacgagcugauggucuuguggcccccaaggaggac

SEQ ID NO: 4182627 - RNA, 55 nt, Human
guacuucugccccacgucccugcaaagguuaggguaagcuuggggcuggcagugc

SEQ ID NO: 4182628 - RNA, 125 nt, Human
guacuugaagaguugugggcauuagugccaggaugcugagcuuaacccuguuagcaaauguguuguuaccacuugcuuguuaagucauguuucaggguaguauggcucaaaaauuuaccagguac

SEQ ID NO: 4182629 - RNA, 98 nt, Human
guacuuuggguuaauuugccugguuucuccaugucucauucuucucaguuguaaaauguggaugacacuugugagaaaucaaaugaaauaacugguac

SEQ ID NO: 4182630 - RNA, 107 nt, Human
guagaaaauguuaauaaugcugauuaaacuuuaaugcguuuugugucuguagccacuacauugugaauagaauagcauagaaaauugaggagcuauuauuuuuguau

SEQ ID NO: 4182631 - RNA, 74 nt, Human
guagaaacgggguuucaccauguuggccaggcuggucucaaacuccugaccucaggugauccgcccgucucagc

SEQ ID NO: 4182632 - RNA, 96 nt, Human
guagaaagcgggaauuuggugggguacauuuacugaugaaaaguaauuucucauuuaucuccucuaagaaaugugugcuuaauucuuacuuucugc

SEQ ID NO: 4182633 - RNA, 127 nt, Human
guagaacucuuuuguaauaauggaaugcaccaaaaggaaaauggaccagaguuguuaaacuccuuuugauggaguaacaaaagggcccauuuuccuugccuuuucccuaauuuagaaaucguuuuau

SEQ ID NO: 4182634 - RNA, 56 nt, Human
guagaagaacuugugccagaggguggaauaaacucucuuaucacaauucauuuugc

SEQ ID NO: 4182635 - RNA, 70 nt, Human
guagaagcuccugggacaagccguggaaguccccucaggaggcuuccgcgauguccuagguggcugcucc

SEQ ID NO: 4182636 - RNA, 111 nt, Human
guagaauuuuugaugagcuuuaauugguuguugagcuugaggaguuauuugaacugaaguaaaauaaguaaucucaaauauuuuaaguccaaaauggccaucgauaucuac

SEQ ID NO: 4182637 - RNA, 91 nt, Human
guagacagucacauaaucauauuuguaucuuuuaaauauuacuuugcagggaauguauuggaaggaagcaagagagggaaugcgauucuau

SEQ ID NO: 4182638 - RNA, 59 nt, Human
guagaccuacugaggcuuggguuccagcucaagaguuuguauuuuucagugaauucuac

SEQ ID NO: 4182639 - RNA, 62 nt, Human
guagacgugaaguuggccugucccggauugaaacucugacagcagccaccucucacccaugc

SEQ ID NO: 4182640 - RNA, 87 nt, Human
guagagaaaaaguaaaucacagaccacaaagcaaauuccuuguugggucauuagagcuugcuuuugucucggguuuggauuuucuac

SEQ ID NO: 4182641 - RNA, 77 nt, Human
guagagaacuggguccagguuugcucuacuugucuuauaacuucuaagaacaaguggcuaccuagauuauauucuac

SEQ ID NO: 4182642 - RNA, 72 nt, Human
guagagacgggguuucaccaucuuggccaggcuggucuugaacuccugaccuugugauccacccgccucagc

SEQ ID NO: 4182643 - RNA, 85 nt, Human
guagagaggucaggaugauuuuuguugauuuuguacuugcuaagucacugucuugcaaaggucagcuccuaguccuggccccuac

SEQ ID NO: 4182644 - RNA, 72 nt, Human
guagaggcaggguuucaccauguuagcagggauggucucgaucuccugaccuggugauacgcccaccucggc

SEQ ID NO: 4182645 - RNA, 72 nt, Human
guagaggcaggguuucaccauguuggucaggcuggucuugaacuccugaucucgugaucuacccgccucagc

SEQ ID NO: 4182646 - RNA, 65 nt, Human
guagaggcucuugcccuucccacacaugcagcuggauugccugugggagcagcagagagcucugc

SEQ ID NO: 4182647 - RNA, 70 nt, Human
guagagguuugaaugaggaagagcacuggccugagggaggaaguccugguccucucauucauuguucugc

SEQ ID NO: 4182648 - RNA, 61 nt, Human
guagagucucagcacugugaugcugaaaggucacccugugugugucugcugaugacucuau

SEQ ID NO: 4182649 - RNA, 93 nt, Human
guagauagaaggccaacuaggaugagcuaggcggaaauaucuguuaaugaaaaauuagaucauuuuagcuaaauggcuuucagaaauaucuac

SEQ ID NO: 4182650 - RNA, 69 nt, Human
guagauagagauguuugggccucauccagauccccucucugcccuguggggcucccaucuccuggcugc

SEQ ID NO: 4182651 - RNA, 78 nt, Human
guagauauuacaagcagcauuaccaagacauggcaaaaagaguuugucugaauuguaauguugcguuugugaaccuau

SEQ ID NO: 4182652 - RNA, 64 nt, Human
guagaucaugagaauguuuuuguuguuccgugauaaaggaucaaaagcuuuguuucuguucugc

SEQ ID NO: 4182653 - RNA, 79 nt, Human
guagaucauguauucugucuccaggaaugugucaguacugaacuuaugacccugucuggacauccuggagaaugacugc

SEQ ID NO: 4182654 - RNA, 65 nt, Human
guagauccgauuuuguugauaccaucguuguuguuguuaacaaugauguuuagauaaaauccuac

SEQ ID NO: 4182655 - RNA, 68 nt, Human
guagaucuguucauuuggcccuuuuguaugaucuauuuagcuacaguggacaagugaacugguccuac

SEQ ID NO: 4182656 - RNA, 109 nt, Human
guagauucugauuucagauuuuguauucucaaaguuaauuugcagcuuucgagcuucaguugggaauuucaaaaguguaauuaaaagaggaaguguguucaggauuuau

SEQ ID NO: 4182657 - RNA, 72 nt, Human
guagcaacuguagcccaaauucuauucugggugaaaauuauaaaguccauuuugaauuggcuaugguuuugc

SEQ ID NO: 4182658 - RNA, 58 nt, Human
guagcaccugcaggaugugcacacggucgacccacguggucuucuccagcagggccac

SEQ ID NO: 4182659 - RNA, 67 nt, Human
guagcagagcugagaguggaacccaagucucucaaagggcucugcuuccuucucucugcucugcugc

SEQ ID NO: 4182660 - RNA, 82 nt, Human
guagcagcaggggacccauauuuuagccuuuaugguuauggcaugaauggccagauuauaugguuuuuagaacuuuugcuac

SEQ ID NO: 4182661 - RNA, 56 nt, Human
guagcagcuucagcccaaauuaccaugcugcuuggaaauggcuuauagcaugcuac

SEQ ID NO: 4182662 - RNA, 64 nt, Human
guagcagugccaaggauggccugggagguuuugcucccccauaaucuucuuuggcaucugcugc

SEQ ID NO: 4182663 - RNA, 55 nt, Human
guagcccaccuggggagggcgagggggagguccugcagcugcucgcgugggcugc

SEQ ID NO: 4182664 - RNA, 57 nt, Human
guagcccucaucugcucaaaagggugucuguagcacuuuuuugagauugaggguuau

SEQ ID NO: 4182665 - RNA, 69 nt, Human
guagcgguuauaacuguuuguuuucuacaugucuguaguaaaguccuguuaacuguuaacaacugcuau

SEQ ID NO: 4182666 - RNA, 59 nt, Human
ggugugugucuaagcccccuucucagugguuuggcugggcuucugguaaagaccacacc

SEQ ID NO: 4182667 - RNA, 63 nt, Human
gguguguguggaaugcucauuuauuuguuagugaaaugaaauguuugagcaucuacaugcucu

SEQ ID NO: 4182668 - RNA, 62 nt, Human
gguguguguuugugaauguguguguguaugugacugaacaccauuuauaacauuuaagagcc

SEQ ID NO: 4182669 - RNA, 64 nt, Human
gguguuaaccagcuaaacuuugcucgaagccuucaguccuuuguagaggagcgagcuggacgcc

SEQ ID NO: 4182670 - RNA, 88 nt, Human
gguguuaucugagcuuuucagaugugugucucugaagguccaggauuuucaaaagaugaacguuuaaaucuacuuucagugugaggcc

SEQ ID NO: 4182671 - RNA, 55 nt, Human
gguguuauucugcccacgacaguaccucaacacaucucugggcagggccagcacc

SEQ ID NO: 4182672 - RNA, 66 nt, Human
gguguuccagccucuuccccucagguugaagccaacuacagaccugcugaggagggggaauuaacc

SEQ ID NO: 4182673 - RNA, 60 nt, Human
gguguugaugauaauagcaguuccaaaguucacucucaaacuguuauucccauuuucacc

SEQ ID NO: 4182674 - RNA, 86 nt, Human
gguguugcugguuuggggcaggaaguagcagucugagcacauuucuuguacaccugcuguuugccuggcucugcgccaggggcucc

SEQ ID NO: 4182675 - RNA, 76 nt, Human
gguguuggagcuggcuaauacugacuuaugagagcauauuguuaaauauucaggaauuuuaccagcagcaaccacc

SEQ ID NO: 4182676 - RNA, 67 nt, Human
gguguuuugguagauugauuauggaagucuggauagacaagccacacuaaacugcucaaaccauacc

SEQ ID NO: 4182677 - RNA, 96 nt, Human
gguuaaaaucugaaagaaauauuacauuagacccacuuucaugagaaaaagcaauaucuucucuggauggcccuggcuguuuucccuucaguagcc

SEQ ID NO: 4182678 - RNA, 64 nt, Human
guaguuuaugcugcugcagugagacccuauuauaacagguuaacacuacaguaguauagaauau

SEQ ID NO: 4182679 - RNA, 124 nt, Human
guaguuuguguguguuuguguguguguguguguguguguguguuuacuucuaugcaguuucaucacaugagcauauuuguguaaccaccaccacagucaagauacaguacaguuccaugacuac

SEQ ID NO: 4182680 - RNA, 70 nt, Human
guauaaaagcaaucgaaagcugagggagcauuuguauuugacaacguugguccaguuuuugauuagguac

SEQ ID NO: 4182681 - RNA, 57 nt, Human
guauaaagacauccauagcaggcuuuauccagccagcuucuuugggauucuuuauau

SEQ ID NO: 4182682 - RNA, 78 nt, Human
guauaaucuggccuucccaucagccucgccuuucugccuacaggagauaagaggcugguguggaggaaacugauauac

SEQ ID NO: 4182683 - RNA, 73 nt, Human
guauacaacuauuguuggguaagguuagauucuaaguaauuuucaugaauaaaaaccccacaauguuguauac

SEQ ID NO: 4182684 - RNA, 62 nt, Human
guauacagcaugaaauauugaaggcuuugguaucuuuaaggcuuagaaauucagcugagugc

SEQ ID NO: 4182685 - RNA, 109 nt, Human
guauaggcgacugucccucucaaauccucgcauuugggcaggagaugcucccuaagcauugaucaccugcccaaaugugaggauuugaguuuaggauuuaggucucugc

SEQ ID NO: 4182686 - RNA, 100 nt, Human
guauaggcuucaagguggcuuucugcugagguggcugccagccucccuggagaaggugucagcugaagaccucaaguaagagccacagugaagcucauau

SEQ ID NO: 4182687 - RNA, 79 nt, Human
guauaucuuuuccuugaugguuaaauauugaucuaguauuuauauugcugaauuauuuucuguggaggaccagauaagc

SEQ ID NO: 4182688 - RNA, 58 nt, Human
guauauggcauuuuguaagggcuugccacguaauaagccucuaacugaugucaaauau

SEQ ID NO: 4182689 - RNA, 71 nt, Human
guauauguacagcugccuuuuuuacuucaucgaguuaacauugacagguaguuugcaugcuguauguguau

SEQ ID NO: 4182690 - RNA, 65 nt, Human
guauauucaugccauuuuucuagauugagaucauagaauguaacgauuucauggcaguaauaugc

SEQ ID NO: 4182691 - RNA, 69 nt, Human
guauauuuuagacacccucacgcaaccuuucuacuucugagaccaggccugucggugucuggugucugc

SEQ ID NO: 4182692 - RNA, 128 nt, Human
guaucagaauccuggaaggcuuguuaaaauacagauugaugggcuuuacccucagagcuucugauuugggagguccaggguggggccugagaaucugcauuucuaguaaguuccggugaugcugaugc

SEQ ID NO: 4182693 - RNA, 61 nt, Human
guaucagaaucuuuggaaaugggacccaucagauguuucacaagucaaaguauucugaugc

SEQ ID NO: 4182694 - RNA, 68 nt, Human
guaucagcaaguaugcauuuggggugauuagguaagaaucuagauaauuaccaugcaacuugugaaac

SEQ ID NO: 4182695 - RNA, 81 nt, Human
guaucaggugauuuuuguccacucaguagagucuaugucucauuaagcugggcaacgggcagaaagauuacagaucgguac

SEQ ID NO: 4182696 - RNA, 74 nt, Human
guaucaguugaagacaagugauaagagaagacuaauguuucuacucauguacaaagguacuuugauguugauac

SEQ ID NO: 4182697 - RNA, 82 nt, Human
guaucauacuuugaaaaacacugugcuagucaaaugccuuugagcuacuugucaugcuugcuggugguguuuucuauguuac

SEQ ID NO: 4182698 - RNA, 71 nt, Human
guaucauaggaaugaggacaauuagcuucagguggcuaauaucugcugaguccuccuuauguccuauauac

SEQ ID NO: 4182699 - RNA, 78 nt, Human
guaucauugccuaaugcucucaguauggacauccuguuacacuaaaccauaaaaauccugagagcugggcagggauac

SEQ ID NO: 4182700 - RNA, 72 nt, Human
guauccagcgcagcugggaggcccacguugggaagucggagaccgaccccgccucccgacugcgccgacugc

SEQ ID NO: 4182701 - RNA, 91 nt, Human
guauccaguuuugucuuaggagagcuguucaaggaagauagagaaaguaagaauuuuaaagugaugcucuccuaauaugaaaacugaguac

SEQ ID NO: 4182702 - RNA, 89 nt, Human
guaucccuggagaaggacugugcaggugaacuguuugccuuuccacgugaaggcaaagagaaacugacuuccuggguugacagggaugc

SEQ ID NO: 4182703 - RNA, 81 nt, Human
guaucuacaauguuuuaugugccagguguuuaguggaaaacaaaacuacaaaacccugcucuuauggaacuuguaguuuau

SEQ ID NO: 4182704 - RNA, 93 nt, Human
guaucuagaccucaguuuccugguuugaagcagcagcacugagaugugugccagugaacugacugggauagcccagggcucugugucugaugc

SEQ ID NO: 4182705 - RNA, 81 nt, Human
guaucucacccugcauuugccgcccacuuuguucccacgggaaacaggaaggugagggugccagugcauggguguagaugc

SEQ ID NO: 4182706 - RNA, 102 nt, Human
guaucucccuccagauauuuguuaauuaugaggcauacccccauauugauuaauugcaaauggaaaaauaguagcuuuauagugaauaaaccuggcagauac

SEQ ID NO: 4182707 - RNA, 70 nt, Human
guaucucuaguaucccuuuuguagguccaaauuugacuuccucauggcccaguagaaaagggaucgauac

SEQ ID NO: 4182708 - RNA, 65 nt, Human
guaucucucugugacagcuuugcugaauauaacuuaaauguagcagaggaaauccagaguaaugc

SEQ ID NO: 4182709 - RNA, 75 nt, Human
guaucuggaauguacagccacuucacaguuaaaauaguuuuauauuuuuuaacuagcuauggauuccuuggauau

SEQ ID NO: 4182710 - RNA, 85 nt, Human
guaucuggggugacucuggggugaugucucugaggugccacucucaucucaggggaccuggcuccgagugagugaguuccagugc

SEQ ID NO: 4182711 - RNA, 130 nt, Human
guaucugguguggugagguagauaucauagcccaaauuugugcccugcaugugccuuuuggcugacagagccaaugcaucaauuaggggcagacaaggcuguguugcuucaucaccaccacugacuguac

SEQ ID NO: 4182712 - RNA, 94 nt, Human
guaucuguacugccacaauccauguugauguauauuuuuacaaucuuaaauuuagaauagauguuaauguggaucuggcuguggauacagauau

SEQ ID NO: 4182713 - RNA, 59 nt, Human
guaucuguuaugugggagaugggaaugacaugaucauuagcucuccaccuaacagguau

SEQ ID NO: 4182714 - RNA, 130 nt, Human
guaucuuaaauguaucaugaaauaccuggcacuauuguucauaaauccaugcauuucaauauaugccuauuuuuugaagugcauaaguaugauuauuuguguauacaggcuccaaguuucuuugagaugu

SEQ ID NO: 4182715 - RNA, 62 nt, Human
guaucuucaaguuccaaagugcaggguuggaaucacucuaguguuuuggaacauggaaaaac

SEQ ID NO: 4182716 - RNA, 82 nt, Human
guaucuuuaagccaucggagugaaaaauaaucaaugucuacguuaguuaaaccaccauucugguauugguaguugaagguau

SEQ ID NO: 4182717 - RNA, 70 nt, Human
guaucuuucccaccaaucacaaugcugcagucuuaguguaugcagucucuaugguaacugggaaacaugc

SEQ ID NO: 4182718 - RNA, 71 nt, Human
guaucuuucucauucucuagacccugguucccgagggcagugaaggagucagauaugggaaaguuucauac

SEQ ID NO: 4182719 - RNA, 99 nt, Human
guaucuuuuaagaaccaauggugauuuuuagggaaauguucuuaagcaauacuuaggaacaaaagguuuuccugaaagacauaguguccgcagagaugc

SEQ ID NO: 4182720 - RNA, 125 nt, Human
guaugaaaagaagugagugucugagauggguggguagccaaggacucuaauguuauagauuucugacgguuuuggcugccuagcauccauucuuucugcuguuaacauucucgauuuuuugauac

SEQ ID NO: 4182721 - RNA, 67 nt, Human
guaugaaguuggacuguauaaauuuggccuacaaaaaacggcaauuuuguaugguugaacuugauac

SEQ ID NO: 4182722 - RNA, 73 nt, Human
guaugaauuuucuuuugaccaccccuuuccccuaccaggggaauaauggcuccauggcagaggcaguuuguac

SEQ ID NO: 4182723 - RNA, 57 nt, Human
guaugagcacauauuuguaccauguguguauauagauacauauguguguguuuauac

SEQ ID NO: 4182724 - RNA, 61 nt, Human
guaugaggagccacgcaguucuuaggcguuacgauaagaaacaaccacugcucuccuuaac

SEQ ID NO: 4182725 - RNA, 72 nt, Human
guaugagugguugaaugguaaacuugacugaaagcucugagaaaagacacguguuccaagcacccgucauac

SEQ ID NO: 4182726 - RNA, 130 nt, Human
guaugaguguguguguguguuugugugucuguguauuuauaggggaaugagagugcccugggugugcacuuuagauauuccucuguacauccugugugugcuuacauggacacauucuguguacuuauac

SEQ ID NO: 4182727 - RNA, 59 nt, Human
guaugaucaacuucauguccuacagauauucgucuuaaggaaacuggguaugguuauac

SEQ ID NO: 4182728 - RNA, 79 nt, Human
guaugcacagccacguaauguggucaucagcacuguccugcugagcugcccuggccacaugcugagcugccgccacuac

SEQ ID NO: 4182729 - RNA, 85 nt, Human
guaugcagguuuauaucagaaggugagauugaauaaugcuugaugcagaaucgaaacuucucauuuaucuguauauuauguuuac

SEQ ID NO: 4182730 - RNA, 85 nt, Human
guaugccuguaaaacagcacccagaggacauacugcuccaugccaugcacagaagccuaacuggguucucguuuugcagagcagc

SEQ ID NO: 4182731 - RNA, 63 nt, Human
guaugcuuauucugugugcuguguccucauaaggguauacagguaauuugaauaauagcauac

SEQ ID NO: 4182732 - RNA, 87 nt, Human
guauggggccacugucagaggggcugugccugcugaguucaagaggaaaugcacuggcacguucuuacacuggcgugugcuucaugc

SEQ ID NO: 4182733 - RNA, 63 nt, Human
guaugguuauacugaccuacaacugcucguuaucaguccauccuauguguaggauaaccauac

SEQ ID NO: 4182734 - RNA, 74 nt, Human
guauguauguguaugcguguauguauggguguuugcacacaugcacaggugcugaugcacgcacaugugagugc

SEQ ID NO: 4182735 - RNA, 76 nt, Human
guauguccuauugguagacauuucuguuccuaauuuuuuuccacugcacaaaaagcugccgauauggucugcauau

SEQ ID NO: 4182736 - RNA, 89 nt, Human
guaugucucucugucuguuucucuuaaguuucuuuauuagcuuguccuugguuggcugcaauuaagaaacuaaaccacuagaggcaugc

SEQ ID NO: 4182737 - RNA, 67 nt, Human
guaugugagagacacacugugcauguaguuuacagacagcacugggugccacaugguuuccagauac

SEQ ID NO: 4182738 - RNA, 73 nt, Human
gggugagccagcaggccuccaguggcgcggaauauuuaucccuccuuagccacgggaugccuucuguucauuc

SEQ ID NO: 4182739 - RNA, 57 nt, Human
gggugaggcucauuuuccugaguucagguuuccuucagcagcagggaagccucaucc

SEQ ID NO: 4182740 - RNA, 67 nt, Human
gggugaggcucccuccaugaggcagaccggcgcgcagccugugaggcggguggaguggagcacgccc

SEQ ID NO: 4182741 - RNA, 63 nt, Human
gggugaggcuggcuggaggcaggugaggcagcccagccucaggagccaggaaccagcuucccc

SEQ ID NO: 4182742 - RNA, 81 nt, Human
gggugagggagcuccaaaauaagauaaggaaguugguagacuacauguuuuguuaauucuuauguuagagugccuucuccu

SEQ ID NO: 4182743 - RNA, 56 nt, Human
gggugagggccugggugcuccagauggcucagugccuggcaggacuggcuccaccc

SEQ ID NO: 4182744 - RNA, 87 nt, Human
gggugagguggaaauuacugcaucauuuucagacaaugggggcauucuagucuuuauuaggaagcaaugugcaucuucuucaagccc

SEQ ID NO: 4182745 - RNA, 80 nt, Human
gggugauggaagagcggcgaccgcgcgcuuuccucguggcgccgccagggccuggcgcguggccgccgcuccucuucccc

SEQ ID NO: 4182746 - RNA, 76 nt, Human
gggugauucuuaccugaucuuaacaaacauuacucuaugaugucugucagauauuaaguuucagguaugugucccu

SEQ ID NO: 4182747 - RNA, 59 nt, Human
gggugcaaacccguucugcaccaagugcacucggaguuuguggguauggguguguaccc

SEQ ID NO: 4182748 - RNA, 73 nt, Human
gggugcagcauagggcaggggaggaaucugaacaagauaugaguuuagcucaguucuagccccauccugaucc

SEQ ID NO: 4182749 - RNA, 59 nt, Human
gggugcagccuagaaccgaauguauguuauaaaagaggugcaggaaagugcugcgaccc

SEQ ID NO: 4182750 - RNA, 65 nt, Human
gggugcagccuuuuaggacuauuuguguuugguuaugauacaaguauguuuuaaaauguuuuccc

SEQ ID NO: 4182751 - RNA, 64 nt, Human
gggugcauucccaaggcugagacaucccuggaguaacuuuaggugucuguccugggcugugucc

SEQ ID NO: 4182752 - RNA, 73 nt, Human
gggugccacuggcaucuaguugguaggagccauggagacuucuaaaaacucuacgaugcacaggauuggcccc

SEQ ID NO: 4182753 - RNA, 84 nt, Human
gggugccugcgcucgcugugguuucuguacauggguaauagaaagcucuuguaauucuggaagccccaugccugccuugccccc

SEQ ID NO: 4182754 - RNA, 55 nt, Human
gggugcuaugugcuaggcacugaauucauaguuuaauucuggcauaauagcucuc

SEQ ID NO: 4182755 - RNA, 57 nt, Human
gggugcugauguugggguagggccaugcugcaaacgcccucuccagcuccaguagcu

SEQ ID NO: 4182756 - RNA, 97 nt, Human
gggugcugcccucagggaccaggugggugcauuccgccacccccuuauccgaggugcgcggggcuccggccuggguucugcugggggcuucuguccc

SEQ ID NO: 4182757 - RNA, 114 nt, Human
gggugcugcggcgauccgggucccggucccagcgcggggggaggauccguguuggauacacggggaagccgcacccguagcagggggacggggaccccaucugugcccagcccc

SEQ ID NO: 4182758 - RNA, 78 nt, Human
gggugcuggagagggcuuuacucugaaguaggggcggccaauauuugaucccaucauucagaaaucccucuucuaccc

SEQ ID NO: 4182759 - RNA, 72 nt, Human
gggugcuggcccugccgccacgacgucucugcagagcugcccgagccgcgggcgguuggggcgaggugcgcc

SEQ ID NO: 4182760 - RNA, 88 nt, Human
gggugcuggguucccagggacucucugccuuccaaaggaccuaccagaaaaacacccgagggaaaggcaggggcccugcccaguuccc

SEQ ID NO: 4182761 - RNA, 72 nt, Human
gggugcuuccugggcuucacagacucuguccugaggagagaggugcaguuugagaaggccagaguggggccc

SEQ ID NO: 4182762 - RNA, 76 nt, Human
gggugcuucuggcccucgucaguuucacugugaugcaaagcuguggagguaucuaaugagggucccagaaugaccc

SEQ ID NO: 4182763 - RNA, 76 nt, Human
gggugcuuugaggggcugggguugacuccaagacccccgcguccuuggagaaagcugcaggcucuggacagcaucc

SEQ ID NO: 4182764 - RNA, 70 nt, Human
ggguggaaauauacaaugugucucuugccagaggcaaaagacuuagaagagauaacaguauguuccacuc

SEQ ID NO: 4182765 - RNA, 61 nt, Human
ggguggaaggugaaggagcagcgagcucugcgugcuugccccgagcccccaccuuccuucc

SEQ ID NO: 4182766 - RNA, 65 nt, Human
ggguggagcauguguagcugaugacauuuuccagagaggaaacaucaauugcaucucccaaaccc

SEQ ID NO: 4182767 - RNA, 63 nt, Human
ggguggagccugugucccagacagauccccuaggccuaucugagacccauacaggcccacacc

SEQ ID NO: 4182768 - RNA, 55 nt, Human
ggguggagcuggaccaggagaggaguaaccaagacucacucccuccugcccaccc

SEQ ID NO: 4182769 - RNA, 74 nt, Human
ggguggagguucaaguucacuugucuacaagggaugcccuuucuacuaacaagugagccugaagcaauauaccc

SEQ ID NO: 4182770 - RNA, 82 nt, Human
ggguggaguucccucaggcagaggauggggagcgucugguguugggacucccuaguucucuaccugcuuuuaacuaauaccc

SEQ ID NO: 4182771 - RNA, 87 nt, Human
ggguggcacaguuagggacuccuguaaguguucugccuuggcuagacagacuucaccuacagcagucucuugaaaacuugguugccc

SEQ ID NO: 4182772 - RNA, 67 nt, Human
ggguggcagcucuuccucccaccggacaccgacccgcccgcugcugugcccugggagugcugcccuc

SEQ ID NO: 4182773 - RNA, 66 nt, Human
ggguggcauuugcugaagagcgguaugacaugaaaaucaaauccuugagaaaauaaaugaccacuc

SEQ ID NO: 4182774 - RNA, 79 nt, Human
ggguggccaggccaacugacauggcaaaggggcuggaucuuucuucacuugcuauguggguugugcacucagcacaccu

SEQ ID NO: 4182775 - RNA, 81 nt, Human
ggguggcccuggcagggcuggcuaggugcguucccugcagaccacgggaagcccugugcuugccugggucagggcuaagcu

SEQ ID NO: 4182776 - RNA, 84 nt, Human
ggguggccuggaccacagucuggaccugcuacagagcucuuacuugcucugggccugucucagagcuggaagccuaugucaccc

SEQ ID NO: 4182777 - RNA, 58 nt, Human
gggugggagagaugagagcagcaaccaggcucugcucacagaacuucucuucccaccc

SEQ ID NO: 4182778 - RNA, 92 nt, Human
gggugggcacaugaccagaucugggccaauccuaguaccacaccugccccuggugcagucauuggcccaggggugggcacguggccuaaccc

SEQ ID NO: 4182779 - RNA, 57 nt, Human
gggugggcaggguucuggagacuggcaucgagccacgcucccugaucccugcuuccc

SEQ ID NO: 4182780 - RNA, 57 nt, Human
gggugggcaggguucuggagacuggcauugagccacgcucccugaucccugcuuccc

SEQ ID NO: 4182781 - RNA, 117 nt, Human
gggugggccaacagcagagggaaagcaguaugaaaggcaauaacucugaguuucuucucauuauguguuacugccuuugauaggcuggacucuccuuuuuugaagguguaagcaccc

SEQ ID NO: 4182782 - RNA, 60 nt, Human
ggguggggacacaggcccacaacuugucucccugcuagggcuggggcuguguuuugaccc

SEQ ID NO: 4182783 - RNA, 56 nt, Human
ggguggggcaggauauuuuggcugcuuugggcggcucagcuagcuuggccccaccc

SEQ ID NO: 4182784 - RNA, 89 nt, Human
ggguggggccugugucucucucucuugucaccccaucugccuaggauacugggcagggccagugcagagaggaagcucaggagccauuu

SEQ ID NO: 4182785 - RNA, 67 nt, Human
gggugggggcugguggugguuucuccaggguucauuuauacugggaccaaauucaccgcccuuacuu

SEQ ID NO: 4182786 - RNA, 103 nt, Human
gggugggggugcugagagagagagagagagaacacaaagggccagcucccacuuggagcuccccucguuucucuccauuuugcucuucaggauguccccaccc

SEQ ID NO: 4182787 - RNA, 90 nt, Human
gggugggguccuguccccagaagggcagcacugggaagggucccuggcagagucucccaggagcuccuaucucugggacagaucuuaccu

SEQ ID NO: 4182788 - RNA, 110 nt, Human
ggguggguaacaggagcuacaggccagcaaugcccuuccuguccucggccuggcucaaggacugggugcagagggcaucagcgaugccaggccuagaaugugccucaccc

SEQ ID NO: 4182789 - RNA, 58 nt, Human
ggguggguguccugugaaggcucaugaucuaugugagcagagcaggcugcgcccuccc

SEQ ID NO: 4182790 - RNA, 69 nt, Human
gggugguauuuuaaaacuagcagcuaagacauaauuuuuuaaagaauucuuguuguuaguauauuuccc

SEQ ID NO: 4182791 - RNA, 64 nt, Human
ggguggucuggcaggcuggaaacccaggauaagcugagguugcauugaagccugaaggccaucc

SEQ ID NO: 4182792 - RNA, 60 nt, Human
ggguggugaaaauuaguggcuaaacauuucuaauuguuuccaucuacggcuauaccaccc

SEQ ID NO: 4182793 - RNA, 129 nt, Human
ggguggugcuuuggucaggagaugcagagaaagggcuggcugugaugagcugggaguggugaugagggccccaaucuggaggcuucuucaccugcccagccccuuucucuuucugaucucccuccaccc

SEQ ID NO: 4182794 - RNA, 97 nt, Human
gggugguucacagaggugaaccaaguaaacaauaugugauucaguuaucaaacaaguaucugaccaaaggugguuuauuugguucaccgaauuuccc

SEQ ID NO: 4182795 - RNA, 61 nt, Human
ggguguccucuggugugugcggucagucuucuucugacuguggaugccaaaggggaggccc

SEQ ID NO: 4182796 - RNA, 65 nt, Human
ggguguccugauggcauugugguuuguguccuguugaaccgggaucugugcugccgucaacaucc

SEQ ID NO: 4182797 - RNA, 83 nt, Human
ggguguccuguggggaccuggcugccacccuccuuaacaacagcuccagggugggagucuggcccucaaagaucagggcagcu

SEQ ID NO: 4182798 - RNA, 56 nt, Human
gggugugcaggucauggcgucucucagagcugggaaugcccaaugaaugcacuccc

SEQ ID NO: 4182799 - RNA, 76 nt, Human
ggguguggcagccacagaggcugggauagcuuggcacuggggucagggcucagccagccugugugccuucacaccu

SEQ ID NO: 4182800 - RNA, 58 nt, Human
ggguguggcugaaaucaaggcaggccagggacaggcacugccgccuauagcuauaccu

SEQ ID NO: 4182801 - RNA, 77 nt, Human
ggguguggucagccugggcuccagagucccuuucagcuuccuggcuaggggucaggaagccccggcucccgcagccc

SEQ ID NO: 4182802 - RNA, 74 nt, Human
gggugugugugauucuggcaggcagaagggccccggguuucuccaguuggccuguguguguugucaccacgucu

SEQ ID NO: 4182803 - RNA, 76 nt, Human
ggguguguguguguuugucuuugagaaauucaucacuuugaugaguuaagcagguagcaagcuaguuuauauuucc

SEQ ID NO: 4182804 - RNA, 57 nt, Human
gguugcagugaggugcagugauuggccagccuggaucacaugcacaucucuggaacc

SEQ ID NO: 4182805 - RNA, 56 nt, Human
gguugcagugagugugggaagucucugcccugcaggcagccuccacucacucagcu

SEQ ID NO: 4182806 - RNA, 98 nt, Human
gguugcauuucaggagugucuguggaguucugcucaucacugacuuaucuucugauuuagggaaagcagcauucccuuggacaucugaagugacagcc

SEQ ID NO: 4182807 - RNA, 69 nt, Human
gguugccaaaagauacuuaauaguugucugaucucaagaaacuagaccauuauagguaacucuggagcc

SEQ ID NO: 4182808 - RNA, 67 nt, Human
gguugcccaguuugcugcucccacccuugccgagcaggggcaccagcuccagcugacgugggcagcc

SEQ ID NO: 4182809 - RNA, 58 nt, Human
gguugcuacacaucacaacagcaggaaugcaagcauuuggcugggcugugggcacacc

SEQ ID NO: 4182810 - RNA, 71 nt, Human
gguugcuauccuacccucaugccaggagucauggcagaacaagaauccagaagcagguagagacagcagcc

SEQ ID NO: 4182811 - RNA, 57 nt, Human
gguugcuccugagagccauucuaauuucaggaccagaauggaaacugggagauggcc

SEQ ID NO: 4182812 - RNA, 58 nt, Human
gguugcugggauucacugauuuagggacacagugguuuccuaaguccugccagcaguc

SEQ ID NO: 4182813 - RNA, 65 nt, Human
gguuggaacaaagaacaugguaggauaacaaaauauuuuuuguagccucuguaguucauccagcc

SEQ ID NO: 4182814 - RNA, 55 nt, Human
ggcaggugaucuagagucaauagugacuuacaaaguguugaccuugguuaccucu

SEQ ID NO: 4182815 - RNA, 61 nt, Human
ggcaggugcucuugugaacccaugaaugcauaaguauuugggggcagagggagcaucugcc

SEQ ID NO: 4182816 - RNA, 57 nt, Human
ggcagguggccaagugucuaagaguuuguuaucuccucuaagcacccccuaccugcc

SEQ ID NO: 4182817 - RNA, 57 nt, Human
ggcagguguugggggcugacugcugauuauuugggugucagugcugaaacaccuucc

SEQ ID NO: 4182818 - RNA, 56 nt, Human
ggcaguaguuuauggcuaaaccuauauuucuuaucuggguuccacuuacuacagcu

SEQ ID NO: 4182819 - RNA, 57 nt, Human
ggcaguaugaguucaaauaauucuguuauuagaaauagaguuuugaauauauaugcc

SEQ ID NO: 4182820 - RNA, 55 nt, Human
ggcaguauucauaaucaacuuucuuauuguaagagagcugacugucaagacuguu

SEQ ID NO: 4182821 - RNA, 86 nt, Human
ggcagucacaagcagggugcugggacaaggucuuuuagaagauggcuguucagaaguccccccagcaucguagcuuggaaguagcc

SEQ ID NO: 4182822 - RNA, 66 nt, Human
ggcagucccagaauccucacucuaucaauuuuuaaccaauuguagaccaaagucugggauuuugcu

SEQ ID NO: 4182823 - RNA, 57 nt, Human
ggcagucuagcuaggaugucacccacaggaggggauacaaaccuugcaggacauguu

SEQ ID NO: 4182824 - RNA, 64 nt, Human
ggcagugaacagaaaugcagaaguggaauuuacuagccaaacacugcaucugagucauuaugcc

SEQ ID NO: 4182825 - RNA, 55 nt, Human
ggcagugcugagaggugaucggaggaagaccuuuuauaucccuuccagcaccucc

SEQ ID NO: 4182826 - RNA, 61 nt, Human
ggcaguggcgugauccggcaccaaaucggcccgcggugcggugcggagacuccaugaggcc

SEQ ID NO: 4182827 - RNA, 62 nt, Human
ggcaguggcuggacagcagggcaccugggggcuuaggguaccccuucugcuccagcuuugcc

SEQ ID NO: 4182828 - RNA, 71 nt, Human
ggcagugggcuguguggaggggauggcuggagguggaagucuacgggcagaucacacagggcuuguaugcc

SEQ ID NO: 4182829 - RNA, 104 nt, Human
ggcaguggggccaggagcagaaugaggcagucuggccugagggcacagggacgcuagcaccucaccaucuccuccugccggagccucuucucugguccauuguc

SEQ ID NO: 4182830 - RNA, 69 nt, Human
ggcagugggugacagacaccucucugugcccaugugggcgcagggcuccacuguggccaagaaacugcc

SEQ ID NO: 4182831 - RNA, 58 nt, Human
ggcaguggugggaggcucgcucugggugcacagacgcugccuucagacaccgcaugcu

SEQ ID NO: 4182832 - RNA, 61 nt, Human
ggcaguggugguggggagcgucaucuagguuucucuccagaugagccaacaccuccaugcc

SEQ ID NO: 4182833 - RNA, 60 nt, Human
ggcaguguguggacagugguggcuggugccugaugcugccaugcuguucuucgcacuggc

SEQ ID NO: 4182834 - RNA, 59 nt, Human
ggcaguguucuaaauccucguuuauucuacucaggacccaccuuauuaggaacauugcc

SEQ ID NO: 4182835 - RNA, 68 nt, Human
ggcaguuggcaggauuugcccggaaggaucaggauagggucuuugggucugaguccugcgugacuucc

SEQ ID NO: 4182836 - RNA, 72 nt, Human
ggcaguuuucuuagagucgagggcaugauaagcuagggacugagaaucucaguccugccauguccuacuguc

SEQ ID NO: 4182837 - RNA, 57 nt, Human
ggcauaagggcagcuggacagugguacauuuuauaccacuguuaguauacuugugcc

SEQ ID NO: 4182838 - RNA, 76 nt, Human
ggcauaaggggauauguagcuuauaugaggaaauugucuuaaguuugucuuuaauucuacauaucucccaugugcc

SEQ ID NO: 4182839 - RNA, 69 nt, Human
ggcauaguggaaaaagaauaggguuagauaaaguuguauguuaugacccuucugguuccuaccaauguc

SEQ ID NO: 4182840 - RNA, 99 nt, Human
ggcauauauaaaauuaaacgguaccugaucgauuuuuuucaucuuuagaauugaugucagcucccaaggauaagagagucugaauuguacuuguauguc

SEQ ID NO: 4182841 - RNA, 72 nt, Human
ggcaucagauaacuucaguuucuguguccucccuugagauauuuuaagauuagaagauucaaaucugauguu

SEQ ID NO: 4182842 - RNA, 97 nt, Human
ggcaucccaucaagaaguaaaugccacaguagcauccaaacaguagaagaugcuggugauguggugcugagugacagcaauuuuacuaugaugugcc

SEQ ID NO: 4182843 - RNA, 69 nt, Human
ggcaucccgccacccugcccuccacucccaggacucggccccguucuggugggaggcaagguggaagcu

SEQ ID NO: 4182844 - RNA, 106 nt, Human
ggcaucccuuuuuguguuuagcaaaagagcucauaacuuaauggauucaucagccugcguuaaguccacaggaguuguguucacucucuaacauccaagaggagcc

SEQ ID NO: 4182845 - RNA, 63 nt, Human
ggcauccuugacaaugagccugguaggucuccaacccuacagaggguaauugaucaaggaccc

SEQ ID NO: 4182846 - RNA, 66 nt, Human
ggcauccuugacacacuccaguacugacaggaaccccuugaagacugugcggggugcggggagguc

SEQ ID NO: 4182847 - RNA, 76 nt, Human
ggcaucuagaaacugugggcagcuucugggaacugaacucagcuuccugccaguggcccacaaaaaaacuagggcc

SEQ ID NO: 4182848 - RNA, 82 nt, Human
ggcaucuauugcccuggccuucaucucagacauucauuuggaaugcagucacauaggauagggcaggggcagggagcaugcc

SEQ ID NO: 4182849 - RNA, 86 nt, Human
ggcaucuccaucagggacuuggcagcaauauggagugagaaacagaucuaagacuucauuugucugcuauagauccugggcaugcu

SEQ ID NO: 4182850 - RNA, 74 nt, Human
ggcaugccagucaucuuaguuaaucuucauauucaguucaugaagcaaauauuucuagagacuggcuauaugcc

SEQ ID NO: 4182851 - RNA, 71 nt, Human
ggcaugccauggcaggaaaaugaacaggcgcugucagagagccagcuuggcagggccugcuggagcaugcc

SEQ ID NO: 4182852 - RNA, 87 nt, Human
ggcaugccccgcugcacuuguggauuugauauacagacacagaauagaagaguguguguguccauguguggugcagagaugcguguc

SEQ ID NO: 4182853 - RNA, 92 nt, Human
ggcaugccccugccucagugccucauccccugcugucagguccugacccaacaagggccugggcugcucauggggaugauaggugguuugcu

SEQ ID NO: 4182854 - RNA, 67 nt, Human
ggcauggauuuaaugaaaggucugcuggaagccacaucaaacagcagcacgaguccacaaauccgcu

SEQ ID NO: 4182855 - RNA, 77 nt, Human
ggcauggcccuguucuguaccucauaaaccacccccaaaaccacauguaguaguagguucacagcgggccgaugacc

SEQ ID NO: 4182856 - RNA, 56 nt, Human
ggcauggcuugguggggcccgcaaguauuacgaggguuugcaugaacaagucagcc

SEQ ID NO: 4182857 - RNA, 64 nt, Human
ggcaugggugcuugcugagugaaggaugaauaaauauuucagugcugaguagcgugcacccccc

SEQ ID NO: 4182858 - RNA, 89 nt, Human
ggcauggugaucacggcuguacacugguuucaaggacaccaacugcugcucuaguccuucugugaccaccagcagccccacacugugcc

SEQ ID NO: 4182859 - RNA, 56 nt, Human
ggcaugguugaguugguguuuaucagucacaaucaagcagcauuguaaccaaugcc

SEQ ID NO: 4182860 - RNA, 109 nt, Human
ggcauguaauauggagauaaaaguuugagaagcuuauagauaucuaacuugcaaaguuggggaagagauacuauggguucuguuuuaaacacguuaagacugaagugcc

SEQ ID NO: 4182861 - RNA, 84 nt, Human
ggcauguagggaaguauauaaauccuuucagacuaccagggaaccacuuaggguuugaaagaauuuauguacuuuccaacugcc

SEQ ID NO: 4182862 - RNA, 82 nt, Human
ggcaugucagcaagggauaaagaguuacuuacagaaguuaaagugaaauuaaauaacucuugaauccauuuguaaaagugcc

SEQ ID NO: 4182863 - RNA, 67 nt, Human
ggcaugugaugcagaagacugagaacaaccaagaaucucugggaagcacuuaucucuggcaugugcc

SEQ ID NO: 4182864 - RNA, 58 nt, Human
ggcaugugccugaggucacacagcaaggaguggcugcgugggaauugggcuacaugcc

SEQ ID NO: 4182865 - RNA, 59 nt, Human
ggcauguggauagcacaggaaugguacuguagauaacugaccaggucuauccacaagcu

SEQ ID NO: 4182866 - RNA, 82 nt, Human
ggcauuagauucucauaggagugugaacugcacgugagagggaucuagguuacaugcuccuuaugagaaucuaacuaaugcc

SEQ ID NO: 4182867 - RNA, 94 nt, Human
ggcauuaguuagauucucauaaguagcgcucaaccuagaucccucgcuugcgcaguucccaguaggcuuggcucuccuaugagaaucuaaugcc

SEQ ID NO: 4182868 - RNA, 80 nt, Human
ggcauuaugccaagaaggugggagggaacgugaggcggacuguuguugcuuuugugagcucucacuuuguggccaauguu

SEQ ID NO: 4182869 - RNA, 64 nt, Human
ggcauuccuuguuccuaggagaucaaugcgcucccugguauuucuccugcuagaacaaggagcc

SEQ ID NO: 4182870 - RNA, 86 nt, Human
ggcauucugaaaggcugucaccccuccuccugagcuagggcuugacaacguucaauccuuagaagggagugaggacugaagcugcu

SEQ ID NO: 4182871 - RNA, 60 nt, Human
ggcauugcggcgugguccggggcgcgacucgggagggagccuccugggcugcgucuugcc

SEQ ID NO: 4182872 - RNA, 77 nt, Human
ggcauuuccuagggucguucaguuggcguuucccacagucuguagcuaaagaaugugcuggcuguucuagggaggcc

SEQ ID NO: 4182873 - RNA, 101 nt, Human
ggcauuuccuggggaauuaauagccagcugggguuaacaguccuugguucgacuuuaggccaucaacucuucuugcugcucauuaauucccagaaagugcc

SEQ ID NO: 4182874 - RNA, 58 nt, Human
ggcauuugcagacuugacuaccugagguguaugguguucagacaaguuuccagaagcc

SEQ ID NO: 4182875 - RNA, 84 nt, Human
ggcauuugcugaacuugaagggagcaguaagcagugacagaauaaugaauauuaucacugaccuguaucaguugugcaaaugcc

SEQ ID NO: 4182876 - RNA, 71 nt, Human
ggcauuuuaaagggugaauuaaacuggcaccacuugagcaaaguaucaaucacccuuugaaguuggcagcc

SEQ ID NO: 4182877 - RNA, 70 nt, Human
ggccaaaaagauguccugaaguuuagugcauuaaugaaugacuuaagcaucagcacaucuaagagaggcc

SEQ ID NO: 4182878 - RNA, 68 nt, Human
ggccaaaucuguaaggcaagaucugccuacgauggcauaaauaaugguguguauuugcaguuuaggcc

SEQ ID NO: 4182879 - RNA, 60 nt, Human
ggccaacaggagaggggaauguagagucugugaccauggcuucccacuuuucucagugcc

SEQ ID NO: 4182880 - RNA, 58 nt, Human
ggccaaccaagggcuauuuacagaacaggugaagucaccucuguuuauucuauuggcc

SEQ ID NO: 4182881 - RNA, 80 nt, Human
ggccaacugagcaaggacagaaaguagagguuguuggugaccuugaccagcccucugcuguucuagucucuugaucugcc

SEQ ID NO: 4182882 - RNA, 68 nt, Human
ggccaacuguagguggccggaggacagucgagcaguuccuucugucuguccugccauccacagcggcc

SEQ ID NO: 4182883 - RNA, 58 nt, Human
ggccaagagcuccuucuuaaccgcacaggcaugugaggcccagaagacuggcucugcc

SEQ ID NO: 4182884 - RNA, 75 nt, Human
ggccaagcaugucuucuuaagcaauuuuccacucaaccaguuggggucacuguugucagguaaaacaguauggcc

SEQ ID NO: 4182885 - RNA, 72 nt, Human
ggccaagcauuuuccugaaguucaagaugccagucaucuucugaagucacugcuucuuggagaaugucagcc

SEQ ID NO: 4182886 - RNA, 65 nt, Human
ggccaagguccagggaaaggcucuagcugucuagucaucuucauggagcuccugggcucugggcc

SEQ ID NO: 4182887 - RNA, 61 nt, Human
ggccaagucucuagagaaaugcuuuauuauugcagacaauacauucucugguuugcuggcu

SEQ ID NO: 4182888 - RNA, 81 nt, Human
ggccaauagaagcagcaggaguaaaggcaugucggucacaaaccuaggcuucaaaagucuuucacuugcucuuuuaaggcc

SEQ ID NO: 4182889 - RNA, 129 nt, Human
ggccaaucaguauuacaucuauugucuccuaaccaguccucagauggucugugccaagugccuaagaaaagggggugucaaaucaucugaaacugugagacaaauaaaagagcuauaaggaaaaggcac

SEQ ID NO: 4182890 - RNA, 64 nt, Human
ggccaauuuggauggcaaggagaacaaaucagugcuugauuugucuagugguauucacguggcu

SEQ ID NO: 4182891 - RNA, 70 nt, Human
gggaaauuccaaagccugaauaauggaauggauacauuucaauuuaacauauauucuggcuuuagauccc

SEQ ID NO: 4182892 - RNA, 94 nt, Human
gggaacagacuucucagaaggacacaucagauugucagcuuggacgcacaggcucacagcuggccugaucucaugcuguccuccucccuguccc

SEQ ID NO: 4182893 - RNA, 55 nt, Human
gggaacagagugccagacugacagaaauuuuugcaccuccuggcauccuguuccc

SEQ ID NO: 4182894 - RNA, 57 nt, Human
gggaacagggcaggccuuuggagcaucugugcuggacagugaggcccuccuguuccc

SEQ ID NO: 4182895 - RNA, 74 nt, Human
gggaaccaaauggaaagagcagaagcuuuauccagaaggucuugggcuucugcucuuuuggugcugggaagccu

SEQ ID NO: 4182896 - RNA, 74 nt, Human
gggaaccacagaguugaugcaauaagacaaaugugagagcuuccaaucuuguuguaacagccucuaauguuccc

SEQ ID NO: 4182897 - RNA, 83 nt, Human
gggaacugcucaggcaaauuucuggugaagcuacugcuuauuaagagaacuucacccaugaauaugccuaaggaguguuuucc

SEQ ID NO: 4182898 - RNA, 89 nt, Human
gggaacuuauucaaucauuuaaucuggcucaugagcauuucuuggugcucuggugcuggugauucagauucaaauccaacaagauuccu

SEQ ID NO: 4182899 - RNA, 74 nt, Human
gggaacuugaggacagaugcugggcacacaguaggugcuuaauaaaagccugacuguguucaguucagggcccc

SEQ ID NO: 4182900 - RNA, 56 nt, Human
gggaacuuggauuauuucuuccugggcaacccugccaccaggccaucccaguuccc

SEQ ID NO: 4182901 - RNA, 63 nt, Human
gggaacuuugugcaagaauuggaaagcaaccauggauggucgcuguguccagaauugcacccc

SEQ ID NO: 4182902 - RNA, 61 nt, Human
gggaagaaauaaagagggaaaugucugugguacaagaaaugacacuuuuaauuuacuuccc

SEQ ID NO: 4182903 - RNA, 64 nt, Human
gggaagaauugagaguuagagauaaaggaauuuucuauucucugaucuuuaauucagauauccc

SEQ ID NO: 4182904 - RNA, 59 nt, Human
gggaagacacaauguagcccagcacgugggccacgaggagcugcccgugugucugcucc

SEQ ID NO: 4182905 - RNA, 84 nt, Human
gggaagagcagguuagggagguggcuuuccagcaguagugcagaagcaggacuggaggccccucccagugaagcagguucuccu

SEQ ID NO: 4182906 - RNA, 81 nt, Human
gggaagagcuaucaugcauguucucuuuuucuaccuuaacaaagaaaucuggagauggaaaacugcugguagucugcuccc

SEQ ID NO: 4182907 - RNA, 130 nt, Human
gggaagaguggcagcucuagccucaguggggucgaugugagggaaguguaaggcacgaaauaaggaaucucuacacaggauucacaugagggguaaaaauuugugaugagagagguauuauacuuuuucc

SEQ ID NO: 4182908 - RNA, 66 nt, Human
gggaagauggcacuugggagcagcagcuuugagcaucuugcaucugcuuccugaggccgucuucuc

SEQ ID NO: 4182909 - RNA, 74 nt, Human
gggaagaugucuuuguuuguacuguuagaauagcugagacuggguaauuuacaaagaacagaaacuuauuuccc

SEQ ID NO: 4182910 - RNA, 61 nt, Human
gggaagcaggugcagcucgccuuagguaaccccaaccuucccuguuagcuuccuguugccc

SEQ ID NO: 4182911 - RNA, 78 nt, Human
gggaagcggggucuccaugugcugggugauggauuuccgggcacagcagcugggggcccugggucaauuauacuuccc

SEQ ID NO: 4182912 - RNA, 74 nt, Human
gggaagcuggcaguuauuaaucaagucuuggccauuuugggccaauggcuagagggguuauuguuuagcuuccu

SEQ ID NO: 4182913 - RNA, 73 nt, Human
gggaagcuuuaccucugcaggcuucucucuucccuaccuccacguugguccuagcugcagagggaggccuccc

SEQ ID NO: 4182914 - RNA, 83 nt, Human
gggaagcuuuggcucuggaacuauuucugaaugacugcaacuuuauugguccuuggggcacaagguccagagccaaucuuucu

SEQ ID NO: 4182915 - RNA, 130 nt, Human
gggaagcuuuuaggcaucugaucagagcgggagccagccgggggaccacagugcuggacagguaacagacauuucuccuacugcggucugucauucugucucccuuuguagcaagaccucaggggcuccu

SEQ ID NO: 4182916 - RNA, 59 nt, Human
gggaaggaaaguuauuagcagagaucucccagaaguccucuguaacugucccuuuugcc

SEQ ID NO: 4182917 - RNA, 80 nt, Human
gggaaggaaggaaggaaaugagguugauggauggcacuuuguccauucuaggcuuuucuuauaucugugucugccuuccc

SEQ ID NO: 4182918 - RNA, 58 nt, Human
ggcucaagcagucugccugccuuggccucucaaagugcuaggauuacaagcuugagcc

SEQ ID NO: 4182919 - RNA, 65 nt, Human
ggcucacaaugucuaagauguuucuaucucugugggccuagaaaucuacuuagacuuucugagcc

SEQ ID NO: 4182920 - RNA, 85 nt, Human
ggcucacugcagcuucuaacuccugggcucaagugaucuuccugucacaugagucucccaaguaguuggaacacaggugccagcc

SEQ ID NO: 4182921 - RNA, 126 nt, Human
ggcucagacuugcacuuuucucucccuagugccucuuucuccagcuuuucugccuuccaaaagguaucaagaaugugggggaaaagagugugggcaguggggaagcagagucaaggcuccagagcc

SEQ ID NO: 4182922 - RNA, 83 nt, Human
ggcucagagaaguuaagcauguucccugagguugcacagccuaggccaucagcccagagagaugcuguagacccuguggugcc

SEQ ID NO: 4182923 - RNA, 63 nt, Human
ggcucagagaccccuggcauggugguggggagaccucgcuuccugucucugggucuuggggcc

SEQ ID NO: 4182924 - RNA, 88 nt, Human
ggcucagauguucaagaacauugugaucacuucagauaauguuuaucuuauuuaugauguugcacagauguucaagaacauugugauc

SEQ ID NO: 4182925 - RNA, 120 nt, Human
ggcucagcaggcugguggcggcagguucaggcucugucugguuccagaccugagggaacacaaagaggacccuuaggaugguacaaggcagggguccccagcucaccugccuggggggcc

SEQ ID NO: 4182926 - RNA, 86 nt, Human
ggcucagcaucacugcaucacucucccagcagguagaacauucaagguugagguggcugcuugcugggaaacaggagagcuggguc

SEQ ID NO: 4182927 - RNA, 62 nt, Human
ggcucagcuuccucugaaaaacgaggcuggugucgccugccaggccucucagagggugugcc

SEQ ID NO: 4182928 - RNA, 72 nt, Human
ggcucaggagaggggcuaaaagugguggcaguaggaagauagagaaaggccuuguuuugccccuuucuggcc

SEQ ID NO: 4182929 - RNA, 55 nt, Human
ggcucagguuuccuucccagcucuaccaccuggagcuuugugaagugacugagcu

SEQ ID NO: 4182930 - RNA, 75 nt, Human
ggcucagugaggggcagagggccuggccacaugaggagccagugcugugggcaggcccgggucugagugcuggcu

SEQ ID NO: 4182931 - RNA, 55 nt, Human
ggcucaguggcuaaacacccacuucucuggggagggugacauuucccaaugagcc

SEQ ID NO: 4182932 - RNA, 58 nt, Human
ggcucaugccuguaaucccagcacuuugggaggccaaggugggaggauugcuugagcc

SEQ ID NO: 4182933 - RNA, 65 nt, Human
ggcucaugccuguaaucccagugcuuugggaggccaaggcggggggaucacgaggucaggagauc

SEQ ID NO: 4182934 - RNA, 86 nt, Human
ggcucaugugcuugucucucugugcccacucgaugccauggagaaggugagagugcagaggacagaggaagggaggcucaggaguu

SEQ ID NO: 4182935 - RNA, 71 nt, Human
ggcucauguuucagaaaguggaggaaauauaaaaacaccuuaacucugugcuuucgagaugugaucuugcc

SEQ ID NO: 4182936 - RNA, 76 nt, Human
ggcuccaagccuucuuuguuacuuacaguuacagcacuguuauccaaacaguaacaaagaaagccuuuggaaggcu

SEQ ID NO: 4182937 - RNA, 63 nt, Human
ggcuccacugcugaccacuccauucagugugcucugggaagagaggcuccugcaguuggggcu

SEQ ID NO: 4182938 - RNA, 56 nt, Human
ggcuccagaaacuucaguccauuuucccaaaauggacaugaugcaucuggcgaguc

SEQ ID NO: 4182939 - RNA, 80 nt, Human
ggcuccaggcaucucagagaaguuucaaagaauaaagguacuuauguucuguccucuuugaagcugcucaaugcccagcc

SEQ ID NO: 4182940 - RNA, 82 nt, Human
ggcuccaggcccagcccuaaggcccagcuggcuacuggaagaccaggggccagcagggaagccuugggcuuggacaggugcc

SEQ ID NO: 4182941 - RNA, 67 nt, Human
ggcuccagggccaguucuggagacucaagaguggcaacguuccucuccagcaaacuggcuaugagcu

SEQ ID NO: 4182942 - RNA, 68 nt, Human
ggcuccauccuggccucgcuguccaccuuccagcagauguggaucagcaagcaggaguaugaggaguc

SEQ ID NO: 4182943 - RNA, 95 nt, Human
ggcucccaggaggggugagcugggccugugccugggugggauuggagaugcucuuuggacaggaugcuggggccccgccugccuucccuggggcc

SEQ ID NO: 4182944 - RNA, 58 nt, Human
ggcucccaggcauggagguaauugggucuuggcuucaaugccacccuuuugggaagcc

SEQ ID NO: 4182945 - RNA, 66 nt, Human
ggcuccccgcccugccagguuccagccccugcucaccuggccggcuguggccagcggggcugagcc

SEQ ID NO: 4182946 - RNA, 69 nt, Human
ggcucccggcgcgcgcuccccucugaccaccuacggaaugaccucagagugggagaaugugccaaggcc

SEQ ID NO: 4182947 - RNA, 70 nt, Human
ggcucccuccccagggucauauugaaggagagagacaucccugcaaaguaaaacuccuggggagccuguc

SEQ ID NO: 4182948 - RNA, 66 nt, Human
ggcucccuggaagagguggccuucuguguaggaggacauagacauuauggcuuucacugggcagcc

SEQ ID NO: 4182949 - RNA, 82 nt, Human
ggcuccuacuuagucauccagggcacuggauauggauuuugccauagcaagauuacuauccacugcuggugagaaaggggcu

SEQ ID NO: 4182950 - RNA, 68 nt, Human
ggcuccucuguccaggcucccuuggugcugccggggcacccacucacaccagagcugggcacaggacc

SEQ ID NO: 4182951 - RNA, 100 nt, Human
ggcuccugacccucagggccagcauggggcagugugggccgucgagccuggaucucgggguccaccuccaagcuggggaccuuggggagucacagcagcc

SEQ ID NO: 4182952 - RNA, 59 nt, Human
ggcuccuggaccagggcuauugggggcucgugugccagacccaggguccagggaaagcc

SEQ ID NO: 4182953 - RNA, 68 nt, Human
ggcuccuucugaggcucuggguuccuggacacaaucuugaauccuaauuaagccguuagagaaaagcu

SEQ ID NO: 4182954 - RNA, 106 nt, Human
ggcuccuugugcaagacugacugcaagcuuuaucugcauggacacuuucuuggcucacagaauuguuuuggaacaaaagcuauucauuucagcuugauuuggagcc

SEQ ID NO: 4182955 - RNA, 77 nt, Human
ggcucgaagcaaucuggcucccagccagguaaacaacaaccucacccugccucugagaccccgguguugcuucugcc

SEQ ID NO: 4182956 - RNA, 55 nt, Human
ggcucgcacuugcuacccacucuggagcaaggugugggugcaagcugcggaugcu

SEQ ID NO: 4182957 - RNA, 61 nt, Human
ggcucgggcuugaggcuguuuaccugguugagguagaaauaaucuucaggcugcuugagcu

SEQ ID NO: 4182958 - RNA, 103 nt, Human
ggcucuacccaguccucuugucuugcacacgguugccacgcucacggagaaaggaugaugguaugaccguggugcaagcacaagggaugaggccaaaagagcc

SEQ ID NO: 4182959 - RNA, 55 nt, Human
ggcucuagagcugugcacacauguucagacauuggagcacaucuugucuagcgcc

SEQ ID NO: 4182960 - RNA, 83 nt, Human
ggcucuagcugaguggggugcagcaguacugugucugguaaaggcacagcaacauagucuguggaccucugucagcuaagguc

SEQ ID NO: 4182961 - RNA, 97 nt, Human
ggcucuagucugagaaagggaggcaaagccagauuuuaggaaguaggauccuuccuggggcuaagucuggugcuguccucacccuucuuccucugcc

SEQ ID NO: 4182962 - RNA, 70 nt, Human
ggcucuauccugagaaggcacagcuugcacgugaccuccugggccuggcggcugugucuucacaggagcc

SEQ ID NO: 4182963 - RNA, 94 nt, Human
ggcucucacggcuccaggagauguggggugugggguauccagaggcugagcagcugaccuucaccuccacaccuugggagaagugcugggagcu

SEQ ID NO: 4182964 - RNA, 72 nt, Human
ggcucucaugguguucuuaguggcacuggcaauauacugacuguuccaccaauccugagacauuugagagcu

SEQ ID NO: 4182965 - RNA, 55 nt, Human
gggacuggaggaccugccuccaagguggcucauauuggcagguggccucaguucc

SEQ ID NO: 4182966 - RNA, 81 nt, Human
gggacuggaggcaguugccccagucacucaggcauugagaaaucugggguauggcuggggcaaaugucucauguggucacc

SEQ ID NO: 4182967 - RNA, 89 nt, Human
gggacuuaacugagaggaucugaguagcagacacccuaagagcaugucauugucuucucaccaguuacucuccaguuggcuagaguccc

SEQ ID NO: 4182968 - RNA, 94 nt, Human
gggacuucaguuaacggaaaggggugugucccaacaaagacucauacagucaacugucuccaugcuggcaugccccacuguuaauugauuuccc

SEQ ID NO: 4182969 - RNA, 58 nt, Human
gggacuucauagcuaggcacuugcauagguacgcagcgcccacagugaggaggauccc

SEQ ID NO: 4182970 - RNA, 72 nt, Human
gggacuuggagagagccucagcuguuggaugaaagagcgaaaacagaugcaguaguuuucaaaccaaguucc

SEQ ID NO: 4182971 - RNA, 71 nt, Human
gggacuuucccaggcuucuggaguaagugccccagugcccggcguccacucccagugccugaggccuuccc

SEQ ID NO: 4182972 - RNA, 66 nt, Human
gggagaaaagucuccacugggaaccaaauucaaagaucuggcugauucccugggacuggacauccc

SEQ ID NO: 4182973 - RNA, 61 nt, Human
gggagaaacauugcacagaaggaagaccuggcucccagucccagcucugccaugcucuucc

SEQ ID NO: 4182974 - RNA, 57 nt, Human
gggagaagcguacagacaugauuucuggaaaaauaacugucugcugagcugcugccc

SEQ ID NO: 4182975 - RNA, 57 nt, Human
gggagaaggagcuaguucuugagggauuaggaaguuuucaguuggcugccaucuccc

SEQ ID NO: 4182976 - RNA, 64 nt, Human
gggagaaggagugcuggccggggcaucgggagccccaggcugucuguccuuugcugccuguccc

SEQ ID NO: 4182977 - RNA, 58 nt, Human
ggccucugcaggccucgacaaggccaggccuccugccucccaaaggccugcacaggcc

SEQ ID NO: 4182978 - RNA, 70 nt, Human
ggccucugcucuucaaaccucggccucacuguuggcugcucugggccccaguguggccaggagcugcgcu

SEQ ID NO: 4182979 - RNA, 72 nt, Human
ggccucugggcucaaucugcuucuguuuacuaacucuccuagaggcagaaagacagagugagcauccaggcc

SEQ ID NO: 4182980 - RNA, 67 nt, Human
ggccucuggucaagacaagcaucuaucaguuuaccuauccaagagcucgagucuuugccagguagcc

SEQ ID NO: 4182981 - RNA, 72 nt, Human
ggccucuguaccccacgucuuccugugcucuccagcuuuggaggcugagaagacagugggguggagacagcc

SEQ ID NO: 4182982 - RNA, 68 nt, Human
ggccugaaccacaggagccaguaaacacaggauuuccacucuauguguagcuuucuucugugggggcc

SEQ ID NO: 4182983 - RNA, 84 nt, Human
ggccugacagccugacaaaggggcucuugucaggcgcagcaagaggggcuguccuggccgcccuugugaggcuguucuggggcc

SEQ ID NO: 4182984 - RNA, 68 nt, Human
ggccugagaaccauggggccaaugggauaagucucaguccaagucccaaggcccaaguacugagugcc

SEQ ID NO: 4182985 - RNA, 57 nt, Human
ggccugaggccaccagcagcccggcaguggcugccucccuguggcugaccucuggcc

SEQ ID NO: 4182986 - RNA, 65 nt, Human
ggccugaguggagggauucugcagcaguucaugagaccugcugacauggggauccaccuuaggcc

SEQ ID NO: 4182987 - RNA, 63 nt, Human
ggccugcacugugggccagcugggugggcucaguacccauaugcugcugccccuagugaggcc

SEQ ID NO: 4182988 - RNA, 61 nt, Human
ggccugcucugcagccucuacaggcccacauggaggcagagacucccaggcugcagcagcc

SEQ ID NO: 4182989 - RNA, 57 nt, Human
ggccugcucuggcuguggucagcgccucggggcucguggcccgagccgggguuggcu

SEQ ID NO: 4182990 - RNA, 63 nt, Human
ggccugcugacccaaguccugugaccguggcccagaaggaagggacaggcaugggcacaggcu

SEQ ID NO: 4182991 - RNA, 65 nt, Human
ggccugcuggggucagagcacuggggguguccccacacccuacugcugagguccccggcacugcc

SEQ ID NO: 4182992 - RNA, 61 nt, Human
ggccugcugucccucugggcuccaugcgcagggcagcugcguggugcaggggcgcacggcu

SEQ ID NO: 4182993 - RNA, 56 nt, Human
ggccuggagcucagugccaucugauuguuucagucagggccugugcucuccagguc

SEQ ID NO: 4182994 - RNA, 92 nt, Human
ggccuggauccuaugaauggcucauggugagugaggcgcaagcuccuuugcugcauuccacaccacucugccugauguuacauggaucugcc

SEQ ID NO: 4182995 - RNA, 83 nt, Human
ggccuggcaccagccaagggccucucugggccuuuccugucauggaugcaggaagggauucaugaggccagagcugccaggcu

SEQ ID NO: 4182996 - RNA, 61 nt, Human
ggccuggcauuccagagauggucuuggaauucuaaaaaugccucugauggaggccagcgcu

SEQ ID NO: 4182997 - RNA, 72 nt, Human
ggccuggccaccuggacuccuugggaguggcuagagaacuccuccugagagcagaguccagguguuugggcc

SEQ ID NO: 4182998 - RNA, 56 nt, Human
ggccuggcccucccggguucaagccguccaggcaggggccccucagggccaggacc

SEQ ID NO: 4182999 - RNA, 62 nt, Human
ggccuggcucccucccccauguccugagcucacugcagaagccaugguggaggagcagggcc

SEQ ID NO: 4183000 - RNA, 95 nt, Human
ggccuggcugcuguucccacuggagaccuggcaucuucuccccgaccuaaaacaaugaaagcagugcucagcccggaugagaucacggccagccc

SEQ ID NO: 4183001 - RNA, 62 nt, Human
ggccuggcuucaugagcaugcgaucuauuuagcugcaugaagcguccaugcuuagaggggcc

SEQ ID NO: 4183002 - RNA, 57 nt, Human
ggccugggagggcaagugcugaugagaacccccauccccaccucccuccccaggacc

SEQ ID NO: 4183003 - RNA, 69 nt, Human
ggccugggcaccugagcacuggggccgcccugggcagagcuggggcggggugcuggggggccuggagcu

SEQ ID NO: 4183004 - RNA, 58 nt, Human
ggccugggcccacugucaagagcagacccugagaaccucuguucugggucccagggcc

SEQ ID NO: 4183005 - RNA, 72 nt, Human
ggccugggcccugguggccaugccucccagagagcaggugggcccuggaggcaggggccccagccccaggcc

SEQ ID NO: 4183006 - RNA, 64 nt, Human
ggccuggguagggccugcgccugugcuugcugcgcagcagcaccccugcgugccuucccuugcc

SEQ ID NO: 4183007 - RNA, 83 nt, Human
ggccuggucccagcccgggguccucagccaccucgguucucaagagagagcugccaggccccugagaacccgcuggccuugcc

SEQ ID NO: 4183008 - RNA, 67 nt, Human
ggccugguuagguccauuggcugugguuugcugaccccuagcaugugccuaguggauuugaagggcc

SEQ ID NO: 4183009 - RNA, 65 nt, Human
ggccuguccuccaagagcacaucugacgugaaagguuagaagaugugucagaggauguuaagguc

SEQ ID NO: 4183010 - RNA, 102 nt, Human
ggccugugaggaaagggaguugggugguccaggcucagcagaugcccaccauccaugcucugcucugagagggccaucagacacccaccuauccagcaggcu

SEQ ID NO: 4183011 - RNA, 55 nt, Human
ggccugugcccucagccuggcucucuucuggggaggggcaggugagggggcagcc

SEQ ID NO: 4183012 - RNA, 76 nt, Human
ggccuguggguuggagcuuggccagaguuagucugugcuucuuggacuauccugggcuguuccgcuugggcagacc

SEQ ID NO: 4183013 - RNA, 63 nt, Human
ggccugugucggccccggguucugccugggaccagauguucugaccaaagggcuggcacugcc

SEQ ID NO: 4183014 - RNA, 58 nt, Human
ggccuuaaucuuuccaggaccucaagccucugugagagucugaagaaagacagggacu

SEQ ID NO: 4183015 - RNA, 56 nt, Human
ggccuuagcugucuuuccuuugguucaggaaauacagaagggaagaccgcugaguc

SEQ ID NO: 4183016 - RNA, 58 nt, Human
ggccuuaggcucuggcuacuacagagcugguuccagucugcacugccacagccuggcc

SEQ ID NO: 4183017 - RNA, 60 nt, Human
ggccuuagugaaaguauuaaacagcugguuagcugcuggguaguaaauuuucauagagcu

SEQ ID NO: 4183018 - RNA, 78 nt, Human
ggccuuauuucaccugugucuccucuguguucucaaauuucucugcuuguaaggacaccagucauaggauuuagggcc

SEQ ID NO: 4183019 - RNA, 80 nt, Human
ggccuucaugggagcccagggcaccugcuucuccacccagcacgcuggucugcuuugcccugggcuuugcuaugacugcc

SEQ ID NO: 4183020 - RNA, 62 nt, Human
ggccuuccaucugccucuguuuuguuuuguuucucagacucuuuagauggaugaggguggcc

SEQ ID NO: 4183021 - RNA, 77 nt, Human
ggccuucugcugcuguucaugguuguaccugcacaggaugccugaaaaggaguaaccguggggucagaagaggagcc

SEQ ID NO: 4183022 - RNA, 65 nt, Human
ggccuugauggauaugguggaugaaaauggcccccagcagggggcuuucacuaggucacaagguc

SEQ ID NO: 4183023 - RNA, 60 nt, Human
ggccuugcgcugaauuuccuccacuguagccucuggauggggagaugcagcccaggugcc

SEQ ID NO: 4183024 - RNA, 64 nt, Human
ggccuugcugaggagaugauaaugucauuuuuugcuaaaauagacgaaguuuuucagauuggcc

SEQ ID NO: 4183025 - RNA, 81 nt, Human
ggccuuggaaaagacacuucaccuuucccagccucagaucccuaaaguucaaggcagggcagguggcgugugcccauggcc

SEQ ID NO: 4183026 - RNA, 55 nt, Human
ggccuuggaaguauuucaguucggaaccccaauucuaaccuuagcuucucaggcc

SEQ ID NO: 4183027 - RNA, 82 nt, Human
ggccuuggagcaguggacccaggagagaggguugcaugggagagaucccagaggcagaaugcucuggguccacucugugguc

SEQ ID NO: 4183028 - RNA, 64 nt, Human
ggccuuggauuuuacccuaaagguaguuauugacugaauuuagguggcgagauacccagagguc

SEQ ID NO: 4183029 - RNA, 66 nt, Human
ggccuuggcugccaagcugcugagucuggccuugauucaguagacccuggggagccuuugaagguu

SEQ ID NO: 4183030 - RNA, 63 nt, Human
ggccuugguucugucacagccgguagauuauuucccuuugugacacacaaaaccagcugggcc

SEQ ID NO: 4183031 - RNA, 80 nt, Human
ggccuugugggcacaagacagauggaaauuaaugauuacagaaauacaguagggaccaugucugaaaugugcucauagcc

SEQ ID NO: 4183032 - RNA, 97 nt, Human
ggccuugugucuugucacgauuuaucuccagacuccagggcucccugggccucgugacaggggcuccuggccuggagagcaggacagauggaaggcu

SEQ ID NO: 4183033 - RNA, 60 nt, Human
ggccuuuagggcaggggaggcuggggaguccccuuuccuaccucucugcccugcaaggcc

SEQ ID NO: 4183034 - RNA, 63 nt, Human
ggccuuuccuucaucaagacuuguccaggaacaucuucaaagauggagggauagauuaaggcc

SEQ ID NO: 4183035 - RNA, 99 nt, Human
ggccuuuggacccugggacucacacuggugcaaccacuccccgcagguucuuggccuuggacugagaguuccaccauugguuucccugguucugaggcc

SEQ ID NO: 4183036 - RNA, 79 nt, Human
ggccuuuguuuuguggccucaaggcugcccucacuuagaaaggaugagugacgguagcagaagccagccaagcagggcc

SEQ ID NO: 4183037 - RNA, 76 nt, Human
ggcgaagcuaaaccuagugguaaaauuagauggacacauaauucugaguguuuacucaaaggguuccaguacugcu

SEQ ID NO: 4183038 - RNA, 84 nt, Human
ggcgaaguguccuuugagcuuggccagcucuggaaggugguagguucucccucauggguuguagagcuggaaggggacaguguu

SEQ ID NO: 4183039 - RNA, 71 nt, Human
ggcgacaguugucaggcugggcugguuuccacaggcauucucuucagcugcagaaaggacaacuaauugcc

SEQ ID NO: 4183040 - RNA, 72 nt, Human
ggcgacccauccuccacuuggcagcgcagggugaaguucuggcccaccggcugccaaggaggcaggggugcc

SEQ ID NO: 4183041 - RNA, 59 nt, Human
ggcgaccucguggcccuggaaggucuggugaaugcugggccaccccuggcacaggugcu

SEQ ID NO: 4183042 - RNA, 56 nt, Human
ggcgagcagagcacugccaggauauccugcccagauuucccaguuucugccucgcc

SEQ ID NO: 4183043 - RNA, 61 nt, Human
ggcgaggcgcgcggcccgggccagcaucuguuugaaggcgcuguuucccgugcgcugcguc

SEQ ID NO: 4183044 - RNA, 69 nt, Human
ggcgccagaaagaaagaagagccaaacuaaauuuggcauuucaccuuucauuuccccccaaaugcugcc

SEQ ID NO: 4183045 - RNA, 56 nt, Human
ggcgccagcgguaaguaagacacacaacauaucuguccaacaugccugauggugcc

SEQ ID NO: 4183046 - RNA, 69 nt, Human
ggcgcccucagcagagcccugcaguucuucaggaggcucucuucucuguuggcaagguuucugaggccc

SEQ ID NO: 4183047 - RNA, 82 nt, Human
ggcgccggccccagacgaggucucuggggaacuccaggggugggagagccacccucuccagcggccucagggccccggugcu

SEQ ID NO: 4183048 - RNA, 64 nt, Human
ggcgccgggcaaggcgagacuaggcccccgcggagcgggggaagcacagaccccagcccgggcc

SEQ ID NO: 4183049 - RNA, 55 nt, Human
ggcgccucccaccgugugcagcugaggaaggcugugcucugagcgugggguugcc

SEQ ID NO: 4183050 - RNA, 80 nt, Human
ggcgcgcggaggcugcgggaggcggcugcuacuggcggcccaagcagcuucccgagcuucugaccuuaaccucucgcgcc

SEQ ID NO: 4183051 - RNA, 55 nt, Human
ggcgcgcucuccuucuggcacccaggucguuuugccugggccggggcagcgcgcc

SEQ ID NO: 4183052 - RNA, 62 nt, Human
ggcgcucagagucaugaggcaacaccaagacauacaguccugucugccuuaugaccuucgcc

SEQ ID NO: 4183053 - RNA, 86 nt, Human
ggcgcucgcggcugcggaacagcagcucguucucgauggacgauccggacgcgggagccaugggagcugcggcugcagugaguguc

SEQ ID NO: 4183054 - RNA, 56 nt, Human
ggcgcucuuguaccugucccucucacuccagaguggaaggugcuggugaggguguu

SEQ ID NO: 4183055 - RNA, 60 nt, Human
ggcgcugcacagggggaaagggagggcuugcaccccaaccaagcugcuuugugcaacgcu

SEQ ID NO: 4183056 - RNA, 64 nt, Human
ggcgcuggcccauggugagcucugggagugucagcucugucgugagugacaaugggucauugcc

SEQ ID NO: 4183057 - RNA, 117 nt, Human
ggcgcuggggcuggcgcuggggcuggggcuggggcuggggcuggggcuggggcuggggcuggcgcuuggguccagugcagcugcgcgucuuccuccauccggcgccagcccgagucc

SEQ ID NO: 4183058 - RNA, 102 nt, Human
ggcgcuucuuggggcugggacaauaguguguggucucucccuuguugcccggagaaagcaaggacagaagcccacacaggggucuuuugggucaugaggccc

SEQ ID NO: 4183059 - RNA, 69 nt, Human
ggcgcuugcaggggcucccccaguucugcgcugugagccggggcacaaagagcccucugcacuagcgcc

SEQ ID NO: 4183060 - RNA, 78 nt, Human
ggcggaacaggaaagaaggcgaagggaccagacgguagaggacuacugcuucuucucauuuguuuuucuauuucugcu

SEQ ID NO: 4183061 - RNA, 57 nt, Human
ggcggaucaccugaggccaggaguucaagaccagccuggccaagauggugaaacccc

SEQ ID NO: 4183062 - RNA, 77 nt, Human
ggcggcaguccagcuggaacggcagcccagcagggacacaaccccagcucgggcgccggccacgcuaccuugcugcc

SEQ ID NO: 4183063 - RNA, 60 nt, Human
ggcggccuugccgcucagcaguggggucuuguccgugggcccgcacagcgguaggccgcc

SEQ ID NO: 4183064 - RNA, 73 nt, Human
ggcggcggcggcagcucgagggccacccgugcaaaucgcguugggcgcggggcccugagcggucgccgcagcc

SEQ ID NO: 4183065 - RNA, 114 nt, Human
ggcggcggcgggcgaggcggcgcccacagcacucgggacucagcugccggagggacaaacuaacuuccugagcgcgggaccugaggcuggcgcggccgggagccaccugcagcc

SEQ ID NO: 4183066 - RNA, 80 nt, Human
ggcggcucuucggcuggagcugagaaaggagcgcuuccccggacucggcucggcuccgaggcucugaagccgacgccgcc

SEQ ID NO: 4183067 - RNA, 62 nt, Human
ggcggcuggcuguguuucaucucugagcccucuaagagacagcagagcacguguuaacugcu

SEQ ID NO: 4183068 - RNA, 101 nt, Human
ggcggcugucccuguuuucuguuuucccuuuccacggcuuggcauuuauucuacgugggagaagcauggggugcagagcgguggcacugggacugcgugcc

SEQ ID NO: 4183069 - RNA, 65 nt, Human
ggcgggacggggcgugcacagaauugcauacuauccccuugcucagugcacgggccaguccugcc

SEQ ID NO: 4183070 - RNA, 96 nt, Human
ggcgggaggaaggaggccucgugagcagauggaggcuucugcagcagcucucucucugcagggccccucugcaugagugugucagcuuccccugcc

SEQ ID NO: 4183071 - RNA, 71 nt, Human
ggcgggagugcaguggcgugaucucggcucggugcaagcuccgccucccggguucaugccauucuccugcc

SEQ ID NO: 4183072 - RNA, 76 nt, Human
ggcgggcaauuuaaagaggauuuccucacuucuucccuaggggagaugagugggggaucucucacacaggccugcc

SEQ ID NO: 4183073 - RNA, 78 nt, Human
ggcggggcugccaggcucugcaggcacccaggguggggaggccacccuuccugcccuacccgcagaauggugcucucc

SEQ ID NO: 4183074 - RNA, 61 nt, Human
ggcgggguggcacucuaaauagaaagcacauaucccccgcuuuccagccgccacuuccgcc

SEQ ID NO: 4183075 - RNA, 75 nt, Human
ggcgggguugcugagaggaugcugcaguggaggccggggauaucucagcagccuccuggaggguccggcccugcc

SEQ ID NO: 4183076 - RNA, 119 nt, Human
ggcggucaggccagacacaggagaagggcagcaugucacuagcauggcaaaggaucccagcggcacaggaggcuuccccuuggcagugcuguguuugcugccuggcuuaaugugccgcc

SEQ ID NO: 4183077 - RNA, 93 nt, Human
ggcggucccucccaccauggguggguugagggcuaaggucuucacugggcucagcccuagccuucggccuacccaucaggggaguucgcugcc

SEQ ID NO: 4183078 - RNA, 70 nt, Human
ggcggucgcugaggucaccccacuggcugugacacucauguuaguaggcagggucacuucggccacagcc

SEQ ID NO: 4183079 - RNA, 83 nt, Human
ggcggugacaagagcucacugugaccucagcagacaauuagcaaggcggugucgaguuacugagcuccagcaggucaccugcu

SEQ ID NO: 4183080 - RNA, 63 nt, Human
ggcgguguccuugcagcucuacccagcucuuggcucugggaaaagggaacaauggacgcuguc

SEQ ID NO: 4183081 - RNA, 65 nt, Human
ggcgucagggugcacagugcaaccgugcccauaggcagagacacauugagcgacccugcaugacu

SEQ ID NO: 4183082 - RNA, 62 nt, Human
ggcgugaauuuugacauggaguacuguggcuuguauugcauugagauuuuaaaauucauguc

SEQ ID NO: 4183083 - RNA, 74 nt, Human
ggcgugacucaucugccauuccuguaccccugaguucucagcacugcuggugccugauggugaugaggucuucc

SEQ ID NO: 4183084 - RNA, 61 nt, Human
ggcgugggcgaggugcucuaucugagacaaaacagcauggggcuguucucugcccugcgcc

SEQ ID NO: 4183085 - RNA, 63 nt, Human
ggcguggggcggguggacacuugcggcuguguucuggaagcaaggucauuucuguuccauccc

SEQ ID NO: 4183086 - RNA, 102 nt, Human
ggcgugguggcaugcaccuguggucccagcugcucaagaggcugaggugaggagauugcuuuagcuugggagguugaggcuucagugagcuacuaccaugcc

SEQ ID NO: 4183087 - RNA, 58 nt, Human
ggcguuacuuccacguagguauguagcacugaaagcaacauaacugucaaguaacguu

SEQ ID NO: 4183088 - RNA, 63 nt, Human
ggcguucugagucacuuggcuggcuugggaaugugagcugggccaggugcaccuuagagagcc

SEQ ID NO: 4183089 - RNA, 78 nt, Human
ggcuaaacuuuuauaacauugagacucaaaauaaggcccaaacaagaguuucauguuacaguguaaaagugagugguc

SEQ ID NO: 4183090 - RNA, 83 nt, Human
ggcuaaauauauucucaggggugaguuggggcuacccugacagugacuccaggcaagcauuuaaccacucauggcauuaaguc

SEQ ID NO: 4183091 - RNA, 77 nt, Human
ggcuaaaucauuacagugccaccucgugguccagccucuugagagguaacaggccacugugaguacaauggugugcc

SEQ ID NO: 4183092 - RNA, 61 nt, Human
ggcuaaauggaauguagaugucaggagaaaaugcuccaccacuuccugcagccauucagcc

SEQ ID NO: 4183093 - RNA, 70 nt, Human
ggcuaagccacccuccuuaggaauacuguguaaaucaguaauucaucuacuccuggagucugguuuggcu

SEQ ID NO: 4183094 - RNA, 62 nt, Human
ggcuaaugaggggaaccaucuguaguacuuugccggcagaugugucccccucauacugugcc

SEQ ID NO: 4183095 - RNA, 77 nt, Human
ggcuaauuuuacaugacaauggcugcucuaugcucuuucauggagcauuggaauggcuuugcaugucccauguggcc

SEQ ID NO: 4183096 - RNA, 57 nt, Human
ggcuacagcugauuggaucaaggacagacaccugaccaaggacagucacgcugugcu

SEQ ID NO: 4183097 - RNA, 66 nt, Human
ggcuacagguggugaagaggcaugaacaagucaggccaggcucagcuuugccaccagcuguaagcc

SEQ ID NO: 4183098 - RNA, 111 nt, Human
ggcuaccaaggggcagagaacagaaacagccaccaaguuccugggccaaguccagggcuuccuggacuguauucagagagcuguggcuuuucucuaccacuugcaacagcu

SEQ ID NO: 4183099 - RNA, 65 nt, Human
ggcuacuagacuuugauacuaggaaaccugcuuggugugccuguuggcucagacucuggugugcc

SEQ ID NO: 4183100 - RNA, 70 nt, Human
ggcuacugaaggcucagguuuucuaagagaugacuggaggccaaguccucaggcuugaguguuuauagcc

SEQ ID NO: 4183101 - RNA, 56 nt, Human
ggcuacugggcagucccuccauuuccccgugccucugaggcugcccagucucugcc

SEQ ID NO: 4183102 - RNA, 93 nt, Human
ggcuacuguuauggaugaccuucaguguguuucucacaugugggugugacauaugguguuaagcaagcagaaguaauaaccaugcagugagcc

SEQ ID NO: 4183103 - RNA, 69 nt, Human
ggcuacuuucuuggucccauguuugauuugauauaguuucagcucaacgcaugcuccaagaaagaaguc

SEQ ID NO: 4183104 - RNA, 75 nt, Human
ggcuagacgggagaccuggaggauguggaugggcggguuuccagggccgggcacguuuccagguugccaucagcc

SEQ ID NO: 4183105 - RNA, 75 nt, Human
ggcuagaggcagagugcaccccaggagugacaaacaccucuguuagugacugggaaugugggcuugccuccugcc

SEQ ID NO: 4183106 - RNA, 62 nt, Human
ggcuagaucuuucacuacuguguagguagucucuacuuacugguaggauagauuacauugcu

SEQ ID NO: 4183107 - RNA, 72 nt, Human
ggcuagcaacugugauuucuaaagaguagcaucuucuaaaggaauauguuauucuaguggaucacgucagcc

SEQ ID NO: 4183108 - RNA, 76 nt, Human
ggcuagcaagguagcagaaugccaugcauuugaagauuaauaaugcaaacaaccaugauguuaacuuuguuaugcu

SEQ ID NO: 4183109 - RNA, 59 nt, Human
ggcuagcacuagauucugaagcagcagucucugcugauaaaccagacucaguacugacu

SEQ ID NO: 4183110 - RNA, 72 nt, Human
ggcugggaugcaaggccuugcucagcacugccaggauuaaggagcauggcuguggcaaguccugcaccugcc

SEQ ID NO: 4183111 - RNA, 61 nt, Human
ggcugggccuucuaaucuggucccugaguaacugagcugggggaccagggaggagcccgcc

SEQ ID NO: 4183112 - RNA, 114 nt, Human
ggcugggcggaucuuuggaacuugacuaggcucaggccucuauggucagcugagggccaggaggucgcucugcugaccuuggugggcuccuuguuggcgaacaucuggccagcc

SEQ ID NO: 4183113 - RNA, 79 nt, Human
ggcugggggcuagcauggauucccucaucagacacccuucccagcugaugggacugccagcugcugauauuucccagcc

SEQ ID NO: 4183114 - RNA, 92 nt, Human
ggcuggggguaggaaguaaugucauagagaaacagagggaccagacucucuauuccagcuguuguuuuaucucagauuuucucuccuaugcu

SEQ ID NO: 4183115 - RNA, 66 nt, Human
ggcuggggguaggagcugugggcggaagagcuggggcaucuguucacagaauccuccccugaaguu

SEQ ID NO: 4183116 - RNA, 69 nt, Human
ggcuggguuggggguccgugaccugguguguuuuuaccuuucucuuggcugcugccaauuuacuuuguc

SEQ ID NO: 4183117 - RNA, 75 nt, Human
ggcugguaauguucauuaaggguagaauguauaaauccauuguggugcauucauacaaugggauauuaugaagcc

SEQ ID NO: 4183118 - RNA, 88 nt, Human
ggcuggucucgaacuccugaccucgugaucugccagccuuggccucccaaagugcugagacuacaggcaugagccaccgugcccggcc

SEQ ID NO: 4183119 - RNA, 66 nt, Human
gggaggaagcacaagugcagugggcuuucuagaguuguacacaugcccacuugaagcauucuuccc

SEQ ID NO: 4183120 - RNA, 64 nt, Human
gggaggaccagcaaaaaagaaucuuguacuaaaagucaaguauuuauuucugcuggcaucucuu

SEQ ID NO: 4183121 - RNA, 55 nt, Human
gggaggacgugccaggcgaucuccagccccugggagccggacgcccacgccuccc

SEQ ID NO: 4183122 - RNA, 58 nt, Human
gggaggagcaugagaggguagugaaacaguaugugacacacccgagcugcugucuccc

SEQ ID NO: 4183123 - RNA, 58 nt, Human
gggaggaggagggccauggucccugcagagacccaggggcccaggccuccuuccuucc

SEQ ID NO: 4183124 - RNA, 75 nt, Human
gggaggaggcugcauucuucccacugcacaaugaagccuccggccgaagcggcaggaagagcgcagccccguccc

SEQ ID NO: 4183125 - RNA, 117 nt, Human
gggaggagggaaggagaggcucccucagaugcuaggucugagccuggcuccccagcacccuggaggccuggcuugccagcccuggcgccugcgccugcccagcuccagcccccaccc

SEQ ID NO: 4183126 - RNA, 57 nt, Human
gggaggagggugcuggcuaaacaggaacugaaugaauggccugaagcucccucuccc

SEQ ID NO: 4183127 - RNA, 58 nt, Human
gggaggagguaagaagagaaagggcuaagugauccaguucuaaguguuaccuuuucuu

SEQ ID NO: 4183128 - RNA, 66 nt, Human
gggaggauaagaaauaaaagccucugaacugaaaagucgcucagggcugugguuccuuuucuacuu

SEQ ID NO: 4183129 - RNA, 108 nt, Human
gggaggaucucagauuaaauguguacacuggacuucugaucuugugaagaacacugccuagaugcauuagucaggugacauguuuagucuuagaagaaagagccuccu

SEQ ID NO: 4183130 - RNA, 81 nt, Human
gggaggcagaggcagaggccggcuggcuccagccgugguaccgcacggcugccacccucggacuuccgucuugagucuccu

SEQ ID NO: 4183131 - RNA, 61 nt, Human
gggaggcagcuuaggguacugacuaagcccauaggagucagacuaucuugguugagauccc

SEQ ID NO: 4183132 - RNA, 104 nt, Human
gggaggcaggcuaggagggccaccggccgagggaggugcugaaggacuauaacgguuugcgagcaggcccuucgcggccucccccggcccuccugcccccuccc

SEQ ID NO: 4183133 - RNA, 56 nt, Human
ggcuggacucugggccucuccagucccagguacggaccuaggcucagagcccagcu

SEQ ID NO: 4183134 - RNA, 75 nt, Human
ggcuggagucucuuguaggggcagaggaagaaccagaugucugcccuuccuuccucugucaggcaggccccagcc

SEQ ID NO: 4183135 - RNA, 60 nt, Human
ggcuggagugcagugacguaaucacagcucaccgcagccuugaccuccugggcucaagcc

SEQ ID NO: 4183136 - RNA, 60 nt, Human
ggcuggagugcaguggcaugaucauagcucgcugucaucuuaaacuccugggcuccagcc

SEQ ID NO: 4183137 - RNA, 71 nt, Human
ggcuggagugcaguggcgugagcucggcucacugcaagcuccgccucccggguucacgccauucuccugcc

SEQ ID NO: 4183138 - RNA, 60 nt, Human
ggcuggagugcgguggcgugaucauggcucauugcagccucgaccugcugggcucgggcu

SEQ ID NO: 4183139 - RNA, 96 nt, Human
ggcuggaguugaggaguggugccacauaaauggagagaguucuucuauaaacggagauaguuccuccauuuacguggcaacuucucaucgccagcu

SEQ ID NO: 4183140 - RNA, 59 nt, Human
ggcuggaugggcugucugagcgcugugccccauacaagaaggauggagcccacuuugcc

SEQ ID NO: 4183141 - RNA, 59 nt, Human
ggcuggcacaaagcuccaaaucuaggcuaugauacuauuuuuggguuccauaugcugcc

SEQ ID NO: 4183142 - RNA, 84 nt, Human
ggcuggcaccuuccuauucuguacacaugacacccaacuauccugagugugcaacaugagacagaacagggcccgguggcggcu

SEQ ID NO: 4183143 - RNA, 55 nt, Human
ggcuggcaggggaugucagauggcacggagccgaggccaucaucccuuugcagcu

SEQ ID NO: 4183144 - RNA, 85 nt, Human
ggcuggccaggccgcaggagcucugcugucuuugggaugagaaaugccacucucacugcuuggcuccugccagcccugggcagcu

SEQ ID NO: 4183145 - RNA, 75 nt, Human
ggcuggcccggggguccuugcugccagccaccauacuggcuccuuaaagcugcugguaccgcgccuccgccagcc

SEQ ID NO: 4183146 - RNA, 71 nt, Human
ggcuggccucgccuguuguagaaugaguccacagaggacagagccauuccagaugaggccaggcccuagcc

SEQ ID NO: 4183147 - RNA, 70 nt, Human
ggcuggccugagcuggagcuuucggccaccgggccuccaggcuccguccagucucaggccucccccagcc

SEQ ID NO: 4183148 - RNA, 63 nt, Human
ggcuggcucuucagacaacgacuccauccaggguccugauggugcuccugcaggaagcaggcc

SEQ ID NO: 4183149 - RNA, 78 nt, Human
ggcugggaaaagacagggucauggcaccugcacggcuggcaucagugguacagugcucauguucucuccuccucagcc

SEQ ID NO: 4183150 - RNA, 62 nt, Human
ggcugggagcuccuggagggcaggaagcugguccuauuggguucuguccccggagccuggcc

SEQ ID NO: 4183151 - RNA, 66 nt, Human
ggcugggaggaugacuugcuacaugaacuugaacaugggagugauagcaagggaucugcuccaguc

SEQ ID NO: 4183152 - RNA, 79 nt, Human
ggcugggccagggccuguggacacgcugccuuuccacaugacagcuguccacccauccacaggcccugcuuccccugcc

SEQ ID NO: 4183153 - RNA, 66 nt, Human
ggcugggcucugccugucugggaugaugccauuccucccuugcccucggcagguagagggccaguc

SEQ ID NO: 4183154 - RNA, 57 nt, Human
ggcugggcugcgggacgcugggcaugcugagaggccacccuggcucugagcccagcc

SEQ ID NO: 4183155 - RNA, 61 nt, Human
ggcugggcugcugggucagagcccuucuccuuccagcaucccgugaccuggcagugcgguc

SEQ ID NO: 4183156 - RNA, 70 nt, Human
ggcuggggagcugcacagagccgaccccagaugccccuccacccccugcccucucacagcucccucagcc

SEQ ID NO: 4183157 - RNA, 77 nt, Human
ggcuggggcaucuccagagcuuuuuccuugacuuggguccaagaccagcucccagaaaggcucugggacccccaacu

SEQ ID NO: 4183158 - RNA, 129 nt, Human
ggcuggggcgggggacgcggcgggcaguggcuggguugcaaagcgcuggcugcagucagguuuggagcaguagugaaaagcagcccagccaagacucugccccuccugggcccucucccagcuccagcc

SEQ ID NO: 4183159 - RNA, 58 nt, Human
ggcugggguguuugccuucgucccugugggggacuagagguggggcugcaccucugcu

SEQ ID NO: 4183160 - RNA, 88 nt, Human
ggcuggguauccucugcucugucugggaggcucagugcucucccgcucgcuuggcggggcaccgaccuccugccgcccggagcccucc

SEQ ID NO: 4183161 - RNA, 62 nt, Human
ggcugggucugugcccagggaccuccucugagaggacagccugagagggcagggacuuggcu

SEQ ID NO: 4183162 - RNA, 89 nt, Human
ggcugggugucagcagaagcaccguggccccgcucucccgccuccccgugcgccugggccuccgugugcuggugcucucgcacacagcu

SEQ ID NO: 4183163 - RNA, 73 nt, Human
ggcuggguuccaagggugagccucacaagacagagaaccagguggaggcugugccaucuuuggucaccuaguc

SEQ ID NO: 4183164 - RNA, 95 nt, Human
ggcugguaccaggcuugccgucccuggagcugagcagugcuguucccucuagaaggagcauuugcuguccagggcacugagccuguggccaugcc

SEQ ID NO: 4183165 - RNA, 58 nt, Human
ggcuggucaggguauuggaggccaaauuagagguggcuggguuauuuauggccaagcc

SEQ ID NO: 4183166 - RNA, 57 nt, Human
ggcugguccuuucucuguccuaauuacaaauuauuagaagagaggauaugaucagcc

SEQ ID NO: 4183167 - RNA, 65 nt, Human
ggcuggucguccuguuguugucucagccugugcagcagagcuuccgacaggagaggcagccagcc

SEQ ID NO: 4183168 - RNA, 69 nt, Human
ggcuggugagggaucucugccugcucuggacuguggcaggagccagcaggaggacucucugagccagcc

SEQ ID NO: 4183169 - RNA, 57 nt, Human
ggcugguuagauuuguggucuucuuccuccuguggaggacccuagagagagccagcc

SEQ ID NO: 4183170 - RNA, 70 nt, Human
ggcuguaaauaccuggaggcuggccucauggggggcacuuuacaggcugccuaccaaguaucauaaagcc

SEQ ID NO: 4183171 - RNA, 65 nt, Human
ggcuguaacuuaaugagaggcagaugucaacggggagcagauguuugcagcucuucaguuauauc

SEQ ID NO: 4183172 - RNA, 56 nt, Human
ggcuguagacguucacagucucccucucucuacggggccugauggacauuucaguu

SEQ ID NO: 4183173 - RNA, 58 nt, Human
ggcuguagggugggcuuuauccucgggacguccuccuccccaaguccagccugcagcu

SEQ ID NO: 4183174 - RNA, 64 nt, Human
ggcuguaguuugaagacuuagcaggugcuuucuacaccucacuuuccucaucacgacuagagcu

SEQ ID NO: 4183175 - RNA, 60 nt, Human
ggcugucacagguucaaacuccccuacucguggcugagucaaugggaucuguuuauggcc

SEQ ID NO: 4183176 - RNA, 60 nt, Human
ggcuguccuaagcuucuaagguguccucccggacaguaucuagaauggcugggcacagcu

SEQ ID NO: 4183177 - RNA, 60 nt, Human
ggcuguccucacugcucacuugcucccccucagguucaguguguauugcugagggcagcu

SEQ ID NO: 4183178 - RNA, 56 nt, Human
ggcugucuugggagcucccccgcggccccgaagccccgcggugcucucaggauacc

SEQ ID NO: 4183179 - RNA, 73 nt, Human
ggcugugcccucacauggggcaggagcagaacacaacagggccaugagcucagcggugccaggaggcgcagcc

SEQ ID NO: 4183180 - RNA, 58 nt, Human
ggcugugcugagggggaagccccucugcccacuggaugagucccccucauucacagcc

SEQ ID NO: 4183181 - RNA, 55 nt, Human
ggcuguggcugcucaggugcagacccugucuguggguggugcuggcagcccagcc

SEQ ID NO: 4183182 - RNA, 55 nt, Human
ggcugugggguccugugguguguggggagcugucacauccaggguccucacugcc

SEQ ID NO: 4183183 - RNA, 62 nt, Human
ggcuguggugccgagagucuggacgcggggcgcugaccagagucacggcgccgaucucggcc

SEQ ID NO: 4183184 - RNA, 56 nt, Human
ggcugugguggcaucccugagccccucgucuguggggagagugccaccaacaaguc

SEQ ID NO: 4183185 - RNA, 55 nt, Human
ggcuguguaucucugugggacagaaaaugaauuuuuugccuuugagguaacaguc

SEQ ID NO: 4183186 - RNA, 58 nt, Human
ggcuguguuucuguuugacauuugcaauuaauuaccgaaaugcaauggagaugcagcc

SEQ ID NO: 4183187 - RNA, 63 nt, Human
ggcuguuauuuuccucugaacucuaauuguugguaucaaaaggauuaaggggaaaaagcagcu

SEQ ID NO: 4183188 - RNA, 110 nt, Human
ggcuguuggggaccuuccaggcguguuaccuguaugcugccugguggcgccugggggauuccaaggggacugccauguagucuauggggcgcagucuggcccugacagcc

SEQ ID NO: 4183189 - RNA, 109 nt, Human
ggcuguuuuaacuaaaauguaagcaaacccaaugucuaacuacaguaaacaaaauuuauuaugauucggacguggcagugguguuuacaucuagguugacaaaauugcc

SEQ ID NO: 4183190 - RNA, 114 nt, Human
ggcuguuuuccucccggggaagguucuggagcauuucuucuccaugggguaagucagaauuuucuaggcaaaccacaggggaggaaugaugcccgggacaggggaggaagugcc

SEQ ID NO: 4183191 - RNA, 68 nt, Human
ggcuuaagagguuuuaggaugcuguuuauucaacugaauugcauuacagaaacuuucaaauuuuggcc

SEQ ID NO: 4183192 - RNA, 75 nt, Human
ggcuuaagauauuucugauuccuuauaaggcagaaauagaaaaugaaaaggagagcaaucagaaauaucgaggcc

SEQ ID NO: 4183193 - RNA, 60 nt, Human
ggcuuacuaguuuaaaaagcagaaauaugcauuaauggaaugcuguaagauuagagagcu

SEQ ID NO: 4183194 - RNA, 90 nt, Human
ggcuuagcaggacaggagcagggcuggggcacgagccaggucucuucucuggcucacagcugccaguccuuccuuugccaccugaagacc

SEQ ID NO: 4183195 - RNA, 73 nt, Human
ggcuuaggcugaacccugggagauuucuccauuuguacuuucuguccagagcaauuuucccuuagucuuuguu

SEQ ID NO: 4183196 - RNA, 77 nt, Human
ggcuuauacaagcuggaagugcauuucucacucaugucaacagcugagcuggugugccaguuccaguuugugaaguu

SEQ ID NO: 4183197 - RNA, 80 nt, Human
gggcauguguagggagacacuugcuuuagagggccccuggguugugggcuccucccugcgauugcucugccuuacagcuc

SEQ ID NO: 4183198 - RNA, 92 nt, Human
gggcaugugucagcucacuggcagccugggguaggcugggacacgcuguccuuuuucugccugaggacugacaccagcucagcaaacagccc

SEQ ID NO: 4183199 - RNA, 55 nt, Human
gggcauugcagacccuuacugcuagagcgucucaggcaccuggucugcaaagccu

SEQ ID NO: 4183200 - RNA, 85 nt, Human
gggcauuuguguucuaauauaauguccuaugggaauaagguaagacuacuccucuauaggaaauuagaacuuggaaacugagccu

SEQ ID NO: 4183201 - RNA, 55 nt, Human
gggcauuuuuccuuaugauccuuccacaguacugggagggauauuuaaaaagcuc

SEQ ID NO: 4183202 - RNA, 74 nt, Human
gggccaaauugauuauauuuuagguaauauccauugugauagaaucagaaggguuuuuuaaaaaucuuugggcc

SEQ ID NO: 4183203 - RNA, 71 nt, Human
gggccacaugcugaguugaugauauagcaagaaccacccucuagcugguccucagcuccagccuugagccu

SEQ ID NO: 4183204 - RNA, 64 nt, Human
gggccacgugaccucuggcuccuuguggcuccagggucuggugaggaucagaggugcguggccc

SEQ ID NO: 4183205 - RNA, 55 nt, Human
gggccagacggggucuccaggcugcaaguccuugccaguccugucccugcugccc

SEQ ID NO: 4183206 - RNA, 73 nt, Human
gggccagcuuugagcugcaggaaggaagacgggagugcaggauucuagaggcguucucugcagcaggcggccc

SEQ ID NO: 4183207 - RNA, 76 nt, Human
gggccaggcaggccuggggucggugcuccggaggaaguggcccucaggagcccguugcuccggcgggccggggccc

SEQ ID NO: 4183208 - RNA, 84 nt, Human
gggccagggaugcuguuuggucaauauugguuuguaaagauuaugaauaaccaacaguccagaugagauggucauuguuugucc

SEQ ID NO: 4183209 - RNA, 56 nt, Human
gggccaggucugaagggagaguaggcuaccccaggacucugcugcgggcuuggccu

SEQ ID NO: 4183210 - RNA, 66 nt, Human
gggccaugagagguucaucaacugccacugaaaugcaaggggcuuggagaggccucugccaggccc

SEQ ID NO: 4183211 - RNA, 76 nt, Human
gggccauuccuccuucccauuccugggggagacacuggagcagcccccauggguguagggagguggauuggacacc

SEQ ID NO: 4183212 - RNA, 110 nt, Human
gggcccacucugcaccugaggccuccagggagggcccgaguugccccggcuaccccauccuaugccgagggcuccagccagcuccuuguggccacagguacccugggccc

SEQ ID NO: 4183213 - RNA, 62 nt, Human
gggcccagcuaauaggaacuuuggacuugaggcagaguauccagagggccggcauguggucu

SEQ ID NO: 4183214 - RNA, 72 nt, Human
gggcccaggccuuaucuccacccugcagauagacaucucugcugggcuagaagcugaggcccaccauggucc

SEQ ID NO: 4183215 - RNA, 59 nt, Human
gggcccagggcugucugacuccagggccuaugccuuaaccaucaggcugcccugugucu

SEQ ID NO: 4183216 - RNA, 92 nt, Human
gggcccaggucccugcgccccggccucccggcccauuucacuccggcuuggggccaagagucuguggagcaaagggaccaaggaagcagccc

SEQ ID NO: 4183217 - RNA, 127 nt, Human
gggcccagucuugagcacugagaccaucccagguguccagggcuuuguuuaggugaccaccuuuugguuuuggaauaugacaaaagcuguggauauggcugcuuacauuagagagaaauaagggccc

SEQ ID NO: 4183218 - RNA, 63 nt, Human
gggcccagugcacagccaggcaggugggguggcccacacuugccugucgcuguugcucagcuc

SEQ ID NO: 4183219 - RNA, 67 nt, Human
gggcccaguggagauaggaguguggcaaaaaaggaguugggugacaaauuagacucuaacuggaccc

SEQ ID NO: 4183220 - RNA, 76 nt, Human
gggccccaggccacagguggaauuaagaaaucugggaaaccaugaacuguuccuuaugccugaggcaauggugccc

SEQ ID NO: 4183221 - RNA, 69 nt, Human
gggccccagggucuuggagaggagugccagccaaggcugggcccagcuccucugcagacccucaggcuc

SEQ ID NO: 4183222 - RNA, 57 nt, Human
gggccccaguccucccacguggacagcagcucugggccugggggugggcuggggccc

SEQ ID NO: 4183223 - RNA, 101 nt, Human
gggccccguuguguguccauuugggcuuugcuggggucccuggucuuuuuacccaggaggcccagaaggaagcccagacucucagggccugcccggggucc

SEQ ID NO: 4183224 - RNA, 59 nt, Human
gggccccuagcuuuguccuccacccucagcacucucucugcuggccaggccaggggccc

SEQ ID NO: 4183225 - RNA, 75 nt, Human
gggcccgcgggacgcacggggccgccaggggaggacaacaagccucaggcccugucccugcgccccgcccggccu

SEQ ID NO: 4183226 - RNA, 104 nt, Human
gggccgaagccuggucucagagaggggccgggccuucucaagugguucugcugccgagaaaggugccagccccuccacugaccacuggccaccugcagaagccc

SEQ ID NO: 4183227 - RNA, 63 nt, Human
gggccgugagcaguggccaggguccuagugcuuaucugggauccacaguccagcuuugagccc

SEQ ID NO: 4183228 - RNA, 85 nt, Human
gggccuagaauaaucagaauagugggggacagucuuuaccagcuggugugaaaauacuucaguguucuggcaaugacuagagccc

SEQ ID NO: 4183229 - RNA, 84 nt, Human
gggccucaaggaacaguuaauccuaaaggcgguacccaaucuucuaauuuccugcuccugagggauaaacugccuuucuggccc

SEQ ID NO: 4183230 - RNA, 77 nt, Human
gggccuccuggguccaggcauaggaacagaaccuacugcucaggucccugaugccuugauccguggacugcuggccc

SEQ ID NO: 4183231 - RNA, 62 nt, Human
gggccucuccggccuuugcauccugacaucagaguucagcaggggcaggagaucucaggccc

SEQ ID NO: 4183232 - RNA, 61 nt, Human
gggccucugugcagaggggccuccuggucgucagagcagccugccccuguggcaggcgucc

SEQ ID NO: 4183233 - RNA, 71 nt, Human
gggccugagcccagaagcccacucggcauaacacauaaggcugugcuuuuggugcauucugggcuuggucc

SEQ ID NO: 4183234 - RNA, 55 nt, Human
gggccugaggcccagacacuggccacccuggcucagagucuggacugcaggcucc

SEQ ID NO: 4183235 - RNA, 77 nt, Human
gggccuggaaugaugacuaggaauuguuaaaucagaaggcagggugauuccacgggcaucauuagugucccaggccc

SEQ ID NO: 4183236 - RNA, 74 nt, Human
gggccuggcacgugugagcugugagcugcaucuuguggagaggugucugcugcacccucacacccacaggaccu

SEQ ID NO: 4183237 - RNA, 115 nt, Human
gggccuggcaggacucuuaacaccccucuacugggcuggguacgugcaggaugugccucgcauaacgggagccugugcccaucccucuggagugugugaggguugagcuuggcuc

SEQ ID NO: 4183238 - RNA, 99 nt, Human
gggccugucugccugcgaacagcuccccuggggaggguuucaggaggucuccaugaccucagggcccagagcucaggcaaguccaggcuggcaaggccc

SEQ ID NO: 4183239 - RNA, 79 nt, Human
gggccuguggggcuggcacaggaccaaacagcuuuucauuuuguuuaagguugaaaccccugugcuccacacagggucc

SEQ ID NO: 4183240 - RNA, 56 nt, Human
gggccuucagccuuggacugagaauuacaccauuagcuuccuuggcgcugaggccu

SEQ ID NO: 4183241 - RNA, 58 nt, Human
gggccuuccgacucccaaggcccuaaauggagucagagccuugagaaucggaaggccc

SEQ ID NO: 4183242 - RNA, 76 nt, Human
gggccuucggcagggagcugcggucuugcgaagacuacuucucugcgcaaaaacgcacagcucguucuugguguuc

SEQ ID NO: 4183243 - RNA, 56 nt, Human
gggccuugccauggagccugaguccuacaaucaggaauuucuuuguguuaaggccc

SEQ ID NO: 4183244 - RNA, 77 nt, Human
gggccuuggccuuggcuguuggagcuugauagacuaaugagauguacaucagcucaggaaacagcugcugagugccu

SEQ ID NO: 4183245 - RNA, 71 nt, Human
gggccuuuaggagguaauuaggucaugagaauggaucucucugaaugagauuacugccuuuauagaagccc

SEQ ID NO: 4183246 - RNA, 79 nt, Human
gggccuuucucuggaggggagugguuaaaaggacaugggagguuaaugucgaaacugccuccccauuagagagacgucc

SEQ ID NO: 4183247 - RNA, 75 nt, Human
gggcgacguagcacagcuucuugaugucacgcacgauuucccgcucggccguggugugaagcuguagccgugcuc

SEQ ID NO: 4183248 - RNA, 61 nt, Human
gggcgaggggccagucuccucugggagcuccccggagagucagagcgcggcccccacgccc

SEQ ID NO: 4183249 - RNA, 73 nt, Human
gggcgagucuuccuccuuguccuaguuacugccuauggaggcaguguuuagaucaagaaggccucucuugcuc

SEQ ID NO: 4183250 - RNA, 95 nt, Human
gggcgcacuggggguucaugaucgcgguucccgggggcggcggcggcggcggcugcuggcucccaggagccgcugugacaucccccggcgagccc

SEQ ID NO: 4183251 - RNA, 75 nt, Human
gggcgcaggaaagaaggaaugugggggcugauuuguggagcuccagcuuccuguccaggccccacauccugccuc

SEQ ID NO: 4183252 - RNA, 90 nt, Human
gggcgccaguggaggaaaagugaguggggccugcagauggcuuccaucucagggagguuccccguucugcuccaaucuccacaggcuccc

SEQ ID NO: 4183253 - RNA, 62 nt, Human
gggcgcgccccgagaggcgcccggcuaccaccagcuagcucagugcuugggggugacgcgcc

SEQ ID NO: 4183254 - RNA, 70 nt, Human
gggcggaagaggggaaguaaugaaugauacuuccagacccaaggaauguuaacuuccuccuccucugcuu

SEQ ID NO: 4183255 - RNA, 102 nt, Human
gggcggagcgccagcggcgcccggggcuacgcgccgcacugcaccgagcggcggcagcggcaagcuugggugugagcccgggagccgcuuugcuuaccgucc

SEQ ID NO: 4183256 - RNA, 81 nt, Human
gggcggaggcacuucaugcugacccgaaaacagacccaaaucgcccuuucugugccuggggggcaugaaccuccacggccc

SEQ ID NO: 4183257 - RNA, 62 nt, Human
gggcggaucauuuguggucaggaguucgagaccagccugaccaacguggugaaacccugucu

SEQ ID NO: 4183258 - RNA, 60 nt, Human
gggcggcaaaccuaaguggcauuuucaccagugcuguuaugcuauuuaauuuuucuguuc

SEQ ID NO: 4183259 - RNA, 67 nt, Human
gggcggccaccugccaacuugcuggaaguuaagaaagggcauuucugagggaggcaggaggcggcuc

SEQ ID NO: 4183260 - RNA, 122 nt, Human
gggcggccccucugaaccaggcuccucgaggccaucuggacgcccuggcaacaugggcaggaagcggcuuccauggcaacuggcguccagggaggcgcugccuggcaacggggccauggccc

SEQ ID NO: 4183261 - RNA, 55 nt, Human
gggcggcgucggcgaggccaucaaaggccggggguggcggcccgccgcguugccc

SEQ ID NO: 4183262 - RNA, 98 nt, Human
gggcggcucagugaugacguuccugugugacucaagugguuucuaaaaggcaagaagccauccccgugaggcauacggugaccagugcugaaucuucc

SEQ ID NO: 4183263 - RNA, 55 nt, Human
gggcggcuucagccagaggaagcugaugagcccaagagcuuccugaaagcugccc

SEQ ID NO: 4183264 - RNA, 93 nt, Human
gggaggcaggugugcggugaguugggggauuagaagcucccagggcucuuccgucagcugcugggaccccagauccacugugacuuuccuucc

SEQ ID NO: 4183265 - RNA, 75 nt, Human
gggaggcauguguuauccacuuaauuauuaagugauauuaauuuugauuucuuggugucuuaacagaucucuccu

SEQ ID NO: 4183266 - RNA, 55 nt, Human
gggaggcucagugguguccucuacugugugguugggggugcuuagaaggucuccu

SEQ ID NO: 4183267 - RNA, 59 nt, Human
gggaggcucugacgucacacguggccccagccaaucggagcugcccguucggagccccc

SEQ ID NO: 4183268 - RNA, 63 nt, Human
gggaggcuggggggcuggggcucuggcugggcggcgcagggcuccgggccaccggccuguccc

SEQ ID NO: 4183269 - RNA, 63 nt, Human
gggaggcuucccagcugagcucagcuccuccagggcugaccauacagcuguggguaagccccu

SEQ ID NO: 4183270 - RNA, 72 nt, Human
gggagggaagauggcucugugagcacagggaggugccagggcagcucccagagcucgagaguaacccucacc

SEQ ID NO: 4183271 - RNA, 65 nt, Human
gggagggcaggccagggcccaggaggagauccgcuccccucugcaggcuggaccugcccaaaccc

SEQ ID NO: 4183272 - RNA, 74 nt, Human
gggcuccgaguggggcguggauccagcgucgcuccagcaacccuggacaacagccucauaaacaggaggggccc

SEQ ID NO: 4183273 - RNA, 55 nt, Human
gggcuccgcccuuggcugagcuggagggcuuggggucaggaccaagggugggucc

SEQ ID NO: 4183274 - RNA, 94 nt, Human
gggcuccucgcccccucgcggccgccggcuguugguccuuuugucugcacuggggagagggccgggggccagcuccggccuaggggggcagccc

SEQ ID NO: 4183275 - RNA, 109 nt, Human
gggcuccuguugggagagggaagguagguucccucuaggauguggcuggaggacacagaacugguccccacucauuccugagaccaccaccugucuggggacagggucc

SEQ ID NO: 4183276 - RNA, 60 nt, Human
gggcuccuuuugaugggccacagucaagaaggcaguuaagcucuguggccuucugagcuu

SEQ ID NO: 4183277 - RNA, 83 nt, Human
gggcucggggaguguccuggggcucgaggacuagacuacuuccugacuauccuugaaaggggcugcagggcacuccugagaac

SEQ ID NO: 4183278 - RNA, 55 nt, Human
gggcucgucugugaacagguuacauggacccucucuagacccagcagaugggcuu

SEQ ID NO: 4183279 - RNA, 62 nt, Human
gggcucucaaggcagggccccauguucgcuccuggcaccagcccuuacuagcuuugagcccc

SEQ ID NO: 4183280 - RNA, 75 nt, Human
gggcucucacaacagagggaauggaucucaugguucuauauuuuucauucugugaccugcucauuuguugagccc

SEQ ID NO: 4183281 - RNA, 92 nt, Human
gggcucucacaugaguggagaggcuucccgcccaugcuggacuguggcuuccaguccugcagccuugggcuggagccugccgcucugagccc

SEQ ID NO: 4183282 - RNA, 58 nt, Human
gggcucugccuggcugggaguaggggauguucuaaggacugggugggaggcagagucc

SEQ ID NO: 4183283 - RNA, 60 nt, Human
gggcucuggacccaggcaagagccugaugguuauucugccacugggucugcaaugagccc

SEQ ID NO: 4183284 - RNA, 78 nt, Human
gggcucugguguguuucuggcugcggcccagggugagcuuguuaaagagguacucugccaggccugcuuccggggccc

SEQ ID NO: 4183285 - RNA, 93 nt, Human
gggcucugguugggggcagcuguggcugccacugcucccucuguccuggggaagcucagccccagcguguuccauuucccccauuccggaucc

SEQ ID NO: 4183286 - RNA, 56 nt, Human
gggcucuguuuagaccagagaucagcaaacuauggucugugggccaaauacagccc

SEQ ID NO: 4183287 - RNA, 66 nt, Human
gggcucuucccacucccccugagugaucccucuccccaccuuccagggcaugugggagaggagccu

SEQ ID NO: 4183288 - RNA, 69 nt, Human
gggcucuuggccacugauuucaaggccggugaugcgacgccuggagacagcagaggcggcaggagcacc

SEQ ID NO: 4183289 - RNA, 61 nt, Human
gggcugaaggcugacguuuguguuuauuuuccagaaaguugcacauuucuagccucaaccu

SEQ ID NO: 4183290 - RNA, 60 nt, Human
gggcugacaaucucuuuacuuaccuuggccaaaagaugugauggaagugacugucaguuc

SEQ ID NO: 4183291 - RNA, 67 nt, Human
gggcugacaguuuccccugaaacuuggcaaugaggggaacaaggacauaggcagagcugugcagccu

SEQ ID NO: 4183292 - RNA, 75 nt, Human
gggcugaccucaugagcuuccagagacaucagaguaagugacccuuauucuaguuucgaagcucuguucuaguuc

SEQ ID NO: 4183293 - RNA, 72 nt, Human
gggcugaccuggaaggacaauagauagugucuggggauccagcuaagauuaagugcuuuuaggccaccgucc

SEQ ID NO: 4183294 - RNA, 83 nt, Human
gggcugagucaauguugcucucaccagucauuccucaaauauuuauggaguuccuacugaugugacagcugagcagaccgccc

SEQ ID NO: 4183295 - RNA, 74 nt, Human
gggcugagugucucgggagaaaggagugggggcauguuuuccuuccaucaccauuucugcgagcuguccggccc

SEQ ID NO: 4183296 - RNA, 111 nt, Human
gggcugaguuaagcugggcugaccugggcugagcuaagcuggguugagccgauccgggcugggcugggcugggcugagccaggcuagguugagcugggcugggcugggcuc

SEQ ID NO: 4183297 - RNA, 80 nt, Human
gggcugccuuuccaggagagccugugcagccggguucugcccucguucggggaacucugccagguuucaggagccagcuc

SEQ ID NO: 4183298 - RNA, 56 nt, Human
gggcugcuacgagaacugaauaagaaaauguauguagagaacucagugugcagccu

SEQ ID NO: 4183299 - RNA, 112 nt, Human
gggcugcugagaggaggcuggugaggucugagauguuggggcagaaggagcccaagggaaauggggcuuguacaggaauccaugguauuacccagcgcucccauagcaggcc

SEQ ID NO: 4183300 - RNA, 55 nt, Human
gggcugcuucuccugccaauccccccucagggcugggguuggagaagagcggccc

SEQ ID NO: 4183301 - RNA, 83 nt, Human
gggcugcuuggcagaccugucccauaaguagugcaacuugggaagauccuaggccucuuguggguagggcagucauccagucc

SEQ ID NO: 4183302 - RNA, 57 nt, Human
gggcuggaccgcucgccucccuccagucccgacacccagggagacgaaguggcuccc

SEQ ID NO: 4183303 - RNA, 58 nt, Human
gggcuggacugcauugccucgcuucuggagggaaagauggcaguggaagucucagccu

SEQ ID NO: 4183304 - RNA, 55 nt, Human
gggcuggaggguggggcguaggguuugaggaggauucugcugcacaccuuccccc

SEQ ID NO: 4183305 - RNA, 69 nt, Human
gggcuggaguguuuaguuauauuuugacuuuuagaaguugucuucauaucuacuuugcaauucaguacc

SEQ ID NO: 4183306 - RNA, 60 nt, Human
gggcuggcagcucuacucagagccuguccuaaggcaaugcuguggugaagcugccuuccc

SEQ ID NO: 4183307 - RNA, 74 nt, Human
gggcuggccagugucccagggaucaggagcggggagcgguccgcgugggucccggaggggacagauggcugccc

SEQ ID NO: 4183308 - RNA, 69 nt, Human
gggcuggcgccugcugcacccacggggggcucucugcucugcgugaugagggugcagcagcgucccucc

SEQ ID NO: 4183309 - RNA, 58 nt, Human
gggcuggcgggaaaggcaauuccagggccacuuccccuuuuccugcgccggccagccc

SEQ ID NO: 4183310 - RNA, 55 nt, Human
gggcuggcuguagccaaacaacuggaucccagccaguugcauaggccagccaucc

SEQ ID NO: 4183311 - RNA, 72 nt, Human
gggcugggaguggugaagccucugccugcacagccagcugggucacgcugcuugcuucccaccagccagccc

SEQ ID NO: 4183312 - RNA, 62 nt, Human
gggcugggauggcuugaagauuagagcugccaaucugaguaucuucaugugguucugugugu

SEQ ID NO: 4183313 - RNA, 64 nt, Human
gggcugggcagggaaaggaagggcccaggcuuccuggcuuuagcugccuucccuaccccagccc

SEQ ID NO: 4183314 - RNA, 59 nt, Human
gggcugggcucacuccucacacucacucccuggagugugccugagucucggcccacccc

SEQ ID NO: 4183315 - RNA, 62 nt, Human
gggcugggggagauggccaggcucacucugccuggcuuuauuaacucauccguaauuagccc

SEQ ID NO: 4183316 - RNA, 69 nt, Human
gggcuggucagcugcgagaugcuuggagguguugaaacaaccaggccagcgcuggcuggaggccagucc

SEQ ID NO: 4183317 - RNA, 65 nt, Human
gggcugguguggcugccagccaagaggcuuggggcaggccuggggcaugcagcugauaccugccc

SEQ ID NO: 4183318 - RNA, 76 nt, Human
gggcuguagucucagauuucugaaagcccucucuacacaauuuugugagaaacacagaggucuggaguugcuaucc

SEQ ID NO: 4183319 - RNA, 73 nt, Human
gggcugucuccauagcuguguguccugcaggaccuggccagccuggcaugcuugcuguuugggaauccagccc

SEQ ID NO: 4183320 - RNA, 74 nt, Human
gggcugugaggcuggguaccugucauaugcuuaaaucggguauacgguggacccuggcuguccuucacaugucc

SEQ ID NO: 4183321 - RNA, 76 nt, Human
gggcugugaguauagaaugcuucuuugccuugcauuugaaaggcugauuugguuauucuaccacuauguacaggcc

SEQ ID NO: 4183322 - RNA, 122 nt, Human
gggcuuagcuaaaagguuaaggaaauacuccuuugaugaaguuuagcuuugaaaggaauguguauauucuuucaucuaacacuacauaggguauguuucuaaguacaaacgucucugggcuu

SEQ ID NO: 4183323 - RNA, 71 nt, Human
gggcuuauauagcuauuccagccaagugugggagagauguuucugccuggaaugagcuggcuaauaaccuc

SEQ ID NO: 4183324 - RNA, 79 nt, Human
gggcuuaugaucuggagguuuuccucaugacugcaggcaggaucucuuuuucaugcaggaccaccccagcaucaagcuc

SEQ ID NO: 4183325 - RNA, 96 nt, Human
gggcuuauuaaaacacagauggcugggccccaccccaggcugucugauucacuagagcuggggcguagcucaggcauuugcauuucuaacaaguuc

SEQ ID NO: 4183326 - RNA, 87 nt, Human
gggaaaggugacaucucugaggagcguuggucacgugugucaaggccuggugacgcgugucuuaugugccucccugggcaucuucuc

SEQ ID NO: 4183327 - RNA, 63 nt, Human
gggaaagucaagacaaggccaaaguuucuaaauugggaaggguucugccagugucuugagcuc

SEQ ID NO: 4183328 - RNA, 80 nt, Human
gggaaagugacagaggcaagaccagaagcccaagcucuugcacuuggcagccuggcaucuugaccugccuggacuccccc

SEQ ID NO: 4183329 - RNA, 62 nt, Human
gggaaaguucugagacugauggcuacuuucugaggugguccccuacaguuucaaagcuuccc

SEQ ID NO: 4183330 - RNA, 59 nt, Human
gggaaauagaucagaacugcugccaguguaggcuuguagauuccaguggucuguguccu

SEQ ID NO: 4183331 - RNA, 75 nt, Human
gggaaauaguacuguuuaaauugucaugccagcaauaggacaacugaaaaugacacccccacagcauuguuuucu

SEQ ID NO: 4183332 - RNA, 60 nt, Human
gggaaaugauguauguauaaggcaggguuucuuaacucuaaguaaaauuugucauuuccu

SEQ ID NO: 4183333 - RNA, 60 nt, Human
gggaaaugugggagagccaguggacauucagugaguaguaaacagcucugccacaauccc

SEQ ID NO: 4183334 - RNA, 67 nt, Human
gggaacaauuuuuaauaaacaugaaguuuucugagcuuuucagaagaaagauguuauuacuguuccu

SEQ ID NO: 4183335 - RNA, 75 nt, Human
gggaacacacugaguguugauuuauccugcucuuugaccuacuuagucauuuuaguguauaucaacauuuguccc

SEQ ID NO: 4183336 - RNA, 78 nt, Human
gggaacacaggcaguguguagcuggaagagaagcgagaagcguacuuugcagguggaacacaugugacuuagugaccu

SEQ ID NO: 4183337 - RNA, 64 nt, Human
gggaacacaugguaacaaaguagcugagugagugauucagcagccaagguaaccugugcuuccc

SEQ ID NO: 4183338 - RNA, 94 nt, Human
gggaacacuuugaaggccccuggguuguuuaaaagacuuugaggucaucuuggcugagguuccagacagcuuagggaaggcaaacucuguuccu

SEQ ID NO: 4183339 - RNA, 91 nt, Human
gggaacagaaaguguugcaaaaugccguuuuucucagugacaaggauuccacagaaggaaguuggcauuuuguuucagcuaucaugauccu

SEQ ID NO: 4183340 - RNA, 56 nt, Human
gggaacagcugggauuuaguuugccacaugcagacaccaagucuggcagcuuuccc

SEQ ID NO: 4183341 - RNA, 76 nt, Human
gggaacagggccacaggggcgggguaauggguauucuuuucugaguuaggccccagcccuguggaccaugguuccc

SEQ ID NO: 4183342 - RNA, 68 nt, Human
gggaaccagggugugaggaggacggggugccggucuggcacagauguaaucuauucacauuauuuccu

SEQ ID NO: 4183343 - RNA, 65 nt, Human
gggaaccgacuaggauaagccaggcucaccccagaggccucugcugcaagccugguuggcagccc

SEQ ID NO: 4183344 - RNA, 77 nt, Human
gggaacguguggagcuguggaguaggggguuggagaaccaggcaagucucuucccuucucuacaccucaguguuccc

SEQ ID NO: 4183345 - RNA, 77 nt, Human
gggaacucagccacaguggcuguggguguaaugcccugaggagguuuacaccauuagaagcuacuuguugaauucuu

SEQ ID NO: 4183346 - RNA, 61 nt, Human
gggaacugaagagagaagccagaguauauucuaauuguaguaaaugguucuuuucauuccc

SEQ ID NO: 4183347 - RNA, 86 nt, Human
gggaacuggagagguuaaagucaucagaaccuuccagaacacuagcgcaucugggacuguaucacuuuaucuucuuuuuaguuuuc

SEQ ID NO: 4183348 - RNA, 69 nt, Human
gggaacuggaguaaaugucacuguugcugugcuuuagcaaagagacugguggcauuuugccccuguccu

SEQ ID NO: 4183349 - RNA, 75 nt, Human
gggcugggucgucucccucgggcugcgugugugugucgggaauccugcgugucgugucugugggcgauccggccu

SEQ ID NO: 4183350 - RNA, 60 nt, Human
gggcugguagggacaagaggggagggaagugaauugcucaaggcuggucccaccaagccc

SEQ ID NO: 4183351 - RNA, 56 nt, Human
gggcuggugggcggggcugaaggagcgcgccccgccuccucuccgcccaccagccc

SEQ ID NO: 4183352 - RNA, 60 nt, Human
gggcugguuccugcugggacggcugguuucugauccauucagcaccagugggggcagccc

SEQ ID NO: 4183353 - RNA, 59 nt, Human
gggcuguauguguugccucuggccaauguauuuagagcaaaggugacaugugacagccu

SEQ ID NO: 4183354 - RNA, 67 nt, Human
gggcugucuccagggcaggugcaggugcugcugagggcuggcuuccugucauggccuggggcggccu

SEQ ID NO: 4183355 - RNA, 102 nt, Human
gggcugugggaacucagaggaaggagagaucccuucugccuggggaaaucgagaggaauucccagaggaggugguuagaacuuugcguucaagcaugggccc

SEQ ID NO: 4183356 - RNA, 56 nt, Human
gggcugugggcagcacgccggccucagcacagagguuuccuguuucucagcagccc

SEQ ID NO: 4183357 - RNA, 66 nt, Human
gggcuguguaucaguuaucuauuguuguauaacaaacacucaacaauguauggcuuaacacaaccu

SEQ ID NO: 4183358 - RNA, 66 nt, Human
gggcuguguccuccugggucauugccagcaaaucaauauuugacugugccacccaggguggugcuc

SEQ ID NO: 4183359 - RNA, 76 nt, Human
gggcuuaguuaaagcugcugaauccuauuucuaaaaugcuucuggaaaaggugguaagucagcaguguuaaugccc

SEQ ID NO: 4183360 - RNA, 64 nt, Human
gggcuucacucugagacuuggagccuagugugcuaagcucccaguucccaaagugaccauuccc

SEQ ID NO: 4183361 - RNA, 94 nt, Human
gggcuuccacagcguugugguuuccacuuggaagggcugcagugggaacugaggggccugcuccgggggcugagcugcaucugugggaaagccc

SEQ ID NO: 4183362 - RNA, 59 nt, Human
gggcuucccauaaggacuuaaguugcccacugugguaacuuucuucauaugugaaccuc

SEQ ID NO: 4183363 - RNA, 58 nt, Human
gggcuucucugcucuccuucccaagucugcgcugcaagggcuggaggaugggaagccc

SEQ ID NO: 4183364 - RNA, 63 nt, Human
gggcuucucuuaugcuaacugguuccuucuuccuugugcaugagccacugccuugaggggccu

SEQ ID NO: 4183365 - RNA, 79 nt, Human
gggcuuggccuugauucucaaacaacuguccaggaaaaucagcacacagauugaucuugagaauuaugucuaaaagcuc

SEQ ID NO: 4183366 - RNA, 55 nt, Human
gggcuuggguauugugagaggucagacagguuugucuccugucacguccaggccu

SEQ ID NO: 4183367 - RNA, 68 nt, Human
gggcuuguccuugggcugugcaugcagcgcauauaaaggcugcuuauguaucucauccaaggaagcuc

SEQ ID NO: 4183368 - RNA, 98 nt, Human
gggcuuguuagaacacaaauugcugggcaccaccuccagaguuccugauucaguaggucuggagaggggccuagaauuugcauuucuaacacauuccc

SEQ ID NO: 4183369 - RNA, 58 nt, Human
gggcuuuaaagcuuuacaugcagugagcaaggaagcuucuggaaagcauuugaggccc

SEQ ID NO: 4183370 - RNA, 61 nt, Human
gggcuuuaacacccagucaggggcagaugugaaaaucacagccucuuggguggcagaggcc

SEQ ID NO: 4183371 - RNA, 65 nt, Human
gggcuuuaccaucugccacagauauggcaguagcuauaaaugaauugggaagguauuucaggccc

SEQ ID NO: 4183372 - RNA, 74 nt, Human
gggcuuugcaaccuguggccaugccuccccacagucuccuugcgcucagggaggcagagccaaggucaaaaccc

SEQ ID NO: 4183373 - RNA, 57 nt, Human
gggcuuuuccauuccaggguucucaucccuuugagcauucaaagaagaggaaggccc

SEQ ID NO: 4183374 - RNA, 68 nt, Human
gggcuuuuguuucugugaguucagacuugaucuuauuuacaguuagcagcuuauuagaaacaucaucc

SEQ ID NO: 4183375 - RNA, 62 nt, Human
ggggaaaaauaugauauaaaguggauuugccacacauccaguuuaugucauauucuuucacc

SEQ ID NO: 4183376 - RNA, 76 nt, Human
ggggaaaauugagcgagggcuggaggggagacagagggaagcggcucugggucuaucccaugccuuugcagucccc

SEQ ID NO: 4183377 - RNA, 69 nt, Human
ggggaaacauucauuuggccucugcuuaaaauucugggaaggguggcauaauauccaugugauuucccu

SEQ ID NO: 4183378 - RNA, 84 nt, Human
ggggaaacugagguacacagaggaacacugacuugcucaaggguguggcugugacaagucacuguucuucaaugaccucucccc

SEQ ID NO: 4183379 - RNA, 97 nt, Human
ggggaaagaagaauuaacuucacaauggaaaauuuuaacauggucugccucgucuagcuagugcaugucaagcuuaucucuguggucuuccuucccc

SEQ ID NO: 4183380 - RNA, 82 nt, Human
ggggaaagauuuagucacucaauauuuaggugccaggcacccacugaacacuaaaguauggaagugaauaagccuggucccc

SEQ ID NO: 4183381 - RNA, 75 nt, Human
ggggaaagguggcuucucccgacacccuggcgggcaguauccaggccugagaucaggagaaagccagcucuccuc

SEQ ID NO: 4183382 - RNA, 76 nt, Human
ggggaaauuacagauucaagcucuuugaagauauuuauuccuucaaaguucuuaauuuguguuuauucauuucccc

SEQ ID NO: 4183383 - RNA, 89 nt, Human
ggggaacagagagcaggagggacaggcgccagggcagagagcaaacucccuaggaccccaccuuccgcagagcuccgccucgguucccc

SEQ ID NO: 4183384 - RNA, 64 nt, Human
ggggaacaucacugaugcccucacugagcucugugggaaaacugggcuccagagauguagcuuc

SEQ ID NO: 4183385 - RNA, 92 nt, Human
ggggaacuggagagcuggggacccggacuccuggguccuggggaaagcagguccaaggauggggucucccagauauuuucucccgugaaucc

SEQ ID NO: 4183386 - RNA, 63 nt, Human
ggggaacugggccucuggaagccuaaugaagguucucuagcuacagaugagcccaguaucccu

SEQ ID NO: 4183387 - RNA, 60 nt, Human
ggggaagcgaagcucuggaaggggcccaggucccgauuggggauccagagaggcuucccu

SEQ ID NO: 4183388 - RNA, 56 nt, Human
ggggaaggcaggcuugacucagguggccaaacagcugucucaagaaaggccucucc

SEQ ID NO: 4183389 - RNA, 81 nt, Human
ggggaagggcagcagagccaggcuggggcaggucagggcuccgccgccaugccugucgagcuuggcagcaauuccuuccuu

SEQ ID NO: 4183390 - RNA, 78 nt, Human
ggggaaguaauuaucuuagaggugauuguauucugccucccucagaauaauuccucccuuucuaggaaaauauuccuc

SEQ ID NO: 4183391 - RNA, 94 nt, Human
ggggaaguguaggcaggccaggccuuucuccauuccugcaggcaaggcacaagcccaggaacggggcgcaaaggccgccuggcucauuucugcc

SEQ ID NO: 4183392 - RNA, 73 nt, Human
ggggaaguuauuugaaggcuaaaggggcagagguuaacuagaauuaacgugucuacuuuuuagucucuucucc

SEQ ID NO: 4183393 - RNA, 89 nt, Human
ggggaaguucagugugcuaaggcagucuaucacaggggauauaaucuagucuagcagucccugaggcagugauguuuaagcaccucccu

SEQ ID NO: 4183394 - RNA, 77 nt, Human
ggggaaugggcaguguggacuagaguaggaguugcauuguugcuauuuuguuuucaguccauuuggccuaagacccc

SEQ ID NO: 4183395 - RNA, 58 nt, Human
ggggaauuggaagcagaauuugauucagucuaaggaaauuauugcucuucaauugccu

SEQ ID NO: 4183396 - RNA, 109 nt, Human
ggggacaagccuccugggcaagcggcugccuccagcucuuguuccaggugaagucccuccugggacagugaccccagaggucaucgcugcucucaggccacccuucccc

SEQ ID NO: 4183397 - RNA, 81 nt, Human
ggggacaggacaguuugcuuugcccugacugguucucuuucuaguuagcaaaaccuaacuuuuuguuuauaaugauacccc

SEQ ID NO: 4183398 - RNA, 93 nt, Human
ggggacaggauucuugaagauguuucuaaacugcagaagauuaaaaauguagcuagcggcacuuugauaguuuaaucuaggaucauuguccuu

SEQ ID NO: 4183399 - RNA, 126 nt, Human
ggggacaggcuucgaaauuccuaaaugacauuagagugacagggcagggccacagugaggcuaagcuuggcacagauugggucugccucugggcucugccccuggcuugcuguguggcuuguuucc

SEQ ID NO: 4183400 - RNA, 75 nt, Human
ggggacaggugugggcagaugcccuacuuaauaaggguuuuuaaggagugggugaaugugcucauaacagucgcc

SEQ ID NO: 4183401 - RNA, 76 nt, Human
ggggacagugcccaccucucuucagcuagggccgagggugaggaccuggcugcagaucugugggacacguggcccu

SEQ ID NO: 4183402 - RNA, 69 nt, Human
ggggacaucacaggggccacaggccuggguguggucuuggcucugugagccacuugauguacaguuucu

SEQ ID NO: 4183403 - RNA, 82 nt, Human
ggggaccaccagggcuggugcaggaaggagcuggcagcagcacggcugucaccacccauguaccacgucuuccaaugucccc

SEQ ID NO: 4183404 - RNA, 124 nt, Human
ggggacccugggggcucaggauccagcaaggggcagcaggaguaaaggaggaaggaaugacaggugcaaauaccuucccacuaaagcccuuguugcccucuggcuccuccccagaguugucccc

SEQ ID NO: 4183405 - RNA, 67 nt, Human
ggggaccgggcaugagagcuggcccgugaggcugggccaggaaaagaagcuggugcucagguacccu

SEQ ID NO: 4183406 - RNA, 56 nt, Human
ggggaccuaggcucugucucuucugguuaagucaguggaggggggcauaguucucc

SEQ ID NO: 4183407 - RNA, 68 nt, Human
ggggacggaccgugugcagagacccacauuuggaaccaaaggauagcucuguccacagguuugucccu

SEQ ID NO: 4183408 - RNA, 76 nt, Human
ggggacugugggagcgcaguggcagcuggugacugcccggauccgcugguucuuguugcuuccuccccaugucccc

SEQ ID NO: 4183409 - RNA, 56 nt, Human
ggggacuugcuauguuguccaggcuggucuugaacuccuggcuucaagcaguccuc

SEQ ID NO: 4183410 - RNA, 57 nt, Human
ggggacuuggaggcuuuaucuggagcugcagcuaccaggagcccccuucuggucuuc

SEQ ID NO: 4183411 - RNA, 76 nt, Human
ggggagaaauagucagucugauuaagggcaaucuuuaccaaucuuuaauccaauauccuggcuauuuacucuuccc

SEQ ID NO: 4183412 - RNA, 110 nt, Human
ggggagaauguggaugugucugaggucacauggcuggccagugggaguggagcagaugaagaugacuauucccaucuggccgcuggcuccuacagaagccaaggcuccuu

SEQ ID NO: 4183413 - RNA, 82 nt, Human
ggggagagagagugugugcagcggcaggugaaguuuugaugucugaguacucugcuuauugcugcaggcagucaaucuucuc

SEQ ID NO: 4183414 - RNA, 73 nt, Human
ggggagaggggagguccaggcauuuggguugggcaggcagcccacgcagcugucuggaguuagcggucuccuc

SEQ ID NO: 4183415 - RNA, 108 nt, Human
ggggagaugauagagcugacagcccccagcccauccugccucagaggugggagcuacuuccccagccuccugcugaauggccaggagcugugggggucagcucucccc

SEQ ID NO: 4183416 - RNA, 55 nt, Human
ggggagauuccaguaaagcugggaacuugaaccccaaguucugcugaaucuucuu

SEQ ID NO: 4183417 - RNA, 65 nt, Human
ggccuggaaugcuuuccuaccacuuuccccacccugugggcuuuagggucagagagauccaggcu

SEQ ID NO: 4183418 - RNA, 55 nt, Human
ggccuggagaaggcccagggagcuuaggacacgucucccucgcuaucuucaggcu

SEQ ID NO: 4183419 - RNA, 82 nt, Human
ggccuggaguaugcuacugcuugggaagcacugugggcagcggcugcaggugacaagaucacagucaaguguauuuggggcu

SEQ ID NO: 4183420 - RNA, 93 nt, Human
ggccuggccgccaccccaauuuaccuugaagagcuugagggccuccgucugcaaggccucagagggcaggguggugagggaggcguauaggcc

SEQ ID NO: 4183421 - RNA, 66 nt, Human
ggccuggccucccuuccuagcguacagaccgaaaccccaaaccgaaauuaagcggagggccgggcc

SEQ ID NO: 4183422 - RNA, 71 nt, Human
ggccuggcucuugcccagccuguaucaacaaaaagaagaaguggggcugaggagacaggggcucccaggcu

SEQ ID NO: 4183423 - RNA, 83 nt, Human
ggccuggcugauggagcuggaaagugcuuuucugagagggaguggugccuucuacuuuccauuccaucuuacaaagccaggcc

SEQ ID NO: 4183424 - RNA, 62 nt, Human
gggggaaauucacaguuuuagcuguccagggauuagcuucagaggaaaggcugauuuucccu

SEQ ID NO: 4183425 - RNA, 69 nt, Human
gggggaagaaagggaggauaagaaugggucuucugauuugucauuuggagccuuccuguuuuauagccc

SEQ ID NO: 4183426 - RNA, 95 nt, Human
gggggaagggggacauuguuuugaacuuaaggcuauaacucaauggaguuaggaauguuuuuaucaacuuacaucuugucuccugcguuuccucc

SEQ ID NO: 4183427 - RNA, 67 nt, Human
gggggaagugucacagacccaaucaggagguuaaggagggcuuccuugaggaggugacacuggagcu

SEQ ID NO: 4183428 - RNA, 82 nt, Human
gggggaaugcgcguugugcgugugugcaaguguauguccaugugugcaugugugugugcgcgcgcaggaagugcgugaaauc

SEQ ID NO: 4183429 - RNA, 86 nt, Human
gggggagaucucuagggcgcacgccgugccccacuucccccuuacgggaaaggcuuuccagcgcgcggacccaggagacucucacc

SEQ ID NO: 4183430 - RNA, 124 nt, Human
gggggagccgggagcggacgcgugggugaguggggaggggagugaguagguaucuucucuucucucggugcaucccucaccuuuucgcuuuuugccuccuggagacaacugaaauuccuucccu

SEQ ID NO: 4183431 - RNA, 100 nt, Human
gggggaggaggaggacgaggaggaggaggaggaggaggagaaggagaaauggacucucacucuucacgccaagugccccucauuguguucaucauccccc

SEQ ID NO: 4183432 - RNA, 61 nt, Human
gggggagggaggcuguuugcuuuaggauaagccuggcuccucuggcccagcugccucugcc

SEQ ID NO: 4183433 - RNA, 81 nt, Human
gggggagggaguugcauguaagugugcaugugcaugaguguguguguguguuuguacaugaaugugcacccaacaucuccu

SEQ ID NO: 4183434 - RNA, 75 nt, Human
gggggcaaaauacgugaauuucuuccuucuccuagaagaaauccuggguuucuuccuagaaggaagaaaucuccc

SEQ ID NO: 4183435 - RNA, 64 nt, Human
gggggcagcggaggacagaugggagcuccuguuaggagccacguuuccucggcugggaaccccu

SEQ ID NO: 4183436 - RNA, 76 nt, Human
gggggcaggaggagagguccagggccccggccagccugugggaggcgggaggcugaggaguuggucgccagccccc

SEQ ID NO: 4183437 - RNA, 60 nt, Human
gggggcaggugcccagggccagaggcuucugcuucaggcuguagugggcacuuggcugcc

SEQ ID NO: 4183438 - RNA, 79 nt, Human
gggggcagucccauugcucugcaauccuccccaaaguguuuccucuuggguggcuauuucagagccugggugugccccc

SEQ ID NO: 4183439 - RNA, 60 nt, Human
gggggccaaggagcagcuucugggcagugugcuggcuccagaugaaugcacuuguucccc

SEQ ID NO: 4183440 - RNA, 57 nt, Human
gggggccagucaucucccaagaacauuagcuguccucuugcaauugauuggcacccc

SEQ ID NO: 4183441 - RNA, 91 nt, Human
gggggccccauauuuacauuucauacuaaggcucaaaaaucauguagcugguuuugcucuugguaaugaaagacuccuugaggugguuccc

SEQ ID NO: 4183442 - RNA, 66 nt, Human
gggggcgguccggagauagugccucucagccaggguugcugggggugacuaucucgggaauccccu

SEQ ID NO: 4183443 - RNA, 78 nt, Human
gggggcgugaggguguugguugguugggauauuaccuaaaggaagcccaguccuaaagcagacgccagugcugccucc

SEQ ID NO: 4183444 - RNA, 119 nt, Human
gggggcuccagugugcuccaccccuuccuuucugucagccugagugcucccgcccccuuugggccucagucucccacagagagggagagcuggguggcccagcaaucucuggagccccu

SEQ ID NO: 4183445 - RNA, 93 nt, Human
gggggcugcaccugguucuauucugauaaaugcauggaaagaacaaggucuuucucugcccaaguuucucaagugugagccaagccaacaccc

SEQ ID NO: 4183446 - RNA, 62 nt, Human
gggggcugccuguugcccaccugauaaagcccaacccccagggcuccaugcacauagccccc

SEQ ID NO: 4183447 - RNA, 76 nt, Human
gggggcuguccugugcauuguaggauuuuuaauagcauccauggccuuuacccacuauaugccaguagcagccccc

SEQ ID NO: 4183448 - RNA, 75 nt, Human
gggggcugugccaggcgccguggccuccaggccagacuggacccuacccggcccucggccucgccagcagucccc

SEQ ID NO: 4183449 - RNA, 56 nt, Human
gggggcuuaccccaggggugaggauguugagcuuucccucccuggggcugccaccc

SEQ ID NO: 4183450 - RNA, 84 nt, Human
gggggcuuucuaaguauauggguaugugagugcuaugauagacaggcugaaaggaacuggcaccaccacccagcccugaccccc

SEQ ID NO: 4183451 - RNA, 78 nt, Human
ggggggauaagugcagggagaauaaaagagucagaaguuccugucuuuucauacuuucccuccccgcucuguucuucc

SEQ ID NO: 4183452 - RNA, 79 nt, Human
ggggggauaccuuagagugaucugcauguaaaccuucacacuguauuuauaugacaguaucauuuuaaaauguugaccc

SEQ ID NO: 4183453 - RNA, 98 nt, Human
ggggggauuuggaacagagauuaucugcaggcuuauacuguaacucuggguagauucuuagugucuguuacgcuugcagaagaguuuuaaguugcccu

SEQ ID NO: 4183454 - RNA, 72 nt, Human
ggggggcacacagagaggcuugucuccaaggcugaaauagcacuuggaggacaugggcuuuuagaacuuucc

SEQ ID NO: 4183455 - RNA, 91 nt, Human
ggggggcauagugacuugugagggaguagaaaauggcuauaaguuccuugaaacuuguugcugcucaaccucuauaaaguucuagccuuuu

SEQ ID NO: 4183456 - RNA, 55 nt, Human
ggggggcccgcuguggggugugcacggccacgcccaccuccuggcgggcauccuc

SEQ ID NO: 4183457 - RNA, 101 nt, Human
ggggggcuacugcaguuugaugcaaucagaaaggcuaaggaagcaucaccucugugcccugcagccugcuuuugcugaacccucaaccugcagagauaccc

SEQ ID NO: 4183458 - RNA, 64 nt, Human
ggggggcuuuacagggcgucaguuaaaacucauugcacacuggaagggcuuuggaaagccuucc

SEQ ID NO: 4183459 - RNA, 66 nt, Human
gggggggccuugauggaguucccagugccaaaggauagagagcugaauggacccagggccucaccc

SEQ ID NO: 4183460 - RNA, 88 nt, Human
gggggggggacauuuaacagaauuugcuugggcaauggguguuuauaguuuuaaaaagccacccaagagauuuggaugugccucuucc

SEQ ID NO: 4183461 - RNA, 55 nt, Human
gggggggugauaaugcuaaauuaacaacaaauaguccagcacagaugaccucccc

SEQ ID NO: 4183462 - RNA, 82 nt, Human
gggggguacaggaggaggagaucccugagaugggucuggacagauugcccagguaaggaugcuccucaucccagcuccuccc

SEQ ID NO: 4183463 - RNA, 58 nt, Human
ggggggugcugaucaguggagcuuagaauuacuuuacacacacaugccuacacccccc

SEQ ID NO: 4183464 - RNA, 86 nt, Human
ggggguaccuauuacaugccugagucugugguguaccugagauaguacaauuagcagcagccacuauucuggcauuagguggccuc

SEQ ID NO: 4183465 - RNA, 64 nt, Human
gggggucagaaucauuugggggacuuugacaugguacauuuguccccaggaaauucugauucuu

SEQ ID NO: 4183466 - RNA, 61 nt, Human
gggggucaucgagggggucaccuuggcucgcccaggccgagggggcuccuccggugcuucc

SEQ ID NO: 4183467 - RNA, 77 nt, Human
gggggucccaugggccacagcaauacaaugucacagaagaggcaaacuucugcugaacuugcugcccagagaccuuc

SEQ ID NO: 4183468 - RNA, 63 nt, Human
gggggucguggcucauaugguaaucuugguggacuuauuauuacuacacaaguaacgauuccc

SEQ ID NO: 4183469 - RNA, 58 nt, Human
gggggucucacucuguugcccaggcuggucuugaacuccugggcuuaagugauccucc

SEQ ID NO: 4183470 - RNA, 92 nt, Human
gggggucuccucagggcugcuggccgugcccucuagaccuugguuguuuccucacuaaaaugagggcacuggccuugagaucagaggccucc

SEQ ID NO: 4183471 - RNA, 86 nt, Human
gggggucucucccggagucggccagcccgaggcaggaagcccugcgguuucuggcuucucccaggcggccuccggaucuggccccc

SEQ ID NO: 4183472 - RNA, 77 nt, Human
gggggucuguugaaguguuuauuuuggccuucccaugggugaaggcccagcuugaaugcugcccaugagagaccccu

SEQ ID NO: 4183473 - RNA, 84 nt, Human
gggggugaagugugugaaggagccacuguucauaagcaccugccuuuauggacgcggcacuuucaucagcauuacaccaauccc

SEQ ID NO: 4183474 - RNA, 110 nt, Human
gggggugagagaggccugagugugcggucccugccugaggcuggccuggcuuguauccaggacuugccuggggagggauuuugggagccacucucagccuccccaccccu

SEQ ID NO: 4183475 - RNA, 129 nt, Human
ggcggggaggcccgggcagggcggcugcggcgcagcucuggcagagcccaacccuggccccgcccaggucgcaggccucgcccaggucccgcugggccgcagcccggccugcacucagccgccaaaguc

SEQ ID NO: 4183476 - RNA, 98 nt, Human
ggcgggucuugcugccucgugagcucugagcagcuggaggucgugacacugaaaugaacacaccugucuccaagcagggcugcaaggcagcuccugcc

SEQ ID NO: 4183477 - RNA, 91 nt, Human
ggcgguauuagauuuucauugauaaauugcaauggggcugucucgucuccacaguacccuuuucacugucacaagaaaacaaagugccacc

SEQ ID NO: 4183478 - RNA, 89 nt, Human
ggcgguggcagcgguggcggcgguggcugcggccucguguugucuacccauccggccuuugcguccacgccgcuuccggggccgccgcc

SEQ ID NO: 4183479 - RNA, 56 nt, Human
ggcggugggugcuuaagggagcaaaauaauguauuuccuuguucuacaucccugcc

SEQ ID NO: 4183480 - RNA, 67 nt, Human
ggcggugucuggagaucagggggcccgggcagcgcaagucugucugcccugcugaucucaccccucc

SEQ ID NO: 4183481 - RNA, 98 nt, Human
ggcguaacgugggagaggaaagaagugucucaucaggcaauaucugauaacagacugauaauuugccucagcauuucagccucuacucaccacaagcc

SEQ ID NO: 4183482 - RNA, 106 nt, Human
ggcguacucgcccaucugguuccccaggcggcccuuggaguugauagugaacagguccucccggggcaggugucugggggccaggaccacacgggcugaguaugcc

SEQ ID NO: 4183483 - RNA, 64 nt, Human
ggcgucccuggugguacggcacuggcagguguaggagcccuccagguugaugcaccaggcagcc

SEQ ID NO: 4183484 - RNA, 69 nt, Human
ggcgucucaaggcccccaggccaagcaccagauccccgcccauggcccccggggucuuggggcucagcc

SEQ ID NO: 4183485 - RNA, 111 nt, Human
ggcguugacagagggggaaaggggaauagaguggguuguggaaaaugucaauuaucaaacauaugcaaggcuuuuucucuguuucuguguuuucuccuuucucacccagcc

SEQ ID NO: 4183486 - RNA, 67 nt, Human
ggcguugcucucccaccccggccgugacgcaaucucuccgcgccgggggcgggacgagcuugacgcc

SEQ ID NO: 4183487 - RNA, 69 nt, Human
ggcguuggguuugguguuguaacaacuggugacauuucaguucaugugacuacuaugaccuaaucacuc

SEQ ID NO: 4183488 - RNA, 60 nt, Human
ggcguugugagcuugguagacacuuguggcuggcaaguggaagagccauguuccaacccc

SEQ ID NO: 4183489 - RNA, 57 nt, Human
ggcguuugggcuguaucuccccaggcuaccaucuugggggggccagcagcagacgcc

SEQ ID NO: 4183490 - RNA, 100 nt, Human
ggcuaaaaucaaggcaacagcagagcuuucuggaagucuaggugagaaucuguuuccuuaccuuuuccagcuucuagaggcauccccuugguucauggcc

SEQ ID NO: 4183491 - RNA, 91 nt, Human
ggcuaaaauuaugaggugcuaugugaaauuccacacaaaugaacuuggaaauagauauuguuuuacuugguguucugcccaggauuuugcc

SEQ ID NO: 4183492 - RNA, 86 nt, Human
ggcuaacacuaucugccuuacagggaugccaugagaauuaaauggaauaaugccucugaggaagauuguguuuucuaaaaauggcc

SEQ ID NO: 4183493 - RNA, 55 nt, Human
ggcuaaggaacgcaggcuucucuuacccagguucccugaacugcuuuuuuuagcc

SEQ ID NO: 4183494 - RNA, 59 nt, Human
ggcuaagggacccuuucuaaugugcuggguauuaagcagcauagauucuuuccuuugcc

SEQ ID NO: 4183495 - RNA, 100 nt, Human
ggcuaauuggcugcuuccacaugggauucugaaacuggagcaagugaggcaaagcccagggugcuuagaacccauucucagugagagcagcaggacugcc

SEQ ID NO: 4183496 - RNA, 60 nt, Human
gugguuuccugaacaccgauggugugcaaggcuguguaugagguauuacaggaaauauac

SEQ ID NO: 4183497 - RNA, 57 nt, Human
gugguuugcugguguacguuuauuauaugcagugaaaguacuuaaucugcaaaccac

SEQ ID NO: 4183498 - RNA, 89 nt, Human
gugguuuucaauuauuugauaugaaaggggcagcgugguuguuuaaacuugauccagccucuuugcaucuuaaacaguugaauagcuac

SEQ ID NO: 4183499 - RNA, 55 nt, Human
gugguuuuuggguuugcaccuacagggagaguuccagugcauuccaaagcaccau

SEQ ID NO: 4183500 - RNA, 58 nt, Human
guguaaagaugccaggaaucuugcaguaaagaucuuugaguccugguauugcaagcac

SEQ ID NO: 4183501 - RNA, 82 nt, Human
guguaacauacauagugaacauuuacagagcacuuauaccacaugccaggcacuuugccaaaugcuuuacauguguuuacgc

SEQ ID NO: 4183502 - RNA, 67 nt, Human
guguaagcauugaaagagauaaagccuuuuuuuaaaagagguguuaaagucucuuuuaaucuuauau

SEQ ID NO: 4183503 - RNA, 69 nt, Human
guguaagccaggccuuagggagaggcaaacaccacuaacuuguuccugcccucccaaugcuucggucac

SEQ ID NO: 4183504 - RNA, 68 nt, Human
guguaagcuaggaacaugccuuauucccuuaagcccauauggaggggaugggcaagccuagugccuac

SEQ ID NO: 4183505 - RNA, 70 nt, Human
guguaagugcccugaugcaauugucucacaauacaaaaccauuauguuagacauaaauuaaggcauacac

SEQ ID NO: 4183506 - RNA, 116 nt, Human
guguacaggacaauaggaauguucauauucauuuuccuggaauuucuuuacagcuuuucucuuaggcauguaaucacucuaggaaggauaugagauuuuucaguuauucaauucac

SEQ ID NO: 4183507 - RNA, 69 nt, Human
guguacauuuguaagcuagagccaugauuuguaaaaccuacaaacuguaacgccagcuuuaaaugucac

SEQ ID NO: 4183508 - RNA, 64 nt, Human
guguacccaguaucaaguguguggggaguucacauaagauauauuauauacauacugugugcau

SEQ ID NO: 4183509 - RNA, 83 nt, Human
guguaccgacagauuuugcauuucacuuucaguaggcauuuggaagcagaacggccucuuuggacugaaaaaaucuagguuac

SEQ ID NO: 4183510 - RNA, 66 nt, Human
guguaccuaccgaaaauuaugauuaggcaaaccuguuuaguuuaugauuuuuuggaaggaaaauac

SEQ ID NO: 4183511 - RNA, 96 nt, Human
guguaccugccacagugccgccauaucaucugccucuuagcucacuuuugaaggugaaugucaagggugaagggugguggccuagaaggugagcac

SEQ ID NO: 4183512 - RNA, 55 nt, Human
guguacuauagcauuuucuaggagcugaaaggcguuuagcaagaguauagugcau

SEQ ID NO: 4183513 - RNA, 101 nt, Human
guguacucuguucucugaguguauuggagcuguuggcuguaaagccugaguuugcauucuuuacaccaagcagaucuuucacuggagacaaaagaagacac

SEQ ID NO: 4183514 - RNA, 83 nt, Human
guguagaacaaaaaggcagaggaagggcagugaauuguugcucucuuuuugagcugggacauccaucuucugccugugaacau

SEQ ID NO: 4183515 - RNA, 75 nt, Human
guguagcuaaguaacaaccuggagagugggggaaagcuuuuauuuccaacauuuaucaagguuguugaccuacac

SEQ ID NO: 4183516 - RNA, 77 nt, Human
guguagcuugcucauuaaaaucugcuuccuuuuacagaaauguuuuuuauguaaaguagauggcagguaaaaaacac

SEQ ID NO: 4183517 - RNA, 55 nt, Human
guguagcuuuauauuguguugggagaaauggaaucccccgauauuacagcugcac

SEQ ID NO: 4183518 - RNA, 103 nt, Human
guguaggacagacucuuuccucaaucuguguggcguugcguggcuaggaguuagauuccuuugccaugacauggcacaagacuaggagcacgguuuucagcac

SEQ ID NO: 4183519 - RNA, 60 nt, Human
guguaggauuuguugaguuucuuagaucuguuuuuucaugaaauuuaggaaauuuuacgc

SEQ ID NO: 4183520 - RNA, 68 nt, Human
guguaggguggucaggaaaguguucucagaggacaugacauguccacuuaauuuccugacuuccccac

SEQ ID NO: 4183521 - RNA, 93 nt, Human
guguaguuuuaagccauuaaauuugugguaauucauuacaacaucaauaaaguaguaguacacuaccaucagguuuuacauauggcauuacac

SEQ ID NO: 4183522 - RNA, 60 nt, Human
guguauaagguggguucucuggcuguuuaaaaacaggcaggagaauucugccugauauau

SEQ ID NO: 4183523 - RNA, 130 nt, Human
guguauacaggugugcacacauacauguauacauguauguauauauguguacacacagugcacacaagcacacgugugugcauguaugugcagguauguaugcaugugcuugugugcacauguguggcac

SEQ ID NO: 4183524 - RNA, 94 nt, Human
guguauauuuucuggugagaaaguuguaucuaagaaaugaccuagagcuuaguugcuuauuuccaaacuggauauaccucagcagaugauacac

SEQ ID NO: 4183525 - RNA, 62 nt, Human
guguaucaguggcuugacagugaauuaugaguuuccugcucuuggcuggacaagucacucac

SEQ ID NO: 4183526 - RNA, 60 nt, Human
guguauccuggaacagauuuuaccuaugaccaauauacaguauuaccuguucaggagcac

SEQ ID NO: 4183527 - RNA, 66 nt, Human
guguauguagauuuuucuggggagagggucuaguuucuucaugacccauaaaaauuuaauaaauac

SEQ ID NO: 4183528 - RNA, 102 nt, Human
guguaugugcuaggggaaucuggcccagucucagagugucagggaagacuucccuggaaaccugucauuggauccaggugguaaguaagguuaaccauacac

SEQ ID NO: 4183529 - RNA, 70 nt, Human
guguaugugggcaaggggcgcauguguguacaguaucuucugaucuucugccuacccugcccgcagacac

SEQ ID NO: 4183530 - RNA, 59 nt, Human
guguauuagugagaaggaagaucugcaucacucacugcacauccagcucacagaugggc

SEQ ID NO: 4183531 - RNA, 77 nt, Human
guguauuguccuaggagacacaaucucauuuacauuuauuagaaguaaugauaucguguccugcagauaauuaacac

SEQ ID NO: 4183532 - RNA, 58 nt, Human
guguauuucauauauugcuguauguacauauuaaucagccagcaaauauuaagugcau

SEQ ID NO: 4183533 - RNA, 74 nt, Human
gugucacauagcacacgcauuagcaaaucauugauuuauucacugucuauggagugcuuguguguucuagacac

SEQ ID NO: 4183534 - RNA, 74 nt, Human
gucauuuuacacaccacaggaaauauuaggagggauuaaauaaagucccccucaaguacaaccuguaaagugac

SEQ ID NO: 4183535 - RNA, 68 nt, Human
guccaaaaguaucagccuggccgcucuguugacaauagucagcaagaggguaagguugaagcaaggac

SEQ ID NO: 4183536 - RNA, 79 nt, Human
guccaaccucacaggcccaaaccacgcuuacauaacccgcagugacacuaaguguuugugaggccugcugaaguggggc

SEQ ID NO: 4183537 - RNA, 72 nt, Human
guccaagggcaggagaagacggauaucccagcuccagcagagugagaaguugcucuuuuucugccuuuuugc

SEQ ID NO: 4183538 - RNA, 72 nt, Human
guccaagguuuauggagcaccacaucuacugauguacaaauuggagcaauguuggccuauauaccucuggau

SEQ ID NO: 4183539 - RNA, 62 nt, Human
guccaaugguaaauccaaauaaacugaacaugggaagugcauuuggauaagaucauuuggau

SEQ ID NO: 4183540 - RNA, 74 nt, Human
guccaaugguugaaaaacauuggcuuuugccaagagugucuuuaaaaagucaagccuuucuuuucccucuggac

SEQ ID NO: 4183541 - RNA, 93 nt, Human
guccaaugugguuuauuauuggaagaauugggugaaucuuguuaaaacacagcuuuaccugaaauuugaucccuaggugugaacccagaggac

SEQ ID NO: 4183542 - RNA, 78 nt, Human
guccacacaucagccagguggucugucacccaucguguguuuaaaaugauggccaagggccuggcguggagugugugc

SEQ ID NO: 4183543 - RNA, 71 nt, Human
guccacaguuuguguuggccaugggcaacuaucucaacgauggacagcccaaaaccaacaagacuacgggc

SEQ ID NO: 4183544 - RNA, 87 nt, Human
guccaccgugcuucuccggcaccgaugccgggagccugcagggggcgcccuugcccaggcuggccuccgcagugccggaggagggac

SEQ ID NO: 4183545 - RNA, 55 nt, Human
guccaccuucuuggucaggccccugaggcaugcauuucuaccaaggaauauggac

SEQ ID NO: 4183546 - RNA, 101 nt, Human
guccacgugcuggauccugccgugccuuucuugauguaccaacuugggagacucucuauugacuccuggccaugcaagaugaggagcuggccagcuuggac

SEQ ID NO: 4183547 - RNA, 92 nt, Human
guccacugucucgguggugguguuuuuugaaucauuaaucagaaugaauagucuaugguacagauaauacaugcugcugaguuucagaggac

SEQ ID NO: 4183548 - RNA, 68 nt, Human
guccagaagcugcaugccccacucaacugucaagaguuagagcaggcaacucugcagugccucuggac

SEQ ID NO: 4183549 - RNA, 70 nt, Human
guccagagagccacggacaggggcaggcuucccccaagcuuuucucuagaauucuggggcuguucugggc

SEQ ID NO: 4183550 - RNA, 56 nt, Human
guccagcaggcagcuucacugcccacaaaggcagcugaggccaauagccccuggac

SEQ ID NO: 4183551 - RNA, 86 nt, Human
guccaggagaguacaguugaaacaagucaacuguacuaacuguacucuaaacaaguugacuuguuucaacuguacucucacuggau

SEQ ID NO: 4183552 - RNA, 70 nt, Human
guccaggaucacgagguugcagcacuggaucaggagacugugggaggcugaguagcuuugugcucugggc

SEQ ID NO: 4183553 - RNA, 59 nt, Human
guccaggcugcccaggguccuggcuggaguaccugggugggucuguggggagccugaac

SEQ ID NO: 4183554 - RNA, 61 nt, Human
guccagggggcuuaagcaaacuccuuauaucuuguggaucuuacuaauguucccucuggau

SEQ ID NO: 4183555 - RNA, 68 nt, Human
guccagucuguuuggcaauacucuguagagcugugcauuuaauuagaguuugguaaacaauucuggau

SEQ ID NO: 4183556 - RNA, 72 nt, Human
guccaguucagcagggcuacccaggggcccuucuuccuccaucccaugguggccugcccugaucccuggcac

SEQ ID NO: 4183557 - RNA, 85 nt, Human
guccaguuuaaagcccugccacccauucacuguaaaucuagaaauacuggacuugaggagguagguaggaggcauuuuauuagac

SEQ ID NO: 4183558 - RNA, 72 nt, Human
guccauaaauaugcaguuuaguuuuauuugucaaauaaaauaaccugagauugagcugccuagcugaaagac

SEQ ID NO: 4183559 - RNA, 86 nt, Human
guccauaguucaauccuagugcuugguggagauggagaggcuuggguucucauuuuggcuccagcacagccuugucaacuuuggac

SEQ ID NO: 4183560 - RNA, 70 nt, Human
guccauccgugguagcauggaucaguacuuccuuccuauuuuuagcugaguaauguuacuuuguauggau

SEQ ID NO: 4183561 - RNA, 66 nt, Human
guccaucugccugucccucucuaucccugcaaguucggggaagaagggucauuggcagcccggggc

SEQ ID NO: 4183562 - RNA, 75 nt, Human
guccaucugucuguccgugcaggucuuauguggaagguaagggagugagaagugccgaaaggaagacagagggac

SEQ ID NO: 4183563 - RNA, 98 nt, Human
guccaugcaccaauugaaguaucugcagcaucucaacucuucagugguugaguuacagagacacuugcugugaggucgcuuccccuuggcuguaagac

SEQ ID NO: 4183564 - RNA, 110 nt, Human
guccaugccauggauguuauggucagcucuggauugaagucgagucacauuucaaaacagaugcaauuucaagaggccagagcgaggccgccgcaucugcuggcugugau

SEQ ID NO: 4183565 - RNA, 76 nt, Human
guccauguucccugcaaccuuucccugggcucuugaggguuuaucaggguugaggguugccuuaguaggcuuggac

SEQ ID NO: 4183566 - RNA, 98 nt, Human
guccauucaccuguugauggacauuuagguagcuuccaguuuuuggccauuagaaauaaagcuacuauaaguguucagauacaaaucuuuguauggac

SEQ ID NO: 4183567 - RNA, 77 nt, Human
gucccaagagcaagaacuugcuguaagaaggauacaugucaugcaguucucuguuguuuuugcucugagagugggac

SEQ ID NO: 4183568 - RNA, 63 nt, Human
gucccacccuggccucgcucucugcagccacagcagcuguugggaagcucugccaggggagac

SEQ ID NO: 4183569 - RNA, 70 nt, Human
gucccacgggccaucauagaggucucugcagugagcagggggugcccagaugaaggaugaacucugggac

SEQ ID NO: 4183570 - RNA, 81 nt, Human
guuuuccagaguggcucccuggguuuggcauucugagcuuaucuaccuggcuuugugaccuaggggcuggcuccuggaugc

SEQ ID NO: 4183571 - RNA, 55 nt, Human
guuuuccauggaggucugaccugaauucaccagugcaaccucauugguggaagau

SEQ ID NO: 4183572 - RNA, 67 nt, Human
guuuuccuucauaucccuuaugugaaggggcgugaacuuuguugaccuagggagauugaaggagaac

SEQ ID NO: 4183573 - RNA, 63 nt, Human
guuuuccuuuuuuccuaugggacaugagggaagaacaccuugugggccaguagaaaggaaggc

SEQ ID NO: 4183574 - RNA, 56 nt, Human
guuuucuaggauccccuccaagcauuuuccaaagcccgaggggcugcuuacaagac

SEQ ID NO: 4183575 - RNA, 71 nt, Human
guuuucuauggguugggcaguaaauauuccaaagaagaauggaaauugaaagaccaacugcauuugaagac

SEQ ID NO: 4183576 - RNA, 68 nt, Human
guuuucucauggcgccaagcccauagcuccaacucgagugaccccugagcuggugcucuugucaagac

SEQ ID NO: 4183577 - RNA, 59 nt, Human
guuuucucugguuuuguuaggugccaaaguggcccccugggcaaaugccagagacaagc

SEQ ID NO: 4183578 - RNA, 66 nt, Human
guuuucucuguguuuuguccaguuuuuaguuguaaucagcaggauuuugacauagcaagacaaaac

SEQ ID NO: 4183579 - RNA, 57 nt, Human
guuuucugccugaaggugaccagugaucuucagagacauuuaucuuuggcaggaaac

SEQ ID NO: 4183580 - RNA, 91 nt, Human
guuuucugguguguuuaauugggccaacagcggagaugccucucucuugagguugcugcaugguucaaaugagcuaaaugcaaaugaagac

SEQ ID NO: 4183581 - RNA, 63 nt, Human
guuuucuguuucuuaacggcauugugguauauuaggagucuuugguuauaagagacagaaaac

SEQ ID NO: 4183582 - RNA, 116 nt, Human
guuuucuuugagcagaaaaguguaacaugagcaaauuugccacuugaguucggcagcuucaggaagucucaauuagcuacauguauagacgaaauauucugaaccuuggagaagau

SEQ ID NO: 4183583 - RNA, 90 nt, Human
guuuucuuuuccuugccaucuaaccagacugccucauaaagauaaaggaaggagagagguagcaucuuuggauguuauuaagaaaaaaac

SEQ ID NO: 4183584 - RNA, 71 nt, Human
guuuugagcagagcaguaacaggagccaacuuucauuuuaaaaggaaugcuuugauugcuguguucaauau

SEQ ID NO: 4183585 - RNA, 71 nt, Human
guuuugaguguguauuauguaucaggaacuaguuaacguuuuagauacauuaucauauuuuacuucgaaac

SEQ ID NO: 4183586 - RNA, 117 nt, Human
guuuugauaucuuuguaguauugagggcagugaugucaaacagugaauaaaguuauauaucuauguggugaucuuauuuuaaccucaauauuauuuuagugauuuguaagucagaau

SEQ ID NO: 4183587 - RNA, 67 nt, Human
guuuugcaauuuucuguccuuguacuauuucacaggaaaagcugcugggcuugaaagcugcuaaaac

SEQ ID NO: 4183588 - RNA, 91 nt, Human
guuuugcauguggcucccagggugugagguucugcagaacaguagccugcuguucccuugaccccagacccuggugcuuucauugcucugc

SEQ ID NO: 4183589 - RNA, 80 nt, Human
guuuugccaagcccugugcuguauuaguguuucaguaaaaggcugcuaaaauauguaagauuagcacuagauuggggagc

SEQ ID NO: 4183590 - RNA, 98 nt, Human
guuuugccucuuaaauucauguauuucuuggcgucuugcuuagagucaccuuuuugacacaugaguccugccagguauguggguuagugagucuguac

SEQ ID NO: 4183591 - RNA, 57 nt, Human
guuuugcucauuugguccaagggucuaaguucugacuuuuauuaccuugagcaaaac

SEQ ID NO: 4183592 - RNA, 75 nt, Human
guuuuggccugaauuauggcagaucuuuauaugugcucaguaagauuuaaauuugcuacaauucuaggcuuguac

SEQ ID NO: 4183593 - RNA, 55 nt, Human
guuuuggcuccuggaggcccuuuagggucucacccucugucccaggaggcggaac

SEQ ID NO: 4183594 - RNA, 99 nt, Human
guuuuguagcagacuagggcuggagucuugaaaguggacuaguucugugaaggagaaagugugggcagguauugcuaacccuggucucagauacagaac

SEQ ID NO: 4183595 - RNA, 104 nt, Human
guuuuguagguuagauguguaaagaauauguaucugagucuaguauguggaguaaguuguuauuuuuauuucuuucagguauguguuguuauuuugcccaagac

SEQ ID NO: 4183596 - RNA, 68 nt, Human
guuuuguuagugucuguugcuuuuguucagauuaagcucugaaacaaaauuaagauucucgucaaggc

SEQ ID NO: 4183597 - RNA, 120 nt, Human
guuuuuaauauggucaauaguauuaaagcuuggaagccuagauucuuuucuuuugaccccaaguggaaaagaaagucuuccuuguuuguuugcuuuuuuuuuccuugugacugugaaagc

SEQ ID NO: 4183598 - RNA, 89 nt, Human
guuuuuauccaaguguuaaggcuuaaugaucaaucccuaggguacucucuuaaacaaugauguuauggcucaaacauuuggaccagaac

SEQ ID NO: 4183599 - RNA, 64 nt, Human
guuuuucaaaggcuucuauuggacguugcagcugacagcugcaguagagcuucuuuugaugaac

SEQ ID NO: 4183600 - RNA, 71 nt, Human
guuuuuccgggagcugaacgucuugcgacaguggcugcacucauacguagguggcucagcaccuggggugc

SEQ ID NO: 4183601 - RNA, 86 nt, Human
guuuuucuaugaacagcuuuguauacaguaacucaauuuugaggucuugaguucugugcaccagaugcuuggaaucauagaagaac

SEQ ID NO: 4183602 - RNA, 83 nt, Human
guuuuugaccaggcucccuaggauucuccaaguucuaaaugagccaugagaggguucccagggguuuccuggagugcagaagc

SEQ ID NO: 4183603 - RNA, 64 nt, Human
guuuuugagaaguuacaaguccucuacggcugucaacucagagaggcacuaauuauucagagau

SEQ ID NO: 4183604 - RNA, 67 nt, Human
guuuuuggaagaugccacuguaucaguuauaauuucuuuugcuagauacuuauaaucuuccaagagc

SEQ ID NO: 4183605 - RNA, 58 nt, Human
guuuuuggcuuuagugccuucugauucaacacccugggucuagcugagagcuaaaaau

SEQ ID NO: 4183606 - RNA, 77 nt, Human
guuuuuuauccuguauucuucugaaauaugggccuguuuguccccaguuauguucaauaggaugcaugauauaaaau

SEQ ID NO: 4183607 - RNA, 129 nt, Human
guuuuuuggggaugcucaagauauuuugcuguugacuuucuauaaggccaaagaauaauaacaucagcuuauuauuagagugcuuugagaaaguuagccaaaacuucagcagaagaaugcccaggaaac

SEQ ID NO: 4183608 - RNA, 82 nt, Human
guuuuuuucuauuagauguuucaaaauagguggauuaaaugaaauuuguucaucuguguguuauuguuuaucagagaaaaau

SEQ ID NO: 4183609 - RNA, 101 nt, Human
guuuuuuuguuucaacguguugcuaguuaucuuaucucaguguauuguauuuauauaacugcauauuugauugagauaccuaaccuaugagacauauuaac

SEQ ID NO: 4183610 - RNA, 67 nt, Human
uaaaaagauuguguagaaaggaugccguauuuaguuacuggugccauauuauauacaguuuucuuua

SEQ ID NO: 4183611 - RNA, 89 nt, Human
uaaaacacaugguaauguguaccauguguuuuacacaugguaauguguaccauguguuuuacacaugguaauguguaccauguguuuua

SEQ ID NO: 4183612 - RNA, 74 nt, Human
uaaaacacuugcucaauucaguugcaaugucaaucaaucugauugcauuguugaugaguugaauaaguguuuua

SEQ ID NO: 4183613 - RNA, 76 nt, Human
uaaaacaguuuuauugaggcauaauugacauagugcacauggcacauacucaguguguucaauuggauagguuuug

SEQ ID NO: 4183614 - RNA, 88 nt, Human
uaaaaccuaaaauguaaauuaaaaugaacaaaauaugcuuugcacaucaaacugucaaggauuuuugucuauugcuuuuucgguuuug

SEQ ID NO: 4183615 - RNA, 65 nt, Human
uaaaacugcaggucaugacccauuaguagauugugaaauuaaguggguugagaccagcauuuuua

SEQ ID NO: 4183616 - RNA, 63 nt, Human
uaaaagcucugcuguuggcuaggucuagcaaccuggauaccaaaauucaauacacugcuuuua

SEQ ID NO: 4183617 - RNA, 57 nt, Human
uaaaaggcccugggcuuggugucuguucagcucucgcacauuccaugggucuauuua

SEQ ID NO: 4183618 - RNA, 70 nt, Human
uaaaagggaaacagccacucaaagggccgaagugauccuacuuggcguuaguauugcugaaucccauuua

SEQ ID NO: 4183619 - RNA, 84 nt, Human
uaaaagucuagauaagguggcuuggaauucuucuggcauucccagauucaaauuccucaaagccaucuacuucauagcguuuua

SEQ ID NO: 4183620 - RNA, 71 nt, Human
uaaaauaagaauauuaguaauaccugucucauaauguuguugugaggauuaaaugcauagugcuuauuuua

SEQ ID NO: 4183621 - RNA, 58 nt, Human
uaaaauagcaugugcagugaaagaaaagcauacacguucucauugcauaugcuuuuug

SEQ ID NO: 4183622 - RNA, 69 nt, Human
uaaaauaugauaagugcuucagugggucaauggacagaauaucuacugaucacagauauguauauuuua

SEQ ID NO: 4183623 - RNA, 59 nt, Human
uaaaauaugcauuugucaguaugaacaaacugaaauaaaugugacaaaggcauauuuua

SEQ ID NO: 4183624 - RNA, 69 nt, Human
uaaaauauguuggugucccugcucaaaguguuaauaaggauacuuugguaucaaacuaaaacuauuuug

SEQ ID NO: 4183625 - RNA, 83 nt, Human
uaaaaucucauuaccuuauguguaaugcugauaaauaugagaccauuugaacagaguuauugugaggaauaagugagauauua

SEQ ID NO: 4183626 - RNA, 77 nt, Human
uaaaaugcagauuccuggaccauucccagacggguugacucagaaucccugcaguguguccagaaaucuguauuuua

SEQ ID NO: 4183627 - RNA, 73 nt, Human
uaaaauggugagcccuugacaucgcccacugucucugaggacauccugggccucagaggugugucccauuuua

SEQ ID NO: 4183628 - RNA, 67 nt, Human
uaaaaugucaaaauaauugauuuguuuucucuugauugugaaaacugaugaagaguuuggcauuuua

SEQ ID NO: 4183629 - RNA, 77 nt, Human
uaaaauuauugcuuuauguggcugauacucauucuguugggucagugccauugccauaugaguugcuaaauauuuug

SEQ ID NO: 4183630 - RNA, 72 nt, Human
uaaaauuuaggaaggcacauuguuggcuaaauuaauucacaauuggguuuagucaguguccuccaaagcuua

SEQ ID NO: 4183631 - RNA, 70 nt, Human
uaaaauuuuucucugaagauuuaucacaguccauucaaaucaagauugaggucucaagagaaaaguggug

SEQ ID NO: 4183632 - RNA, 86 nt, Human
uaaacaaagacucuuaacaugggggguaagucugcauggcaaauucauguagaccuuuucugucuuaggagagguuauuuuguuua

SEQ ID NO: 4183633 - RNA, 77 nt, Human
uaaacaauuccucucuaggcauagccccugaauggcuucuacauggcuaaacaagugccucagaggaagaauguuua

SEQ ID NO: 4183634 - RNA, 67 nt, Human
uaaacaugaucacuccggcuuuuucuuugcaaauagggucaagggagaaggcagguagguuaguuug

SEQ ID NO: 4183635 - RNA, 67 nt, Human
uaaacuacugggcaaggacaggcucagaucuuuaacccucagaucacuugcccuugccaguauuuua

SEQ ID NO: 4183636 - RNA, 69 nt, Human
uaaacugcugugcauacacaaacaugucacgugaaaaccaaccuccaugcaguauaugucaguaguuua

SEQ ID NO: 4183637 - RNA, 69 nt, Human
uaaagaaaaugaaaagaagcuucaaggugugcauaugugucuucuugaaagcauuuucuucauccuuug

SEQ ID NO: 4183638 - RNA, 106 nt, Human
uaaagaaagagggucucagaaaccuuagcuguauuuuuauuucuuuuccuauauuacuacucugagguaaagguacgaagugagggauugacacccuuuuuuguua

SEQ ID NO: 4183639 - RNA, 85 nt, Human
uaaagacucagucaugaaaaggguagaucccuaagucagauugcuauuuuaauuacugucuauguuuugcaugaaaaaaucuuua

SEQ ID NO: 4183640 - RNA, 83 nt, Human
uaaagagagaagauuuuaagcuugaaacacuaaagcuguucuaaaagaaaauagugcuuuaaguuuacagagaaaacuuuuua

SEQ ID NO: 4183641 - RNA, 73 nt, Human
uaaagagugagaguuucugcaacuguauucugaaaguauugacagagcuguuguuaauuaacucauuucuuua

SEQ ID NO: 4183642 - RNA, 76 nt, Human
uaaagauaaagauggugcuguaguagauauuuaggcuaguuccugacaccuugcuaaauggcacccuccuccuuua

SEQ ID NO: 4183643 - RNA, 77 nt, Human
guuuuuaaacagaggaauagugaugcuuaaauuuucaucuuaagcagaugcuuuaaacuguucaucuguucagaagc

SEQ ID NO: 4183644 - RNA, 66 nt, Human
guuuuuacaugcagagggaagggagaagacaggccauuucuucucccccagugcauguggccaagc

SEQ ID NO: 4183645 - RNA, 85 nt, Human
guuuuuccauuuacucauucgcuguucaacauugagcaucugcgacacaucagcuccaguggauacagcagugggguggaaaggc

SEQ ID NO: 4183646 - RNA, 56 nt, Human
guuuuuccguuuauuuucccaaguugguggauuugaggcaaaaucaacgggaagac

SEQ ID NO: 4183647 - RNA, 83 nt, Human
guuuuuccucuuauugcuguuuaaugaugucuuaucauaguagcuagaaccuauagggcaauguugaacaacaauggaacaac

SEQ ID NO: 4183648 - RNA, 90 nt, Human
guuuuucucaaccuggcugccagcaauguguccagccucaucucuuuuuccugcugaaaagcauucugugcuacagccauucagaaaaac

SEQ ID NO: 4183649 - RNA, 66 nt, Human
guuuuucucacacuauuuauucugcuucuuugaagaugguaggaggucaggagagugugagugaac

SEQ ID NO: 4183650 - RNA, 127 nt, Human
guuuuucuuacuuccugguuucuccccaauacuugaaacauucuccuauugauucauugcauccauuuaaguaucuaaguugccagggaguguucaugauguuggggggauacaggggggacaaaac

SEQ ID NO: 4183651 - RNA, 110 nt, Human
guuuuucuucuuuauaguaggccugacagaaacauacugaagcaaucugggagacaaccugugauagauccuaugcuaaauguuaauguuaccucuguugauuuaaaaac

SEQ ID NO: 4183652 - RNA, 70 nt, Human
guuuuugcagcucaguaaaagaggagcagcuuugcugguuguucugauuuucauugacguuguagucaac

SEQ ID NO: 4183653 - RNA, 100 nt, Human
guuuuugcauaaaguugguuuuccaguuaucugugcugcauauguuguugagaaauaugagacacacauucuggagagaaggaguugcauuugcaaaagc

SEQ ID NO: 4183654 - RNA, 56 nt, Human
guuuuuguaguaauguuuuuggcuguuagaggccugaagcacauuucuacaauaau

SEQ ID NO: 4183655 - RNA, 100 nt, Human
guuuuuguaguaggaacacugggcuuaugcuguggaguaggauauaacaauucuacaaaccagcagaauagguccacccacagccaaugcuacuaggaau

SEQ ID NO: 4183656 - RNA, 84 nt, Human
guuuuugugaugccauguuaaugcaaagcagagggcaagcagcugccaaauugcccucccuucauuccacugcaagacagagac

SEQ ID NO: 4183657 - RNA, 80 nt, Human
guuuuuguuaagguugagcucacuuuuauuauggaaacacaaccuccagaguuuaugaaagugaagcuuaugaaaaaaac

SEQ ID NO: 4183658 - RNA, 69 nt, Human
gugaccagccuucagcagacacagggccugggugcccucuggaaaucugugugugccgaggguggccac

SEQ ID NO: 4183659 - RNA, 67 nt, Human
gugaccagguaauguaaagcaggguaaaaucccaucaaauggcugugcugauucauucccugcucau

SEQ ID NO: 4183660 - RNA, 93 nt, Human
gugaccaguuuaagcucuuccugccuguguguauagcaugggacauacagguucucuagggaacagaaagcuuucaggaaaauggaaauucac

SEQ ID NO: 4183661 - RNA, 64 nt, Human
gugaccaugguuuuuacccuacaccauacagaacugcugauggggucaggcugagaacaggcau

SEQ ID NO: 4183662 - RNA, 67 nt, Human
gugacccaaauguccauugaauggaugagcaaaaugugguauacccauacaauggaauuguauucac

SEQ ID NO: 4183663 - RNA, 65 nt, Human
gugacccaggcuggagugcaguggugcgaucuccgcucacugcaagcucugccuuccggguucac

SEQ ID NO: 4183664 - RNA, 55 nt, Human
gugacccagguagguaagcaauggugagaacacgauguguccaucaucugggcac

SEQ ID NO: 4183665 - RNA, 71 nt, Human
gugacccguauggaaaugucuccuucuggagggaacccagaggaaaaauaucucccuauuccaagggucac

SEQ ID NO: 4183666 - RNA, 74 nt, Human
gugacccuaaggaaugaagggauucuuugcaggacuguaauccuggaaaucuuccuucacucuuuccauuucac

SEQ ID NO: 4183667 - RNA, 77 nt, Human
gugaccuuugcugucagccgcuauuuucccagcagacaaaugccucuggagagugagugguaaagacagauauucac

SEQ ID NO: 4183668 - RNA, 81 nt, Human
gugacgacaugagauuugggagggaccagaagcagaaugauaugguuugacacuguccccacccaaaucucaucuuguagc

SEQ ID NO: 4183669 - RNA, 77 nt, Human
gugacgggaccacugcaugugggaggcacacgggcccuguggcauccacagcuguggucuccuuaguguccugucac

SEQ ID NO: 4183670 - RNA, 66 nt, Human
gugacggggcugagggccaauuccuacugauagcgcuuagugggcugggggcacuugcaacgucac

SEQ ID NO: 4183671 - RNA, 67 nt, Human
gugacgugcagguguggccagcagcuuguguuugucaaugguaggugguggcuauggcugugcucgc

SEQ ID NO: 4183672 - RNA, 62 nt, Human
gugacguuuaauagugacaugggugcauucccacacacacccauuccacccagaaaugucau

SEQ ID NO: 4183673 - RNA, 64 nt, Human
gugacuaccccaaggagugaacugcaggucaagcauuucucuuccuccuaggguugcaagugac

SEQ ID NO: 4183674 - RNA, 72 nt, Human
gugacuagaaagagaggccagaaaguaugccaccuuuagagaggggucauguaaucaaggcuuaguucucac

SEQ ID NO: 4183675 - RNA, 66 nt, Human
gugacuagauccacaggaaccaaaacgcaguuuccaaaagcucgagugacugaaggaucuauacac

SEQ ID NO: 4183676 - RNA, 55 nt, Human
gugacuauggcccugucugugagcucuuccagagcuacaaguacauuauaguuau

SEQ ID NO: 4183677 - RNA, 58 nt, Human
gugacucccaacaauauaccaucaggcugaaauugugccuguggucuggagggagcac

SEQ ID NO: 4183678 - RNA, 57 nt, Human
gugacucucacuuuaccugacuccaaaagaaaauggguagguuagaaagagagacac

SEQ ID NO: 4183679 - RNA, 83 nt, Human
gugacucuguccuggauaagucugcacaacugcaaauaaauguguuggaaaagaauuaacuagggcgugauacccagagucau

SEQ ID NO: 4183680 - RNA, 58 nt, Human
gugacuggcacagugagucauaagcaaguggagguuugcagcuccuggaccaggucac

SEQ ID NO: 4183681 - RNA, 87 nt, Human
gugacuguagacaacaggaggaacaugugaguagcuucuguguaucccuguggaacugccuugucucuugccuguugcugcucccau

SEQ ID NO: 4183682 - RNA, 72 nt, Human
gugacugugagggugacaguucuggucucucugugugagcauggggaagcccccuauguucccucacagcac

SEQ ID NO: 4183683 - RNA, 70 nt, Human
gugacuguguuguagaggacgaugccgggaaggcccagccuugcuaauuucuccucaacacacccuucau

SEQ ID NO: 4183684 - RNA, 74 nt, Human
gugacuguuucaaaggguacugugagaguuaaugaguaccucuguugcauuucauccugcuuggaaacagucac

SEQ ID NO: 4183685 - RNA, 65 nt, Human
gugacuuacacagcaggcucucuugggcuaucgaguccuucauagaacacugcuaguauaaucac

SEQ ID NO: 4183686 - RNA, 80 nt, Human
gugacuuaccaggggguuagggauguagccagaacuuaaaucgcaagggcugggguuccugagucccggguaaagauugc

SEQ ID NO: 4183687 - RNA, 77 nt, Human
gugacuuugcaggucaauaaaugcuauuuagcuucaugugcaaaguuuauuaauugacuugugcagaagaaagucac

SEQ ID NO: 4183688 - RNA, 129 nt, Human
gugagaaaggacaggugccugugaggcaggacuuaaaggaggcgcuggcccucaggggcaugcgagggcagggugagcaccugagagugagggccuccuuaaagucugugguccaggguccuuuggucc

SEQ ID NO: 4183689 - RNA, 97 nt, Human
gugagaaauaauaguagcuaccaauguauugaguguuugcauaugugugcauguguguacaugccagccucuaagcacuuuacauucauauucucau

SEQ ID NO: 4183690 - RNA, 58 nt, Human
gugagaacuuccuggaauguuaagguugaucuuucuaccagcauuuggaauucuacac

SEQ ID NO: 4183691 - RNA, 55 nt, Human
gugagaaguuguaggagaauuuugcaacacuguaaaacacuucuacauuuuuugu

SEQ ID NO: 4183692 - RNA, 62 nt, Human
gugagaauaccagcagugagaaaaucauagccaugcugaauucauuacugcgguagucacac

SEQ ID NO: 4183693 - RNA, 61 nt, Human
gugagacucuggggcugcagaaugacuugauaaugucaauucugagaagggugggucuggc

SEQ ID NO: 4183694 - RNA, 73 nt, Human
gugagagcgugcugggucagccucucccuggcgggaauccucuccguccagucuucuaaccuagcagccucac

SEQ ID NO: 4183695 - RNA, 55 nt, Human
gugagagcugcuagacuguuauauuucgggggucuugcaggguagcuuuucuuac

SEQ ID NO: 4183696 - RNA, 68 nt, Human
gugagaggaauggcaaaaggauaacaaggauggauacuauuuuuauguccuauuuuggcaugcuccau

SEQ ID NO: 4183697 - RNA, 68 nt, Human
gugagaggaugucuuaagcccagaaguucaagaacagccuggacaaugaagugagaccccaucucuac

SEQ ID NO: 4183698 - RNA, 109 nt, Human
gugagagggaaaauaagauuuucuuguaggggaaggaugguaagacauaaccuucacguuaugcuuccucccuuccacucaaaauggcccauuuuuauuuuccacuuac

SEQ ID NO: 4183699 - RNA, 63 nt, Human
gugagagugcuguuagguuaauauaguucucaaaggauuggauucuacuuaacaacaccucac

SEQ ID NO: 4183700 - RNA, 77 nt, Human
gugagauacuaaccuuuggucauuuacuuuucaguucuuggauuaaaaggucuggaucagugguucuugguucucac

SEQ ID NO: 4183701 - RNA, 86 nt, Human
gugagaucaagugagguaucuuagagaguguagagacuagagaaaagcaggcuuagugcaaaccucagagacacacuagaacuuac

SEQ ID NO: 4183702 - RNA, 56 nt, Human
gugagauguuugugcuuuguuaaugccguguuaaacgacagcuacaggcaucccac

SEQ ID NO: 4183703 - RNA, 84 nt, Human
gugagauuuggauggggacacagagccaaacuauaucagcauccaagauggagucacucuugucuccacaccccacauucucac

SEQ ID NO: 4183704 - RNA, 67 nt, Human
gugagcaaaaguugauggugcuuucuuuccuggucacauccuuggaagcucccauuaacugagccau

SEQ ID NO: 4183705 - RNA, 73 nt, Human
gugagcaaagggcagaaauauugauacuguggucauucagagccauuuuuauaacuuauauuuuguuccucac

SEQ ID NO: 4183706 - RNA, 84 nt, Human
gugagcagcuggcuaggggcuuccaacccuaccgacuccucacccggggucccuggguucccguggaagugucagucagcccac

SEQ ID NO: 4183707 - RNA, 61 nt, Human
gugagcaguccuuauggggccuugauucauuggauaauaagguuugaagaagacugagcac

SEQ ID NO: 4183708 - RNA, 71 nt, Human
gugagcagugucuacaguggcuggaggguugguaagcaacaccuucacacuuucacuuggauauugcucau

SEQ ID NO: 4183709 - RNA, 78 nt, Human
gugagcaugugugguuuacuguggcgcugcucagcccugaacuccgcugagcagguguuaauagaucacucaguccau

SEQ ID NO: 4183710 - RNA, 56 nt, Human
gugagccacccccugccccugagucugcagccgacucugggguggaggaggcugac

SEQ ID NO: 4183711 - RNA, 100 nt, Human
gugagcccaccccagccuguccuguuggguuguuucccucugccacuggaacccagcagagaacccagcagauuggcugaggaaugcguguggccuucau

SEQ ID NO: 4183712 - RNA, 60 nt, Human
gugagcugcacaggggaugagggcagugugagaugcacgucuuuggccuugugagguuau

SEQ ID NO: 4183713 - RNA, 63 nt, Human
gugagcuggaauaguggagaaaauuuccuugaauugcaagguauugucuucuauuuaguucau

SEQ ID NO: 4183714 - RNA, 56 nt, Human
gugagcugucaggugugccuagaauguaagcauugcuggagucaugggacacucac

SEQ ID NO: 4183715 - RNA, 73 nt, Human
gugagcugucuaugucuuuaguaucuuuuggaagacucaauguauuccacagauuaaaaacauacuuagccac

SEQ ID NO: 4183716 - RNA, 117 nt, Human
gugaggaacugggcaugcaguaaauggguaagaacagugacagccaacauuuauuuaacuucuguaugaagauguuggcuucagugcuuuaccuagaagaugccauugaacccucac

SEQ ID NO: 4183717 - RNA, 66 nt, Human
gugaggaagggugugacggcaccuggcacaagccuggugcucagaguuagaccaggauucacucac

SEQ ID NO: 4183718 - RNA, 80 nt, Human
uaacuuuauuucuaucauaaggaaucucauuuugguggauuauauuuuccauauaaugggauuccuuaucagugagguug

SEQ ID NO: 4183719 - RNA, 60 nt, Human
uaacuuugaagggaauuuuacucaaguaaauuauuauagugggauucuaauuuagaguug

SEQ ID NO: 4183720 - RNA, 58 nt, Human
uaacuuugagaacuuucugguguauuuugaauguauccaggacuuuccuccaaaguua

SEQ ID NO: 4183721 - RNA, 92 nt, Human
uaagaaagaaaaauucaccagucuucuggguguuuccagaggaauauuugauguccucuggacacccagaggucuaggauuuugcauuuuua

SEQ ID NO: 4183722 - RNA, 73 nt, Human
uaagaaagaaaggcucagaaguuuguauuuccuucaguaggaaauaggagauaaugaugccucucuuggcuua

SEQ ID NO: 4183723 - RNA, 87 nt, Human
uaagaaaggccaccagccugccugaauucaauuccuggcuuggucacuuucaagccauaugacuuuggcaagugguguuauuucuug

SEQ ID NO: 4183724 - RNA, 80 nt, Human
guuuuuuaaguugagccaaaauguuuaauaagauauuucuuuguuuaugaaccuuuguguuggaccugggcuuaaaaagc

SEQ ID NO: 4183725 - RNA, 129 nt, Human
guuuuuuaaguuuaaaaaaaaauguaaguaaccuugcagauguuaucacuuagacaugcuaguuaagaaaaauacagaauguaaagugaugauagcuaggauauauaagaaguacuuuugagaugagac

SEQ ID NO: 4183726 - RNA, 68 nt, Human
guuuuuugaugucagagggcucauuuccuggaauuccuagagacagaaaucuucugacuucaagaaac

SEQ ID NO: 4183727 - RNA, 96 nt, Human
guuuuuuuuaaaaagcugaguucucauugcaugagacagaaaacauacgcaagagaaaacuguggguuaucucagcaagagaauauuagaaagaac

SEQ ID NO: 4183728 - RNA, 88 nt, Human
guuuuuuuuuuaaauguguuuuagagcaauguacaagggcaauuuuucguccuguuuugucauguguucuuaaauacauuuccuaaac

SEQ ID NO: 4183729 - RNA, 68 nt, Human
uaaaaacaugcagucaauaaacaugugugauaaacuuuaauaauacagauaaugauuguaugugagua

SEQ ID NO: 4183730 - RNA, 56 nt, Human
uaaaaccaggucuugggauuuacgucugaaagagauaaauccuaaaauugguuuua

SEQ ID NO: 4183731 - RNA, 87 nt, Human
uaaaacgaaggcagguucuaucaaacagccauuaauauacuaugugccauuuuauauugagacuguuugucuguuuuuuaaauuuug

SEQ ID NO: 4183732 - RNA, 72 nt, Human
uaaaacugaaucuauuguuuuuuaaaguaguuuggacaacuguguccaucuuauaggcagaguucaguuuua

SEQ ID NO: 4183733 - RNA, 60 nt, Human
uaaaagauuauauauguguacgaguuuaugcuuuuccuuucuugcacauguguucuuuua

SEQ ID NO: 4183734 - RNA, 63 nt, Human
uaaaaguaaaaucaccaucucuuuguggguuucuuuucacaaugaggcauugauuugcuuuug

SEQ ID NO: 4183735 - RNA, 90 nt, Human
uaaaaguuagcagugauagaugggaacuauggucuuguuucugaucucaaagagaauaaaucuaaaguuucuucauuguuuuaauacuua

SEQ ID NO: 4183736 - RNA, 123 nt, Human
uaaaaguuuugaagcauuuucagcucauggugaauauauguauugauucauuauugaacaaauauuuguaagaauacauguuuucuacuauucuggaggcuuuauaaaaacauaaaacuuuua

SEQ ID NO: 4183737 - RNA, 129 nt, Human
uaaaauaaauguauuauggugacuaaaacagaaccaaauuaaugucaguuuuaggaauauguauuuuaaaguugaguccucucugacuuauuccagcugcaaguuuuggaguuaugcauauacuuuuua

SEQ ID NO: 4183738 - RNA, 84 nt, Human
uaaaauacagcuuugcauugauccuaaaauggaauagacucaguaauaucugaucuccuagaaucuuuguaagauuguaauuua

SEQ ID NO: 4183739 - RNA, 85 nt, Human
uaaaauacaugggaaaguuagacucuucuaaaugggaaaacgauuaucucagaacaguucuuaauauugccgucuuuguauuuua

SEQ ID NO: 4183740 - RNA, 130 nt, Human
uaaaauauacacauacaugcauaaaaaaagaguagauauaaauauaucaaugugccaagugacuuucuacaguauggcauuagcguugaauuuuauuuucuuuagagauauauguaugaggaauauuuua

SEQ ID NO: 4183741 - RNA, 118 nt, Human
uaaaaucacguaccuuagagcuagccugccuugguucaagucauacuaacuucaaguuagaacuugguucaauacuaacuugaaccaaggcaggcuagcucuaagguacaugauuuua

SEQ ID NO: 4183742 - RNA, 62 nt, Human
uaaaaucagccgaccaugguggcacgugcuugugguuccagcuacuugguaggcugagguua

SEQ ID NO: 4183743 - RNA, 63 nt, Human
uaaaaugguaacuuucauuugcauuuccaaaagaauuucauugcaaaugaguugcauauuuug

SEQ ID NO: 4183744 - RNA, 98 nt, Human
uaaaauuuuagcaagucaauucccaguguuuuaagaaaguaauuuuguacuaguguguaggauuuauuccagaaaugcaaggaugguuugauauuuua

SEQ ID NO: 4183745 - RNA, 71 nt, Human
uaaacaagcugucugauauucuguaugaaagggcauuggcaacaguagaguuucaguuuauaguuuguuug

SEQ ID NO: 4183746 - RNA, 66 nt, Human
uaaacagcuacugugucaaaggccaagaguuucuauuuucaaaucaugggacaugguagcucuuug

SEQ ID NO: 4183747 - RNA, 76 nt, Human
uaaacauagaauuguuauauuuucuguauuuccuugauaaguagaaggguugaacauguaucaguucuuuuguuug

SEQ ID NO: 4183748 - RNA, 62 nt, Human
uaaacaugucaucccaaaagcaagagaguaccucccuaauucucuucuggguguuauguuua

SEQ ID NO: 4183749 - RNA, 80 nt, Human
uaaacauuuuauaaggacauucugcuuuaacaaauuacaugguguugagguggggaguauauguaauuguaaaagguuua

SEQ ID NO: 4183750 - RNA, 66 nt, Human
uaaaccugcagagcaaguaacauccuccucauuuuuagaugaggaaguuaacacucugaaaguuua

SEQ ID NO: 4183751 - RNA, 74 nt, Human
uaaacgugcagagaucaauagcauuuugucuguuaaggaucagaauuugcuucuguuuguuucugucauguuua

SEQ ID NO: 4183752 - RNA, 84 nt, Human
uaaacucaaucuggauaaauagauacacuugcacauaaugggaaaaaaauguguguauaguguuguuuauugagguuuuguuua

SEQ ID NO: 4183753 - RNA, 85 nt, Human
uaaacucuuccuggcuacuagguaccauuuagaacuguggggcaauaauuuacuucaugguaccuuggugaccucaaaaaguuua

SEQ ID NO: 4183754 - RNA, 66 nt, Human
uaaacuguagaaagagugugacuacuagcauuaucucugguagcucucuuuaucuuucuauauuug

SEQ ID NO: 4183755 - RNA, 125 nt, Human
uaaacuguuggucuucuguuuagccauuauucucaguucugugcaggagugagcugaaacaaaguuguauagcccagagagugagaagcugcauuucaugucucccaacagucagaaagggauua

SEQ ID NO: 4183756 - RNA, 62 nt, Human
uaaacuuuccuuugucugggugugguuuaagcacaggccauguuuggcagaaggauuguuua

SEQ ID NO: 4183757 - RNA, 93 nt, Human
uaaagaagauuucagguguaucauggaguugaauuggcuaauauuguuuuucugauaguuucuuaggcugccgguacaucuguucuaucuuua

SEQ ID NO: 4183758 - RNA, 90 nt, Human
uaaagaauuuaacuguauaaacucuuuggucucaggaaagguagcacgugugacacuuuucugguacagggaauuacagggaauucuuug

SEQ ID NO: 4183759 - RNA, 65 nt, Human
uaaagagaucuuaauaugaaugcuauguaagauguuauaugagugucauguaugagauauuuuug

SEQ ID NO: 4183760 - RNA, 68 nt, Human
uaaagaugucagucagauaggauuagggcccauucauaugaauucauuuuagcugaaugacuucuuua

SEQ ID NO: 4183761 - RNA, 59 nt, Human
uaaagcgaugggcuaggcagugaauuuucaaaaauguucaauguucaguaauuguuuua

SEQ ID NO: 4183762 - RNA, 57 nt, Human
uaaagcugcaggcucagaaaacacuuguauccccggaugcucugguuuguuucuuua

SEQ ID NO: 4183763 - RNA, 98 nt, Human
uaaagcuggaucuucuauuuauauauuuuugugauauuugauuuuccccaaaaagcaguuagaaucaagaguuguguaauauuuaaggaaaagcuuua

SEQ ID NO: 4183764 - RNA, 57 nt, Human
uaaaggaacagaggacucauuucucuugagugugugugugugcuccuguguccuuug

SEQ ID NO: 4183765 - RNA, 76 nt, Human
uaaaggaggugaaguuggccaguuuaguuuuuucaguuuacuuggggaacucauuagccugcuuucagcccuuuug

SEQ ID NO: 4183766 - RNA, 85 nt, Human
uaaaggcauuuugaauauacuuacagcuuugaucugcaacaaauccuacauggagaaagggaaauuaaugugagcaaugccuuua

SEQ ID NO: 4183767 - RNA, 82 nt, Human
uaaagguaacugucaucuuguaagcaauguuucaaaguagauuagagucugaacauuaaguuuuagaugucaauuaucuuua

SEQ ID NO: 4183768 - RNA, 79 nt, Human
uaaaggugccuguaaguuguaugggcucuagaaucaaacucggguucuuauuucagcucugccauuuacuagcccuuug

SEQ ID NO: 4183769 - RNA, 79 nt, Human
uaaaguccggacuagcaaucugccuuugaguugagcuuuucucuuacaagguaaguuguuaagucaugccuugauuuua

SEQ ID NO: 4183770 - RNA, 88 nt, Human
uaaagugcuuaguacacugccuggcccucagugagugcuauguaagggaauaauguuaauggguccaggcacuaugcuaaguacuuua

SEQ ID NO: 4183771 - RNA, 66 nt, Human
uaaagugggcuuuguggaaaaguuaaauaaaucauuuuaauuuaagaaacggcaggcccuacuuua

SEQ ID NO: 4183772 - RNA, 130 nt, Human
uaaaguuaauaaguaucagagauaguaaucaagaugguccaguagcagggauaccagcaucguaugauaggaaaaaagguauugguagauauugagacuauuuaauaaauuucuguucucauauauuuug

SEQ ID NO: 4183773 - RNA, 75 nt, Human
uaaaguuauuugccucugcuuucaaggauaucugcuggcaucaugagaaucagagcaaauccagaccaagcuuua

SEQ ID NO: 4183774 - RNA, 58 nt, Human
uaaauaaguucagguaaagaaaucagccuaaaguauaaggugagacugagcuuauuug

SEQ ID NO: 4183775 - RNA, 61 nt, Human
uaaauacagucauuugagccauuauuagcgaaagguauugucuuuguuaggacuguguuua

SEQ ID NO: 4183776 - RNA, 65 nt, Human
uaaauacugccugugagguaacucggcgaaauacuuucacagaggccucaugaggugagcauuua

SEQ ID NO: 4183777 - RNA, 58 nt, Human
uaaauauaugcuaaacacuuuuggagggaaacugggagaaaguguaagcauauaauua

SEQ ID NO: 4183778 - RNA, 81 nt, Human
uaaauauauuucuacugugagaaacaugaaugggaucuacuuaaucuagauagucaaacucuacauagggaauuguauuua

SEQ ID NO: 4183779 - RNA, 93 nt, Human
uaaauaugaagugaagcauuggaaagucagaaaucaucuaguguauugacguaauccauguacuaguauuucuacuuuuuuuccuucuuuuug

SEQ ID NO: 4183780 - RNA, 84 nt, Human
uaaaucuguggauaagcacugugauuuauaacauuuuacuuggauaugguagauguuaucauucagaguagcacuuaggauuua

SEQ ID NO: 4183781 - RNA, 130 nt, Human
uaaaugaagaaccuaucugauguuuuugcuuuguuuucuauaacuggacuggauuggauauuuuuauuaagaccuccuagguguuauagaggaaaaaacgcaggaaauauagugaaauaugcuucagaug

SEQ ID NO: 4183782 - RNA, 80 nt, Human
uaaaugacaggguggaaaagcuaguuggaaccucuugaaauaauugguucuaauaugagaauuucacauuugucuauuug

SEQ ID NO: 4183783 - RNA, 99 nt, Human
uaaaugagauagucacagagaacaacaaaaauaguaauuuaagcucccauacaacaucaaguguguucagucuauuuuugguucuucggguucucuuua

SEQ ID NO: 4183784 - RNA, 97 nt, Human
uaaaugauuuuggacggaaaggcuacgggggccgugugcagacaaaaucagcugccgcgucgaugcccucuaguucugaaguucacugcuuuauuua

SEQ ID NO: 4183785 - RNA, 80 nt, Human
uaaaugugucccuggucauaucagaaaguuuuauuaucacuucaggguagcucucugauaaauugauaaagacauauuua

SEQ ID NO: 4183786 - RNA, 90 nt, Human
uaaauuaacacuucaaaauuauacauagaucugugugggcaaacuacuuacccagcagggucucugugucuauaacguaggguuauuuua

SEQ ID NO: 4183787 - RNA, 88 nt, Human
uaaauuagaggaugaggaggugagguuuuggggugcuuuuaaaggcuuuaaaaguugcuggcuuugguucauuauuagcucuaauuua

SEQ ID NO: 4183788 - RNA, 65 nt, Human
gugaggggucuggacgcacagucacugaacgcaaaggauggcacccaugcgucugcacccuacac

SEQ ID NO: 4183789 - RNA, 57 nt, Human
gugagggucugugccggcggggcaugcgacccgccaggcaggugucggagcccucac

SEQ ID NO: 4183790 - RNA, 77 nt, Human
gugagguacaauuuuauacccucaucagaagcuucuccaauuuuagccuuucuaguggguauaaaaugguaucucau

SEQ ID NO: 4183791 - RNA, 87 nt, Human
gugaggucacaguuuccuaugcaaauuuaaugaaacuauguauauagcaaauuauacguacgauuucuguggguacgugaaccuuac

SEQ ID NO: 4183792 - RNA, 76 nt, Human
gugaggucauucauuauaguaauuuuuagugugcuugccaaaugccaagggaaaucauauggugcaguaaucucac

SEQ ID NO: 4183793 - RNA, 58 nt, Human
gugagguccagggaggauacgaagcauuugaaaacauguucccucccuguaaucucac

SEQ ID NO: 4183794 - RNA, 70 nt, Human
gugagguuuguaguugcuuuacaucuuuggguuugcaguuccagaauagaaggcagcugucauucccuac

SEQ ID NO: 4183795 - RNA, 80 nt, Human
gugaguagggcuuagguuuaguuugugguccaugaagcaaaacuguggggcacugcugauuucauaggcaggaaauucac

SEQ ID NO: 4183796 - RNA, 97 nt, Human
gugaguaugacuguauucugagacuugugaguccuucuagcgaauaaucaaacuuggaguggucuuggagacucuacacgcuaauauagacacuugc

SEQ ID NO: 4183797 - RNA, 55 nt, Human
gugagucaugucccaucugauuuauauuggaucuggcuguggagccaugacucac

SEQ ID NO: 4183798 - RNA, 60 nt, Human
gugagucuauuuugcuuauucuauguaauauuuuauauggcaaauaagagaaagauuuau

SEQ ID NO: 4183799 - RNA, 55 nt, Human
gugagugaagaagagcauagguauuccugauauuuggcauguuaacuucacuuac

SEQ ID NO: 4183800 - RNA, 65 nt, Human
gugagugaaguggccaggaccuagcagcugccagugcagccuggauccauguggcuaccaaccac

SEQ ID NO: 4183801 - RNA, 57 nt, Human
gugagugagggacuccaugacuccuaaucucaggacacaggcuggguccuuccuggc

SEQ ID NO: 4183802 - RNA, 84 nt, Human
gugaguggaaccagcuggagggcaucuacuuaguccucugaggacacaugaaggcuguguggagcccccgagcugauuacugac

SEQ ID NO: 4183803 - RNA, 58 nt, Human
gugaguggcggcucuggggcguaaacccaguccuggcaggcuccugggccucacucau

SEQ ID NO: 4183804 - RNA, 68 nt, Human
gugaguuggggucccacucagcuccccuggcagcgggcuccagaggggcgggaacucaaccucaucac

SEQ ID NO: 4183805 - RNA, 99 nt, Human
gugaguuugacuauuucagacacuucauguaaguggaaucauucaguauuuguccuauggcuggcuuauuucacuuaguguaaugucuuccagauucac

SEQ ID NO: 4183806 - RNA, 96 nt, Human
gugaguuuggggaugcagcugucagggagaacaucccuucuugaaugagcagaagacuucaugaauccgcugaacaugcugcagcacuaaauucac

SEQ ID NO: 4183807 - RNA, 75 nt, Human
gugauaagucugggccagggcacagccuaauguggcaaaaaaguccugggagcuguauugugguucagacuucac

SEQ ID NO: 4183808 - RNA, 74 nt, Human
gugauaaucuaucuguucuucauuaaaacugauacuaaguucacauuaaugaauaugacaggagaggaagucau

SEQ ID NO: 4183809 - RNA, 93 nt, Human
gugauaauuuacaacguuccuggugcuaaguaguuccccgcuuaagaaugcguuggcugggcagagauuagcgcagggaguugugugugucac

SEQ ID NO: 4183810 - RNA, 59 nt, Human
gugauagucuccugguuguguugccgagcucuggcauucugcuuaagggaggcugucau

SEQ ID NO: 4183811 - RNA, 65 nt, Human
gugauaguggcugccaagauauaauuccuagucugacagggcuugagauauggcagucaaauuac

SEQ ID NO: 4183812 - RNA, 71 nt, Human
gugauaugggaaguucagaagauucaugggauuuacauucuggauuuuagaaggcuuccuaacaaugucac

SEQ ID NO: 4183813 - RNA, 82 nt, Human
gugauauuucagccaagggaacugagccggagggaaugcauugucucccacagucucccauggcucaagaagauuuaaucac

SEQ ID NO: 4183814 - RNA, 98 nt, Human
gugaucaagcaaagaucaggaauuaggugagauggaaagagggagacccauuuugcucauuacuugaagaucuuguuaaaguuugcuuuauagauggc

SEQ ID NO: 4183815 - RNA, 71 nt, Human
gugaucaagugauucucccuacgcgggagcucccucucccagcucccaaguagaugggaauacaggugcgc

SEQ ID NO: 4183816 - RNA, 62 nt, Human
gugauccaagagagaggaagggggaaacugcuauguuauuucugcauuguccucuugguuac

SEQ ID NO: 4183817 - RNA, 74 nt, Human
gugauccacuccuggaggugccccauggguaggaccuugagccaggugagggugagccccaggauggagaucac

SEQ ID NO: 4183818 - RNA, 69 nt, Human
gugauccuaagccacucaaaucuugugguuggaugcuaccacaggacaaccuggcuuauuaugaaucau

SEQ ID NO: 4183819 - RNA, 129 nt, Human
gugaucgugauccuguuuucauuuaugugcaaaucuuggaagacauuuauuugaaucaauuugccaugcuaaucuagugaaaacaguuauuuaaguagugucuuagagcaaaguauuugaagaauacac

SEQ ID NO: 4183820 - RNA, 84 nt, Human
gugaucugccaugccacugugacugcauugaaagaugucccuuucucugccagucaguuggugugggacaaaacacagauauac

SEQ ID NO: 4183821 - RNA, 130 nt, Human
gugaugaaggccagggacaggacuguggcugugagagggaaaugcagugggaaacuggagagacuucaaagggaagguguccacuucucaccuccucuacugcugccacccugguccaggcgacugucac

SEQ ID NO: 4183822 - RNA, 67 nt, Human
gugaugaggcaaaggacggcacugccauuccuccccuuggugugccaucacugaacuucugaaacac

SEQ ID NO: 4183823 - RNA, 70 nt, Human
gugaugaggggcucagaggucaguagccaaucacagaagcgggcagucugaccuuccgugccccucucau

SEQ ID NO: 4183824 - RNA, 129 nt, Human
gugaugcagguguguccuucuccuauuggcucucgggaugcugcuuaaguaucucaggugaguuucugaggagguagaagccaguguuuuugagaguugucuaagaggaagguuguuaaaguuuuccau

SEQ ID NO: 4183825 - RNA, 92 nt, Human
gugaugcuggugggaggcuugcauggcuuucuuggugugggguucauuugccuucuaggucccuucaucagugagcaagccucuccagccgc

SEQ ID NO: 4183826 - RNA, 129 nt, Human
gugaugcuugagacaaaguccccauucuugaaugguuucugccaauccgacuuugugaauaaacucuaaugacaauauuuuugagaaaaccaucguaagaaugccaucaaugucuuggaagugaauuau

SEQ ID NO: 4183827 - RNA, 85 nt, Human
gugauggaccuggcugagccuggagcaucuggugaggucuaguccccuauuaaugcuuccaugguucccugcacuucuccgucac

SEQ ID NO: 4183828 - RNA, 115 nt, Human
gugaugggaacuucuauacagacagccagccuuucuauugguuucucuucuucucgugguaguuuugggaggagccauagauagugcugcugauaugugcuuccucuuccccaac

SEQ ID NO: 4183829 - RNA, 91 nt, Human
gugaugggauaugaaggcuuaugugugacuuucgcgaggcuguguaugcaugugacaguacgugugugaggaucuucgugugauugugagc

SEQ ID NO: 4183830 - RNA, 65 nt, Human
gugauggguauuuggggugauggguauuugccuucagggucugccucagagaaacagcugcacac

SEQ ID NO: 4183831 - RNA, 58 nt, Human
gugauggucauccuucccuucugguaacaccugaauauagauagcugaugaccaucau

SEQ ID NO: 4183832 - RNA, 62 nt, Human
gugaugucacagaauaagugauaucacaggauaaguggcaucacaggauaagguggcaucac

SEQ ID NO: 4183833 - RNA, 78 nt, Human
gugaugugacggcagaggcagauauuggggugauguguguacaagccaagaaacaccaaugacugcuggccacaucac

SEQ ID NO: 4183834 - RNA, 65 nt, Human
gugaugugagccucuagacccuggccugcagggacugagggcagcucuaggggguuaguuauuau

SEQ ID NO: 4183835 - RNA, 124 nt, Human
gugauguuaaccugggcccuacuuccuugauaaaccuuagugagccuuuuggcugcucaucuacaucaggcucagcaaagcaggcuccuagaaccaaggaagucccuccccaccauaauccuac

SEQ ID NO: 4183836 - RNA, 66 nt, Human
gugauuauuuuuaaugccuuucuagacaagccugcaaacuucuacaggguauucaaggguaguugc

SEQ ID NO: 4183837 - RNA, 98 nt, Human
gugauuccucagccagagcaaccucucuaugccaaguacaggcacugcucagggagaaggagagugcugaacggcaagggugcagguggagggauggc

SEQ ID NO: 4183838 - RNA, 75 nt, Human
gugauucucaguguggaaaugagaaugaaguuuuuuuuaaagacaggcuacaauaauucccaugcagagaaccac

SEQ ID NO: 4183839 - RNA, 79 nt, Human
gugauucucaucugucuccagcauugaacaucaaggcaguuuccuccauguugagagcugagaucagccugugauccac

SEQ ID NO: 4183840 - RNA, 82 nt, Human
gugauugcuuccauguguauuuguuguugugaacaaaguaccaauaugaacaacagcauauuucauauauugaaaaaauuau

SEQ ID NO: 4183841 - RNA, 62 nt, Human
gugauuugaaaucccuucuacuguagggcacagucuacuagacaaaagggaguuucaaagac

SEQ ID NO: 4183842 - RNA, 83 nt, Human
gugauuuuaccuuuacuuccuucacuuuaagccaaucaugaaauuucagugauuucuggggugagggcgaaaggugguguuac

SEQ ID NO: 4183843 - RNA, 82 nt, Human
gugauuuuaguacagugaaacuuguguaggaauucuaggcuacagaacugcaaaauaaucaaguuguauuguuuuaagacac

SEQ ID NO: 4183844 - RNA, 63 nt, Human
gugcaaauacuguacugaacacuguaugcacaugcuguucaaaagccacaguuacuuuugcac

SEQ ID NO: 4183845 - RNA, 76 nt, Human
gugcaaaugguuuggacuauucaauagcccaaauggucaaaugguuuugggcuauugaauagcccaaaucauucac

SEQ ID NO: 4183846 - RNA, 66 nt, Human
gugcaacuuuagaccccaaguagcuagagaaaaguuucucuaggugccugucgucucugguuacau

SEQ ID NO: 4183847 - RNA, 55 nt, Human
gugcaagaggacaguaaggguggagguguggaugcuuaacccagucuuuuugcac

SEQ ID NO: 4183848 - RNA, 108 nt, Human
gugcaagccaacuucagaccucauguauauguuuguggcucuccuuguaauaaagugaaaauaaaggaaggagcuaugcauaacugaucagagaagaagagauggcac

SEQ ID NO: 4183849 - RNA, 130 nt, Human
gugcaaggguagacugggccacugggcaguuuccagagucccucuucacaucccaaauggcaaaggcccauuugucucuaggaagugaggguuuggggacaugucccacccaacccagaaccacaaaucc

SEQ ID NO: 4183850 - RNA, 129 nt, Human
uaagaaccuguuaaauauuauguuacaaguuauagaaggaaaauguaauuaacaaugaaucucugugcuuggcaagauuacauucuccuuguauuaggauuugugcaugugugauacagcagguuguua

SEQ ID NO: 4183851 - RNA, 79 nt, Human
uaagaagcauuuuuggaauguauuugaccaaagaaugcuuauguucuuaagaaauugcauucuaauccgaugucccuua

SEQ ID NO: 4183852 - RNA, 129 nt, Human
uaagaauaaccuggggugugauuuuagcaaaauggauucccagguucuggccccuggagauuaauucaguaggucugaguggagccaggcaaucuguacuuuguaaaagcuucccaggugauuuugaua

SEQ ID NO: 4183853 - RNA, 80 nt, Human
uaagaauuaacagggucauucugaaaauguaaacuugaaaaggcuuccaaaucuguucaaaauggcucugugaucucuua

SEQ ID NO: 4183854 - RNA, 59 nt, Human
uaagacacagaaguugcuguuggguuuucuggcaugagcccuuuggauucuguguuuua

SEQ ID NO: 4183855 - RNA, 83 nt, Human
uaagacauuuacuacuaacaugcugguucaaugaagguguuccccaaugcacaucuuuuuggaaacggcugaguagaugcuug

SEQ ID NO: 4183856 - RNA, 82 nt, Human
uaagacgaguuagcaaauguaaaaugccuacaacaaugccuggaacgcuguaagcauuauauaauuguugauuauuuccuug

SEQ ID NO: 4183857 - RNA, 100 nt, Human
uaagacuuaacaguccuucaagaaaucuggaaacuagagaacuccugcaacauggacucccaauuuuucuagauauuccuugaagugagugagccucuug

SEQ ID NO: 4183858 - RNA, 66 nt, Human
guuuccaucuccaggacauaaucuugcaggaucaccucucacccuuaucucuuggugacuggguac

SEQ ID NO: 4183859 - RNA, 63 nt, Human
guuuccaugcagcagccucccagccacuguagcgcaaacaaagccagaggugcugcugcagac

SEQ ID NO: 4183860 - RNA, 61 nt, Human
guuuccauggcucuguuaaugggaaguaucgacucuuuguaggaauagagccacugggaau

SEQ ID NO: 4183861 - RNA, 67 nt, Human
guuucccagguaauucugaggcagagugaggauucagaacuaguugcuuuaagguaucuggagaaac

SEQ ID NO: 4183862 - RNA, 99 nt, Human
guuucccauugauuucauuauuaaauuuuaaauguauuuccucuuggugagggauaccugcaguauuuuauuguuuaauguaguggcucauggggaaau

SEQ ID NO: 4183863 - RNA, 77 nt, Human
guuuccccagcacagggcuugagaggugucugaggaguucuuagggacucucuagcacccugugcuuuuagggaaau

SEQ ID NO: 4183864 - RNA, 62 nt, Human
guuuccccaucucuaacauggagcuggugacuccucagcuguccaggccaugguggggaggc

SEQ ID NO: 4183865 - RNA, 56 nt, Human
guuucccuuugauuuucacaguaggcuguucugugugggaauguuggagaggaaac

SEQ ID NO: 4183866 - RNA, 72 nt, Human
guuuccggauccuggcacagguuggucccaggcuccucugccggggcgacuauguccagggccuuugggaac

SEQ ID NO: 4183867 - RNA, 72 nt, Human
guuuccuagauaacuuggucuuggauuucuaagucauaauguaagaagucugaagacucaugucugaaaagc

SEQ ID NO: 4183868 - RNA, 90 nt, Human
guuuccucagucauaaaauuuguggauuagauuagaugaucuuuaagaucauuucugccucauguauuuuaugauucuauguguggugac

SEQ ID NO: 4183869 - RNA, 79 nt, Human
guuuccucauuccugguggcaucuugagacgguuugguaacauccaagcugugcagauguuaccacggagcauggaggc

SEQ ID NO: 4183870 - RNA, 55 nt, Human
guuuccucucgccccuggguuuuuggagcacccggguugaggggccaggggagau

SEQ ID NO: 4183871 - RNA, 130 nt, Human
guuuccugaugaaaauaucuuccccagaaaagccagagcuugacgugcaacggaccaaccagaggcugcugggauucccauguugugccuggcugcagcugugggcagguuaccaaccccauugggauuu

SEQ ID NO: 4183872 - RNA, 100 nt, Human
guuuccugggcaagggcucgaaccagcuauuagugucuauuugcacugcaugaaaacaaaauuuaauguaaagacgcuuauagcuugccuacccuaaaac

SEQ ID NO: 4183873 - RNA, 70 nt, Human
guuuccugggcuuuguuucucuccuaccucagcuggguccugagugaguugcaaaguguuacuagaaagc

SEQ ID NO: 4183874 - RNA, 84 nt, Human
guuucgggugagucuuuuguggauggaaaauagcaggaacuaguuguguuaugucuuuaucccaauaugagacucgccacuuac

SEQ ID NO: 4183875 - RNA, 58 nt, Human
guuucgucaauucagguacaggucugucugggagaccuggcccuguggaggcaggaac

SEQ ID NO: 4183876 - RNA, 98 nt, Human
uaaugaaggggaaagguuagcuauggaaugccaaguucacugcugaguuauucaguaacaaaugcaucugggcauucaugcuaauuucucuacaauua

SEQ ID NO: 4183877 - RNA, 80 nt, Human
uaaugaauaugaccucuaucuaugauuguggaaauucugaguugaauuccaaauaucuuggugguuaggucaguguauua

SEQ ID NO: 4183878 - RNA, 62 nt, Human
uaaugagaucuaccugugauguuugcccuuaaguggcaaauacuaaacauaagauuuuguug

SEQ ID NO: 4183879 - RNA, 89 nt, Human
uaaugaucucuacugcuucuucuuuuaauaaaugucuuuaguagcuagagaacaguuacacaagagaaaggaccaacgagaaaucauug

SEQ ID NO: 4183880 - RNA, 59 nt, Human
uaaugcauuaaaguuagagacuucugagagauucugaaguccuuaacuuuggcguauua

SEQ ID NO: 4183881 - RNA, 89 nt, Human
uaaugcuagauccacaugcaauaguaauucuagucugugguuuuauggacauuuaaauuauuguuuugucuagauggguucagucauua

SEQ ID NO: 4183882 - RNA, 59 nt, Human
uaaugcugccaagccaugcagagauggaagagaauuuuagguauguuuuggaaguguua

SEQ ID NO: 4183883 - RNA, 73 nt, Human
uaaugcuguacagcaucauacuaccuaaaugauuuguuguugucauuguuaauuguaugaucugacgauguug

SEQ ID NO: 4183884 - RNA, 63 nt, Human
uaaugcuucuguuaggaucuucuuuauauuaccaaaauugaagaagcuggaagaccagcauug

SEQ ID NO: 4183885 - RNA, 70 nt, Human
uaauggauuucaggguaaaaaguguucaacaaugcauccauuuucugaagcucacccuguaaauucauua

SEQ ID NO: 4183886 - RNA, 84 nt, Human
uaauggcuuuuugaugcauauugauucuuuauguaccauaugacuaauagcauaacucuagauguacacucagaaaagucauua

SEQ ID NO: 4183887 - RNA, 87 nt, Human
uaaugggauucuuaugccugaggauagcucuuccuuacuugucaauauuaucauguagauuugcuucuccugccuggaauccuguug

SEQ ID NO: 4183888 - RNA, 76 nt, Human
uaaugguuagcuuccacaucugucuucaguacaggaaggaacuagacuguaagcucuguggaggcaaaaaccauug

SEQ ID NO: 4183889 - RNA, 58 nt, Human
uaauguaccuccagauguuguacccugagaaggagacaacaucauucagguaguauua

SEQ ID NO: 4183890 - RNA, 93 nt, Human
uaauguauuugacagagauugaaucaggaaauaaauucaugacauuucaguuaacuaguauuaccuguuuguagaaucucuguuggaacauug

SEQ ID NO: 4183891 - RNA, 107 nt, Human
uaaugugcccaugucuagcuccucucaugccuuagacaaugccuagcuuacagggguucuuuaaguggagaaggaaauaaauugcuacaccaaaugggacuauauua

SEQ ID NO: 4183892 - RNA, 66 nt, Human
uaaugugucaaauacauaugcucucucuuuguccagugcccagcacagagccuguguugacaguug

SEQ ID NO: 4183893 - RNA, 59 nt, Human
uaauguuaaggaacugcccuuccuuuccagaugagaaagaggggcagcucuuagcauua

SEQ ID NO: 4183894 - RNA, 76 nt, Human
uaauguugguguucacugaagcuggcuuuaaaauaauuacaacacuaaaaacagagcagcagugaucauuacauua

SEQ ID NO: 4183895 - RNA, 98 nt, Human
uaauguuuuuguuguguuuguguucugacauguuuucaagauuuauaauuuaguuguguuucugugauauguaaacaggaaguagaggagggauauua

SEQ ID NO: 4183896 - RNA, 123 nt, Human
uaauuagauauucucuaaaauauuaggaugaguuaauucauuuuuaacaucauggauuuaggaaggugauucuauaaauccuaaggagaauaugauuuacuuggaauugaagaggaauaauua

SEQ ID NO: 4183897 - RNA, 76 nt, Human
uaauuaggagccaguuuagaccucaguugcuugaugagguagcuucaacuguugucacgaauguggcuccuuuuug

SEQ ID NO: 4183898 - RNA, 77 nt, Human
uaauuauaauuguagacauuugucaagaaugacucauuuggccaauggaguguuggcaaauguuuacuuaauaauua

SEQ ID NO: 4183899 - RNA, 92 nt, Human
uaauuauaugaauguugaaaagucuaaguuuguaacuuggagagugucucuauucuggaaacuaaagaugaaucaacacaaaucauaaguug

SEQ ID NO: 4183900 - RNA, 82 nt, Human
uaauuaucccucuuuagccaggagcucguaacaguaaagaaucugaaguuuguucuuuguugagcaaguaggacgauaauua

SEQ ID NO: 4183901 - RNA, 62 nt, Human
uaauucaugcacuuaucugguccauuuuaauaauggccugggccagaaguaugcauguuuua

SEQ ID NO: 4183902 - RNA, 95 nt, Human
uaauuccaguugaucuacauucucaccaauguuugguaucauugauuuuguucauuuuaaacaacaugguggguguguagucauauuguggguua

SEQ ID NO: 4183903 - RNA, 83 nt, Human
uaauucugcagguuugcucuguucaaaguuaauaggucuguauggugacccauagaugagacaaaguagagacugcuauguua

SEQ ID NO: 4183904 - RNA, 96 nt, Human
uaauugaggguacaaccaguuaaguuacaaagcacuucaagugaaaucauuguuucaucaagaagugucuguauuuuaugagguaaacuaagauua

SEQ ID NO: 4183905 - RNA, 84 nt, Human
uaauugcauauugcuuuuauuucuauggacuaauguuuuaaucagucuuauuauaguagaacaagggagcagagaugccgauua

SEQ ID NO: 4183906 - RNA, 62 nt, Human
uaauuggcuauagcauuauggauuguuucuggagugaaauagucuuagucuauaguuuugua

SEQ ID NO: 4183907 - RNA, 66 nt, Human
uaauuguacaacaggauugauguaccaccucugccuaugagagugguucaguauguuguuaaguua

SEQ ID NO: 4183908 - RNA, 56 nt, Human
uaauuguauggagaaggcugcaagacaggcacuguggucuucaguagauacaguua

SEQ ID NO: 4183909 - RNA, 56 nt, Human
uaauuuaauuguguggugcugggguguuuuucccccuagcaaauacaucaaaauug

SEQ ID NO: 4183910 - RNA, 85 nt, Human
uaauuuacggcagcucaggaaaggccaugcaagggcaaggggcaaugccuuuaguuauuuucuuggggaauuuguccuuaaauua

SEQ ID NO: 4183911 - RNA, 60 nt, Human
uaauuuauaguugcaguagggguagauaaagaugucaugugucugcugcagcuguuguug

SEQ ID NO: 4183912 - RNA, 85 nt, Human
uaauuucugucagagaaagcacuaaaagagaauccuggucaaaggagaggauucuuucaggggcuucuuuauuuggcagauauua

SEQ ID NO: 4183913 - RNA, 129 nt, Human
uaauuugcugcaugaccuuggcaggacccaccgggcuugcaggaucuuuucucugugcacugaugggaugaggcuggaucucuguugccuucauucgugcuguuuaugccaacaggguuugcaguuuua

SEQ ID NO: 4183914 - RNA, 61 nt, Human
uaauuuuacuuccugagcaccuuucuuuccuccaaaggcugcaaaguucaggauagaguua

SEQ ID NO: 4183915 - RNA, 107 nt, Human
uaauuuucauaaucuuaaacaucauguaggaguuuguuuaguaaauuaguaguuauuagcuuauuugauuaguaaaccuguacauguuuagaagauucagauaauua

SEQ ID NO: 4183916 - RNA, 58 nt, Human
uaauuuugucacagugacaugcccugucacagggcguauguguucuguuauacaguug

SEQ ID NO: 4183917 - RNA, 94 nt, Human
uaauuuuuuaauugauacaaaauuguacauauuuaugagcgacacagugauguuucaauacauacaauguauaguggucaaauuaggguaauua

SEQ ID NO: 4183918 - RNA, 102 nt, Human
uacaaaaacuuagccaggcaugguuguccaagcuacuuaggagucugaggugugaagaucacuugggcucaggaguuugagaccagccuggccaacacugug

SEQ ID NO: 4183919 - RNA, 130 nt, Human
uacaaagauguagaagaggaggugauguagaguaaaggccagaguacuagaggcuggauguguuaaauaucagcugugugaccuuggccaaauuauucaaauguucuggcuucaguuccuguaucaaaaa

SEQ ID NO: 4183920 - RNA, 64 nt, Human
uacaaagauucauuugcauuauugcauucucucuagagucauugaugcuuucugagauuuugug

SEQ ID NO: 4183921 - RNA, 58 nt, Human
uacaaaggcagguuucccaggagaaauuuauaggaaguagucuggggugugcugugua

SEQ ID NO: 4183922 - RNA, 68 nt, Human
uacaaaggcccuucggcuuccucagccccgcucagugaguguugugaaggucagcgaggggccuggua

SEQ ID NO: 4183923 - RNA, 56 nt, Human
uacaaaggcgguuuuucugggcuccuucacucugagaucaguaagaaugccuugua

SEQ ID NO: 4183924 - RNA, 79 nt, Human
uacaacagcucugagagcuagguguuauuuuuucccuuauuuuucagaggaaugacuuguagcucugagaagugaagua

SEQ ID NO: 4183925 - RNA, 62 nt, Human
uacaaggucagcuguccugagcaggucccaccagggcagguccaggugagcagaucugggug

SEQ ID NO: 4183926 - RNA, 127 nt, Human
uacaagugagaaggagaagagagccaaaaauuaauguggaaagcucuugaguucuacugugaacaaucaauuggacccauguuuuaaaauuuugagucauuuaauuuuuuuuuuuuuuuuuacugua

SEQ ID NO: 4183927 - RNA, 119 nt, Human
uacaauagagucuuucuuucaaagagcucacaguccacuggaaaaucaggaaaguauguuggugacuccaguacaaugugauaaggucuguggaauggcacauagaaagcuuuguagua

SEQ ID NO: 4183928 - RNA, 71 nt, Human
uacaauagggagguuuaggggagccaauauccaucuguucauggcuuuuauucuucagcacuccuuaggua

SEQ ID NO: 4183929 - RNA, 103 nt, Human
uacaaugguaaugaauuuacagggugagcuucagaaaauggaugcauuguugaacacuuuuuacccugaaauccauuaauauuaucaguccaucaccauuuua

SEQ ID NO: 4183930 - RNA, 70 nt, Human
uacgcauggaaauccaguucccuacucuuauagcaccucgcaugagggggaacugugauuuucugcagug

SEQ ID NO: 4183931 - RNA, 69 nt, Human
uacgcuuucucuuaucagugcacuugaagagauuugucucugagauuuguauggugagacuguugugua

SEQ ID NO: 4183932 - RNA, 72 nt, Human
uacggagaggugggcagucaugaaaucuagagagauguucucuggaguuuuuucugucugugccuuagugua

SEQ ID NO: 4183933 - RNA, 75 nt, Human
uacacugcucucuguucuuugucacugggaacggaauagacuuuucccaggaucugagggcagagaguauccgua

SEQ ID NO: 4183934 - RNA, 55 nt, Human
uacagaaaaacaucuggagccguaaauaaguugagcagcccggauacauucugua

SEQ ID NO: 4183935 - RNA, 67 nt, Human
uacagaaauacagucaggccuagguaaccaccaaaacucuuuuuaguccuagacuuuauguucugua

SEQ ID NO: 4183936 - RNA, 111 nt, Human
uacagaaauugauuugcaaauauuuugcaacuuacaaauacacuuaggagagaaggucuaauuuguucccauuuguauuuugugaaugugcagauuguuaaaauaucugua

SEQ ID NO: 4183937 - RNA, 98 nt, Human
uacagaagcuuggaagugccaguuaguagacuuuuccauuuaguaaagugcugaauaaauaaacuuuuacuacaacugguuucuuuaaaguguuugua

SEQ ID NO: 4183938 - RNA, 58 nt, Human
uacagaagcuuuugaaaagaugaggaaccuuuggaucugggaauggaagccuucugug

SEQ ID NO: 4183939 - RNA, 59 nt, Human
uacagaaguaaauaccaaaagcuucugcuaaaagauuugaagguguuugcuucuaagua

SEQ ID NO: 4183940 - RNA, 82 nt, Human
uacagaggagugagauaggcuugagcuaagagagaaccuguagguucugguuugguuugucugguuucuagcucccaaggug

SEQ ID NO: 4183941 - RNA, 56 nt, Human
uacagagguguguguaggacagucuuuaauuucuaggaacauacaggccggcugua

SEQ ID NO: 4183942 - RNA, 60 nt, Human
uacagaguguuauuacagaauccugccagaggcuuucuuuuucugcaauaacaugcugug

SEQ ID NO: 4183943 - RNA, 63 nt, Human
uacagaguuaaaguggaguuuaaauaguuuuacuuaauguuuaaauuuccaauuaauuuugug

SEQ ID NO: 4183944 - RNA, 55 nt, Human
uacagaguuuuccugccaagaauucuggugacaguugucaggcaauaaaauugua

SEQ ID NO: 4183945 - RNA, 65 nt, Human
uacagauuccugggcuccuccuggcgauuuuaauucaguaggcuuaagaggaucagaaaucugua

SEQ ID NO: 4183946 - RNA, 64 nt, Human
uacagcaacuccuauauugaaagccuggaauucuggagcuugaugauaccuaggagauguuuua

SEQ ID NO: 4183947 - RNA, 62 nt, Human
uacagccaucauguauguauauuuuccucuaaccuuuuugcauguauauuuauauggcugua

SEQ ID NO: 4183948 - RNA, 73 nt, Human
uacagcuuugggaaggccccauaccugcaagggacaaagcucuagccaaaugacuuuccuggcaaaaguugua

SEQ ID NO: 4183949 - RNA, 56 nt, Human
uacaggcaaauauacuaacaucccaguuaaaacaauguuuaguauaacugccugug

SEQ ID NO: 4183950 - RNA, 59 nt, Human
uacaggcauguagcauggugauuaagaaucaaagcugggcauggugacucgugccugua

SEQ ID NO: 4183951 - RNA, 76 nt, Human
uacagguacaugccaccaugccuggcuaauuuuuuaaaaaaauuuagaaggcugggcaugguggcucacaccugua

SEQ ID NO: 4183952 - RNA, 62 nt, Human
uacaggugcaugcuaccaugucuguuuaauucucuuuuuuguagagaugggguaucaccgua

SEQ ID NO: 4183953 - RNA, 64 nt, Human
uacagguuuaggcacaacuacucagcuagaacaagcucucugagggagauggccugccauugug

SEQ ID NO: 4183954 - RNA, 78 nt, Human
uacaguaaaaaguaaacaggccccagggagguugaaagagcugcauucacaaccugggucugucacuggcuagcugug

SEQ ID NO: 4183955 - RNA, 65 nt, Human
uacagucagcuuuuuacaugugaaauacagcaaaauguauaaaugaaaaaagagcugauuuugug

SEQ ID NO: 4183956 - RNA, 101 nt, Human
uacagugagaagugaagcuugugauacugacccagaggaacugcaaaguucuccaucaacccagcuagggccuuugggaucuguaaacuucaugcucugug

SEQ ID NO: 4183957 - RNA, 55 nt, Human
uacaguggcaaguggauuuccagauuuuaaucugcauccagagguagccacugug

SEQ ID NO: 4183958 - RNA, 68 nt, Human
uacagugggcagauuauagaugaugcccuuaggguugugggguaaacauuuucaucugugcccuugua

SEQ ID NO: 4183959 - RNA, 104 nt, Human
uacaguguuuaagagaaucaccccauaauauuaaaugcuuuuguauuaauaaaucuggauguauauggcauuuuaauguaugaguauuuucauugaacacugug

SEQ ID NO: 4183960 - RNA, 95 nt, Human
uacauaaauaaaggcuuuaauuaucuacaggaguaguaaaggcuaaugauguagcugucuuugaguaauaauucugccuuaaaauuguuugugua

SEQ ID NO: 4183961 - RNA, 84 nt, Human
uacauaacaagaaugccagugguuggcccugcaggcuuggugucauggcccccaagguaccacuggagacucugguucuuugug

SEQ ID NO: 4183962 - RNA, 60 nt, Human
uacauaauaaggggcauggugucaauauaguugaaauaucuguugugccucuuauaugua

SEQ ID NO: 4183963 - RNA, 56 nt, Human
uacauacacaaaugcugaaugguggcuaaaaaucucaucagcuucuguguauugua

SEQ ID NO: 4183964 - RNA, 72 nt, Human
uacauaccuccccacauucacuucucuguccaccugggccaggugagaagccauuugaaugcgauauaugug

SEQ ID NO: 4183965 - RNA, 120 nt, Human
uacauacuguauaaggaauaaaaaacaggcuuuauuauugguuaguguugauacuguaugucuauaaaauuauucaaucauauuaaaagucuguguuuugaauucaugugcauguaugua

SEQ ID NO: 4183966 - RNA, 79 nt, Human
uacauagauaugacaauaccaugcagaaauaacauaauacagaagugugugugugugugugugugugugugugugugug

SEQ ID NO: 4183967 - RNA, 66 nt, Human
uacauagcuguuucuuuaaauguguuauaacuuuuuaccacccacaggcuaaagaucagccaugua

SEQ ID NO: 4183968 - RNA, 69 nt, Human
uacauaggagucuggugaagaggucaacuucauauggggacaaauggccuauuucaucaguucaaugug

SEQ ID NO: 4183969 - RNA, 67 nt, Human
uacauaggcagggauuaggguugauuacguaacaggcguaaucaucuguuguucccuuggaaaugua

SEQ ID NO: 4183970 - RNA, 79 nt, Human
uacauauaccuuuaccuugaccaaauaggggaaaaggugagcagaaaggucagauguuuggcaagaagaggaguaagua

SEQ ID NO: 4183971 - RNA, 60 nt, Human
uacaucaaggaacaccugguaucagugcacgccaucauugaugcugguaaccuuggugug

SEQ ID NO: 4183972 - RNA, 55 nt, Human
uacaucacaaacaugaagugucggccaauagucaggcauggcauguagugaagug

SEQ ID NO: 4183973 - RNA, 66 nt, Human
uacaucacagagacagaucuauuuugccugcagcaaaaugcuaggcacaugcucaauguguaugua

SEQ ID NO: 4183974 - RNA, 67 nt, Human
uacaucacaggcauuuugaguguccaccuugaccuuuuuucaggggcaacucaaaugcugugcugua

SEQ ID NO: 4183975 - RNA, 81 nt, Human
uacaucccacacucgaugcuggaaugacagcugcugccuguacaccagcuucugucuaccggcgugaaacuggaagaugua

SEQ ID NO: 4183976 - RNA, 57 nt, Human
uacaucccagccagcagaaucagaaaucuugaauuugguccugcugccuggggugug

SEQ ID NO: 4183977 - RNA, 76 nt, Human
uacaucguugcauaucuuaccuaaaaacaggcugaauuguguuugucucuuagucuuauauguaaaaggagaugua

SEQ ID NO: 4183978 - RNA, 61 nt, Human
uacaucuguaugugcacauguaucauguacuaauagugcauaauaauuccacuacagagua

SEQ ID NO: 4183979 - RNA, 58 nt, Human
uacaugaccuagacuugcuaaaaauacuaauaauuuucgaagggcuuuagguggugua

SEQ ID NO: 4183980 - RNA, 64 nt, Human
uacaugagauaauaaauagcuuucuuauuuaaggcaacuugaagcaaggauuauuguucaugug

SEQ ID NO: 4183981 - RNA, 63 nt, Human
uacaugcaauuuuuucuugucaguuacuccucaauaaaacugggaaggaaaggaauguaagua

SEQ ID NO: 4183982 - RNA, 68 nt, Human
uacauggaaagaacauggacugugggguuaaguaacuuagguucagugucuuguucugcugcugugua

SEQ ID NO: 4183983 - RNA, 84 nt, Human
uacaugucaaggauaggcuaagugaauuacauguauuuuuaaggcuauugugccuuagugacauguauucuucauggcacugua

SEQ ID NO: 4183984 - RNA, 74 nt, Human
uacaugucuggggcuggcugggguuggcugaccuagucuggccuugccucaauagcuccaccucaaaacgugug

SEQ ID NO: 4183985 - RNA, 65 nt, Human
uacaugucugugugucgaaaagauuauaguuguaagaguugacaaaacaacacagauuucaugug

SEQ ID NO: 4183986 - RNA, 68 nt, Human
uacauguguucuguuucaaguuaauuugguuugcugaugaaaggucauugaagucagaaauauaugug

SEQ ID NO: 4183987 - RNA, 103 nt, Human
uacauguguuucaaauguauagcuaggaauugaaaaguggucugagcuucaaaaagucuuacuauauuuuaauacuuccauaugaauuugacuucauuaugua

SEQ ID NO: 4183988 - RNA, 94 nt, Human
uacauuaaauguacuauuacaauggaguuuuuuaagcaaaaucuaguauaaugccuggcccuuuguagacuaccaguaauuguuauuugaagua

SEQ ID NO: 4183989 - RNA, 107 nt, Human
uacauuaauuuuuuuguaaggcaauagcuuuaggaugguucucuugguguuucuauuuaucuaagccaguagguagaccugagguuuuucuucaagaaaauuaugua

SEQ ID NO: 4183990 - RNA, 61 nt, Human
uacauucaacaugucacuaugugagcugcucagggaugcaguucagugagaaugucaugua

SEQ ID NO: 4183991 - RNA, 100 nt, Human
uacauucaacuuuccuuugauuuuaaacuugaaaacuggcaaaggaauggaagaauauuucagucaugaguuguuuucaguuuucagacgaaugaaugua

SEQ ID NO: 4183992 - RNA, 64 nt, Human
uacauucguguguguguguguaugugagugcacacacacacauacacaagcguacaugaacgug

SEQ ID NO: 4183993 - RNA, 82 nt, Human
uacauucuacuuuuucacucccuuucccaguguguaauagauuaaaaacaauggguuaucucugugaagaacuuggaaugua

SEQ ID NO: 4183994 - RNA, 65 nt, Human
uacauugaauuuuuuagcauguaaguaucuucaauaaaauugcaugcaauuaaaagguaagugua

SEQ ID NO: 4183995 - RNA, 92 nt, Human
uacauugaggagggguauaauaauuuuuuucaauuaaaagaagucauacauuucucaacuuugagaaacauuguucuuaccuucccagugug

SEQ ID NO: 4183996 - RNA, 68 nt, Human
uacauuggccuacggaagcuacugauguauauuaucuaugauagcagaaaccaagcuucuucaaugug

SEQ ID NO: 4183997 - RNA, 59 nt, Human
uacauuguuccagcgauagagaagcauuucugguuuuugauuugcuuugaacaauagug

SEQ ID NO: 4183998 - RNA, 85 nt, Human
uacauuucuacuguucaagccacuguuuguguaauucguuauggcagccauaggaaacuaauacagucuggaacauagagaugug

SEQ ID NO: 4183999 - RNA, 61 nt, Human
uacauuugauucucuccuccaacagucacauuggcucuuggcccuagaugauuaaguugua

SEQ ID NO: 4184000 - RNA, 62 nt, Human
uacauuuguguguauauccuuccagaaauuuuuggcgcauuuauauacacaguacauaugug

SEQ ID NO: 4184001 - RNA, 90 nt, Human
uaccaauucaaaugaguuuguucuauuauuugcgugcgucuuaaaacacccaaaucagaucagagacaggcuccugguugaaauuuggua

SEQ ID NO: 4184002 - RNA, 61 nt, Human
uaccacuuuaguucagacuuucauuaucuugcuggauuacugcaaagcugcugaaguggua

SEQ ID NO: 4184003 - RNA, 130 nt, Human
uaccagaguagugcuacagggucauaggaaauugugcagugcguggguguugaaaaagauuccuucuuuuagcaaaaaagcucugcguaauuaucaugucuuugcuugauaauuagcacuacuccaacaa

SEQ ID NO: 4184004 - RNA, 79 nt, Human
uacggagcauaugaccuacaaccuagcaugauugguucccacuugucauaggcauggauguggguucagaugcugugua

SEQ ID NO: 4184005 - RNA, 70 nt, Human
uacggcaaauacuguucuugacuuuuacuguaucgagugagaacuguaaggcuuagaacagcauguggug

SEQ ID NO: 4184006 - RNA, 77 nt, Human
guuucuauguuccuuucuuuuucucucugccucagaagaagcugggcagguagccuagaggagguugcggaagaugc

SEQ ID NO: 4184007 - RNA, 55 nt, Human
guuucuccacacccugggaaggcuccgcgagugccccaugggugccuggggguuc

SEQ ID NO: 4184008 - RNA, 64 nt, Human
guuucuccauaguauuauuaaacuagggggcucaucaguuuacaacaguagcuauggaugagac

SEQ ID NO: 4184009 - RNA, 96 nt, Human
guuucuccauggcaaauagacucuguuaaggguaaacagcaguaauuuaaauuucuaaauggcucuguggucuuagcaugcuuugcuaugagaaau

SEQ ID NO: 4184010 - RNA, 55 nt, Human
guuucucccuugcauaacugguugggcaauggugccagucacagggaagaggaac

SEQ ID NO: 4184011 - RNA, 57 nt, Human
guuucucuacaugcaugcagacauauguauaaauuugcauuaaaaugauggagaaau

SEQ ID NO: 4184012 - RNA, 64 nt, Human
guuucucucugccaugugcucccugcaguucaagagggccauccaugcgccagacagauuaaac

SEQ ID NO: 4184013 - RNA, 61 nt, Human
guuucugacaaauucugguuccuguuucuuggaauccaauccuacucagaaaguuagaagc

SEQ ID NO: 4184014 - RNA, 59 nt, Human
guuucugagagccacacacagcaugagugugagugccguucuguucagcugucagagau

SEQ ID NO: 4184015 - RNA, 60 nt, Human
guuucugauuuccagugagguuaugcauguauucuuaacauuuauuggccuuucaggaac

SEQ ID NO: 4184016 - RNA, 55 nt, Human
guuucugccaucugaaaaucuuguuuggaguuugaaacagggcagaagcggagac

SEQ ID NO: 4184017 - RNA, 66 nt, Human
guuucuguaagacugaauugacuucacuaugaaauaaggcuuucucgguaucaguccugcagaaau

SEQ ID NO: 4184018 - RNA, 117 nt, Human
guuucugugguucucauauggaaauaguuuacacaugcucacuuauuuguucagcaaacaucugagugcuugcugugugcaagaaacuguguucaauacugugaagacuacugagau

SEQ ID NO: 4184019 - RNA, 56 nt, Human
guuucuuaaauguagcaggaccuaagaaguccuagcuccugguauucuuuagagau

SEQ ID NO: 4184020 - RNA, 57 nt, Human
guuucuuagguaaauucuuugagcugagagacaaguuagagaauucccuuuggagau

SEQ ID NO: 4184021 - RNA, 75 nt, Human
guuucuucaguuacucaacagagguggauagaguacuggcuccgugccaaauuacauggguaaacacuggagaac

SEQ ID NO: 4184022 - RNA, 81 nt, Human
guuucuuuaacucauggcugaaacaguaacacagaagacauaaaccucaaaucugugucugggucuguaacauggggaaac

SEQ ID NO: 4184023 - RNA, 113 nt, Human
guuucuuuaccauuuucauaacuucguagagaaucagacuguaauuucauuggugaaaagcuaagauucuuaaauuuguuucucuuugaaagauaaugaaaaccuaaagagau

SEQ ID NO: 4184024 - RNA, 66 nt, Human
guuucuuuccuguggguuuugcucauuucacccaucuuaucuguaaacuucccaggaacagggaau

SEQ ID NO: 4184025 - RNA, 57 nt, Human
guuucuuucuauugacugaacacccccucugguguuguguuuauaaauaguggagac

SEQ ID NO: 4184026 - RNA, 68 nt, Human
guuucuuuguuugauaaguaugcugcacuucacgacaggugaguauucuagcuuauuagcagggaggc

SEQ ID NO: 4184027 - RNA, 86 nt, Human
guuucuuuugcuggcuacucaaauuuuuaguaagaauuucuccauaugaaugagagaguugcuaccaagaugcuagcaaaggagau

SEQ ID NO: 4184028 - RNA, 62 nt, Human
guuugaaacaugcaccuggaggaauuuaucugugaagaguccuuucagaguuuguuucaagc

SEQ ID NO: 4184029 - RNA, 67 nt, Human
guuugaaaugagcaaacugucagcuugccgauuaccaugcacacaguauaugcucauuaaaucaugc

SEQ ID NO: 4184030 - RNA, 63 nt, Human
guuugaagcuaaugucauuucagucucauuuggaggcuucagagauuucacuaguuucuccac

SEQ ID NO: 4184031 - RNA, 88 nt, Human
guuugacccuugagcagagguugcccuuggugaauucgcuuuauuuauguugaaucacacaaaggcaacuuuuguuugaguaucaaau

SEQ ID NO: 4184032 - RNA, 67 nt, Human
guuugagcaguuuaaaucuguauuuucuaucuaauugauguguugcaagaggagacuguacucagac

SEQ ID NO: 4184033 - RNA, 62 nt, Human
guuugagggaggaagcuugugggcaaggccacagccguccgcaaugcaagccuuuuaugaau

SEQ ID NO: 4184034 - RNA, 95 nt, Human
guuugagguaaaauucuuagaacagugucugacacauuguagcucaggagcugugaguggaggaggcugagacuaagaaugauucuacuuuuuau

SEQ ID NO: 4184035 - RNA, 83 nt, Human
guuugagguauaugcauugauagaaaaacauggacuaaaaaaaacucagucuguauuuauauauucauugugaauucucaaac

SEQ ID NO: 4184036 - RNA, 91 nt, Human
guuugagugaguucauuuauuuauaccauugccuuguuccagaaaggauuucaggcaacugguuaaguaaauuguccaagaucacccagac

SEQ ID NO: 4184037 - RNA, 80 nt, Human
guuugaugaagguagaacauuuguagcagcugagugaucugcuuaggaccucagccaggagaguguucacagcaucaagc

SEQ ID NO: 4184038 - RNA, 70 nt, Human
guuugaugcagcagucacaggcuuuauguagugacuuaucuggagauaagagucuugacuguuguuagac

SEQ ID NO: 4184039 - RNA, 65 nt, Human
guuugauucuggccacacacuauuauucugcucuccucucugcaaaugaagguggugcuacagac

SEQ ID NO: 4184040 - RNA, 56 nt, Human
guuugcacuagcauuuguccaugugguucuuuuacacauaagagugaugugcagau

SEQ ID NO: 4184041 - RNA, 58 nt, Human
guuugcagcauucaugucucaauauguucaguauuucaggcaauucgaaguugcagac

SEQ ID NO: 4184042 - RNA, 64 nt, Human
guuugcaggugaagugcccuggaggcaggaugucugaaaacuccuucaggcucuuccccuggac

SEQ ID NO: 4184043 - RNA, 56 nt, Human
guuugcagucccacguggcauggccuccagcccaacccacaguggagacuggagac

SEQ ID NO: 4184044 - RNA, 97 nt, Human
guuugcauuauaauggagaaauguuucuaguuguaugucacugacacuauguugaaacaguggccacugacuuggaaaucacuucagauaugcagau

SEQ ID NO: 4184045 - RNA, 92 nt, Human
guuugccauuuaagccacuguuauguuagguuuucugucacacugcacaacccaaauccuaauaaugcacuagugaaguagauaaggcagau

SEQ ID NO: 4184046 - RNA, 55 nt, Human
guuugcccguugccaggugcccggguuccggcccuggcacuagcgacggccaugc

SEQ ID NO: 4184047 - RNA, 130 nt, Human
guuugccugugugugucaggcauuauucuauaauccuggaauacaagagugaaccuuggucuuauagcauuauauuccaggaagguaagacauaauaagacauuaauauuauaaauacauaaaaguacac

SEQ ID NO: 4184048 - RNA, 80 nt, Human
guuugcguguaaucuaauuacagagguuugccaguuccuacucaggagcuccccuggugacuuucugugguacugcagac

SEQ ID NO: 4184049 - RNA, 71 nt, Human
guuugcuaaugccucugaaaucacaacuuuagcuccauguaaggcugcucugauagaagaggcuuagaaau

SEQ ID NO: 4184050 - RNA, 58 nt, Human
guuuggaagaugcugcaucuuaucucccuucuuggagauuuauagcacacuucagaau

SEQ ID NO: 4184051 - RNA, 84 nt, Human
guuuggaagguagucaaauaucuggcacuuaaaugagaauuugggccucaagaucucgcuuugagggucaguugccuaucagau

SEQ ID NO: 4184052 - RNA, 61 nt, Human
guuuggaaguuaagugcagcaguuuccaaaaaaucauaacugugacauuuuuauuccagau

SEQ ID NO: 4184053 - RNA, 73 nt, Human
guuuggacaguuuguguacagguguuuccaagucagggucugauuaacugagacuuccugugcaauuccuagc

SEQ ID NO: 4184054 - RNA, 70 nt, Human
guuuggacuggaaaguucuuugcgguggggcuguccuguacauuguaagaggcuuugcagcauuccagac

SEQ ID NO: 4184055 - RNA, 63 nt, Human
guuuggcacuaugaugaggcuaucacuucugugcauauuugaucccucagaagguagccaagc

SEQ ID NO: 4184056 - RNA, 79 nt, Human
guuuggcugaccucagauuguggcuccgcuguuacucucuguguaaugugggaucguaaauuugggacaaagccgguac

SEQ ID NO: 4184057 - RNA, 88 nt, Human
guuugggagcaugguaaaguagcaaguuuagacugagcaaucaggagccuuuuuuuuggauguguuaacuuugaaaugccuuuuagac

SEQ ID NO: 4184058 - RNA, 66 nt, Human
guuugggcugggucuggaggaagggagauacuuaacugugucccagggaaggcccagcacucaaau

SEQ ID NO: 4184059 - RNA, 117 nt, Human
guuuggguuuuuuguugcuguugcuuguuuauuuguuuguuguguuuaagacguuuuacuugucccugaaauguuugucaucacacagauacacgcucaggauaagaacuaccagac

SEQ ID NO: 4184060 - RNA, 55 nt, Human
guuugguacagguucgaauaucauggagaugaguguggaagaacacuggccaggc

SEQ ID NO: 4184061 - RNA, 59 nt, Human
guuuggugguagcauuggcuaugcuuguaauuugcaaagaggaagugcugcuggcaaac

SEQ ID NO: 4184062 - RNA, 83 nt, Human
guuuguaacuggcccaggaaaagcagugccagcaacucaaaugacugcucucacugucuucuugagaaaacagcagugcaagc

SEQ ID NO: 4184063 - RNA, 59 nt, Human
guuugucaggagguugaagucaucucccgucuugagcuucaaagugugaccugacaagc

SEQ ID NO: 4184064 - RNA, 85 nt, Human
guuuguguuaagauguugccauguggggacaauaucauaauauaacauacuauucugugugugucugcacauguauaauacagau

SEQ ID NO: 4184065 - RNA, 86 nt, Human
guuuguuaaagagauuuccauauuuuguaacagugccccccuucuccugccccuguuaugauaaauuggcuagucucugugaaggc

SEQ ID NO: 4184066 - RNA, 67 nt, Human
guuuguuuuggcuucuugggaugggucauuauauguauaguggccuauaugugagaagaaaacaaau

SEQ ID NO: 4184067 - RNA, 118 nt, Human
guuuguuuuuguuucuggcagguagguagaauagagacaguuuaacaauauagucagagauugagaugauauauaguuggguuucauucuacagauacacuucugguuuauugcaagc

SEQ ID NO: 4184068 - RNA, 65 nt, Human
guuuuaauguagaacugucaggacccugugaaaauaauggguggugacagguuuaggauuaaaau

SEQ ID NO: 4184069 - RNA, 73 nt, Human
guggcagacagcauuguaagaaugaagaccugggugguuaucagaguccauguucuucagggcuugaggccau

SEQ ID NO: 4184070 - RNA, 77 nt, Human
guggcagagcuggcugguagcccugaucccacucuccacuugaaggacagcugauuaggcuccaaguaccucuucac

SEQ ID NO: 4184071 - RNA, 67 nt, Human
guggcagggugagcgucagccuuaagagggaugaugaccucuggcaggacaugcugaccaugcagac

SEQ ID NO: 4184072 - RNA, 100 nt, Human
guggcagguccgggaaguggaggccgaguucacgcagucagcacucauagcucccagcucccugcuccugagcgguuuccaugacaacccggccagccac

SEQ ID NO: 4184073 - RNA, 67 nt, Human
guggcagguggcaugacugccuacaaacacaaaguucccgggguccacaugucauagacugauccau

SEQ ID NO: 4184074 - RNA, 56 nt, Human
guggcagucgcugacagauacacuugccaccuaaguuaucuuuccaaaacugccau

SEQ ID NO: 4184075 - RNA, 82 nt, Human
guggcauucagcacuuuuuguaaagcuuugagacuacaucaaaccaaaaauagggauguaagcugaaaagucuggaaacuac

SEQ ID NO: 4184076 - RNA, 57 nt, Human
guggccaagguuuauuuugauacauuggacaaagugcagucuucugagccuugcuau

SEQ ID NO: 4184077 - RNA, 67 nt, Human
guggccacugauuggcccauccaugagucugugacacucacaguccaggaguuuccaauuaagcuac

SEQ ID NO: 4184078 - RNA, 59 nt, Human
guggccaguggugggcgcccugggcuguauguccccaucugugucugccuuugugccac

SEQ ID NO: 4184079 - RNA, 74 nt, Human
guggccaguuuugaucagagguuuaagaaacaccaugaguuugucuugucccuggagcuucuguccccuggcac

SEQ ID NO: 4184080 - RNA, 60 nt, Human
guggccauugaaagauugggaacuggauuucuagguuacaacauugauucauuuggcuau

SEQ ID NO: 4184081 - RNA, 56 nt, Human
guggcccaggcuuggcgcuggcagugaugcuaggccugggauggccuugggaucac

SEQ ID NO: 4184082 - RNA, 96 nt, Human
gugucauagauguauauucugugccaggauaucuuuaaguguguuuaaggcugugacaucuauaggccagguugauaugcacucuccaaugaccac

SEQ ID NO: 4184083 - RNA, 94 nt, Human
gugucaugcucuguccugucuucaggacccggaauuuuggggucugagugacaccagcauucacuggaccugcagagaaggacaaagcugaugc

SEQ ID NO: 4184084 - RNA, 70 nt, Human
gugucauguuaacagaggacacaucaaacucucuccaugauaguauugaccucuuugugagcaauggcau

SEQ ID NO: 4184085 - RNA, 68 nt, Human
gugucauuucacaauaucacucacacauugguuuuugucaauugagggauucagaugugaaguggaau

SEQ ID NO: 4184086 - RNA, 82 nt, Human
guguccagaaaguguccagccugcacagggugcauugcaggcagucccagcacgcucucaggccagggcaugaacuguauac

SEQ ID NO: 4184087 - RNA, 130 nt, Human
guguccagcacguggguggucaguagguuguccggaggcuccgugcugcugcccugggccaggagaaggaggccagggugagccucuggagcccugugcccgccuacccacaccaauccugcguccacac

SEQ ID NO: 4184088 - RNA, 76 nt, Human
uaaggauaugagauuugggaggggccagggauggaauaauaugguuugacucuguccccacccaaaucucaucuug

SEQ ID NO: 4184089 - RNA, 68 nt, Human
uaaggauuucuuucauuuugaguucuaucuuguaguaaaaccugauaguuuaaugaaugaauucuuug

SEQ ID NO: 4184090 - RNA, 72 nt, Human
uaaggcauuagagugaaagcaagcaauuuuuuaaugaaacauuuauuugccuucuuuuacugcagugcuuug

SEQ ID NO: 4184091 - RNA, 81 nt, Human
uaaggcccuucacagagucucagggaugaaagcauggaguuggugcuaucauuauuaccgugaggcccucguauugcuuug

SEQ ID NO: 4184092 - RNA, 75 nt, Human
uaaggccugucuggggcucagccaaacuggggaguaguacacgagaagaggaauggggagcccuagaggguuuua

SEQ ID NO: 4184093 - RNA, 100 nt, Human
uaagggaaaaagucuggagauggauguguguguuuguacugccugcgaaguggucaguagggaaauaggcuuauauaaaaacaucugacucuuuuccuua

SEQ ID NO: 4184094 - RNA, 88 nt, Human
uaagggaaaggagccaacuuugugucuguuaauaauuauucccacugaaugaugcaagucagauauaauagacuacucuuauuuuuua

SEQ ID NO: 4184095 - RNA, 83 nt, Human
uaagggccgggcgcgguggcucacgccuguaaucccaacacuuugggaggccaaggcaggcggaucacaaggucaggcgauug

SEQ ID NO: 4184096 - RNA, 83 nt, Human
uaagguaggcuauuuggaacuuauaauaaguuuucugguagaaacaauauccaaagaguuccaugaguuucaggcucccuuua

SEQ ID NO: 4184097 - RNA, 55 nt, Human
uaaggucauggugaauaauaagcuaauagacaaaguauaugacaucaugaucuua

SEQ ID NO: 4184098 - RNA, 128 nt, Human
uaaggugagcagcugggaaccucugauuauaaaauucuguaugccaauggguuuuuuguaguaaaaaagaguuauuuguuagaaaugcauuagcacauauagguauucgauucaaaagcugugauuua

SEQ ID NO: 4184099 - RNA, 93 nt, Human
uaaggugaugcugaauuaguucucccugcauacacauaucacuccuaagcaugggacagacagugugagugaggcugaggaaguaugauguug

SEQ ID NO: 4184100 - RNA, 62 nt, Human
uaagguuuauaggaaauuuguuccugacccaagggucagagaauagcuuacuaugaauuuua

SEQ ID NO: 4184101 - RNA, 99 nt, Human
uaaguaaaauagacugguaacuaggauacaaauucuguaauuuaacaucucagaauugaaaagugcauuguuuguguuccugcagucuguucuuucuug

SEQ ID NO: 4184102 - RNA, 64 nt, Human
uaaguagaguucauaccaggccuggguugaucuauccacgccugggagaaugaccuccaacuug

SEQ ID NO: 4184103 - RNA, 59 nt, Human
uaaguaguuuguagccccauaguacaaguaugacuuggcauggaguugagaauuacuua

SEQ ID NO: 4184104 - RNA, 118 nt, Human
uaagucacacagcgaugcuuaccugcaaaggaggaugggaaagaagcaaguguccagcuuuuuuccagucucuuuugugcagauuggacaaggaagauagacauggcugaguuauuua

SEQ ID NO: 4184105 - RNA, 64 nt, Human
uaagucucaguuugaaugcugacacugacauucacugacagugugacuucaagcuggcuacuua

SEQ ID NO: 4184106 - RNA, 82 nt, Human
uaagucuguucauucagcuggguaggagguucaugucaaugaaagacccucuuucuagguuuaugaauggagaauagacuug

SEQ ID NO: 4184107 - RNA, 72 nt, Human
uaagucuuugcuauugugaauagugccgcaaucaacauacgugugcaugugucuuuauagcagcaugauuua

SEQ ID NO: 4184108 - RNA, 80 nt, Human
uaaguggugugacucauagcucucaguuuuugguagacagcugaagccagagaacauucagagcuguagacaaacacuua

SEQ ID NO: 4184109 - RNA, 55 nt, Human
uaagugucccuauugugauuuuagaugugucuuucccccacugugggggcauuua

SEQ ID NO: 4184110 - RNA, 61 nt, Human
uaaguguucugcugaagcagccacauuagaauagccuguuuggcagcuugggcagcaguua

SEQ ID NO: 4184111 - RNA, 128 nt, Human
uaaguuacugauuaucaaaacuacagaaaaagcugaaacauuagccuaaacuggugauuaaucccccuaagccuguuaucuauuguauuaguuuuuuaucacugcuguaacaaauuaucacaaauuua

SEQ ID NO: 4184112 - RNA, 63 nt, Human
uaaguucuuucuuaaaaggaaacucguucuaauucauauuuuucuucucgaagagggagcuua

SEQ ID NO: 4184113 - RNA, 84 nt, Human
uaaguuuaggaagugaagagauuagaaaucaagcauauguagguuugaauucuggcccucucacuuauugacuacauaaacuug

SEQ ID NO: 4184114 - RNA, 79 nt, Human
uaaguuugugcuugguguaggguagcucaggcaguuggaagaaacaacaugucuggguauucacaaggacacugauuua

SEQ ID NO: 4184115 - RNA, 96 nt, Human
uaaguuuuuuucccuugcuucauuagugucuuaguccauuuggguugcuauaacaaaauaccauugacuggguagcuuaugaacaacagaaacuua

SEQ ID NO: 4184116 - RNA, 80 nt, Human
uaauaaacauuucuuaguaucuuuugauacauagaacagacucuugcuugaguauuaggaaauaugaagaaaguuuauug

SEQ ID NO: 4184117 - RNA, 62 nt, Human
uaauaacacuguaaaaauuguuuggcguaguugcagauaagguuaggauuauaguguuauua

SEQ ID NO: 4184118 - RNA, 70 nt, Human
uaauaauacuugccuuuauguccugcaugcucugagagugucagaguguuauaaaggccaaguuuuauug

SEQ ID NO: 4184119 - RNA, 72 nt, Human
uaauaauuugagaagaaccaacugaaguuauuggguuugagaaaaacaauuugguuccuucugaaaguauug

SEQ ID NO: 4184120 - RNA, 98 nt, Human
uaauacaguaucauuuugguuuuguaaauuagcagacaaauuggaaauauaucauacaaggcuccuguaucuuuacagaagagaaggaugcuuaauua

SEQ ID NO: 4184121 - RNA, 127 nt, Human
uaauaccugggggagagucacuaaccucuguucucuggugaucaaucaccucggcuacguugugcugacaaugucuggaggucaucugguuaaugagacagcacuagaaaauuccuucccaggauua

SEQ ID NO: 4184122 - RNA, 82 nt, Human
uaauagaaagaaaugcaaauauuaaugguaugacucuguaaaagggaguuauauuuuguuauuugcuuuaacauuucuguug

SEQ ID NO: 4184123 - RNA, 56 nt, Human
uaauagaaauaugggugaagggaacguauuuuuuucauucauacucuuuucuauua

SEQ ID NO: 4184124 - RNA, 77 nt, Human
uaauagccugcugaaggagagacguguguguagcaggauguguugcuacaaagaauuucucuagcucuuuguuguua

SEQ ID NO: 4184125 - RNA, 82 nt, Human
uaauagcugguaacuuacagggccccuuuaaaaggaaucauuuuaucuuuauagaccaccuugcaaguuacagaugcuucua

SEQ ID NO: 4184126 - RNA, 76 nt, Human
uaauagggaaccaaauucucuuacuguuugacauaacaaaguuaugaguuuguuaugagaguuugguuccauauua

SEQ ID NO: 4184127 - RNA, 82 nt, Human
uaauaggggguguaguagguaccugguuaucucauacucguuaacauuccuuugagagucagggaacuacuucucccuauug

SEQ ID NO: 4184128 - RNA, 76 nt, Human
uaauaguuggaaauauuggguaauaguuggaaagggaacuuuccaaaacugauacucauauauuugcuggagguug

SEQ ID NO: 4184129 - RNA, 96 nt, Human
uaauauccuaguucacagacuccaugaaucugagccucgguuuccucauauugaaaugugggucauaguaucguguuaagagcuguuaggagauug

SEQ ID NO: 4184130 - RNA, 55 nt, Human
uaauauccuugcagcaaguguuucaguugaagccuggcagcaaacgaggagguua

SEQ ID NO: 4184131 - RNA, 63 nt, Human
uaauaucuauacuggggauugcggagucugaaucuuugugucugccccaaaguuuagauguug

SEQ ID NO: 4184132 - RNA, 110 nt, Human
uaauaugaggggauaucugaauaaagggauagaauugaauguaugaaaaggaaguaaaauacgaguuaauauucaaguuauucuuucuuccaguuuccuauucacuauug

SEQ ID NO: 4184133 - RNA, 76 nt, Human
uaauaugaggucucugcaguucuuaaauggcaaguucauaaauacaugccaggcuguaaacaccuucaaaauauug

SEQ ID NO: 4184134 - RNA, 129 nt, Human
uaauauguagagcaucucaagaguuggcaagaucuugucuuggcuuugagaagccacaaaccucccucaucugcauuuucugggggccaggacagugguaaaaacggcugcucucucuacccgguauug

SEQ ID NO: 4184135 - RNA, 57 nt, Human
uaaucacaucaggguaaaugggguauccaucaccucaagcauuuauccuuuguguua

SEQ ID NO: 4184136 - RNA, 92 nt, Human
uaaucacauuuugaagaggcaauuauacuagguuuuggaauuuuggcuaccccagggacucacaucugugugauugucauuuucugugauua

SEQ ID NO: 4184137 - RNA, 64 nt, Human
uaaucacugugagucuguuuucuuacccacaaaauggaaagauaacuccuucaucacaggauug

SEQ ID NO: 4184138 - RNA, 82 nt, Human
uaaucaggcuuguaauuauguuaauugcuggagacuuacaucaauccuccagcaaagugauaggauuucaggggaacgauua

SEQ ID NO: 4184139 - RNA, 115 nt, Human
uaaucauugaaaaaaaaaauaugcucacaauauuuaugacauuggugcaugauauucugaaauguaacaaaugguauacaugucaaugcgauguaauauuuaucuucaaugauua

SEQ ID NO: 4184140 - RNA, 67 nt, Human
uaaucccugaaacauaauagaugcccaguaaauaacugacagguguacacaguguuauuagagauua

SEQ ID NO: 4184141 - RNA, 77 nt, Human
uaaucuccccucugacacauccauucaacuagacuaaauccaauauugacauuuguaucuuaggggaaaggagguua

SEQ ID NO: 4184142 - RNA, 76 nt, Human
uaaucuuauaggccaucuaaguaauuuugguaauuuuuaauguagcaaaauuacucaaguuggcuuuauuugguua

SEQ ID NO: 4184143 - RNA, 74 nt, Human
uaaucuuggagucagaggaaggcuugcucugggugacauuccuggaaaguucugcucugauuggcuugagauug

SEQ ID NO: 4184144 - RNA, 92 nt, Human
uaaugacagcagagguaauuggcauuuuccuguuuaucuucauagcaugguaaacagguagggacucuaacuugccuuacaugcuguaauug

SEQ ID NO: 4184145 - RNA, 55 nt, Human
uaaugacuugaaggacccauggcacacccauguggagacuuccagcaggacauua

SEQ ID NO: 4184146 - RNA, 118 nt, Human
uaaugaugaaaaagggaaguuaggcaguuucuuaauagcaggggccaauugagaguaagagaaaaaaauugguagugcuauugaaagcccuguuucuucccucauucucaggucauua

SEQ ID NO: 4184147 - RNA, 58 nt, Human
uaaugaugugugcaaacugaauucacaguaaugugguuucuauuuguaccguacguug

SEQ ID NO: 4184148 - RNA, 126 nt, Human
uaaugauguucugugacuuucaguauagcacggggggaauauuuagggggaaaaaaugaccugcuuaaauagucaaaucaguggcaauuauugagauaacagucauucaaucaucuaacgucauua

SEQ ID NO: 4184149 - RNA, 70 nt, Human
uaaugcaugauaguuauguaagaggucaccaucggugggagaugagugauggguacauuggcuugcauua

SEQ ID NO: 4184150 - RNA, 130 nt, Human
uaauggaacuuagaauguuagaauauuguaauauucgaagaauguuagaauauuguaauauucgaagaauguuagaauauuguaauauucgaagaauguuagaauauuguaauauuggaaguuccauuua

SEQ ID NO: 4184151 - RNA, 68 nt, Human
uagcagauguucccuggucccuuuuccuggauuggggugaggaaaggggaccaggggacaccugucug

SEQ ID NO: 4184152 - RNA, 87 nt, Human
uagcagcacaauguaauugaggaauggauaagaaccaucugagaauuuacuggucuuuuccuauugauucuguuacuugugauucua

SEQ ID NO: 4184153 - RNA, 74 nt, Human
uagcaggcauggagaugacuguguagaacccucuaaaucacacuaaccaguccugucuuuaugacuucaagcua

SEQ ID NO: 4184154 - RNA, 105 nt, Human
uagcagggaugggcugggggugccagggcugcuacuggcugaaagucauuuuagggaaauuuauugggugagcaagcucugggccucccuccccaucuccugcua

SEQ ID NO: 4184155 - RNA, 64 nt, Human
uagcaggugcucauuuaacuccuuuauuuauguccuugggagugcuggugaaggcacacuguug

SEQ ID NO: 4184156 - RNA, 57 nt, Human
uagcaguaguagauuauaugagaccaugcaugguucauaagugcucaguuacuguua

SEQ ID NO: 4184157 - RNA, 58 nt, Human
uagcagucauuguggagccugcuguguguccuugccaggcucuaaggagggcugucua

SEQ ID NO: 4184158 - RNA, 89 nt, Human
uagcagugucuuuacuauucacuguggguccuuuggauaguuuaugcuaaccaggugacucauggugagccccuagauaguuuuugcua

SEQ ID NO: 4184159 - RNA, 75 nt, Human
uagcauaugguagaaaucauucccaaacccauaucuucugaguaugagguucagaaagguugaauguuguaucua

SEQ ID NO: 4184160 - RNA, 77 nt, Human
uagcaugagucgugugguuugcagaaaucucuggcagguuuggaccaccagaagauggcucaaaccaugcucugcug

SEQ ID NO: 4184161 - RNA, 58 nt, Human
uagcaugcucaggaaaugcugcagaguggagcaguuaauagauuucccagcagugcua

SEQ ID NO: 4184162 - RNA, 78 nt, Human
uagccaacagaguugaaaauuaagugaauuucaagugaagucaggugaagucauuccauauucaugacucgaugucua

SEQ ID NO: 4184163 - RNA, 55 nt, Human
uagccacaggccaugagauaccagggggccguuccuuggauggagccugugguug

SEQ ID NO: 4184164 - RNA, 92 nt, Human
uagccagagccuguuuaaaauacuuguggccaauguuuguuauacugugguuccccuguagcauguaaauugguuauuaaguacugugguua

SEQ ID NO: 4184165 - RNA, 69 nt, Human
uagccagcaaggcugcugaugacuaggucuuuuagguauuucuaggagccaaauuacuagcucugguua

SEQ ID NO: 4184166 - RNA, 62 nt, Human
uagccucaguagauccacaagugaaagguauacuccuucagcacaugugaauuacugaacug

SEQ ID NO: 4184167 - RNA, 71 nt, Human
uagccugaggccaggaccauuagcccagaucuuucccaccaguucugcugaucguuucccuggcccugcug

SEQ ID NO: 4184168 - RNA, 67 nt, Human
uagccuuauuuuacuuggauucugauugaaauauguucuccucagaauacaggaugaaacaaagcua

SEQ ID NO: 4184169 - RNA, 84 nt, Human
uagccuucacaaggccuccaucucccaggcauucuaaccucugaagaaagcucucuguccccuggacugccuguguggagggua

SEQ ID NO: 4184170 - RNA, 86 nt, Human
uagccuugggugaguuuuguaauauucaagaucugcaugaguaaaucacucauuugauaaugcugcaacagcucaucugaucccua

SEQ ID NO: 4184171 - RNA, 73 nt, Human
uagccuuugguggugaccauuaguccauggcaucccuugaccugcaguggcaguggcaucaccccaauaucua

SEQ ID NO: 4184172 - RNA, 91 nt, Human
uagcgauuauaaguacuugccuaggucaauauggaauucuaacaguugaacagaauguccuuuguaucccuaggcagacaaaauagagcug

SEQ ID NO: 4184173 - RNA, 71 nt, Human
uagcgcuucauguuuguaggacugaggccucagcuccugaaggaugccugccuuugccugcgacguggcug

SEQ ID NO: 4184174 - RNA, 79 nt, Human
uagcguuaauugcugaaaugaaaggauaugggucuguguaauugaaacauuugcuuuuauuugcaguaaucauuugcua

SEQ ID NO: 4184175 - RNA, 76 nt, Human
uagcuauaucaguauuuggcuugauucauguucaauauugacaacagcaugucuaguuaaauacugcucgcagcug

SEQ ID NO: 4184176 - RNA, 60 nt, Human
uagcuaucaaaccaggaguuugcuacuaauuuagguauguuaauuuauucaugauagcua

SEQ ID NO: 4184177 - RNA, 63 nt, Human
uagcuauucaguaagccaaaaccaugguuuucauaagcaagguaaaaauuuacugaaugccua

SEQ ID NO: 4184178 - RNA, 60 nt, Human
uagcucauguaauccgaacauauuccauuaacucuauggugauuucguuuucaugagcua

SEQ ID NO: 4184179 - RNA, 77 nt, Human
uagcucucugucuguuauugguguauaagaaugcuugugauuuuuguacauugauuuuguauccugagacuuugcug

SEQ ID NO: 4184180 - RNA, 72 nt, Human
uagcugauauacaguguagaauccuguacuuagaaaugaagaucugaguugaacuccacuguguauuaauug

SEQ ID NO: 4184181 - RNA, 77 nt, Human
uagcugcagcugcucuucauuuccccccagcaaaacaagaggaaauggaugguggagaugguggagacagcuuccug

SEQ ID NO: 4184182 - RNA, 83 nt, Human
uagcuggaguaggcuauguggucauauaagauaaauaaucauacuuuugauuuauaaagauacuauauagcuuucucuugcug

SEQ ID NO: 4184183 - RNA, 105 nt, Human
uagcuggcugugguggugugcaccuguagucuuagcuacccaggaggcugaugugggcuugagccugggaggcugaggcugcagugagccaugaucaugccacug

SEQ ID NO: 4184184 - RNA, 58 nt, Human
uagcugggccuauacagcuggguauaaugacuauuuuaguguaaggcaggcacaguug

SEQ ID NO: 4184185 - RNA, 70 nt, Human
uagcuguaacacagcuaauaacacucuccaagcuguaacacagcacagucuccuagcuguguuucagcua

SEQ ID NO: 4184186 - RNA, 61 nt, Human
uagcuguauaagcaauaugcaaauaugggaaaauaauguaggcaguguguaugaauagcug

SEQ ID NO: 4184187 - RNA, 69 nt, Human
uagcugucaccagaaauggccauugguagacuccuugacuugcuccugggccuuucugagugacagcug

SEQ ID NO: 4184188 - RNA, 113 nt, Human
uagcuguggggcauggccagcauucggucuggcuguuauacgcuguggugguacuuagcuugugaaccaggccugauaggugagacugggcaugcacuucuacucacaggcua

SEQ ID NO: 4184189 - RNA, 55 nt, Human
uagcuguuacccauaaaagccaaauuugagguuugguaugcaugauugacaguug

SEQ ID NO: 4184190 - RNA, 67 nt, Human
uagcuguuucagugcagcagaaggcuuccuuuaugucuauuucaacugcagcauuggaacaugucug

SEQ ID NO: 4184191 - RNA, 121 nt, Human
uagcuuccaggaauggcaggcauacagaccccaaauuuucacuggaaaugcacagcuguagauguuagcaucugagugaauaagguccaugacagguuuucuggugcccagccauuuucua

SEQ ID NO: 4184192 - RNA, 57 nt, Human
uagcuucgagucaaaagacacaguuccagucucagcugugucacuaacuagaggcua

SEQ ID NO: 4184193 - RNA, 66 nt, Human
uagcuugacuguuuuuuguuccugaaggggaaaucucccucugggccuggaagggcagugcaucua

SEQ ID NO: 4184194 - RNA, 63 nt, Human
uagcuugccaggcucugguuccagcccucgucucaggggcacauggagacuuggcaucaccua

SEQ ID NO: 4184195 - RNA, 89 nt, Human
uagcuugguuuuaugaccuggcugguugugauucccauauauuaauaaguggguucauggucaggacuuacagggccagggccagggug

SEQ ID NO: 4184196 - RNA, 55 nt, Human
uagcuugugccauuuacugcauggcugaaaguuccagugcaagaaagcacagcug

SEQ ID NO: 4184197 - RNA, 83 nt, Human
uagcuuuaaaacaucuuugauaaacuuagugaugaauguggcguuuugaaguaauuauuaguuuguuggagagugggaaguug

SEQ ID NO: 4184198 - RNA, 63 nt, Human
uaggaaaagugaugugaaaaugccuuccaaauggaaagcacuguacaaaugucacuuucccug

SEQ ID NO: 4184199 - RNA, 130 nt, Human
uaggaaaauagguuguaacauaaauugcaaaugaguuguaacauaaaaaauguaaccuuaugcaccuuuuuggagagucguuuggcaacaguuuauguaacggaaacuuacaaaaauaucuauucacuua

SEQ ID NO: 4184200 - RNA, 75 nt, Human
uaggaagccucugcucuggggcuccccaccagagagacuuucuugggauugcccugcaguucgggaugcuuucua

SEQ ID NO: 4184201 - RNA, 83 nt, Human
uaggaaggagcaaaggccaaguuagaagaggauaccugccuccugacuccuuggggggcucucuuuuuggccugcccuaccua

SEQ ID NO: 4184202 - RNA, 82 nt, Human
uaggacacuuguucauuugcaacaaccaaauaugggccuuuuagucacuauagaugguugucgcaaaugaaugauuguuuug

SEQ ID NO: 4184203 - RNA, 68 nt, Human
uaggacaguauguucuuccaggacagaacauucuuugcuauuuuguacuggaagaacaugcaaaacua

SEQ ID NO: 4184204 - RNA, 70 nt, Human
uaggaccagcagggucagggucugcagcagagcgauuuauggaccuggcucugucugcugugugguccua

SEQ ID NO: 4184205 - RNA, 80 nt, Human
uaggacccuugcgugaacuccuaugacccacugaacucccugggaguggguggguaugagggggccucacuaggguccug

SEQ ID NO: 4184206 - RNA, 57 nt, Human
uaggacugauaaggggccagagcagguaaagccagaggcugggccauaucaguccug

SEQ ID NO: 4184207 - RNA, 59 nt, Human
uaggacuugguuugaagauuuuaauuccugugcgugguaagaucucacuccaaguccua

SEQ ID NO: 4184208 - RNA, 92 nt, Human
uaggagaccgccucaaagcagucaggcugcgcuucucugauaauggaccguuccuaugagacuggcaguagcugcugcuggccuuccucuug

SEQ ID NO: 4184209 - RNA, 87 nt, Human
uaggagauaccuugcaaagccacaacauuaguuagccagacugguucagucaucugggagacguguguugucagugguaggauccug

SEQ ID NO: 4184210 - RNA, 58 nt, Human
uaggagcagaguugggauuugagcagguucaccugacuucuccuccaaguugcuccug

SEQ ID NO: 4184211 - RNA, 69 nt, Human
uaggaggaaguuggcaauagugucaaaugcugacaucuuagcagcauuucugagccaacucucuucuug

SEQ ID NO: 4184212 - RNA, 70 nt, Human
guguccauaugucaggugugaauucaaguucaaaauuacagacaugauuuccacauagacgaauggagau

SEQ ID NO: 4184213 - RNA, 85 nt, Human
guguccaucccuaggcccaaagggugacauuuagaugguagagaaagugaauggaaccaagcuauguggucugggguauucacac

SEQ ID NO: 4184214 - RNA, 62 nt, Human
guguccaucuagaauuuauuucuagcagcauguagcuaauagcaauggagcuuagaggacau

SEQ ID NO: 4184215 - RNA, 78 nt, Human
guguccccaugaaaacagccuccugugauaagaggcaacuugauuauuaagguuucuguuuuuuccuuauuggaucac

SEQ ID NO: 4184216 - RNA, 76 nt, Human
guguccccuuugaaauuggcucauugguuugauguggaucagggaugagaucagaaagccaauaucauagggccac

SEQ ID NO: 4184217 - RNA, 99 nt, Human
gugucccuucuucccggugggggcagugggacagaugcuaggagaacacuuggagcuggccuccugacacaguccacacuugcuucccuggagggucac

SEQ ID NO: 4184218 - RNA, 110 nt, Human
guguccuagcuggaguggauccaguguccacagaagcuugagucagaaauuguaagagccuuucuccugguaugugacacugacaucugcucccuccugguaugugacac

SEQ ID NO: 4184219 - RNA, 83 nt, Human
guguccucgcgcccugugcccccgcagcgggcccucagccgggguggggacccagcuugcgggcggcaggaggcugagguugc

SEQ ID NO: 4184220 - RNA, 100 nt, Human
guguccuguaaaugcuuuuagugacuuauugaaccuugggcacauccggacccaggcuccaaggccaaagggccacugucagcauuuaaagccaggguau

SEQ ID NO: 4184221 - RNA, 58 nt, Human
guguccuuagaagaagugaaagagagucaaguucacucucuuggcugugugaggacac

SEQ ID NO: 4184222 - RNA, 67 nt, Human
gugucgcccaggcuggauugcaguggugcuaucucggcucacugcaagcucugccaccuggguucac

SEQ ID NO: 4184223 - RNA, 97 nt, Human
gugucggguggugggcaguggguaguggguggaggguuugguguuuagugucuucuuuucugucagugcccaaauuccugcccaauuacuuagacac

SEQ ID NO: 4184224 - RNA, 78 nt, Human
gugucuaagugacauucuuggagcagucaaagaaguuuccgugaauuucucacaugugcuccagaauucacaaaccac

SEQ ID NO: 4184225 - RNA, 65 nt, Human
uaguuagggauuuugaacuuacugcuugcuagagaagccggacugguaaggaaauucacuaauua

SEQ ID NO: 4184226 - RNA, 77 nt, Human
uaguuaguuauuuuaguagugacuagcucccugaaaaaaauacuuccagccacuucccauugcaaaguagcagacug

SEQ ID NO: 4184227 - RNA, 77 nt, Human
uaguuaugccuggcuaucuauuuauuucuaucucuaagcuaucuuucagaugaaauguguauauuauggcagaauua

SEQ ID NO: 4184228 - RNA, 76 nt, Human
uaguuaugucugcaugcauauuuuagccucaaagagugugucuaauuagguacuuuugaugugugagacauaauua

SEQ ID NO: 4184229 - RNA, 103 nt, Human
uaguucagggaugccuuauaauuuauaugcuauuuuaaugaagaugucuaauguuuuuggagaauuagcauaacaugaauuaagucagucaacccuggaacua

SEQ ID NO: 4184230 - RNA, 66 nt, Human
uaguucauaaauugauuaugugcuuuuguuugcuauguuguauuuaaagcauuuaguuugugucua

SEQ ID NO: 4184231 - RNA, 58 nt, Human
uaguucccagguaaggagaaggcagcuggcagauuuagggcaggccucuugggaauua

SEQ ID NO: 4184232 - RNA, 77 nt, Human
uaguucccauaauuauaaacgcaaguucagaggccccccuuaaaaugaucuuuacugcuguuuauaauaggggagua

SEQ ID NO: 4184233 - RNA, 124 nt, Human
uaguuccuuaggaaagauuuccacaugucaaauuacucagucugaggauaggaacagauuuaaggcguuaugggaaaccuaagaaaguuuguuuuuauccauaagacagucauuccuacaacua

SEQ ID NO: 4184234 - RNA, 63 nt, Human
uaguucuagggcaucaucccagacauuauuuugagaaucucuguggugaggcccuagaaucug

SEQ ID NO: 4184235 - RNA, 82 nt, Human
uaguucuauaguuguucagauaaggaacuguuggugaugacuagaaugacaacagaaggcuuuguggaguagacgagaacug

SEQ ID NO: 4184236 - RNA, 69 nt, Human
uaguucuauuauaucaguaaguggaagcuuguaaugaaggcagagcccagaaaguaugucauagagcua

SEQ ID NO: 4184237 - RNA, 109 nt, Human
uaguucugagguucugagugguggcaugacauggccugacuuagguuuugaagaugucacuuccugcugucugcuguguuaagcacuuaacugcauuuuauuagaauua

SEQ ID NO: 4184238 - RNA, 73 nt, Human
uaguucuucuaggcuuauaacuuccuggaaaacccaugugagaaauuccaaagugcuauguuuauaagagcug

SEQ ID NO: 4184239 - RNA, 64 nt, Human
uaguucuuguccucucuagcagggcuugccuugaaagaaggagcugacuagagagaaagagcua

SEQ ID NO: 4184240 - RNA, 60 nt, Human
uaguugacuuguuccuaugaaauggugcuuuggugucaugucauugguacaaauugauug

SEQ ID NO: 4184241 - RNA, 56 nt, Human
uaguugaugugaugaugcuuuucauucacuaaagaaagugcuaagucacccagcua

SEQ ID NO: 4184242 - RNA, 80 nt, Human
uaguuggccaccuugagguuccugacggugaggaagaggugcagcccuuccaggagcauccaggugaagcaagccaggua

SEQ ID NO: 4184243 - RNA, 60 nt, Human
uaguuuaauuguacauaaucaagacuugauaaauaugucuugaauuguaugauuaaacug

SEQ ID NO: 4184244 - RNA, 71 nt, Human
uaguuuaguguggaauuugucugcccucacugaaaacuccaguuaggcaaugaauuauuccaaguaaauua

SEQ ID NO: 4184245 - RNA, 60 nt, Human
uaguuuauauucaacggaguaucuaauugaaagauuaugaacgcguggaaauguagacua

SEQ ID NO: 4184246 - RNA, 99 nt, Human
uaguuucauuucagaaccauaaaugaggacaugauacuuguguucuuggcagagcuggguacugaugucuucaguugcuguucucuggaagugagacua

SEQ ID NO: 4184247 - RNA, 129 nt, Human
uaguuucuguuuccagauagaaaugggggauaauacuggaaauaguaaugcauaaguggacagggucugaccauuaaaauguuuaccauuuccagaaugaugccugcagauguuacaaaauugaaacug

SEQ ID NO: 4184248 - RNA, 57 nt, Human
uaguuuguaggauccagucuaaacugccaguauuauuaggcugggcuacaacaacug

SEQ ID NO: 4184249 - RNA, 95 nt, Human
uaguuuuaagagguauguucaaagcuuauaucagaacaaugcuuuucuauaaugagugagagaguucaaaauauaugcuuuaccucagaaaauug

SEQ ID NO: 4184250 - RNA, 89 nt, Human
uauaaaaugaaaauggaugucuacauguguucuuaagagagauaauuucuguucagacacuuuacauguauauauucagacauuuuaua

SEQ ID NO: 4184251 - RNA, 55 nt, Human
uauaaaauucucaguuugggguagaugacgcuaugguuaaaacuggaauuuugua

SEQ ID NO: 4184252 - RNA, 70 nt, Human
uauaaaccuaacugccucaucaccagugcacagcacagugccuggggaaaagcaggcauuuaaauuuaua

SEQ ID NO: 4184253 - RNA, 55 nt, Human
uauaaagacauccauagcaggcuuuauccagccagcuucuuugggauucuuuaua

SEQ ID NO: 4184254 - RNA, 106 nt, Human
uauaaaucacaggucauuuucuuaagaagcaagucucagcaaaauauuuucucauaaagaaagagaauuugaagagacaauuuggaaagcaaccuguugaccuaua

SEQ ID NO: 4184255 - RNA, 63 nt, Human
uauaagacacgccccacucacucuaaugcaugauucuaaggagcuaguagaggcugucuuaua

SEQ ID NO: 4184256 - RNA, 64 nt, Human
uauaagaccgcagaacaaauggagcuguggacaguagcucacauuuuauaucucugguuucaug

SEQ ID NO: 4184257 - RNA, 72 nt, Human
uauaagcacauccuugacugaugcaggaaucuagcuuacuccuuuuccuaaugucaggcgaugcugcucaua

SEQ ID NO: 4184258 - RNA, 130 nt, Human
uauaauaaagacaaguauuaauaacucugccuaacagucuuacagaaguagccacagagugacuaauguaugagcugguucuugaggcaugaauaggauuuagguagguggagaagaguagaagaggaua

SEQ ID NO: 4184259 - RNA, 77 nt, Human
uauaauauauugcuggaggggccucugauagcuucuagaucaggauuuauacagugccucuuccauuagauguuaug

SEQ ID NO: 4184260 - RNA, 110 nt, Human
uauaauuaaagcauauguauaugaagaguuuagugaagacaggucagauucaaagacuucagaucugaccugucuucauuaaacucuucauauacauaugcuugguuaua

SEQ ID NO: 4184261 - RNA, 81 nt, Human
uauaauuauaucuccuacauuacguaugcaacgcagacauuuucugaaacauaaauacagugugugggaaaugugacugua

SEQ ID NO: 4184262 - RNA, 123 nt, Human
uauaauuaucauauauuugaaauuguuuucagaaaauauuaucagaaaaauucuuccacagaguaauuuugguguggaaugaucugauguauuuuaugauaacuuuuagacaaugaaauuaua

SEQ ID NO: 4184263 - RNA, 73 nt, Human
uaccuguguuaucuucuugacugauggaaauaguaaggaauucaaucuaucagaguagaaggcaacguuggua

SEQ ID NO: 4184264 - RNA, 62 nt, Human
uaccuucuaggugaugguuacaugggcauacacaucaucgugcuguacacuuaagauaggua

SEQ ID NO: 4184265 - RNA, 70 nt, Human
uaccuugaaaagaaggugcucacagauacuuggagauacaggucugaguucaggcuuucacucaagagua

SEQ ID NO: 4184266 - RNA, 79 nt, Human
uaccuuucuagucuauucauucaauuuagcucuugacuggcagagagagugugaagaaagugcaauggccuaggaggua

SEQ ID NO: 4184267 - RNA, 106 nt, Human
uaccuuucucccuuuccuugcuauuuacagaaucugacauuauauuuaauaccacgcugccgguugucugcaugauucuaggcaggaaaauuggguuagaacggua

SEQ ID NO: 4184268 - RNA, 82 nt, Human
uaccuuugccucugcuagaaggucaaucucuuuuccgcuuaagaggagaucugggcuguuucuggcaggggaaagaagagua

SEQ ID NO: 4184269 - RNA, 66 nt, Human
uacggccaaagcucuggggauagcuuuuucccgcucuuugagaggaggccgauuucagaggucgua

SEQ ID NO: 4184270 - RNA, 77 nt, Human
uacggcuaugucaguauucagcaaacgugaacagaauaauuuguuuccacuagcugcaauacuugaaccaaguugua

SEQ ID NO: 4184271 - RNA, 57 nt, Human
uacgggaagggcggggagaggcuggccagggagggagguuucccagcccuugcugug

SEQ ID NO: 4184272 - RNA, 97 nt, Human
uacguaauguaacuauuaggcugggcugaacuucaucugaugauaaaugauaggucacagaaaguucaugcccaauaacagaaguagcauaucagua

SEQ ID NO: 4184273 - RNA, 76 nt, Human
uacguauauucuuugagucaguaauuccauuucuagauauguauucuagaaaaucuggcaagggaauaauauugua

SEQ ID NO: 4184274 - RNA, 84 nt, Human
uacgucauguaguaggagggugcuuacugauuuugguaucaagauacaguguuacauuuuuaucugcuccauguuaaccaugug

SEQ ID NO: 4184275 - RNA, 68 nt, Human
uacuaaaugagcuguuaggauaguuugugauggaaacugaucauacauaaauaagaguuuaguuagua

SEQ ID NO: 4184276 - RNA, 57 nt, Human
uacuacauacagaauuuagagaagaucaaacaagcuuuucugaguucgguaugagug

SEQ ID NO: 4184277 - RNA, 123 nt, Human
uacuacaucuguaugauaaagugugauagcagaaaaacuaaaauaaggaugugacauucuauguauggaccuuuucugucuuucuuugacacauuuauauuuauagaaauagcuuauguagua

SEQ ID NO: 4184278 - RNA, 119 nt, Human
uacuacauggacaugauguugagaaauccaguguuugaugggauuuucagauguguugaguuugaaauuaauuagguuccuacagauauuguaauuuucauuuucaguauaaggcagua

SEQ ID NO: 4184279 - RNA, 71 nt, Human
uacuacuaaauugaaaaucuacagaacaaaucauuuaugaaaugugugggcaugcuuuuaauuugguggug

SEQ ID NO: 4184280 - RNA, 57 nt, Human
uacuacuuugggauuucaugagagcuaaguaauacacuuaagucucuuagaguagua

SEQ ID NO: 4184281 - RNA, 60 nt, Human
uacuagacugaacccucugcugcacugccacccuuggcacaaacgagggcucagugagua

SEQ ID NO: 4184282 - RNA, 55 nt, Human
uacuauacccucuaacaccuuucaaaagaaagucccagccuuggaggauguagua

SEQ ID NO: 4184283 - RNA, 121 nt, Human
uacucaaugcugugcuucugaauauucagaaaauaaauuggauuauugguuuaguaucaaaaaaguucuucugcucugauaaucugauuugcuuucaauguguauguacuaaauuguggua

SEQ ID NO: 4184284 - RNA, 82 nt, Human
uacucaugccuggagacuuagcugagauuaagugaacuucuccaaguggaaauucucuucucaguggucucucagccuugua

SEQ ID NO: 4184285 - RNA, 78 nt, Human
uacuccucauuuuguaucacuugcaauuuugacaaaacuuccuucuuugucuaaggcauugaacaaaagaggggagua

SEQ ID NO: 4184286 - RNA, 60 nt, Human
uacuccuuaaagugcaccuccucauguucauacaugcuguuaaggagguuuuaaguggug

SEQ ID NO: 4184287 - RNA, 71 nt, Human
uacucucucuguuaccauauggaguaguuucuugacaaggaaaaaggaacacugagggaaaagagauagua

SEQ ID NO: 4184288 - RNA, 57 nt, Human
uacucuguuuagccaucaccauuguaaagaaucucuagugggagaggcaacagagua

SEQ ID NO: 4184289 - RNA, 62 nt, Human
uacucuguuuugugcagugucauauccuaagcaucuagggcagugucugcauauagcaggug

SEQ ID NO: 4184290 - RNA, 66 nt, Human
uacucuuuucaugucauguccuugaggcaaaccuccccagcaucuugucucucacugaagagagua

SEQ ID NO: 4184291 - RNA, 94 nt, Human
uacugaagccacugaauaauggucugugaucuuaucaauuuucauaaauuaagcagguugaaacuggccaauguuuagcuagcaaauuuuagua

SEQ ID NO: 4184292 - RNA, 97 nt, Human
uacugacaagguacuuaaaaguggauacuaauuauugugcaugucuauacauuuuugcaauaaguuguguuaucacucaaaagugaccuuguuagug

SEQ ID NO: 4184293 - RNA, 85 nt, Human
uacugagcccauacucugugcagagaacugugaguucucuggaugugagcagcuuacaguucaaugacaaagacagggcugugug

SEQ ID NO: 4184294 - RNA, 69 nt, Human
uacugaggcugaauucuuagcagagcagauuacauggaacugugcuaaguugagaauaaagcuucagug

SEQ ID NO: 4184295 - RNA, 59 nt, Human
uacugaugauuuuucagcagaggaucucagucagguuuguuuuggaaagaucauuggua

SEQ ID NO: 4184296 - RNA, 56 nt, Human
uacugcccuguaacugccagguacugggcuagugcuuuacauauacagcgggagua

SEQ ID NO: 4184297 - RNA, 79 nt, Human
gguaaaugacacuaggcuuuuugcacucucaaaaguaauuuuuuuuccuuggugcagggaccugucaguaucauuaacc

SEQ ID NO: 4184298 - RNA, 80 nt, Human
gguaaaugauccaaagccacaggggcagaucugccaucuaucucucaagauguggcuccugucuuugggucccaggugcc

SEQ ID NO: 4184299 - RNA, 61 nt, Human
gguaaauuuuaugugaugaaacuagguaccuccuagaaguguucccauauaacuguuuacc

SEQ ID NO: 4184300 - RNA, 89 nt, Human
gguaacaaugaaguacuacuuuaccuccaucagacugaaauagccauuucggcugcuugauauggggaaaguuuacuucaaguauugcu

SEQ ID NO: 4184301 - RNA, 63 nt, Human
gguaacaggaccccgcguggugucucugcuagagggagagacugauuggguguccgaguggcc

SEQ ID NO: 4184302 - RNA, 66 nt, Human
gguaacaggugaaaaagcaaccauauucgaaugaauguggacucuuguauuuuucacuagauuauc

SEQ ID NO: 4184303 - RNA, 76 nt, Human
gguaacauaauguuugaccaaaaaacugcaugaagacuggcuuuuagcuaugcauucuuggugacauuauuuuccc

SEQ ID NO: 4184304 - RNA, 67 nt, Human
gguaaccaauccucauguucaacaaccgccuccuuguuaagaaagguaaugugaggaauuguagacc

SEQ ID NO: 4184305 - RNA, 118 nt, Human
gguaaccagagggcagcaaaggggauugauauacuuugagaugaugcugaucgggguugggaagauacaacaaacgcaguuuuucuaaguaucccuuuugggccccuugcuggucucc

SEQ ID NO: 4184306 - RNA, 64 nt, Human
gguaaccauauuuuccauuaaguucccacuauuagaugggaacuuacagaugggagaauggacc

SEQ ID NO: 4184307 - RNA, 94 nt, Human
gguaacucaaguaauuuuucaaagucagugcaagcaguacacucaaagcccuggcucuguugucucugaauugcaacagaaaaauaauuguacc

SEQ ID NO: 4184308 - RNA, 73 nt, Human
gguaacucuguaaagcauaacguuuguuauaaaacagaaggaaaacaacaaguggguacuuuacagggaugcu

SEQ ID NO: 4184309 - RNA, 55 nt, Human
gguaacugaggccauauucugaaaucaaaaauaccaggaggccuggguauuugcc

SEQ ID NO: 4184310 - RNA, 90 nt, Human
gguaacuuaaaaauguacucaaacucacuaagacagauggucugaaauaaucugaauuaucuguggguagagugaguacuugauuaaacc

SEQ ID NO: 4184311 - RNA, 68 nt, Human
gguaacuuagcucauggcugugaaaaaccagaccgcugaccagucuuagccugugggucauaguugcc

SEQ ID NO: 4184312 - RNA, 79 nt, Human
gguaagcuuaaagucuuuacaaccuaaguugaagcugggguucacauuugaggaacuuagguugaaggaagcaagggcc

SEQ ID NO: 4184313 - RNA, 68 nt, Human
gguaaggccuuggcagaggccaggcugcuacaaaugaaauccaccuggcuucagagucuggccaugcc

SEQ ID NO: 4184314 - RNA, 81 nt, Human
gguaagucaugacuguuauuuuguugaagugauuuuuuagaauuuuuaaagguuuauucaacaaaauagaguuaucuuacu

SEQ ID NO: 4184315 - RNA, 76 nt, Human
gguaagugcuaaagacuaagagaacaggaucuggaaucagacugccuggguauaaauccugccucuuguauuuauc

SEQ ID NO: 4184316 - RNA, 93 nt, Human
gucauagcagcugcugauggccugacagacaguuuccgcagcgcuacaugaggcccuuuggugucucugucaggagauuggcagcugaaugac

SEQ ID NO: 4184317 - RNA, 65 nt, Human
gucauauaacccacugcuuugguucuuuagagaaaacgcugaggcccagagaguagguuagugau

SEQ ID NO: 4184318 - RNA, 84 nt, Human
gucauauucucugaccacuguagccacuuaagauagucucaaauaugaauaauuuucaguggccauaguggagaagaugcugac

SEQ ID NO: 4184319 - RNA, 129 nt, Human
gucaucaucaucauuuugccacaugcuaaaauaaaucauagcaauggugguauuuggagaacuaguuaaaugcuaauuucauaaaugguauccuugcugugcugauauuucugcaguugacauugauac

SEQ ID NO: 4184320 - RNA, 63 nt, Human
gucaucucaaauguuuccacuucugcuuccugagacagccaggagagcaaagcaagagaucac

SEQ ID NO: 4184321 - RNA, 76 nt, Human
gucaucucauugugaucugucuuuccuuauagucucuguucagagaaggaguguacaggucaugcagauagaugac

SEQ ID NO: 4184322 - RNA, 116 nt, Human
gucaucuggaguuuaggugaacagugcaauuucugggccucacacaagacuugaugauuuggggucuaugggguugagucccagagaucugcauugcaaugggauuuuuggaugau

SEQ ID NO: 4184323 - RNA, 78 nt, Human
gucaucuggcagucccugauugagugcaaaaauacagauugcugcugcugcucaaaucagucaggagaugccagagau

SEQ ID NO: 4184324 - RNA, 94 nt, Human
gucaucuucagugugaaggacuagcauggagggcaggagguugaaggacucguccagcaaagcucucuagccagugcuuugggccugggaugac

SEQ ID NO: 4184325 - RNA, 81 nt, Human
gucaucuugcauuucgcagauccugugguuuuccugugcaugaugcaugccccucagggaacggguaucuugcaaagagac

SEQ ID NO: 4184326 - RNA, 61 nt, Human
gucaugagcaccgaacccaugugguccagccucagggccugauggccaaccugcuuaugac

SEQ ID NO: 4184327 - RNA, 61 nt, Human
gucaugauugggggugggcaggagccagggaugcugcugaacaucccgcagugcacgagac

SEQ ID NO: 4184328 - RNA, 74 nt, Human
gucaugcagcagcuguucuugggacagacaggcugggacacucacgucaaggucugccaggauagcaugcaggc

SEQ ID NO: 4184329 - RNA, 71 nt, Human
gucaugcaugcaaaugugcuaaucugaauccuugaaaauggcuucagauuuaugccauuguaaucguugac

SEQ ID NO: 4184330 - RNA, 78 nt, Human
gucaugcugcacauggccuuuaucucagugucuguggaacuucccgauuggaagaguuaaggccacugucaguaugau

SEQ ID NO: 4184331 - RNA, 75 nt, Human
gucaugcuuacacucagguaaaacuagggagacacguugugccccuagcagaaaaucugaaaugucaaagcagau

SEQ ID NO: 4184332 - RNA, 74 nt, Human
gucauggaaauacacaagagguuuccauucuuggucagucugaguuugggguuugaucugguguguuuuuagau

SEQ ID NO: 4184333 - RNA, 58 nt, Human
gucauggguggccccgugugcagucuggaguaagacugcaagguuggugacuaauggc

SEQ ID NO: 4184334 - RNA, 119 nt, Human
gucaugguaaguucaauguguguauauauauguauguauguguguauaaguauguauauauguauguaugugugugcuuaaacacauacauacauacacugacauuguacauacuauac

SEQ ID NO: 4184335 - RNA, 82 nt, Human
gucauguaccacugugccuauuuuaucuuggacugauaaggguguuccuuucugugauagguggcauagugagauggaugac

SEQ ID NO: 4184336 - RNA, 85 nt, Human
gucauguugguugcuugcaggccuuucuagcucuaugucuucguggaggaagauagccugcagguguaaugccuuggaaaaugac

SEQ ID NO: 4184337 - RNA, 80 nt, Human
gucauuaacaagaccagaggauauaaccagacuuuagucauugcuccugugugguugaguuccuugagggcuuugaagac

SEQ ID NO: 4184338 - RNA, 129 nt, Human
gucauuaauaaccacccucagagugcauuuuccugggcuuucuguguaaucuuuauguucuuccuuuugaauaguccagaauuugcaugaaugaggcccagaagaguacucugucugaguuuuaaugau

SEQ ID NO: 4184339 - RNA, 66 nt, Human
gucauuaguaaaucuggccucagcaaacauuuacugagugucugccagcugccaggugcugaggac

SEQ ID NO: 4184340 - RNA, 79 nt, Human
gucauuccaaccaaauaucugcucaagcaaucaguugugauagcuguaaaugucaaccagguauuuuggucugaauaac

SEQ ID NO: 4184341 - RNA, 59 nt, Human
gucauuccuugagccguggccagggccagcauguggcacuggccuggggccaagaggac

SEQ ID NO: 4184342 - RNA, 60 nt, Human
gucauucuaucuuggacuggaucuaggacgguguccagaaaucaauacaagauaaaugau

SEQ ID NO: 4184343 - RNA, 66 nt, Human
gucauucucagaucuuagaggaauauuaaagugugaauguuuuauuucuaagauugggaaacugau

SEQ ID NO: 4184344 - RNA, 79 nt, Human
gucauucuccugccaucugcuguugaucuaauggugaguacaugacccaagauggaucagucagacugaaggggacgac

SEQ ID NO: 4184345 - RNA, 95 nt, Human
gucauucugcgcgguguagucguacaucccaaucaccuggcacacugcaggagacagggcugggugagcggcugcacacccgccggagaaugcac

SEQ ID NO: 4184346 - RNA, 91 nt, Human
gucauugagggcuacuuccagagaguuauuccccuggcacuuccagccaagcagagcagccucucugguuguggcaaaagccauuagagac

SEQ ID NO: 4184347 - RNA, 60 nt, Human
gucauuguaauauucucauuuaguuuggguccugagacuuauaaagagaauaccgguggc

SEQ ID NO: 4184348 - RNA, 67 nt, Human
gucauuucucaguguacauuauguuaguuccuuggaauggagauagguguuauauagggaaauagau

SEQ ID NO: 4184349 - RNA, 65 nt, Human
gucauuugcucuuacugccacuaguggauaacuguuaucaggcugagggcuguaacagcagaggc

SEQ ID NO: 4184350 - RNA, 91 nt, Human
gucauuuuccaccaccccguuucccacuguggcagagccucgcauagaagauucgagggccugggugggagaagaggcacuggggaaaggc

SEQ ID NO: 4184351 - RNA, 69 nt, Human
gucauuuucugccagugaaauugugucaguuuugugacugaaucaguuuccuggcacucugcaaauggc

SEQ ID NO: 4184352 - RNA, 78 nt, Human
gucauuuuucaugugugucuguuuuuaaaguuuaaacaauuaacaguacucaagugacagagacucaugaaagaugac

SEQ ID NO: 4184353 - RNA, 95 nt, Human
guccaaaaguauacuugaauuggggguuuugcaaggcauagugaaauucauccauccaucugucuugaaaauuccuaauguuggucuaugaaggc

SEQ ID NO: 4184354 - RNA, 86 nt, Human
guccaaauccauuagguuuuuuguuguguuugaaagcuguaauccagagagaguuugaaagcauaugcuaaagaccauuuuuaggc

SEQ ID NO: 4184355 - RNA, 85 nt, Human
guccaaggucacaccaugaaggagugaaagggcuagaacuugaaaucagggaugucuggcuccacuuucuucauuuacuggggac

SEQ ID NO: 4184356 - RNA, 92 nt, Human
guccaauugcagccggggcuccuccagccugggaugagucuuggaaaaucugucaucauccuggagaagcuccuucgggccugcaaaaaggc

SEQ ID NO: 4184357 - RNA, 61 nt, Human
guccacagagguacucuuuugggcuuuuuaugucuuaaagccaaaucuuaacuucuguuac

SEQ ID NO: 4184358 - RNA, 66 nt, Human
guccacagcuggccagggccucucgggcaugugccugccacuuagugccuuccaguucaguggcac

SEQ ID NO: 4184359 - RNA, 64 nt, Human
guccacagggauggccacacauuuaacauucccaaccagaaauguccuagucaauccucuggac

SEQ ID NO: 4184360 - RNA, 60 nt, Human
guccacauagugaggcugauacaggccgucuggugacaggaggcugucuggcguguggau

SEQ ID NO: 4184361 - RNA, 66 nt, Human
guccaccauagggagggcguggcgugugccugguuggcaggcccguaggucccuugugguuggagu

SEQ ID NO: 4184362 - RNA, 77 nt, Human
guccaccuggcuucaguuccuguguuguuuuccuagcacuaugguggacagcacacaagcuggcugcuaagagggac

SEQ ID NO: 4184363 - RNA, 79 nt, Human
guccagaaccucaagagcuggcagagagcagaagccucguggcaaaguguucagccuguucaugcuguugcagggggac

SEQ ID NO: 4184364 - RNA, 66 nt, Human
guccagagccagcuguccuuggcauccgucaggcagaggggugaggugauugcugguguuugugac

SEQ ID NO: 4184365 - RNA, 58 nt, Human
guccagagcugguguuacaaguccacagugugaagaaccauggagccagcucuaggau

SEQ ID NO: 4184366 - RNA, 66 nt, Human
guccagaggccucuggagugcucugcaggugggcagccuggggcucuccacagugucucaagggac

SEQ ID NO: 4184367 - RNA, 65 nt, Human
guccagauugaaauacauguuugauuuggaaaguaauuaaaucuuacaccgaauuuaaacuggau

SEQ ID NO: 4184368 - RNA, 57 nt, Human
guccagccaggccugucucugggaagggguuugagagcuuugggccacuggcuggau

SEQ ID NO: 4184369 - RNA, 55 nt, Human
guccagccugagucagucaguggcugccugagcccugagcugguccaggcucaac

SEQ ID NO: 4184370 - RNA, 70 nt, Human
guccagcguccccgccgucgcucaggcugcugcugcgucguuugcggcugacuuuggcggggcgcggggc

SEQ ID NO: 4184371 - RNA, 87 nt, Human
guccagcguuacaaaugccaaagcugagagagaggacaacugaaaauucacaggaauuucugaguuuugcuauuaccuguacuggac

SEQ ID NO: 4184372 - RNA, 95 nt, Human
guccaggggcagagcugagccaggguugcagggagccagcagaaggugguucccagcugcccucuccagcccugagcugagcccacucucuggac

SEQ ID NO: 4184373 - RNA, 55 nt, Human
guccagugcagucaaggaagaaccagcccugcuggggcuccaguacugccuggau

SEQ ID NO: 4184374 - RNA, 99 nt, Human
guccauauuugucuuaucuguacuuuuaaugagcauugcugucuucauuuuccaaaggcaugcgccaauuuauuagagucauagagcaaguuuaguggc

SEQ ID NO: 4184375 - RNA, 83 nt, Human
guccaucaaggguaaaucuauaugacaagagaacaauucagcugguucugaaagucugcauggagauauacuauuugaaggac

SEQ ID NO: 4184376 - RNA, 71 nt, Human
guccaucacugcuuguuuucuaaaacaucauuuauagaccguaagagauucagcagaagacggguaaggac

SEQ ID NO: 4184377 - RNA, 79 nt, Human
guccaucuggagacuuccuggucuguauguugugucauuuugauuucuuguugaagggccauggagacuuagaaugggc

SEQ ID NO: 4184378 - RNA, 56 nt, Human
guccaugauucuguguaguagauguuaucauacauuuauacauuuauuucauggau

SEQ ID NO: 4184379 - RNA, 69 nt, Human
guccaugccauuaacauuagcuagcagacaucaagcugccuaguggauaaaauguuguuugacaagggc

SEQ ID NO: 4184380 - RNA, 60 nt, Human
guccaugcccucaagcagcaucaaagcaacugaaacagagcugcaaaggcacacuugggc

SEQ ID NO: 4184381 - RNA, 66 nt, Human
guccaugguugcuuucauguaaaagcagcagagucaaguuguugcaacagagaucagcugaugggc

SEQ ID NO: 4184382 - RNA, 83 nt, Human
guccauuaaaguaggcugaguaucuagagugcaaaauaaagucacaauuuguaagauauucagcuuauugaaauaauauguac

SEQ ID NO: 4184383 - RNA, 110 nt, Human
guccauuccuaguuguagaaguaaaaugccauuguaucauugagaguagaaaaaauuaauucugucuggcuuuagagacacacuggcauuugagcucagccuuggaggac

SEQ ID NO: 4184384 - RNA, 91 nt, Human
guagaagagagaaugcaagcaucuugagagucagggacuacaucuuagauacauuuguuuccuucaugaugcuuagcagagcuucuuguac

SEQ ID NO: 4184385 - RNA, 90 nt, Human
guagaaggauccagcuuugccugaucauauacccuggagucaauauuuuauuuucuuuguuuaagacagugcaagcugaauuuuuacuac

SEQ ID NO: 4184386 - RNA, 65 nt, Human
guagaaguuugggggcgaaggcagagagcauuuccuucucggcuuuuggcgccuccacgcugcac

SEQ ID NO: 4184387 - RNA, 61 nt, Human
guagaaucccaguggcuauauuggcaaaaugcagcaugcguggccuucauugggguguuac

SEQ ID NO: 4184388 - RNA, 79 nt, Human
guagaaugauaugugugccauuucagcaguuuagagguaugaaacuuugugccuuaccugagacacacaaguuagcuau

SEQ ID NO: 4184389 - RNA, 58 nt, Human
guagaccauuuaucuggggaguuuuaucuaugggaacaauccagaugauauggauuac

SEQ ID NO: 4184390 - RNA, 56 nt, Human
guagagaaaguguuagagcagaggccugcuggcuuguuucuuuguauugucucuau

SEQ ID NO: 4184391 - RNA, 84 nt, Human
guagagaaccucaucaugagauuugagaauagcuuuagaguuacucuugggauagugucucauggcccugugagggaacucuac

SEQ ID NO: 4184392 - RNA, 71 nt, Human
guagagacgggguuuuacuauguugcccaggcaggucuugaucugggcucaagugaugcuccugucucagc

SEQ ID NO: 4184393 - RNA, 67 nt, Human
guagagagagagcaagcaugcauauguacuugcacaauacccaaugacaugauucuuucuuucauau

SEQ ID NO: 4184394 - RNA, 74 nt, Human
guagagauggggacuugccuuguugcucaggcuguucuugaacuccugagcucaagcaauucacccgccucagc

SEQ ID NO: 4184395 - RNA, 74 nt, Human
guagagauggggucuugcuauguugcccagcuuugucucaaacuucuggcuacaagcaauacucccaucuuggc

SEQ ID NO: 4184396 - RNA, 55 nt, Human
guagaggacauuugacaugauguuggacaccagcauccuaagugccuuucucuac

SEQ ID NO: 4184397 - RNA, 126 nt, Human
guagagggagagguuaaaacguguguuuacauuuacacuugccaugcugcacacugaggaacauuuguuuccaguucccaugacagguguuaccuguucagauaaagcuuuagccuuuucuucugc

SEQ ID NO: 4184398 - RNA, 62 nt, Human
guagagguugauaguaauguuuagcccuaguggguauagaacaaauucucaucaacuugugc

SEQ ID NO: 4184399 - RNA, 90 nt, Human
guagagguugcuaggacuauaguguacauguagacacccuuggggaugccaguccuauauguccaccuguaugcuaaacuucucuucugc

SEQ ID NO: 4184400 - RNA, 70 nt, Human
guagagguuggguggaccacgagcccaagcagacaagcucagucugcagcuuccaucuccacugcccuac

SEQ ID NO: 4184401 - RNA, 72 nt, Human
guagagucacgugggugaguguccucccaugguuuccucccuggaagcggugcuggcccauggggacuguac

SEQ ID NO: 4184402 - RNA, 57 nt, Human
guagauaacucauuuuguauauccauucaucaguaaauggacauuugaguuguuuau

SEQ ID NO: 4184403 - RNA, 73 nt, Human
guagaugauuucuguagauuugaucuaauagaucuaaauucuauuagauuuguuucuguagaugugauauuac

SEQ ID NO: 4184404 - RNA, 66 nt, Human
guagaugcuagcaccaagaacccagcauugagcugcuccuaugcuuuaguugagucuggggucuac

SEQ ID NO: 4184405 - RNA, 80 nt, Human
guagaugggccuguuccuaugcugguugaguucuuacggugagcuucuauuggcuguaguagagaagagacggccacuac

SEQ ID NO: 4184406 - RNA, 111 nt, Human
guagaugguguaggagacugagcugaaaauguauugcacccaguaguuuaaauucugagcucuugagagaagagacugggugcauuuuguucaaucuucuauccuggaugc

SEQ ID NO: 4184407 - RNA, 81 nt, Human
guagauuuaagaaguucugaaauaaaauccugucuugaauuucuagaguagugauuuccauuucaggguuuuggaauuuau

SEQ ID NO: 4184408 - RNA, 76 nt, Human
guagcaacugagguagggcacaccuagguggggcaucccauauaaccuuuucuagguuggccuugcccagugugac

SEQ ID NO: 4184409 - RNA, 58 nt, Human
guagcagugguuccuacguguugguaucuaagccagguucuggggcuccacugugaac

SEQ ID NO: 4184410 - RNA, 55 nt, Human
guagcauacacugccaagucuggucaauuguuugacaaggcagcugugugcaugc

SEQ ID NO: 4184411 - RNA, 55 nt, Human
guagcaucuguacugacauaauccgcacuuuagggugaugaaugucaauugcuac

SEQ ID NO: 4184412 - RNA, 86 nt, Human
guagcccagcacagcagagugugagauagccaccccugacagccaccugguauuuccucauucugcuuugcacuggauuauguuac

SEQ ID NO: 4184413 - RNA, 80 nt, Human
guagcccuaguauauauuuauagaacgguucugugcaaaucuauuucaggauuacacagaaauuuuauugccugggcuau

SEQ ID NO: 4184414 - RNA, 61 nt, Human
guagcggcauccauucugcaguucuguuuggaacuguucuuguguuugcuauguauguuau

SEQ ID NO: 4184415 - RNA, 55 nt, Human
guagcuaagagcuccaggauuuuguaauuaaugagacuuuauaguuuuuggcuau

SEQ ID NO: 4184416 - RNA, 70 nt, Human
guagcuacacccaagucaaccccuggcuuguuuuccacuaacggagccaaauacaaacugggguggcuac

SEQ ID NO: 4184417 - RNA, 64 nt, Human
guagcuacugcaguuguugcauuuaaauugauuuacaugucaagacuggcaguuuagcagcugc

SEQ ID NO: 4184418 - RNA, 74 nt, Human
guagcuauuuuggagucagaugacuguaggacacacaagauuaugugucuuuuguaugacugccaauuaguuac

SEQ ID NO: 4184419 - RNA, 100 nt, Human
guagcugauuuuuucccucugucuuaaagcucauuaauuagaagcuaacuucccccaguuguagcuuuuuaaugugcugcuuuagaagagcuuucacugc

SEQ ID NO: 4184420 - RNA, 78 nt, Human
guagcuggcacauagcagguacucaguuauugaugcaucauguccccuuuacugccuuauaugcugugugugaguagc

SEQ ID NO: 4184421 - RNA, 56 nt, Human
guagcugucucggucaggaguuaacagacugcuuaaccuuuacuaugacuagcuac

SEQ ID NO: 4184422 - RNA, 60 nt, Human
guagcugugugacuuugggcaugucauugauccucucugagccucagucacauggccuac

SEQ ID NO: 4184423 - RNA, 84 nt, Human
guagcuuaugauugugcucuaauaaagccugacauuaauuaugacaugggaaauggaaggucuauuaguuauaauuauaauuac

SEQ ID NO: 4184424 - RNA, 66 nt, Human
guagcuucuguucaucuuccaggcacagugcuaggugcugggaugcuaagaugagcaaaagaaaac

SEQ ID NO: 4184425 - RNA, 118 nt, Human
guaggaaagaggagggauccaucuggguuggucuguggauuuuuaauauuuuuuaauggaacaugaaaaccuccacagcaacaucgaaaccagggagaaagugauccuugcucccugc

SEQ ID NO: 4184426 - RNA, 59 nt, Human
guaggaaaguaaaugaaauacagcaauuuacacaaaugauguuucauaagcuguccuau

SEQ ID NO: 4184427 - RNA, 74 nt, Human
guaggaaauuugaaauaugugggucuuacuacacaggauaaggcuagagaucuauagauuugaugauugccuac

SEQ ID NO: 4184428 - RNA, 87 nt, Human
guaggaaggccuuugagcccagguggccuugccaucuccugcuaaagugguaggaguaggaguggccaucccucagaaguaaccugc

SEQ ID NO: 4184429 - RNA, 84 nt, Human
guaggaaguggguauucuugcagcuucuaacagcuucagcaacuuuguuguucaaagccagagcugcaagacaccuuaucucac

SEQ ID NO: 4184430 - RNA, 96 nt, Human
guaggaauucagacucuucaagauuuucauguuuuuuaucuuuugagugauugggaacauucuagaguguugugaaaaugugucugcauguccugc

SEQ ID NO: 4184431 - RNA, 82 nt, Human
guaggacaagggaaagaucaaccacgccggguugccaggacaauagugaauggaacagcuggguugggugccuuggcugugc

SEQ ID NO: 4184432 - RNA, 87 nt, Human
guaggaccagcuacaugauguaagagcccaucuagguguggaacccaugugaauguauaguuuguauauccaugaagcugggccugc

SEQ ID NO: 4184433 - RNA, 71 nt, Human
guaggagaaaguaaaugugauuuacugaugaagaugccacccccaagugacccauuaaccacuuucccugc

SEQ ID NO: 4184434 - RNA, 58 nt, Human
guaggagucaggaccaaauggaaauucccuuggauuuauuuuccuccugacuucaugc

SEQ ID NO: 4184435 - RNA, 77 nt, Human
guaggaguucuucaccaaggucagaggcaacaagaauaguagguuccagccuguccuugugaggucccagcuugugc

SEQ ID NO: 4184436 - RNA, 120 nt, Human
guaggauggaggccagagagggcacguggccugugguccugguggugccggugcccggagggcuucccugggcucuggggucccggugcaaggcgcaccuguccuggcugcuccuccugc

SEQ ID NO: 4184437 - RNA, 72 nt, Human
guaggauugggagagaggcauagagucuggaagacauuauauuaacuguagauguaucuucucuuaucgugc

SEQ ID NO: 4184438 - RNA, 59 nt, Human
guaggcaaggcuguggcccuggucuagcauuucccaugcaggauuuacagccucgcugc

SEQ ID NO: 4184439 - RNA, 73 nt, Human
guagggagugaauguuugaugagaaauagaguggauacagaguuccacucccuacaaaucauuuauuaacuac

SEQ ID NO: 4184440 - RNA, 103 nt, Human
guagggaugcuguuuggauauucagcauaaacuucauggauaauauaaagcuccuaaacagaaaacaaagggagccaugguguuaaggcugaaaaacacccac

SEQ ID NO: 4184441 - RNA, 73 nt, Human
guagggccagcuguggacuggcagugaccuuggugccuuugacucauauacccauuguccuuccacccccuac

SEQ ID NO: 4184442 - RNA, 72 nt, Human
guaggggaggcaguguugaaaaggagagccagccagggcuuuguucucccaucagccacuuccgucugcuac

SEQ ID NO: 4184443 - RNA, 59 nt, Human
guaggggcucugugacaguaacccuuucacugccagaggaaacugaaggggcccucuau

SEQ ID NO: 4184444 - RNA, 61 nt, Human
guaggggucagugcgauuucccacucccauaacuuggagcagugacggguacugacaaugc

SEQ ID NO: 4184445 - RNA, 58 nt, Human
guagggguguggguacuaggacuggcuaaaucagaucugaccuaaccccaccaccagc

SEQ ID NO: 4184446 - RNA, 75 nt, Human
guagguaagaccuugagucaccuggaccagccucaucauuucugaggcuucagaugaccuuagcauccaaucugc

SEQ ID NO: 4184447 - RNA, 90 nt, Human
guaggugcucuccuggguguccauccggccaccuccagccccacacaugaaugagugggcugcagagcugggugggccuccgagcccugc

SEQ ID NO: 4184448 - RNA, 57 nt, Human
guagguggagcuuuagggacugggacagucaguuuccagccucuugcucucacaugc

SEQ ID NO: 4184449 - RNA, 68 nt, Human
guagguggaguggugccugcagaucccuucuuuggcaaugugucugagagagcaccuauccacucuac

SEQ ID NO: 4184450 - RNA, 64 nt, Human
guagguguauaugaaaauuuuuguccuuugcagcugucuuagacacauauucauauguacuuac

SEQ ID NO: 4184451 - RNA, 77 nt, Human
guaguaaauaacuuccuggguuuacguauugggucucuguugggacucaguguaaagaacucagaauuauaaauugc

SEQ ID NO: 4184452 - RNA, 66 nt, Human
guaguaaauucaaggggaguuaaaguggaugauuucuauggcaacuuccaggccuugaauuauuau

SEQ ID NO: 4184453 - RNA, 79 nt, Human
guaguaacuaaguuagcaucaaugcauucacuucaaaccacuugaagaaaugaaguguuauuuaguuucacagagcugc

SEQ ID NO: 4184454 - RNA, 62 nt, Human
gguaaguguuauuugcaagugagucacaccaagauguaauuuacuugcaaauaacaauuauc

SEQ ID NO: 4184455 - RNA, 118 nt, Human
gguaaguuuuuacaagauuugaagaaaaaguuccaucaaagggguauaauugcauaaugaauaucauuggaaaaugcaugcuuuuuaggcaggaauuuacuucaaacguugacuuacc

SEQ ID NO: 4184456 - RNA, 73 nt, Human
gguaauagcucugaccaagagacugagggauauagauuucuccccacccuucuaaacucagagccuagcuacc

SEQ ID NO: 4184457 - RNA, 76 nt, Human
gguaaucagcagaauguugguagcaggaguucuaaagucuuagagguuuccuguuagccauuauuagcuauacacc

SEQ ID NO: 4184458 - RNA, 76 nt, Human
gguaaugaggauuccaagaugaaggaagccuaugcccuucccugggccucuucauaaucuugggauugagauugcc

SEQ ID NO: 4184459 - RNA, 92 nt, Human
gguaaugcauuuuccuucuuguaaugaucugccugaaacaaacauuuagccuuacucguggaaugucaaaacuagaaggaacuguagugauc

SEQ ID NO: 4184460 - RNA, 56 nt, Human
gguaaugcuuccuauauagcacucugauucaagagagcuauuuggcaagcauuucu

SEQ ID NO: 4184461 - RNA, 62 nt, Human
gguaaugguguuccaggcuucucccuuccaacagagagaaaccgauucugcaugucauuacu

SEQ ID NO: 4184462 - RNA, 97 nt, Human
gguaauucauauuguauugggauuuuggcuguaguucuaaaacuauagauaauuaaugcuaaggcucagguucuaaggacaauacaaaagaguugcc

SEQ ID NO: 4184463 - RNA, 78 nt, Human
gguaauucauguuguacuauucaucaaugauucauucuuguuuuccuguugaguaguauuccauuguauggauauacc

SEQ ID NO: 4184464 - RNA, 61 nt, Human
gguacaaaugucuccucuuuuguuagggcucuuauauacccucccaagugggcauuggucc

SEQ ID NO: 4184465 - RNA, 78 nt, Human
gguacaacuguggcacaucguuucuuugguauccauaugaucuaccaguuaaagggaaauugaaaaguguuuugugcc

SEQ ID NO: 4184466 - RNA, 60 nt, Human
gguacaauucugggguaugcucuacacagucccuaagaacguccucaacaggauugcacc

SEQ ID NO: 4184467 - RNA, 69 nt, Human
gguacagaaauggggccccaggugcugucugcauaccuucccugcaccaggaggccuugguucugagcc

SEQ ID NO: 4184468 - RNA, 77 nt, Human
gguacagagagagcugacuuuggagucagaagguccuguuucaaauucuggcuccauuacucagcaucugauugacc

SEQ ID NO: 4184469 - RNA, 57 nt, Human
gguacagcagccuucagggccacugguucccacuaugcccuguagaggcugcugacc

SEQ ID NO: 4184470 - RNA, 67 nt, Human
gguacagcauuugaaauuacuggaauaugacaagugcugcuguccccaugucuuuggaaugcugacc

SEQ ID NO: 4184471 - RNA, 85 nt, Human
gguacauuuuuaaagaaaacguuuugaggaguuugggucuaccuaauguuuuuuccauguuuuacuaaaucuuuucaaaugaacc

SEQ ID NO: 4184472 - RNA, 72 nt, Human
gguaccaagugcauuccaccgugcagguugcagucacuagagagucuccuguccauuguggauuguggcacc

SEQ ID NO: 4184473 - RNA, 76 nt, Human
gguacccaaguggcuauaggauaaaguacaaauccuuauuuaauguauuauucauggucuuccacaauugggcuuc

SEQ ID NO: 4184474 - RNA, 62 nt, Human
gguacgggaacuugggcaagccccagcuguagccuacucagccuugcccagggucuccugcc

SEQ ID NO: 4184475 - RNA, 64 nt, Human
gguacuacuuucccccacauauuugcagucguuauccugcaaaaaaugggggauggguguuauc

SEQ ID NO: 4184476 - RNA, 100 nt, Human
gguacuaugcuagguguuuucuaauuaaaucuacgcuagguguuuucuaauuaaaucuacgcuagguguuuucuaauuaaaucuaugcuagguguuuucu

SEQ ID NO: 4184477 - RNA, 65 nt, Human
gguacugacauguauuaguacauauggugcugauaauacaucaaggugcuaauaaauguacaacc

SEQ ID NO: 4184478 - RNA, 56 nt, Human
gguacugccagggcaagccaaagccucagcggcuggaggagccuggagcacgugcc

SEQ ID NO: 4184479 - RNA, 57 nt, Human
gguacugccgucaugaagggcccaguuggcuaagcacaggccuucagacugcaugcu

SEQ ID NO: 4184480 - RNA, 114 nt, Human
gguacugccucgcucuuuccaauuaauaauaugcccuguggugcuauaugacuuuccuucagguaccuaucacaggugugauuuacauuauuugguggauauauaaucaauacc

SEQ ID NO: 4184481 - RNA, 66 nt, Human
gguacuggaaguggcccuaggaagcagaaccucaggaugguauuauugaaggaucacuucuguacc

SEQ ID NO: 4184482 - RNA, 64 nt, Human
gguacugucaugcauuauggcauguuuuagcaucccuggucucauaugccaaaugccaguaacc

SEQ ID NO: 4184483 - RNA, 82 nt, Human
gguacugugucuuaggauguggaauacagcuuguuuuguuguucccuaaggcugcuucuuccccgucuuaagagauaguucc

SEQ ID NO: 4184484 - RNA, 82 nt, Human
gguacuguuagagcgauuuguccugcauuucugggcaaccugugggcagaagaggagaaggauagauccuucugauaucucc

SEQ ID NO: 4184485 - RNA, 82 nt, Human
gguagaauugaagaaguuacuuagggacauuuugaauuuuuugaauuagaguuuuuguaaguacaauugauucucauuugcc

SEQ ID NO: 4184486 - RNA, 67 nt, Human
gguagaccaaugcauacguguuuguggcaagugugcuuguuuggcaaaugugugugugguguaggcc

SEQ ID NO: 4184487 - RNA, 75 nt, Human
gguagagacaggaucgcccuguugcccagauuggucucucaaauuccugagcucaagcgauccucccaucucacc

SEQ ID NO: 4184488 - RNA, 87 nt, Human
gguagagaugcauauucugggcuucacgccagagccacugacucacagccucugggguggagcccagcacccugcauuuaacaaacc

SEQ ID NO: 4184489 - RNA, 63 nt, Human
gguagagcucccugccuacacggaccuuccauuauagaaggggaggcaggcagagcuaguacc

SEQ ID NO: 4184490 - RNA, 98 nt, Human
gguagaggcaaaauggauguaugcacaagaggcuagaaaagagccauauugcauuuugaucuucuuuuucugcauucguucauguuauuuccucugcc

SEQ ID NO: 4184491 - RNA, 84 nt, Human
gguagagugugucuauggaagggguugucaugguaacagcuucuguuggcuucuagcccuaccuuuucuggacacauucaugcu

SEQ ID NO: 4184492 - RNA, 60 nt, Human
gguagaugggaauaauuaucuucuuacaagaacauaaagaaguaaugugucucuucuacc

SEQ ID NO: 4184493 - RNA, 59 nt, Human
gguagaugggccaggcaaccuggggaggccucugggcuuggaggucuggccuaccugcc

SEQ ID NO: 4184494 - RNA, 57 nt, Human
gguagauugaugagucauggggguugacguuuccauguuauuauuagcagucuugcc

SEQ ID NO: 4184495 - RNA, 86 nt, Human
gguagauuugucacuggggccacaugcagaagagggccauugucuucuuucaauguucugcucagugagaacaucuucacgucacc

SEQ ID NO: 4184496 - RNA, 77 nt, Human
gguagcaacagccugcaggaggccgucagcugcacccaggagccaggacgacauggucauccucaggcacagcugcc

SEQ ID NO: 4184497 - RNA, 80 nt, Human
gguagcagagagggagucccaggcagccgagccgguagugcccagcccagccuaccacagcuccuggcccucugagcauc

SEQ ID NO: 4184498 - RNA, 66 nt, Human
gguagcagguagugcuaaagacuuacuagacugcauguuugugcuuucugcugcauuccucuaauc

SEQ ID NO: 4184499 - RNA, 111 nt, Human
gguagccaacuauuuauaggguagaagucuggcuuuaaggaguaaaaaugccuccauuucauguugguuuuauuaccccuuaaacaccagugcccuugaauugugugcucc

SEQ ID NO: 4184500 - RNA, 58 nt, Human
gguagccacaaguuaacuccaaguucuccaagggguucuggaggcaccuguggagauc

SEQ ID NO: 4184501 - RNA, 58 nt, Human
gguagccauaaguuaauuccaaguucuccaagggguucuggaggcaccuguggagauc

SEQ ID NO: 4184502 - RNA, 68 nt, Human
gguagcccacugaacuucagcaaucaccagugcccagcacauggccagcccugagguucagcccuauc

SEQ ID NO: 4184503 - RNA, 57 nt, Human
gguagcccucuccagcgaggucugagagcagcucucagauucuggcagauggcugcc

SEQ ID NO: 4184504 - RNA, 76 nt, Human
gguagccugcaggcugggcggggccuugggcucuggaggagcuuaaagggccgauuuccaggccaaggugggcacc

SEQ ID NO: 4184505 - RNA, 65 nt, Human
gguagcucugggacuagaaccccaggggcaaucuggacuuccuggcucuaaguccugagugcacc

SEQ ID NO: 4184506 - RNA, 83 nt, Human
gguaggacuaugguguggggaucuucuguaugccagguacacaugcauaaugcaugcacagauccuggcacuuagucaaugcc

SEQ ID NO: 4184507 - RNA, 70 nt, Human
gguaggaggaucaccugaggucaggaguucgagaccagccugaccaacguggugaaaccccaucucuacu

SEQ ID NO: 4184508 - RNA, 56 nt, Human
gguagggggcaagaguuggguggacuugagagugggaugcccagagcccucuuauu

SEQ ID NO: 4184509 - RNA, 69 nt, Human
gguaguaaaauaugugagcagcguucuguggaagacacacaauuuccuguccauaugugcugugcuacc

SEQ ID NO: 4184510 - RNA, 73 nt, Human
gguaguaguuuagugggacaguuuaaaguugggauuugaaguucaaaucugucccuuaacuagucauauuacc

SEQ ID NO: 4184511 - RNA, 91 nt, Human
gguaguauaggcuaauaauuauuuguaguucuucaugaauucagcuucugccaagugaauaccaucaagagcuuugcuagcaggugcuacc

SEQ ID NO: 4184512 - RNA, 58 nt, Human
gguagucaguguuaguuugauuuggcaauagcaccagacuaauaaaacagugacagcc

SEQ ID NO: 4184513 - RNA, 61 nt, Human
gguagucauggauagcuaugagucacaaauugaaacaaaugguguccgugaauuaguuacu

SEQ ID NO: 4184514 - RNA, 87 nt, Human
gguagugaaaauuuuauuacugcuguagcagcuacuaacucugaaaaugguuauuugcuccuagagaguaauacaguuuugacuucc

SEQ ID NO: 4184515 - RNA, 56 nt, Human
gguaguggagcaugagaggugugauccccccacucugccacugugcuuacacugcu

SEQ ID NO: 4184516 - RNA, 85 nt, Human
gguaguggcagucugaaacacugguaaagacugccgauccuggugugagucagacuagguuugauuccaggcuguaccacuuacc

SEQ ID NO: 4184517 - RNA, 62 nt, Human
gguaguggcauucgauuuuggugggaaauguaucucuuugccugccguuaaauguuacuucu

SEQ ID NO: 4184518 - RNA, 76 nt, Human
gguaguggggcauaggugauuugagaagaagaacccagagauguggguucaaauccuagcccuguggccugcuauc

SEQ ID NO: 4184519 - RNA, 74 nt, Human
gguauaaaauaaugucuuaaugucuuauuucuuccagugaggaaguugacauccagagacauucuuugucuucc

SEQ ID NO: 4184520 - RNA, 90 nt, Human
gguauaaaauguaagucuaugcagaguucaauugaaaauuuucauuguugacuugauuacucaaccauaggcuaauagaaaaguuaugcc

SEQ ID NO: 4184521 - RNA, 61 nt, Human
gguauaauccuugcagccauugcacagacccacaggcgucugccagugugugccaggagcc

SEQ ID NO: 4184522 - RNA, 81 nt, Human
gguauagaacaaaagaaugugugauugaagcucuugaagagauuuauuucaggagagaggcaaacauuuugcucugauacc

SEQ ID NO: 4184523 - RNA, 80 nt, Human
gguauagcagucagaggucuucuaaaacagaugcacaaucuuuuauuuauuacagaccuuuuuauuguuacagcuguacc

SEQ ID NO: 4184524 - RNA, 59 nt, Human
guccacugcacuggauucuugcccugaguacacagagguuagaggucagugcagucgau

SEQ ID NO: 4184525 - RNA, 62 nt, Human
guccacuucuauugggucuugguguguuuccaccaaccuauugauucccucuuggaagggau

SEQ ID NO: 4184526 - RNA, 62 nt, Human
guccagagaguaaaggggguaagcaagcucuuguuauuagcccauauguacuuacccugggc

SEQ ID NO: 4184527 - RNA, 81 nt, Human
guccagccaagcagcuccuugauucaaggccauugcauuuucugaguauggccugacuguccagccagggcugcucuggac

SEQ ID NO: 4184528 - RNA, 109 nt, Human
guccagcgagaacauccagaaacuucauuugcaagcuugggguuacccugaaggaaauccucauggcuugcaagauucaguuccuggggcuuggcucucuuuccuggac

SEQ ID NO: 4184529 - RNA, 58 nt, Human
guccaggaagcaauaaauagaauucauuaugaaaucuauaauuggaacuucacuggau

SEQ ID NO: 4184530 - RNA, 59 nt, Human
guccaggacuuucuuaaggcacuccagauuagguuggaauugcaagccaguccugugac

SEQ ID NO: 4184531 - RNA, 62 nt, Human
guccaggagagcucucguucagugugcggaagaacacucugaccucuagagcuguccuagau

SEQ ID NO: 4184532 - RNA, 58 nt, Human
guccaggcaccucccuugugcuggguguuaccuccaugcugaggggucugacuuggac

SEQ ID NO: 4184533 - RNA, 64 nt, Human
guccaggcuccagcucuaacaugcugggccccaagggcugggcaggagagauugcagccaagac

SEQ ID NO: 4184534 - RNA, 61 nt, Human
guccagugcuuauagaaucagugcuugugccaaaacauuuuguuucaugaagcacuuggac

SEQ ID NO: 4184535 - RNA, 56 nt, Human
guccaucuugcaaugagaccuaacuugcaccugccuguuuuucugcaugauuggac

SEQ ID NO: 4184536 - RNA, 129 nt, Human
gucccaaaagaauuaaugugacauuacagaaugugccauuuggucgucaucuuguuucccauuauuggauuggacuugugguaucacuucuguuuacaucaacccuagaauucaaauaaugaggaaagc

SEQ ID NO: 4184537 - RNA, 61 nt, Human
gucccaaggccaggcaucuagaaaagcucucuccuuguuuuaucuggcagaacuuugggac

SEQ ID NO: 4184538 - RNA, 60 nt, Human
gucccagcaagauaagaccauguccagaaggaccaguggcaguaaagcuggaaaagugac

SEQ ID NO: 4184539 - RNA, 75 nt, Human
gucccaggucaucacugagagcagaucccacgcgcccgagcugccgcggugaagaugccucaggugacccgagac

SEQ ID NO: 4184540 - RNA, 113 nt, Human
gucccaucccaucccugucccugagcugucuaugguccugucugugcccucuucccuggagaaugaggagaugccugcuaggauggcaagcagccacgugguguucuuuggac

SEQ ID NO: 4184541 - RNA, 67 nt, Human
gucccaucugaugugcaaaaggcagacgugaaggcaggugcuggagcugagagcacauagaaggggc

SEQ ID NO: 4184542 - RNA, 76 nt, Human
gucccaugcugagaugagggagcuggaggaggggagacuggcucucacuccucauugcugcccauugggaugggau

SEQ ID NO: 4184543 - RNA, 69 nt, Human
guccccaaaggccaagcucagguaaaaggcagacccggcuuuucuccaaaguggcuaggucuaugugac

SEQ ID NO: 4184544 - RNA, 68 nt, Human
guccccaaguuagcaucuccuccagucuauucugcagaauucugguucucaggaaugcuaauaggggc

SEQ ID NO: 4184545 - RNA, 59 nt, Human
guccccagcugugacgagagcccaucccagggaggggcacuuggaucuuaguuggggac

SEQ ID NO: 4184546 - RNA, 89 nt, Human
guccccaggcagagcacaggcugcugugaacuguggcccaacugcagggccaguccagggcagggcaagaccagugugggcugaggggc

SEQ ID NO: 4184547 - RNA, 61 nt, Human
gucccccugaaagcagccgcagaaacagcugccaccuauuugcauagcugagcaggaggac

SEQ ID NO: 4184548 - RNA, 119 nt, Human
guccccgcuggcccagacuugcagccucgucuaaaaccucccgccccagguuaaaaggcaaaauaacggcaccuggaggggcaauggagcgcggacgggcuguucgagggcagcggggc

SEQ ID NO: 4184549 - RNA, 60 nt, Human
guccccugcagccccuuggagucccaugagugggcuccugaaggcucugcagggucuggc

SEQ ID NO: 4184550 - RNA, 75 nt, Human
guccccuugcuuuccuuaguccagcccuccaggucccaaccagcagggcugggccaauggcaauggcaauggaac

SEQ ID NO: 4184551 - RNA, 75 nt, Human
gucccggagcugacuggcugccuuuucagugugcccccgccacuggccagugccugccagugcagcugaugagac

SEQ ID NO: 4184552 - RNA, 127 nt, Human
gucccgugguggggcucagggugcaggaggagcccuggaucugguuccuugaggaugccacacaaaaggccuucagaguaccauguccuccuggccucuuucuccacccuggguuggacauaggggc

SEQ ID NO: 4184553 - RNA, 73 nt, Human
gucccuaaaaguagcuccaaggcaggaauuaaaaaugguucuggaagcuuuugagcaacugagcuagcaggac

SEQ ID NO: 4184554 - RNA, 59 nt, Human
gucccucacccagaugcucccagaaccuguucuaaagaaauauuagggagaacagggac

SEQ ID NO: 4184555 - RNA, 82 nt, Human
gucccucaguuucuuccauuaggguucucagguuggcaugugcuuucaucucaggaggacccugaugcuguguuucaggggc

SEQ ID NO: 4184556 - RNA, 78 nt, Human
gucccucccucaagggcucccugccugagguggcagaaaggccauucccacccagccagaugcaggaagcccaggggc

SEQ ID NO: 4184557 - RNA, 87 nt, Human
gucccucgcgggccgggcguccccucagccacccauggggcacccuucgccucccucgggggaugggggaucggcuugcguccggac

SEQ ID NO: 4184558 - RNA, 78 nt, Human
gucccugagugcugugaaaggccacgugccaagauuaaccugaauuuuucuuugcaaauggcuuugacucaaugggac

SEQ ID NO: 4184559 - RNA, 61 nt, Human
gucccugcaucaccacgggacuugggcuguuccaaugguccuggugaagaugaaaagggac

SEQ ID NO: 4184560 - RNA, 76 nt, Human
gucccuggccaggcuggcuggaugguugguucgcugucugacgagcagccagcccuccaccagcagcuccgggggc

SEQ ID NO: 4184561 - RNA, 63 nt, Human
gucccuggucuaccguggcuucaucuacccaaugcugccuggagggccagguggaccaggggc

SEQ ID NO: 4184562 - RNA, 64 nt, Human
gucccuucuucauguacuuuuccuuuuucagcuuuucugaauguguacauuuucaggaggggau

SEQ ID NO: 4184563 - RNA, 110 nt, Human
gucccuuucuuugugauuuaaaucuguauaauaugacuuagaaacaaagguguuuagcagcacuucuauuuuuuucaguggugugagcauaaaccacaaaguauccggau

SEQ ID NO: 4184564 - RNA, 69 nt, Human
guccgggaacccggcgucuccgccuccggcugcuccgcgcggagagccuguucggaggcgcccccgggc

SEQ ID NO: 4184565 - RNA, 60 nt, Human
guccgggucaccuaucaauuuugugcaugggugcacaggacaggauuugggaucuagggc

SEQ ID NO: 4184566 - RNA, 67 nt, Human
guccguugacagggcacuugacacuuuauaucauaguaguuuugugaacuugucagcuaccaaggau

SEQ ID NO: 4184567 - RNA, 92 nt, Human
guccuaaaaggccacuggcugccguggggcugaggcuggaguucugccgaggcucugcaaguccagccccuggcacaugguucugaugggac

SEQ ID NO: 4184568 - RNA, 78 nt, Human
guccuaauugaguucuguguaaagggguuaccauaugcuuuuuucagguggcaagcaguuacccaggauucguuggau

SEQ ID NO: 4184569 - RNA, 69 nt, Human
guccuacucugggcuuugauuuguuacagugaaagaauacaaaguaaaauuggcucagggcaaaggggc

SEQ ID NO: 4184570 - RNA, 108 nt, Human
guccuagagcagcugugcugacuguguuccuucuggauuagauucucagcaguucuaaucuucagcacuccagagacugggauauauaggcaccaggcuccucuggac

SEQ ID NO: 4184571 - RNA, 77 nt, Human
guccuagcacccaggguugguggcuuggaggcccagaagacaucccuuugcccuccccaugacccggugcugggugc

SEQ ID NO: 4184572 - RNA, 55 nt, Human
guccuagugccuggaagcugggacucacgaccguccagcugccugcacuuuggac

SEQ ID NO: 4184573 - RNA, 74 nt, Human
guccucccuagccucccuagcugcaccuucuacaggacccuuuggagggugcaggggaagcugcccuggagggc

SEQ ID NO: 4184574 - RNA, 55 nt, Human
guccucccugggagcuucugagugcagaggggacucagagaccccgggaagugac

SEQ ID NO: 4184575 - RNA, 74 nt, Human
guccuccuaaguuuucuaauacuagaauaauuuuauuagacccugucaguguuaggaaagagagagaaaaggac

SEQ ID NO: 4184576 - RNA, 63 nt, Human
guccucuagguuggucaucaucauccucauuuaagaggaaaacugagccaggcuaggaagggc

SEQ ID NO: 4184577 - RNA, 107 nt, Human
guccucucacccccagcaguugccaugggguuuccuuccagauucgaggauccuugccacuugaagccuggacucagggugcuccagcgcuggggaguggugagggc

SEQ ID NO: 4184578 - RNA, 75 nt, Human
guccucucuucacuuggauggcaguugagucucugaaagagauucaucccgaaggucuuuuaagugaagagaggc

SEQ ID NO: 4184579 - RNA, 73 nt, Human
guccucuggaagaugaguucuucucuugccuuuguuucuuuccaaaccugcguagcuuaccuuccagacgggc

SEQ ID NO: 4184580 - RNA, 71 nt, Human
guccucugucaagcuugucuuguccauagcaguggauacuguacagugucuugggcacagcuuuggagggc

SEQ ID NO: 4184581 - RNA, 61 nt, Human
guccucuuagccacuuaauuauacugacacucuagcauuaggacaugggggcugggggggc

SEQ ID NO: 4184582 - RNA, 64 nt, Human
guccucuucuaagcucauucaggguguuggccaaaucccauuucuuguugcuauaggacaggac

SEQ ID NO: 4184583 - RNA, 113 nt, Human
guccugagaguccaggccuccucucucugacuggaaagccuguccucagaguccagaccuccucucucugacuggaaagacuguccugagaguccaggccuccucucucugac

SEQ ID NO: 4184584 - RNA, 62 nt, Human
guccugagcuugauccuucugucucuaucucuguacaccugggacaccuugcaggcucagac

SEQ ID NO: 4184585 - RNA, 56 nt, Human
guccugaggugcucagccaggaagcgacuaugauugauuugcugugcacccagggc

SEQ ID NO: 4184586 - RNA, 62 nt, Human
guccugccugagugauguggcagccacaaguagaaaauguggucuguucaaucuaggcagac

SEQ ID NO: 4184587 - RNA, 78 nt, Human
guccugcggcugcaagggcuucaaguggccaagaggcacuccuggucuuaaggcccuugcucagaagugaugcaggcc

SEQ ID NO: 4184588 - RNA, 57 nt, Human
guccuggagcagcuggaagaugcugucauugcacuccaugauccaguguuccuggau

SEQ ID NO: 4184589 - RNA, 88 nt, Human
guccuggaggaagaucugcugugaugggcacuguuugagcacacaagagauauacuaaaccugaggccuccccagcagaccuccugau

SEQ ID NO: 4184590 - RNA, 55 nt, Human
guccuggggcucacuuuguacuucuuuucagugaagacaggaaaagcuccaggcc

SEQ ID NO: 4184591 - RNA, 57 nt, Human
guccugggugugauauucauagaggguaauggugccucuggggaagacaucuaggau

SEQ ID NO: 4184592 - RNA, 61 nt, Human
guccugugacaccaauauuuaauuuucucacugaggauauuucccauugugucagcagagc

SEQ ID NO: 4184593 - RNA, 74 nt, Human
guccugugcacuugaaacacuuaauccaacaguguauuauuuaucucuguggagcaguguguucauacagguac

SEQ ID NO: 4184594 - RNA, 79 nt, Human
guaguauuucaggauuuuaugagauaguuuguuuacuuuaaguagaaauuucucauuauuuuauaaacuuggauucuac

SEQ ID NO: 4184595 - RNA, 103 nt, Human
guagucaagcugucaaaguuucugucaucugaaugcuugaguggggcuggagaauccacuuccaaguuuauucaugugacuguggcuguuggcaggagacaac

SEQ ID NO: 4184596 - RNA, 64 nt, Human
guagucccagcuaccugggaggucaaggcagaagaaaugcauuagcccagguguuugaggcugc

SEQ ID NO: 4184597 - RNA, 75 nt, Human
guagucuauaaauauauaugccugauaaaagugauuagcaaucaggaaauacuuauuuauaaugugugagacuau

SEQ ID NO: 4184598 - RNA, 56 nt, Human
guagucuuggauuuuaaaaagugaccaggaagguauuuauuaaaauuuaagccuac

SEQ ID NO: 4184599 - RNA, 84 nt, Human
guagugauuaaaucauaauucaaauaagcuuaaauaaggagaaaacauuuauagcaugaaugaauugugaaaugugagcacuac

SEQ ID NO: 4184600 - RNA, 82 nt, Human
guagugccauuucacuauaauaugucaaaauacuuccuuugguaacagaguacaugacguaguuaaaguuuucuggcagugc

SEQ ID NO: 4184601 - RNA, 61 nt, Human
guaguggguggauuccagcaacgcugccuaauauccuacagugcuccaaacacacccacac

SEQ ID NO: 4184602 - RNA, 87 nt, Human
guaguguaggcauucagguuucuauuacuccaauauaguagucgcuuauuugaacugguaguuggaaaucugaauuugucugacuac

SEQ ID NO: 4184603 - RNA, 130 nt, Human
guagugucuggaacagucugauuugucuccauaucugcauugucccagaagugacuuuggcacuaaaaaguugaucauuaauuacuguuugggccaggugugguggcucaugccuguaauccuggcacuu

SEQ ID NO: 4184604 - RNA, 80 nt, Human
guagugugaccauccugguaaugaaucauggcagccuuucacuucagccaagaucucagugacuaugggugucaggcuau

SEQ ID NO: 4184605 - RNA, 105 nt, Human
guaguuaguagagaaugguuuuaaauauuccacagaggacuccgauugguuuuugagcuuggauaguuacugugcaguugagauagagccauucuaaaagacuac

SEQ ID NO: 4184606 - RNA, 55 nt, Human
guaguuaguuaagaugaguuuauuagggugggaccuaaacuccgugacuaauaac

SEQ ID NO: 4184607 - RNA, 64 nt, Human
guaguuauccauauucagacugugaauucuaaaccuggauucucucuagaauguggauuuuuac

SEQ ID NO: 4184608 - RNA, 88 nt, Human
guaguuauuagagcaagaauuguacaaacuggguggcacaaucaguuguaaacuucccgaguuuuggaacuuuuguuuuguucacugc

SEQ ID NO: 4184609 - RNA, 59 nt, Human
guaguugcuuagcacugaagcuuuagaaaaauuuaauccuuuagugaaaaggggcuaac

SEQ ID NO: 4184610 - RNA, 62 nt, Human
guaguuguugcuuagcuguaagcuggaaauuucaaggcagaaacagcagauaccacaacuau

SEQ ID NO: 4184611 - RNA, 89 nt, Human
guaguuucugacacacagagcaggugcugggaagaugcucaucaucauuuuccucccaugcacauuguucucuaaaacucagucacugc

SEQ ID NO: 4184612 - RNA, 114 nt, Human
guaguuugcagaguaucugcucccacccuuggcuuuccagaucagagugagucaggaggcuucuaggguugaggccacagggaggggguucuggaaaacuccuaugcauucuau

SEQ ID NO: 4184613 - RNA, 66 nt, Human
guaguuuucucuguguucugcuuacuauguuugaauaaugucuuaacugggguaggagaaggcuac

SEQ ID NO: 4184614 - RNA, 70 nt, Human
guauaaaacacaugcuucuuuugauuaugaggccccacuugaugacuaacaaagggaguaugaaguauac

SEQ ID NO: 4184615 - RNA, 130 nt, Human
guauaaacuuccuuuucuuuagaauggcauucagugcugcaggcaauagaaaaccugauuaacagugacuucucauauagggauuuuuguuugucaugcacaacaagugugggaaaaagaaguucaggac

SEQ ID NO: 4184616 - RNA, 115 nt, Human
guauaaaucucucucugcuuuucuuucaauaucucuaagaaugaggcuuccccaaggcccucagaagcuuggagauguguugaauuuguguaaagcaguaggguagcacugguac

SEQ ID NO: 4184617 - RNA, 72 nt, Human
guauaacuggauucugucuuuggaaaaaagaaucauugacuuuaccacagacagauuucaguaaauuugugc

SEQ ID NO: 4184618 - RNA, 82 nt, Human
guauaauauuucuagaauuuuuaaugcaguauaaaaugugguauuuaccaucaaggugcuuuauuaagagagaaauuugagc

SEQ ID NO: 4184619 - RNA, 65 nt, Human
guauaaugguaaucacuguguuagggauuaaguauacuucccacccuguguuuuugccauuguau

SEQ ID NO: 4184620 - RNA, 57 nt, Human
guauacagucauugugcugggaaaucuucucauuauccucacagugacuucugauac

SEQ ID NO: 4184621 - RNA, 104 nt, Human
guauacauucauuuaauaaacucuucagaauaauguguuagagaaguuaagucuucuccauuaacaaauuaguuuuuauaagaggaggaugguguaaaguauac

SEQ ID NO: 4184622 - RNA, 62 nt, Human
guauacauuuauugagcaccugcugaaugccagaugcugugugcuaggugccagugauauac

SEQ ID NO: 4184623 - RNA, 79 nt, Human
guauagcagcuggcuuugucaagggcagcaggaagcaugcgugacccugcuggccuugacaaaguagacagagucuuac

SEQ ID NO: 4184624 - RNA, 56 nt, Human
guauagguagccauauuugauaguauagaucuauaugugucugugguuaccuauau

SEQ ID NO: 4184625 - RNA, 94 nt, Human
guauagguguucaggaagucaaaauagaguucugucuucaagugaguuuggggaaaggagagcauuauuuuuccuuucuggagauuuccagugc

SEQ ID NO: 4184626 - RNA, 104 nt, Human
guauagugugcagaugguacacugaacaacucuaggugguaucauucacguaguucaugugguacaucuuuaaauuguucaguguacaaccuguacaacuguau

SEQ ID NO: 4184627 - RNA, 70 nt, Human
guauauacaguucgugcugcuaggagauguucccacugcaggggagcaaauucagaagcagaaugguuac

SEQ ID NO: 4184628 - RNA, 82 nt, Human
guauauauauacauauauaugaguauguguaugccuauauauguguacauauguaaacauguauaaaaauguguauauauac

SEQ ID NO: 4184629 - RNA, 59 nt, Human
guauauauuuauuucacaaauagguaucuuuuugauggcuuuugugaagaaaaugaugc

SEQ ID NO: 4184630 - RNA, 57 nt, Human
guauaucucuuacauacacacauaugcacacacacguguuuguuugugagagaguac

SEQ ID NO: 4184631 - RNA, 82 nt, Human
guauaugcaaugaacuuuuuuaaauggacauauucuuggcaaaaaugucaguaacaugucuguuaagaaaagucauuuaugc

SEQ ID NO: 4184632 - RNA, 71 nt, Human
guauauggaaaaauguaucuugucauggcucaaaagacacaacauuguuaagaugucaauuuuccacauau

SEQ ID NO: 4184633 - RNA, 61 nt, Human
guauauguucuugcacuggaaagaacugcagaauaauuuuuccuuuggaagaugcauauac

SEQ ID NO: 4184634 - RNA, 77 nt, Human
guauauucaaggaugccaauaaauguuaauaucuaaaauuggauugugauaauuguugcaaaacucugugaauauau

SEQ ID NO: 4184635 - RNA, 86 nt, Human
guauauucaucguguagaaauacucuuuuuugccuuuuacuuauuucuacauauagguuauugaguuuuucugcaugguucuguau

SEQ ID NO: 4184636 - RNA, 67 nt, Human
guauauugcaaguuaaaaauuauuagugcuacauuaagcaacugggaaauuaggggcuugcacugac

SEQ ID NO: 4184637 - RNA, 117 nt, Human
guauauuuaaaaauugcuaagggauuagauuguaaauguuuucaccauaaaaaauugauaaguauucgaggugauggauauguuacuaguuugauuuauuuauuucacaauguauac

SEQ ID NO: 4184638 - RNA, 80 nt, Human
guaucagagagcuuuguggcugggaagaagguaacuaaauaauuaguuucauuuauucagucauucauucguucugucac

SEQ ID NO: 4184639 - RNA, 58 nt, Human
guaucagugugcaucucugaaugauggugauugucuuuuaugggucaugcugaauugc

SEQ ID NO: 4184640 - RNA, 60 nt, Human
guaucauaguugaaggacuaucaugucauaucaugacaguguggaaagucaacuugaugc

SEQ ID NO: 4184641 - RNA, 85 nt, Human
guaucaugccuggcacagauuaguagcuguaauaacugggaauaaucccaguaguagcugaaauuauuaugugcaaaggagauau

SEQ ID NO: 4184642 - RNA, 81 nt, Human
guaucauuaagcugacuuuuaguuccauguucauguuagcucuaccaauaaaggcaggugcuaagagagguaaaaagauac

SEQ ID NO: 4184643 - RNA, 81 nt, Human
guaucccauucucugaucuucacauaccccuauucuuucauugcuugauuaaagguacgcgaaggucagagaauaggauac

SEQ ID NO: 4184644 - RNA, 65 nt, Human
guauccuauggcuauuuuauugacacaucccuucagcauguguauauuuggugucaauaggaugc

SEQ ID NO: 4184645 - RNA, 72 nt, Human
guaucgcccaggcuggagugccaguggagccaucucggcucacugcaagcaagcuccgccucccggguucac

SEQ ID NO: 4184646 - RNA, 80 nt, Human
guaucucauauaguaugauaggcuagacauuguuuagauuuguggauugacagguguggggcugugguacucgugugugc

SEQ ID NO: 4184647 - RNA, 65 nt, Human
guaucuuccaaaauuagucucaguuauaauuuuggaauguaacaugagaaucaguuuggggacac

SEQ ID NO: 4184648 - RNA, 65 nt, Human
guaucuucuaucccugguuuaggcaagagguguugagaguccgagcuagggcaaauaugagauac

SEQ ID NO: 4184649 - RNA, 62 nt, Human
guaucuucucaaaaaauguagguggcuccauagagggacccacaaaccauuugugaaggagc

SEQ ID NO: 4184650 - RNA, 72 nt, Human
guaucuuuguguguguguguguguguguguguguguguguguguguguauguguaugcaugcacuaagaugc

SEQ ID NO: 4184651 - RNA, 104 nt, Human
guaugaaccagucccaaguuugaucuugaucaaggcuaucaugaaagccaagauuucuuuucuccucagaggccuugguuaugguaugaugcagugguuuguac

SEQ ID NO: 4184652 - RNA, 57 nt, Human
guaugaacugagguccaccaggguacucagaagaugucccucacuccucauucaggc

SEQ ID NO: 4184653 - RNA, 62 nt, Human
guaugacugcagccuuugggcucauaaaugccaugcuuuacugucuggaggcuaggucagcc

SEQ ID NO: 4184654 - RNA, 63 nt, Human
guaugaggcagagaugaccagcugaugauugagaaguaucagacagggaguucuguguccuac

SEQ ID NO: 4184655 - RNA, 88 nt, Human
guaugaggggcugaucaaaaucuuuccuguuuuccagaauuggagacaaaaaccaauucugagaacaaaagguacucaguaccucugc

SEQ ID NO: 4184656 - RNA, 90 nt, Human
guaugaucauuauaaauuccagauaugauaggauuagcacaggguuccucaaauucuguagaacugacauuuuggacuggauaaucauac

SEQ ID NO: 4184657 - RNA, 80 nt, Human
guaugcagggcagcugugcuagaagccacgaacgcuauucucugucugggguucuaugccagccaccuucuacugccuac

SEQ ID NO: 4184658 - RNA, 83 nt, Human
guauggagaccauguuuacuaccaggagaauguacucacccuaagacaguacaguaaguccaggguaaauaaaucucccaugc

SEQ ID NO: 4184659 - RNA, 80 nt, Human
guauggaugaaucaugacguguugcugagugaaagaagccuuccacaaacauacaguacauuucauaugauucuacguac

SEQ ID NO: 4184660 - RNA, 56 nt, Human
guaugggcucucacccaacugugucggaacucugugcacugaggugcagcucaugc

SEQ ID NO: 4184661 - RNA, 55 nt, Human
guaugggcugaguggcugggucuaguuucuuagugaaauuccacugggcuuauac

SEQ ID NO: 4184662 - RNA, 64 nt, Human
guccauucuggagagaaaccuuacaaauauaaugagugugguaaggucuucacucagauuucac

SEQ ID NO: 4184663 - RNA, 65 nt, Human
gucccaaguuggaaggcagaguaacauguaaguuccuauucuaguucugccacuaauuaggugau

SEQ ID NO: 4184664 - RNA, 66 nt, Human
gucccacugggcaacuagaaaauuccuaagaaugaaggaguuauuugguucuugcuaagugaagac

SEQ ID NO: 4184665 - RNA, 89 nt, Human
gucccagcagauggcaaagaggugagaggagccuuugucuuggaccggccccagaggcuccgucaucccucuuugguuguuucuggugc

SEQ ID NO: 4184666 - RNA, 59 nt, Human
gucccagccacuugggagacugaggugggaggaucaccugagccuagggagguugaggc

SEQ ID NO: 4184667 - RNA, 56 nt, Human
gucccagccccagggggccaggguaaggccagggccuauguuccugggcuagggau

SEQ ID NO: 4184668 - RNA, 64 nt, Human
gucccaggugggcuccaccucugcccucugugauguggaguaggggcuggggcuccuuggguac

SEQ ID NO: 4184669 - RNA, 126 nt, Human
gucccaguuucuugaugucauuuuggugaaauucaacuugauuaaucccaugugaguaguucacaauuaucuacuucauuacguugaucacuuggucacuaauuaaucaaagucuaguacugggau

SEQ ID NO: 4184670 - RNA, 57 nt, Human
gucccauuucaagaaauucaugauguuauucuaagucaguguuucucaacauggggc

SEQ ID NO: 4184671 - RNA, 84 nt, Human
guccccagguccugcugcugcacauccucauugccuaaugaguaccuggugaggaaugcugagcagaggaagcaagauguggau

SEQ ID NO: 4184672 - RNA, 64 nt, Human
guccccagucccccagggccgccugugugcaguucccgccagcaucccucaggggccucuggac

SEQ ID NO: 4184673 - RNA, 74 nt, Human
gucccccagcauccucagacucuccgugggacugaaaguuucaauaagcuucuugacggauguucuggugggac

SEQ ID NO: 4184674 - RNA, 91 nt, Human
gucccccuccagccgcguacuguccagcuuggcuccuggggcuuggauguccaccuccaugcugggcagagacacguccagguugggggac

SEQ ID NO: 4184675 - RNA, 66 nt, Human
guccccgaucuugaccagccugucguuguccagcagcacguugcgcgcggcuaggucucgguggau

SEQ ID NO: 4184676 - RNA, 70 nt, Human
guccccgcgccuggagaggaggcgacgcguggccggcggcuuuguggcgcgcggguuccagcgcgggggc

SEQ ID NO: 4184677 - RNA, 83 nt, Human
guccccucagagaaggaaguugcacuguucaguuccuacugaggaaaagaaauuugcagaugcugcuccucucuagaauagau

SEQ ID NO: 4184678 - RNA, 83 nt, Human
gucccgucggcugcggccgcgcgcggcccggggucgccgugaguacucgccaggcuggccuguguggccgccaccacgggcac

SEQ ID NO: 4184679 - RNA, 79 nt, Human
gucccuaccagggcuuugccaaaguccagcucuuauauggaaccugaguuacuacuggugcugggcagggcucagggac

SEQ ID NO: 4184680 - RNA, 57 nt, Human
gucccuccuccaaagccaauuagguccaaccaggcccagugcauggagggagagggc

SEQ ID NO: 4184681 - RNA, 57 nt, Human
gucccucugcaaagccugugcugaaggagacaccagcucagagcaguucagagggau

SEQ ID NO: 4184682 - RNA, 67 nt, Human
gucccucugggccaucagguccaagccccuuggugcacagaaggggaaacugaggcccagagagggc

SEQ ID NO: 4184683 - RNA, 100 nt, Human
gucccugagcuguguuuugugagcuugcuccaugcccauccucagggugagacguaguccucaggauacaggagccacagaacgacauuccucaaugggc

SEQ ID NO: 4184684 - RNA, 65 nt, Human
gucccugccucagagcuacacacacgcaggcccuucgccugggcacugcagcucagggcaggggc

SEQ ID NO: 4184685 - RNA, 63 nt, Human
gucccugccucucagacuuccuuucaugcaaaucgcccugagugaggggugagggguagcaac

SEQ ID NO: 4184686 - RNA, 82 nt, Human
gucccugcuucuuccuuaguuauuugguccccuccuccucccagcaggauuaggguaggaacugaguggaagggcaggagac

SEQ ID NO: 4184687 - RNA, 57 nt, Human
gucccuggagcaggguacaggggucaacacacugccuucuguuuuuuguaccagggc

SEQ ID NO: 4184688 - RNA, 68 nt, Human
gucccuggaucugggacagcugcaugcaguagcgguucucugucuccgccagguugcccuccagggau

SEQ ID NO: 4184689 - RNA, 76 nt, Human
gucccuggcacugugccuucacacuggucacugugaaaagcagaucacacuggacucagaggccagaauccaggac

SEQ ID NO: 4184690 - RNA, 61 nt, Human
gucccugguuugcccaggaccaucccaguuuuagcacugaaaguccugggcaaacugggau

SEQ ID NO: 4184691 - RNA, 83 nt, Human
gucccuucucuccccacacuccccaagccccgcucucaguggguccuuaacaaacggggaaaagguggagagagaagcaggac

SEQ ID NO: 4184692 - RNA, 82 nt, Human
gucccuucucugugcuuccucugccaacacucugugcgguguuuccgggagucagaauggcaggguggucaagaguacggac

SEQ ID NO: 4184693 - RNA, 55 nt, Human
gucccuucuugaguuagaacagguggguggacuuguacaagcucaccaaguggac

SEQ ID NO: 4184694 - RNA, 115 nt, Human
gucccuuuugacaaugguaucuuaggggcuugaggguccaugaaucauccuuucaguccuggaggaggcccuagagcucuagagucaccaauuguuugucacuaaagggagggac

SEQ ID NO: 4184695 - RNA, 62 nt, Human
guccgguucuuagcaugaugcaaaauaauuucuuuucuuuuguauaaaugaagaugcuggac

SEQ ID NO: 4184696 - RNA, 61 nt, Human
guccuagaaacucucacgagugaaacagcaaccugugcugucuuugcuaguuucugagggc

SEQ ID NO: 4184697 - RNA, 65 nt, Human
guccucaccuuuucucugauugcuagccaaaggcccaagggagcagagggaggagaggugagggc

SEQ ID NO: 4184698 - RNA, 55 nt, Human
guccucacuggccgcacgcugagaacgagaagcucgggugggcagcagcgggggc

SEQ ID NO: 4184699 - RNA, 56 nt, Human
guccucagaugcugcugaaauguacacaucucauaguuuaugccagcguuuaggac

SEQ ID NO: 4184700 - RNA, 59 nt, Human
guccucagcuccaggcuugcucagccugcaccuuggcuggcggcguguggacugaggac

SEQ ID NO: 4184701 - RNA, 74 nt, Human
guccucauuuacacagaggacacugggcuggggacgugccccgagccugagucucuucuucugucaaauggggc

SEQ ID NO: 4184702 - RNA, 89 nt, Human
guccucccgguugauggguuguuuccugcaccgugugggcucugguggguaggggaggagaguaggaaggaggccaucuuggcggggac

SEQ ID NO: 4184703 - RNA, 61 nt, Human
guccucuacggaccucaucuccaggcaccacugagaugcuuuugguccaagaguccaugac

SEQ ID NO: 4184704 - RNA, 62 nt, Human
guccucugaaagaugaaccauggccuaugcauccuugggaaccagguuccuuuagaguuggc

SEQ ID NO: 4184705 - RNA, 58 nt, Human
guccucugagggggcugcacgcccugcccgcaggcucggggaagccaccucagaggac

SEQ ID NO: 4184706 - RNA, 58 nt, Human
guccucugcccaggucaagguuggaagaagaaaaccccagaaucugacccagagagac

SEQ ID NO: 4184707 - RNA, 78 nt, Human
guccucuguuccuggucucuggagcuucaauuugggaaagugacccauuagcuucugaggaccagggugagagagggc

SEQ ID NO: 4184708 - RNA, 68 nt, Human
guccugaacugccuucuuagugaccuguggcauguccugaauagccuuucugagcaggcagguaggau

SEQ ID NO: 4184709 - RNA, 58 nt, Human
guccugaggaugcagagauaaaugagacccagccuccaccucugcaggaccucagggc

SEQ ID NO: 4184710 - RNA, 59 nt, Human
guccugauauuuuucacuggccucugggauauaucugugaugucagugguaucaaagac

SEQ ID NO: 4184711 - RNA, 96 nt, Human
guccugccugcuggaacuugguguaucucuuagauacuguaucuaaugcuaucaagagucucuacauuaaucuuagcuucuccagucagguuagau

SEQ ID NO: 4184712 - RNA, 68 nt, Human
guccugcuucugcuccccacccuccuacucugugagcagaaucaggagcuagggggcaaugcuggggc

SEQ ID NO: 4184713 - RNA, 62 nt, Human
guccugcuucuuaguuccuucuuugugacaaaccaaaagaauaagaggauuuagaacaggac

SEQ ID NO: 4184714 - RNA, 55 nt, Human
guccugcuugcagcucucacuggcagccagggcugcauuugaguugggagcaggc

SEQ ID NO: 4184715 - RNA, 60 nt, Human
guccugcuuguuaggccuaguccauugucuauaguguauuaguggccagaaaagcaagau

SEQ ID NO: 4184716 - RNA, 97 nt, Human
guccugcuuuggguaacuuggcucagugugagggagaugugaguauaccugucccacgcgcugugcugcuuccggucugcccaucuugcccguggac

SEQ ID NO: 4184717 - RNA, 121 nt, Human
guccuggaggagcacuggauuaggaaucuggaggcccaguuucagcucugccuuugcacugacacuaggggcugaggcugagauuggucuugggaaucuuuaagcuccucucaguuuugac

SEQ ID NO: 4184718 - RNA, 61 nt, Human
guccuggaucugguucccugagccuuuauuaagaaugaauguuuucuugccaauccaugac

SEQ ID NO: 4184719 - RNA, 65 nt, Human
guccuggcagaaauggggcugugggccuagcaggacuacucucuccuuuuuucugcucuuaggau

SEQ ID NO: 4184720 - RNA, 60 nt, Human
guccuggcccacuggcaggcuggacaggcggccagcaggagagccaguggguccaggugc

SEQ ID NO: 4184721 - RNA, 73 nt, Human
guccuggccucuggggguauggugaugaacaacaacaaaacauaaaacagauucaugcccuuuuagagcugac

SEQ ID NO: 4184722 - RNA, 55 nt, Human
guccuggcuuaguucgcuguaacuucccuauaugacuccacugugcagccaggac

SEQ ID NO: 4184723 - RNA, 78 nt, Human
guccugggacuugaaagcuggcuucacauggaggaaggaacacuccuuguugcugcagucaccugaaaaucccagcac

SEQ ID NO: 4184724 - RNA, 111 nt, Human
guccugggauggaugaauucacaguggcugacaggcuggccguucuacagcugcaaaugucacugugagcuagaucugaucagcugagacuuugcugugaccggguaggau

SEQ ID NO: 4184725 - RNA, 63 nt, Human
guccugggccugcugaggcugagccaguggagcuggaugacagccuguaucagggaccaggau

SEQ ID NO: 4184726 - RNA, 57 nt, Human
guccugucccugggucccuggcuuugcccugugcuugucaggagccuaggacaugau

SEQ ID NO: 4184727 - RNA, 57 nt, Human
guccugucucucugcugcugggacccagggcuuuuucagcugcagaacccacuggac

SEQ ID NO: 4184728 - RNA, 62 nt, Human
guccuguugugagcugccuucccuaaccccucugcuaaagaacacagcugcaggcucaggac

SEQ ID NO: 4184729 - RNA, 71 nt, Human
guccuuaaaaguuccauaaaugaguucaggcugccaacccucaguuucauguguauggaacauuuuuugac

SEQ ID NO: 4184730 - RNA, 76 nt, Human
guccuuaaucauugcucuuugucauguccuuaacugucugagaagacaggcagggcauggaaaaagucuugagggc

SEQ ID NO: 4184731 - RNA, 56 nt, Human
guccuuagaccuggcaaauggggaggguccaggccgucacucgccggcuagguggc

SEQ ID NO: 4184732 - RNA, 73 nt, Human
guccuuagaggcccucucugcucagucuaggucuuaaagcugagaucaaagcacaaggggcaggacuagggau

SEQ ID NO: 4184733 - RNA, 55 nt, Human
guccuuaucacagggucacaacaguucccaucagauuuugccccugggugaggau

SEQ ID NO: 4184734 - RNA, 58 nt, Human
guccuucauggaguuacagccuaaguaaaugucagguugugcuaagugcuaugaaggc

SEQ ID NO: 4184735 - RNA, 68 nt, Human
gguauaugagucaaaggcaccaaggucacugccaguccacagcuggcccuacugccuugaucugcacc

SEQ ID NO: 4184736 - RNA, 71 nt, Human
gguauauuucuccuccagauggugguuguauauuuauagagcacaucugugaucugggggauuguaugucc

SEQ ID NO: 4184737 - RNA, 55 nt, Human
gguaucaaagaagggggugccagagaaagccaagggcgcccccuucuuugaugcc

SEQ ID NO: 4184738 - RNA, 67 nt, Human
gguaucagagagugcaaaauauagcuacuuaccuccaaaggaagcaauaugcauacuuucugaaucc

SEQ ID NO: 4184739 - RNA, 58 nt, Human
gguaucaggacuucauuccuuuuaauguuuagauaauagaggaggugauucuugagcu

SEQ ID NO: 4184740 - RNA, 58 nt, Human
gguaucauggguuaugacauucuucucugagagagaaggccagaauuucaauggugcc

SEQ ID NO: 4184741 - RNA, 56 nt, Human
gguauccugaaucucauaugcagucacaguucuggaaagucuggaggucaggagcu

SEQ ID NO: 4184742 - RNA, 76 nt, Human
gguaucuaugggcuaucaaauggagguauccagaagaaacuggauacauuagaaucugguacucaggagaaauauc

SEQ ID NO: 4184743 - RNA, 79 nt, Human
gguaucuggcaugugggcugcaacuguggaugaucgccucggugacaaugcauaccuagcagcucagaugucagauacu

SEQ ID NO: 4184744 - RNA, 88 nt, Human
gguaucuucuuucuaugaagcaacagcccuccuauuuggcaagaacaucccagccaaaggggagguucuucaaggaauugagauagcc

SEQ ID NO: 4184745 - RNA, 55 nt, Human
gguaugacuccucugagaaagagcuucuugcguuuucucagggaggagucaagcc

SEQ ID NO: 4184746 - RNA, 58 nt, Human
gguauggaggucacaucacuccuuugcccuuaggcuugaguggaacgcucuucacacc

SEQ ID NO: 4184747 - RNA, 84 nt, Human
gguaugggaaaguaaugcaggaggaggugagguagaacugugcuuugucauccacacgagccccgauuccuccuguucccaacc

SEQ ID NO: 4184748 - RNA, 55 nt, Human
gguauggucaggggcacaaagcccacacuaaucgcucacugacccuugaccagcc

SEQ ID NO: 4184749 - RNA, 63 nt, Human
gguauguaaagcccuuagaacaguaucuggcauuucauaacugaucaaggguuuaauuuuacu

SEQ ID NO: 4184750 - RNA, 59 nt, Human
gguaugucuuucauuucuuggaggcuagguugagcaacuaucuuccuggaagucauucc

SEQ ID NO: 4184751 - RNA, 84 nt, Human
gguaugugugcuuuugcucugcccaccugccucccacccuacccuucagugcaggucucggguucagcagugagugcucaugcu

SEQ ID NO: 4184752 - RNA, 80 nt, Human
gguauucccuuugguauggucaaagccuguguaauacuuaagcaugucucauacacggcuugaccauuuugauugaauuc

SEQ ID NO: 4184753 - RNA, 67 nt, Human
gguauucuuggcggcucucagggaagguuugggauuucggaaaggcuguucugagggugcgggagcu

SEQ ID NO: 4184754 - RNA, 67 nt, Human
gguauugguaggagaauauugaaauuuuaggcaauucuuaagagcucccuucuccuugcauuguacc

SEQ ID NO: 4184755 - RNA, 59 nt, Human
gguauuuaacaaaaauaucaggcaucacauguauugugggcuugucuauugucaaugcc

SEQ ID NO: 4184756 - RNA, 57 nt, Human
gguauuuauaugucugaagcugcucugagucuggccguccuagacaauguggauauu

SEQ ID NO: 4184757 - RNA, 76 nt, Human
gguauuucaggugguaaaaugugaaauggauuuuugaaggcaaaauguuuauuugguuuaucacuuguuuaugucc

SEQ ID NO: 4184758 - RNA, 86 nt, Human
gguauuugagaagagucugugaacuuggcagggaaaggcuauuaugcaauuuccuugaaugagucauggaaaaaccuuaaauugcc

SEQ ID NO: 4184759 - RNA, 113 nt, Human
gguauuuggccagcuucgagaaagccccaugcaugccuucaggaggguuccagacaagggcacccugucccaacccacuuguaggugcccuggccucaaaguuguaaaauccc

SEQ ID NO: 4184760 - RNA, 62 nt, Human
gguauuuuguuagggugugguauuuguuacagcacagcauauugaacccuacagacuguacc

SEQ ID NO: 4184761 - RNA, 91 nt, Human
ggucaacuaauuucuaaggauguucucuguugcaaggguuauugacucuucagucaaacacuguaacauggaaaaucuaaccuaguuggcc

SEQ ID NO: 4184762 - RNA, 71 nt, Human
ggucaacuuuguugagcuucuuagaaauagugauguauagugaauguuucuaucuggaucaauagaugacc

SEQ ID NO: 4184763 - RNA, 57 nt, Human
ggucaagacgggcucugcccuuugcuagcagugcaaacuugggcaaguugcuugacc

SEQ ID NO: 4184764 - RNA, 86 nt, Human
ggucaagcacaggugaguaacaaugggugaugaacuguagcagucaacaugcagaagugcuuucuggaaacacuuguguucugauc

SEQ ID NO: 4184765 - RNA, 65 nt, Human
ggucaagccggcugggccgaggcugcccacaccugggguccucgcggcgcgaagccagugcggcc

SEQ ID NO: 4184766 - RNA, 76 nt, Human
ggucaaggcgggcggaucaccugaggucaggaguucaagaccagccuggccaacauagugaaaccccgucucuacu

SEQ ID NO: 4184767 - RNA, 97 nt, Human
ggucaaggcuguggggcugccaggucaccaggcccuggacacucaagccgggucccuccggugggggcagggcaggggcugcgcccucagccugacu

SEQ ID NO: 4184768 - RNA, 130 nt, Human
ggucacacccuuggagcauaacaugccuccuaaauacagguuuuuaguuacuaaugguagcuuaacaggcuuagaacuguucuccacaguacaggaaaucuuguucaaaagguacuugaaaggugugacu

SEQ ID NO: 4184769 - RNA, 98 nt, Human
ggucacacggucacacagagcagaggucgggcauaugggcuccugguuggauucccgggaugccaguccuggcccugccugccuugugcuguguggcc

SEQ ID NO: 4184770 - RNA, 82 nt, Human
ggucacacugaucacaggugguaggaaaagaaacuuuaaugauuuccuuuucucauuaccacccgugcccuugguucuggcc

SEQ ID NO: 4184771 - RNA, 56 nt, Human
ggucacagggaagggcucucaacugugacccgccgagggcgcuucgauucgugacc

SEQ ID NO: 4184772 - RNA, 78 nt, Human
ggucaccaagccauucuccucaugccaaagaagcgguacaaauagaaaugccuuccagaggcuugaggaaaauugacc

SEQ ID NO: 4184773 - RNA, 77 nt, Human
ggucaccgagagaguugaggaagcaacacucgaggucccagccuuugcaggagcuagacuuagaucuuccgguggcc

SEQ ID NO: 4184774 - RNA, 62 nt, Human
ggucaccugacccaagcauggcgggcugaguccaggaggggucugcauguuggagguguacc

SEQ ID NO: 4184775 - RNA, 62 nt, Human
ggucacugaccacaaagauauucuguucccaaagagcaccauauucguggucaaguaaggcc

SEQ ID NO: 4184776 - RNA, 74 nt, Human
ggucacuggucagugaaacaguauuuccuaaguaugucugacuuccacaauacuugaauuucaugucaggggcc

SEQ ID NO: 4184777 - RNA, 55 nt, Human
ggucacugucugagguacuggagauuaggacuucaauauaccuuucugcagggcu

SEQ ID NO: 4184778 - RNA, 88 nt, Human
ggucacuuuuaaugucuucuuuuggguucagacaugauuacagagaaauuuggguuuuguccugauccaucagugagauaaaguggcc

SEQ ID NO: 4184779 - RNA, 122 nt, Human
ggucagaaaggcauauuaucugcauauuagcagccuauucuucucuuggagaauaucuaaguacgcaaggagauccaagagaagauggguuaucaggaugugaagaguaguuaccuguggcc

SEQ ID NO: 4184780 - RNA, 58 nt, Human
ggucagaacaaggguaaauaaaugaaauguugauuaauuuguuuauuauguucugauc

SEQ ID NO: 4184781 - RNA, 76 nt, Human
ggucagaauggugucugucaucugagauggagugggguuuccauuacccccucugggugacagacucuugguuacc

SEQ ID NO: 4184782 - RNA, 71 nt, Human
ggucagagcagcauuuuacaggaugauaaauuacccucguuuagcugaauccuagaagugcaugucugacc

SEQ ID NO: 4184783 - RNA, 59 nt, Human
ggucagagccauggagcaacuggcccaaaguuacccaguggcucuucugggcuuugacc

SEQ ID NO: 4184784 - RNA, 65 nt, Human
ggucagagggcguacugaaguaggaagaggagggcuugccugccagcugcuucaggcgccuugcc

SEQ ID NO: 4184785 - RNA, 68 nt, Human
ggucagaggggauuccuugggagagagaauugcaguaccagauugcaggccgagggcccugucugacc

SEQ ID NO: 4184786 - RNA, 61 nt, Human
ggucagcacaaauggccguguucaaagaagucucugacucuuugccaagucguuuggcacc

SEQ ID NO: 4184787 - RNA, 66 nt, Human
ggucagcaguguagcaucuucaaaagucugucucucugcuucugucacaauuugcuuacucugacu

SEQ ID NO: 4184788 - RNA, 60 nt, Human
ggucagcccugcggagguguauacugugguggcagccacuccucuucagcagggaaaacc

SEQ ID NO: 4184789 - RNA, 79 nt, Human
ggucagcucccuuucuugacaucucaagagcuggcuucagccccaggacacaguucuuagcaggugucuuugagcuacc

SEQ ID NO: 4184790 - RNA, 88 nt, Human
ggucagcucgucaaucuugugcuugcagcuggggagagugaguagacauuucgccugacguuugcugccagcauaaaaaugaguuacc

SEQ ID NO: 4184791 - RNA, 64 nt, Human
ggucagcuuucuauguugcuaaacaacaggggauucuggguucaguaacguugaaaggcaggcc

SEQ ID NO: 4184792 - RNA, 62 nt, Human
ggucaggaagaaggguggugaguccuauuauuuagucuccuuugguacccuuuuucaaaacc

SEQ ID NO: 4184793 - RNA, 57 nt, Human
ggucaggagcccuuggcccccucuccacccuugggcuggggcccaagcccucuugcc

SEQ ID NO: 4184794 - RNA, 79 nt, Human
ggucagguagguccagcugucuagcuuuguagagggagggcagguccuucccaaggcacagggcagggacuccuugacc

SEQ ID NO: 4184795 - RNA, 56 nt, Human
ggucagguccaguaaaaagaguccuccgguggaggagggugaggcuggaguuugcu

SEQ ID NO: 4184796 - RNA, 60 nt, Human
ggucaguccccuggcaggagggacgugcagaaaagcacggggcaggcagaggggcuggcc

SEQ ID NO: 4184797 - RNA, 88 nt, Human
ggucagucugguaaacugcaguuuuugguaaaagcacccuggcuggcugacacugccgaaacuguagaguuuucauuaccuacugacu

SEQ ID NO: 4184798 - RNA, 74 nt, Human
ggucauaauaaugauaaugguuauagcuaugagaaagacauuaaguacuauauacacauuaucuuguuguaucc

SEQ ID NO: 4184799 - RNA, 66 nt, Human
ggucauagcacuguucacacaauguucuggggagcccaggagcuccuugaaggcaguagcuggacc

SEQ ID NO: 4184800 - RNA, 71 nt, Human
ggucauaucuauuuucaagggagcaagaaagugcaguugcauugugugcuucagagaagaauggaaagauu

SEQ ID NO: 4184801 - RNA, 101 nt, Human
ggucauauuugaaaugguguuauuuuucaauagaaguucuucacgaaggcaucaucucuaaaaugugguuaucuuuuguuaggagaaaacaucaaaugacc

SEQ ID NO: 4184802 - RNA, 61 nt, Human
ggucauucagagucugcuagugccacggccugcccaauaggagcuggcagaauuuugaacc

SEQ ID NO: 4184803 - RNA, 62 nt, Human
ggucauuccugacugggaagguugcuugacaagucaggauugugccuccagucagaaggacc

SEQ ID NO: 4184804 - RNA, 85 nt, Human
ggucauucucugcaaaugccuacuaaagcaaauauaacucuugcaaguuagcuuuggauucuuuggggaauguagagaaacagcc

SEQ ID NO: 4184805 - RNA, 85 nt, Human
ggucauucugcacuuccuuugcuucccuuccaugaccagcuggaacccccaucccggagaggcaguauuuggggugacagaugcc

SEQ ID NO: 4184806 - RNA, 72 nt, Human
guaugguagaauacaaaauauauacuggagacuuguaaagucucuuagaaccuuguuuuggaacugccaugc

SEQ ID NO: 4184807 - RNA, 82 nt, Human
guaugguggcaaugguagaauuauguauuggcuuuuaaagcuucuucucaaaagucacaugcauuuucuucaauucacauau

SEQ ID NO: 4184808 - RNA, 101 nt, Human
guaugguuaucccuuggcuauuagguaugugguugcuaugacuaggguuuggaauaguaucacaacgucauauagcuauuuacaauagcaaaugggcauau

SEQ ID NO: 4184809 - RNA, 92 nt, Human
guauguauucauuccugauucacaaacaaugcuuuggaauuuauaguguauguaguuucaaauccuguuuggauacaugaggaguaucauac

SEQ ID NO: 4184810 - RNA, 62 nt, Human
guauguauuuauggaguccucacuauguaugucacacuggauuagguacuaugaauauauau

SEQ ID NO: 4184811 - RNA, 83 nt, Human
guaugucaacuacucaucaagacaaauacuaauggaagguuuccacaaauuagguuuugcuuguguaaugguaggaagacaac

SEQ ID NO: 4184812 - RNA, 60 nt, Human
guaugucaugagccuugugcgucaccucacuguggugcaugugcaagggcgugugcacgc

SEQ ID NO: 4184813 - RNA, 105 nt, Human
guaugugaauaauuucuauuaguucuauaagcagauagaguaugaccuacugguauuaccuguacugcuuuauggggcaaaccucuagaucaaaccucuacguau

SEQ ID NO: 4184814 - RNA, 59 nt, Human
guaugugacacuuagaacagugucuagcacauccuaagcacucaauaaaugucauaugc

SEQ ID NO: 4184815 - RNA, 65 nt, Human
guaugugcagguuaagucuacaguggaggugggaaacagccuuugcagaagaaaccuacaaauac

SEQ ID NO: 4184816 - RNA, 67 nt, Human
guauguggaagaaggugguguugguaggucacagaagggugggcccagccagccucuucccauaugc

SEQ ID NO: 4184817 - RNA, 103 nt, Human
guauguggauuuaagugcauguguguauaaaugcguguguguauaagugugugugcguauguauaaaugcauguguggauguguauauguaugaucuacaugc

SEQ ID NO: 4184818 - RNA, 89 nt, Human
guauguguauuguuguaucuaccugcagauauguaugucuuauuguaucuacauguagguauguauguauacuuuuaauguacacauau

SEQ ID NO: 4184819 - RNA, 61 nt, Human
guaugugucuuagaacuugggacuuagaacucuccccuucucccuggaaugagaugcauau

SEQ ID NO: 4184820 - RNA, 55 nt, Human
guauguguugaauucaggggucgugacuuacaccacucugaaguccagggcauac

SEQ ID NO: 4184821 - RNA, 62 nt, Human
guauuaggugguggaauuguagaugaaguuuucuuucuucaaauaauuucauuuacuuaugc

SEQ ID NO: 4184822 - RNA, 60 nt, Human
guauuagguuggugcaaaauugacaauggcaaaauacacaauuuugcaccaaccuaauau

SEQ ID NO: 4184823 - RNA, 59 nt, Human
guauuauuuacauacauguguguauaucuacuuguguaugugcauauguguaagaauac

SEQ ID NO: 4184824 - RNA, 90 nt, Human
guauuauuuuaucccuguuuugugagucaauguauugcagcaacuauugauuguuggcaagauguauugaucauuagggucuaauauggc

SEQ ID NO: 4184825 - RNA, 129 nt, Human
guauucaaaguaucaauaaccuuggaaaauacaaugcuuuuauuuaauaucuugcauguaauucccuauguggaagaaaguguguauguuuaauagaaugcauugguuuggaaagaauacuuugaguau

SEQ ID NO: 4184826 - RNA, 76 nt, Human
guauucacacacauuuagagcagaauuugauuccaauacucuaaucaaugaacaucuagcaaaguguggugaauau

SEQ ID NO: 4184827 - RNA, 69 nt, Human
guauucacuguugaccuggaagugggucgggucaauacuucccauggugacuauggucaacagcgguac

SEQ ID NO: 4184828 - RNA, 58 nt, Human
guauucagugacaggguauuaugagcucuuugugcacauaauuccauguuaugaaaac

SEQ ID NO: 4184829 - RNA, 70 nt, Human
guauucaugaacgaacauauguauaaauauaaacauucagguaauuauguguauguucauucaugcaugc

SEQ ID NO: 4184830 - RNA, 112 nt, Human
guauucaugggcagcuccaaugugagcaaucagcacugucuuuuauuugaaggauacuguccuuuaagcguaagucaugcugacauguaauaaauggaguaucuauguuugc

SEQ ID NO: 4184831 - RNA, 56 nt, Human
guauuccugcaaauagcagugaaauguuugcaaggcagugugguuuucaggaauau

SEQ ID NO: 4184832 - RNA, 81 nt, Human
guauuccuuuccucucugaguggguauuaacaagauuagcauuaaugggaauuaaauugguuuagagaggaacacauaugc

SEQ ID NO: 4184833 - RNA, 86 nt, Human
guauucgguuggugcaaagguaauugugguuucugccauugaaaguaaaggcaagaaccucaauuaccuuugcagcgaccuaauac

SEQ ID NO: 4184834 - RNA, 67 nt, Human
guauucugccuucagacaccacagccaguuugauaguugucccacaugcuguucugaagcagaaggc

SEQ ID NO: 4184835 - RNA, 74 nt, Human
guauuggcaguauacauagcacuacucaagaagccaaagaaacacuugugcagugcuaagugucacaugucugc

SEQ ID NO: 4184836 - RNA, 71 nt, Human
guauugucauagaggccuauauaauuuaggaaaacaaacucuggaaaauuuaugcuucucuguggaaauau

SEQ ID NO: 4184837 - RNA, 77 nt, Human
guauuucacauauggauaugcuauccauugauauuauaauagauaaauaaauuguagcauaucuuuguguggaauac

SEQ ID NO: 4184838 - RNA, 71 nt, Human
guauuucauccauucugauguauuuuguuuuguaccugauaaaaugaagauaaaaugggauggagagagac

SEQ ID NO: 4184839 - RNA, 120 nt, Human
guauuucuucaagcuauuuugcuuccuuuccccaaucauaucgaauguguuuuuaacuuaauauaaucaaagcaaccugguaaugacuggaaaaggggguaaagaaauugacugaaaugc

SEQ ID NO: 4184840 - RNA, 85 nt, Human
guauuugauacugaaaaacuggaugucccuguaugauucgucauaaauuaagcgaacacagcagggauaaccacucuucaaguac

SEQ ID NO: 4184841 - RNA, 67 nt, Human
guauuuggaaaggacauguaaguauaauuaucucaguaagaagcuuacaaauugucuuuuaaaauac

SEQ ID NO: 4184842 - RNA, 56 nt, Human
guauuuggucuauuuggcauccauuuaucacagggccaaaucacagggccaaaagc

SEQ ID NO: 4184843 - RNA, 75 nt, Human
guauuuguugaauaccccugucuuuguuugugcugcuauaacacaguaccugagacuggguaauuuacaaagaac

SEQ ID NO: 4184844 - RNA, 74 nt, Human
guauuuuacugaaauuccauuucagccacagaaaugccgaaugccugccggugaaauguaauuucuugaaguau

SEQ ID NO: 4184845 - RNA, 103 nt, Human
guauuuucagagacagcacaggaagugggccuucacaaugucaggauacaggaagcuaucggacuauugaaggccacuuccugugagcuggucauucacauac

SEQ ID NO: 4184846 - RNA, 61 nt, Human
guauuuucaugauuucagaccacugggucacuguggugauuauuggagugauggcagguac

SEQ ID NO: 4184847 - RNA, 106 nt, Human
guauuuucauuuauacugguaugaaaugauuccauguuauauuacuuaguuagcaaaaugguaugcauaguaugguuucauuugaguaaaauauaaaaaagaauac

SEQ ID NO: 4184848 - RNA, 73 nt, Human
guauuuucucuuuaguuucauuaguauucuaauauugauauuagugguaaggaugaaauuucaggguaaauau

SEQ ID NO: 4184849 - RNA, 130 nt, Human
gucaaaaucuuuuuguguauauauguuuuuuucaguugauacacaauggaacaauguucaugaaccugacauuugcuuuguaguguuaagagaauguaauggcaucuauauucagugaaagcguuuugau

SEQ ID NO: 4184850 - RNA, 77 nt, Human
gucaaaauuacaagccaucuccuucgcucucccauggugaauuggggagcugugggauugguugaguguaugcugac

SEQ ID NO: 4184851 - RNA, 94 nt, Human
gucaaaauuucaaauuugagaaggaggcaagagucuugucgugcaaggcacugguccauuuucugcagcagguuugguucaauuaauuucugac

SEQ ID NO: 4184852 - RNA, 73 nt, Human
gucaaacauccgggauuaugugugauauaaaauuuuuugaauuauauguauguccuuuaaaaggagccaugac

SEQ ID NO: 4184853 - RNA, 66 nt, Human
gucaaacuugauuguaugaaguuauuuuuagccaugguuugaaauaucuuuagcaaucaagaagac

SEQ ID NO: 4184854 - RNA, 72 nt, Human
gucaaagccagguuucuuuagcugucauggaaagaagagagcuuaguggcaguuggaaaaacgguuuguaac

SEQ ID NO: 4184855 - RNA, 57 nt, Human
gucaacuccccaugcacugucccuggauucggaagguacaggcgcuggggagauggc

SEQ ID NO: 4184856 - RNA, 77 nt, Human
gucaagagggcacugcuuuuaccuaggugagagacagugguggcuuggaccagggugggagcaguagaauucuugac

SEQ ID NO: 4184857 - RNA, 57 nt, Human
gucaaguuuauccgcucauucaucauucacaccucagaugaagcggguuuccuugau

SEQ ID NO: 4184858 - RNA, 91 nt, Human
gucaauacugcuggacugaaacugguaagaaugugaugauuauacaucauuguguccuaacaucuaguuaaaguucugaggcacuauugac

SEQ ID NO: 4184859 - RNA, 59 nt, Human
gucaauauagaucaaugcacaguauacaauagaaugaauuguauugaucuaauauuggc

SEQ ID NO: 4184860 - RNA, 70 nt, Human
gucaauauuuuugguuuuccuuugggucaaacuggguaccguugcagagguugagcaaaaaugauaugac

SEQ ID NO: 4184861 - RNA, 112 nt, Human
gucacaaggguguggggucagugucugcuggugagcuguauauuguuuuaauauuacuuauauugagaccagugcuugcuuagcuaccagagaaaaauaaacauauuguggc

SEQ ID NO: 4184862 - RNA, 64 nt, Human
gucacaauguaggcugaaaaagcuuugugaacguuccacaaagcaucaacacuauauugaugac

SEQ ID NO: 4184863 - RNA, 64 nt, Human
gucacacaaccucucugggccugcuuccugaugauuagauuagaaugccuagagagagugcgau

SEQ ID NO: 4184864 - RNA, 59 nt, Human
gucacacagagcccugugcucagguggacccugagcuuggauuaaugcucugcugucac

SEQ ID NO: 4184865 - RNA, 65 nt, Human
gucacacagcaguuuagaggacagccaagucugggcugccuggcugccuccagcugcugccugau

SEQ ID NO: 4184866 - RNA, 77 nt, Human
gucacacagucaaguguaguggugucaggucuaucugaccuaaaguccaugaucuuccuucauuaugcucuguugac

SEQ ID NO: 4184867 - RNA, 81 nt, Human
gucacacuaaagcagcacaguaauauugguguuuaauauauauuucacuacgccaauauuuacgugcugcuagaguggaac

SEQ ID NO: 4184868 - RNA, 57 nt, Human
gucacacucuucccuccacaugcccugcagggcuacucuuggaggcagaguucuggc

SEQ ID NO: 4184869 - RNA, 94 nt, Human
gucacacuuugagaagcaugguucuaaaggacuauacagauuaaagucauuaaucucugugggcuuuggacuugaaguuucagcagccuuugac

SEQ ID NO: 4184870 - RNA, 59 nt, Human
gucacagaguuauuaauuguguuagucuucuuaaugcaccaauguuugacuuuguugac

SEQ ID NO: 4184871 - RNA, 68 nt, Human
gucacauaggcccuuggacucaugcucgaaccggaaggucggguugaucaacaagggcucagugagac

SEQ ID NO: 4184872 - RNA, 117 nt, Human
gucacauauguacuuucugguaugauucuacauuuaaaaggaaaaucugggcuguagauauagauuuggcaauguuuuagcauguagauaauauuuaaagacauaaaacugguuggc

SEQ ID NO: 4184873 - RNA, 79 nt, Human
gucacauauguuuauacuuugauguacucaugcaaaacacauggcaaaaauggguuuauuaaugugaacuguauaagac

SEQ ID NO: 4184874 - RNA, 62 nt, Human
guccuucugagugcccaggcaggccgggcccugugcugagcacugggcacauagcugagagc

SEQ ID NO: 4184875 - RNA, 125 nt, Human
guccuugagcaaccuggauucugguagugagugguguuuugggggugcuaggauccuggggacaauugggagcuccccaagauguugggugccuccggaauaaccugaagacaagguuggaggau

SEQ ID NO: 4184876 - RNA, 64 nt, Human
guccuugaugagauauuuacucugugaccauuucuuucucugagaguguuuuucugucaaggac

SEQ ID NO: 4184877 - RNA, 82 nt, Human
guccuugcuauugugaauggugccgcaauaaacauacgagugcaugugucuuuauagcagcaugauuuauaaucguuugggc

SEQ ID NO: 4184878 - RNA, 67 nt, Human
guccuugugcugaggguguugcuagcaugugcuuuacucagugagcagcagugacucagcacagggc

SEQ ID NO: 4184879 - RNA, 79 nt, Human
guccuugugggacacgggucuccccuucuccgggcucgcgggggacugguccaggagggggagccgugccggcaggggc

SEQ ID NO: 4184880 - RNA, 98 nt, Human
guccuuguuuuaacuuuccagcucuguugcccuggaaacguggugaagguggaaugucagcuguguuaccaggcaguauugcuuauaguagaaaugac

SEQ ID NO: 4184881 - RNA, 74 nt, Human
guccuuuggagaagaaugcauccuuaauagauguucaagacauauuugaagauugcuuuuuuuaaaaaaguggc

SEQ ID NO: 4184882 - RNA, 79 nt, Human
guccuuugggauaaagggggaccaaaugacuccuagcuagaagcugggagcuuggguguaccccaguacuugaaaggau

SEQ ID NO: 4184883 - RNA, 81 nt, Human
guccuuuugaaaugacaacuuuaauggguuucagcucuuuuaucuagagcuugagauaauucaagcugaguuuuucagggc

SEQ ID NO: 4184884 - RNA, 120 nt, Human
gucgaaagugaaugucuucaggaacggggugagacauguuaggggugcugcuuuccuaaacaacacgguagcaccacuucaugcuuucaguuaugugcauacugaacuuucauuaaaaac

SEQ ID NO: 4184885 - RNA, 84 nt, Human
gucgaccuuuucagaaggcaacuuaaaaagagaaugguggaauguuuguaucauugaauauaagugcuauuuuugaaaagugac

SEQ ID NO: 4184886 - RNA, 66 nt, Human
gucgagaagaaggacuuggaguuggauaaggaagcccccagcacuuuccaggccuuguucucagau

SEQ ID NO: 4184887 - RNA, 81 nt, Human
gucgaucgagcaucucugacaccaucucaugacagcccuacgggguauguagaagcugcucaaagaagaauuugaaucgac

SEQ ID NO: 4184888 - RNA, 68 nt, Human
gucgaucugagccuauggucagcauuugccaauaguguguacaugcagauuauagcuaaugauuugau

SEQ ID NO: 4184889 - RNA, 71 nt, Human
gucgcauggagaagguaguccauucuaagccauuucauauaaacuuauugggcaucuccucugugccaggc

SEQ ID NO: 4184890 - RNA, 81 nt, Human
gucgcuguagggcaggcugaagggguagaggggucuguaacgugaguccugccagagcagcuuguccuccaggaaggcgac

SEQ ID NO: 4184891 - RNA, 79 nt, Human
gucggaggaucugaaguccggguguugagcagccaucaggggaaguggcuguucuuucagcccagggcuugccuccggc

SEQ ID NO: 4184892 - RNA, 92 nt, Human
gucggccggggccccgcuguucuuugggagcuaaaaucugccauuucgcuuagcagagaccccaguucacaauagaagagguggccgccgac

SEQ ID NO: 4184893 - RNA, 106 nt, Human
gugagaacuuguuagaaaugcaauucuugggauccaucccaaaucuacucaaucagcagcuuuggagauagggccuagcaauuuaugucuuucugguaauucugac

SEQ ID NO: 4184894 - RNA, 55 nt, Human
gugagacacgugugugaccugguggcagccugugggaugugcauguguaacucau

SEQ ID NO: 4184895 - RNA, 83 nt, Human
gugagacagcccaugugauuuccugggaguaagcuccacacauaggucugcugcccacaaugauuacauggaugaugacuuac

SEQ ID NO: 4184896 - RNA, 61 nt, Human
gugagacugggggcuuggccuuuucuccagcaaggacaaaaaccauugucuucagucucac

SEQ ID NO: 4184897 - RNA, 68 nt, Human
gugagagguaugguauauuggaagaagaucccuaauucuucuauacucugaauaucuauaucuuuuac

SEQ ID NO: 4184898 - RNA, 81 nt, Human
gugagaggugaguuacaggaggagguccagacccugaccuuggaucucuuuguaauuaacuuaaugaccaugagcccucac

SEQ ID NO: 4184899 - RNA, 102 nt, Human
gugagaguauuuugacagcaacugucagcaaggugcaagcggcugccaucgccuccgauuggcugcagacaccuauggcaggaugcugaauaauauuccagc

SEQ ID NO: 4184900 - RNA, 124 nt, Human
gugagaugagaauccuuagagucugguucacuaugacugggauuguuccuguaugggggaagagcuauucccaagcuuagggcucucaguuacagugaauuaucucacaaggaucuuuaauuac

SEQ ID NO: 4184901 - RNA, 78 nt, Human
gucuuacaacugucauggcacuagaguggggucuugggaaccucuggcaucuuuccuuuaguugcugaguugagaggc

SEQ ID NO: 4184902 - RNA, 82 nt, Human
gucuuagcauccugcagcucuuacggagggcggggcagucucuggacuccugccuucggaggaacugcuauaagcgcaaggc

SEQ ID NO: 4184903 - RNA, 68 nt, Human
gucuuagcauuacaucuuugaugcaguaugucagaggacauagagcauucauagcauguaagaaggau

SEQ ID NO: 4184904 - RNA, 69 nt, Human
gucuuagcugaaugccuuggauuuuuacugcuucuguaacaaauuuccauuaauuuaguggcuuaagac

SEQ ID NO: 4184905 - RNA, 69 nt, Human
gucuuaguuuugaagaauuaacagcuguggaugagagucuuugcacacagcgauucuucucuuuaggau

SEQ ID NO: 4184906 - RNA, 80 nt, Human
gucuuauaggugguauuuaaaauuauuuggcucuuucaaauaaaaaggggagugaauaaucuuggguauuaauaaaaggc

SEQ ID NO: 4184907 - RNA, 70 nt, Human
gucuuauccuucaggaaaccauccucaguaauucacguuggugagcggggcuccugguaggaguacagau

SEQ ID NO: 4184908 - RNA, 76 nt, Human
gucuuauuuuccuuacuuauaaaauagugauaauauuccuuugcuuucuggauuauguguaagugaagauuaagac

SEQ ID NO: 4184909 - RNA, 60 nt, Human
gucuucagccaagagaagguacgaccuacuccugaguucuuggcuucucuggcagaagau

SEQ ID NO: 4184910 - RNA, 77 nt, Human
gucuucaggcuuaugccaucuuccagagaccugcagcaguucugucagucccuuaaagguggcagcagcuugaaggc

SEQ ID NO: 4184911 - RNA, 62 nt, Human
gucuucaguggcaaauggaucugucaacaggcuccauugccugggguuguugcugcugagau

SEQ ID NO: 4184912 - RNA, 60 nt, Human
gucuucaucugcgcacuuggggaaauacaggcaucuaucccugagggugguugugaagau

SEQ ID NO: 4184913 - RNA, 114 nt, Human
gucuucaugguaauaagaacuucuuuuuagguuucguauguggacaugcauucuuaucucauugggugcaauacauacuuagacccagagaacauguucagauugucauaagac

SEQ ID NO: 4184914 - RNA, 90 nt, Human
gucuucccacccggggcgcauuucuguucaucaucuggacacaugcggcucgcagauguguuuccuggugaacaucugggguggggcggc

SEQ ID NO: 4184915 - RNA, 59 nt, Human
gucuucuagaagcucgaaaaggaaaggaggcaguuucuuccuuagaguuuccagaaagc

SEQ ID NO: 4184916 - RNA, 92 nt, Human
gucuucucaaaauggguucagauugacccagugggucuauuuauaaauguaaccaaugaaaggucaauucuauaggucauaauuugagaagc

SEQ ID NO: 4184917 - RNA, 68 nt, Human
gucuucucuucagcucugcuucucccauucauuuagguaauuacuggagggagccagcuguggaaggc

SEQ ID NO: 4184918 - RNA, 67 nt, Human
gucuucugcccaggaggucccauggggcaugaaauauugauuuaggaauuugcugggcaugaaugac

SEQ ID NO: 4184919 - RNA, 64 nt, Human
gucuucugccuccauuagaguugcuucuggagaugucaaaauauuucuaauguuggcagcaggc

SEQ ID NO: 4184920 - RNA, 63 nt, Human
gucuucugcucuccauacuuccgcaccuggacccuggggugagggugggguggggcaugaggc

SEQ ID NO: 4184921 - RNA, 62 nt, Human
gucuucuggccaacuugcuuguuggcauaaccugucgacuugucuguguggcccaugagggc

SEQ ID NO: 4184922 - RNA, 60 nt, Human
gucuucuguuuacuuugaaguuguccauccugauaaugaucaccugguaaagagagagau

SEQ ID NO: 4184923 - RNA, 55 nt, Human
gucuucuuuucagucugcuuguucacuaacacgagcgcagacaaugugaggagac

SEQ ID NO: 4184924 - RNA, 67 nt, Human
gucuucuuuuguccgggugcugggguuggugggcaaauguccucagaguccaguuuggcaggaagac

SEQ ID NO: 4184925 - RNA, 84 nt, Human
gucuugaguuugaacuucaugccaagcauguucagaagucuuugcagagauucaagcugugguguggggugcaggugauaagau

SEQ ID NO: 4184926 - RNA, 83 nt, Human
gucuugaucacauauuuccagaacagaauccagagaaaggaggggugcuacuggagcugaggggaaugcugagagcuuggggc

SEQ ID NO: 4184927 - RNA, 78 nt, Human
gucuugauugaauucaaaugcaaucuucguucagcuaaaaaauaaugagccagguuuauuuagaauuucaguuaugac

SEQ ID NO: 4184928 - RNA, 69 nt, Human
gucuugcaggaauagcuacagagcugguaugucacugaggucccagauucuucuguauuuuugcuuugc

SEQ ID NO: 4184929 - RNA, 68 nt, Human
gucuuggccgugcagaugaagaacugggaaccauuuguguugaguccagcauuugccauggacaagau

SEQ ID NO: 4184930 - RNA, 63 nt, Human
gucuugggcaccuuucuauauucaguggcucagaauaccuagcucacagagggugcuuaauac

SEQ ID NO: 4184931 - RNA, 74 nt, Human
gucuugggccccucauuucuccaaugccagaugccugggcagcagggcuggaaccagagugaggcaggugaggc

SEQ ID NO: 4184932 - RNA, 62 nt, Human
gucuugguguugucccugcccaaucuagcugaaaaggcaggcagauggcugcaccaaacggc

SEQ ID NO: 4184933 - RNA, 64 nt, Human
gucuuguauggcgacagcagguaauuaaaacaauaauuguuuucugauguugcuucugcagaac

SEQ ID NO: 4184934 - RNA, 55 nt, Human
gucuuuaaaaauaggcucaucacucugcuggagggggugucugggcuuuagagac

SEQ ID NO: 4184935 - RNA, 57 nt, Human
gucuuucaaguguuccaggcauugguauguucuaguguucucagcuacuagagagac

SEQ ID NO: 4184936 - RNA, 93 nt, Human
gucuuucucacuagacuaucucuagcucucucaccugcucucucucucugauugaagccagcugccaaguugugagaugcucucuggaaaggc

SEQ ID NO: 4184937 - RNA, 83 nt, Human
gucuuucucagccuguuguucucuuguuagcccuuugauguuucaaagcugacgaggucagcaucuuccaggcugcaggaaac

SEQ ID NO: 4184938 - RNA, 79 nt, Human
gucuuucuucuuuuuaaaaaccaaaggaauggagaacuugguaaguaccaccaacuaauccuuugaaaagaagaccgau

SEQ ID NO: 4184939 - RNA, 61 nt, Human
gucuuugcccucucugcaagcuagacucgcuacuggcccuucccagagugggccaagagac

SEQ ID NO: 4184940 - RNA, 82 nt, Human
gucuuugcuauugugaauagugcugcaauaaacauacaugugcaugugucuuuauagcagcaugauuuauaauccuuugggc

SEQ ID NO: 4184941 - RNA, 56 nt, Human
gucuuuggcuccccugggcagccgagagggaggaccgucugagggagcacgaaggc

SEQ ID NO: 4184942 - RNA, 60 nt, Human
gucuuuggcuugucuccucaguugcuuacaaaguuguaucugggagucaaucucaaaugc

SEQ ID NO: 4184943 - RNA, 62 nt, Human
gucuuuguuucuacucuggggcuguggauuccaacaaggucccuggaggaagaaacaauggc

SEQ ID NO: 4184944 - RNA, 71 nt, Human
gucuuuuuauuuaauauaaaacagcaacagcaacaagaaauuacgaugcuguaugauguuaaguggaaagc

SEQ ID NO: 4184945 - RNA, 77 nt, Human
gugaaaaccacaaugugcucuccaaggaaaaaaguagguuucccuauugcuuauucuugagagucaaauaguuucau

SEQ ID NO: 4184946 - RNA, 75 nt, Human
gugaaaagcggacuucaggaauucucuacaccuggacaucucccuugcucugguuccugauagauuccuuuugac

SEQ ID NO: 4184947 - RNA, 65 nt, Human
gugaaaaggaguccuuguuuucauuugaucuuauuaaauaugaaugaaauuggauaucuuuucac

SEQ ID NO: 4184948 - RNA, 76 nt, Human
gugaaaauguguagucauugaucaagaaaucccauuuauaggaaucccuucuugagaaauaauuaaacaugagcac

SEQ ID NO: 4184949 - RNA, 58 nt, Human
gugaaacaguagucuguggguuucaaaucagaggccauuaagcaaacugcuguuuggc

SEQ ID NO: 4184950 - RNA, 70 nt, Human
gugaaagcacuuaacuggaaaagaauuuucauccacaggaagaaaaaaccuucuguaguugugcuuuuac

SEQ ID NO: 4184951 - RNA, 56 nt, Human
gugaaagcaucugacugugccaguucugauuuugguacauaaauggauguuuucau

SEQ ID NO: 4184952 - RNA, 80 nt, Human
gugaaagugacugacaaguagaugaucuuucugcauagacucuaugccaaauaagaaggucuacagucauaaacauuuau

SEQ ID NO: 4184953 - RNA, 88 nt, Human
gugaaauaccuagcuuaguuuugagcaucugccugaguacuacugccugaguacuuccaguugucauaaagcuaggcuguuuauccac

SEQ ID NO: 4184954 - RNA, 86 nt, Human
gugaaauggugauaauaccuaacauugugcagagguuucugauuucagacucgaaggcccucucuacauguuagacgcuguuucau

SEQ ID NO: 4184955 - RNA, 75 nt, Human
gugaacccgcuucucuggguuagucuugucguuguacaaaugggaaaacugaggcucccgagggugugggucugc

SEQ ID NO: 4184956 - RNA, 98 nt, Human
gugaagaaggaacuguuaacuggcagcucgaugacuucugcauuccuuguggugaagccaugcaggauuguuggguucuguggcacuuucuccuuugc

SEQ ID NO: 4184957 - RNA, 73 nt, Human
gugaagaccaguccacgucaagaagagguuaagacuaugaucucacuucugucauguggcacaagcuuuucau

SEQ ID NO: 4184958 - RNA, 77 nt, Human
gugaagagcaagaugcuuagaagcagauuaucugguuugaaaacccagaucugaguaugauuugccugaaucuucau

SEQ ID NO: 4184959 - RNA, 130 nt, Human
gugaagagccacacugcgggucauuguguaccugaguagggaguucagaggcugguuugcaggcuccugccacaggccugacccugagcuucacaccuuauugaguuuucacuaaugccgauggcugucc

SEQ ID NO: 4184960 - RNA, 88 nt, Human
gugaagaggaacagaaagcaguagagggguagauguucuuaggaugauccacaucuguucuucucuugucccugugcuuccuggucac

SEQ ID NO: 4184961 - RNA, 57 nt, Human
gugaagccgucaaguagaucagcauucuugccuguuuucuuugcugaugagcaucau

SEQ ID NO: 4184962 - RNA, 64 nt, Human
gugaagccucugcugauuaguauaugacagauauaauaccauagccuauuagcuugggcaucau

SEQ ID NO: 4184963 - RNA, 97 nt, Human
gugaagcuucugcucuguauuuucaucuaagagucuuacauuuaauccacuuugaguuaauuuuuguauaugacguuaaguaaggguucaguuucau

SEQ ID NO: 4184964 - RNA, 55 nt, Human
gugaaggccaguaggguccuggccucacccaggccugccucuacuuaccucucau

SEQ ID NO: 4184965 - RNA, 90 nt, Human
gugaaggcugucucccacucaaggugucagcucauucauucuuccaacugaccugcagaggagagucuggcgcugagaugacaccuucac

SEQ ID NO: 4184966 - RNA, 58 nt, Human
gugaaggcuugacgucaucaggcagcauuagcaucaccugggacuuuucaagccucac

SEQ ID NO: 4184967 - RNA, 127 nt, Human
gugaaggcuuugcagggcuaguuuugggaaaucuuagguuuggcuucaucugacuccucuacuggagcgaggcgugcagccaagccugcuuagaccuccccaggccacgggcccgcggcagcccagc

SEQ ID NO: 4184968 - RNA, 55 nt, Human
gugaagggaaacgcucagcugguauaucaugucccagccacgaagcucccuucau

SEQ ID NO: 4184969 - RNA, 89 nt, Human
gugaaggucagcuggcuggucagugcacaacggcugugagacccaccucucauuuucuauugugggcugagucaugucacuaaagucac

SEQ ID NO: 4184970 - RNA, 76 nt, Human
gugaaggucuguuucucuucacucuagacugauaaggauccuuaaucagcaagacuaggggaauacuuaucuucac

SEQ ID NO: 4184971 - RNA, 60 nt, Human
ggugaugcaaaccuuacauggaccuuggggugacagggccuccuuggauuuuguauccuc

SEQ ID NO: 4184972 - RNA, 62 nt, Human
ggugaugccucagagaaaacuucuuccacaaauggccagaagaugucacugcagacagcacc

SEQ ID NO: 4184973 - RNA, 117 nt, Human
ggugauggugaauacaagaaaaccuauuaauuuuccagugauuuacagugcacuacauaacauaaugcauuguugauuuggagugugaaagcuguuaauuuguucuauuuagucacu

SEQ ID NO: 4184974 - RNA, 75 nt, Human
ggugauguuaugaagaugaauguacaacuuauaugcagguauguaauauaaacacaaugucaucauaaugucacc

SEQ ID NO: 4184975 - RNA, 72 nt, Human
ggugauguuccgagucuccaagggguugucgugagugcagucgggagagcgagucuggggcucggauucgcc

SEQ ID NO: 4184976 - RNA, 59 nt, Human
ggugauguugauggugcagacacauuguccaggcaagugcuagaaccccagcaacagcc

SEQ ID NO: 4184977 - RNA, 77 nt, Human
ggugauuuccuggagccaagccuaggccccccacacugguggggugagggucuggagcuuggcuaagggauugcacc

SEQ ID NO: 4184978 - RNA, 85 nt, Human
ggugcaaagagucccuuucugugugagugagcacugcugugucuucuccaccagagcuuaaaacuccauggaaagggacuucauc

SEQ ID NO: 4184979 - RNA, 72 nt, Human
ggugcaaccugagcgcguugcuuucuaagucucuuuuacaucucuuagaagguagacguguucaugggaauc

SEQ ID NO: 4184980 - RNA, 77 nt, Human
ggugcaagggcgcaggccacaguggagucucugggucuuccccgggugacuuugcuguuggcucugggccccacacu

SEQ ID NO: 4184981 - RNA, 57 nt, Human
ggugcagaaggaagggagcuggggaagauacucucauucucccucuacccucugacc

SEQ ID NO: 4184982 - RNA, 62 nt, Human
ggugcagauuugaaacauaauauuccuuuaagaaaaggaagcuuagauuuccagaucucucc

SEQ ID NO: 4184983 - RNA, 56 nt, Human
ggugcagccuccccagugacagccccaggucuuugccacuggagagcuggaaaacc

SEQ ID NO: 4184984 - RNA, 67 nt, Human
ggugcaggacgaaguggggguucgcaaauaccacaauauaaagcagacucugccagucuccugcacu

SEQ ID NO: 4184985 - RNA, 57 nt, Human
ggugcaggcgguggggcaaguaacggcuuuugguagccccgccccuccgacccgccc

SEQ ID NO: 4184986 - RNA, 61 nt, Human
ggugcagucagccauagccucuccuggcugccagccagugcaggcugagggugauuguguc

SEQ ID NO: 4184987 - RNA, 59 nt, Human
ggugcagugcaggguaauuauacacugugguauaauuuguuauaacuugggcugaggcc

SEQ ID NO: 4184988 - RNA, 80 nt, Human
ggugcaugaggccagaaugagucucuggggcucacagcagacagaccccagcugaacucuucuggacugacaaugcuucc

SEQ ID NO: 4184989 - RNA, 83 nt, Human
ggugcaugccgggaagcagcauccugggcagaccuugaaaagagacacuaggucggccggggaggcugcuggcaucugaaacc

SEQ ID NO: 4184990 - RNA, 55 nt, Human
ggugcaugguggaggugacccuggagagguuggcagggccagacgcuagagcacu

SEQ ID NO: 4184991 - RNA, 71 nt, Human
ggugcauuuucugcuucuuauuucauaaaaaaguuacaugugggcuuuagauugcagaggauuugggcacc

SEQ ID NO: 4184992 - RNA, 111 nt, Human
ggugccacauaugcacuugaguauuugggcauguggagggugcuuaaguuguguuucuccccaaagagguuaggccaauugcuccccacuccccaaccagguguaugcauc

SEQ ID NO: 4184993 - RNA, 58 nt, Human
ggugccacgagucaccuuccaggcaaggagucccagcugauggagacuuguggccucc

SEQ ID NO: 4184994 - RNA, 55 nt, Human
ggugccagaagauuuggugucuggugaggacucacucaccacuucuuuuugcauc

SEQ ID NO: 4184995 - RNA, 73 nt, Human
ggugccaggaggggguggaguuucgccggcccgcggacagaggcugccggaucucccgacccccuccagcacc

SEQ ID NO: 4184996 - RNA, 74 nt, Human
ggugccagggcuccauugcucauccuugagccacagaaagggccaaguucaggaauugccuggggccugggauc

SEQ ID NO: 4184997 - RNA, 61 nt, Human
ggugccaucugggguggacuuuaagcaaagggugacacuuagcagguggugacucgaagcc

SEQ ID NO: 4184998 - RNA, 79 nt, Human
ggugcccacugccaucgggggccccacugccagagucuggggcaguugggcagauggcccccgguaguucuggugcacc

SEQ ID NO: 4184999 - RNA, 68 nt, Human
ggugcccagguaccuugagccguugcugaugagaaugcucucccgaauggucagggugcaguaauacc

SEQ ID NO: 4185000 - RNA, 74 nt, Human
ggugcccucaggcagggagucuuucacccucugucauuugauaggagaaaguuugccucucucuugagccagcc

SEQ ID NO: 4185001 - RNA, 62 nt, Human
ggugcccugagccccucacuguccuuccaagacauggcaggcagagagcauggcuggggccc

SEQ ID NO: 4185002 - RNA, 65 nt, Human
ggugccggucuuaagcugacugugaccacguuaaauuaaggauucauaggaaggaaggcgguguc

SEQ ID NO: 4185003 - RNA, 79 nt, Human
ggugccucaacuuuuaaauuugauaaagugauuuccacucauugaugucaccagauuuguuacauuaaaaaguaggucc

SEQ ID NO: 4185004 - RNA, 113 nt, Human
ggugccuuaaugucucuagcaucaguuuccuuagcugugaaaugagaauuauuauaauuccuacauacaaggcuaaaauuagcugauauagauaaggcauuuagaaaggugcc

SEQ ID NO: 4185005 - RNA, 64 nt, Human
ggugccuuaucugcacccucccccuccuguccccugaggagggacagagugcagaggggccucc

SEQ ID NO: 4185006 - RNA, 79 nt, Human
ggugcgcaugcaguggggcugcaguuggucccuggagggaagcagagcuggagcagccccacuggccagugucgauacu

SEQ ID NO: 4185007 - RNA, 57 nt, Human
ggugcgggagcagggugcuucugaguuagcgguggcucuggugcccuggcucccacc

SEQ ID NO: 4185008 - RNA, 65 nt, Human
ggugcguuuauguggcucaucuuugggaaguaaauauguaagaauuuauagucaauaaacguacc

SEQ ID NO: 4185009 - RNA, 89 nt, Human
ggugcuacaagucaugguuuauuucucugaaagguuaucugaaaauuaaaaaucaaugaaucuuagaauaaauacugacuuugaguauc

SEQ ID NO: 4185010 - RNA, 62 nt, Human
ggugcuaggaggguuauggcaagaucuggccucacagaugaagucauuauccuuuugguuuc

SEQ ID NO: 4185011 - RNA, 78 nt, Human
ggugcuaucaggugauagaaucagauaaaaggauuuccuauaaggcauucugcugguaacucuauaaaagguggcauu

SEQ ID NO: 4185012 - RNA, 101 nt, Human
ggugcucaggaagaucaaaucaaacugauuuguuauuuuuauagagugcuguauguauguguguaugacagacagagaaagagagaucuuccuugggcacc

SEQ ID NO: 4185013 - RNA, 110 nt, Human
ggugcucugauguggccagcggcgugggcuggacccuccugcucccuccucccucccggccuggggcaggguuuguccccaggagccccgcgucgcaucccuaggguacc

SEQ ID NO: 4185014 - RNA, 109 nt, Human
ggugcucugcuucucgaaacugggcucugcaucacucuuacuggcuuuugauugggauuauaucaauucucuguggugaugcugguggcccugugcugaauugggcacu

SEQ ID NO: 4185015 - RNA, 85 nt, Human
ggugcucuguucacugaaugauauaagaucuuucuaaauugagcuuuuagaaauaguuugguauuuucaugaaaaaaauaguacu

SEQ ID NO: 4185016 - RNA, 70 nt, Human
ggugcugauguuauugaugcugcagauuucaugagguggagacacucacuuuagcucagucgacagcccc

SEQ ID NO: 4185017 - RNA, 67 nt, Human
ggugcuggcuacaaguguguuuaguuugugacaauucaucaaacuguauauuuauggcaugugcgcu

SEQ ID NO: 4185018 - RNA, 60 nt, Human
ggugcuggguuccaugagagaccuacugggucagaaucucucagauggggcacuaguauu

SEQ ID NO: 4185019 - RNA, 72 nt, Human
ggugcugguuacacaagugugugcaguuuguaaaaacucaaugagcuguacauuuguguacacuugucugcu

SEQ ID NO: 4185020 - RNA, 56 nt, Human
ggugcuugguugaggucucuugguugagagacagaaaggggcaaacccaggacacc

SEQ ID NO: 4185021 - RNA, 100 nt, Human
ggugcuuuuccuagcuuaaggcaaguaagugaugggaggcuucaagagaaacucacaauggagcagcaucacuuugagcugccuuugcaagaaggauacc

SEQ ID NO: 4185022 - RNA, 65 nt, Human
ggugcuuuuguugugguuuuaguaucagcacuauagaacagauacacugacugggacagaagacc

SEQ ID NO: 4185023 - RNA, 75 nt, Human
gguggaaagccaggccagacucacacccuugcucuucucuugcaguuggggaauggguuuuucugucugucuguc

SEQ ID NO: 4185024 - RNA, 127 nt, Human
gguggaacaggaaggugcaagacuucggcuucauguuugaguggcggaggaagcaugucacccugaaggcaguuggcagccacuuugcaaccaagagagaagccaaccuuggaguaaaccugauacc

SEQ ID NO: 4185025 - RNA, 95 nt, Human
gguggaagaauugcuugaacuugggaggcagagguugcagugagccaagauugugccacugcacucaagccuuggccacagagcaagacuccauc

SEQ ID NO: 4185026 - RNA, 113 nt, Human
gguggaagcuuacagaaagaagggcaucuucacauauuuccaaugauuauucaggaaaagucuuuuggugacuugugggauguuaaauuuaacuuucuucuuauguuuuggcu

SEQ ID NO: 4185027 - RNA, 76 nt, Human
gguggaaggggcaaugggcuuuucuguaagggcacuaauccccuucaugagacuccacugccaugaccuuaucacc

SEQ ID NO: 4185028 - RNA, 95 nt, Human
gguggaauuucuucuuccuuguagggcuggggagugaauaagggacuccuugucuugucucuuaaaggucuucagcugacuggaugaggcccacc

SEQ ID NO: 4185029 - RNA, 59 nt, Human
gguggacagugcugcaucuccaugccagccaagugugugacaggagagucacuucugcc

SEQ ID NO: 4185030 - RNA, 61 nt, Human
gguggacgucaaucagugucaguccaagcaaacuggaggucugcccauuugugaugucccc

SEQ ID NO: 4185031 - RNA, 80 nt, Human
gguggagaagggaagaaacaguucuugagccccuacuguuuggugaauguucacauguguuaucuucuuuaauccccacc

SEQ ID NO: 4185032 - RNA, 64 nt, Human
gguggagacuagaccagaggugagugaucuuuggggauaucuuuggccuugucuggucuucucc

SEQ ID NO: 4185033 - RNA, 64 nt, Human
gguggagagaugcugcccgcagacgugacccccgguugguuugcuccgggcaauauuuugcacc

SEQ ID NO: 4185034 - RNA, 64 nt, Human
gguggagagcaggcuagagggaggcuggcgagaugggccaggucaccauggcaugcuccacacu

SEQ ID NO: 4185035 - RNA, 62 nt, Human
gguggaggagccgggggcugaggaagggaugaagccauccccuagucuuccgcguccccacc

SEQ ID NO: 4185036 - RNA, 83 nt, Human
gguggaggcuaugcaugugugagagcaagagguauauggaauuucucuguaccuuccucuuaauuucgcugugaaccuaaacc

SEQ ID NO: 4185037 - RNA, 91 nt, Human
gguggauaacagcccccucuucugucccuugggucacaacucugaggugcuuucuacacagcugcucagaggggaccuagcagagucuacc

SEQ ID NO: 4185038 - RNA, 61 nt, Human
gguggauugaacuaagaugguagcaacagauagggagcuaugguaauguucaguauccacu

SEQ ID NO: 4185039 - RNA, 61 nt, Human
gguggauuuaugcugagaaacaggcaaccuaagccuucauuaucaaugcaugaaaucagcc

SEQ ID NO: 4185040 - RNA, 68 nt, Human
gguggcacaguggcagcugcagcucgagucuccuaguguggaguccagggucccugcccucugucauc

SEQ ID NO: 4185041 - RNA, 79 nt, Human
gucauauacugagagcaaauacauucuuccuagacauaaaaguuuauaaacguuuggaugugugcucauauauauagau

SEQ ID NO: 4185042 - RNA, 63 nt, Human
gucaucacaugccuaucaugagcuggcucugugauucagucaguguugauuuguaucugagau

SEQ ID NO: 4185043 - RNA, 59 nt, Human
gucaucauccacuggagccggcagggaaugugccccugugggucacaugggugacugac

SEQ ID NO: 4185044 - RNA, 63 nt, Human
gucaucugaaggcuaaaauggacugaaauccaagaugguucacucacguggcuuacaguugac

SEQ ID NO: 4185045 - RNA, 61 nt, Human
gucaucugcaucucuuauaaaugaugcaaauauguuucucuuaggucagagaucagauguc

SEQ ID NO: 4185046 - RNA, 61 nt, Human
gucaucugugcuuuugguaggaaaugugcugaccauguccugcauuuuaaaaggcaguugc

SEQ ID NO: 4185047 - RNA, 100 nt, Human
gucaucuugauccauggccccugcuauccugcaccaugaaugcagggagcccagaaucccagcagcaaggugaggguggaggugguugggugggggagac

SEQ ID NO: 4185048 - RNA, 112 nt, Human
gucaugaagccugagcuguccugggaacaggcacuaccucucucugagggagagcagcuugaccuaguuccucuucucagggccaugcuguaguuuucccugcuuuugugac

SEQ ID NO: 4185049 - RNA, 112 nt, Human
gucaugacccuacaagaaaaaguugaauugauugauauguacuguagauuaaggucuguaccuguaguugcaggccauuucagacauucaauucaucuuguaaacagaugau

SEQ ID NO: 4185050 - RNA, 59 nt, Human
gucaugccuuuaagagauacugaggacuguuuuugcagcuuaagucuguaaaggaugac

SEQ ID NO: 4185051 - RNA, 81 nt, Human
gucaugcugagccacccuugcuucccugcaggccuccugagucgcagccuaggaauguagcaagaggugagccaguguggc

SEQ ID NO: 4185052 - RNA, 69 nt, Human
gucaugcuuuggcccuccaccuggcugugcuccucuuacuggggcaaggagacuguagggccaagggac

SEQ ID NO: 4185053 - RNA, 78 nt, Human
gucauggaaauaagugguaccaagcucagugaagagauuuucuuuauguacuuacuauuacuauauuuaaaacgugau

SEQ ID NO: 4185054 - RNA, 86 nt, Human
gucauggauaacaaaggauucugggcaguuuauucaguucugucaaaacgaucacugaacuucuagcuugcucaggccuuccaugc

SEQ ID NO: 4185055 - RNA, 87 nt, Human
gucauggggagaacuugaacuuuuccucugaagaagaugggagccauggaaaucugagcagaagggugcacgugcugaccucaugau

SEQ ID NO: 4185056 - RNA, 78 nt, Human
gucauguacuaguuauuaauagagaggugggcuaaaaagcguuuuuauuccaguaaucucuguaauacaaagaacagc

SEQ ID NO: 4185057 - RNA, 84 nt, Human
gucauguccauucuuuuacguauugucgagggcugcuuggugcuccacuggcagaauugaauaguugugaagagcccacauggc

SEQ ID NO: 4185058 - RNA, 73 nt, Human
gucaugucucaucucuuaaccccacucacucucagagaguagagacagugguuuugaaagaggaagacagaac

SEQ ID NO: 4185059 - RNA, 77 nt, Human
gucauguucagcagccuagaagcucuaccaaccccauccuuuggauuuuuauggaggcuucauugcauagacaugau

SEQ ID NO: 4185060 - RNA, 65 nt, Human
gucauguuccugguggcuuugccaacuguagcaccuagcucaugguggcagaaguagcagaugac

SEQ ID NO: 4185061 - RNA, 104 nt, Human
gucauuagugaugcguuugggcagcuuugcccucacuguccucagucacaagaaaggauggacaugagcagaggacccuguagaaaaaggcagacauacaugac

SEQ ID NO: 4185062 - RNA, 74 nt, Human
gucauuaguugcuguuaagccacaauuagaucacuuuuugacaugacauaaaauuaguuuggcauaacugaugc

SEQ ID NO: 4185063 - RNA, 61 nt, Human
gucauuccucccuuggaguaagacacguacauaaauaauuauaauaugaggcaggagugau

SEQ ID NO: 4185064 - RNA, 57 nt, Human
gucauugacuagaauuccaaagcucaagguacacuuauggaaguugaagucagugac

SEQ ID NO: 4185065 - RNA, 118 nt, Human
gucauugcuguaauuguuaggaucauauuaccuuggaaaugcuagaguaacuuaaacagagaaaguguauuuuaguuccggguaaaacaaaucuaauagacccauuuaacucagugau

SEQ ID NO: 4185066 - RNA, 57 nt, Human
gucauuuaaagaccauugugggcuagagaguagggccuacagaggagagggaaaggc

SEQ ID NO: 4185067 - RNA, 99 nt, Human
gucauuuaaagaggagauggccacuuuugugaaauugaaagaaggaaauagugaccucuucauacucaucacauagguaucauucccuguuuaaacugc

SEQ ID NO: 4185068 - RNA, 58 nt, Human
gucauuucccucucaucucuauuauuacccaggugaaaggagaucaaagggagagaac

SEQ ID NO: 4185069 - RNA, 57 nt, Human
gucauuugagucagcaacaggauaaucugaaucugaggccaaaaugacucaaaugac

SEQ ID NO: 4185070 - RNA, 72 nt, Human
gucauuuuaucagcacacgucacuagcuucucaagugagacuacucugaagugaucuguguuugaagaaugc

SEQ ID NO: 4185071 - RNA, 65 nt, Human
gucauuuuucaggagaguuucggguaacugcagaagccuguguuuacuguuuucugauaaguggc

SEQ ID NO: 4185072 - RNA, 71 nt, Human
guccaaaauagaauuccaaguccagccaggccaaagaucccuggugccuggcuggacuuggugucugggac

SEQ ID NO: 4185073 - RNA, 93 nt, Human
guccaaagguaaaaaagagaacauaaggaauagaaauuguuaagcugcaaagaaacaucucuguauuuuauagacuaacuuuucugcuugggc

SEQ ID NO: 4185074 - RNA, 67 nt, Human
guccaacuuccuccuaaaacccaguccugucucucuaugcacagcuuuguguagaaggaggauggau

SEQ ID NO: 4185075 - RNA, 55 nt, Human
guccaagagggagcuacagagcaaaaauuguccugugcugggucccaucuugggc

SEQ ID NO: 4185076 - RNA, 69 nt, Human
guccaaggucacagggcuuauacuaauugucugacucuacuugacaauacaggcuucuggacuuaagac

SEQ ID NO: 4185077 - RNA, 85 nt, Human
guccacaauuagcaggcacuucugcugcuugucuuucucaggucaggagaugggccacaggagaggcugucagcuggaggugggc

SEQ ID NO: 4185078 - RNA, 58 nt, Human
guccacagagaaaguuccucucaggccacagaggccugcuggcaauuuuccugaagac

SEQ ID NO: 4185079 - RNA, 66 nt, Human
guccacagagggcugggcaggcgccuacucaggguagugugggccgaggcuuagcccaucugggac

SEQ ID NO: 4185080 - RNA, 75 nt, Human
guccaccugugguuguaaacaucgaaagagugacugcuucucuuuacauuuuuuuguagcaagcgcagauaggac

SEQ ID NO: 4185081 - RNA, 74 nt, Human
guccacuccuggguucuaaauuugaaauguucucucuuaaucaaugaacucuuggaacagcaccugguguggau

SEQ ID NO: 4185082 - RNA, 91 nt, Human
guccacuggauuuccuucauggagagagcuguuuuacucagaaacauaucuucagguuuguuuacaaaaaucaggucuuugggggauggau

SEQ ID NO: 4185083 - RNA, 67 nt, Human
guccacuucccuuggugaccagcuuggggugcccuaguauucacaggcuggucuccgaggacuggau

SEQ ID NO: 4185084 - RNA, 55 nt, Human
guccagagggucaaguuucuuggguccuuucccaagggaguugagucucaugggc

SEQ ID NO: 4185085 - RNA, 80 nt, Human
guccagccuauaguugacuuuggcuuaagcagcaguuguuggaacaaucuguuguggccaagaucauaaggucucaggac

SEQ ID NO: 4185086 - RNA, 70 nt, Human
guccaggacugcuccagacaccugcaggggcagauaaaauucugcugcaggugcugugagcaggugggac

SEQ ID NO: 4185087 - RNA, 101 nt, Human
guccaggcucccagcucccagucuguguccuuuacagugcaccacccucaugccuugugcaagaagccagcaccaaugggaauugucacaggaggcuagac

SEQ ID NO: 4185088 - RNA, 56 nt, Human
guccagggccccgagcaccaggcccagcagggcugucagugauuccggcucaggac

SEQ ID NO: 4185089 - RNA, 83 nt, Human
guccagggugagggcucagagcaggcccacugcccucccaguccagggugagggcucagggcuggcuuauccucacaacagac

SEQ ID NO: 4185090 - RNA, 60 nt, Human
guccaguaacacuaagaaucuaaauuuaaauuuugguuuaguuugggauuggugcuggau

SEQ ID NO: 4185091 - RNA, 67 nt, Human
guccagugacaaguagcuggccaugugaaaacagaagugcaggcauaaucugcugugucgucugggc

SEQ ID NO: 4185092 - RNA, 88 nt, Human
guccagugugaggugcagcugguggagucugggggaggugugguacggccuggggggucccugagacucuccugugcagccucuggau

SEQ ID NO: 4185093 - RNA, 64 nt, Human
guccauacucaaauauuaguucaaggagccaauuucuagcuccuuagaacuuuucaguauggau

SEQ ID NO: 4185094 - RNA, 86 nt, Human
guccauccauuuguaucaacaugcauguuauuuaucaguauggaguauuauaaagaacaugugugugggaaucagaucaaugugac

SEQ ID NO: 4185095 - RNA, 55 nt, Human
guccaugcccucaccuggugggugaaacaacucaaaggucagacuuaggcugggc

SEQ ID NO: 4185096 - RNA, 103 nt, Human
guccauucugccuacucuaccuccaucagcacucagccuuccuucuccuugaggagaaugcagauggcugguguaugacugagaaggguauaggauaaggggc

SEQ ID NO: 4185097 - RNA, 55 nt, Human
gucccacauuacccugacugacaacuaagcaauugcuagacugugugagugggac

SEQ ID NO: 4185098 - RNA, 64 nt, Human
gucccacuguccucgcaggggaugggaucaggugucagcaccuccccauggaguacaguugggc

SEQ ID NO: 4185099 - RNA, 72 nt, Human
gucccagagagcacuaguccaucugcauguuaaacagauaggacacagugguucugugaguaaguuugggac

SEQ ID NO: 4185100 - RNA, 70 nt, Human
gucccagagccuccacagaugcaaagggcaguuauggucaauggccugagcucuggggaggcaagggggc

SEQ ID NO: 4185101 - RNA, 67 nt, Human
gucccagcugggagcggccauauuguuuucugaaaccauggaaaccauucccgacucuccuggguac

SEQ ID NO: 4185102 - RNA, 55 nt, Human
gucccaggaguugcugggccuugagggacagacacaggccuagcuuuuuuggggc

SEQ ID NO: 4185103 - RNA, 55 nt, Human
gucccagggcaaggcuguuucuggacaauaaagcauagccuucaggcccugaggc

SEQ ID NO: 4185104 - RNA, 78 nt, Human
gucccaggggacaagaagggaaagaguguguguuccccaggcugggguccagcucucacacccuccucccacuggggc

SEQ ID NO: 4185105 - RNA, 56 nt, Human
gucccaggugcccagugggcagccagaagcagcccacacuccugcacaccugggac

SEQ ID NO: 4185106 - RNA, 72 nt, Human
gucccaucuaugccuggcauucuggaagggucuaagagagugggcugcaaagaggccaggcugcagagggau

SEQ ID NO: 4185107 - RNA, 68 nt, Human
gucccaugagcaaacacucagcauccucugcaccauagaacacaugcuucuguguauguuucagguac

SEQ ID NO: 4185108 - RNA, 76 nt, Human
gucccauuccaucuugcauuugcuaaaaugcauuuggaaucacauuauuauagauuaugcaagauuggaagacggc

SEQ ID NO: 4185109 - RNA, 55 nt, Human
guccccacucagcucccaggacagagguaacucauggaagucuugaguagggggc

SEQ ID NO: 4185110 - RNA, 58 nt, Human
guccccagagcugguggugguuucucagcucugcauuuccaccucauugcucuggggc

SEQ ID NO: 4185111 - RNA, 94 nt, Human
guccccaggcagggcucagccugccucccugcugcugaggccccuaccaaauuggaacccgaguagcaccagggaagcagggccugcaggggau

SEQ ID NO: 4185112 - RNA, 62 nt, Human
gugaagucacugcaggcuaguggaggggucccaggcagaauccaggccugcaaugacaaagc

SEQ ID NO: 4185113 - RNA, 77 nt, Human
gugaagucccuugagggaguacuguuugagcagacuaaaggauaaagagccagaugugccuccagggugacauccac

SEQ ID NO: 4185114 - RNA, 88 nt, Human
gugaagucuaaauaauuacuuuuccuggaaccacugcuacuggguuauacauuaugcuucagggaaaggugauggcaagaguauucac

SEQ ID NO: 4185115 - RNA, 59 nt, Human
gugaagucucauuugaugcucugaacagggaaaguuuagagugaagguugacacuucac

SEQ ID NO: 4185116 - RNA, 67 nt, Human
gugaagugauuuguacaaaaugucguaguguaauuuauugagugucaugugguauuaaucgcaacau

SEQ ID NO: 4185117 - RNA, 72 nt, Human
gugaaguuuaggaaacgcugcuauugacuuugaugcugguucuucacagucgauucuguuucuuaauuuuac

SEQ ID NO: 4185118 - RNA, 56 nt, Human
gugaauaaagggaguuuucaaauuaugaauauaugauacuccaaaacuuuguucau

SEQ ID NO: 4185119 - RNA, 83 nt, Human
gugaauaagcaauguuuuggugagaaaguuuaucuggcaaaagauaggauagacauuugaaugugaaaugauugcuuauucac

SEQ ID NO: 4185120 - RNA, 70 nt, Human
gugaauagagcagccaagauagguauacaggaaaugcaaauguaauacacaagggccagcucuuguucac

SEQ ID NO: 4185121 - RNA, 70 nt, Human
gugaauagaugaauagaacaaugauugaaaggauaaauaacauaucuuaaucuguuuuaucauuuguuac

SEQ ID NO: 4185122 - RNA, 130 nt, Human
gugaauagguuaugugagaggugacuggguuauuugggaggugacugguuuaucuggcagugacuggguuaucugguaggggugacuguuaucggggggugaguugguuuaucuggggugccuggguugu

SEQ ID NO: 4185123 - RNA, 79 nt, Human
gugaauaugugaauaaacuugaucugauuaccgauaucuuuuuuaaaaagucucuuuagguauucauuuacauguucac

SEQ ID NO: 4185124 - RNA, 69 nt, Human
gugaauauugcauugggagagcugaaaaaguuuauguacuuucagacaucucauaauguauuauguagc

SEQ ID NO: 4185125 - RNA, 75 nt, Human
gugaaugaagcaaaaugucugcacauauucuuaguuaccuaaagguaugauguuagauuguuuuucuucacucau

SEQ ID NO: 4185126 - RNA, 59 nt, Human
gugaaugcaaacuguuucugauccucuuuccugauugggcuuaaauagaaugcauucac

SEQ ID NO: 4185127 - RNA, 66 nt, Human
gugaauggauaaauacuuggugguauauucacacaguggaauacuacauacuauguaaacauuuac

SEQ ID NO: 4185128 - RNA, 75 nt, Human
gugaauguacuuaagguggcugaauuauauacuuaaaaugguuaaaaugguaaauuuuaccuuauguauauuuac

SEQ ID NO: 4185129 - RNA, 81 nt, Human
gugaaugucaacaggcuuucuaaggcaaaagugguauuugaaucugguuuucuguuuuaugaugucguuguugguauuuau

SEQ ID NO: 4185130 - RNA, 58 nt, Human
gugaauuauauauuaagguccuuuagcacaguguugcaggacauuaguuaugaauuac

SEQ ID NO: 4185131 - RNA, 69 nt, Human
gugaauuccuucuagagcuuguuuaggugcuccuuggcuccuuggugcugggcucuggcaggauacagc

SEQ ID NO: 4185132 - RNA, 67 nt, Human
gugacaaaagcuuugcagcuaagcacaguaauuuauguugauaaauugcagcugucagaguguucac

SEQ ID NO: 4185133 - RNA, 59 nt, Human
gugacaaaggucaagcuuuugagcauggucaccauguaauaaagucuggacuauuucac

SEQ ID NO: 4185134 - RNA, 70 nt, Human
gugacaagagucucaagagaaauauuaacaaugauuuuggggguucagaggucucuggggacacuuucac

SEQ ID NO: 4185135 - RNA, 63 nt, Human
gugacaaggaaaggauuuuguaagacauuaguguacaaguugagcaauguugguuccugucac

SEQ ID NO: 4185136 - RNA, 77 nt, Human
gugacaauuauguuuauauaauaguuucauaaaggcuuguuugagccuaugugaaucucuuauuacuacgcugucac

SEQ ID NO: 4185137 - RNA, 95 nt, Human
gugacaauugauggaucguagggaccacaguucauuaacucuauaugccuaucucuugucaguggacuuuuaguauccuuauuuuccauuugcac

SEQ ID NO: 4185138 - RNA, 64 nt, Human
gugacacaguuguguuauuggcagugauaagacagaauugcacagaaacaggcaacgugugcac

SEQ ID NO: 4185139 - RNA, 65 nt, Human
gugacaccugccaagccucuaauucuucaccccgggaagagagaacacccucggcaugggcucac

SEQ ID NO: 4185140 - RNA, 77 nt, Human
gugacagagugaaaagcuagagcaguagcaucaagauauaaaccaaggcucauugucucucuuuucauauauauuac

SEQ ID NO: 4185141 - RNA, 58 nt, Human
gugacagccucuugggagguugaggccccagccccuuaucucuucaaggcugauuuac

SEQ ID NO: 4185142 - RNA, 67 nt, Human
gugacagccugcagccccaggucgcuggaggacaugcucagcagacucugugguugcagagcugugc

SEQ ID NO: 4185143 - RNA, 88 nt, Human
gugacagcuggagaauauguguccacaaacaacacaaagcauuauuuguguguuuuacaaauucucuuaaacgauaucacgcuuuuac

SEQ ID NO: 4185144 - RNA, 60 nt, Human
gugacagucaaagacaugacuugaugcggagaugugaagugugacuuuuuugacugucac

SEQ ID NO: 4185145 - RNA, 73 nt, Human
gugacagugcacaggagaggaaccuaaccuaguauaggaguaauggaaggcuucuucucuauguacaagugac

SEQ ID NO: 4185146 - RNA, 71 nt, Human
gugacauuucgugacgugagaacuaggacagcaaguauucauagaacacuucucacugggacaaaugucgc

SEQ ID NO: 4185147 - RNA, 75 nt, Human
gugacauuuuuccuuuuaaauaaaugucuuuacauuuuuaaaagugaauugauuuaaggggaaaaaagaguucac

SEQ ID NO: 4185148 - RNA, 91 nt, Human
gugaccaagcaaaaucuguuuaugcaucguuaauaccaaugggacucauuucaucaugguccaauuauugaugcaauaaacugugggucau

SEQ ID NO: 4185149 - RNA, 104 nt, Human
gugaccaccuaccagaaagacuuagagccaggagccucggggcucuucgcacccaggucuuuagagcuccuggcaucucagcaguguucuuucuaguaacgcac

SEQ ID NO: 4185150 - RNA, 98 nt, Human
gugaccagggcggggccuggaauaguggccucaggggcagaaaccacuucccuccccucaccaaggccuccuggcuccaggccuugcuauggugucac

SEQ ID NO: 4185151 - RNA, 62 nt, Human
gugacccaugcagugguuuuggacaaugaaauauauacagaaguaccuggcauaggagucgc

SEQ ID NO: 4185152 - RNA, 129 nt, Human
gugacccucagucagugccuagcagguuucuugggcucucucccagcacagaggaaggcaacaucucacuucuagguggcucuuucugucugggauccugauuucucuagucuugacugcuugggcagc

SEQ ID NO: 4185153 - RNA, 73 nt, Human
gugaccggguucuuguucuaggauguggagggagcagggacuuugaaacaaacugggauaggauccuguuuau

SEQ ID NO: 4185154 - RNA, 76 nt, Human
gugaccgguggcggguucggaugcagaggaggcuucucagugcgguuccuccucaucucggaaccugccaccccac

SEQ ID NO: 4185155 - RNA, 56 nt, Human
gugaccguccguucagguugguccucagccuugggcaagccuggagggcuggucac

SEQ ID NO: 4185156 - RNA, 81 nt, Human
gugaccucgucugucucagguucaugaacaugaaggugagagcagcucuuccucacagcaugaccaggcagugacaaacac

SEQ ID NO: 4185157 - RNA, 82 nt, Human
gugaccugccuauggagccacauggaaaaggccugagaauggccucuaggagguggccaguggcuaucaaggaaagggacac

SEQ ID NO: 4185158 - RNA, 56 nt, Human
gugaccuggccgccuaaacccagggcagugccugauuauaaguggacacaggucac

SEQ ID NO: 4185159 - RNA, 55 nt, Human
gugaccuuauuuggaaauagggucauguagacaugauuagcucaggugaggucau

SEQ ID NO: 4185160 - RNA, 66 nt, Human
gugaccuugggaaggagguaagaucgcucacugcuucuuuuacuuuaucugcuuuuuaaggcucac

SEQ ID NO: 4185161 - RNA, 63 nt, Human
gugacgccaggaguggagccagggugugcaggacacugcagcaccuauggacacuugugucgc

SEQ ID NO: 4185162 - RNA, 60 nt, Human
gugacuaagauucuuugauaugaauuuaggucauccugaaauauaauaaauuuugguuac

SEQ ID NO: 4185163 - RNA, 130 nt, Human
gugacuauguaucagaaaugcagaugcuccaccuacagaaauuccaaaucaacuagucuaggguggugcccaggcaucgguguuugggauuuuugguuguuguugcugcugcuguuguugaucuuguugu

SEQ ID NO: 4185164 - RNA, 59 nt, Human
gugacuauuucacauagucuuucugaauugucaguaauaggcuuggguaaaaaggucau

SEQ ID NO: 4185165 - RNA, 60 nt, Human
gugacucagcaacccacacacggucucagcagcugagaccguguguggguugcggugcac

SEQ ID NO: 4185166 - RNA, 70 nt, Human
gugacuccaaagggaagaguggaagugacuggauuguuuuaaaagucaguuucaauuugccuugagucau

SEQ ID NO: 4185167 - RNA, 74 nt, Human
gugacucggcuuguugacgacuugacuuucucaacuauaaaauggggaucaugcaucaucacauuccguuucac

SEQ ID NO: 4185168 - RNA, 62 nt, Human
gugacucuauaguaggaucaguccauguguuauuauuggaaaugauuucuauuauuaguuac

SEQ ID NO: 4185169 - RNA, 88 nt, Human
gugacucuccccuuucuuuauuuggacuuggcuauaucuggaugugauaccggagcuacuacuaccaaacuaaagaggaaagugucac

SEQ ID NO: 4185170 - RNA, 95 nt, Human
gugacucuugagagaugaauucaagauacucacaauguucuuuaaagagagguggucaaggugugaauaccuugaauucaucacucaagagucac

SEQ ID NO: 4185171 - RNA, 55 nt, Human
gugacugagcgucuggggaagaaggugauaaacagcuucucagagcuugcagcac

SEQ ID NO: 4185172 - RNA, 82 nt, Human
gugacugggcccaggccucuuccggcuccaguaccccccggggcgauucuggcaacucagccagaggaagccuggcccucgc

SEQ ID NO: 4185173 - RNA, 80 nt, Human
gugacugguugaaaccauuaaguccccaagucuuuguugugcuguccucagcaugguggauuugugauucagcuuagcac

SEQ ID NO: 4185174 - RNA, 58 nt, Human
gugacugugcacuuuuguucucagugaacuccagagcccaggaugguguauggcucac

SEQ ID NO: 4185175 - RNA, 56 nt, Human
gugacuguuguuugcuacgugcuagacaguaugccaagcaugacacagugguacac

SEQ ID NO: 4185176 - RNA, 96 nt, Human
gugacuugcuaacugaugagaacagaacagaggccuuauguuucagaaacuaaugggaauuauggucacuguuccuggggggcuuaagcaaguccc

SEQ ID NO: 4185177 - RNA, 69 nt, Human
gugacuuuuagaacauuuaguggguuauguagccaucacuauaauccuguuuuagaacauuuuugucac

SEQ ID NO: 4185178 - RNA, 79 nt, Human
gugagaaaggucugaugcaucacuaaauagugccgugggcagaacacgcuaacaguggcugcauccgcacuuuuguuac

SEQ ID NO: 4185179 - RNA, 77 nt, Human
gugagaaccaaccagcuccucaccccauugugcucuguagacuagcugggacagggcggggguugggggugucucac

SEQ ID NO: 4185180 - RNA, 55 nt, Human
gugagaaucuacuuccgagcucacaaaugugguuguuggcaguuaagaaucuuac

SEQ ID NO: 4185181 - RNA, 59 nt, Human
gugagacacugacuccaaaaauaaagaauucucagaauuugagucuguggugucuacac

SEQ ID NO: 4185182 - RNA, 77 nt, Human
gguggcagaagugcccucgugcccagggccucucauaucacuggaggacuugggguggagggugcugggugcucagc

SEQ ID NO: 4185183 - RNA, 67 nt, Human
gguggcagcggugugcaaggagggccugaugggucaagauccucuuugcccaccgcccugcaucacc

SEQ ID NO: 4185184 - RNA, 69 nt, Human
gguggcaucuggagaacuugcaagaggauguaacagacacauccuaauugcacagcuuuuaauguugcc

SEQ ID NO: 4185185 - RNA, 87 nt, Human
gguggcaugugaccauguuugaccaucaaagcuucacauucccuugacugcagugauuggaucagagauggauaaugacaggccacc

SEQ ID NO: 4185186 - RNA, 61 nt, Human
gguggcaugugccuguaaucucagcuacucaggaggcugaggcaggagaaucacaugaacc

SEQ ID NO: 4185187 - RNA, 90 nt, Human
gguggcauuagccacauguggcuauuuuaauguuaauuguauuuaauuauaauuaauuuaaacuuaaauagccacaugugguuagcuauu

SEQ ID NO: 4185188 - RNA, 123 nt, Human
gguggccaacaagucaugcaaaggaagcuaugagacccugauaggaguagaagaauauagcuccuguugccuucuuguaccuuacagaggagcaucccaagcugaauggcuauggcagccauc

SEQ ID NO: 4185189 - RNA, 58 nt, Human
gguggccaggccagcucuggcccugugggguuccugagaaggcuggcccuggguggcc

SEQ ID NO: 4185190 - RNA, 128 nt, Human
gguggccagggguggaggggcagcuguggucacuggcccagugggagggagcuaggccacuaggaaccggucaggccagcaccaucccuauccccaugcuagccaccacacccaccagcucugccacc

SEQ ID NO: 4185191 - RNA, 62 nt, Human
gguggccuaugggugggcuguccuggagucaggugcuagcuucaguccaaucagaggccacc

SEQ ID NO: 4185192 - RNA, 78 nt, Human
gguggccucugguguccuuuagaauuuaagcucagcauuuacuuuggacacaugauuuuugaaggacauggaggugcc

SEQ ID NO: 4185193 - RNA, 67 nt, Human
gguggccuggucaggugugagcuugcaccagcagugcaggcucugugugugccuggcacagcacacc

SEQ ID NO: 4185194 - RNA, 66 nt, Human
gguggccuuuuaugagcaggguggccuuaaacaaggcuuauaaacuagacuucaucgaagguuacc

SEQ ID NO: 4185195 - RNA, 109 nt, Human
gguggcgaauaggaagacugggaggaugucuuguuuaaugaacugcuaaaacuuuuggaaaauuuuaagcuagugaagucccucaacacgguauuuccauuugaaaacc

SEQ ID NO: 4185196 - RNA, 55 nt, Human
gguggcucacgccuguaagcccaggacuuugggaggcagaggcaggugggucacc

SEQ ID NO: 4185197 - RNA, 55 nt, Human
gguggcucacgccuguaaucccagcacuuugggaggccaaggcaggcggaucacc

SEQ ID NO: 4185198 - RNA, 55 nt, Human
gguggcucaugccuguaaucccagcacuuugggaggccaaggcaggcagaucacc

SEQ ID NO: 4185199 - RNA, 56 nt, Human
gguggcucaugccuguaaucccagcacuuugggaggcugagguagggcagaucacc

SEQ ID NO: 4185200 - RNA, 122 nt, Human
gguggcuccugggcacccacaggccugugcccccuucagagcuugcuugccaugucaccagagaagaggaagcuggcggcucaggaggggcaguucacagagccacguccugaggagccacc

SEQ ID NO: 4185201 - RNA, 60 nt, Human
gguggcucguuuuucuugaaaggcuaaguaacuaaugccuuuuauugaugaauggccacu

SEQ ID NO: 4185202 - RNA, 73 nt, Human
gguggcugaggggcccagaggaacagggaucuggcuagaaagcaccuguucuuaacaaggguccccagcagcc

SEQ ID NO: 4185203 - RNA, 80 nt, Human
gguggcugcaaaugaugcugcugugcuuuguuguagguuucuauauaacgcugggcauggugccuuauuuaacaguuccc

SEQ ID NO: 4185204 - RNA, 80 nt, Human
gguggcugggugugggaugcucagggccuggagccauaccagcauggucaggacucugacccgucccgaacccagcuccc

SEQ ID NO: 4185205 - RNA, 61 nt, Human
gguggcuuugugcugguagcaagcucuguaucacugggcugcaagcaugcacagauacacu

SEQ ID NO: 4185206 - RNA, 83 nt, Human
ggugggaaaccacuguaauguuuuaaagcagaggaggaacaugaucugauuuaggcuuuaaaaugauuauucuggcuucuauc

SEQ ID NO: 4185207 - RNA, 85 nt, Human
ggugggaccagcgcuguccuggggccccgagccagaagcggggaacccgacuaucugccaggucccagggcgcgccugggccccc

SEQ ID NO: 4185208 - RNA, 62 nt, Human
ggugggaccaucacuugagcccaggaguucaagaccagccuggaccacauagugaggccccc

SEQ ID NO: 4185209 - RNA, 60 nt, Human
ggugggagagcucugucuccagagcuguagcaguagaugggauaguggucucuccuuauc

SEQ ID NO: 4185210 - RNA, 91 nt, Human
ggugggaggagaggagugggaagcagugcaacccauccuuuucuguccuuguuuggguucagaauuccuauuucaucucucugucuccacc

SEQ ID NO: 4185211 - RNA, 56 nt, Human
ggugggaugccauugcuguucuagagggucauccauggagcucccugcaucccacu

SEQ ID NO: 4185212 - RNA, 57 nt, Human
ggugggauggaggaucuuagacccuccacuggccccugagacgaccccaucccgacc

SEQ ID NO: 4185213 - RNA, 82 nt, Human
ggugggcagcccaccccaguguggcuugagacagggagagcugcugcccugcucggggugcagugggcucggggugcccacu

SEQ ID NO: 4185214 - RNA, 62 nt, Human
ggugggcauuaucagaaaagcaguguuacagcuuucuaguucccucuggaauguaucccacc

SEQ ID NO: 4185215 - RNA, 80 nt, Human
ggugggccaacgggagaaugcagcuggggccgccccacuuccugcccccguggaggggccucucauucucccuggucccu

SEQ ID NO: 4185216 - RNA, 71 nt, Human
gguggggacagcucucacauggcucggcagaguggcugggcgccucaccauggggagcagugcuccugacc

SEQ ID NO: 4185217 - RNA, 77 nt, Human
gguggggagaagagcucagcacuaaaaucauguguuccauuuggggcacaucgagucugaguugcuaugagaccacc

SEQ ID NO: 4185218 - RNA, 60 nt, Human
ggugggggagagaggcauucuuucuguuccuaggcagggaucaagugcccuuccccugcc

SEQ ID NO: 4185219 - RNA, 59 nt, Human
ggugggggcggagcacgugaccacgccucuuaaaggggcugucgcaggucgccccaccc

SEQ ID NO: 4185220 - RNA, 78 nt, Human
ggugggggcucuguagcccaagccuggcuggcgaugucgcugcguguccauguccaggugggcccuggggccuccucc

SEQ ID NO: 4185221 - RNA, 59 nt, Human
ggugggggcuggcucguccugugcccaaggcugggugggagagcacugcagccccggcc

SEQ ID NO: 4185222 - RNA, 62 nt, Human
ggugggggcugugcacaggcucacugagacuuauuucagaagaaccagaacagccccccacc

SEQ ID NO: 4185223 - RNA, 60 nt, Human
gguggggggaggaggcagggaacaguagaagaaagcaaugcuaugucccuuucccccauu

SEQ ID NO: 4185224 - RNA, 67 nt, Human
gguggggggaugucguggguggcagcugggguccuggccagggccagccgcagcauccacacccacc

SEQ ID NO: 4185225 - RNA, 68 nt, Human
gguggggggcuugggggaauggcugugaucagugcugccaauucccagcugccgggcugcacuccacc

SEQ ID NO: 4185226 - RNA, 74 nt, Human
gguggggggucaggcuccccuagaaugaagacgggccucuuggggccugcagggccugggccuacccccucauc

SEQ ID NO: 4185227 - RNA, 55 nt, Human
ggugggggugguuuuucagguuaaguuugcucuacagaaacuggcuacucucucc

SEQ ID NO: 4185228 - RNA, 59 nt, Human
ggugggguauuggguaguuguucugugaagguacagaagagcacauuuaguauguuacc

SEQ ID NO: 4185229 - RNA, 55 nt, Human
ggugggguauuugguacuuguacugugaacagaagaguaccuuuuguauguuacc

SEQ ID NO: 4185230 - RNA, 90 nt, Human
ggugggguguucauuuacucugaccuggccuuggugggccauuuucuucuaaaucguucuccuuccagcucagggaaaugcuauucuacu

SEQ ID NO: 4185231 - RNA, 99 nt, Human
ggugggucaucugaggacaacaugauucuagguaguguccaaaugccucauuucuuaacauuuacauuguccagaaauuauuguccauccacucccacu

SEQ ID NO: 4185232 - RNA, 61 nt, Human
ggugggugcugggaacgaggaauucaggacaugcccuggccuacccugcucagcacccauc

SEQ ID NO: 4185233 - RNA, 66 nt, Human
gguggguggaaacagcauguaccuugccauuggagaagcuggguuuaugcugugauucacccagcc

SEQ ID NO: 4185234 - RNA, 76 nt, Human
ggugguacauuuguacgugcuuuguaaccuguaaagcccuuuacuguacacgugucauuuacagcucuguaucacc

SEQ ID NO: 4185235 - RNA, 70 nt, Human
ggugguacugcuggcuggaucagagauuggcauccuuacugccauguccuaugaccgcuaugcugccauc

SEQ ID NO: 4185236 - RNA, 64 nt, Human
ggugguagucggccucgguggcuccccgggugacccaggaggcccggcgcaggcggacuuugcc

SEQ ID NO: 4185237 - RNA, 69 nt, Human
gguggucacuucuuucaucgaaacuccuuguccccucggagucugguguaugaaagugaauucuccacc

SEQ ID NO: 4185238 - RNA, 65 nt, Human
gguggucaggggcuguggcuauggcuuuccaggagcacguggcuucccuuauggccccugucccc

SEQ ID NO: 4185239 - RNA, 62 nt, Human
gguggugaggaucacagcucacugcagccucaagugagccaggcucaagugauccucccacc

SEQ ID NO: 4185240 - RNA, 86 nt, Human
gguggugauggugguagugguggugguagauguugaaucccuguuucaggcucuuaacucucccuccuuacaucccccuuuccucc

SEQ ID NO: 4185241 - RNA, 111 nt, Human
gguggugcacgccuguaaucccaguuacucaggaggccgagguugcagugagcugagaucacgccacugcacuccagcacuccagccugggugacagggcgagacuccacc

SEQ ID NO: 4185242 - RNA, 60 nt, Human
ggugguggguaaaagcccgggucugucuggcuccagaguccaggcuguugcucaucuucc

SEQ ID NO: 4185243 - RNA, 58 nt, Human
gguggugguccagggcagggcugaaccacgagggaaggcaguguuccagaccuucacc

SEQ ID NO: 4185244 - RNA, 71 nt, Human
gguggugucugcugcccuggagccuggaggacuccaguccugugcaccagagcagggcagcagggcucacc

SEQ ID NO: 4185245 - RNA, 61 nt, Human
ggugguguugggagcaagugguauauauuucuaagcuauuuguaagagccccacaccugcc

SEQ ID NO: 4185246 - RNA, 55 nt, Human
ggugguucacgccuauaaucccagcaauuugggaugcugaagagggcagaucacc

SEQ ID NO: 4185247 - RNA, 55 nt, Human
ggugguucacgccuauaaucccagcacuuugggaggcugagguagguggaucacu

SEQ ID NO: 4185248 - RNA, 80 nt, Human
ggugguuuucagcagauggguuguguuggcaugugguaugcccgggauaaacauuuauugauuaaaaaauaagaaccacc

SEQ ID NO: 4185249 - RNA, 82 nt, Human
gguguaaagcaauacaaguggucauugagcuuugauuuuccuauucagaacagguuaaucuacuuguaaauugaguuauucu

SEQ ID NO: 4185250 - RNA, 74 nt, Human
gguguaacugggccgaaauggacagaauagacauuauaguaaagguucuuuuugcuuugguuucaaguugcacu

SEQ ID NO: 4185251 - RNA, 76 nt, Human
gguguaauuacaggcaguuggaauagaucaaugaaacaaaauugauagucuagaaauuuugccuuguauuuaugcu

SEQ ID NO: 4185252 - RNA, 57 nt, Human
gguguaccugaugaccuguggcugaaaagagagacucaggggugaucgggugacacu

SEQ ID NO: 4185253 - RNA, 70 nt, Human
gguguacgugcuguagucaugaugcugcagguucuuguagguaguguugucaaacggcucagcaggcacu

SEQ ID NO: 4185254 - RNA, 67 nt, Human
gugagaccuccuugggcugacucugucccucuaccuaagaucacagcuccuguaagguggucgucac

SEQ ID NO: 4185255 - RNA, 69 nt, Human
gugagagaacaaagauuacguaguccugcuuccuaguuaagguuauuaaaguguauuuuugugccucau

SEQ ID NO: 4185256 - RNA, 59 nt, Human
gugagaggaaagauauauacuucuggguuugcaauuuuaaagauguuucuuuuccucac

SEQ ID NO: 4185257 - RNA, 86 nt, Human
gugagaggcaagacagcugaacaggugggauaaggccuuuguuuugugguuguuuuuguugucauugcuguuuguucaguucucac

SEQ ID NO: 4185258 - RNA, 90 nt, Human
gugagagggaugugccggugcugagauuuccuucaaggcucugaaagcuggaagcgagacagagaucuccugcagagcaucucuccucac

SEQ ID NO: 4185259 - RNA, 62 nt, Human
gugagagguacggaaagagcgugggaagcaucagagauuccacauuaauuccuaacuuuugc

SEQ ID NO: 4185260 - RNA, 66 nt, Human
gugagaggucuuaagaucuagacugcaccugggaagugaggucaugucugagaauaaggccgacac

SEQ ID NO: 4185261 - RNA, 80 nt, Human
gugagaggucuugugaaggacugugcccucagccugugaagucugccuaacucuggcuaguccaucgcaagucacugcac

SEQ ID NO: 4185262 - RNA, 69 nt, Human
gugagagugagaagcacagucugggucgguaggacaaucuaguugucuaucugugcuuuaaacuccuau

SEQ ID NO: 4185263 - RNA, 60 nt, Human
gugagagugguuuauguccauguagaaaaucuugacuacugaacauaaauaacucuuuac

SEQ ID NO: 4185264 - RNA, 82 nt, Human
gugagaguuagcauuuucugggcugaaauaaagguucugaaguuauaacccuccguuuccccugggaaggugcuuugcuggc

SEQ ID NO: 4185265 - RNA, 84 nt, Human
gugagaguuaggaaaaaauauggauuguugauuuggaaggagacuaauaaacuaucccugccauaauuuuuuuucauuuuacac

SEQ ID NO: 4185266 - RNA, 62 nt, Human
gugagaguucaguguuucuaguagugaagaaauucucuacuucccaagucauuuaacaucac

SEQ ID NO: 4185267 - RNA, 59 nt, Human
gugagauaacucuaggucuucgagaugucaucaaagguggccuugauggaguuguccau

SEQ ID NO: 4185268 - RNA, 61 nt, Human
gugagauauaucagcuacaguuccacugagcaugcaugugcucacuacuguagcuucucac

SEQ ID NO: 4185269 - RNA, 84 nt, Human
gugagaugcagccuggauugcagaaugcuauaucuuuauuuuaaucaccagagcuugguuuuaauaaucacaugcugcacuaac

SEQ ID NO: 4185270 - RNA, 68 nt, Human
gugagauuuuuuguuccuuucuuauuagagucacagagagucagaagggaacucagagaugauuuuac

SEQ ID NO: 4185271 - RNA, 77 nt, Human
gugagcaaugaccaucaugcccugcagugagugcgucugccgggagcagagcucagagcagggcacucuugacucgc

SEQ ID NO: 4185272 - RNA, 58 nt, Human
gugagcacugagcauucgucuucccaacugucccuauaaggccauguucuaugcuuac

SEQ ID NO: 4185273 - RNA, 67 nt, Human
gugagcagauagagaagagcccuggugcuggccacugugagcaucagccucuguccuggaggcucac

SEQ ID NO: 4185274 - RNA, 67 nt, Human
gugagcagcauggagaaguagcuagaaacaggggcuugggcucuggcuaugcgcuccggcuucuugc

SEQ ID NO: 4185275 - RNA, 88 nt, Human
gugagcaguucccuuuacagauggauaauuguuuguguaagaccaaccagauaaaguccaaacuguguagaacacacgugugccucac

SEQ ID NO: 4185276 - RNA, 57 nt, Human
gugagccaggcugcaguuggcuggcuguggagcccacuggcuggagugcugguccau

SEQ ID NO: 4185277 - RNA, 74 nt, Human
gugagcccugcugaguccggcucagaugaucagaagcauccugccagcccacagacucaugagcaguacuacac

SEQ ID NO: 4185278 - RNA, 63 nt, Human
gugagcccuggcccggcugugcuuuggagccaaccacuagagccaggccaggccggggcacac

SEQ ID NO: 4185279 - RNA, 105 nt, Human
gugagccuggaaaaaguagguagugacacuuugugacucugagaaaauauuaagaaaggaaaucaauaugcuucuguuuaaagagucacaaccuuggaggcucac

SEQ ID NO: 4185280 - RNA, 87 nt, Human
gugagcucucugcagugcacuggggugggccugguagagcagcugcagugcugcuuggcacuguacccaguggaguguggagcucau

SEQ ID NO: 4185281 - RNA, 55 nt, Human
gugagcugaugucugccugugcacugauauguuguauggcuuuacuaagcugcac

SEQ ID NO: 4185282 - RNA, 75 nt, Human
gugaggagggaggagggagggaggagggagggagggaucgcguccccccucucccucacuuaucaaucaccccac

SEQ ID NO: 4185283 - RNA, 83 nt, Human
gugaggaguagugaaaggagccugagacugggcaccaggagaccugggucuugguucaugcucuguuccaccugaccucucac

SEQ ID NO: 4185284 - RNA, 106 nt, Human
gugaggaguuugaaaaaaauaccaauaccuguguccugcgucaagccaauuaaaaaucaugaucuauugggguggugucagggccaggguauuuuaaucuuuucau

SEQ ID NO: 4185285 - RNA, 97 nt, Human
gugaggauagacuugugcuugccuggcauuucuggggcccaggccuccccauucugugcccauguggcucuagaaaggccaaagccaccuccucuac

SEQ ID NO: 4185286 - RNA, 58 nt, Human
gugaggaugcauaugauggcaagaaaauggcagcucugccuggaugugcuggccucac

SEQ ID NO: 4185287 - RNA, 85 nt, Human
gugaggauguagaccagggcagcaaugcagcugcugcugaugaaggccaggagcaugucauuguugaacguccugcgcacuucau

SEQ ID NO: 4185288 - RNA, 59 nt, Human
gugaggcaggugagccaguuguaaggggacaugacaaaauggcuuuagacgugccuuau

SEQ ID NO: 4185289 - RNA, 57 nt, Human
gugaggcccagagagggccacagcaccaaagccagagaaggccuucucugcccucac

SEQ ID NO: 4185290 - RNA, 57 nt, Human
gugaggcuggcugacuucugaagcaucgaauugugcauuggaaacucagcagcacac

SEQ ID NO: 4185291 - RNA, 78 nt, Human
gugagggcggggagggagaggacaguucuauaagguggaccuuggguggagcuuuuaucuccuucuuuaugcccauac

SEQ ID NO: 4185292 - RNA, 68 nt, Human
gugagggguggcugagcaguuugcauauauuaggucaauuccccaagcugcuggccucauucauucac

SEQ ID NO: 4185293 - RNA, 76 nt, Human
gugaggguggugugagcuugaggcccaugaggggauggccaaggugggcgugggccccagccacucccucccucac

SEQ ID NO: 4185294 - RNA, 72 nt, Human
gugagguaggaguuuucauuccaguuuuauuucauuuacagaugaggaaauugagaaucagaauaaugucac

SEQ ID NO: 4185295 - RNA, 92 nt, Human
gugagguagggaaggcugguauuaugauccaugguuuauagauuagggaauuaaaucucagauaugaauuagcuuucccaaaauauccucac

SEQ ID NO: 4185296 - RNA, 78 nt, Human
gugaggucaagggcaugaagcaguggacagcacauucuuugugaucauacugcuccuccugccccacgguggccugac

SEQ ID NO: 4185297 - RNA, 78 nt, Human
gugaggugggaaagaagaagagccauuuuacaaugagcuuuguggagauguguagugcuuuuggccauuggggaucac

SEQ ID NO: 4185298 - RNA, 90 nt, Human
gugagguugugguugauuuuucccccuuuccuuuuaguuuccuaaauauagaauuaauggguuguagggaaagucaacaauuguucuuac

SEQ ID NO: 4185299 - RNA, 60 nt, Human
gugaguacauauugaguggugauauuucuuuugaaauauucaaacuagauauguauaugc

SEQ ID NO: 4185300 - RNA, 80 nt, Human
gugaguaguccuugugaagacgcuggacuucuuccugcagacaaggggagcugccagcaaguuucaaacagggcacuuau

SEQ ID NO: 4185301 - RNA, 71 nt, Human
gugagucuaaaguguguuuugaugaaauauauuaggaaacuuguuuucaaguaagauacauuucagaaagc

SEQ ID NO: 4185302 - RNA, 55 nt, Human
gugagucucauucuaguguaucaaaucauguuugaacauuucugggagaacucac

SEQ ID NO: 4185303 - RNA, 86 nt, Human
gugagucugaagcccugaacacauaaggcuuuccuguauuuuacauauggagaaaaccauuguguuauauaugggaucagacugac

SEQ ID NO: 4185304 - RNA, 62 nt, Human
gugagucuuuggagacaguucaguauaagcaggauuaucucuggauuguauagaagguucac

SEQ ID NO: 4185305 - RNA, 63 nt, Human
gugagugccuuacuugaugaucugagggaacaggccccuuaucuucacagacagagcaaucac

SEQ ID NO: 4185306 - RNA, 57 nt, Human
gugaguggaaguguguauauuugugugcaaguguguacucauauacuuccaccuuac

SEQ ID NO: 4185307 - RNA, 66 nt, Human
gugaguuauuugguuugcaugcagaauaguugaauaaauucauugauguaaacacagguaauguau

SEQ ID NO: 4185308 - RNA, 64 nt, Human
gugaguucaagacugcuuuaggauguucagaugcagauguccucagcauggaaucuggacuugc

SEQ ID NO: 4185309 - RNA, 80 nt, Human
gugaguuggauuuguugcuagcagcacugauccauuuguauguauguuugucagugggcguggcgacaucgcuuacucac

SEQ ID NO: 4185310 - RNA, 62 nt, Human
gugaguuggcauauggcuuuuaaauuguuuacuuaguuauaggucaugcuaugucaaaucgc

SEQ ID NO: 4185311 - RNA, 78 nt, Human
gugaguuggucaguuuccuucaggccauugaucuaaguagaagagauuuaauggccuguauggaaagugaaaguuuau

SEQ ID NO: 4185312 - RNA, 67 nt, Human
gugaguuuagugauaagaauuaugaaaaugacuuucauuuucauauuguaguuugucuuacccuuau

SEQ ID NO: 4185313 - RNA, 68 nt, Human
gugauaacaggguaguaauuuaauacaaguguuuuaauuuguauuucaaggcacucucagguuuuuac

SEQ ID NO: 4185314 - RNA, 124 nt, Human
gugauaauuguaggcuccugucaaaggucaucaauggcuuaugguaaauauuucugucuuguucuuaauagcaaggaaaggaagccaagccugacacucaacaggguuugcuuuaaaaugucac

SEQ ID NO: 4185315 - RNA, 70 nt, Human
gugauagaucugaaauauauuuugaguguuauuuccuuuaugguaaugcucaaaauguuucaucuaccau

SEQ ID NO: 4185316 - RNA, 59 nt, Human
gugauaguucuuacuccaaagugccauuucuuagugauccuugaguucagagcugucau

SEQ ID NO: 4185317 - RNA, 55 nt, Human
gugauaucuuacaauucucuuuuaggacagaguccagacaggagagaagagucac

SEQ ID NO: 4185318 - RNA, 71 nt, Human
gugauaugauagagaguaacuguggucacuuuacgauugggaggccaggaggaucucucuaaagauguuac

SEQ ID NO: 4185319 - RNA, 83 nt, Human
gugauauucgaaagucuuaggcauuuuauuucucaguuuagagauuuaaaaauggccagacuauuuaaagauugaauacuuac

SEQ ID NO: 4185320 - RNA, 66 nt, Human
gugaucacaguauuuuagaugugucucuucugauuguaagacacauacccacaaggucugugaagc

SEQ ID NO: 4185321 - RNA, 74 nt, Human
gugauccuuaccuccaugugggcccuucaccagcuugggccucaucucugguguccagcauguguggaagucac

SEQ ID NO: 4185322 - RNA, 70 nt, Human
gugaucuuauaaaaaugaugucgaaaaguaagcucuguguucuagaguuuguuuucauuauaaagauuac

SEQ ID NO: 4185323 - RNA, 72 nt, Human
gugaugaaaucaaaggaguuuaaguuacuggauuuacuaaauucaauuuaagguacuacuuugggauaucac

SEQ ID NO: 4185324 - RNA, 92 nt, Human
gugaugaagugccaagcccagagggcaugagagccacaagaccagccugccuuuccaggcucucucugccccugggacucugccucacucac

SEQ ID NO: 4185325 - RNA, 68 nt, Human
gugagauugaaaggucuuuaaauugguaguauuguaucacugcaaauuuaaugguuuuugagaaucau

SEQ ID NO: 4185326 - RNA, 61 nt, Human
gugagcacaguugcauugcaagugagugauucuuucauuuuguuaaugucaccgugcuugc

SEQ ID NO: 4185327 - RNA, 72 nt, Human
gugagcagacaucaaaggcugcucaguggacagggccuggaugacaacagcuuugauucuuucugccaucac

SEQ ID NO: 4185328 - RNA, 76 nt, Human
gugagcagagaccaguguuuucauccucccuuggguaccaugaaccccucaagggcaggagccuguuuugccucau

SEQ ID NO: 4185329 - RNA, 75 nt, Human
gugagcaggauaggggcucccuucccuauacagucugggagggaacaugugccucugucuaaaacaccuccucac

SEQ ID NO: 4185330 - RNA, 76 nt, Human
gugagccaagagagaggcacucauaucuguuccaccuguuugugaacagaaucuuggguucuuuucacuugaucau

SEQ ID NO: 4185331 - RNA, 60 nt, Human
gugagccaaguucacaccauugcacuccagucuggaugacagagugagaccuugucuuac

SEQ ID NO: 4185332 - RNA, 74 nt, Human
gugagccaauaguuaaacuguuaggaauuuugugaucuggguugaccacagguuagcagcuugaaacuggccac

SEQ ID NO: 4185333 - RNA, 55 nt, Human
gugagccaccucugcuccacacagcacagaauuguggcacagcaagugggcucau

SEQ ID NO: 4185334 - RNA, 79 nt, Human
gugagccaugccuaaguauuucuggccugugaaaggaacacaguuucagagccagggcagaaaaaccaugugugcucac

SEQ ID NO: 4185335 - RNA, 128 nt, Human
gugagccaugggacucagugccacugcucaaggucuccauggcugagccugggggcucuuacaacaggcuccaugcccaagguggcaguuguggaaccaucagagagggcacagagcucaugguuuau

SEQ ID NO: 4185336 - RNA, 65 nt, Human
gugagcgagccgcaccugggcgccuacaucaacgccugcgaggagcucagguagggcucgcccgc

SEQ ID NO: 4185337 - RNA, 55 nt, Human
gugagcuguuggaguggcagagcuguucaacaucacucagcuaaacaacacugac

SEQ ID NO: 4185338 - RNA, 60 nt, Human
gugaggaaaaaauaagaagcaguuccucaauggagacuuuauaaaucuuaauuuccucac

SEQ ID NO: 4185339 - RNA, 83 nt, Human
gugaggaaaauaaaugauaauaaugcuaguguuuauugaauguuuaacuugugcuguuuuaaguguucuuaucauuuccucau

SEQ ID NO: 4185340 - RNA, 81 nt, Human
gugaggaaacugaggcccagagcgaguggcucagcuacggucagaaugcugguauccugcuucugggccugguguucccau

SEQ ID NO: 4185341 - RNA, 70 nt, Human
gugaggaauccuguuuuagauaagcuuauacuaaaaaaguauacagaaaaugaugcagaguuuuucucau

SEQ ID NO: 4185342 - RNA, 129 nt, Human
gugaggagaaacaguggggugagggugucagcgagggugauuacaggcugaggaugauugcaucauggaaaaacuccagagaucuggcacguucuccagcuacccuuuuaguuuguaucccucccucac

SEQ ID NO: 4185343 - RNA, 60 nt, Human
gugaggagcucuuugacucacgaggccuuguuaccacuugugucugcacugaguccucac

SEQ ID NO: 4185344 - RNA, 70 nt, Human
gugaggcaguuuccagacauuauugauauacuuucaaguauaucaguagaacaauggacauugagugcac

SEQ ID NO: 4185345 - RNA, 60 nt, Human
gugaggcauucuuuugcugcauguccaacauucuugauggcacagaggaccaugcuuugc

SEQ ID NO: 4185346 - RNA, 77 nt, Human
gugaggccgaucaacacugaaggaauggggcuuuuugggggaagagcagccuccagggguggaggagcaggccucac

SEQ ID NO: 4185347 - RNA, 55 nt, Human
gugaggccuaccccccuguguuuucuucugagaguuuuauaguuuuaggccuuau

SEQ ID NO: 4185348 - RNA, 83 nt, Human
gugaggcuagaggcgggcugucuuuccuuuuggcauuuuugauggucucagacuaaaagaaggaagcuaccuucuggccuuau

SEQ ID NO: 4185349 - RNA, 55 nt, Human
gugaggcuugucucagauggggggcucaucucuuccugacuacacggcacugcac

SEQ ID NO: 4185350 - RNA, 129 nt, Human
gugagggaauugaccgaucuacaggugaagaaaacaaagggccacauuugggucccugguuugacaaagccagaggcucagauggcccuggcacuuuaacuaagguagcucaaggugaguuucugucac

SEQ ID NO: 4185351 - RNA, 58 nt, Human
gugagggaucugcuuccccucuaacucacaugguuuuugggaggcauuggucccucac

SEQ ID NO: 4185352 - RNA, 58 nt, Human
gugagggcagcuuggucagugugaguuuaaaacagcaugaccucugagcucccguugc

SEQ ID NO: 4185353 - RNA, 65 nt, Human
gugagggcuaaauuguggcagguacuguaauugauuggcuagguacucaugucauauguuuucac

SEQ ID NO: 4185354 - RNA, 77 nt, Human
gugaggggcuguuucuugaggcuacuccugguaccaauucgcgcauugccaggggcccagcaggagacagaaggcac

SEQ ID NO: 4185355 - RNA, 112 nt, Human
gugaggggugggggacagggagagaagagacagggagggcaggcagggcagggacaggccccugccucagucuaaagucucucacucuuuuuccuguggccgcccucuucac

SEQ ID NO: 4185356 - RNA, 78 nt, Human
gugaggucuguggccugugaggagcgggcagggaugcaggugugccugaccuagcccugcuccucucugcagucccac

SEQ ID NO: 4185357 - RNA, 74 nt, Human
gugaggugagggugcacccagagcagauucguucccgaugcaccagggccugugcuggguguuccgcacuugac

SEQ ID NO: 4185358 - RNA, 72 nt, Human
gugaguaccaccguggaggcacccuggccacaagaguguacaaaaugucuccauggaugauggagaacucac

SEQ ID NO: 4185359 - RNA, 67 nt, Human
gugaguccuaugggacugucugugugagauggagaagacacacagagggucugggcacaggacacac

SEQ ID NO: 4185360 - RNA, 62 nt, Human
gugaguccuuucacguggaaggagauugaaaaagauaagcuuucacauagaaagugauuuac

SEQ ID NO: 4185361 - RNA, 120 nt, Human
gugagucuugcacgaacugcaggaagagaaccagaggaaaguauuucuggaagcagguagaucuccuguuucugcuaaucuuuuacugaguuuguggcugccuagucagugcagguucac

SEQ ID NO: 4185362 - RNA, 91 nt, Human
gugagucuuuuuuuaaaguguucauuuucauuuguucuguuucuuuugucacucagaaaacaugauauugaggcugggcacgguggcucac

SEQ ID NO: 4185363 - RNA, 63 nt, Human
gugagugaagcaggccuuaguccaaagacuugcuaguggucugaagcugccugcauuccucac

SEQ ID NO: 4185364 - RNA, 80 nt, Human
gugagugauacugauuccuuugaggcuugcauuaaacauuuuuuagggugagucugaaguagucuuuaguguuaauuuau

SEQ ID NO: 4185365 - RNA, 76 nt, Human
gugagugcauguaugugugcauauguguggcuggauucaugcagcuacauucauaugugugcauacauguguccau

SEQ ID NO: 4185366 - RNA, 68 nt, Human
gugagugugcauucaugccugugugagcucaugucugugugaguucauaucuaugagugugcauucau

SEQ ID NO: 4185367 - RNA, 95 nt, Human
gugaguguggauggggguacgcacuuugucuuuuuguccaaaauuguuagaauuccaagauggacaggcuccuagggguucccccacccacuuac

SEQ ID NO: 4185368 - RNA, 87 nt, Human
gugaguugcugagaguaaauuuuuguuaacagccucuaaugugcuuacaagcugauuuuuaaaaaauguauuauucuagagacucuc

SEQ ID NO: 4185369 - RNA, 76 nt, Human
gugaguuguuaaguuacauauucuugggcuauaaaaagacaacugcuauggucugaaugugugcuccaaaauucau

SEQ ID NO: 4185370 - RNA, 92 nt, Human
gugaguuguuucaagggcagagauuaauuaagacagccuguaucauucaggcuuuguggacuuuuucuuuguucuucucgaagccuauucau

SEQ ID NO: 4185371 - RNA, 90 nt, Human
gugauacauuugcagaaggggugggaauguggcuuuguccguauuuccaaauguaaaacaggucucccauccccucuguuugguuguggc

SEQ ID NO: 4185372 - RNA, 81 nt, Human
gugauacucuucagaacuauaaaaaguacuguaaaauacuuuuucauacauaguacuuuuugugggcugaaacuguauuac

SEQ ID NO: 4185373 - RNA, 86 nt, Human
gugauauguucuacauucauuugcacuggauuacuggggugcuuuuuagcaugugccaagaaauugagucauaaugaagcauaucc

SEQ ID NO: 4185374 - RNA, 58 nt, Human
gugauauuuuuaaagauuaaggaguaugacaucaauuaacagucuuuaaagauguuac

SEQ ID NO: 4185375 - RNA, 68 nt, Human
gugaucaauggucuacagccagagaccugcagaggcagcaggugacccucaguguggacuuagagcac

SEQ ID NO: 4185376 - RNA, 78 nt, Human
gugaucagacccuggucaaagaccaggaaaugcuucucaacagagguaggccuugaucuuuggagggguucugaugac

SEQ ID NO: 4185377 - RNA, 63 nt, Human
gugaucagcagcggugugggccuuccucacagcacuucucacacacauuugcugucugauuac

SEQ ID NO: 4185378 - RNA, 68 nt, Human
gugaucaguguuuugugcauucuugaaagggcaaggguugucauaagaaagagcagaaagcacuucau

SEQ ID NO: 4185379 - RNA, 60 nt, Human
gugauccuguuagaucccauuagauuuaagaugucuacauguuccuucugacagggacac

SEQ ID NO: 4185380 - RNA, 117 nt, Human
gugaucugugaagaggaaaaagaauaaagcaaccagagauuguggccuuuggguuucugccugcugagaaaugacagauagaaucccagccagcuggaagcucugauucacagaaac

SEQ ID NO: 4185381 - RNA, 96 nt, Human
gugaugaauaggcugugguauauguaaaacugucuaaugguauauugugugucaacauauguacauuuguaguaauaucacaggcauuuuuauugc

SEQ ID NO: 4185382 - RNA, 77 nt, Human
gugaugacagcuggacuucccugggcugaaagcugaguguggcugcuccagcucuguucuggggaagcuguugucau

SEQ ID NO: 4185383 - RNA, 69 nt, Human
gugaugagcaagauggaaagagaugaggugugggccacgacagcaucuguucuauccacguugcuucac

SEQ ID NO: 4185384 - RNA, 77 nt, Human
gugaugagcguggcuggggaggucagccagccccugguggggugggcguaacuagcuccuagggccacgcccagcac

SEQ ID NO: 4185385 - RNA, 64 nt, Human
gugaugauaggaacccuggaacgaaaagcaucucccguugucuccuuguucguuccugacaggc

SEQ ID NO: 4185386 - RNA, 87 nt, Human
gugaugaugcauuuccccuacauuccaaaaacuagcagauaucugcaauaucugcuagcuuuuggaacguagggaaaaugcagucac

SEQ ID NO: 4185387 - RNA, 79 nt, Human
gugaugauuucaaaagacuaagaagaguauuauuccuuguucuuuggagguuuugcuuuucagucucaauaucugucac

SEQ ID NO: 4185388 - RNA, 76 nt, Human
gugauggcacaacaguuaggugggcuaaucuguuugugcaaaugaccuuugcugcagacgaagcccaugccaacac

SEQ ID NO: 4185389 - RNA, 59 nt, Human
gugauggcuccagacagaaggggccaaaauccuauuuuuaacucugucuugacugucac

SEQ ID NO: 4185390 - RNA, 67 nt, Human
gugaugggagcucauagcaagacagucagacccagccugucugaguguauggaauuagcucccuugc

SEQ ID NO: 4185391 - RNA, 91 nt, Human
gugauggggacaagcuggcguggagcggggggcaggcagccuugagcagaucagggcucaguucugcuucaugcugauugaauuuauccac

SEQ ID NO: 4185392 - RNA, 70 nt, Human
gugauggggcugguauucagaugcauacagaaaauuuucucaugccuggaauuaucauuauucuugucac

SEQ ID NO: 4185393 - RNA, 100 nt, Human
gucccccaauuagcauuauccaagcacagcagagccuugcuugaagaaagaagcuuuaggcagaauucauugugcugcugaggauugugagaggggugac

SEQ ID NO: 4185394 - RNA, 56 nt, Human
gucccccacacuuccaugucacacgacugugauuuacauaugcaggugugaggggc

SEQ ID NO: 4185395 - RNA, 79 nt, Human
gucccccgcauggccaguuuguuuacugaugguuuucauuuggcagaaucaggaagacagccuggcuugaugucaugac

SEQ ID NO: 4185396 - RNA, 106 nt, Human
gucccccuucaaaccugaagugcugucuccuucccccgggggccuacuugccgcuuuggggcgcaccccgugggagagacacgcacccugggugcaagccagggac

SEQ ID NO: 4185397 - RNA, 76 nt, Human
guccccgacguuuggcuugaugaaacauuuucuugauauuuuucaacaguuaucagcgugcaaaucuuuggaggac

SEQ ID NO: 4185398 - RNA, 83 nt, Human
guccccuccuagccucaagagauucagggacagaucaccaguccuguccucugggagccuugagccuuuugaaggaggcagac

SEQ ID NO: 4185399 - RNA, 81 nt, Human
guccccugacgaggacuggggcucuagccaggccuggggcggagccuggggucuggacggcugcaggaagcgggagggggc

SEQ ID NO: 4185400 - RNA, 59 nt, Human
guccccugcuguggaucuguggcuaguaacagccugggagcagcagacagacaggggac

SEQ ID NO: 4185401 - RNA, 57 nt, Human
gucccggggcucgaaggcagaggcuccccuaggugugcccugccugaccccggcuac

SEQ ID NO: 4185402 - RNA, 62 nt, Human
gucccuacccucacgagacuucaagucuacugggacuugaguaaguugaagggaaggaagac

SEQ ID NO: 4185403 - RNA, 70 nt, Human
gucccuaggccagguuccucaaucuugacaguauuuacuuuugagguuggauaauuuguuguaggggggc

SEQ ID NO: 4185404 - RNA, 57 nt, Human
gucccuauaacuaaacagaaacacagucaucuguccaucugugcaguuuaggaaggc

SEQ ID NO: 4185405 - RNA, 58 nt, Human
gucccucccaccuuucacugucacucauggggagggcagugcuggagauggguggaac

SEQ ID NO: 4185406 - RNA, 62 nt, Human
gucccucucaaauuuauaugcuggcucucaaauccgcaguguggcuguauuuggagauggac

SEQ ID NO: 4185407 - RNA, 81 nt, Human
gucccucuugcuucagcuucauguccagguacuguguuagaugcagaugcugugugaauguugggcaacaucagaggugau

SEQ ID NO: 4185408 - RNA, 57 nt, Human
gucccuggaaacuuguaacuggacacacuguaauuuguccagcugucuuucagagac

SEQ ID NO: 4185409 - RNA, 61 nt, Human
gucccuggggaaucagcuggaggcaggcaggcaucagucucuucugcuuuugcuuagggac

SEQ ID NO: 4185410 - RNA, 77 nt, Human
gucccugguagcccuucaagagcucuguccuaugaacaagagagggcagaaaccaccuugauggagcaaguggggau

SEQ ID NO: 4185411 - RNA, 106 nt, Human
gucccuguguggagucaguucuuuaugggugccugcaggugccggcuucacaguaagaaaacugucagcuucgccugagguaugggcacagaggugacgcagggau

SEQ ID NO: 4185412 - RNA, 79 nt, Human
gucccuucuagcuccuacuguugcagacaguaaaaaugauacuaaugaugaccugugcagcagcagcuguggagaugac

SEQ ID NO: 4185413 - RNA, 69 nt, Human
gucccuugaccccugcaggacugugacaugggaagggacacucuauucugaguccaugggggcagggau

SEQ ID NO: 4185414 - RNA, 61 nt, Human
gucccuuuacagaaaugucugcuacuccuuucaaagagucacagaaauuuguaaaagggau

SEQ ID NO: 4185415 - RNA, 63 nt, Human
guccgcauuguuuaagugggugggguuuaugguacuagagucuacaacgcaagcaacauggau

SEQ ID NO: 4185416 - RNA, 97 nt, Human
guccggcagguaccgguccuuccaguggucgaggaagaccauguccaguguguccacaucauacuucuucuucagcugggggaugauguccugggac

SEQ ID NO: 4185417 - RNA, 93 nt, Human
guccggguugagucggcagcgucggggccguccgucuuggcagaugcagagcuggcagucggccuugaugcguugcccaggccaguagcgggc

SEQ ID NO: 4185418 - RNA, 67 nt, Human
guccguaugccuccaagauucuuacguugggaccuaaucccaaugugaugguauuuggaggugggac

SEQ ID NO: 4185419 - RNA, 115 nt, Human
guccuaaaaucaaggugucagcaggacugcauuccuucuggaggcucuaagggacaaucuguuuccuugucuuucccagcuucuagaggcugccugcauucuuugguuuguagac

SEQ ID NO: 4185420 - RNA, 73 nt, Human
guccuaauucuaacaggguaggagggcaugaaucaucagauucucucuuccacaaaccacugaagauugggac

SEQ ID NO: 4185421 - RNA, 57 nt, Human
guccuacaguuagggaacugggccccgaguuuggccauggcucucacccugugcgau

SEQ ID NO: 4185422 - RNA, 76 nt, Human
guccuacauucuuuaggcaagaacucacugagaauguuuuuagucucacauucugccaaagagaaaguggcaggac

SEQ ID NO: 4185423 - RNA, 121 nt, Human
guccuagccaagaggguaugcuugagugagggcuagaguugagauggggagcuugcaaggaaaagcugcuuuauucaggguuuacccccagcacacucaauaccaguuucagggcagagau

SEQ ID NO: 4185424 - RNA, 84 nt, Human
guccuaguaguaccaaagugcucauagugcagguaguuuuggcaugacucuacuguaguaugggcacuuccaguacucuuggau

SEQ ID NO: 4185425 - RNA, 64 nt, Human
guccucagggagggaggaaaauuugcucagcuaccauuugagacgaguugcaucuccccaggau

SEQ ID NO: 4185426 - RNA, 63 nt, Human
guccucccauuggccaggacuugccgucugaaaggggccucuauccuggucauguggcugggc

SEQ ID NO: 4185427 - RNA, 64 nt, Human
guccucucuucaaauauagucacauuagggguuagaguuucaaugcauuaauuugggagaguac

SEQ ID NO: 4185428 - RNA, 94 nt, Human
guccucuugagguaccugaauuaccaaaagcuuuauguauucugaaguuauugaaaauaagagcuuuugggaauucagguaguucaggagugac

SEQ ID NO: 4185429 - RNA, 70 nt, Human
guccugaauauuagaugaugaguccuucauauuuugagugguuucagcaucuacauauuuagaaagugac

SEQ ID NO: 4185430 - RNA, 75 nt, Human
guccugaaugcaaagugaggugaguggccuuugcaaaugccagcuggaaaugcugcucugcuguguaagcaggac

SEQ ID NO: 4185431 - RNA, 59 nt, Human
guccugagggcgauucagcagguuugauuauaugccaaguaccugugaauaccccaggc

SEQ ID NO: 4185432 - RNA, 82 nt, Human
guccugaggguuacugcuucugcuugagaagucacaugccagaacucaauccaagucucagccagaaagugauuuucaggac

SEQ ID NO: 4185433 - RNA, 87 nt, Human
guccugauagcaggcauggcuuuaggcaggcguccccagguccgagaaggagagcccccauccuagccagccugcggaacucgggac

SEQ ID NO: 4185434 - RNA, 68 nt, Human
guccugcagccacugcaggcagaggaggcccugcuucccugacccaucugccugcggcugcagguggc

SEQ ID NO: 4185435 - RNA, 66 nt, Human
guccugccucucaaaugucauuccucuaugauucucuaucacagagaugcccauuuggguucaggc

SEQ ID NO: 4185436 - RNA, 130 nt, Human
guccuggagaguaguauuucggaugucugggcugugggaugugggaggaaugucacugagccauuccucagguggcacaugccauuccugccccguccccacauaggaaugcgggccacuucucacaggc

SEQ ID NO: 4185437 - RNA, 66 nt, Human
guccuggcccacuaugccagcaucugccagcagaauggcauugugcucaucguggagccugaggau

SEQ ID NO: 4185438 - RNA, 73 nt, Human
guccuggcuacucaccugaggguguagcucgcaaaggugggaaucuggugcuggcuuuuccuucaggcaggau

SEQ ID NO: 4185439 - RNA, 112 nt, Human
guccuggcucauggagacggugcagaugggcaugcuggagcgggcgcaguacagaaggcaugugcccagcagcagcguccccguccaugccuggcacucgggccugugggac

SEQ ID NO: 4185440 - RNA, 63 nt, Human
guccugggcuuugagggcaggauggaugagaaugcaccaccaugcagaaggauccccauaggc

SEQ ID NO: 4185441 - RNA, 59 nt, Human
guccuggggaauacagaagccgccucgaaugaauggucggacucaccuuuucccaggac

SEQ ID NO: 4185442 - RNA, 82 nt, Human
guccugguuucaguucucuuggaaguuaugugaggaucuggucucacaccuuaccccgagagagcccugaagggcccaggau

SEQ ID NO: 4185443 - RNA, 56 nt, Human
guccugguuuucacagaccuuuccaauuaaauggcguuguucuugaaaagcaggac

SEQ ID NO: 4185444 - RNA, 70 nt, Human
guccugucugucauuagccuugacuguagcuuucuaaaguggucuacagaauagaauagggacaggggac

SEQ ID NO: 4185445 - RNA, 97 nt, Human
guccugugaccaacacggcagggcuucgcuccuggugcaccaugcuccgcgcggucaggcggccacaagccaugcuguaacugucaguccauaggau

SEQ ID NO: 4185446 - RNA, 60 nt, Human
guccugugccgaggugggaagccagugccccucucuaaagucuucagccuggagcaggac

SEQ ID NO: 4185447 - RNA, 72 nt, Human
guccuguuaagaugcagaguccauaaccgcuccauagaggagcagggggaggcguuuguguugugaugggau

SEQ ID NO: 4185448 - RNA, 73 nt, Human
guccuuagcccagugcugagggugcugcugguccugagaccuaagccauacuccacucugagcucugggaggc

SEQ ID NO: 4185449 - RNA, 71 nt, Human
guccuucugauauauuuuccauggucugcaguauucaacucacugagacugagggaaauauucugccagac

SEQ ID NO: 4185450 - RNA, 66 nt, Human
guccuucugauucugugguaguuaaugccucaggcauagucuguccagugcagagaacagaggggc

SEQ ID NO: 4185451 - RNA, 81 nt, Human
guccuugacuuuggcuugcacuggcaccaaccucagcccucgcugguugggagcucucagcugcaguccauagucacugac

SEQ ID NO: 4185452 - RNA, 55 nt, Human
guccuuggagguguggaaucugacuguguaaaguaagugguuacccacccaaggc

SEQ ID NO: 4185453 - RNA, 57 nt, Human
guccuuggagucaggcaaggcugcgcaguggugggcagaccagccugguuucaagac

SEQ ID NO: 4185454 - RNA, 58 nt, Human
guccuuggcacccaugugauucugacauccagaagggauaugagauggugcuagagac

SEQ ID NO: 4185455 - RNA, 58 nt, Human
guccuugguaugacaugcaaaaugugugcugggcacugcaccuguguaccaagaugac

SEQ ID NO: 4185456 - RNA, 83 nt, Human
guccuuguagucuccugccacuucuugcuauggagugcuguaccaaggucucugcuaguuucuaguuggcuugacauaaugac

SEQ ID NO: 4185457 - RNA, 58 nt, Human
guccuuguggggugcgaggagacguccagacacaaguguuuacuucaacucccagggc

SEQ ID NO: 4185458 - RNA, 123 nt, Human
guccuuuaacccuucaagcaauuaaaauugugguuuuagcuucaguucuagcuucuuucuaccacaaggucuggggaguauccucaacugaaaaaccauauuuaguucccuucuuuaaaggau

SEQ ID NO: 4185459 - RNA, 55 nt, Human
guccuuucgagggugagugaaagcacaugcuguccuuuacaugcuugaggcggac

SEQ ID NO: 4185460 - RNA, 117 nt, Human
guccuuuuagccuuggcagggcaccuaaguaaacuugccaagagcuuugcuagccgugggcaggccgagcucauuggaggaggugcuaggaacgcccugcucucuggcuuucaggac

SEQ ID NO: 4185461 - RNA, 120 nt, Human
gucgacacaauuaugggaauagcuaaaauucaccaguagaccuaguggguucaauucaacaagauuauugagagccuguuuugugggagaugcuauugcucauaugcuagugaaacagac

SEQ ID NO: 4185462 - RNA, 64 nt, Human
gguguacguucuucugaacuuugaacgacacuuuucaaguggugcugauuaagaacuguauacc

SEQ ID NO: 4185463 - RNA, 64 nt, Human
gguguagcaguguaggaaugugaauccuggagauaaauuucagggcacguuucugcaaugcucc

SEQ ID NO: 4185464 - RNA, 70 nt, Human
gguguagguguggcccaggugucugcagcucugaagguggaggugcagcccagguguagcucuuugaacc

SEQ ID NO: 4185465 - RNA, 67 nt, Human
gguguauuagcuguuagcuacaucagaaugacuuagcguaacccugaucagcuaacgcuuguaucuc

SEQ ID NO: 4185466 - RNA, 61 nt, Human
ggugucaacaucagaaaaugcuccaucacacagcucguagaagcacagccugauggacacc

SEQ ID NO: 4185467 - RNA, 85 nt, Human
ggugucaaucucagacaaauggguacccgugauugcaacagcgccugcagcagcuccagguuacccucagucucagaaggacauc

SEQ ID NO: 4185468 - RNA, 74 nt, Human
ggugucagaccuggagggaaguucugacuugggcccuuaugcaccaagucaggugagacucucugggccucacu

SEQ ID NO: 4185469 - RNA, 63 nt, Human
ggugucagaggaggcugaguaggaaggagggacuuuaccccugcccccuaauccugugauauc

SEQ ID NO: 4185470 - RNA, 101 nt, Human
ggugucagccagggcugugauuucaucugaggccaggagcccucuuccaagcucacugguuguuggcugaauucaauucauugcaguuuuagggcugaccc

SEQ ID NO: 4185471 - RNA, 68 nt, Human
ggugucccuggaauggacucugcgcuguguccaguccgggacgcgcagagcccucuucuguggacgcc

SEQ ID NO: 4185472 - RNA, 58 nt, Human
gguguccgcgcuguagaaggucagcaucugcuuggugaucagggauggguuggacacc

SEQ ID NO: 4185473 - RNA, 110 nt, Human
gguguccucucugucacagguguccuuucucucacuagcugugugcagucaccaaaaacgcagccagugggaugagaaagaaggcccagaaccagacagacaggugcacc

SEQ ID NO: 4185474 - RNA, 85 nt, Human
gguguccugggagacagaagaccuggauuccaggcuuagcucugugcugggugcccuggguaggucaguuccccucccuggaccc

SEQ ID NO: 4185475 - RNA, 79 nt, Human
gguguccugggauucaugaaaagauucuuuccacaauuacugauuuguuaagaaaauuuauucauguuaguucuauacc

SEQ ID NO: 4185476 - RNA, 61 nt, Human
gguguccuuaugcauaccagaguguaagucuucauacauucugaugccauaaugaggacuc

SEQ ID NO: 4185477 - RNA, 64 nt, Human
ggugucguaaaagggccgcaguggcagcguccuggccgacggcuaguagcccauuuuggauacc

SEQ ID NO: 4185478 - RNA, 73 nt, Human
ggugucuaaagaagcagagcuguggguguuuggagaggcccaaucccaaaugccacuucagcuucaggcaacc

SEQ ID NO: 4185479 - RNA, 60 nt, Human
ggugucugauuccaaggccacacuccuccuauugcacaggugugcuuucaaccagacacu

SEQ ID NO: 4185480 - RNA, 77 nt, Human
ggugugagagaaucaauugaaguggaacugaagaacagccuucuagauaguaaacauguaauuguucauuucacauu

SEQ ID NO: 4185481 - RNA, 73 nt, Human
ggugugaggguuuuaagggaaugaaauaguaacauuaaauuugcaacaguuauucugcaaaaucuucaaaucc

SEQ ID NO: 4185482 - RNA, 86 nt, Human
ggugugcuuuaaugacuaagaccuaaaauugugaauauuuauacauaaacauuccaguuguaagguuuuucauaagaaaguugacu

SEQ ID NO: 4185483 - RNA, 56 nt, Human
gguguggcagggcgugacauuuggcccaggucagugucuggauccugcucaguucc

SEQ ID NO: 4185484 - RNA, 60 nt, Human
gguguggcaguggaccugugaagagggagaaucuagccuucagccuguccaguguuaacc

SEQ ID NO: 4185485 - RNA, 86 nt, Human
ggugugggauggcagcagcgggugugggcagcaacuauggugccagcaccugggcucagucugcaccugcggguucuaauugcacc

SEQ ID NO: 4185486 - RNA, 56 nt, Human
gguguggggagguucugcuucucugaguaguggagacaguggagcccacucacagc

SEQ ID NO: 4185487 - RNA, 74 nt, Human
gguguggggcaagggugggauuggaggaagcugccugggcaagcgagguccuccucacgcuguugcuugucacc

SEQ ID NO: 4185488 - RNA, 73 nt, Human
gguguggguaggagugcagagaauaaaucugggccuguuuuguucauuuguucaucugcucuucucuccuccc

SEQ ID NO: 4185489 - RNA, 77 nt, Human
ggugugggucagcuuuauuaauggaucuucaugguaagauggaaccagccagaaaugaugagguguugaacuauacc

SEQ ID NO: 4185490 - RNA, 60 nt, Human
gguguggguccuugugcuugcuuuuggcaaguuucugagcuacacagggccuccauuacc

SEQ ID NO: 4185491 - RNA, 82 nt, Human
ggugugguuaggguauuuguugaguuguuaugucuucuaucauaaguagacauggaaguuuaauauauuuuuuaaacacauc

SEQ ID NO: 4185492 - RNA, 97 nt, Human
ggugugugauuucugugaauuggcugagauuugaauaguaacuauggucauucaaaaauggcuguucacaucuggaccauuucucaaaauaagcauc

SEQ ID NO: 4185493 - RNA, 56 nt, Human
gguguguuuuagugacaucucucguucuugcuuuagauguuuuggagacacuaacc

SEQ ID NO: 4185494 - RNA, 103 nt, Human
gguguuaaauguaaugcaguggaccaagaguucaagagugaaccacuuuaauccugcuuccagagauggugugcucuguaaccuugggcaauauauuuaaccc

SEQ ID NO: 4185495 - RNA, 102 nt, Human
gugcuugauacaugguguacauugauguuuauugagugaaugagcaugaagccacaauuuuuaugacaguucuuuagagauguauuuuguacccacaggcac

SEQ ID NO: 4185496 - RNA, 63 nt, Human
gugcuugcuugaggcgagacauuuggaaugcuaguuuagaauguuuuauagcucaagcaauau

SEQ ID NO: 4185497 - RNA, 63 nt, Human
gugcuuggguuucaacagacagacaugagcccagaggcuuccuggcagggaacuugucagcac

SEQ ID NO: 4185498 - RNA, 112 nt, Human
gugcuuggugcuucuucuaauucuuugcugcccuccuuugcuucuccuaguucuugaagguauuaggaagggcaaaagagauggagaugauucagcaauuggaaccgagcac

SEQ ID NO: 4185499 - RNA, 111 nt, Human
gugcuuugggaugcaaaaauaaaucacacauggauucugcaucaguacuuuccauuccaguauaggaaugaagauacaggcagggccaugugaauaaaguccuaguuucac

SEQ ID NO: 4185500 - RNA, 63 nt, Human
gugcuuuuaucuaucagauugguuccugcuuagggaagcagcauguaugagggugaacggcac

SEQ ID NO: 4185501 - RNA, 130 nt, Human
guggaaaaauagcaacuuaguaugauggagagagagagcagacaggccuggguucaaauuugggcucucuaguuugucagguuugcaaccucgggcaaauucucuagcuucccugaacuugaauuucccc

SEQ ID NO: 4185502 - RNA, 89 nt, Human
guggaaaaucaugaaguagguucaggagauauugcacaguccacguggucaugggcugugcgggaagccagagcacugcuuuaugccac

SEQ ID NO: 4185503 - RNA, 65 nt, Human
guggaaacaccuuggucugauucagagcauuaccuuguaauggcacuaggaccagggguugccau

SEQ ID NO: 4185504 - RNA, 64 nt, Human
guggaaagagacuggaaacuagggucacauacuucucugugacagugagugccaguuuaccuac

SEQ ID NO: 4185505 - RNA, 66 nt, Human
guggaaaggggagggauauuagaggauagaugugacaguucuucugggaagcugguccuguucuau

SEQ ID NO: 4185506 - RNA, 79 nt, Human
guggaacaagcaagcacugcaugucuuucauucagaguucucugaggaaccaccuuggguaggcuuuuguuugucacac

SEQ ID NO: 4185507 - RNA, 61 nt, Human
guggaaggaauuaacagacuagaucucuuuucacucuggucuccucuuaauugccuacuac

SEQ ID NO: 4185508 - RNA, 56 nt, Human
guggaaggcauuuuccagccucagggccaugcuucugagagaacaaugccuccuau

SEQ ID NO: 4185509 - RNA, 65 nt, Human
guggaagucauguaguaguauuuuuguuugccuuuauggcuauuaugugauuauaugacuuuuac

SEQ ID NO: 4185510 - RNA, 86 nt, Human
guggaagugugggggugggaggaggacacucugcuucagccccuaggccuguuccauguguccuuguucccauuccagacacccac

SEQ ID NO: 4185511 - RNA, 67 nt, Human
guggaaugaaaaguacuucagaaugacugaagcuuacaauggcuaaaggaguucuaggccauuccac

SEQ ID NO: 4185512 - RNA, 70 nt, Human
guggaaugaauagauuugcauuggagguacacaacaaugccauuggugaugaagauauucacguuucuau

SEQ ID NO: 4185513 - RNA, 87 nt, Human
guggaaugaccaagccauaugguagguauauguuuaauguuuuaagaaaaugcugaacuguucuccagcauggcuguaccauuuuac

SEQ ID NO: 4185514 - RNA, 96 nt, Human
guggaaugucacccuuaccucaacuagagcaaacuccuggaguucugcaaguccaaggacauuguucuaguugccuacagggcccuggcaucucac

SEQ ID NO: 4185515 - RNA, 64 nt, Human
guggaauucaguccagugcuaacagguugagguuuccuuuacuacaagcuacuggucuuugcac

SEQ ID NO: 4185516 - RNA, 61 nt, Human
guggaauuuggagcuuuguuucuagaaacauuuucucaugacuagugcuccagccuuccau

SEQ ID NO: 4185517 - RNA, 74 nt, Human
guggacaaaaagacuuccaacucaggagggacuagaaggcauuucucugcuguguuagcagguuuaguguucac

SEQ ID NO: 4185518 - RNA, 77 nt, Human
guggacaaaacaggcaucacucagcaaagcugaaucaggaaagagcuuuccaggcugaguuugcuugcaguguccau

SEQ ID NO: 4185519 - RNA, 57 nt, Human
guggacacagggcaaccucugggagacugucaagggcuccuaugaugcucugcccac

SEQ ID NO: 4185520 - RNA, 67 nt, Human
guggacauaccgugccccaaugcggaaucgggguuccuggaggugcuggaguggcacuguguggcac

SEQ ID NO: 4185521 - RNA, 72 nt, Human
guggaccauacaaaaauaggugauuggcagaauuuggcuugccggcuguaguuuaccaaucccuugguuuac

SEQ ID NO: 4185522 - RNA, 60 nt, Human
guggaccugcguaggugcugggccgcgguucccguucugcccgcccggggcgcagggcgc

SEQ ID NO: 4185523 - RNA, 116 nt, Human
guggacgcagcauccuuuuuagguuaucaauguuucauauuucuuugaaacuuuggacaagcaauuuuugaaaggguuaugagacugaauaccagguacugaauucuuguuuccau

SEQ ID NO: 4185524 - RNA, 87 nt, Human
guggacugaacucugugaccccuccauugaaaaggcaaaacuguaucacuguguuuucaugcaagcaggcacugggaagcaguucgc

SEQ ID NO: 4185525 - RNA, 76 nt, Human
guggacuuggggaaggcacaguuaucucuuauaugaaucuccacaaaagcuuccuaacuggcuuuccucauuccac

SEQ ID NO: 4185526 - RNA, 73 nt, Human
guggagaagcucacaguaggacaccagcagccacggccaacagaagggcugccaauccagcugugggagccac

SEQ ID NO: 4185527 - RNA, 88 nt, Human
guggagaaggagaagagugggagggaggcuguagauagcuuguagguuugggcuguacaggguuauccuuucccauggccuuuuugau

SEQ ID NO: 4185528 - RNA, 83 nt, Human
guggagacuuacaggcuuacaggcugcaaguaucuaaucaucuuccaugcuuucauguuuguugccuuuagcaucacuuccau

SEQ ID NO: 4185529 - RNA, 96 nt, Human
guggagauaaguugggcagugaugagcucaggugugcaaaauaaaacuuacuuuauuucuacauuacugaggucaacucagcucauaagaucccau

SEQ ID NO: 4185530 - RNA, 73 nt, Human
guggagcagcaagcacucaaaggcucacuugggugggacuucuuagcagucuuuccugcuugacuguucuuac

SEQ ID NO: 4185531 - RNA, 63 nt, Human
guggagcauuagugaugcuagucagaaggugcggcuguuugauuacacaccacagugcuccau

SEQ ID NO: 4185532 - RNA, 74 nt, Human
guggagcugaaggggugggcucagcggccagaugggccgguucgauucugggcuccacuacuugcuaacuccac

SEQ ID NO: 4185533 - RNA, 98 nt, Human
guggaggauaguuacaugggugcuggguagcaaccaaaaaaugucaaguacugugcaccccuuuggcuacucaacauguacucauaccuaucuuccac

SEQ ID NO: 4185534 - RNA, 64 nt, Human
guggaggauucagcgaggcagccuggaugaucaagaaugauuuccucuccccgcugguucccau

SEQ ID NO: 4185535 - RNA, 99 nt, Human
guggagggauuaggaaaaggucauuuuuuccucuguuggugagaauguugucagcugcaggaacaaaaaugugucgucuuaccuaauaaaacuuucuac

SEQ ID NO: 4185536 - RNA, 80 nt, Human
guggagggcccaguccagggagcccaggcuuuggggagcaguuucaagccugugcaggccccuggcucgggugcccccgc

SEQ ID NO: 4185537 - RNA, 57 nt, Human
guggaggguguagugcuguggcucggccccgccgcgcacagcuccgcuuccucacac

SEQ ID NO: 4185538 - RNA, 118 nt, Human
guggagguaauauuggagcaguggauuauucucagugcuauaaguagagaagccacuuaaaagucauucugccuuagcaauugucaagggugauucuguuccauuguuacuguuccac

SEQ ID NO: 4185539 - RNA, 63 nt, Human
guggaggucccgggcaggagcagacaaagccccucguaggcagcaccaggccuggcucuccac

SEQ ID NO: 4185540 - RNA, 58 nt, Human
guggagucauacagaacaagacuguuucuuccuaacagugcuucugauaugaugccau

SEQ ID NO: 4185541 - RNA, 55 nt, Human
guggagugccucgggguugcagggucaggcaauccagcugcccagagcauuucau

SEQ ID NO: 4185542 - RNA, 59 nt, Human
guggaguggguuguacucagggaguguaguuggaagcacuugccuggcaccagcuccac

SEQ ID NO: 4185543 - RNA, 83 nt, Human
guggaucaaaaauuugaauaggacucagcagugaucaucugucugugaucugugauggucuugaucaucaagauuugauccau

SEQ ID NO: 4185544 - RNA, 74 nt, Human
guggauccugggguggugaccucgucccaaauggucagggacaaccagggaggcuuuacugccucaggacucac

SEQ ID NO: 4185545 - RNA, 63 nt, Human
guggaucuacuguaugggauaggaaugugucauuuuuuucuaucaacaaacacagggauucau

SEQ ID NO: 4185546 - RNA, 67 nt, Human
guggaugccuggucccaccucuagguaucuagauucaguaaaucuggagugggacacagaaaucugc

SEQ ID NO: 4185547 - RNA, 71 nt, Human
guggauggcuaguugagaagggccacagacaaucuccuguacuacugaacucuuccuagccagcucuccau

SEQ ID NO: 4185548 - RNA, 129 nt, Human
guggauguguagacuacauagugguuuuuucaacccaggaacauaacaguauaauggaggauaggaaggcagaagauguuuaaaggguugagaaauaaugguauauguauaauggucaguaagcagaac

SEQ ID NO: 4185549 - RNA, 70 nt, Human
guggauuauuguacuuucaauaagguuagaacaucuuugauuguagguacaauguuuuacccuuguccau

SEQ ID NO: 4185550 - RNA, 56 nt, Human
guggauugaagcaauuguuccuagcugccaugcaguggagaugccucucaguccau

SEQ ID NO: 4185551 - RNA, 115 nt, Human
guggauuugggucuaugucguacuaccucaaaacgucuccagucucuggcuguuugugacuucccaggagcucaugaaaauagaucagaaauuguagaacauuagacugagccac

SEQ ID NO: 4185552 - RNA, 63 nt, Human
guggauuuuaaaaguagagaugaucauuauuauuuuaugauccuuuaaguuaauaaaauucac

SEQ ID NO: 4185553 - RNA, 59 nt, Human
guggcaaaaccccaucucuucuaaaaauacaaaaauuagcugagugcgguggugcacac

SEQ ID NO: 4185554 - RNA, 93 nt, Human
guggcaagaaguaaacaaagacauuuaugaaaagugcugugugccuggcacagaauagacgcuccaaaaaugucucuuugcuguuuuagucau

SEQ ID NO: 4185555 - RNA, 59 nt, Human
guggcaagcuguuggcagauagcucugcagaaauaccagggccaggcagcagcugucac

SEQ ID NO: 4185556 - RNA, 56 nt, Human
guggcaaguguuccaagaggcgauuuauucuuucugcugauggacacacuugccau

SEQ ID NO: 4185557 - RNA, 58 nt, Human
guggcaauucccuuggucaacagaggguaagaaugcuaccuagauuauggaaugcugc

SEQ ID NO: 4185558 - RNA, 62 nt, Human
guggcacauggugcuucuggauguggguucauauuugcagcuagagggaugcugugugaaac

SEQ ID NO: 4185559 - RNA, 56 nt, Human
guggcagaaacuggcagaggaggaugcuggcagcaccaccgggcuuguuucuccac

SEQ ID NO: 4185560 - RNA, 90 nt, Human
gucuuagauugaucuucuaaacuuuguuuauacucugaguuaucuuugaguagauuagggaagagcaaagcuuacaaagguagcuaagau

SEQ ID NO: 4185561 - RNA, 60 nt, Human
gucuuauagcucaaaggaagaguucacauuuaauggaagcucuucuucaggcucaaggau

SEQ ID NO: 4185562 - RNA, 55 nt, Human
gucuuauucugaguuggccacccagaaagcuggaccuggcaggcccaggauggac

SEQ ID NO: 4185563 - RNA, 70 nt, Human
gucuuauucuguguaucuccaaaggcacucauuguuagagucugggagugaagcaacagauggaugagau

SEQ ID NO: 4185564 - RNA, 128 nt, Human
gucuuauuugcauggcagggcuggaggcuacacugugacuuggcauucaugggacaacaaaaugaccagucauucuguguuccauggaggccagucagagcagguuccuugguggugugcucagggac

SEQ ID NO: 4185565 - RNA, 58 nt, Human
gucuuauuuuaagucaguuuggguuagggaaagcuggccauugaugugaaaguaagac

SEQ ID NO: 4185566 - RNA, 60 nt, Human
gucuucaacaauaacuaccacuuuguuguccucgaagugacaagguaguuaguuggaugc

SEQ ID NO: 4185567 - RNA, 74 nt, Human
gucuucagaaugcuauuucugaaaugcuaccuuugaguugguucagcccucauuugagaaaguauuuuuaagac

SEQ ID NO: 4185568 - RNA, 78 nt, Human
gucuuccaaaguggcuguacuauuuuuucauuccuaucagcaaugaaugagacuuccugguacugucaguuuggggau

SEQ ID NO: 4185569 - RNA, 78 nt, Human
gucuuccacuuuucuacccacugugacaaugaucuucccaggauucuaagucaacccggugagguaagcaggggagac

SEQ ID NO: 4185570 - RNA, 74 nt, Human
gucuucccuguugaaaaccuuuauuugguacuauucuacaaaggguaauagcaaacaaaagguacaucgaggau

SEQ ID NO: 4185571 - RNA, 55 nt, Human
gucuuccuuucaccucugcgaagaaugccuugaguucguccaggugcuggaagau

SEQ ID NO: 4185572 - RNA, 67 nt, Human
gucuucgucagguguggguguuuggugccugcauggguggccuugcacagagcaguuaggggaagau

SEQ ID NO: 4185573 - RNA, 70 nt, Human
gucuucucuggagaccucuccugagagugcugucuccaugugcacuuacacaagagucuccaucucaggc

SEQ ID NO: 4185574 - RNA, 66 nt, Human
gucuucuggaagagagccagcuaaugaauuaccagaugaacagcuuuuggcucacuuaucaaggac

SEQ ID NO: 4185575 - RNA, 94 nt, Human
gucuucuguguacuugcuuccaaaugcuuucuuucauauaaccauauaucagguuaagauauaaaguguuuugugagcagucuggauggaagau

SEQ ID NO: 4185576 - RNA, 58 nt, Human
gucuucuuaggccuugaguguuaauaagucauuucuacacuccagguggcaugaggac

SEQ ID NO: 4185577 - RNA, 62 nt, Human
gucuugaaagggagcauggcugcagggaauuaacaaaaauccaugcaucuccuuuuagagac

SEQ ID NO: 4185578 - RNA, 75 nt, Human
gucuugaacuccugaccuugugauccacccgccuuggccucccaaagugcugggauuacaagcgugaggcacggc

SEQ ID NO: 4185579 - RNA, 130 nt, Human
gucuugaagacuuucuaacuagaauuagaauugaugaguuuugggggauguuagauaagguauguuugguuuauaucucuaauacugcuguaauuuaaacacuaagauguagcaaugaaguugccaagau

SEQ ID NO: 4185580 - RNA, 57 nt, Human
gucuugaaucucucugagauucaguuucuuuagcugugaaacggagacgaucaugac

SEQ ID NO: 4185581 - RNA, 65 nt, Human
gucuugacuuugaugaagcuggaucuaaauuacaaauuugagaaucagcugcacagagguaagau

SEQ ID NO: 4185582 - RNA, 58 nt, Human
gucuugauaucucauggucuuacuugcaaaggcuacaguguuccaugacuauuuggau

SEQ ID NO: 4185583 - RNA, 61 nt, Human
gucuugcaaaguagcugagagguucuaaccaaaaggaugaaugucaaagugcuuugcaaac

SEQ ID NO: 4185584 - RNA, 58 nt, Human
gucuugccccucugcccaguccucagagcacugggagccaggcauaucggggcacgau

SEQ ID NO: 4185585 - RNA, 130 nt, Human
gucuugccuuauguuuucaacauaaugggaauguuuucuacggagaaaaauguuuucaauauuucccuccagggaaagcuuacaguucuccaacaugaucuaugacucaacagguaagucuaacuaauuc

SEQ ID NO: 4185586 - RNA, 72 nt, Human
gucuugccuucacugcacuugaggauuuuccacagccaugcauggggauguucucguguaagagggucagac

SEQ ID NO: 4185587 - RNA, 85 nt, Human
gucuugcucacaaaacuauuuuuggagcuaacucucuuauagaaaaucaucaaaaaggguuuuauccaaaauguuucaguaggau

SEQ ID NO: 4185588 - RNA, 102 nt, Human
gucuuggagacacagaacacauuggaggggcagaaagcaggagguggcaggugauaggccuccuauugcugccauuuuccaauguaaaucuuugcucgagac

SEQ ID NO: 4185589 - RNA, 65 nt, Human
gucuuggccagucagagucacaguaauuuguucaagggaauauacuaugcuucugauccaaugac

SEQ ID NO: 4185590 - RNA, 83 nt, Human
gucuuggugcagugaugaagucaguuagugggaaaacgggauuugguuucgcaacuuuuccagagcugucucuugcauaagau

SEQ ID NO: 4185591 - RNA, 68 nt, Human
gucuugguuuuaugaagguaacuggcauuggcagagcugcuggcugccugccugcauagucccacgac

SEQ ID NO: 4185592 - RNA, 59 nt, Human
gucuuguaauuuagcuuugaggcuucuaccugagaugaccacagaacaaauugcaggac

SEQ ID NO: 4185593 - RNA, 69 nt, Human
gucuugucuacggcugguuuuguucuauaauggcagaauugaagagauaugaguaguugugacagagac

SEQ ID NO: 4185594 - RNA, 59 nt, Human
gucuuuacucgugacaauguccuugaguugauuuuucucagaacauguuugaguaagac

SEQ ID NO: 4185595 - RNA, 125 nt, Human
gucuuuagcuaaggcuuagcagaaaagccuucuccuauggggagaacuuucugugagguuccauauggucccugcugacucuuccuggagugaagaaggcuuuuccaagccccuugauggaagac

SEQ ID NO: 4185596 - RNA, 71 nt, Human
gucuuuauuacaaauccuuuucauaacccacaaaggaugugguucagaaagaugguguaauaaugugagac

SEQ ID NO: 4185597 - RNA, 97 nt, Human
gucuuucaaauuauugaauuaaaguagaggagaacacaaauuauagguugucuuggugugugaguuuucucuuguuauucauuaaucugauuaugac

SEQ ID NO: 4185598 - RNA, 68 nt, Human
gucuuucauaauucagcacauugaaccaauuacuuugccaauuggcucaccucugaagugugaaaguc

SEQ ID NO: 4185599 - RNA, 56 nt, Human
gucuuucugccaugugaagagacaaagggaaguuggcucuuugcaaugcagaagac

SEQ ID NO: 4185600 - RNA, 60 nt, Human
gucuuugagauagguauuaucauccccuuucuauaaauggugaaauagauacucagagau

SEQ ID NO: 4185601 - RNA, 65 nt, Human
gucuuugcaaaugcucugcagagcuggcccuucucgcaggagugguguggauuauuugcaaaaac

SEQ ID NO: 4185602 - RNA, 72 nt, Human
gucuuuguaacugucuauugagacagacaauuuacauauguuaagucuccguagauaguaaaugcaaacgac

SEQ ID NO: 4185603 - RNA, 79 nt, Human
gucuuuguaugcucauauacuggauguuugcuuuuugcaagacaccauuugacaguggcagugggcaugguacaaagac

SEQ ID NO: 4185604 - RNA, 74 nt, Human
gucuuugucuuuguguuguugguguauuugccucuuuuccugugccagauacaaagcuacucgagggcagggau

SEQ ID NO: 4185605 - RNA, 86 nt, Human
gucuuuugccaggacaucuacauguugauuuaaagaaguagauuaggcuucugcuuugaguuaggauguagaauaaugcaaaagac

SEQ ID NO: 4185606 - RNA, 78 nt, Human
gugaaaaaguagacugcucagaguaaguauggaggaucauacuucugcauacacugaauguaguuguuucuuuuccac

SEQ ID NO: 4185607 - RNA, 96 nt, Human
gugaaaagaaguuuccuguuuuguauuuagaguguuuuaauucgaucuuaaagcauuuaagcuucugcaaagcauuaauuuuggcauucuuuucau

SEQ ID NO: 4185608 - RNA, 103 nt, Human
gugaaaaguaugguaauggacucagaucucaacagcuggagucauugaucaguuaugcuccccacagcagaagaucugagagcaacauuuucauugcugccac

SEQ ID NO: 4185609 - RNA, 59 nt, Human
gugaaaauuuaugggaguuuuucauucuacucaaugagagauugcuguauguuuugcac

SEQ ID NO: 4185610 - RNA, 72 nt, Human
gugaaacaggcccagugaggauuaagguaaaccugagcggguugcccugucuuaagcuggcaaauguuucac

SEQ ID NO: 4185611 - RNA, 89 nt, Human
gugaaacaucgggauugguggugguugccaaauguaggaaauacguugaugauacguggacagauaggaaaucgcuauuaaccuaacac

SEQ ID NO: 4185612 - RNA, 82 nt, Human
gugaaagggcauugagcuguagugcuuugggauuagauagauuugcucuucaauccaguuucugucagcuacucucuguuac

SEQ ID NO: 4185613 - RNA, 83 nt, Human
gugaaagguuuacaggaggcaguggguguugucuagaaggaaauccagaacugcuucacuguuucugagacugaacuuuuuac

SEQ ID NO: 4185614 - RNA, 117 nt, Human
gugaaaguauaugcaucaaaaauuaacagcaguuaugaguagaauaguugagagcuuccaaaauauauauugcuuuugcuugcugaugugcuuguuuacauuauguuuugcuuuuau

SEQ ID NO: 4185615 - RNA, 72 nt, Human
gugaaauacacuggacaucauugcauuuugauagaagggucugaguuuuugaugaagucuaguguacuuuac

SEQ ID NO: 4185616 - RNA, 82 nt, Human
gugaaauuuaggcccagaaauguuagaagguguuguaaauucugugacuacacuccaauuuucuagguugcugaccuuucac

SEQ ID NO: 4185617 - RNA, 90 nt, Human
gugaaauuucuuuugauuaaaacaggugucagcaaacuauggcucaugggccaaagcugcccagcugccuguuuuuggaauaagcuuuau

SEQ ID NO: 4185618 - RNA, 59 nt, Human
gugaacaaggagacuacaacuucagcaagaaagaucauggagaugcagucaauguucac

SEQ ID NO: 4185619 - RNA, 129 nt, Human
gugaacauuauaugauuuuuaguauauugagucagaaacuagauguauuagagauucauguuaaauaugauacaaaucugauaaaacauaaaguuuccuuaagaugcuuaucauucaucaccuaaaaac

SEQ ID NO: 4185620 - RNA, 81 nt, Human
gugaacauuuguucucuuggcuauaauuuguaaauagguggaagggaagcugcuuguuaaaauuggagccgagagauucgc

SEQ ID NO: 4185621 - RNA, 77 nt, Human
gugaagaaagucauugguagcuugauagggauggcauugaaucucuaaauuacuuugggcaguauggccauuuucac

SEQ ID NO: 4185622 - RNA, 83 nt, Human
gugaagaaauccaguggugagguggggcuucagggacguaucguccaguugcucuggcuccauuucccuauguuugucuuuac

SEQ ID NO: 4185623 - RNA, 108 nt, Human
gugaagaacgcugggucuggaaucagaagccucaggucuuaguucugucaucaacuauuuugcgaccuuggacaaaagacuugaucacucacagucccaguuucccac

SEQ ID NO: 4185624 - RNA, 78 nt, Human
gugaagacuuugauuguuagagaucucuuuccuguggcuguuaugguuacagagggcuucucugaacuucagucucau

SEQ ID NO: 4185625 - RNA, 66 nt, Human
gugaagaucaggguccuagaguaacuuaauauuuuguacauugguuauuugacuccucauuuuuau

SEQ ID NO: 4185626 - RNA, 64 nt, Human
gugaagauuuaagcacaauagucuggauccagaucuccagagauaugcugccuaaauuuauaac

SEQ ID NO: 4185627 - RNA, 60 nt, Human
gugaagcaguugcguggguuccagugacagagauccuggguuucauuuguaucugcucac

SEQ ID NO: 4185628 - RNA, 113 nt, Human
gguuggagauuaagagguggcaaauuuacuuuaagacauaccaaguugugugauuuaucacacaaaccuggauucuuaugagugugaaaagugccacugucaauaauuuugcc

SEQ ID NO: 4185629 - RNA, 101 nt, Human
gguuggagucuaagcugguuuccucuauuccugucuuacucaagggaaauuccuaccccuggccaagacagaaauaggagaaaccagcuuaaaauccaucc

SEQ ID NO: 4185630 - RNA, 66 nt, Human
gguuggauuuccuaauggugccuuagucauucauacacauuauucuggggccaaaggguuccaauc

SEQ ID NO: 4185631 - RNA, 58 nt, Human
gguuggcaagaaaugaggagagcugagacuggcuuggaaucccucagucugccaggcc

SEQ ID NO: 4185632 - RNA, 65 nt, Human
gguuggcacaaaaguaauugccauuccuuuuaauggcaaacaccccaauugcuuuuguaccaacc

SEQ ID NO: 4185633 - RNA, 60 nt, Human
gguuggccaggcuggugucacaacucuugaccucaagugaucuaccacccuuggccuccc

SEQ ID NO: 4185634 - RNA, 69 nt, Human
gguuggccucaggagguuuccugucuaggcugggucuuguccuugcgcuggcuuccuccuggggccacu

SEQ ID NO: 4185635 - RNA, 65 nt, Human
gguuggcucccggcacuuggcaugucaugguucuaucaugcuaauuccauaugccggagcucauu

SEQ ID NO: 4185636 - RNA, 112 nt, Human
gguugggccucuagaucuaaugaagauaagcaaaugcguuuagaggaaacaugucaccacaugcaucuccaggcucauuucaugcccccucuuucuagaucuuggucccucu

SEQ ID NO: 4185637 - RNA, 62 nt, Human
gguugggggcagucagggugucagagaagcucgagggcgguccucugggcugcacccucgcc

SEQ ID NO: 4185638 - RNA, 65 nt, Human
gguuggugagugagugcguuccugaggcuuagcugggcaaaggaaaacgucucagcuugcugacu

SEQ ID NO: 4185639 - RNA, 98 nt, Human
gguugguggguaacucagggcaggaagggcuguuucuccaagagguccuccuggagccaggacccuuccccgcccugcccagucauucccacccugcu

SEQ ID NO: 4185640 - RNA, 88 nt, Human
gguuguaaauuacccuuuuaauucucuccucuucagaggucuccagacugagccucucuuggggaaagagaagaauguggcaugcacc

SEQ ID NO: 4185641 - RNA, 63 nt, Human
gguugugacauggguagcagggacauaugucuagugacauagauuugcuaugcauaucugacc

SEQ ID NO: 4185642 - RNA, 60 nt, Human
gguugugcaugacugugaauagcugugaauaugcaugguugcacauggcugugcauggcu

SEQ ID NO: 4185643 - RNA, 71 nt, Human
gguugugcuucaccagcugccaagggcuacacugacucuggucgagugcuccugaagcuugaggcaucacc

SEQ ID NO: 4185644 - RNA, 75 nt, Human
gguuguggacucaccuugaguuagccaccgucgguguuuucagacacagucccuggccucaagaaguucaaaacc

SEQ ID NO: 4185645 - RNA, 101 nt, Human
gguugugugacaaggaccugguuuuagcugaacuaaggagcaaaguucucaacaccuuugccuccugaguagcugggauugcaggcuuaugucacuauacc

SEQ ID NO: 4185646 - RNA, 109 nt, Human
gguugugugggagccaucaauguaaggacauuagaaaugaugcuagccagcuuuccuggggcauuacuaggugcuuacccugggccaaugcucugaagugcacaggacc

SEQ ID NO: 4185647 - RNA, 62 nt, Human
gguuguuacuaaaauaaugcacauuguucgcuucaaaagugccuucuauuuuagugacaguc

SEQ ID NO: 4185648 - RNA, 58 nt, Human
gguuguucuguccuuggaccacagucaccagcacugacagugccagccacaggacgcc

SEQ ID NO: 4185649 - RNA, 67 nt, Human
gguuuaaaauuucauuucugugggcagguucuuaaagucucuguauauauuaaugaaauucuaaacc

SEQ ID NO: 4185650 - RNA, 62 nt, Human
gguuuaaagcaaccaucaauuuggaaguugcuuuugaagcuccuuauaguugucuuugaacc

SEQ ID NO: 4185651 - RNA, 130 nt, Human
gguuuaacauguaugcaucauaaaaggcugcuguaauguguuaagucacuuaaaucaaguaguauaagaauuucuuggcuggcugacaauguagcaguaaccucuguaugagaaaaauauuucccuugcc

SEQ ID NO: 4185652 - RNA, 80 nt, Human
gguuuaaccugggaagcagcugagcuucaggaauggggggcugggcccagagucuggaguugaaguucuucccccagacc

SEQ ID NO: 4185653 - RNA, 72 nt, Human
gguuuacacugaaagagaggauugaagggcaaaugaggaaccauuuaggaauauuuucuuucagguuugauc

SEQ ID NO: 4185654 - RNA, 58 nt, Human
gguuuaccugauacaggugaugauuuuaaugaucauacagccuuuguuaguguauccc

SEQ ID NO: 4185655 - RNA, 99 nt, Human
gguuuaggaagaaguuauaucuucuuuauuuugugaggugcuuagaaauaaauauuugaugaugaugauaaaguuuccauaggauuucuucucuacucc

SEQ ID NO: 4185656 - RNA, 66 nt, Human
gguuuaguggucuggcucaggagcuagccuuuugugguucaucuccuggcucugccacuuacuacc

SEQ ID NO: 4185657 - RNA, 85 nt, Human
gguuuaguuuaauaauaauguuguaagaguguaaguaccaguagcuucauguacauucuacaacccaauaauaauuaugcugacc

SEQ ID NO: 4185658 - RNA, 74 nt, Human
gguuuauacaguuggugaugaggcuaguaggggguuauucaacucuccugugguuugcacuaauuguauugauc

SEQ ID NO: 4185659 - RNA, 84 nt, Human
gguuuauagucucuccacauuguuauaaaggaauguaauagaucauguuuccuuauaugacauugggacaguuuguuaggaacc

SEQ ID NO: 4185660 - RNA, 66 nt, Human
gguuuauaguugcuaggauguguuuauuaaccuuuguuaauuucaaauuucuuagcgugcugugcu

SEQ ID NO: 4185661 - RNA, 91 nt, Human
gguuuaucaaagaucagauaguuguagauauguggcauuauuucugagggcucuguucuguuccauuggucuauaucucuguuuugguacc

SEQ ID NO: 4185662 - RNA, 77 nt, Human
gguuuauggaaaggcuguggaaacuuaacgcuaucaucacaguauguuaagaaugacaaccauaccauuuccaugcc

SEQ ID NO: 4185663 - RNA, 63 nt, Human
gguuuauguagggcauuuccuagagggcauccucuuuaggaaauacuguccuaugaaaggacc

SEQ ID NO: 4185664 - RNA, 93 nt, Human
gguuuauugggcucaagaguucugcaggcuacacaggaagcauggcgcuggcaucugcucggcuucuggugaggccucaggaaguuuacaacc

SEQ ID NO: 4185665 - RNA, 63 nt, Human
gguuucaacucagcuaguaaggacuguccucuuaacagaacuuugccaauagccaguuaagcc

SEQ ID NO: 4185666 - RNA, 62 nt, Human
gguuucacaacucagcaaggagagcuauucucuaaauaaguucacuuucuguaguggaagcc

SEQ ID NO: 4185667 - RNA, 93 nt, Human
gguuucaccagguggcacgcaaugucaacuuaucucuuuaucuguggguucacguucaugauuugauuaggaugaugugcgccuggucucacc

SEQ ID NO: 4185668 - RNA, 64 nt, Human
gguuucaggccccagagccagggcuuucugacagaugcaucaccuggcugaggggccaaggacc

SEQ ID NO: 4185669 - RNA, 57 nt, Human
gguuucaguucagaagucaagaguaacagcuaaugcuuuuacuucaggagugaaauu

SEQ ID NO: 4185670 - RNA, 57 nt, Human
gguuuccuaugaauaaauauugagcuauaacacuagcuauagaauuucauagagacc

SEQ ID NO: 4185671 - RNA, 127 nt, Human
gguuucucccugaguugccuacugguguaucucuggugucucuaucuaugccugaaguuacucaauaaauacauuuuuuauggguggggauaacugauucuuacaacaguccuauaagguagaugcu

SEQ ID NO: 4185672 - RNA, 82 nt, Human
gguuucugcaucuucuccuaaggucagaauugccacuagccuauguggcacauuugcacacauuagaagacggugcauuucc

SEQ ID NO: 4185673 - RNA, 62 nt, Human
gguuucugccaaagaaguaaauggaaucuccaaauuccauuauuuccauggccaguuugacu

SEQ ID NO: 4185674 - RNA, 67 nt, Human
gguuugaacagcuuuggagaagucugguucuaguugguuucaguucucuccagaugccguuugaauc

SEQ ID NO: 4185675 - RNA, 67 nt, Human
gguuugaauaaaccuguguuuaccgccaucuguuuccuuggugguuucacagaugguguucauaucc

SEQ ID NO: 4185676 - RNA, 63 nt, Human
gguuugaccaagaaaaguucuaaaauuuuauccuugaaugucuucagaacacuugguuagauc

SEQ ID NO: 4185677 - RNA, 76 nt, Human
gguuugacuguccuacccauuugucugcuggucauuuagggugacaggcaggacagagguguguggagucgauacc

SEQ ID NO: 4185678 - RNA, 57 nt, Human
gguuugauuccugcuucugugcucacagcaugugaccugaggcaaggaguuuaagcc

SEQ ID NO: 4185679 - RNA, 93 nt, Human
gguuugcaaccuaggcugggccaguuaugucucaucucaguguccaaaguggcagauucaagagaagggacauaucuucaagccaggcaaauc

SEQ ID NO: 4185680 - RNA, 74 nt, Human
gguuugcauuaacucaacauucuccuaguuucaccauuucaagaacugaagaacugaaaguugaugcacagucc

SEQ ID NO: 4185681 - RNA, 56 nt, Human
gguuugccaggaagcacagaauaauggaguucaguguuacucaaggggcagucacc

SEQ ID NO: 4185682 - RNA, 76 nt, Human
gguuugccagggcaggagguggaagggagccccauuuacagugguaacuuccuuucccuuuccauccuggcaggcu

SEQ ID NO: 4185683 - RNA, 67 nt, Human
gguuugcuuugggagguugucugggagauugcugaacuuuugauauacacaccuccaaagcaggacc

SEQ ID NO: 4185684 - RNA, 67 nt, Human
gguuugcuuugggagguugucugggagauugcugaaguuuugauauacacaccuccaaagcaggacc

SEQ ID NO: 4185685 - RNA, 58 nt, Human
gguuugggagguuugauuuggacacaaucugagaggagccaggacagacuucaaagcc

SEQ ID NO: 4185686 - RNA, 57 nt, Human
gguuuggugaauuggaaauuguggcuauuaacuaauauuuaccaacucaccaguauc

SEQ ID NO: 4185687 - RNA, 88 nt, Human
gguuuguauguaugacugaaggacuagauugauuaauacuuaauaguugguaagcauuuauuuccugcaguuauuuaaaugugcuucc

SEQ ID NO: 4185688 - RNA, 90 nt, Human
gguuugucccggccccuguuggagucauuccuuccaggccugaaggcuguggacugaaagaaccggcaguuaggggcgguuagaaaaacu

SEQ ID NO: 4185689 - RNA, 75 nt, Human
gguuuguccuggaucaugccucugaauuuagucucugauuuuuauccaggggugauuuuugacuuguauaaaacc

SEQ ID NO: 4185690 - RNA, 99 nt, Human
gguuuguggcuucacuguuccuguagggugcaugacaagaucccuucucuugaggaaggacaaaauugaucacccuagcagcagugaugcauagaaacc

SEQ ID NO: 4185691 - RNA, 116 nt, Human
gguuuguuucuggggcucguuuucauucagcccaucagcuuucuaugauuguaaauggaggaaucgggggacaguguggggugagauggaacuagcaccagucuuggagacagacu

SEQ ID NO: 4185692 - RNA, 102 nt, Human
gguuuuaaaaguuguauagucaugaauggacacuuuuuaauaccaucuaugagaaauucaauggcaaaguguuuucauacccauaugcuaacugcugaugcu

SEQ ID NO: 4185693 - RNA, 77 nt, Human
gguuuuaaggcgugugguuuuugcuguuguuguuuuuucaauuagcagcauuaauuccauuugcaaccuuaauugcc

SEQ ID NO: 4185694 - RNA, 76 nt, Human
gguuuuacaaggauauuauuauuuucuuucagagugcuaagcuauucuuaaaggcacauagugucuaugauaaauc

SEQ ID NO: 4185695 - RNA, 80 nt, Human
gguuuucaagucuguuccaugucuugcucugauugcucauaaguggugcaauccagcacauggacacagucuuccagacc

SEQ ID NO: 4185696 - RNA, 104 nt, Human
guggcagaaaugcaacggccucacuccuggacagauccccaucauccaacaggguggguguagaagcugccagccugugguaggagccagcauucacuucccac

SEQ ID NO: 4185697 - RNA, 62 nt, Human
guggcagagggugagcuggacuaggaauuagcagaccuggguuccaguuccagcuuugccac

SEQ ID NO: 4185698 - RNA, 58 nt, Human
guggcagagugcgguucugacccugcuuguccuagucuuugagcugcuauucugcuac

SEQ ID NO: 4185699 - RNA, 58 nt, Human
guggcagcagguacucacgcacguccagcucuggggugcaggugccaucgcugcucau

SEQ ID NO: 4185700 - RNA, 68 nt, Human
guggcagccaugagaauauaacacucagaucuccagaugugugaaguuacuacuucuuaugcuaucac

SEQ ID NO: 4185701 - RNA, 65 nt, Human
guggcagccucagguuccgguguaucuuccagcacuuagaaggaacacaacuuccugagagccac

SEQ ID NO: 4185702 - RNA, 98 nt, Human
guggcagcuuggagacuguaggugggaggaaaaggaauugccaguucaguaaacuuugucaaugcauuauucucccacuucagacuuccgagggccac

SEQ ID NO: 4185703 - RNA, 57 nt, Human
guggcaggauuacagucaugagccacugcauccagcucauguguaacuuuugaccac

SEQ ID NO: 4185704 - RNA, 67 nt, Human
guggcaggauugggcugaaggagugggauggagcauucugugcuauucuguuaaccgaaccuuucau

SEQ ID NO: 4185705 - RNA, 57 nt, Human
guggcagucucaucuguggcucuccuugggacugggacacucaaugagaccugcagc

SEQ ID NO: 4185706 - RNA, 79 nt, Human
guggcaguugauuggaagaggaaggagacucuuggggaucacaguuuaacucccuucuuucccuuccagcagcucccac

SEQ ID NO: 4185707 - RNA, 62 nt, Human
guggcauccagauacccugagggcguguaacacuccaacuuuccccauaugucuggagcuau

SEQ ID NO: 4185708 - RNA, 88 nt, Human
guggcaugauugagggcccuggcuucuugcuggcuguuggcuggagucuacucucaguuccuagaggccacucucagcuccuugccau

SEQ ID NO: 4185709 - RNA, 76 nt, Human
guggcauugccuucugcaggaagcccuccccgagcugcaaaacccucuccgcucucacugcacuagguaaugccac

SEQ ID NO: 4185710 - RNA, 68 nt, Human
guggccaaaucaugucaaaggcacacacuuccaaaggaguccuuccuguugacguugaccuuggccac

SEQ ID NO: 4185711 - RNA, 69 nt, Human
guggccacccucggcacacacagauuuccagagggcacccaggcccugugucugcugaaggcuggucac

SEQ ID NO: 4185712 - RNA, 60 nt, Human
guggccagaggucccauguguccacaugcugcaugucccacacugaggaaccucugccac

SEQ ID NO: 4185713 - RNA, 75 nt, Human
guggccagccagagagagucccugggccuggaggccagauggcagccaggaaugcagggcucucccuggggcugc

SEQ ID NO: 4185714 - RNA, 57 nt, Human
guggccaggagaccuugggcauuccaccccccuaccaugccaagauucccucuccac

SEQ ID NO: 4185715 - RNA, 71 nt, Human
guggccaguuacagagccaguuagagaaacugcccaguuuccucuugaauugguaucuuugacuaggcugc

SEQ ID NO: 4185716 - RNA, 56 nt, Human
guggccaugugcuugcaggguaucgcauagcccggaugcccaugccccuuggccac

SEQ ID NO: 4185717 - RNA, 66 nt, Human
guggccccagcaucagcacccaaggagcagcccaaaaugggcugggagggguuauuuugggguugc

SEQ ID NO: 4185718 - RNA, 64 nt, Human
guggcccugccgugggugucauggcccauaggagaugcuuugggcccagcacccacagccccuc

SEQ ID NO: 4185719 - RNA, 69 nt, Human
guggcccugcugacccaguccaggcagggugugacaggucugcccagcccugaggucacagcugucugc

SEQ ID NO: 4185720 - RNA, 56 nt, Human
guggccggccuguuugcacucacagcauagcacuuagugcagccaagcugagccgc

SEQ ID NO: 4185721 - RNA, 79 nt, Human
guggccuaaggagguagccaggccuggaggacugaguguagcgaguggagaccucaggcugggcugccccuggggccac

SEQ ID NO: 4185722 - RNA, 108 nt, Human
guggccucaagaggauuaauuauaaaaugauuuaaguuaaccugacaugcugaaggguccuguaacuuugcccuuuauaugguugacuaugaguuacuugaaggcuau

SEQ ID NO: 4185723 - RNA, 89 nt, Human
guggccuggaagcucaaacuggguggaguccaccacagcucaaagaggccugcuugccucuguagacuccaccuuugagggcagggcau

SEQ ID NO: 4185724 - RNA, 56 nt, Human
guggccuuaagaaacaaacaacaacaacaaaaguaauguguguuuaaagaggccau

SEQ ID NO: 4185725 - RNA, 58 nt, Human
guggccuuuccugaagaaaugagggaugcuuuucucucacaacuucauggcaggccac

SEQ ID NO: 4185726 - RNA, 55 nt, Human
guggccuuuguccaggcgaaacucaaaccagguaccuggacuaaaaccaggccac

SEQ ID NO: 4185727 - RNA, 83 nt, Human
guggcgagaucuuugggaggucauaaaucuguucuugacaugaauacaaagggcuugauugaugacuccucagauuaacauac

SEQ ID NO: 4185728 - RNA, 60 nt, Human
guggcgcagaggguggcagagagguccccggugccaucacuguuaucucacucuggcugc

SEQ ID NO: 4185729 - RNA, 70 nt, Human
guggcggugucauuucuacgguuggcuuuucuugcuacagguugggccaagguggagaaggcacugguau

SEQ ID NO: 4185730 - RNA, 118 nt, Human
guggcgguuuccaaagugcgggggacaagguguggcaugcagggagugcuccuauuaucgugauuauugugguuuuuccugcaucuuuuccugcccuuuccucccauccuacucccac

SEQ ID NO: 4185731 - RNA, 106 nt, Human
guggcgugcccggcuucucuccuuggccaccuccaugaucuccuggaaggaggcauuguccucacucguguagcggcucaggaagacaucuaggcugggcagcggc

SEQ ID NO: 4185732 - RNA, 93 nt, Human
guggcucagccagagcuggauggucaagauggccucacucccauuucugucaacucugaggcucucuuccguguggucucuccaacaggcuac

SEQ ID NO: 4185733 - RNA, 61 nt, Human
guggcucauauugagugauuucuuugggaaaagcuaaaggaaagacauuacugugggcuau

SEQ ID NO: 4185734 - RNA, 124 nt, Human
guggcuccaucuggaugcaaaagaaaggauggguugggggagggagugagcagcccugggaaaugucccuggcucagcagcucuuucucagcaacaauucugcaguguagaacaggaagcaugc

SEQ ID NO: 4185735 - RNA, 59 nt, Human
guggcucuaggugagcauggagcgcuuuaacucuuccgcgcaugcucagccuuagccau

SEQ ID NO: 4185736 - RNA, 65 nt, Human
guggcucucaggaaguuguguuccuucuaagugcuggaagauacaccggaaccugaggcugccac

SEQ ID NO: 4185737 - RNA, 104 nt, Human
guggcucucgguggaaggggagcuggaaaggggaucgagugggaagaaggugaucuuucccugaagcccagccugucuccagccaggcuccccucugaagccgc

SEQ ID NO: 4185738 - RNA, 61 nt, Human
guggcugagccugauagcugucuccuguaucaugcagcugagaaaggcaggcucaccccgc

SEQ ID NO: 4185739 - RNA, 82 nt, Human
guggcugauggagagugugauuugggcguaggucuuauuugcaaaccugcucauguucuaagcuuucuucagguaguaccac

SEQ ID NO: 4185740 - RNA, 85 nt, Human
guggcugcagcaagaagucccugugggguggaggcuguuuggagccagcagaagccucuacacccagcaggugcuuaggagccac

SEQ ID NO: 4185741 - RNA, 85 nt, Human
guggcugcaggggcugucagucauaaucccuguccuuucacacaauaugcagccgugggaaggcuauaugacucagcccugccac

SEQ ID NO: 4185742 - RNA, 61 nt, Human
guggcuggaauggagcugagccuguggggucccugcaggcucacagugcuaguccacccgc

SEQ ID NO: 4185743 - RNA, 58 nt, Human
guggcuggcccuggacccuaaggccugacugagcuagggggucccuccggccugcuau

SEQ ID NO: 4185744 - RNA, 82 nt, Human
guggcugggguaucuguucuccugagacugugccuggcaugagcacaggugcuccucggggagcuggggaugucccagcuac

SEQ ID NO: 4185745 - RNA, 76 nt, Human
guggcugggugggagcauggucccagugcccaggagaaagagcugagcuggcaggaggggcccucccccuggccac

SEQ ID NO: 4185746 - RNA, 92 nt, Human
guggcugucucaggccgacugcccacagauaugugcagucugcucucaggaucaggcacacgacuuugggggucagguacaagaguagccac

SEQ ID NO: 4185747 - RNA, 59 nt, Human
guggcugucugcagaugugucuguugcuggauguggacacaaggguaacugccagccau

SEQ ID NO: 4185748 - RNA, 92 nt, Human
guggcugugguagaacugccaucauaggaguuggugaauuacccuuccaucuucuuccagcuucucucugaugcagcucucccauuuuccau

SEQ ID NO: 4185749 - RNA, 57 nt, Human
guggcuugagcaggggcagagguugugaugcuauuucuguugacuccuagcagccau

SEQ ID NO: 4185750 - RNA, 68 nt, Human
guggcuuggauccuuguggagugucagaggcaguacucugagcuuacucagggauacauuuuagucau

SEQ ID NO: 4185751 - RNA, 58 nt, Human
guggcuuuggaauuguagacucguccagaagcuggacagauaacgugaccgaggccac

SEQ ID NO: 4185752 - RNA, 55 nt, Human
gugggaagaacuucaaguggcuuucuacaugaguaacuugaagagaacuucccac

SEQ ID NO: 4185753 - RNA, 84 nt, Human
gugggaagguauuagaaccuccugggagcuuucuccagguacaccugaccaagcuuuuccucaggagagucuuauaucuccuac

SEQ ID NO: 4185754 - RNA, 67 nt, Human
gugggaauggagugguucuugcccucugagcuuacagacuaagaaggcagaaaagcuuuacaacuac

SEQ ID NO: 4185755 - RNA, 69 nt, Human
gugggacagguguuuauuuagcuuuauugagcagcuaugauaugccaacagcuuuagaaacacuuucac

SEQ ID NO: 4185756 - RNA, 89 nt, Human
gugggaccuggggcuaguagagucuuccucaggaagcccgucuuggcccgugcuugucugaaucuggagcucucuuguccuugucuugc

SEQ ID NO: 4185757 - RNA, 77 nt, Human
gugggagaaggaagccaggagggugcagagggugcaggcagaauucccugcaucagcugugcuucuugacuccccac

SEQ ID NO: 4185758 - RNA, 55 nt, Human
gugggagacuaucucagggacccacacuucccaguggcacccuggccacucccac

SEQ ID NO: 4185759 - RNA, 55 nt, Human
gugggagcaggcugaugauagguaagaaucauguaucuagaaucucucuccccac

SEQ ID NO: 4185760 - RNA, 63 nt, Human
gugggagcccucagggaggugcaagcuggagaggaucgggucaccugccugcaggggcuccac

SEQ ID NO: 4185761 - RNA, 60 nt, Human
gugggagggagauaacugggggauuggagucugucucauucuccccauucuuauucccau

SEQ ID NO: 4185762 - RNA, 60 nt, Human
gugggaguggggcaugugaaccuggaugugcgccacagccagggagcgggucucagccac

SEQ ID NO: 4185763 - RNA, 80 nt, Human
gugggaucucauauucuggauccuaugcacuggacuccaaggagucaacguuuacagaaucuuggacuaaugggacccac

SEQ ID NO: 4185764 - RNA, 114 nt, Human
gugggaugauaaauugagggaguugaauuuucuucauauuuugaaaauagggcccaacugaaaauaccucaaacauugaugggaaguuuaauauuucauuuuuaucuuucccac

SEQ ID NO: 4185765 - RNA, 68 nt, Human
gugggaugggaggagagacugaccugggagccacuucagaacauccuuccuccuuuucucccacccac

SEQ ID NO: 4185766 - RNA, 82 nt, Human
gugggaugucucaggggcagucugugugcguggacaguggaaguucugcuugcguucugcucccucccaucuuugucccuac

SEQ ID NO: 4185767 - RNA, 69 nt, Human
gugaagcuucccccccaggcuuucgcugccucucccaccuuguggggaccugccugggagaaguuucac

SEQ ID NO: 4185768 - RNA, 57 nt, Human
gugaaggaaggaauugaucaugcgcuccccuggagcggggauccgguucuccuucau

SEQ ID NO: 4185769 - RNA, 56 nt, Human
gugaaggaggggccacagauauucaaaauaauugugucugcuggccaaaacuucac

SEQ ID NO: 4185770 - RNA, 113 nt, Human
gugaaguacaguaauuaauuuuagcuaaagccuuuuaugaucaguuaaugauauaucuuuauuugauuuauaaauggcaggauagauuaagguuaauaaacuauucauuucau

SEQ ID NO: 4185771 - RNA, 67 nt, Human
gugaagugguagagagagcauaagcuuugaagucagacccagggucaguccucccucugccacucac

SEQ ID NO: 4185772 - RNA, 84 nt, Human
gugaaguuugauugaccugcauacuaaguaaaucugccaccuuagccucacuaguaucauguuggaauuaaucaaacuguccac

SEQ ID NO: 4185773 - RNA, 77 nt, Human
gugaauaggucuguaucaguguguuaucagugcuaggugagaugauacacuggccuuugcagagcccuacccuucau

SEQ ID NO: 4185774 - RNA, 84 nt, Human
gugaaucgugucuuaaacagaaagcagauguacuuaucuacuuagaguuauucuagaguauuucuguuuccuguucacauuuau

SEQ ID NO: 4185775 - RNA, 65 nt, Human
gugaaugacuggaugugauggggagaugacggcaaguugcauccaaaccauucaucagccaucac

SEQ ID NO: 4185776 - RNA, 91 nt, Human
gugaaugcagaggacucugaggugccacccaagagccuuuuaaaauaaauagaaguuuuuaaaaaugcuacuuaagagucacugcagaagc

SEQ ID NO: 4185777 - RNA, 77 nt, Human
gugaaugcauuggacaaaaaucagccaucucuauacuuaaccauuuggauuugugcauuuuugugcauguaauuuau

SEQ ID NO: 4185778 - RNA, 70 nt, Human
gugaauggcaaaaauuaacagaucaaccaaccuacacuugguuauauuagaauguauuuuugccauuugc

SEQ ID NO: 4185779 - RNA, 130 nt, Human
gugaauggcagaauucguggauccagagcuccuucugugaagagcagaaccauguccaaaagugaaaguggaaaaggguggucuugucuucauggcagaauggccuggccuaguucaggcugcgguuuac

SEQ ID NO: 4185780 - RNA, 82 nt, Human
gugaaugguacaaguguguguuugagcaggaggugaauaugccagggaaacaaaucuguucacacacuuguacucuccucac

SEQ ID NO: 4185781 - RNA, 58 nt, Human
gugaauuaggcuauggcagagguagguggauaaugugucugugaaguagccugaucac

SEQ ID NO: 4185782 - RNA, 78 nt, Human
gugaauuagggugguccuugaccuacugucucuuuaaaccaguggccuuuuuuccaaggaaucccauuucuaacucac

SEQ ID NO: 4185783 - RNA, 71 nt, Human
gugaauuuaagacugacuucaccaguggcauuauucuguacuggacagguucaugguuuuaauuuagucac

SEQ ID NO: 4185784 - RNA, 79 nt, Human
gugaauuucuuuugaggauauuaguguuucccuauuguaucuagcuuuaaaacauuggauauuuauuaaaaggauuugc

SEQ ID NO: 4185785 - RNA, 63 nt, Human
gugacaaauauuguucuugguaaaaucaaaacugaauuugcaugaugagaacaauaugcuuac

SEQ ID NO: 4185786 - RNA, 59 nt, Human
gugacaaaugcaaauugggcugcuucguccaaacaugucagccuauuuagcaggugcau

SEQ ID NO: 4185787 - RNA, 71 nt, Human
gugacaaggggcuuaccuggggaggucaguuugauuugaaauuauccaagaguaagaggacucuuugugac

SEQ ID NO: 4185788 - RNA, 77 nt, Human
gugacaauaagacagcaauaugggagacggagggcuuuguccccugcccuuccuauuccuguguguuguuguuucac

SEQ ID NO: 4185789 - RNA, 66 nt, Human
gugacaauauuagcucaggggccuucugggaucaauaauugguugucuuugaguuaaaauucucac

SEQ ID NO: 4185790 - RNA, 79 nt, Human
gugacacauuuccuugcuucuuuguauuauucuuaaaauuaugguacaacuguauuaggcaaaggagggcaggugucau

SEQ ID NO: 4185791 - RNA, 69 nt, Human
gugacaccuuugugaagugaugauguauuuguauaagaaaauucauuuuagucacaacaggggaauuac

SEQ ID NO: 4185792 - RNA, 59 nt, Human
gugacacuggguaaauuugaggcugagccuuaaaaggucugcagcuucaccugugucau

SEQ ID NO: 4185793 - RNA, 82 nt, Human
gugacagcaucuaguaaacaguguagguggccaggcaaugcagauuccaggcacuauauauacuuuuuauucaucaugucau

SEQ ID NO: 4185794 - RNA, 72 nt, Human
gugacauucaagucugcccagagucagcagccaagcagcgugcucucugaucuacagauuugcauuguucac

SEQ ID NO: 4185795 - RNA, 103 nt, Human
gugaccaaccucuaggacacauggcagggccugagggcugucuauccuucuuguuaguagagccuccuggcucucaggccugcugcguugucaggauguuugc

SEQ ID NO: 4185796 - RNA, 59 nt, Human
gugaccagugaucuacugggauuuugagaggaaaaagaguccccccagaauacuggcac

SEQ ID NO: 4185797 - RNA, 63 nt, Human
gugaccaguuggcaggggugggugggcuccccgcacaccacagcaccaccugcaaacucucac

SEQ ID NO: 4185798 - RNA, 72 nt, Human
gugaccccagaaaggguucucugaggugcugcggucccuacccagcagccaggggcucugucuggaaguggc

SEQ ID NO: 4185799 - RNA, 74 nt, Human
gugacccgggaaacagucccacggagaagccaggacccugggccuucucccugggggcucuuuaugcaggucac

SEQ ID NO: 4185800 - RNA, 67 nt, Human
gugacccucuagauggaagcacugucuguugucuaagaaaagaucgugcaucccuuuagaguguuac

SEQ ID NO: 4185801 - RNA, 79 nt, Human
gugacccuugcuuguuuugaagaaagaugacagauuuccugcagcucuuucuacaagcaggcagcugcggaaacaucac

SEQ ID NO: 4185802 - RNA, 79 nt, Human
gugaccggugagcggcugcucuuuucagaucccacucuucccaagguggacugcaaacuugacagcucgucaccuccac

SEQ ID NO: 4185803 - RNA, 66 nt, Human
gugaccucuguccugcagucuggaaacugccuucaagcaguaaguuagggcagugauagggcccac

SEQ ID NO: 4185804 - RNA, 99 nt, Human
gugaccuggguggcccugucccuggccgucuguccacagacacugggugugcuucauuugacuggccacgggcgggcaaggacagccucccaaggucac

SEQ ID NO: 4185805 - RNA, 64 nt, Human
gugaccuucugcuauacuuaugaauacauauaucuguguaucuguguauguguaaagggcuugc

SEQ ID NO: 4185806 - RNA, 66 nt, Human
gugacgaccgucuccgguccuguccuucaucccaagaugagcagacuccauugagugagucguggc

SEQ ID NO: 4185807 - RNA, 86 nt, Human
gugacguaccuaugaucugcagguaguuguagaauuaguacauugcuguuuauuaaaacauacauugccucauugguaagggucac

SEQ ID NO: 4185808 - RNA, 79 nt, Human
gugacuauaaacagccugcccaaauuggcuuaaucagaugcagccuugaucuugccaagggaaggauguauaugaucac

SEQ ID NO: 4185809 - RNA, 60 nt, Human
gugacucugccuguugaaacugucugcuagcuggcccagcaucuccaggcauggccucac

SEQ ID NO: 4185810 - RNA, 68 nt, Human
gugacucugggaggugucggacgagcccccugaggucugucugugggcaacgccucccaaagugucau

SEQ ID NO: 4185811 - RNA, 55 nt, Human
gugacugagaaagaccacauggagacucaagucuucucaugucugucucauucau

SEQ ID NO: 4185812 - RNA, 92 nt, Human
gugacuggcuguauuccauacuggaguccacaguucacugucuggugcucagcugggaugaguggacccaguuggaauguaggaagacucac

SEQ ID NO: 4185813 - RNA, 72 nt, Human
gugacuggcuuccuuguuuccacauuaugucugugaaauucaucccucuuguggcagacaggaggagcucac

SEQ ID NO: 4185814 - RNA, 62 nt, Human
gugacuuaugaagaauacuuagcuguuuuuuuaacccagucugagucuuuuaauaggugcac

SEQ ID NO: 4185815 - RNA, 93 nt, Human
gugacuucauugcuucgugucagaucagagguuccucgcucugaagggaaaggcaaacacuuuugaucugacuaugggaggcggggagaauac

SEQ ID NO: 4185816 - RNA, 87 nt, Human
gugagaagauacuuugcaugcaugaagugccauauaaugaccuuccuuuuguguucagcucauuccauguguauuuugagucuucac

SEQ ID NO: 4185817 - RNA, 93 nt, Human
gugagaaucuauccuaaauaucugaagaauucucaacauaguaaugaugcucuguauauaguguagagaaaucuuggaacggguagaacucac

SEQ ID NO: 4185818 - RNA, 86 nt, Human
gugagaguuaaaugaaaugguauguacgaugugcuucacagaauuccuggcauauaacacaugcucauuaaauauuagcuauucau

SEQ ID NO: 4185819 - RNA, 58 nt, Human
gugagauauuuaccuuauuuuuugacacuaaguguuggaaauccaguguguauuuuac

SEQ ID NO: 4185820 - RNA, 57 nt, Human
gugagaucaucuugggaaacaaagauguggccccacauuacaucccuggugauacau

SEQ ID NO: 4185821 - RNA, 123 nt, Human
gugagaucugaccuauaauuacuaggagcccucucauaaggcaaagcacucugcaguuguguucugauuucauaaauguaccuucugccuuacuggcuuauaguuuuacugggcauaucucau

SEQ ID NO: 4185822 - RNA, 83 nt, Human
gugagaugauguguguguguuguuuuaagcugcuaaauuugggaguaauuuguuauaaagcaauauauauaaaaauauagcac

SEQ ID NO: 4185823 - RNA, 65 nt, Human
gugagaugccuggcacccagcaaggaguuauuaaauguuagcuguuugugguuguuagcucuggc

SEQ ID NO: 4185824 - RNA, 83 nt, Human
gugagaugggaguugagacauuuugccccagauacauuaauuuagucauaacaaguaacagggcacaguccagccccauccac

SEQ ID NO: 4185825 - RNA, 57 nt, Human
gugagauuuucuccagguucagaagcaaagaauggacacuacagggagaagacucac

SEQ ID NO: 4185826 - RNA, 74 nt, Human
gugagcaacagugggcaggcccuaggcgauuugggaagagcgggugucagaaagccugggguuuggccagccac

SEQ ID NO: 4185827 - RNA, 76 nt, Human
gugagcaucuauuacaugaggggaaaagacauaucaucuugaacugucauuuucuaaucuguugucagugacucac

SEQ ID NO: 4185828 - RNA, 62 nt, Human
gugagcauuugaugaguaaauuauuuugauaagcaagugguuugcccacucgagugauuuau

SEQ ID NO: 4185829 - RNA, 92 nt, Human
gugagccugguggaggcuccaugagcuccugcacaaggcacugggagacuugguuauacugcugggguucuggauuccucccacagggucac

SEQ ID NO: 4185830 - RNA, 59 nt, Human
gugagcucucccauagggcaagaucaucauaacacaaugucaccccagggagugcccac

SEQ ID NO: 4185831 - RNA, 77 nt, Human
gugagcugcuaacaucucucuccauugugccagcgggagcagcugguggaagugaugcugaggugacggcugcugac

SEQ ID NO: 4185832 - RNA, 70 nt, Human
gugagcuuaauagucaugcuuucuacccuucacaagcuuacacuggagaagaggcaggcauuaaguacac

SEQ ID NO: 4185833 - RNA, 57 nt, Human
gugagcuuccugagugguggccacuuggcaaagugaguccaucgcagggaagugggc

SEQ ID NO: 4185834 - RNA, 60 nt, Human
gugagcuuuaggagaaggaggucaaacagcauauuaguuugccuauuauuuuaagcuuac

SEQ ID NO: 4185835 - RNA, 69 nt, Human
gugaggaccuucuugcuguguccuaacaugauggaagguggaagggcaaaagagaugaacuauccuuac

SEQ ID NO: 4185836 - RNA, 63 nt, Human
gugaggagccugggccgcuggaggcuggcugugcagcaggcgugcuuccaggcccagcugagc

SEQ ID NO: 4185837 - RNA, 59 nt, Human
gguuuuccuaguaggccuauuagaaucacaggauucuaguaaugagaggcaggagaauc

SEQ ID NO: 4185838 - RNA, 84 nt, Human
gguuuucugccaaaaauaucagcuuguagacugcuuaucugaaaggagagcugcugcccauaggugacauauggcuugaggacc

SEQ ID NO: 4185839 - RNA, 64 nt, Human
gguuuugaccucuccaaauccuaaacauuugcaauguguagagguauuuuugauggucauuacu

SEQ ID NO: 4185840 - RNA, 79 nt, Human
gguuuugguuguuuaccuaaucuaguuguacuuuucuuaaacagaggaaaguuaucuuugauuagaaauaagcaaaacu

SEQ ID NO: 4185841 - RNA, 69 nt, Human
gguuuuguugauugagccaagauacuccaaguuugcaguuggcuguguaaggugaaaucaacaaaugcc

SEQ ID NO: 4185842 - RNA, 88 nt, Human
gguuuuuacuccaaguuauuuucacagcagugugcugcuuuuguuguugacaaaaguaguugcugcucugaaagaggcaugaaagacc

SEQ ID NO: 4185843 - RNA, 73 nt, Human
gguuuuuauaauaguuuacaaaaaugaugcauuuaguaaaauauuguuuugguaagcuucauguguugaaacc

SEQ ID NO: 4185844 - RNA, 68 nt, Human
gguuuuucagcauucuuuacaaggaugaggauguauggucuucucuuuguccaaauguaucaagaauc

SEQ ID NO: 4185845 - RNA, 89 nt, Human
gguuuuuccuacacaugaaugcgagaaauggcugauaagcacaguaauuuaagauugcguauucauguagugagauuuagucauuaacc

SEQ ID NO: 4185846 - RNA, 79 nt, Human
gguuuuucuuguuugcuaaaucccuauaauauuccuuuucccaucaaggggauauguguggguuugugcuagaaucacu

SEQ ID NO: 4185847 - RNA, 66 nt, Human
gguuuuugcacuuaacuuauuugaaauugauugcaauuuaaagaugcaguuaugugcucucuaacc

SEQ ID NO: 4185848 - RNA, 81 nt, Human
guaaaaaacagggccuuucaggguaaaaggucagaaaggacacuuuauauucuaagacggccuaaaaauuagaauuuuuac

SEQ ID NO: 4185849 - RNA, 88 nt, Human
guaaaaaguuauacauagaucuuugacugcguguggggucagcaccccuaaccccuguguuguucaagggucaacugugcucuuuugc

SEQ ID NO: 4185850 - RNA, 81 nt, Human
guaaaaaugcuuccaauuuuacgucuguauaaaaagugaauuuuuuaaaaagccaaugugaaguaucugagagcauugcac

SEQ ID NO: 4185851 - RNA, 77 nt, Human
guaaaacuggguaaauauagauagcuggauuguauuaauaucaauauccuggcuguaacauuuugccauaguuuugc

SEQ ID NO: 4185852 - RNA, 107 nt, Human
guaaaagaggugaggaaaagagacagguuauugaaucaaagugguggaguccccaagcaaucuuuuccgcucccuaguagccugccuauuucucaaacucugucgac

SEQ ID NO: 4185853 - RNA, 73 nt, Human
guaaaagaugacaauggacauaguuaaaacagaacaaaucuaguuuuaauauuuucuaguugucagcaauuac

SEQ ID NO: 4185854 - RNA, 91 nt, Human
guaaaauaaagugacauuuguaugacacuuuaaagucuuugcagaaaaaauagauuuuaaaguggugguacauuuaugauauuugugauac

SEQ ID NO: 4185855 - RNA, 85 nt, Human
guaaaauaaguuuaguguuuauugaggauuuacuauuacuauugcauaguagaauagauggauacuauuguaaacuauguauuac

SEQ ID NO: 4185856 - RNA, 94 nt, Human
guaaagaaaguccguuucccuuguuuacacagugaauuuacucaaggagcacugucuucauggguaaaacacugguggcuuuacugcucuuuac

SEQ ID NO: 4185857 - RNA, 130 nt, Human
guaaagaacugaccaugcuuccacugaaauguuacagucaccuagaaugaccaagaguguuuuauaugaagccucuuggagucuaucauucuguuuggagugacagcugaaguuuuauauuuauuuuucc

SEQ ID NO: 4185858 - RNA, 79 nt, Human
guaaagaagaaacuucaaggauuugcaaaucuuuuucaucuuaaaaguuuuguggccuccugugagguuguaguuuuau

SEQ ID NO: 4185859 - RNA, 108 nt, Human
guaaagaauacuaguuccugucuuccagaauuuucucuauagucaaaugaaagcuugaucuuucacauuuguuuuaagaaguugggcugacacugguuuucucuuuac

SEQ ID NO: 4185860 - RNA, 57 nt, Human
guaaagagcuaguuuauaacuugucuucagaauuuuggauacaagacuagcauuuac

SEQ ID NO: 4185861 - RNA, 59 nt, Human
guaaagauaauguucuagcugucagcagaugucugacacuugauggagcguaucauuac

SEQ ID NO: 4185862 - RNA, 67 nt, Human
guaaaggcccauucaaacagcuagguguucagcacacauaucuucugccuaguuugggucuguuugc

SEQ ID NO: 4185863 - RNA, 67 nt, Human
guaaaggcuuuuagugaugguaauggccaggcuucauagcauuagccaucacuugcaaaaccuugac

SEQ ID NO: 4185864 - RNA, 83 nt, Human
guaaaguucacaagaugugguggggaggaaaugaccacuguaacucugugguccaguucccacacccauauugugauuuuugc

SEQ ID NO: 4185865 - RNA, 77 nt, Human
guaaauaacaguuguucccagcaaugaaaguugaauguuguugccccuuuguuuucacaugcugggcaauaguuugc

SEQ ID NO: 4185866 - RNA, 59 nt, Human
guaaauagaugguuacugagugucuccccuacuccuucacccaguaacuauguuguuac

SEQ ID NO: 4185867 - RNA, 72 nt, Human
guaaauauccuguuuugcacaauuauauugcaucauauuguuaauuguugugugcuaaaacaguuuguuuau

SEQ ID NO: 4185868 - RNA, 79 nt, Human
guaaauaugagucagcaccugaguaauaagcuuguuucuauuauaauuaauaauauugcuggggugggccauguucugc

SEQ ID NO: 4185869 - RNA, 60 nt, Human
guaaauauguugaugugcuggcuaguagagcuuuugguagauagcacacugacaucugac

SEQ ID NO: 4185870 - RNA, 80 nt, Human
guaaaugagguaaaauguguacaguaagugaaucuagguaaaacauauguagaugauauuuguaccauuuuuauucuugc

SEQ ID NO: 4185871 - RNA, 77 nt, Human
guaaaugagucaaaugggggaagaccaugaggcacacugggaaaucugccuuuucagucccucguuucuucagcugc

SEQ ID NO: 4185872 - RNA, 78 nt, Human
guaaaugcucaauaaauguugcuguuauuuuuaaaagaauacauaaaaaggaaaaggauauauuuauugaguaucuac

SEQ ID NO: 4185873 - RNA, 69 nt, Human
guaaauuagacauuaaaugccauuuaaucagucagauaaugauuaauguuagaguaauguuugaugggc

SEQ ID NO: 4185874 - RNA, 75 nt, Human
guaaauuccagugaccauagaguauggauuguugaccauucuugacaugccauuggucauggugauggacauugc

SEQ ID NO: 4185875 - RNA, 109 nt, Human
guaacaaauggccuaugugaacugaacugagcuggugaauaucaguuaagaaaaggcagucacuguguguuugucuagcacaggcagcauguaggacccuguagguuau

SEQ ID NO: 4185876 - RNA, 103 nt, Human
guaacaagaauuuauuaucuuacaguucuggaagguagcagucccaguccaagauguuggcaggguugauuccuucugagggcugggagggagauucuguuuc

SEQ ID NO: 4185877 - RNA, 77 nt, Human
guaacagagcugaguggcuccaugcagaagucuguguucaacaucugucaugcuggagaucauuaauguucaauugc

SEQ ID NO: 4185878 - RNA, 82 nt, Human
guaacagggacuacucaguuaucacauucagagcccugcuccuuaagaacucugagaacuccggguuagauccuuaaguuac

SEQ ID NO: 4185879 - RNA, 55 nt, Human
guaacagucucccuggagucaacuuucugucaggugggccucaggcagcugugac

SEQ ID NO: 4185880 - RNA, 58 nt, Human
guaacauccagauauguaacauuuguaacauccagauauguaacaaucuggauguugc

SEQ ID NO: 4185881 - RNA, 70 nt, Human
guaacccuuacuagagacaccaguaccauucugcaaauaguagauggaaauugcuuucugagagggcuac

SEQ ID NO: 4185882 - RNA, 95 nt, Human
guaaccgacugcuccacuuugcccagaacugucccaguuuuagcagugaaaguccccugucccucaguucugggcaaaccaggaugguuggucac

SEQ ID NO: 4185883 - RNA, 113 nt, Human
guaacguaaugacuaccauaugguaaggcuucuuggaauacugcaggguagacuuuuccugcaacauccaaugacgccucaucauuuuuggaauuuuucauuuuuuccauuac

SEQ ID NO: 4185884 - RNA, 64 nt, Human
guaacuaagaggaagcuaguuagaugaaugaauggucugucugaaauaggcuucuuuuggugac

SEQ ID NO: 4185885 - RNA, 62 nt, Human
guaacuaguugacuuuuucauuuuguuagagguauuuucgcugaacaaggucaauugguuac

SEQ ID NO: 4185886 - RNA, 81 nt, Human
guaacuauuauguuuuauaggcuguugcuauaugguaacaauuuuauaugguaaaucuaauuguggauaaauaauaauugc

SEQ ID NO: 4185887 - RNA, 78 nt, Human
guaacucaugacauuuuaaaaagaacaucauguuugucauucacauaauguucuuguucaaaugucaguugaggugac

SEQ ID NO: 4185888 - RNA, 95 nt, Human
guaacucugcgugauuuaagaguacuuaacuccaaauaggaucuuaggacauacgagaucucucauaagaugaguacuuaaagacguugaagugc

SEQ ID NO: 4185889 - RNA, 72 nt, Human
guaacugacauguggaggcuauuugcaauggaacuuagacuaucuagucuuuuguagcuaacacauucauac

SEQ ID NO: 4185890 - RNA, 110 nt, Human
guaacugcuagcuauuuuacuuaucaucuccaaggccaugauuacuugaaggaaaggagaauauguuuucuuucucacucuuuaggaagucauaguggaggagcaggaac

SEQ ID NO: 4185891 - RNA, 75 nt, Human
guaacuggugagauaaauuauuuaauccuuaauuucugaugauuuaauagaugaucuguuucaugccauaguuac

SEQ ID NO: 4185892 - RNA, 66 nt, Human
guaacuuuggauuuaggguaccauugaaauugauuuccuuagaggugugcuagaggcaaaguuugc

SEQ ID NO: 4185893 - RNA, 101 nt, Human
guaagaagaaauccucagacucuuauuuugaaguaauaauugaaaauuuaguaucaaauaauacaugugaugagaauuuggacuggauuuacugaacuuac

SEQ ID NO: 4185894 - RNA, 99 nt, Human
guaagaauacuaggaagccaucggagggguuugaacagaggagggacauaauuugacuuguauuuugugaggaucacucuggcuuugguguggguagac

SEQ ID NO: 4185895 - RNA, 69 nt, Human
guaagaauguuauccccaaaacaaaagcuuaaaguccucuaagcuuuucagugggcaaugaugugauac

SEQ ID NO: 4185896 - RNA, 77 nt, Human
guaagagaccuggacugaguuagauggccugggcuccagucauaccuugcuaucucuuuaguacuagauuuuuuuac

SEQ ID NO: 4185897 - RNA, 78 nt, Human
guaagagcacagaaguaguucucaggacgucaagguuauagauuacccuuggcaauuccaagaacuuuggauuuuuac

SEQ ID NO: 4185898 - RNA, 72 nt, Human
guaagaucuacaggauaguuuaauauugaggaauagagauuuuaaauguucuaaagguccugaaggauuuac

SEQ ID NO: 4185899 - RNA, 119 nt, Human
guaagauuggaggaucuaacaagguucagaaaauggaacugggcuacuagguauuuggagagcaacuaccuucuuucaguuucguuuucuucccaaauuuuucaaauucucccccuugc

SEQ ID NO: 4185900 - RNA, 63 nt, Human
guaagcaaacagcaaaugauuuuuuauaaccaaauagagauuuuaguuuugcuauuugcuugc

SEQ ID NO: 4185901 - RNA, 90 nt, Human
guaagcacucuaguuuuacugauacauugggaaauggaguaguagaauaagagaccagucaugcagugugucaguugaaagagauuuuac

SEQ ID NO: 4185902 - RNA, 85 nt, Human
guaagcaguugcuuugcucccaagggcauaugguaucuuugcuccacagugccugggacacagcagauacucaauaaaugcuugc

SEQ ID NO: 4185903 - RNA, 57 nt, Human
guggagccuuauuuggaucuucuguggggucccagacagaagaaagggagguuuugc

SEQ ID NO: 4185904 - RNA, 58 nt, Human
guggagcuggcccaagaagcugcauuucuaacaagcucuuuuguggagcagcugccac

SEQ ID NO: 4185905 - RNA, 80 nt, Human
guggagggccagugagucgggagagcugcuaaucuuuuucuugacuucagggacaguuccuuguccucauuucccuccau

SEQ ID NO: 4185906 - RNA, 67 nt, Human
guggagguucuauguguaggaggucccaggauagugaguccucuuccuucucacuguggaaaagaac

SEQ ID NO: 4185907 - RNA, 66 nt, Human
guggagguugugagcauuuuggugagcuuuuccucuaggaaaguucuuucagcuuagagcccccau

SEQ ID NO: 4185908 - RNA, 73 nt, Human
guggagugcaggguauguggaagcagacaguugaggccucagcacugcccuuacaugcccugcaugcucccac

SEQ ID NO: 4185909 - RNA, 95 nt, Human
guggagugccgucucgcacaugaaggcuggggucgugaccaccuuguuuuucugguccacgugagcuucgugugcagaguuacggaaaaagccac

SEQ ID NO: 4185910 - RNA, 63 nt, Human
guggaguggccuggcccugagaacccacgaaauccauugucuggcuaggaggggcuauuccac

SEQ ID NO: 4185911 - RNA, 80 nt, Human
guggaguggcugugcagugugggguaggccugggcccaggcaggagcaaggccgccuccgccugcccacccuccucucac

SEQ ID NO: 4185912 - RNA, 93 nt, Human
guggaguggggagacaaggagaaccaaagaaaugccuugcaagcaaguuuuuggucugucuccuguccaaccaccccuaauccccaccuccau

SEQ ID NO: 4185913 - RNA, 77 nt, Human
guggauaacaguguggacuugagaucugccaccgaagccacugggcaaguuauucaaccucacugucacuguucuac

SEQ ID NO: 4185914 - RNA, 70 nt, Human
guggauaagaggccccuguagaugauacagcgggacagagcacaguccagcucagaugcagggaucacac

SEQ ID NO: 4185915 - RNA, 70 nt, Human
guggauaauggccaaaucucuauuuuucugaguagccaaacuuagcggucagcauuuagccuuuauccac

SEQ ID NO: 4185916 - RNA, 71 nt, Human
guggauagaauuuacagggaauauuuuggcuucuuaugaagaagcacucccaaguaaauggacuuauccac

SEQ ID NO: 4185917 - RNA, 58 nt, Human
guggauauagcacauuuuguucaugcauucaucuguugaacauuuggguuguuucuac

SEQ ID NO: 4185918 - RNA, 76 nt, Human
guggaucuccaccuaauugagaagggcuuugaggcuuuggacucuggcuuuuauucaguuggcaguggggaaccau

SEQ ID NO: 4185919 - RNA, 113 nt, Human
guggaugagaaugauguauaaauuugaguacuuuugauuaaaauaugaaguuauuguugguucaacaaaugcaaguuuuaugucaaaggaaaugaaaacaauguuugcuccac

SEQ ID NO: 4185920 - RNA, 72 nt, Human
guggaugaggucgagucacuuguugccuuuggcuaaugcauaggggcacgaguagagcucuagaaucaccau

SEQ ID NO: 4185921 - RNA, 62 nt, Human
guggauggauuuugaggaaugguagagauucuaaagagugaguccacaucagaguuuaccac

SEQ ID NO: 4185922 - RNA, 91 nt, Human
guggaugggcagcuccauccuggccuugcuguccaccuuccagcagaugugggucagcaagccaggaguaugaugagucuggccucuccau

SEQ ID NO: 4185923 - RNA, 78 nt, Human
guggauggguauccuguuucuuaaucagucuugacaggcuuagggcuugucuugacuuuagagccaggaauauuccac

SEQ ID NO: 4185924 - RNA, 70 nt, Human
guggauggguuaucucuacaggaauauaaucaauaagguguguauucaggucgagcuaacugcuugucac

SEQ ID NO: 4185925 - RNA, 67 nt, Human
guggauggugguccaguaucauauucugaagauccaaucaacuaugcaugcuguucuaccagucuac

SEQ ID NO: 4185926 - RNA, 68 nt, Human
guggaugucuauguguauuuguaaacauuacguguuuuaacuuaaaauacauagauguguuuuuccau

SEQ ID NO: 4185927 - RNA, 60 nt, Human
guggauucugagacaguuuagugggcagaaaguuuauuagagagaaccaucaggaucuac

SEQ ID NO: 4185928 - RNA, 76 nt, Human
guggcaaaugcccugucucucugcuaggccuccagugauaccaucaaugguagcuaugggaguuagggcaucucac

SEQ ID NO: 4185929 - RNA, 80 nt, Human
guggcaaccacucaacucugccuuuugcaguguaaaagcaccccugagcaaugcauaacagagugggccugguugcacgc

SEQ ID NO: 4185930 - RNA, 69 nt, Human
guggcaaggagcaugaaaaguccauaaacagaaugauuauauaccacugcuucaugcccaauuugcuac

SEQ ID NO: 4185931 - RNA, 79 nt, Human
guggcaaguuagggagcaguuaaaaugauuccuuguuaccacagggcugacauauuuggugcucuaaugacuuagcugu

SEQ ID NO: 4185932 - RNA, 65 nt, Human
guggcaaguugaauuugauguuguuugaccugaaugucaaacauaggcacacauucaggggauac

SEQ ID NO: 4185933 - RNA, 66 nt, Human
guggcaaugucugaaaaucagacugcaguaaaagucuuggugcaucugauucucaggcagaaauac

SEQ ID NO: 4185934 - RNA, 62 nt, Human
guggcacacaggagagagcucaaggcgccugcugccagccgcacucacagcugugugaccgc

SEQ ID NO: 4185935 - RNA, 72 nt, Human
guggcacuaaauacagcauuucagggaagcaaauaaauaugcuuuauaaagaaaacagcuguauuuuuccac

SEQ ID NO: 4185936 - RNA, 64 nt, Human
guggcagagaaguugucuuucuuguuuguaacugagugcucagagccugaaagacuucuggcac

SEQ ID NO: 4185937 - RNA, 59 nt, Human
guggcagagccaaggcuggagcuaugggccucccccuccucccccacuguuucugcuac

SEQ ID NO: 4185938 - RNA, 60 nt, Human
guggcagagccaggcuuugaacacaggcagacuggauccagagucugagcucuuaaccac

SEQ ID NO: 4185939 - RNA, 60 nt, Human
guggcagagguuccucagugugggacaugcagcauguggacacaugggaccucuggccac

SEQ ID NO: 4185940 - RNA, 56 nt, Human
guggcagcauggcuuuuagcugggaauugcccuccagccuaagagcuagcugucac

SEQ ID NO: 4185941 - RNA, 61 nt, Human
guggcagcuacauuuaaugcaauucuuguuuuaaaaauuuuuauugauauguagcuguugu

SEQ ID NO: 4185942 - RNA, 55 nt, Human
guggcagcucauguuguuuuaauaaucacaaauugcaagccaccacugcugccac

SEQ ID NO: 4185943 - RNA, 60 nt, Human
guggcagugaggcaggagcagucggcgcccacacgccggaucugccgcacccgcugccac

SEQ ID NO: 4185944 - RNA, 68 nt, Human
guggcagugggacagucagaagugagcagggaguuuuaaguccugccacccucaauuucucuugccau

SEQ ID NO: 4185945 - RNA, 84 nt, Human
guggcaguguugucaagggcaaugugaggaacaccccuugccuuggaguguccugcgagugcgcuuuuggucagcaguggccau

SEQ ID NO: 4185946 - RNA, 65 nt, Human
guggcaguugaauuuuguucagaacacauugaauuugaggugucuuuggaauauuuagcugaagc

SEQ ID NO: 4185947 - RNA, 67 nt, Human
guggcaucauagccaaggugcuuugccuaaaaucacucaucucuucaaagucccuggcaugagcuac

SEQ ID NO: 4185948 - RNA, 80 nt, Human
guggcaucuccuccccugcccaugaggaggguggugcugaguaaagguagccucugcgggcaggagauggcagggaccau

SEQ ID NO: 4185949 - RNA, 93 nt, Human
guggcaugaauggcccccagauuccuggccugaucucuggaugggcgaagaagaggggaggcagaggagcuggaaacauggggcaggguccac

SEQ ID NO: 4185950 - RNA, 69 nt, Human
guggcaugacucuuugggcugcccaauuuaaagagaauuacauugaacagaaaaacucagagagcccac

SEQ ID NO: 4185951 - RNA, 116 nt, Human
guggcauuucacuguauugguaagaaacuucauuaguagugagacugugcuucaggugaugucaauuucaacagcugauaagaagacauuuuaaagauaagaucagcaauugucau

SEQ ID NO: 4185952 - RNA, 79 nt, Human
guggccaacagcgaugauugcagcccuacagcugucacaacaacccauugaccacugugugcaaugcugugcuugccac

SEQ ID NO: 4185953 - RNA, 65 nt, Human
guggccacccagaguagcuuuuccuuggcgaauuugccacagagcugaaccugggucauagucau

SEQ ID NO: 4185954 - RNA, 64 nt, Human
guggccagaugucccucucagguuuguuuucucuaaaauaauccugucuugaccaucaggcuac

SEQ ID NO: 4185955 - RNA, 64 nt, Human
guggccaucaaagaaaaagagagaaacucuggggaaccagccauuguccugguucuguggccac

SEQ ID NO: 4185956 - RNA, 82 nt, Human
guggccaucccaacuguggccagcagguggcuguguguucacacagaccucacugcaggcccccugcagggugggagggcac

SEQ ID NO: 4185957 - RNA, 78 nt, Human
guggcccacacagacagcaucuaauaaugggaguggagaggaaagggaaaggcacucagaugcauguuggugggugac

SEQ ID NO: 4185958 - RNA, 55 nt, Human
guggcccaggcacccugaugacuuccuguuucucagaaaaguaagcuugggcagc

SEQ ID NO: 4185959 - RNA, 65 nt, Human
guggcccaggcuggagugcaguggcacaaucucggcucacugcaagcuccgccucugggguucac

SEQ ID NO: 4185960 - RNA, 93 nt, Human
guggcccaguugcggucucuucacuugcuggaugguggcucagccugacagguuucacagguauccacgggucugaguccagagcugccccac

SEQ ID NO: 4185961 - RNA, 55 nt, Human
guggccccuugggggcuccaggcaggaaagaaagcagagcccucuccauggccac

SEQ ID NO: 4185962 - RNA, 60 nt, Human
guggcccggggggugcggggcaaccuggcaaaguugcccaaguccuccaccgagguccgc

SEQ ID NO: 4185963 - RNA, 71 nt, Human
guggcccguccugacgccgcgcccagcuccgccagccggccgaccugcgcagcaaucagagaggagcacac

SEQ ID NO: 4185964 - RNA, 123 nt, Human
guggcccucgggcggcucugaggugcaggguugagccugggcuuucggcggcuuccuccguuuuucggagcgaagggcacgccaaggcuuguuugccucugucuugagugucgcccaggucac

SEQ ID NO: 4185965 - RNA, 103 nt, Human
guggcccuggccuguggcccucacugagggcaccgacagaguggagggucucugcugauucucucuuguccuuaagggccugcuucaggccauguggggucac

SEQ ID NO: 4185966 - RNA, 57 nt, Human
guggcccuugagcuauaguuuggugaccgcugcccuagacugccaucuuugggccac

SEQ ID NO: 4185967 - RNA, 80 nt, Human
guggccgccaacugugccgugggcaggggcucugcagcagagcggaauggccguaaugacccuggccugguggcggaaac

SEQ ID NO: 4185968 - RNA, 56 nt, Human
guggccuagagaagccaaaagauuggaccccccgaucuagaucuucuuuaggccau

SEQ ID NO: 4185969 - RNA, 57 nt, Human
guggccugccgugugguauggggcuaggggacgccaucaugcggcaugucaggccuc

SEQ ID NO: 4185970 - RNA, 85 nt, Human
guggccuggaacugauggaagaugugguuagagggagucagucugccucugagucaugcgcauaggacuucagucagcaagcugc

SEQ ID NO: 4185971 - RNA, 64 nt, Human
guggccuggggaccugugagaccuugcggcugaucaugggucucucggcguuucccacgggcac

SEQ ID NO: 4185972 - RNA, 61 nt, Human
guggccuugcucacauguccagacguuggcuggcuguuggcaaugguggugacagggucau

SEQ ID NO: 4185973 - RNA, 74 nt, Human
guggcgaugguguuccugugcuggauggucagugguuguugacauguaguuagaaaauagguagcaaguuccac

SEQ ID NO: 4185974 - RNA, 98 nt, Human
gugggcaauuugauuauagaggagggcuuuguugauguuaaaauaaugagcucuggaugacauugguugcaagguacucacuuccuccaaaugcuuac

SEQ ID NO: 4185975 - RNA, 68 nt, Human
gugggcacauaguuuuauggucagaauccuaguuauguggauuuuuauuucuugucuauguagccaac

SEQ ID NO: 4185976 - RNA, 58 nt, Human
gugggcagccccuucaaggccaaggucacuggugagugccgguuugggggagguccac

SEQ ID NO: 4185977 - RNA, 80 nt, Human
gugggcaugcugcuggcaucuaggggguggaggccagggaugcugccaacuauccuaaaaugcacaggacagccguccac

SEQ ID NO: 4185978 - RNA, 95 nt, Human
gugggcauuuauaggagucugaguccucauagacaaggacaagcggaccaguguuuuaaugagggccauuuauuaaacggcuaaugaaauccuac

SEQ ID NO: 4185979 - RNA, 60 nt, Human
gugggccaggccggagugcagaugggcaaugccugcugggagcuguacugccuggagcac

SEQ ID NO: 4185980 - RNA, 60 nt, Human
gugggccaggucugcggucauuuccaggcuugacuggaggagguccgcuuccaggcuuau

SEQ ID NO: 4185981 - RNA, 70 nt, Human
gugggcccugggccaagaugccagggucucauccaguugucagugaccuggcucugggcaccguguccac

SEQ ID NO: 4185982 - RNA, 68 nt, Human
gugggccuccccagccuggaguucccagccaugguuuggaaagccaucuggcugcugggagaguuaau

SEQ ID NO: 4185983 - RNA, 63 nt, Human
gugggcuaaaguggggcagggcagacacuggccagcuguccacccaacccauuuccaguucau

SEQ ID NO: 4185984 - RNA, 68 nt, Human
gugggcugcaggaacgacggaggggcggcccuucuccugccccugaugucacugcuucugccucccuc

SEQ ID NO: 4185985 - RNA, 74 nt, Human
gugggcugcuuccuccuuccacccuugcucagauucccagugacaggaagcucggggaagccaggucagcccac

SEQ ID NO: 4185986 - RNA, 83 nt, Human
gugggcugucggugguauuuuggguauagagggcauauuauguuaggauggaaaauucccagcaugcacgcugacacuccuac

SEQ ID NO: 4185987 - RNA, 69 nt, Human
gugggcuuaccaggucccaagggcuacacagcucuguucaagcagcaugcccagggaccugagcuccau

SEQ ID NO: 4185988 - RNA, 62 nt, Human
gugggcuuaugggcagcagcuuagcaaccauuucaaggcacucagcugucucaugggucugu

SEQ ID NO: 4185989 - RNA, 65 nt, Human
gugggcuuccuggaugccugggccaauccuaagagaggacugcacacacagaauuuaggguccac

SEQ ID NO: 4185990 - RNA, 65 nt, Human
gugggcuuguuuugaugagaucaaugagaagcaaaaucuuuagaucucacaagaaauaagagcau

SEQ ID NO: 4185991 - RNA, 78 nt, Human
guggggaaaggaaagaguaugcaccuuguuuuuaauuuuaggaaacaaggguuuuggauuuguugcuuuauuccucau

SEQ ID NO: 4185992 - RNA, 78 nt, Human
guggggaagacagacaauuuuuuuuaagcacuacgucugugccauaacagaggaacagaugagguguuuggagagcac

SEQ ID NO: 4185993 - RNA, 60 nt, Human
guggggaaggaagugcagacuuuaaaacaauuaaugguuuugguaacuauucuucucugc

SEQ ID NO: 4185994 - RNA, 115 nt, Human
guggggaccagguuuggggaggccgcugcugcugccgccgcaacugccgcuccuacuccuaauguuguggcuguuguuccgggagcugcagccucgccauugcugguuaucccac

SEQ ID NO: 4185995 - RNA, 60 nt, Human
guggggagcaauugcccccuuagauaggcacagcuucucuaggucuuuguaguuccccau

SEQ ID NO: 4185996 - RNA, 65 nt, Human
guggggagcaggccuggggugaggccugggaaccagggucuucaucuacccugcagggcccccac

SEQ ID NO: 4185997 - RNA, 105 nt, Human
guggggagcuccaagcaggugggcaggacccaggggccuggugaccaggacagacccccacuguccaucaacuuuccuggcccuguccucugcuaaacuucccac

SEQ ID NO: 4185998 - RNA, 56 nt, Human
guggggaggccuaagcaaguuguguuuugagcacaggugcuuuagugauuccccau

SEQ ID NO: 4185999 - RNA, 124 nt, Human
guggggauuaggugaauaauagaugggaaacucugcauccaggguugagcacgggagccagaagagggcuccuccuguuucucaggccugggugucagggugcccagcagaagcgaguccuugc

SEQ ID NO: 4186000 - RNA, 67 nt, Human
guggggcaggagcaccugggccaucccuggauccucuaggcuggcuuggcucuccuguggaccccau

SEQ ID NO: 4186001 - RNA, 58 nt, Human
guggggccacacaucucuuucuaacuccuuguugaguaguaucauguuguggcuugac

SEQ ID NO: 4186002 - RNA, 76 nt, Human
guggggccagguaugcagcacacuccagguacugcccagcagcagcugcuucugcuuuacuugguucauuucccac

SEQ ID NO: 4186003 - RNA, 59 nt, Human
guggggcuaaaaacugugcaguuagacaagggucucucucugauggguguuggccucac

SEQ ID NO: 4186004 - RNA, 55 nt, Human
guggggcucucggcgcggcaggcgcuucccggcccugucuggccgcgggcuccgc

SEQ ID NO: 4186005 - RNA, 104 nt, Human
guggggcuggacccuggccucacucuuccuggaggggcagacugaggagaucacaggguucugcagaauucgaggaagaaaaggcccuggccuuucagugcuac

SEQ ID NO: 4186006 - RNA, 56 nt, Human
guggggcuguggccacugcagagcagcccaggggaccuugcugugcacagcccuau

SEQ ID NO: 4186007 - RNA, 84 nt, Human
gugggggcaacguguagcccuugaugcugcggccagugcggacgcggcugcugagcacguaguuaggguccaggucgucuccac

SEQ ID NO: 4186008 - RNA, 85 nt, Human
gugggggugucgucugggcccuuccugcucucuuagcugccugagugacugggcagggcagggccugggccacugacacccccuc

SEQ ID NO: 4186009 - RNA, 102 nt, Human
gugggguacugggucccauguagggaacuaaauucacugcagccaaugaaaaguacuguacagugagguggaguaguucccaagacaggaugcaugcuuggc

SEQ ID NO: 4186010 - RNA, 57 nt, Human
guggggucacccuucccuuccaugagucccuaucaugaagacccgugguguccccac

SEQ ID NO: 4186011 - RNA, 63 nt, Human
gugggguguccagcagcgagcuaggcaauucucugcauucaguuccaaagcugggcaguucac

SEQ ID NO: 4186012 - RNA, 61 nt, Human
guggggugugcucagagcagggggccugaagaauggcuccucuguuuacaacacacccaac

SEQ ID NO: 4186013 - RNA, 72 nt, Human
gugggguugcagguuccagaguacuuacauccuuaaaggacauaaacaucuguagccuucagucacccccac

SEQ ID NO: 4186014 - RNA, 63 nt, Human
gugggguuggcagaggucucguuguggcugaaucacagcccaacuucuucugcccaauccugc

SEQ ID NO: 4186015 - RNA, 90 nt, Human
gugggguuuccaggcccacucgguggggcucguuuacuuggacgagggcagggcagagagcaccgaccagagugccucaaaauaacucac

SEQ ID NO: 4186016 - RNA, 62 nt, Human
gugggucagaaauuuaggcuggacuuggcugggaaccucugcuacuggaugagcuugcccac

SEQ ID NO: 4186017 - RNA, 58 nt, Human
gugggucauaauucuugguuugugauaauauuuaguuacaucagaaauccugacccac

SEQ ID NO: 4186018 - RNA, 90 nt, Human
guggguccaagcugccuuggcugaggagggagcugaggaggugugagccccugccaggaacccccugcccagaccauguacuuggcccac

SEQ ID NO: 4186019 - RNA, 63 nt, Human
gugggucgcuggguguauuuuaaucugugacauuccacacuuuguguacucaccagcacauac

SEQ ID NO: 4186020 - RNA, 56 nt, Human
gugggucuggcuuugagggucagcagaauucagguugcuggcagggacaggcugau

SEQ ID NO: 4186021 - RNA, 76 nt, Human
gugggugaggcuuccuguuaagucguucugagaacugcaguuuucagagcuuuggagaccaggaaugccugccaac

SEQ ID NO: 4186022 - RNA, 62 nt, Human
gugggugagggaguggaacgaggugccgggacucccagcccaggguucugcucugcaccagc

SEQ ID NO: 4186023 - RNA, 78 nt, Human
gugggugaucagcaggucucagcagcuccuuggcuccuauacuccuagaggagcuggugauaccgugggaugcccugc

SEQ ID NO: 4186024 - RNA, 82 nt, Human
gugggugcaauaaauaggagagguuucuuuucaucuuuaauuuucaaugacugagaaacuucagcuauucuuuugcuuacau

SEQ ID NO: 4186025 - RNA, 58 nt, Human
gugggugcccacgaggccaggcugguccggagaggaugcucugggcugugggaccugc

SEQ ID NO: 4186026 - RNA, 73 nt, Human
guggguggcagagccaguaaguggcugagacagaacucacucuaggaucugcuggcuccaaccuggcaucuau

SEQ ID NO: 4186027 - RNA, 66 nt, Human
guggguggguagaggugauagaagcaguguauuugagagagcucacaacugucaccgccaccacac

SEQ ID NO: 4186028 - RNA, 63 nt, Human
guggguguaagagaagcuaaccagaggaagugaaucacuuccuguggucauucuucugcccac

SEQ ID NO: 4186029 - RNA, 63 nt, Human
gugggugucaguaucuuuaacggccuucauucuugguugugagauuuuauuugauaugcccac

SEQ ID NO: 4186030 - RNA, 55 nt, Human
gugggugugagugacggcguccugguggccggccggcccgucaccuucuacccgc

SEQ ID NO: 4186031 - RNA, 69 nt, Human
guggguucuuggcuaggcccuggggaugcaauggucaauaaguuauccuccagcccucuaggaaaaugc

SEQ ID NO: 4186032 - RNA, 56 nt, Human
guggguugcugaagaaccuacuagaggcauucugagaggugaauucagcaaaccau

SEQ ID NO: 4186033 - RNA, 56 nt, Human
gugguaaagcugauugaauugaaguuuugcaagucuuugaaaucagcuguugccau

SEQ ID NO: 4186034 - RNA, 78 nt, Human
gugguaagaacuggaaccauucacugaacaguucaacugacuauucacuugaccacugaaugguucugaacuugcaac

SEQ ID NO: 4186035 - RNA, 81 nt, Human
gugguaagaauuaaaaccuaggaagcaguuucaacagccacaaacgcauacaaacacuucuuaggucuuaagucaguucac

SEQ ID NO: 4186036 - RNA, 56 nt, Human
gugguaaugugugcguguguguauaaauauuuauacacauauauacacguuuaagc

SEQ ID NO: 4186037 - RNA, 59 nt, Human
gugguacagcugaaaggcuugcucauuguaccacugcaaaucugauaggauuguaccac

SEQ ID NO: 4186038 - RNA, 117 nt, Human
gugguagaaacaggaaaagaaaagguggagggaagauugaagggcacuccaguggucauuguuuccuaaggaggcccaguagugcugccuuuauauaacuuucuauuugauuaccau

SEQ ID NO: 4186039 - RNA, 102 nt, Human
gugguagagcuggguaaacugacagggugaccagagcuccaagucacuccuuucuggcugugaguggcugcuucugguugcuccaguguucugaucuaccau

SEQ ID NO: 4186040 - RNA, 57 nt, Human
gugguagagucuggaacccacucuggaacccaggcagucugacuagacucugcucac

SEQ ID NO: 4186041 - RNA, 60 nt, Human
gugguaguacugggucaaagggugagauuguucacaaggcucuugauucauauuaaccau

SEQ ID NO: 4186042 - RNA, 79 nt, Human
gugguaguggccauacccaggccccuucccauggaaggccuuaucuucuguucccuaggaccuggggaggccuuaucac

SEQ ID NO: 4186043 - RNA, 86 nt, Human
gugguauauaguauuuagcauagugguuagugcuuaguaagcacgugauggauguuagcuaguacugcaggugcuauggaaaucau

SEQ ID NO: 4186044 - RNA, 57 nt, Human
gugguaucugucucccccacuggagugugagcuccugugggcaaggccgauguccau

SEQ ID NO: 4186045 - RNA, 82 nt, Human
gugaggaugcaugagggggguuaggaaguuggagaaguaagaugaucaaauguccuaaauugccuccacuuuaaugccuuau

SEQ ID NO: 4186046 - RNA, 98 nt, Human
gugaggcagagagugggaaaacgcagggaaugugggcacuuaugucgguuaaggugucaaauuuuacaugucuggguuuuguuuccaccaggcuccac

SEQ ID NO: 4186047 - RNA, 64 nt, Human
gugaggcaggcacuguuaucagcaccauuccuacugagaauugugcaggacaugucugccuuau

SEQ ID NO: 4186048 - RNA, 86 nt, Human
gugaggcccugccuggugcugauucacugacuucuguucagucucugcaccagagcguccagugaauuccaggccccgcgucucac

SEQ ID NO: 4186049 - RNA, 75 nt, Human
gugaggccugcccuggggaaguucgucacccaagaacagcagaggaugaagggaacagccggggcuggcacucac

SEQ ID NO: 4186050 - RNA, 56 nt, Human
gugaggcugggggcaauggucagagugucuguagauacucacccucccccucucac

SEQ ID NO: 4186051 - RNA, 83 nt, Human
gugaggcuguguggggauaggaggguuggagaccaugucucuaucucaugcaucaacucuucauccuucaaucaucuccucau

SEQ ID NO: 4186052 - RNA, 68 nt, Human
gugagggagggaaaguuuaacacuccccaaccccaaggauaucagagugauaguuucccuccagucac

SEQ ID NO: 4186053 - RNA, 56 nt, Human
gugaggggcucugacacccugugugggccccgcacugggaagaaugagccugucau

SEQ ID NO: 4186054 - RNA, 76 nt, Human
gugaggggcuggggguaaacgggaaaggaggugggugcaggaaacaccuucucugaguucuccuccagccccacgc

SEQ ID NO: 4186055 - RNA, 78 nt, Human
gugagggugcaauccucauagaacucauugcugggaagauguggccagugaugaguuccgugaggacugaauccucac

SEQ ID NO: 4186056 - RNA, 77 nt, Human
gugagggugucugcguaacuggcaucggaaucgaaaggccccgccucccccaugcacgggugcgcgcacacacucac

SEQ ID NO: 4186057 - RNA, 64 nt, Human
gugaggguugcuuucuuucggggucuccgugcuuggugacgcucuggagaauaguagcuuuugc

SEQ ID NO: 4186058 - RNA, 64 nt, Human
gugaggucaugcaaaauugaaucagguauuuggaguuuuguuccugauucuaccacugacucac

SEQ ID NO: 4186059 - RNA, 57 nt, Human
gugagguccucccugcugggagaguuccauggauguucuuggggaggagggcugcac

SEQ ID NO: 4186060 - RNA, 125 nt, Human
gugagguuccaggcuuucuuccuagaugcagucccugacacccggguggaggcggggagguaaagaaugccugccucacccugucuggcagggcagaucuagaauuaaaggucuucaagauucac

SEQ ID NO: 4186061 - RNA, 79 nt, Human
gugaguauaguguaguucuucuggugggaaaauuauauaacguuaaaucauccuucuucaugaagauauauguauucau

SEQ ID NO: 4186062 - RNA, 98 nt, Human
gugaguauccuuucugcuuuuuaaaaugcuuggguuuucuuucuaugaauuuccauuaaugagcaucuuuaggaagagaaagauucugcuuuauucau

SEQ ID NO: 4186063 - RNA, 76 nt, Human
gugaguaugaguguauguacauaaaauacauauuuuaacggaaucugaauauuuauguguauucauauaugcacac

SEQ ID NO: 4186064 - RNA, 80 nt, Human
gugagucccuaguggaaagacaugaucuaaauggcaaacaucuuucuucaaaaugacugugcuuucucuggaggcaucau

SEQ ID NO: 4186065 - RNA, 65 nt, Human
gugaguccugugggcccaccaugagccaggcucugggcuggggcucagguggcucagggacugau

SEQ ID NO: 4186066 - RNA, 76 nt, Human
gugagucuuggccagggggucagcaggcacuuggcuccagccaacuuuuguccgaucuccuggaauccagacuuac

SEQ ID NO: 4186067 - RNA, 101 nt, Human
gugagugaaaaggcauggauuugaagauuuguccacagagugaugaauggcuguacucucaguuucuaucugugugaaaaucuacucguccucacagucac

SEQ ID NO: 4186068 - RNA, 71 nt, Human
gugagugggaccugcgugugucaucccuucccucagcuuggagguguuugaccucacaggucccaucugau

SEQ ID NO: 4186069 - RNA, 92 nt, Human
gugagugggcagggccccuggaucccagcacugaccucaguuacaugaagagucugaguccauggcaggaucugggcccacagucuucucac

SEQ ID NO: 4186070 - RNA, 65 nt, Human
gugagugugaagaggggugugugucaacccaaggcuauucuuaguugaucccuucucauaagaac

SEQ ID NO: 4186071 - RNA, 91 nt, Human
gugaguuaccacuuuacccccacuaggaugguuaaagucuaaaagacaguaauaaguguuggugaggauguggagaaauuggaacccuuau

SEQ ID NO: 4186072 - RNA, 130 nt, Human
gugaguuaugauugccaccacugcacuccaccuggugacagagcaagaugcuguauuguuguuguuguuuugagauggagucucacucuuguugcccaggcuggagugcaauggcacaaucucggcucac

SEQ ID NO: 4186073 - RNA, 92 nt, Human
gugaguuccuccgugugauagcauuacaucucuaggcuaggaauuuuuuauucuuaagcguaugauaaugaaauuuucauauggaaagucac

SEQ ID NO: 4186074 - RNA, 65 nt, Human
gugaguuguuucaaaaugaugcuguaacuuggcaaggacugcagaacuauuuugaaaaauuucac

SEQ ID NO: 4186075 - RNA, 65 nt, Human
gugaguuguuuucacaaacccaugauggauaauggcuaauggguaguacugugguaacaaagcac

SEQ ID NO: 4186076 - RNA, 60 nt, Human
gugauaaaauucaaauagcucugacucccuggagaacaagaggauauuggauuuuuucau

SEQ ID NO: 4186077 - RNA, 66 nt, Human
gugauaagcuuuggugacugugauugcauugguuggcagcagauggcagugaucaaaagcuuacau

SEQ ID NO: 4186078 - RNA, 81 nt, Human
gugauaggggagaaggagucaagaggaacuugucauauuaucugaagcugacuagucauuugcauuccgucuccaaaucac

SEQ ID NO: 4186079 - RNA, 89 nt, Human
gugauauagcuuauaugagauagacuaugucauacagguuauaugauauagguuaugugauauaggcuauuugauauagguuauaugau

SEQ ID NO: 4186080 - RNA, 67 nt, Human
gugauauuugggaaagggauuaugaguagauauuggguguuuacuacaauauuucuuucuauauuau

SEQ ID NO: 4186081 - RNA, 130 nt, Human
gugaucaccuaaaugaguucucaccucugggacuaauugcuuucuugugcugagaagugaggaugacuguugauuuaguacaagagauuaauuacuuucagagcuccuucagagaucauuuguacuccau

SEQ ID NO: 4186082 - RNA, 78 nt, Human
gugaucagcugcuucaagaugaagcugaucuucccagccacaggcugccaggagcucauugaaguggaugaugaacac

SEQ ID NO: 4186083 - RNA, 128 nt, Human
gugauccagagcacgcgacggaggcgccgggcaucccaggaggccaauuugcugacccuggcccagaaggcuguggagcuggccucacugcagaaugcaaaggugagaguggcaugcaguggagccac

SEQ ID NO: 4186084 - RNA, 55 nt, Human
gugauccuccugccucagccucccaaagugcuggcauuacaggagagaaccucac

SEQ ID NO: 4186085 - RNA, 67 nt, Human
gugaucgugguggggauauuuuacaggagaucugcuagcagagucuugggaucucuucaccaccuac

SEQ ID NO: 4186086 - RNA, 86 nt, Human
gugaucuggugguuucuuuggcugccuucaccccuggccacaucuggguguguucuuugggcuaaggcaguaaaucaccaguucau

SEQ ID NO: 4186087 - RNA, 81 nt, Human
gugaucuguaaacuuucagcccuagaaagucuaagcagaacauuuucuuagucuuuuagaggcugcuguggggccagacau

SEQ ID NO: 4186088 - RNA, 58 nt, Human
gugaucuuuuaggucacacagcuaaugcuuuguaaagcauuuccuaaauccagaucgc

SEQ ID NO: 4186089 - RNA, 89 nt, Human
gugucccuuagagcuuaggcuagccauucagucuuuuccuuuucuagguaacuaacaguggcuggacuauggcuuugaauaugggucac

SEQ ID NO: 4186090 - RNA, 69 nt, Human
guguccgaaaguuuucucacacaguaauguaaucaaccccauuuuguggcuguggaaauugucaggcac

SEQ ID NO: 4186091 - RNA, 55 nt, Human
guguccucuaauuggccucuugcacaggaguguguagggaaucuuuugggggcac

SEQ ID NO: 4186092 - RNA, 66 nt, Human
guguccugcuuacugcuuuggacguguggaauauguuguaagugccagggccaguaagauuggcau

SEQ ID NO: 4186093 - RNA, 55 nt, Human
guguccugggcacugacuagacuugcuggguguguaagaaggccugcccagacac

SEQ ID NO: 4186094 - RNA, 61 nt, Human
guguccuucuuccucaucucauuugcuuugugagcaauucaugggcugaggaaggggucac

SEQ ID NO: 4186095 - RNA, 57 nt, Human
guguccuuuccgggccuggaggcuuggccccuccucucccaagccuggcaggggcac

SEQ ID NO: 4186096 - RNA, 67 nt, Human
guguccuuuggcucuggagcuccugggcccggguuccgcauccgggaggagaaaggagcgagcgcgc

SEQ ID NO: 4186097 - RNA, 84 nt, Human
gugucucagcuuggaauaucuuguaucugaccucauaaaauugauccugauuuugugggugguaaaauacaaugauagaggugc

SEQ ID NO: 4186098 - RNA, 80 nt, Human
gugucuccagcacuguauaggugucuggaauugagauaagaaucaauuucaauacaaaauacauuuuuugcuuaaagcac

SEQ ID NO: 4186099 - RNA, 77 nt, Human
gugucuccgccugcucauguuggcugcuauagacccccucccagauuuuucuucacagccaacaugggcacacacac

SEQ ID NO: 4186100 - RNA, 84 nt, Human
gugucucgaaguuucugaugcaaagcauuugaaugggcuugacuacuugcucagaacaaaugcaugagaaauaagagggaauac

SEQ ID NO: 4186101 - RNA, 66 nt, Human
gugucucuuggcucuaucacuuauuaguuguguuugugacuuuaaguuccaugagagcagagacac

SEQ ID NO: 4186102 - RNA, 57 nt, Human
gugucugagcccagugagucucgcagggccucccugccuccaccgagggccaggcau

SEQ ID NO: 4186103 - RNA, 112 nt, Human
gugucugaugcaauucuugugcccuuccuugauuuuaacuggauagucuggaccauuugugucuuaaaggcaguguuccagcagaaaagagguagggaugagacaugcacac

SEQ ID NO: 4186104 - RNA, 55 nt, Human
gugucugccacccacugacggucaguauugauuuugcugccuuggauggcuacac

SEQ ID NO: 4186105 - RNA, 57 nt, Human
gugucugccuucuauuuagaaagaaaguuaaucuuuuugaaucugauauggcagcau

SEQ ID NO: 4186106 - RNA, 58 nt, Human
gugucugcuugcugagcauuuaauugggugcaaauguuaagugcaaagagacagauac

SEQ ID NO: 4186107 - RNA, 105 nt, Human
gugucuggaggcuucuguauuagacagugcaggucucaacaauuacuucaacuagaacaaaaaguagaauugaguuucacuguucccuugcaaauuuccagaagc

SEQ ID NO: 4186108 - RNA, 56 nt, Human
gugucuuaggguugcacagagucucccucacuggagggaguguaacuaugagccau

SEQ ID NO: 4186109 - RNA, 112 nt, Human
gugucuuauacccacauuccaccagccagaaguuagucauugaagccccaccucaaugcaagguggggcucuaugacuaacuucuggcugguggaauguggguagaggacac

SEQ ID NO: 4186110 - RNA, 65 nt, Human
gugucuuauugauguuggcacucccuaacauguacauaggauaguguucagcauguaguaaauac

SEQ ID NO: 4186111 - RNA, 82 nt, Human
gugucuuccagcgagccggcggcuuguuaucaagaauccguuuagaauguuugaacucagccucugggggagcugggagcac

SEQ ID NO: 4186112 - RNA, 79 nt, Human
gugucuugcaccacucuguuguuccacugcuguagcaauauauuuaagugguaaugaacacgcugguggugcaagaaac

SEQ ID NO: 4186113 - RNA, 60 nt, Human
gugucuuguguggagcucuaugucuagccucuagcauaauuccugacacacaagaaguac

SEQ ID NO: 4186114 - RNA, 70 nt, Human
gugucuuuaacaaggacuaaggaacagcugauucauucaugcauugaacuguuuuuaaguccuaagaugc

SEQ ID NO: 4186115 - RNA, 67 nt, Human
gugugaaaaugugcacaauaugguucaauugauggaaguauguuguauaaucauguuuuggucacac

SEQ ID NO: 4186116 - RNA, 73 nt, Human
gugugaagcaaucucuggggguggagcugaggaaucugcauuauuaacaguuuccugggagauucuuacacac

SEQ ID NO: 4186117 - RNA, 72 nt, Human
gugugacaggugaaauguccuuauuaaaaauaguaauaguaaugacaauuuuuaucuguuaauauuuagcac

SEQ ID NO: 4186118 - RNA, 73 nt, Human
gugugacuuuggacuagugauuuaauaaccuugaacuucagcuucuuuccuuaaacacuaguucgaguagcau

SEQ ID NO: 4186119 - RNA, 64 nt, Human
gugugagcaagauucagagauuccagcucucagacuuuaagcuggaagucagacuuucucacac

SEQ ID NO: 4186120 - RNA, 65 nt, Human
gugugagcagaguuguuucuccugaggccccucuccuuggccugcagauggcugcugccucacau

SEQ ID NO: 4186121 - RNA, 95 nt, Human
gugugagccacugugcccaucuauaagucuuuauuaguguuuuuuguacuugagcauauagacacccagugauugagacuugcccagggccacac

SEQ ID NO: 4186122 - RNA, 82 nt, Human
gugugagccaugauguguccagagcuccccacauaggaucgaguuaccucugggaggauaugguacauaauauggcauccac

SEQ ID NO: 4186123 - RNA, 65 nt, Human
gugugagcugguggauuaugcuguacaggaauuugucaaagccugaaucacauagacaaacacac

SEQ ID NO: 4186124 - RNA, 88 nt, Human
gugugaggaaaaaccuaguguuuuaaagacauuuguugaucuaaugucuaaugaauuaauuaauuacuagguuguauuuuuccuacac

SEQ ID NO: 4186125 - RNA, 58 nt, Human
gugugagugggacagugugggacuacugggaagauaagucugauaaaaacuacuccau

SEQ ID NO: 4186126 - RNA, 95 nt, Human
gugugcaauccugggucccugggccggggcauggacauugcucaccaggcagccuucccaugaccccuggcauccaggguccccagggcugccac

SEQ ID NO: 4186127 - RNA, 79 nt, Human
gugugcacaugugugugcgagcguguguguguguggacuugcucacgcgggcacauaugcuguaagcacauguguucau

SEQ ID NO: 4186128 - RNA, 84 nt, Human
gugugcaccaucucaaccuuuguucaagcuacugauagcuucuguacacuauacaguaucuuuugaaggcagaaugugacauau

SEQ ID NO: 4186129 - RNA, 61 nt, Human
gugugcagaggcaggaggugcugagcuguugguauaagcagacuucccuucucuggcacac

SEQ ID NO: 4186130 - RNA, 56 nt, Human
gugugcaggggcuugguggagcuguggaaguggguaccagccaaagcagggcgcau

SEQ ID NO: 4186131 - RNA, 68 nt, Human
gugugcaguguuuguccaguguccagcuucaucccgucaugggcagacugguuauacacgggcaacac

SEQ ID NO: 4186132 - RNA, 87 nt, Human
gugugcaucugugcccauguaugugcacguguguuugugugugugcaugcacacaugugucugcaugcagugucucagauccuacau

SEQ ID NO: 4186133 - RNA, 58 nt, Human
gugugcccgggggaagcagguguguuucagugugugccgugccuccccguggguacac

SEQ ID NO: 4186134 - RNA, 59 nt, Human
gugugccuaugaguggugaacauuauaccaguaaucacaauauugcuacauaggaacau

SEQ ID NO: 4186135 - RNA, 64 nt, Human
gugugccucgccaagcugucggcaugaugaacagcuucccuuggcugagcagauaacaguacac

SEQ ID NO: 4186136 - RNA, 72 nt, Human
gugugccucuauagaugugugcaucuauuuuucugugcaucuauagauguguacaucugugagcuugcaugu

SEQ ID NO: 4186137 - RNA, 65 nt, Human
gugugccuuuuggugaaguuguugagaauuuuaaugcauuuuaguucucauucaucacggccuau

SEQ ID NO: 4186138 - RNA, 67 nt, Human
gugugcggguuccugagggcugggacucccagggccccaugggaaaguguagccugcaggcccauac

SEQ ID NO: 4186139 - RNA, 61 nt, Human
gugugcucagcucauuuggauaagcacguggaauaccuuaguucagauggaaagaguaugc

SEQ ID NO: 4186140 - RNA, 74 nt, Human
gugugcucagugggccuugcagggugcagggggcucuggugcgccucugcaucccagcaggcuccggagcucgc

SEQ ID NO: 4186141 - RNA, 64 nt, Human
gugugcugggaauggaggcauaacauaauauucauguuuuaaaugugucuaauuccaggagcac

SEQ ID NO: 4186142 - RNA, 123 nt, Human
gugugcugggcccagcagaguaguucuucuagacuaggcugggcucccucaugugucugcagucagcugccaagucacuggaagccugaauagucuaagauaaccucagcugggauggcacau

SEQ ID NO: 4186143 - RNA, 84 nt, Human
gugugcuuccauaucugucuuugugaguucacuuuaaauacaugcauaagauuguagugaauuuaaaacacugaggagguccac

SEQ ID NO: 4186144 - RNA, 70 nt, Human
guaggcacuuucugggcccugggggcauaguccugaaugagagaacaugucucugccccagagagcuuac

SEQ ID NO: 4186145 - RNA, 63 nt, Human
guaggcagccagcaucaguugggucaauagcaauaggugauacucacugauguugccugucac

SEQ ID NO: 4186146 - RNA, 61 nt, Human
guaggccagugugaaaccugguaggagccacagaacagugugagguuuuacauuggccuac

SEQ ID NO: 4186147 - RNA, 67 nt, Human
guaggcuugguuuauagaaguaaucacuaaaagcaauugugauaaucugacaaagacuuaagcuuac

SEQ ID NO: 4186148 - RNA, 91 nt, Human
guaggggcagcucuggguguagaaagaacccucuggggucgugucaaagauggaccagagggagagucuggaggccgggagaagcuggugc

SEQ ID NO: 4186149 - RNA, 62 nt, Human
guaggggguggaaucuuuagauggcuccaaguuccuggcccucugauguucacacccuguau

SEQ ID NO: 4186150 - RNA, 72 nt, Human
guagggguuuggaaaucaaggggacaaauugugggguguuaaaaaccacaaacuuauuuccaaaccuauggc

SEQ ID NO: 4186151 - RNA, 76 nt, Human
guaggguaaaagcuuuuguuuucguaacuguuucugugccacacacuccaccagauagaaugcaagaccucucuac

SEQ ID NO: 4186152 - RNA, 77 nt, Human
guagguaacauugaagaaaauauguaagacuuguaguauuugacugacaaguacauaauuucauguucuaagccugc

SEQ ID NO: 4186153 - RNA, 68 nt, Human
guagguaauggcaacaguccagaaguguggaugccaaaaauucacauucuuuauuugccauccuuuac

SEQ ID NO: 4186154 - RNA, 91 nt, Human
guagguagcucuuuggaggcccagcuugaagugggaaggguuuccuauugaacccucucccuugggugggcuuuggucugugacuaucugc

SEQ ID NO: 4186155 - RNA, 90 nt, Human
guagguauugacuuggugucuuuuuuauacauguugucauuucauagacacuggcugaaaguaaagaacaccaauaaaguccuuauuuac

SEQ ID NO: 4186156 - RNA, 59 nt, Human
guaggucuagggcgaaauccagaaacucguuuuugucaagcagauguccucuggacuac

SEQ ID NO: 4186157 - RNA, 56 nt, Human
guaggugagugggagaagaggcugccgacccagguaucuguccccucugauccugc

SEQ ID NO: 4186158 - RNA, 98 nt, Human
guaggugccagccuaggggagcuuccaaggaggggaaggcaaagcccuggccccugccuguguccccuucuuggcauguuccacaugcucgguccugc

SEQ ID NO: 4186159 - RNA, 66 nt, Human
guagguggcagcaggagauguggaaacuuggccauugaaaaguuccuauuuccugaugcaacccac

SEQ ID NO: 4186160 - RNA, 83 nt, Human
guagguucucugcagggcccaaggucaacggaacauuccaggccgacuuuccucugggcccugccacccacggaggaaccuac

SEQ ID NO: 4186161 - RNA, 83 nt, Human
guagguucucugcagggcccaaggucaacggaacauuccaggcugacuuuccucugggcccugccacccacggaggaaccuac

SEQ ID NO: 4186162 - RNA, 80 nt, Human
guagguuuaugaauguguauaugaacauacagguguguguaugugcaaguuugugugaaggugugugcauguguuucuac

SEQ ID NO: 4186163 - RNA, 55 nt, Human
guaguaguggucauaauagagaaguuauuuagacucuugugugcugcccugcuac

SEQ ID NO: 4186164 - RNA, 87 nt, Human
guagucaagagaucauaugcaguaaugaacucuauggaagaggauuaaauaugacauucauuugguaaaugauuucuguaugauuau

SEQ ID NO: 4186165 - RNA, 60 nt, Human
guagucacuuaugugcagcugcugaacucuccaaacaaacagcugggcaauuaugacuau

SEQ ID NO: 4186166 - RNA, 91 nt, Human
guagugauaggucagaaugaaauagccuguuggauguguaauauguagagucuacauuauuuaggccuauuguauucuuaucuguauauac

SEQ ID NO: 4186167 - RNA, 67 nt, Human
guaguggcagagccagguuucugauucauauuuuucugauuccagagccuaagaucugauccucugc

SEQ ID NO: 4186168 - RNA, 57 nt, Human
guaguggccagaccaugggucaggucuguccgguuuggauccagcucugccacuuac

SEQ ID NO: 4186169 - RNA, 85 nt, Human
guagugggugggguaucaguuauggaauggcaccuccuuccagaggacugaucaugucauuuucagcuuaugcuucccuuuaugc

SEQ ID NO: 4186170 - RNA, 68 nt, Human
guaguguaucuucuuucucucugcuaaugcugaaagggauaguacaagggaagagugaaggucaauac

SEQ ID NO: 4186171 - RNA, 59 nt, Human
guagugucccaggcagcguucucccgugugcaaaggguuaaaugugcuugggagacugc

SEQ ID NO: 4186172 - RNA, 68 nt, Human
guaguguguuuguggguugacauuugaagcuucuuauuacaagaggaauuggcucaugcaacaccuac

SEQ ID NO: 4186173 - RNA, 75 nt, Human
guaguuaaaugguuaagcugggguuaaaugcagggagucuaccuccuggguguguccucuuaacuauuaugcugu

SEQ ID NO: 4186174 - RNA, 56 nt, Human
guaguucucugaagauguagggugacauccuagccaaucauccucagacucucugc

SEQ ID NO: 4186175 - RNA, 91 nt, Human
guaguugaugcuuuugagcugcuucuuauaaugugucucuuguguuaaggugcaucuagugcaguuagugaagcagcuuagaaucuacugc

SEQ ID NO: 4186176 - RNA, 92 nt, Human
guaguugucuacacuuuguuuuccuagguuagcuuuuugggcccucauuagcagaagauggcagccaggaggguguaguuuuccacaauuac

SEQ ID NO: 4186177 - RNA, 77 nt, Human
guaguuguucguagcacguaguuucuuaucagugaguaggacugagaguucaaguggcugcugcaaaugagcacuau

SEQ ID NO: 4186178 - RNA, 78 nt, Human
guaguuuacuaguugagaguuuggauucugagccagccacacuggagucagaauucuagcucuucccuuauuagcuau

SEQ ID NO: 4186179 - RNA, 130 nt, Human
guaguuucaugauaacaaaauuguuaacucugcuuauaguuuguccacagucaugcauauaaaaguuuaaaggacauugcauggauacagcugauagcaggauuugacucacucuuuuuucuaauacugc

SEQ ID NO: 4186180 - RNA, 81 nt, Human
guaguuuggaagaagggaaggccauugaucuuccaguccugguguggcaggcagugcagaguccucuucuuccagcacugc

SEQ ID NO: 4186181 - RNA, 87 nt, Human
guauaaaacgaaagcucaauguguauauauaaaauccaccaagaggccugauaaugcaccuuugaguauggcugcuuuuguuuuugc

SEQ ID NO: 4186182 - RNA, 97 nt, Human
guauaaccuaaggagaugguuaaaaugcagauuaugacucaguaggucuggauugaggccagaaagucugcauuucuaacaagcucucacguaaugc

SEQ ID NO: 4186183 - RNA, 78 nt, Human
guauaauuaacaaacaguuaaguguggaugguaaaacuucccuagguccuaucuagaacugaaacucuguaauuauau

SEQ ID NO: 4186184 - RNA, 86 nt, Human
guauaauuaagagucaauuaagggccauuauggaugggugcuuaaagcaucaagugaagggcucuugaagguugcuuuguuugugc

SEQ ID NO: 4186185 - RNA, 81 nt, Human
guauaauuagcauguuguguuguuaaaaucucagugauaaacuugcauauuagcaacagagcucuuguuuccacauuauac

SEQ ID NO: 4186186 - RNA, 125 nt, Human
guauacaaauuuagaauuaaaauguuuucuauuuuuuucaugauuaacuuagugaauaacuuaaauccuuaauccucguagugguuagaaagaugaggagacuuuuuugacuuacauuuguaaau

SEQ ID NO: 4186187 - RNA, 65 nt, Human
guauacaugaaacugccugcuuucuaucuguuuauuggaaaacucuaacaggcagacauguaagc

SEQ ID NO: 4186188 - RNA, 100 nt, Human
guauaccaccgauauccugguguucucagcaacaaaacugaugggaggaauguccauucuguguguacugagaugggcuuggauguguguguggcaauac

SEQ ID NO: 4186189 - RNA, 75 nt, Human
guauaccugaugaucaucuguaaaguuagaguauaucuuuuugcuuucuuuggaguuaguguuauuccaggauau

SEQ ID NO: 4186190 - RNA, 90 nt, Human
guauaccuuuuguauuucugaagcuugauaaacuauaaagccuugaguauucagguucauggcaagguuuagauggauggggagguauac

SEQ ID NO: 4186191 - RNA, 91 nt, Human
guauagaaugcauuuauucuuuauguuaaugaaucuauuugaaauauuuuguggaaucuuaaaugugaaggguaauuguuuauuugauuac

SEQ ID NO: 4186192 - RNA, 58 nt, Human
guauagaugaggaaccugaugguauggucuuucuaccacucucccaccauaucuguau

SEQ ID NO: 4186193 - RNA, 104 nt, Human
guauagcgugguuccguaaauuaagguugauauguaucuagggauuuuauuuauugauguucugacaugugagauuuuguuuguugcugaaucaaaaccuauau

SEQ ID NO: 4186194 - RNA, 103 nt, Human
guauaguauagcuggguuugugggcagcacuaugacauuuaauucuuuaaaaaugacuaaaugaguaaaacagugguguugcauagcuuuccaugauacaugc

SEQ ID NO: 4186195 - RNA, 74 nt, Human
guauaguuguucacagaauaucuaaugucagagcgauucauuauguugacguuuuauagucuuuccaauuauac

SEQ ID NO: 4186196 - RNA, 114 nt, Human
guauauaacucguuuucccauuuaguugcaagacacuuggaagcacagaccaaggcuuacauuuguguuuuaauguuuuucuuguaaaugcuuuaugccuaaauguuucuguac

SEQ ID NO: 4186197 - RNA, 73 nt, Human
guauaugcuuauaaugggaguacagaaaaauagguuuggcuuccuauuuagugaaacccauaaagcauuauac

SEQ ID NO: 4186198 - RNA, 57 nt, Human
guauauucacaaaaugagguccucagggugaccuugagugagugcuguggguguuac

SEQ ID NO: 4186199 - RNA, 81 nt, Human
guauauucuggaaugggagucagacagagaaaugugaucaccucaccaggcuuuagucugcucucacucgcagaagaagac

SEQ ID NO: 4186200 - RNA, 78 nt, Human
guauauucuguauugguuaguaaauaaacauaauuuuaugucuuguguuugcuaaucuuauggugaagcagaaaauac

SEQ ID NO: 4186201 - RNA, 87 nt, Human
guauauuguugccuggacuaaaaucuuuucuuacuuuauuacuagguaagaaaagaagaguaguuaucauuuaggcaguuaaggugc

SEQ ID NO: 4186202 - RNA, 61 nt, Human
guauauuguuguguguaugcgagcaugcaagaacguguguguacaaacuaacaacauaugc

SEQ ID NO: 4186203 - RNA, 117 nt, Human
guauauuuagacaaacuucucauuucucugcaguguucggaauucaucaugccuguaugacaagguuguguuugagaacaaaaggggaccugugugacauguuuuauuucaauauac

SEQ ID NO: 4186204 - RNA, 83 nt, Human
guaucaaaaucaaccaggaggugcuggaagaaagcgggcaaguuguggccugguuguacaaaugcuccugagugaugugaugc

SEQ ID NO: 4186205 - RNA, 62 nt, Human
guaucaagcccuuuucaagauacaacaauacugaaggguucucgaagaggguuaauauauac

SEQ ID NO: 4186206 - RNA, 55 nt, Human
guaucacauauuuacugaguagccugccuggaccuauacaguaauuaagugguau

SEQ ID NO: 4186207 - RNA, 80 nt, Human
guaucagcaucaucugggagcuuguuagaaauguagaaucugcauuuaaccagauccccaggugaaugaaucacugguac

SEQ ID NO: 4186208 - RNA, 71 nt, Human
guaucaucaggaucucucuggaaugccucucacucucugccacugaggauuuauauauuccuugaugauau

SEQ ID NO: 4186209 - RNA, 66 nt, Human
guauccacuagguugauuguuagucagggugagaaggaccuuggccaaauccuccaugguggcugc

SEQ ID NO: 4186210 - RNA, 100 nt, Human
guauccauuuucagagccuuugauuagcaccugaggaaaaaaggguacauggaaagcuauguaauuugcccucaaguuaauuuguuggucugaagaguac

SEQ ID NO: 4186211 - RNA, 59 nt, Human
gugcccacucuuuugauuuguguuucugccuagacagugcacagcaugaguguuggcau

SEQ ID NO: 4186212 - RNA, 74 nt, Human
gugccccaagaggguugcccgcuucagagggaggacacgaagcccccagcucccucgagcagcgaccccuccac

SEQ ID NO: 4186213 - RNA, 78 nt, Human
gugccccagauggagcugaugguagaagaaugacuguucuuuaacucuucuuuccucaucaaguacaucugagcccac

SEQ ID NO: 4186214 - RNA, 68 nt, Human
gugcccccaaaguaacugccuuuccaauuuguuccuaauucaaacuggaaaggcaguuauuucugcau

SEQ ID NO: 4186215 - RNA, 66 nt, Human
gugcccccggcucugccugucucauccugcaagggcgcugaccuuggacaaggccagagccagcac

SEQ ID NO: 4186216 - RNA, 94 nt, Human
gugccccucuuaagagcuuuuguaggugauauagucucucacuuccaaacaugaguucuucacauuaccuacgguggcacuggggguggagcac

SEQ ID NO: 4186217 - RNA, 71 nt, Human
gugcccugcaugccccggguaugccccgugucccagagggaaacguuuacuugcucggcgcugcuggucac

SEQ ID NO: 4186218 - RNA, 61 nt, Human
gugcccugguccccagcauauaaaaugacgauuguacaauuccaguguugagggacuguac

SEQ ID NO: 4186219 - RNA, 69 nt, Human
gugcccuguuuacuggagaagaugaccuguggguaguuccauauuuaagcuagugaaaagaauugguac

SEQ ID NO: 4186220 - RNA, 78 nt, Human
gugcccuguuuugaaacuugcauagagaggaaaugagaugaagagucaaugugcaaucauauuuuaaaauguggguac

SEQ ID NO: 4186221 - RNA, 89 nt, Human
gugcccuuacaacagaguggacguaugugcuucauuuucugauauauuaguaaaucugagaaauauuguccagguuguauaggauguac

SEQ ID NO: 4186222 - RNA, 59 nt, Human
gugcccuuauaaaggaggccugagggagcuuucuuacccuuuccauuuugugagggcac

SEQ ID NO: 4186223 - RNA, 59 nt, Human
gugccgugugauuggcugaggcugucugugccauaggaaagcagaaaucacaccagcac

SEQ ID NO: 4186224 - RNA, 72 nt, Human
gugccuaaagguagucugcugguguacuuuuacaaauagcaccauuaacagaauuuuacaugcuuaggucac

SEQ ID NO: 4186225 - RNA, 87 nt, Human
gugccuaacgauuugcccugccuuggacagccaguccucuucagguggugggcugcugguagggguaggaagcaaggccuggggcac

SEQ ID NO: 4186226 - RNA, 71 nt, Human
gugccuaugucugagugcauaugugcugggggggcucuguugaaucagcacuggcgcugggcagguggcac

SEQ ID NO: 4186227 - RNA, 55 nt, Human
gugccuccaggcucgacuagucccuagcacucgacaacugggucucugaggucac

SEQ ID NO: 4186228 - RNA, 88 nt, Human
gugccuucuuauauauugccagcuuaguggauucugugaugugagcauuaaaaaaaugaauuuacaaguugaauaacaaggaaaccac

SEQ ID NO: 4186229 - RNA, 58 nt, Human
gugccuuugagaaguuucucugaagcuuaaucggaaugggaaaauuucagaaugguac

SEQ ID NO: 4186230 - RNA, 96 nt, Human
gugcgaaaguucagucaaaugguugcacagauuacuugggacugcgccugugauucagcugugcagugauuuguacaauuagaacagcuuucucgc

SEQ ID NO: 4186231 - RNA, 76 nt, Human
gugcgacugcagugcaggccccaggccaggccgcuguuggcccagaggcuuggcaggugcccugcgcaaguugcac

SEQ ID NO: 4186232 - RNA, 58 nt, Human
gugcggagaccuaauuaguauccagggaacacuaggcuugaucacauaggucucccau

SEQ ID NO: 4186233 - RNA, 122 nt, Human
gugcggggcgggacagggagaggggccuccucgggaggagcugagugugugugcgcacguguuugcgcagauggagacgagguuccgccgaggcccgucugucugggagcgccugucugcgc

SEQ ID NO: 4186234 - RNA, 63 nt, Human
gugcgugguucuagauccugucgucccuccgcuugggggcacaacgggcugggacccaugcac

SEQ ID NO: 4186235 - RNA, 87 nt, Human
gugcgugucaucuuugcucugaugggguggacauagcagaaaaucuaacucugucuguagccccauacagaaugccagggugagcac

SEQ ID NO: 4186236 - RNA, 77 nt, Human
gugcuaaacugaaaucuuuauggaaauaacaaaaugagaauuuauauugauuauucagcaaagguuuuauugagcau

SEQ ID NO: 4186237 - RNA, 76 nt, Human
gugcuacacauagauugcucaaugcccaacagaaaauaccacugucagaacaugaagguuaauuugucuggagcac

SEQ ID NO: 4186238 - RNA, 76 nt, Human
gugcuacuggcaucuagugcguugaggucagagaugcugcuaaacagccuacaacgcacaagacagccucuaccac

SEQ ID NO: 4186239 - RNA, 87 nt, Human
gugcucaaggcuuguccuucugguugucuuugcgugggagggagaggagcgcaggacguaacccaggacagccuuccagaaagcagc

SEQ ID NO: 4186240 - RNA, 112 nt, Human
gugcucagggucccguugacguagacuuucaggcccuccuuggauuuccauguaaauaggacaugaguccaauaggggccuggaaaagagugaagaucgccauucugaguac

SEQ ID NO: 4186241 - RNA, 59 nt, Human
gugcucauagaugaugcucuuuuccuguuagcuggcacaugagcuccaucugucagcau

SEQ ID NO: 4186242 - RNA, 58 nt, Human
gugcucccuccagaccacaggcacaauuucagccugaugguauauuguugggagucac

SEQ ID NO: 4186243 - RNA, 67 nt, Human
gugcucccuccagaggcuccaaagggagauuccauuccuugggucuuccagcuucugguggcuccac

SEQ ID NO: 4186244 - RNA, 83 nt, Human
gugcuccguccauacggguuguuaaaaaaucaugaauaucuccuucgguguaauaaugauuauagcaauuuuguagauggcac

SEQ ID NO: 4186245 - RNA, 79 nt, Human
gugcucgggagugugucucagcaccgcugcgcgugcgggggcacaucccugugugcaggugcuggguaccuacgugcau

SEQ ID NO: 4186246 - RNA, 56 nt, Human
gugcucuggguaaagacccacuaccuugauaguuguucaucuggaacccagagcgc

SEQ ID NO: 4186247 - RNA, 61 nt, Human
gugcucugugaggcccuugagaucugggcucauuacuccaagaccucuucccuucaugcac

SEQ ID NO: 4186248 - RNA, 77 nt, Human
gugcucuuccuuaagacuauaaagaaggcugagagaagaaaaagcaaaucaaguggucuuaggugaagaaaaugcau

SEQ ID NO: 4186249 - RNA, 73 nt, Human
gugcucuuguuuauccccugagcaacaaacugaauaccacuauguggcagggauugugcagggggcuagagau

SEQ ID NO: 4186250 - RNA, 130 nt, Human
gugcugaauuagaaucucaaaggcugggguuucggaaguuuucugguugauacucuuaugcagucaaguuuguaaaucacugaacuaaaugagcuuuaaggccuuucucacagaucuaauauuuagugac

SEQ ID NO: 4186251 - RNA, 69 nt, Human
gugcugagauuggagugagcagaacugcauaucucauuccagcugcagcucacuccaauaguuuaguau

SEQ ID NO: 4186252 - RNA, 61 nt, Human
gugcugagcacagcugcccaggcagaagaggaaggaacccagggcuccuguggcugcagcc

SEQ ID NO: 4186253 - RNA, 57 nt, Human
gugcugagcugcagaugcgcucugacaagcacguagagugcagauguccuuucacac

SEQ ID NO: 4186254 - RNA, 68 nt, Human
gugcugaggauacagcugugaacaagagagacaagggcucugcauucacagagaguauauucuaguac

SEQ ID NO: 4186255 - RNA, 57 nt, Human
gugcugaguagaaugaaugccuuuggucccaaagguuuuguuacuagauucagaugc

SEQ ID NO: 4186256 - RNA, 60 nt, Human
gugcugauggccaccccuguuccucccacagacacggccauggagcaggcacgucagcac

SEQ ID NO: 4186257 - RNA, 72 nt, Human
gugcugcagggccuccugcaccuggagcccacccuccgcuccagccagcugcucugggaggcccuggagagc

SEQ ID NO: 4186258 - RNA, 65 nt, Human
gugcugccaggucuugcuguccauccuuaauuaaauggugggugggcgaggcaggaguggagcac

SEQ ID NO: 4186259 - RNA, 81 nt, Human
gugcugcugccuuuggcaauaauuguaauucaauuuaugcauccacaaaauuauccaauccuguugccuaugcagugucac

SEQ ID NO: 4186260 - RNA, 56 nt, Human
gugcugcuugggggcagagcaguuucuggucacagaagaaagcccucaggcgacac

SEQ ID NO: 4186261 - RNA, 65 nt, Human
gugcuggaaggugggugaagugcagauacuccuuuuuguguguggcuguggaugcuuuccagcac

SEQ ID NO: 4186262 - RNA, 74 nt, Human
gugcuggaggccaugaggcucuaggugcuaagaaaacagaaagcgcuuggggacggggcuccaggugacagcac

SEQ ID NO: 4186263 - RNA, 70 nt, Human
gugcuggcaguggcagugaugguagcaguccuggugcuguuagugguggccguuugucugcugcuagcac

SEQ ID NO: 4186264 - RNA, 55 nt, Human
gugcuggcccaguauggacugcagguuugacuuuugcaggauuccaggucaguau

SEQ ID NO: 4186265 - RNA, 126 nt, Human
gugcuggcugguaggguggugugggcagaggagcucuguguagccugaggguuccugagggagacaggcaggcuucggccagagcaguucugagaauggauuccaguaguauaauggcagcagcau

SEQ ID NO: 4186266 - RNA, 61 nt, Human
gugcuggugcccuacacauuuccaguuuuccaagcaaauguucacggggagcauagagcau

SEQ ID NO: 4186267 - RNA, 69 nt, Human
gugcuguauugagacaaggucguauuucaaucugugagagaaaauaaucccauugucuggaagcagcau

SEQ ID NO: 4186268 - RNA, 67 nt, Human
gugcugucuuugucuugguaucccuagugcagugcccauccucaggccuggcccaggaugauggcgc

SEQ ID NO: 4186269 - RNA, 77 nt, Human
gugcugugcuugcccagugucuacugucauugcuguggauacugcagugucagugccugggugguuccacacaucgc

SEQ ID NO: 4186270 - RNA, 63 nt, Human
gugcuguguccuggcugauguucgcugagaguccagcacucuaaaucauccugggucaugcac

SEQ ID NO: 4186271 - RNA, 83 nt, Human
gugcuguuucuauucauauuggauaugguauucuaugguauuggcuauagauacauacauuuuaaaauguuauuuaacagcau

SEQ ID NO: 4186272 - RNA, 82 nt, Human
gugcuuagaaccauucaguuaccacugauggccuucacacaaggccacaagugguccugaguccucacaaggaucagagcac

SEQ ID NO: 4186273 - RNA, 60 nt, Human
gugcuucugccaacuaauuaacaccuccuuugcaagcuguaaauuggacggcagaugcgc

SEQ ID NO: 4186274 - RNA, 104 nt, Human
gugcuuguuuguuaucugucugucugcuguccgaguauauucucacagauaaaauggggaagagcuccaaaaacagugagagaagguauucacagauaaagcau

SEQ ID NO: 4186275 - RNA, 73 nt, Human
gugcuuuaauaagauuucacuuucauuucccugaguagcuauguucuggggccugugaaucuucuuggagcau

SEQ ID NO: 4186276 - RNA, 58 nt, Human
gugcuuuacaaacuauaaagugcgguacaaauaucguucuugucaguuuauaaagugc

SEQ ID NO: 4186277 - RNA, 55 nt, Human
gugcuuuccauccucccugcugccacugcucaggagggcagaagugcagaggcac

SEQ ID NO: 4186278 - RNA, 76 nt, Human
gugcuuuuucaguaauuagguuccaucuuugaucaagagaaaaucaaagugaggacuugaguacugugggagucac

SEQ ID NO: 4186279 - RNA, 64 nt, Human
gugcuuuuugauaugguuuauguauaugcccaacuccuaaugcacaaaccuguuaguagagcac

SEQ ID NO: 4186280 - RNA, 59 nt, Human
guggaaaagaugggaugcaggagugggagauaacuuuucacuguaugucuuuuuuugau

SEQ ID NO: 4186281 - RNA, 60 nt, Human
guggaaaagcuagguuuugaaucugaguuuguuuuucuucaaagcuuaagcucuuuccac

SEQ ID NO: 4186282 - RNA, 58 nt, Human
gugugcuuccuguauugauuccaugacucacggagcaugagcuaagcagaaagcacac

SEQ ID NO: 4186283 - RNA, 55 nt, Human
gugugcuuguuuuguuuuacuaucaggauaggaauguaaagcauucuuggcauac

SEQ ID NO: 4186284 - RNA, 66 nt, Human
guguggacuauuguuaguaauagucuacacagggcuguguggacuauuguuaguaauaguccacac

SEQ ID NO: 4186285 - RNA, 96 nt, Human
guguggagagcucugucacccgagcaggcgagaacuacuuagcugauuaauuagcaaagcugagaaaucucaauugugggugaggagcacacacac

SEQ ID NO: 4186286 - RNA, 71 nt, Human
guguggcacucuggguucuucuccuuugcugggccccugggcaggcauggugagaacucagccugucaugu

SEQ ID NO: 4186287 - RNA, 104 nt, Human
guguggccauuaauaguauacuggaacaguagguguaaccaaacaagcugauacacauuuaccuauagcuugcuaacccuacuucaguaauagauguccuaugc

SEQ ID NO: 4186288 - RNA, 60 nt, Human
guguggcccugcguccugagucucccugcuagagcaggcuugggcaggagcagggagcac

SEQ ID NO: 4186289 - RNA, 80 nt, Human
guguggccuggccgguaucccaccuccugcgucagccuccgagugaagaagggguucagguacuuggcguccagccacac

SEQ ID NO: 4186290 - RNA, 56 nt, Human
guguggcucagaacuacuucuaguugcuaagcaacccacaagcagcuguagcccac

SEQ ID NO: 4186291 - RNA, 56 nt, Human
guguggcugugggagauguucaugcuauacaaaaugcccaaaugcccaugccacac

SEQ ID NO: 4186292 - RNA, 64 nt, Human
guguggcuguuuagugacuuucccagugugcuuugcuggaaauaaagagacaaauggcauauac

SEQ ID NO: 4186293 - RNA, 130 nt, Human
gugugggaagcagacuggagcucuguuacugaucguugaaauuggguguggcugucauggagaucacucuggaucccugguccauuaucccgcuuuccagaaaagacagguuccaguucaaauccuuggc

SEQ ID NO: 4186294 - RNA, 74 nt, Human
gugugggacauagggauuuauggguacugcucacucuuuuggcacauuuuccacaucucuugauguaccuacau

SEQ ID NO: 4186295 - RNA, 87 nt, Human
gugugggaggggagaaauguacacuuugcaucuugauguuaaagcacauaucaguaucaauagcgucacaaucauucccuuugacac

SEQ ID NO: 4186296 - RNA, 55 nt, Human
gugugggcuaugugcgugggcauguaugaaugcauguguauguccaaugcccuac

SEQ ID NO: 4186297 - RNA, 78 nt, Human
gugugguagggucaggcuuuucuucccucagugccugccuggaaccaguggggguaagagccuggucuuacaccuugc

SEQ ID NO: 4186298 - RNA, 120 nt, Human
gugugguccuggaggcaggucuaauuaucuugugcagaugaaagaauuaggaugucauaaccugacucauggaaaaucugcauacuagauuugauugcuucugcucuucuauguuuauac

SEQ ID NO: 4186299 - RNA, 95 nt, Human
guguggugagagaaaugaacggcguacagcuguaacugauaaugacaguccucagaaauagcucuaagcuccuuuucaaacucuuuuaccacuac

SEQ ID NO: 4186300 - RNA, 69 nt, Human
guguggugaggggccugugcacacaggagcugaccugggugcugacuggggccugaaaaucucccacau

SEQ ID NO: 4186301 - RNA, 62 nt, Human
gugugguggcagagaacaaggagaggugcuagucaccauucaacucuucuuugucccuucac

SEQ ID NO: 4186302 - RNA, 65 nt, Human
gugugguuggggucagauagggaggaccguacacaaggcaucaucucuagcuuccuuaggaacac

SEQ ID NO: 4186303 - RNA, 130 nt, Human
gugugguugggucugugguccugugcucugcuauugcucagagaaggagaugucccaggaugccccaguggcacauuggucacugaagaaugagagacaugcauaggagaccugaacucaacugguggcc

SEQ ID NO: 4186304 - RNA, 62 nt, Human
guguguaaaccuccaaucuggggcauaauguagaaauugggugggcagugguuugcgcgguc

SEQ ID NO: 4186305 - RNA, 61 nt, Human
guguguacguauauauacugugcaugcauauuuguguguguguacauacauauguacacac

SEQ ID NO: 4186306 - RNA, 81 nt, Human
guguguagagcauggccucucuccuggaauggcaucuuauacauauaacccauuggagccaagaguuuuaccuuuacaugc

SEQ ID NO: 4186307 - RNA, 81 nt, Human
guguguagccgugcuuacucaucucugagccuaccccagaaggcagauguaaggaacagaagagcaaugcaggcaacacac

SEQ ID NO: 4186308 - RNA, 56 nt, Human
guguguaucucuuguuggcaugaauaugucuguuuguacaacaaguagagacauac

SEQ ID NO: 4186309 - RNA, 69 nt, Human
guguguauugaaugucuggcagaaacugaguaauagcugaacagaacagucagggauucaagugcucac

SEQ ID NO: 4186310 - RNA, 84 nt, Human
gugugugagcugaacgugcuucugcagcauguacucggucacguacuucuugucgcacacggagcacguccacugcuugcccac

SEQ ID NO: 4186311 - RNA, 96 nt, Human
gugugugauaggucaagaaaauugagaauugugaguuuggagaauuauagcaaucuuuauuaggguuucaucaaggcucuugacaaguuuacacac

SEQ ID NO: 4186312 - RNA, 66 nt, Human
gugugugcgugcaugugugugugugugugugugugugggcauguacacaugcaugcaugugcaugc

SEQ ID NO: 4186313 - RNA, 72 nt, Human
gugugugcucguauguaugugugcagcuacguaucuauguggaaacacccacgcaugcauaugugugugcau

SEQ ID NO: 4186314 - RNA, 121 nt, Human
guguguggagaaaagcaugaaccaagagccauguaauccuggggagaugaagguggacagucgagccacguuuuaucccucugguuuccaugaggucugacuaugcuucccuaccacguac

SEQ ID NO: 4186315 - RNA, 81 nt, Human
guguguggcagugcugauauccuuuaaccuggaccgggcguguugguguuucagggaggaugugaaaagcugugcacagac

SEQ ID NO: 4186316 - RNA, 111 nt, Human
guguguguacacauaggaucuagaaugacaugcaagaguauacacuuaaaaauaugaugcuuuaauauucuuauuuugcuuuuccuguguuuuucaauucuuuauacacac

SEQ ID NO: 4186317 - RNA, 76 nt, Human
guguguguagucaguagauccaaacuuuugagaaaugaaugaaucaaggggcaaguuuuguugacugaauucacac

SEQ ID NO: 4186318 - RNA, 56 nt, Human
gugugugugaacaugugugugugcgugugugugugcacgugugugugcacgcgcgc

SEQ ID NO: 4186319 - RNA, 70 nt, Human
gugugugugcaucucuuuuauucuaaaaucaggauuuuuaucauggauucaaaggaguauguucauaugc

SEQ ID NO: 4186320 - RNA, 114 nt, Human
gugugugugcauguaaaugcccaucugugcagcuaaguguaagugccaggugcccuuuggugcacucuccuguucauuuguauuugucuuugcuaaguuuacauucaugcacau

SEQ ID NO: 4186321 - RNA, 59 nt, Human
guguguguguguguggggaggguuugucuccagggucagaagucacauacauaugauac

SEQ ID NO: 4186322 - RNA, 60 nt, Human
gugugugugugugugugcaugugugugagcgagagcaggcuugcacaugcacgcacgugc

SEQ ID NO: 4186323 - RNA, 74 nt, Human
gugugugugugugugugugcacgugcaugugugugugcacauguguguaugucuguaugcacacauauuuucac

SEQ ID NO: 4186324 - RNA, 91 nt, Human
gugugugugugugugugugcaugcacacacacguagagaaaagaacauucuuucucuguguguguguguguguauauauauacacacacac

SEQ ID NO: 4186325 - RNA, 66 nt, Human
guguguguguguguguguguguacuacauugaaaaaaaaugcagugccaaacaguacauaacauau

SEQ ID NO: 4186326 - RNA, 83 nt, Human
guguguguguguguguguguguggugcugugugcagagugcagugagcguguacagggugcagcgagcggacacaguguaugc

SEQ ID NO: 4186327 - RNA, 60 nt, Human
guguguguguguguguguguguguguguguguguguguguauacaugugugcauacgugu

SEQ ID NO: 4186328 - RNA, 62 nt, Human
guguguguguguguguguguguguguguguguguguguguguaugcaugcaugcacaugcac

SEQ ID NO: 4186329 - RNA, 81 nt, Human
guguguugccugcauugcucuucuguuccuuacaucugccuucugggguaggcucagagaugaguaagcacggcuacacac

SEQ ID NO: 4186330 - RNA, 60 nt, Human
guguguugggagugaaauggguggauuuggaucaugcccucagaauugcucccugcacac

SEQ ID NO: 4186331 - RNA, 122 nt, Human
guguguugucaaaacuauuuucaucguaaugggaaauugcuaguugcuuuuuucacuguauugacauuugcauugaggaugcauagcaauuuuggguuaaaacugcuggugccuuagcacac

SEQ ID NO: 4186332 - RNA, 114 nt, Human
guguguuguguucuaaaacuugaugaggugguaauuggcauuccagaugcuuuucucagauacuaaucuaugcuagaugaguaaauggagucuucccucuaggacagaauaugc

SEQ ID NO: 4186333 - RNA, 63 nt, Human
guguguuucuugucagcucggaugguucuguucccauggcuucccacccugcuaagaauacac

SEQ ID NO: 4186334 - RNA, 57 nt, Human
guguuaaaugcaaucacaugcauccuuguaagagggaggcagaaggagauuugacac

SEQ ID NO: 4186335 - RNA, 72 nt, Human
guguuaacacggacuagcugaacaaccuugggcaaauuacuucucuccgagcaucagugucccuguuaauau

SEQ ID NO: 4186336 - RNA, 81 nt, Human
guguuacauguuuucaaucauaguggucaacaauauauaacgcuguuauuaaccagguccuuugaaaacaauuugugacau

SEQ ID NO: 4186337 - RNA, 82 nt, Human
guguuaccauuugauuuugccagagaccuaguaagaauguccauguucucuugcuuuacauguucugguaaauugguaaugc

SEQ ID NO: 4186338 - RNA, 70 nt, Human
guguuagagcaugcccuugcuacuauguugauucagauuuaccauagggcaguggcaucucuuaaaacau

SEQ ID NO: 4186339 - RNA, 59 nt, Human
guguuagccuuggguucaagguagguugcugccuuagcaguggguaccagggcuuuuac

SEQ ID NO: 4186340 - RNA, 77 nt, Human
guguuauaaucuccgcuguauuucugucugccaugaugauugaucuuuggcuaacaaaucagcuuggauggcagcac

SEQ ID NO: 4186341 - RNA, 64 nt, Human
guguuaugcucuacaaucuaaggggccucuuggggccgggcucugagggagugggcaguggcac

SEQ ID NO: 4186342 - RNA, 116 nt, Human
guguuauuugcauauaaaaaaagagaaaggcauguugucccucaucuuuuccaggaaagagugcugagcugcucuaauccuaugguggggagggaggagggccguguagaggacgc

SEQ ID NO: 4186343 - RNA, 82 nt, Human
guguucaaggcugucuuuccucuuugugacacagcugaugaacuuaggugugauucgaagagcaaagugcagguguguuuac

SEQ ID NO: 4186344 - RNA, 58 nt, Human
guguucaauuaugcgauguuaaucaagagcccuauugaggauauccaauaaugaacac

SEQ ID NO: 4186345 - RNA, 57 nt, Human
guguucauugcuagugaggugugucacucuucccaggcccucagagcuagugaacau

SEQ ID NO: 4186346 - RNA, 87 nt, Human
guguuccagaguccaugggcagauacacaaaagucuagugagggcggacucugccucagaauuugugugcugucuugaagagaacac

SEQ ID NO: 4186347 - RNA, 63 nt, Human
guguucccugguaaacugacucccaaccgugacuaggauaucggagggcuuauuagggagggc

SEQ ID NO: 4186348 - RNA, 123 nt, Human
guguucccuuuguucagaugaguggucuuuauuugagauugucauuuaauaugcugucauggaagaaaugacuaaaucugaagauagggccaaauccaauuguauuagaugaagaggcugcac

SEQ ID NO: 4186349 - RNA, 130 nt, Human
guguucugaugaucuccugcuccauaacaaaucacccccaaaacuuggugacuuccaucaauaguuuaugauggacuuuacccuuuggguaguguuugugucucaguuucaagguaguuacuggaauuac

SEQ ID NO: 4186350 - RNA, 75 nt, Human
guguucugcaaugcugccuccuuugaggaagugucugacagccuccacuucuagcaaggggcagcugcagaaaau

SEQ ID NO: 4186351 - RNA, 70 nt, Human
guguucugcccugcccaucuacccuguccgauucaccuaaagguaggccaggcaggacgggcagggccac

SEQ ID NO: 4186352 - RNA, 59 nt, Human
guguucugggaacaaaguggagugggaaagccuauugcuuuugugugcucccaggguac

SEQ ID NO: 4186353 - RNA, 77 nt, Human
guguucuguugucucagaaaaaggagaaacugguaguuagcuaaccacuaucucucuuuacugugauaauuuugcac

SEQ ID NO: 4186354 - RNA, 73 nt, Human
guguucuuaacuggaaaaugucagagcccuuuuuauacauucggggucuucugucagggccauuaaugagcac

SEQ ID NO: 4186355 - RNA, 74 nt, Human
guguucuucuuugagcucagugacucgacuuuaucaacaguaaaauguagucuaauugagcuaugugauaauau

SEQ ID NO: 4186356 - RNA, 80 nt, Human
guguucuuuuuguucccagagaauuuguuuucuuaaucuuaauccugaaaacagaaauucugggacagaaaauugaagac

SEQ ID NO: 4186357 - RNA, 87 nt, Human
guguugauguuugaaaaaaggacucagacugaagggagaggaaugaugucaucucuugaagcaggggccaguucuuaaacuuaacac

SEQ ID NO: 4186358 - RNA, 84 nt, Human
guguugcauguaugcacgguguuaggaugucucugcauguguguagguaugcuuguccaaguacauguguguacauguuuguau

SEQ ID NO: 4186359 - RNA, 64 nt, Human
guguugcugcacgauaaauaauuucuaggaagcuuuuaggaacauuugcuuuugcagccaacau

SEQ ID NO: 4186360 - RNA, 58 nt, Human
guguugcuuucucuaaugccaccuggucauccagccaggacaugggaggaaguauggc

SEQ ID NO: 4186361 - RNA, 65 nt, Human
guguuggauccuguuaugaaugcuuuauuaucucaaauuuugcagcauuccuaggagguaagcau

SEQ ID NO: 4186362 - RNA, 117 nt, Human
guguugggauucugcagcuagcaagugacagaguucggauugaguuugaggucgucuaagugccuaauccaggcucuuuccacucuggugcauuugcuucucaagugcucccaagac

SEQ ID NO: 4186363 - RNA, 101 nt, Human
guguugggucagcccucacagauguaguagcuuuauugcacauuuuagauuguuuguaggcuaggucuacuacacauauuuggaaggcaguaucccaauac

SEQ ID NO: 4186364 - RNA, 87 nt, Human
guguuguaaagcaaggagcagcaagcuacgggucugcaggccaaauuuagccugcugcuuguuuuguaaauaaaguuuuaccggcac

SEQ ID NO: 4186365 - RNA, 57 nt, Human
guguuguggagcuugucaggggcauuucaaugucaccugugaagggcucacagcuac

SEQ ID NO: 4186366 - RNA, 62 nt, Human
guguuguuuuguguuuucacagcaaucugacugugugcacgugaggauacuuaagagaacac

SEQ ID NO: 4186367 - RNA, 84 nt, Human
guguuuaaaaguuauugaugcaggacaacuuugcauaucaauacacaagcauuuauuugauuuguuuuaauagcugugaaauau

SEQ ID NO: 4186368 - RNA, 82 nt, Human
guguuuaauauagugucuggcauauuguuggaacauacuuaugacauaugcaaacaauagacccaugacacauaccuaacac

SEQ ID NO: 4186369 - RNA, 82 nt, Human
guguuuaauucuguauggaaacauccuccagcagcucauuugcuucugauauucucugaggauuuccauagauucugaucac

SEQ ID NO: 4186370 - RNA, 98 nt, Human
guguuuacauagcuuugacucuaugauaguuuuucaguagugccagacacauugguauguacucaucaacuauugaauugaaaacuuuauguagauac

SEQ ID NO: 4186371 - RNA, 123 nt, Human
guguuuaggcucgauuucauagacacuggacagguugaguaggaggagaccggauuagcuuuaauugacucuucauuuucgaccugcucacaggcuuuuaaaacauaaaucaacccucagcac

SEQ ID NO: 4186372 - RNA, 59 nt, Human
guguuuaucacguuucauuuguguguuauacuauauagaacacagaaauguguggccac

SEQ ID NO: 4186373 - RNA, 60 nt, Human
guguuucaaacagcaggucuuucauagcugggaaaaccccaagcuagaccugcuggacac

SEQ ID NO: 4186374 - RNA, 90 nt, Human
guguuucaggcuggccacagcaaugcugugaugucacguuccaguuccugugacucauggaggcugcugggcuccaggacuugaaaaugc

SEQ ID NO: 4186375 - RNA, 70 nt, Human
guguuucugaugcuauuuuaaccacuuauaguuaccauugugagaggagaaaugcauuaacaagaaacac

SEQ ID NO: 4186376 - RNA, 100 nt, Human
guguuucugcuaguuggauuggagucugcuuuugugaagagcugauugugggguaagagucugcucaacauuuguaggauaaguucacuggaggagaugc

SEQ ID NO: 4186377 - RNA, 66 nt, Human
guguuucuucacaagcugggucccaacaauuacugcugaugccagaugaacccagagagggagcgc

SEQ ID NO: 4186378 - RNA, 107 nt, Human
guguuugacauucuugugggcucucuaaagucuuagaucacuccagccuuguaugcuaacuuuggagacugauaaaggcuauuggugccuaaaaggcugugaaaugu

SEQ ID NO: 4186379 - RNA, 75 nt, Human
guguuugacgugaggaauugauacagaguugaugccuucuauggggacagcugguacucaguucuugucaagcac

SEQ ID NO: 4186380 - RNA, 81 nt, Human
guguuugauggaagaggaguaacagcuacuagcccuuaaaugaauaagacauaagccagucacucacuaugccauagacac

SEQ ID NO: 4186381 - RNA, 68 nt, Human
guguuuggaauuggcauucuauucuauggucauaauuuacagaguuguuuagugguaguucuaaaugu

SEQ ID NO: 4186382 - RNA, 74 nt, Human
guguuugucuuggccaagguucugaaugaauaaaaauauucccucaaaauuagugaccaaaggcauguuagcac

SEQ ID NO: 4186383 - RNA, 55 nt, Human
guguuugugagcuaggugacaugacgcaggcucugccacuugcuccacgauacac

SEQ ID NO: 4186384 - RNA, 58 nt, Human
guguuuuaagaaagaagcucagcuuuggaaacaaaacagugggagcuuuuuaggauac

SEQ ID NO: 4186385 - RNA, 84 nt, Human
guguuuuaccuucuuggagcuuaugugcuuaauaaacaucauuaagaauacaaacuuaaggcuuuacagaaauaggcaaaauau

SEQ ID NO: 4186386 - RNA, 62 nt, Human
guguuuuagugcugcugagcugagugugaaccgcuccuuguuucagcaagcacucuggacac

SEQ ID NO: 4186387 - RNA, 58 nt, Human
guguuuuauggagucauaacguguccaauucucccacacuuugcggcucacagagcac

SEQ ID NO: 4186388 - RNA, 62 nt, Human
guguuuugagguuguaaagaugauauuacuucaagguguuuuaucugaaaaccucaaaauau

SEQ ID NO: 4186389 - RNA, 72 nt, Human
guguuuuguacucuuuuauguuauggugagucagguauggcuacaagagacaccagggaggcucagaaacac

SEQ ID NO: 4186390 - RNA, 103 nt, Human
guguuuuucuacaagaacuuucucagagagguuggugauaagaauaucuuauuaguauuuuuauacucugcuacucuaguggaaaaucuauucugaaaaacau

SEQ ID NO: 4186391 - RNA, 61 nt, Human
guguuuuugcuuuuuacaaaagggucaggaauuuugaucccaaagguccgagcgggaauau

SEQ ID NO: 4186392 - RNA, 73 nt, Human
guuaaaaaugcagaucccugaaucucaccccaaacuuuuaaauaugggugggccuggacaucuguauuuuaac

SEQ ID NO: 4186393 - RNA, 86 nt, Human
guuaaaacaaguucauccacauuuacuggaugcucaggcuccacguggaccacccuggcuuccaguaggugcgauguggcugugac

SEQ ID NO: 4186394 - RNA, 70 nt, Human
guuaaacggaccuuccuaagugcaagaagcuauuaacuuuuugcauuugaucuuggguucucauuuuaac

SEQ ID NO: 4186395 - RNA, 89 nt, Human
guuaaagcacagauucugaggucacacugcuuggguccaaguccugcuuuacuccugccuagcaggugaccuauaguaaguuauuuaac

SEQ ID NO: 4186396 - RNA, 83 nt, Human
guuaaagggcaggcuccuggguguggccgccagagauccugauucugugaguuaccacgacacccgggagucugcaguucaac

SEQ ID NO: 4186397 - RNA, 56 nt, Human
guuaacaaccaaacagaaguucccaaucagugaugaauggaagcuuggugguuaau

SEQ ID NO: 4186398 - RNA, 60 nt, Human
guuaacauauguaaaguggauagugacugauuuucaaaacauuauucauacaugugugac

SEQ ID NO: 4186399 - RNA, 69 nt, Human
guuaacaucacaccacaggcauuuucuaucagcauacucgagauacuguguggugugguucuaauuaac

SEQ ID NO: 4186400 - RNA, 69 nt, Human
guuaacccuggaaaguuaaagagaauuagaaguuuucaauguaacauuuccaggcaggaaaguguuagc

SEQ ID NO: 4186401 - RNA, 62 nt, Human
guuaacucugcaacuuuugaggcuggggaccuagcugucagugaguuaguugcaaguauaac

SEQ ID NO: 4186402 - RNA, 75 nt, Human
guuaagaauguuuugcuggauguuggcuaaaaucaaaacuguucuuggucaauuaaacagagaucauucccagac

SEQ ID NO: 4186403 - RNA, 62 nt, Human
guuaagacagcauugcugagggcuuccugaggaacagugaaguucagcuagguuggagcaac

SEQ ID NO: 4186404 - RNA, 82 nt, Human
guuaagaccaucacagagacacuugcauagcagaguuuaguuaauuccaugaagaaucaguguguuucauguagguccuaau

SEQ ID NO: 4186405 - RNA, 87 nt, Human
guuaagagggaaaugcuuuauccaauaacaaaaucuuuugaaaacuucaaaaauguuuuauauugguagguaggaauuccucauugc

SEQ ID NO: 4186406 - RNA, 100 nt, Human
guuaagaguaugcauacuuuagagcuagauugccugaguucaaauaccagcucugcuaauuccugggcaaucuacugaaguauuuuguguaucuguuugc

SEQ ID NO: 4186407 - RNA, 66 nt, Human
guuaaggacucuccagcuagcaaauacauuaccauuauuguauuugccagaaggugggucauuagc

SEQ ID NO: 4186408 - RNA, 55 nt, Human
guuaaggaucuugagaugaggagaaccucuugacuuaucucaguuuguccuaaac

SEQ ID NO: 4186409 - RNA, 55 nt, Human
guuaaggcaaccagggccaggcuggauuuuucagagggcacaugguuuccucagc

SEQ ID NO: 4186410 - RNA, 80 nt, Human
guuaagggugguguaggagaucaaauaaauuauccuuuaacauccagacuauaagauuuugacuucuaccuacccaaagc

SEQ ID NO: 4186411 - RNA, 96 nt, Human
guuaaguauuaggcugaugccaaaguaacugaggccuuugccacuacuuuuaaauggcaaaacucgcaauuacuuuugcaccaaccuaauaauaac

SEQ ID NO: 4186412 - RNA, 129 nt, Human
guuaauaggcagugauucuucaaugcuccuucagugaaguuacagucugcuugcugacugcuaauuaaaacaaguuugcucucuaagacugugacuaaaagguagcaaggucaucuuauuuaaugcaau

SEQ ID NO: 4186413 - RNA, 78 nt, Human
guuaauccuucuugcaacuuaguggcagcucuggcccccacagucuacuugagcuuguauaauucaugaaguuuugac

SEQ ID NO: 4186414 - RNA, 69 nt, Human
guuaaucuaucuagugaaauaguccacuaaugucuuuaaagugguacauuucucaucuaguagaguagc

SEQ ID NO: 4186415 - RNA, 81 nt, Human
guuaaugcuuucauuuuccccagcauuggacagcaagccaaaagcaguauccugcuggaauggaaaaugaaggaaacauac

SEQ ID NO: 4186416 - RNA, 79 nt, Human
guuaauuaaaaacaguguuuuaucaguagguauugucauaaaauuaaaccuuuugagacuuccacuguguauaauugau

SEQ ID NO: 4186417 - RNA, 63 nt, Human
guaucccagcuacucgggaggcugaggcaggagaaucacuugaacccgggaggcugagguugc

SEQ ID NO: 4186418 - RNA, 58 nt, Human
guaucccggcaucuaugucuuccagaacuuggguucuguggcauagugcuugggaaac

SEQ ID NO: 4186419 - RNA, 94 nt, Human
guauccucuuccgagucauauuuagcuuguggaauugcagaacuguccccaguuauuucagucauuccaggagcuaacuguggucucaguuuac

SEQ ID NO: 4186420 - RNA, 84 nt, Human
guauccuuucuugaaauuugauuagcuguguaauuuuuucaucagagaaaugguuacagucugauuaaguuauauaggagauac

SEQ ID NO: 4186421 - RNA, 67 nt, Human
guaucuaucucuuggcugcuagcaggggucaaaugacuugugauauguaaagcacuaaggauaauac

SEQ ID NO: 4186422 - RNA, 123 nt, Human
guaucuccccuguuguuucauuuaguauccuuucucuguccuccucuugguguauauauuuucuaggaaauaagggacaagacaaagggcaaauaguuaagaaaaaaacaccagaugagauau

SEQ ID NO: 4186423 - RNA, 76 nt, Human
guaucucuuggcugaaugcccuggcuggaucugccguugggccuggcucuccagcuggcuucggaaguggagguau

SEQ ID NO: 4186424 - RNA, 56 nt, Human
guaucugaguggguaugggauccuggggucaggcccauguucacuugcucaggagc

SEQ ID NO: 4186425 - RNA, 84 nt, Human
guaucugcauauaaaaucaaggcuagagguuaaaauuuuaaugauaggagauuaaaacuaaaaugccugauuugugcagcuugc

SEQ ID NO: 4186426 - RNA, 88 nt, Human
guaucuggcucaaaguaagcacacaauaaauguugccuuuuaauaguguaguuauuuauuauugugguuacuucuggguaccagauac

SEQ ID NO: 4186427 - RNA, 91 nt, Human
guaucugucuacauguacuuggagugguuacucaagcaaaucuccagugugauugggaugcuggggaccaaucucuguuuuggauagcuac

SEQ ID NO: 4186428 - RNA, 59 nt, Human
guaucuugacuccaugccucaguuucucuaauuaaaugaggacaaaagguuaaugauac

SEQ ID NO: 4186429 - RNA, 99 nt, Human
guaugaaauacaguugcagucauguauacuccaucuccaaagaauggauucauucuucaugucaugguauauugacuauaauuuucuguuuuuaauuac

SEQ ID NO: 4186430 - RNA, 81 nt, Human
guaugaaggcaguucuucucggcugucagauaguuugaccagugucaggcuaucccgacgagagcagcauaccuucauugc

SEQ ID NO: 4186431 - RNA, 56 nt, Human
guaugaggcaggauauuaacuuuuacaagcaaagagggaauguauugccucagcac

SEQ ID NO: 4186432 - RNA, 92 nt, Human
guaugauguacauuuagagcucaauagaacaggacuucuggaauuuuaacaacauaaugagggucuucuuuuuggcuuucuguacaucaagc

SEQ ID NO: 4186433 - RNA, 63 nt, Human
guaugcacaauaugaucuauuuggguuuuuuuccuaaguguaugugaaggugugugugugugc

SEQ ID NO: 4186434 - RNA, 121 nt, Human
guaugcaugaguuuuguauauuccuauguggcuuguuuccacugugugaagcauuuuguguucacccuguguuucauguggacauaguuguacauaagaaaaucucaaaucugugcuauac

SEQ ID NO: 4186435 - RNA, 56 nt, Human
guaugcaugcauguguauguacgcaugugugugcauguguauuuguauguguguac

SEQ ID NO: 4186436 - RNA, 64 nt, Human
guaugcauuuacgguacaacagcaggccacuagaaaagacagcuuguugccucugagaucauac

SEQ ID NO: 4186437 - RNA, 70 nt, Human
guaugcugcaggucaucccugugcuucucugccagcaucugcagauccucauacuugaucuggugcaugc

SEQ ID NO: 4186438 - RNA, 71 nt, Human
guaugcuuugaaucaauuauccaggcuguuggaacuugugguccugcaaucuccaugcuugauuuucaugc

SEQ ID NO: 4186439 - RNA, 56 nt, Human
guauggauggaugaagcaucuuaggacaucuaaagaaagagaucacuccuccauac

SEQ ID NO: 4186440 - RNA, 64 nt, Human
guauggggacucacugacuaucuugagauccagucaucaugugguauugugagauccacuauau

SEQ ID NO: 4186441 - RNA, 75 nt, Human
guauggguguuaauuauuggugaauagaauucaaagucagaaucuuuucuguuaaauauugauagauauucauac

SEQ ID NO: 4186442 - RNA, 76 nt, Human
guaugguuacuacagagagagcuccagugaccuggaguggucuagcuggggaccagcugucucugaguaggcauau

SEQ ID NO: 4186443 - RNA, 59 nt, Human
guaugguucagaggccaugauuaauuaggcaauauccugaauggcucugggaucacugc

SEQ ID NO: 4186444 - RNA, 58 nt, Human
guauguaccuagaugcaaauccugaauaucaugucgcaauuagugcaucuggacaugc

SEQ ID NO: 4186445 - RNA, 68 nt, Human
guauguagggaaugugagauggccuuuagauaucauugccaacuuauugaacauucucgaauucauac

SEQ ID NO: 4186446 - RNA, 74 nt, Human
guauguauguauauguuuaagagaaauuacugaggaaacucugagggccauaucuuuaauauguaaauacauac

SEQ ID NO: 4186447 - RNA, 57 nt, Human
guaugucaccucuccuaagcacagcauuaaaugauugggagaggaaaaugagcauau

SEQ ID NO: 4186448 - RNA, 84 nt, Human
guauguguauauguuggcauguaugugcauuuuuguauguuuauauguauauauaaguguauauauaugaaauauauaauauau

SEQ ID NO: 4186449 - RNA, 71 nt, Human
guauuaaaucucauuuugguuucuacuuaguaucaggugcagcuaauugggaaaugaaugagacaagaugc

SEQ ID NO: 4186450 - RNA, 95 nt, Human
guauuaaauuuuuuuaaagguagaguggaauguccuugaucauaagaacauuaauguuuugauauuuauuugcuuuuauuauuaaaauguaauau

SEQ ID NO: 4186451 - RNA, 59 nt, Human
guauuagaaugcagccaugcucauuauaaaaaauguauugucuauggcuguguuugugc

SEQ ID NO: 4186452 - RNA, 63 nt, Human
guauuagcuagguuaccugggucagaaccagaaaguaggcucccagcagugacccagugauac

SEQ ID NO: 4186453 - RNA, 80 nt, Human
guauuagguuggugcaaaaguaauugcaguacuugccauuaauggcaacaacugcaauuacuuuugcaccagccuaauac

SEQ ID NO: 4186454 - RNA, 84 nt, Human
guauuagguuggugcaaauguaauugcuauuuugguccuacuuuaauggcaaaaacugcaauuacuuuugcaccaaccuaauac

SEQ ID NO: 4186455 - RNA, 61 nt, Human
guauuagguuggugcaacaguaauggcaaaaaccacaguuacuuuugcaccaaccuaauau

SEQ ID NO: 4186456 - RNA, 60 nt, Human
guauuaguuaucuacugcuguguaacaaacuaucccaaaccuaguaguagaaaacaauac

SEQ ID NO: 4186457 - RNA, 74 nt, Human
guauuauaggcacguuguuuaucagaagggcauaaauacauauuauuacuuugaaagcaaugggucuauaguau

SEQ ID NO: 4186458 - RNA, 61 nt, Human
guggagucaggcuugcugagccugguacacggugucagagagcucagagccugaacuucau

SEQ ID NO: 4186459 - RNA, 55 nt, Human
guggagugcaacgguuggaguuuggguaugaauucaaauacuagcucuacuccau

SEQ ID NO: 4186460 - RNA, 58 nt, Human
guggauagaauaagugacugcuucucugagguuugggaggcaauaaaguuuugucuac

SEQ ID NO: 4186461 - RNA, 79 nt, Human
guggauagccaagagcucaccggagagcauuugcagagcuuucuguaaaucuuccaauugggccucuuuuacuguucau

SEQ ID NO: 4186462 - RNA, 82 nt, Human
guggaucaucuugcacaagcucugggaugcagacaucccaaucuggagauucccauccucagcagcagcaucugggauccac

SEQ ID NO: 4186463 - RNA, 93 nt, Human
guggaugagaguaugaaagauugaucaugaauugacaauuguugaaauugugcgauggguacaugagaguuuauuauauaguguucuaucuau

SEQ ID NO: 4186464 - RNA, 80 nt, Human
guggaugaggcagaggaaaugggaauagaugguaugggcagaaucacaugauacaucuuguuuauuucaauucucaccac

SEQ ID NO: 4186465 - RNA, 92 nt, Human
guggauggaugcauguggucccuuaggaaguguguccagaagcggccacuuugcuucuguuucauugaucuuagcuacaugccugcacccac

SEQ ID NO: 4186466 - RNA, 98 nt, Human
guggaugucacauacccuccuggugcaugcuacugucuagaggaggcacuggggccucucaggucacaggauggccaggaauagaugcugucagacac

SEQ ID NO: 4186467 - RNA, 76 nt, Human
guggauguuggaugaccuuguaauuauaauuuuuaggugugauaauagcauuagguuuaugcagcaaaauauccau

SEQ ID NO: 4186468 - RNA, 61 nt, Human
guggauguugugucuacucaugagccaauuguggagcuaugagaacaagaacaaucuccau

SEQ ID NO: 4186469 - RNA, 56 nt, Human
guggauuagcuuuuguucuugacuuggagccaguccuguaucugagcugaguccac

SEQ ID NO: 4186470 - RNA, 119 nt, Human
guggauuauguuguuuuuccucuggauauuuuaguacuugaauuucuuacauaacaaauuguuuauggagcaaggaaacuauggagagauccuaaacuaggggcuacaaagcuguccac

SEQ ID NO: 4186471 - RNA, 129 nt, Human
guggauuauucucuggcauuuuaccuuauuuaccuuagcuguugaauguagauccauaaaaaucagcaugacaauaagccagcagaaagguagagacaaucaggggaaaauguacagagauuuuucaac

SEQ ID NO: 4186472 - RNA, 62 nt, Human
guggauugaaacaguagcucauagaccaaugcuggucugagaacugauuuucacucaucugc

SEQ ID NO: 4186473 - RNA, 97 nt, Human
guggauuuuaauagaauuuuaagaugcauucauggcaguuuaauaagugguuacaguguaaccaucaaauuaggucuguaugaaguuaaaacuccac

SEQ ID NO: 4186474 - RNA, 58 nt, Human
guggcaaauugcaagcaagcuuuuagaauuuuuuauauggaagucuuggaauuuccac

SEQ ID NO: 4186475 - RNA, 73 nt, Human
guggcaaauugugugcugagcugggauccaggaguucuggaccuucaucuuggcucugccacuaauuagcugu

SEQ ID NO: 4186476 - RNA, 67 nt, Human
guggcaauucaguugugucugaccucgaugccccaguguuuaggccaggauagcuuaauuaauccau

SEQ ID NO: 4186477 - RNA, 92 nt, Human
guggcacaaauaaauguguguaacaccaaacugaacagaaucugggguuuuugaagaaaaaaucuuucaguuacaguuacacacagggccac

SEQ ID NO: 4186478 - RNA, 63 nt, Human
guggcacagagauggggcaugaacacccugcagaggggacucccagccucuucucuugcauac

SEQ ID NO: 4186479 - RNA, 59 nt, Human
guggcacuugcuucagaugauguccccaggcaccaugacauagcugcagaagaugccau

SEQ ID NO: 4186480 - RNA, 65 nt, Human
guggcagacgcccccacacacgcucccuucuagaugaauaugaagaaagcagggcauuuugccau

SEQ ID NO: 4186481 - RNA, 56 nt, Human
guggcagagcaggagacaggaccaggcauccuggcguuugucugaacuccugccac

SEQ ID NO: 4186482 - RNA, 82 nt, Human
guguuccucagucuuuuugauaucaugaugaacagauuaaguugauguguucaucaugauaucagguaagcuggccgaagac

SEQ ID NO: 4186483 - RNA, 96 nt, Human
guguuccugacuuucucugugcuuauuguucagauagagaugauuauaauuucauuuguauuuaacgguaagucuuccacucucuagucugaacau

SEQ ID NO: 4186484 - RNA, 119 nt, Human
guguucuaaaggagguugcccagaugucucuaugacagugggucuugcaaagagagaaauguucuauguucagggccacauuguugcaugauggaaaaccaacucuuuccuugacucac

SEQ ID NO: 4186485 - RNA, 84 nt, Human
guguucuaauagaaggagguagugaaaugauaacagagcaguaggggauauuccuacucauuucaguuucuucucauagaucau

SEQ ID NO: 4186486 - RNA, 68 nt, Human
guguucugucugagcaccacaggauaucauaugugaguggcuuccaguggguugcugagggaggggac

SEQ ID NO: 4186487 - RNA, 64 nt, Human
guguucuugccaaggccaacauuuucauguucacucuguuaaaugcugugucuagcaggaacac

SEQ ID NO: 4186488 - RNA, 87 nt, Human
guguugacaggaaaaaguuuaggaugaaacacuguguucaguacauaacacuacaguugcagucuugucacuaauucuuguaaauac

SEQ ID NO: 4186489 - RNA, 106 nt, Human
guguugaggaggaaaauggguaguuccuggcgacugacugcagcugcagaagggaaagaacuggagucuccccaggagcgugacugugacccgcuccucucaauuc

SEQ ID NO: 4186490 - RNA, 66 nt, Human
guguugauagagacauucaaccucagauuaccaauucugucacaaccgaauguuuguauucagcgc

SEQ ID NO: 4186491 - RNA, 62 nt, Human
guguugcugaaaacaggucaucaggaacuguuguuuuccuggccauuugaacuucagaccac

SEQ ID NO: 4186492 - RNA, 66 nt, Human
guguuggauaugcaucuuugaauaguuguacggauacacacaaauuuuaauuugcauguaugacgc

SEQ ID NO: 4186493 - RNA, 55 nt, Human
guguuggccaccuuauggcuauuggauuaggucuggcucauaggaaggccauugc

SEQ ID NO: 4186494 - RNA, 62 nt, Human
guguuggcuuugguuuuuauugccaggaauggucauggccacauuggaccgaagcuuaaggc

SEQ ID NO: 4186495 - RNA, 114 nt, Human
guguuguagguccaaaguuguauuggagaccagcuguauacaagucguguaaacuuuauugucugaggacuucaucaccuguauaaaggcccucacaguacggacugccaacac

SEQ ID NO: 4186496 - RNA, 59 nt, Human
guguuguguuucccuugcauauucccauucuuaaggagggguuuuugggagcauaacac

SEQ ID NO: 4186497 - RNA, 78 nt, Human
guguuguuugaagcaauuaaguuugugaucuguuauagccacaguagaucaaaaacuuaauggcuuuauaccugacau

SEQ ID NO: 4186498 - RNA, 95 nt, Human
guguuuaaucuaugcccagcacaguguuagguaauuugaugaaaguauuucauuuaaucaccaagugacccugugaaggauguauuauuaaacac

SEQ ID NO: 4186499 - RNA, 74 nt, Human
guguuuaauuugcuuguccuggugacuguccguugacucuaagagcagacagagaucagaggcauaagcagcau

SEQ ID NO: 4186500 - RNA, 72 nt, Human
guguuucauugaaguuuuacauccucuccaaaacuuaagguguuuuaguuaguggggcugucagucuagcac

SEQ ID NO: 4186501 - RNA, 67 nt, Human
guguuucuggcauugcuuuggugcaguggcuuuccaauugaugaccacagcccacaguaagaaauac

SEQ ID NO: 4186502 - RNA, 116 nt, Human
guguuugaauuuauggguugggcuagugacaguugacagagccuuccuauagagacacaggauucuccaucaccacuggcacuuugccccuaggaccacaaugaguaucaaaccac

SEQ ID NO: 4186503 - RNA, 58 nt, Human
guguuugaugcccugugguuuuucucucacagagaccacaguccagucaucauggcac

SEQ ID NO: 4186504 - RNA, 76 nt, Human
guguuugcaagaacaggcaguugguuggauuuggcccacaagccguaguucacugaccccuguuuuagauaaauac

SEQ ID NO: 4186505 - RNA, 76 nt, Human
guguuugcaggggcuggcucuguuucuggcuuugccuauuggcuucauccuaaacaggcuauuucuuuacaaacac

SEQ ID NO: 4186506 - RNA, 55 nt, Human
guguuugcuguucagguugcaugaagggcaaucuuuagcaaccugucagagaugc

SEQ ID NO: 4186507 - RNA, 75 nt, Human
guguuuggguguacacguggccaucuuuacacauauggggucuuggugugaaaaugucacugugcagaucaaagc

SEQ ID NO: 4186508 - RNA, 63 nt, Human
guguuuguggggagggagggaaucuuugagacacugucaguucucaguccugcccagggaggc

SEQ ID NO: 4186509 - RNA, 80 nt, Human
guguuugugucugugcacacgugcccaacaguuauauaagguguacauaaacuacuguagcacauugcauauauaaacau

SEQ ID NO: 4186510 - RNA, 59 nt, Human
guguuuguuggaaaagguguccugcccauacugaggugagacccuaauuuagcaagugu

SEQ ID NO: 4186511 - RNA, 61 nt, Human
guguuuuacccauguugagaauaggcagacaauaugacaucugggcuuggguagaaaucac

SEQ ID NO: 4186512 - RNA, 69 nt, Human
guguuuucacauguguggcagugcaaguaaauaacacauuauuugacugaaucaggcaugauacugcac

SEQ ID NO: 4186513 - RNA, 70 nt, Human
guguuuugcaagaggaauucuagaagcaaucucuuuaaugaaugcuauuuggcacuuuugaccugggcac

SEQ ID NO: 4186514 - RNA, 82 nt, Human
guguuuugcaguagagcuuuaaaucaauccagugagaggacuguucuacuuauaagaucugauugaaaugcuuuccuaacau

SEQ ID NO: 4186515 - RNA, 81 nt, Human
guguuuugcucuguugugcaugugggauacaggauaaggauuauaguaccugcaauuccauagaaauuacagaagaaagac

SEQ ID NO: 4186516 - RNA, 84 nt, Human
guuaaaaagggauuaauaacaggguugauuugcaauagaguccaaacucacauugcuuugacucuuuguucuuauucugauaac

SEQ ID NO: 4186517 - RNA, 86 nt, Human
guuaaaaauuugaagagaaaugcacacauuugguacugaaaaugaacuuauuuuuaaagaccaguuugcacuuuuuagacaagagc

SEQ ID NO: 4186518 - RNA, 84 nt, Human
guuaaaaugcauauuuccaggccccacucuagaccuguugaauucaaaucucugaggaugaggcccuggaaucagcauuuuagc

SEQ ID NO: 4186519 - RNA, 78 nt, Human
guuaaauacuuuacaggaugucucagacccuugcuuaaguuuauuuucauugguggagacuccuuggggcuauuucac

SEQ ID NO: 4186520 - RNA, 60 nt, Human
guuaaauggggaugaguagauggaacuauuugaaagugccaauauuuaacccgauuuuac

SEQ ID NO: 4186521 - RNA, 72 nt, Human
guuaaauuacaacuguucccacugucuguaaauaauugcuuaggacagaaaauacaguccuguauuauugau

SEQ ID NO: 4186522 - RNA, 79 nt, Human
guuaaauugcuauggcuuuuaaggagaucugauaaaaaggaaguuagauuauuuaaacuggccaaacguaagaauuagc

SEQ ID NO: 4186523 - RNA, 75 nt, Human
guuaacaugggugcacuuuguugucauugaugccuuagguuaguaucacugagacaacuguguuucuaacuggac

SEQ ID NO: 4186524 - RNA, 66 nt, Human
guuaagaaucaagacuuaucuuuggggucuuuaaauguaugccaagauucaucuuguauuuuuaau

SEQ ID NO: 4186525 - RNA, 89 nt, Human
guuaagaaucuauucaggcagagugcagcagguaaaucucuaagacaaauaacagugcugucuccuggccugaauaucaauuucuugau

SEQ ID NO: 4186526 - RNA, 61 nt, Human
guuaaggagaaggcaucauucaaguguccacagcagugaaaagaugcauuucucugagaac

SEQ ID NO: 4186527 - RNA, 103 nt, Human
guuaaggcaagaaccagccauuuucacuucuuuugugauucuucacuugcuucaggccaucuggauguauacgugcaggucacaggggauauguugucuuagc

SEQ ID NO: 4186528 - RNA, 88 nt, Human
guuaaggcuauuuucacuuguggaucuucaguugcuucaggccaucuggauguauacgugcaggucacaggggauaugauggcuuagc

SEQ ID NO: 4186529 - RNA, 67 nt, Human
guuaagugguuuucucauugaacaaauguuaagcacugacauaaaccagugagcaaaacugcuuggc

SEQ ID NO: 4186530 - RNA, 67 nt, Human
guuaauauuagguacaugucugaaguaucuccaaucauggaaauucuccagaccuugugacuaugac

SEQ ID NO: 4186531 - RNA, 61 nt, Human
guuaaugagaggcuugacuaggacugaaugauccaguuuagacauggcuugcucacuuggc

SEQ ID NO: 4186532 - RNA, 78 nt, Human
guuaaugagugaguccaagguucauggcacagauggugccuucacgcucuugucagaagccucgaaauauguauuaau

SEQ ID NO: 4186533 - RNA, 62 nt, Human
guuaaugcuuugucagccuaagggcauucuuuaaugcacugaaaggaaaccagagcauaaac

SEQ ID NO: 4186534 - RNA, 66 nt, Human
guuaauguaagggcuuuggguuuuacucugcaaaagaauggagcucuggaaguucuaagcagaggc

SEQ ID NO: 4186535 - RNA, 126 nt, Human
guuaauuacuggacccaaggaaguaccaaaaauuguggggcugaauacucuggcugcugugacucaaauuccuuggaauucacccuuaauuuucuuggauuuuucuuuugguuaaaaaaaauugac

SEQ ID NO: 4186536 - RNA, 77 nt, Human
guuaauuaguuccuuuuuaagucguugugguaaauuuggcuguaugcaucuuacguuuugaaagggaugggauuaac

SEQ ID NO: 4186537 - RNA, 67 nt, Human
guuaauuguuacacuguaagaacuccacaaacuugaucagagaggugaguagcagugugacauugac

SEQ ID NO: 4186538 - RNA, 67 nt, Human
guuacaaaggcuucaucucagagcagggggcaggcucugcucauuguucuggagagguguuugggac

SEQ ID NO: 4186539 - RNA, 61 nt, Human
guuacaaauguaaauucuggggccucacuuaggccuauugaauuagagucugcauuuuaac

SEQ ID NO: 4186540 - RNA, 100 nt, Human
guuacaauaaucaaaaguacucugaagagcuaaaacuggugauuugaauguuuguagacucuagauuaacaguuuuguugaagagugugguuccaguagc

SEQ ID NO: 4186541 - RNA, 81 nt, Human
guuacaccagaaucucuguggggacucccugggggcauccccagguuuuaaaugcuuccugaggugauucuaauguguagc

SEQ ID NO: 4186542 - RNA, 69 nt, Human
guuacagacaggaaguucagaagaaaugagccagucccuuuuauuucuucuuccucuuuugucucuaac

SEQ ID NO: 4186543 - RNA, 96 nt, Human
guuacauaaccuauagagaaauuucagggagucauuuacacacuccaaaauauggaaugucuaaaaaacuccuaggagagagauguggggugugau

SEQ ID NO: 4186544 - RNA, 75 nt, Human
guuacauauagacaguuacucuagugaagcaaauuaggaaagcuauugucuugguguagcuuguuuauaugugac

SEQ ID NO: 4186545 - RNA, 59 nt, Human
guuaccagcagccuuucccgcacagcacagcgcucagccuuugaagggcugcagggcac

SEQ ID NO: 4186546 - RNA, 84 nt, Human
guuaccuccugcaugguugugcuauugcccccagacuucucccuggcccucaaucuuguucauaaucaugcaguagagaguugc

SEQ ID NO: 4186547 - RNA, 78 nt, Human
guuaccuucccuaguacugaacuuaaaaauccccugggaaaguuaggauggaaauuuacaucagugggggaaggagac

SEQ ID NO: 4186548 - RNA, 76 nt, Human
guuacuaaguuguguuuuguguucaaaauaguauauauaaauacauguuuuguguacagaauauuuaaacagugau

SEQ ID NO: 4186549 - RNA, 64 nt, Human
guuacucaggcuggagugcaguggcuauucacaggugagauccuggugcacuacagccuggaac

SEQ ID NO: 4186550 - RNA, 86 nt, Human
guuacugucuucccugucuuugugcaccccugggggguuacccaaguucauuucuagcagguggauuuagacgggaguuacuuaac

SEQ ID NO: 4186551 - RNA, 59 nt, Human
guuacuguguguauauccucaucuguaagaaauugagacauaggauuccacauagcaac

SEQ ID NO: 4186552 - RNA, 80 nt, Human
guuacuguuaagauuuauuauagcauguguagauaaauauauuucaguuuucacaucuauaacuuagauaacacgguagc

SEQ ID NO: 4186553 - RNA, 80 nt, Human
guuacuucugaguuguuuugcuuuuuuuggacauggacuuucaacuucuaauucauaaugacaaacauacucagugugau

SEQ ID NO: 4186554 - RNA, 57 nt, Human
guuacuugggacagaaagaaugacccagagcccuggaacaaacugggucccaaugau

SEQ ID NO: 4186555 - RNA, 62 nt, Human
guuagaaacgcaggcucuccggguuuguccuggaccuauugagcuggagugugcauuuuaac

SEQ ID NO: 4186556 - RNA, 60 nt, Human
guuagaaaugcagaaacuugaccccaccccaaauggcugagucaaaaucugcauuuuaac

SEQ ID NO: 4186557 - RNA, 67 nt, Human
guuagaagauuggcagcuuaacuguccauuuuuaucaguuaggaaacaaaccugccucuucuuuagc

SEQ ID NO: 4186558 - RNA, 96 nt, Human
guuagaaguccagcaguggucucucucugggcuaaaaucaaggugucggcaaggcugcauuccuucuggagcccggggagcccacaguuuccuagc

SEQ ID NO: 4186559 - RNA, 84 nt, Human
guuagaauggcgacacagauaauuuaguuaaaacguaucuuuaaccuuuuuuuugcaugcgugauuaaucugugagucucugau

SEQ ID NO: 4186560 - RNA, 88 nt, Human
guuagaauggggaucgagauuuauccaagggagcugacaaucuguauaguaccuuugcauggauuuuuuaaaaggccccucucuggac

SEQ ID NO: 4186561 - RNA, 81 nt, Human
guuagacuucuagaaacggcaaccgugcagaugucugggaacccagaaaucagcaaaaaugccuucagaacuccacuuaac

SEQ ID NO: 4186562 - RNA, 67 nt, Human
guuagagauacauuuguagcuugaagaguugcuuauuugauaaguuaucggaguguguuucaaagac

SEQ ID NO: 4186563 - RNA, 69 nt, Human
guuagagggccugcugcuaugacuuccuggggaagccuuccacagggaauccagcaggagguugcugac

SEQ ID NO: 4186564 - RNA, 65 nt, Human
guuagagggcugccuuuuguuuaaauaagaauaaaaauaauaauuggcuaccucagcccacugac

SEQ ID NO: 4186565 - RNA, 58 nt, Human
guuagaggugucaggagcacagguuucagagucaggcugcuuguguucauaccuuagc

SEQ ID NO: 4186566 - RNA, 61 nt, Human
guuagauaagaguaggccguaugauccuaucuagaagacggcaugccugcugguaucuggc

SEQ ID NO: 4186567 - RNA, 91 nt, Human
guuagauauguacauuucugggcucuucccagauccagagaugucugaaguucuggguuugaaguagagcccaagaaucuuuguguuuaau

SEQ ID NO: 4186568 - RNA, 61 nt, Human
guuagaucacauguagaguagggggcucauuucuaaccacuacuuuacagagaagacugac

SEQ ID NO: 4186569 - RNA, 74 nt, Human
guuagcagaguccagaaaacagugugcucccugaugaaaaggccacggucacugucuucugggcucugccuggc

SEQ ID NO: 4186570 - RNA, 94 nt, Human
guuagcaugggccuaaagucgacaaauuucuaagccuuuggauauguaguugcuaaauuguuuucuagaaguuguaauaauuuaggcuccuggc

SEQ ID NO: 4186571 - RNA, 59 nt, Human
guuagcaugguguagugugauuuaguguggugucugcaugguguuugcaugguguuaac

SEQ ID NO: 4186572 - RNA, 68 nt, Human
guuagcgggaggccucaguaccuugcuuugugauucucuccauagggcugcugggguauccucauggc

SEQ ID NO: 4186573 - RNA, 78 nt, Human
guuagcugccaaaauuauuccugauuuuaaaagaagaggugaaagcuuaaauaauuugaaacaggugauucagcuaau

SEQ ID NO: 4186574 - RNA, 80 nt, Human
guuaggaagauuuuucuuaaugcuccgagugggaggugaagauagacccaacuggaacaguauugggagagaucucuaau

SEQ ID NO: 4186575 - RNA, 89 nt, Human
guuaggauacauagaucuuugcagggugcugacuagguggaagagccguuccuuuggccaaauacacaccuuuugagaauguaucagac

SEQ ID NO: 4186576 - RNA, 60 nt, Human
guuagggaaggcugcugucagcuuugugguuuagaguagacaggaaucuccuuucugaac

SEQ ID NO: 4186577 - RNA, 66 nt, Human
guuaggguuagguguagucuagggaaggaaacaaggauuccgugagagcugccacgugaccaugac

SEQ ID NO: 4186578 - RNA, 57 nt, Human
guuagguagaggcacauuucagauuuagacuaaggugcaaauggcuuucuacuuaau

SEQ ID NO: 4186579 - RNA, 130 nt, Human
guuagugacuuuuuuaagagcacauuaaaugcagagguaauauagaauaaugggaaguucuggauugacagauagacauauauucugauuccaucugugucauuaauugcuguugggaaugucacuuaac

SEQ ID NO: 4186580 - RNA, 91 nt, Human
guuaguggcuaugcuuaugggcuugcugauuugggcaggauuacuguucagucccuccuucauggguaggcccacuuuggcuugccaagac

SEQ ID NO: 4186581 - RNA, 60 nt, Human
guuaguggcuccuauuggguuuugagccaccccaggcuuuccucaccuggaggugcugau

SEQ ID NO: 4186582 - RNA, 95 nt, Human
guuaguguugcugugcauaugucuugaggucucaucugaaguaaguuuguguaugaucgaagauuucaauggauauugcaagguaacuaauuaac

SEQ ID NO: 4186583 - RNA, 94 nt, Human
guuaguuaggccaacaguacauagaucucuacccucagaucuauuccuucuacaucuaucuuaggguagcuuauauugcucuugugucugugac

SEQ ID NO: 4186584 - RNA, 67 nt, Human
guuauaacgagaaauuugucuguuccauggguacacuugcccaugcaguaaauguucuaguuuguac

SEQ ID NO: 4186585 - RNA, 67 nt, Human
guuauaaugauaaugaugggcacuaguggaauaucugccagaaggucauuacaauuaucauuuuaau

SEQ ID NO: 4186586 - RNA, 87 nt, Human
guuauacaaaacaaccacuucaucucuacagaaucuuauuauuggaauauaugauuguaaguuucuauagagggugggaaguauaac

SEQ ID NO: 4186587 - RNA, 90 nt, Human
guuauacaaaucgcacucacuugcuuucuuccuguugcacagcauacaacuggcaggaucuuugagagugaagugagguaucaguguaac

SEQ ID NO: 4186588 - RNA, 78 nt, Human
guuauacuggaaagcucuggaauggaaauaugucauaucuacuuuauguucucuuaauccggugcuuucugugguugc

SEQ ID NO: 4186589 - RNA, 86 nt, Human
guuauagcuaaggaaaguaauguucaaacaaguuaaugccacauagcuagugucagcaucagguugucugaauucacagcuagagc

SEQ ID NO: 4186590 - RNA, 91 nt, Human
guuauaucuggccugucuagcuuucccaauguucucugauuacuauuucugagaacauugggaaagcuaugguagcuuuaagguagguaac

SEQ ID NO: 4186591 - RNA, 124 nt, Human
guuauauuuaaaauaaucucuagugcuuuucuaaucaaguugagagucuuuuugcaauuuuauaaaagugauuuggcaauuugacaaaguaggucaucaaagcucuguuuccaaaauauguagc

SEQ ID NO: 4186592 - RNA, 80 nt, Human
guuaucaaaugguaccaugagaugccacuaaugucgaguaaacaauuggaaauggaucucaugcugugcccuugugggac

SEQ ID NO: 4186593 - RNA, 66 nt, Human
guuaucauagcuagauaccuuauggaaaugagugaagcauuucuaaguguauugagcuuggaagau

SEQ ID NO: 4186594 - RNA, 76 nt, Human
guuauccagucugugcaguaaagagggugcuggggcccagaccccagcccugaacccugcugcauggacuccuggc

SEQ ID NO: 4186595 - RNA, 78 nt, Human
guuaucccuugaauaccuagugggaugauagauuucuuuauuaggaauaaaucaauccuauugguagucagucaugac

SEQ ID NO: 4186596 - RNA, 82 nt, Human
guuaucucaaaucccacucagaaacugccauugucaugcaacaauaggccacaauauuuugguaggaaaauuagagauguac

SEQ ID NO: 4186597 - RNA, 83 nt, Human
guuaucuuccuuuucagacacccaguucagguacuccgaucauaaaaugugaguucugaagaacugucuagagaaccaauagc

SEQ ID NO: 4186598 - RNA, 58 nt, Human
guuaugaacucugggaacugcgcugugccagaaaagugcuucccaagguuucaugugc

SEQ ID NO: 4186599 - RNA, 68 nt, Human
guuauggcuucucagucaugaaaagcucaguuauuuggggucuacauuuucucacugagagccuugau

SEQ ID NO: 4186600 - RNA, 57 nt, Human
guuaugguuuuaguugaaugauaagugucauaaucuugucuaaacuagucccauaac

SEQ ID NO: 4186601 - RNA, 92 nt, Human
guuauguaguugcuugucucagcagaggcaguauucaguaguggcuaagagcauaggcuaauucuguuucugccacuuaguagcuauguaac

SEQ ID NO: 4186602 - RNA, 67 nt, Human
guuauguauugagaaccugcagcauuaugucugauacugugauaaaugcuggaaauucaggcaugau

SEQ ID NO: 4186603 - RNA, 79 nt, Human
guuauguggcaaggcugugggggcagagcugcuaugaaaacagaagucucuggaguucucucucagccugcugugucac

SEQ ID NO: 4186604 - RNA, 129 nt, Human
aaaaugacucuauuuuauaucuugaaaugugugcagcagagaauccaguuagugugugaaauuuguauuuuuaaauacuaaaacuacuaauuguauaguugauguaauuuuaagaaaaucagucauuuu

SEQ ID NO: 4186605 - RNA, 69 nt, Human
aaaaugaggccagaucaugcagagagggcccuggcggccaagagauuuuugauaguuuggauuuauuuu

SEQ ID NO: 4186606 - RNA, 87 nt, Human
aaaaugagguuauccacuuuccaaaggacaaguuucagaauaagacuugaggccacaugaauucuuggacaguauuuuacuucuuuu

SEQ ID NO: 4186607 - RNA, 87 nt, Human
aaaaugcuucauguauaaggaauuuagaauagggaaaauauauuagguauucguugugcucauuuuccggcaguacagaagcauuuu

SEQ ID NO: 4186608 - RNA, 70 nt, Human
aaaaugggccaggcugcugacugcuaaagaaaaacacaaauuggguacauagcaggauuugguuuauuuu

SEQ ID NO: 4186609 - RNA, 84 nt, Human
aaaaugucccauuugucaaacaaauuaccaaacuggagguacaugagccugcagauauauuuuauuuggucaaugguuuguuuu

SEQ ID NO: 4186610 - RNA, 60 nt, Human
aaaauguuaggcaucuucugguuucauuugccagagauuucuuuugaugccugucuuuuu

SEQ ID NO: 4186611 - RNA, 93 nt, Human
aaaauuauaacauuuccugauauagaagucuagaacaagagacaugaacuaugaaacuuauucaguuucuacccuuggaagugucauuauuuu

SEQ ID NO: 4186612 - RNA, 58 nt, Human
aaaauuauuaccuugggagguuguguucauuagaacauucucauuuggugaucauuuu

SEQ ID NO: 4186613 - RNA, 89 nt, Human
aaaauucuuagagcacaguauaauggucuuagauagugaucgaauuuacacuguuaucaauugaucauuuacuuguucuggacuauuuu

SEQ ID NO: 4186614 - RNA, 61 nt, Human
aaaauugcuacuguaccaucuccauauugguagaagucaauuagaggcagcuagcaauuuu

SEQ ID NO: 4186615 - RNA, 60 nt, Human
aaacaacucaacuucuaguuguuaacuguguguuaauuaguggaauaaguuaaguuguuu

SEQ ID NO: 4186616 - RNA, 98 nt, Human
aaacaaguccugaaugcuagaggauguucuaggcacucaugaggucuucccuuaugacucauguuugucccugacauccucucccauuuaucuuguuu

SEQ ID NO: 4186617 - RNA, 61 nt, Human
aaacacagcauguccuuggggaaggagugaacagaccacaucucuaacacagcuuguguuu

SEQ ID NO: 4186618 - RNA, 98 nt, Human
aaacagaaugcuaaaggaaggaauguggccacuuuuuucugggcauacaauuagucuagucaauagaggucacacuggaccaagcauuugagauguuu

SEQ ID NO: 4186619 - RNA, 109 nt, Human
aaacagagaaggaggcaaucagugugagaggaguuacuauuuccgaggccuggccuuuggcgcucgggucuccuccucuuauacccuuuugcugcuuugaaaucuguuu

SEQ ID NO: 4186620 - RNA, 69 nt, Human
aaacaguaggaagagcuugcuuguuuuaacagaacauuuauuuguacacauuaagcucuuuagauguuu

SEQ ID NO: 4186621 - RNA, 71 nt, Human
aaacagugauguugaguguaaaagcuugcacuugaaauaagcacaugaaaaaaugcucaacaucauuauuu

SEQ ID NO: 4186622 - RNA, 64 nt, Human
aaacauaaggcuguuccaggguuuaugcuucccccaagguagcuguuucacaacagccguguuu

SEQ ID NO: 4186623 - RNA, 94 nt, Human
aaacaucacaucugacauuugaguugagacucuuuggguaaaguuaauuaauucauuuagguauucacuuacuugucagguauagauuaaguuu

SEQ ID NO: 4186624 - RNA, 60 nt, Human
aaacaucuugguucaauuucuucauuuucacgaugaugaaacuaggaacuagagaaguuu

SEQ ID NO: 4186625 - RNA, 67 nt, Human
aaacauguagugcaugaggaucuuccugugcucuuuauaaucugagauucugauguuucuauuguuu

SEQ ID NO: 4186626 - RNA, 64 nt, Human
aaacauuugcaacucgguuuggggguuucaacaaagugccacuuaaacuugacaggcaaaguuu

SEQ ID NO: 4186627 - RNA, 77 nt, Human
aaaccuccaucacacauucuguccucaucugccccaaggguacccccuggaaggagaugggacauguacaaggguuu

SEQ ID NO: 4186628 - RNA, 58 nt, Human
aaacgcccgugguugccaagguagcacuuucuuguucuuuucauuuccucggguguuu

SEQ ID NO: 4186629 - RNA, 66 nt, Human
aaacgugaugggaggguggaaaggcucugagcacucacucagcgucucggccgucuccaggcguuu

SEQ ID NO: 4186630 - RNA, 74 nt, Human
aaacuauuucugguguguuagagcucagggcagcauuugccaaugaugcuuugauauguacuggcaauauguuu

SEQ ID NO: 4186631 - RNA, 78 nt, Human
aaacucuaguccuugcagcucuguaugcugauuauuugaccucagaggaucuaggaaacagggcugaaacucagguuu

SEQ ID NO: 4186632 - RNA, 91 nt, Human
aaacugcacguucccagcgcuuuccuccccgccccuuuccuggguuuucuguuuacugggauguggagaggaagugcaaacucuguaguuu

SEQ ID NO: 4186633 - RNA, 63 nt, Human
aaacuuaguagucauugcuuugaccuucaacacugguugucagguuacagugauuauagguuu

SEQ ID NO: 4186634 - RNA, 90 nt, Human
aaacuugaggagaaaguuaucacaaaauugagacuugccaagaauguaccuuauuuguuguaauuuuugaaagauuuuugcuucagguuu

SEQ ID NO: 4186635 - RNA, 94 nt, Human
aaacuugcaaaacaauuauauauaaaaucagauauggauauaugugugcauugugcauugacaauguauuuguaucuguauaaguggcagguuu

SEQ ID NO: 4186636 - RNA, 56 nt, Human
aaacuugcuggcacguguauggaugagcauucucacuccugcaaaaggacaaguuu

SEQ ID NO: 4186637 - RNA, 60 nt, Human
aaacuuuguucgucugauguggaaaauuaugcaguuucccaaggcaggggaucaaaguuu

SEQ ID NO: 4186638 - RNA, 57 nt, Human
aaagaaaacuguuuaggcugcacucaaaggaucagguguggucaacaggauuucuuu

SEQ ID NO: 4186639 - RNA, 130 nt, Human
aaagaaaacuucuccuuaucuacuauuuaguuauuuaagauuuguagagaaaaagcaaaacaaauguugggcucuuucuauuuugcacugguuuucaaaacaauaaguugguuaggagaugauguucuuu

SEQ ID NO: 4186640 - RNA, 60 nt, Human
aaagaaaaucugugaaagugugucuuaucauggacgggacaggcuuuuacggauaucuuu

SEQ ID NO: 4186641 - RNA, 59 nt, Human
aaagaaagugggcuucugucccaaacuggcugccaacaggacaauuguucauuuucuuu

SEQ ID NO: 4186642 - RNA, 99 nt, Human
aaagaaaugaaggaaaugaagucuauuaacugauuucuuaacccaaaaaagagagaagaguuagaaaugguuuauaguuuaauauccuacagucucuuu

SEQ ID NO: 4186643 - RNA, 78 nt, Human
aaagaagaggguaugggaggggugccuggaugaggagagaucagaauucucagcugguguuucuucuccuucuuuuuu

SEQ ID NO: 4186644 - RNA, 77 nt, Human
aaagaaggcugaagaagauccguuuucuguuugauaggcucaaaccaucauggcagggcuucuguuuaguuuuguuu

SEQ ID NO: 4186645 - RNA, 74 nt, Human
aaagaaugcuacuugacucagcucauuggucaaauuagaauguaacccagcuggaugaguuuguagcauuuuuu

SEQ ID NO: 4186646 - RNA, 73 nt, Human
aaagaauuucauaucccuguuuucggugugcugugucacuguuugccauggguaaagguauaugaaucucuuu

SEQ ID NO: 4186647 - RNA, 71 nt, Human
aaagacaauuacauuagcaaacaucuugguguucuuuuuucagaacacuaagauggcuguuguuuguuuuu

SEQ ID NO: 4186648 - RNA, 91 nt, Human
aaagacaggcuggaacucuuaggcacaggcagaaguugcaguucacaggugaaauuuguucuuuauccuggaagccugggcucugcucuuu

SEQ ID NO: 4186649 - RNA, 96 nt, Human
aaagacauuuucacaguguagaaaauuugagguugauagauguguuaauuaauuaauuaaauucuacaacuucaaagauguuauuugaaugucuuu

SEQ ID NO: 4186650 - RNA, 80 nt, Human
aaagaccaucacaagaacaacugcuuuaaaagcaccgccuuuggugcuguugacuuuguuguucuuaucaagauguuuuu

SEQ ID NO: 4186651 - RNA, 74 nt, Human
aaagacucugcugacuaguugacuaucugaaaugcacucagaaagaaaauauagaacuauuagcaauaguuuuu

SEQ ID NO: 4186652 - RNA, 129 nt, Human
aaagagaaugugcaaaguaugauggcgagaaagcaaauguuauauucagggauacuuguucugugaacuuaguaguuugagauuuuccuaaauauaauguuuacaguguuuuuauauuaaugauuuuuu

SEQ ID NO: 4186653 - RNA, 57 nt, Human
aaagagacaccaaagacucuagccucuagggaaauaggucuguugggguggcuuuuu

SEQ ID NO: 4186654 - RNA, 110 nt, Human
aaagagaggauaccgugcaauagaggaaggcugagagcaacgugucagagagccaaagaaaaauuuugccaucuuacuuuaggcuggucuuuugcauauauucauuuuuu

SEQ ID NO: 4186655 - RNA, 73 nt, Human
aaagagaugcacauacgucaguggcugucauccaaauggaaauaugaacacaucugcgugugucucucucuuu

SEQ ID NO: 4186656 - RNA, 58 nt, Human
aaagagcaagcuguuccugagaauucauuuauuugcuuccaggaugcugcugcuuuuu

SEQ ID NO: 4186657 - RNA, 85 nt, Human
aaagagccugauucucuucauauggcaaaggcacauauucguauuuaugaaucuuaccauuuggggcagagcuucagggcucuuu

SEQ ID NO: 4186658 - RNA, 56 nt, Human
aaagaggauggaguagucagcuccuguuuugcugucagcaacuuuuccaccuuuuu

SEQ ID NO: 4186659 - RNA, 110 nt, Human
aaagaggaugggcuuugcaaacagaagggguuugcacacagccagugaguggcaaauucuacuuuugccgcucacuagcuguguggcuuggagcaaguuacagucucuuu

SEQ ID NO: 4186660 - RNA, 91 nt, Human
aaagaggugguguacagaaaggccacugcaagggaagguuggcuuauuuuaaacuucucugaagugaccuguucauggauucauucucuuu

SEQ ID NO: 4186661 - RNA, 55 nt, Human
aaagagucuggcguuuuaauggagagguucuacucaccaaccuugccaguucuuu

SEQ ID NO: 4186662 - RNA, 130 nt, Human
aaagauaacaguaugcaccuuuuuuuguguguguggguuuuaguguggaccgggaccuuugcuacacacuuuacucucauuaucuuacuagaaccucacaacaauccuaugauguaccuguugauuuuuu

SEQ ID NO: 4186663 - RNA, 64 nt, Human
aaagauacacaucuauuuaagagacagagcauuaaacuuuguaauugaucauguguguauuuuu

SEQ ID NO: 4186664 - RNA, 107 nt, Human
aaagaucuugaggucacagaaaaggucaaaauggaggcacagcugaaucaauccacuuauucaacccaaguucuccauuuuccuccaauuucuggaccuaauuuuuu

SEQ ID NO: 4186665 - RNA, 88 nt, Human
aaagaugacuuugaauuaacgacacaagugaauaucugaauucaauuugaguuuguaauucuuccaaguaaaacagaguuuaaucuuu

SEQ ID NO: 4186666 - RNA, 130 nt, Human
aaagaugaugaggcaggaauuaauaaagaaaugaagucguguguguuugguugccugucagagggcacacaauuucauaaacaccaugccuggacaauuugauauuaauauuuaacaccucugcaucuuu

SEQ ID NO: 4186667 - RNA, 69 nt, Human
aaagauuuugacaccagacuuuaaucauagcugauagguccaugacaguacuggugacaauacauuuuu

SEQ ID NO: 4186668 - RNA, 58 nt, Human
aaagcaauagcaacaacuuuacaggccuuugggcaaugucauaguagugcuauucuuu

SEQ ID NO: 4186669 - RNA, 66 nt, Human
aaagcacuauagccaaauagccccaggaaccucuccuucuuugauucaauugguuguggaugcuuu

SEQ ID NO: 4186670 - RNA, 57 nt, Human
aaagcacucuauccuuuguagaauggcauauccugauuuucuaaaggaaagugcuuu

SEQ ID NO: 4186671 - RNA, 77 nt, Human
aaagcacuuuuauuuugaauuaagggcuaauagaauuguccucuuaaaugagcacuugcaagauuaaaaguugcuuu

SEQ ID NO: 4186672 - RNA, 60 nt, Human
aaagcaguauaguggaagggcuggggcuauaacguugacguccuaacacuaguacucuuu

SEQ ID NO: 4186673 - RNA, 121 nt, Human
aaagcagucauaauacagagcauguuuucuuugaaaguguuuacuugggaacuguacuaaucuauuaacuugaacuguucuuuguucuuucuagagggaacacuucuuauuuuucuuuuuu

SEQ ID NO: 4186674 - RNA, 94 nt, Human
aaagcauuaggucagucccauggguccuugcuggcuucaaaggaguggccucuauuugaucagugagggcagagguacagaaccuaaguucuuu

SEQ ID NO: 4186675 - RNA, 129 nt, Human
aaccagauguagucccuguaccacacuguugaggacgagauguggccuccugcaugcuaucauucuaguccuuauggucugcuucguguucugacuauccugcauucaucaauauccaucucuaaaguu

SEQ ID NO: 4186676 - RNA, 66 nt, Human
aaccaggaaaaacacauugaagagggggaaucauaaucaucccacuucaacaguuauuucuuaguu

SEQ ID NO: 4186677 - RNA, 92 nt, Human
aaccaguaggaaggugcccagcuauuccuuucuuaguuaagucuauccuccugcuucuccugaggguggaguacugggugccgcugcugguu

SEQ ID NO: 4186678 - RNA, 116 nt, Human
aaccaguuauuggacuuguccacacuuuucaaguacauguuguucaaaagccacauguucucgucuaugaggucaagagcagcaugagcuaugaacuggugcagacagugacgguu

SEQ ID NO: 4186679 - RNA, 58 nt, Human
aacccacuuguuugauuauugccugaggagacauuccucuauauggaauagguggguu

SEQ ID NO: 4186680 - RNA, 63 nt, Human
aaccccaugcugugggaugagcaaggggacugccccauugcugguccccugcagccugugguu

SEQ ID NO: 4186681 - RNA, 100 nt, Human
aacccccaacuugcgugggucugcaauuuuuuagcacaaggagagccuuuuaaagaccugguucuucaaggaaagaaugcagguagugugguuggggguu

SEQ ID NO: 4186682 - RNA, 78 nt, Human
aacccucugaaguuauucagugggcugacauacaauuugcaaaguauugccucacaugaauaauuucucuccaggguu

SEQ ID NO: 4186683 - RNA, 67 nt, Human
aacccugagagcuacaggucucguccucgccauuuuacaggugggaaaacugaggcucucagcaguu

SEQ ID NO: 4186684 - RNA, 69 nt, Human
aacccuuccgggcagcuggcuuauagguuugugguaaaagcgaaggugugggucaggcuguuggggguu

SEQ ID NO: 4186685 - RNA, 65 nt, Human
aacccuuuucaucugcuugaaguugugggaugucauucacauaaauuuaccagaugauacagguu

SEQ ID NO: 4186686 - RNA, 58 nt, Human
aaccuaaucaccuugugaaggcccugccucuccacaucauuacaauggugauuagguu

SEQ ID NO: 4186687 - RNA, 71 nt, Human
aaccuacauuaacaggcaaauaauguggcuaacauuuuaauaucacagagcaaauugacuguuaauggguu

SEQ ID NO: 4186688 - RNA, 64 nt, Human
aaccuaggaaucaucaaaacagauaugagacaagaacuuguaccucaugcagguguucuagguu

SEQ ID NO: 4186689 - RNA, 128 nt, Human
aaccugaaaccucuuccuuuaugcucgcgauuuucuaugacuugcuuagaaccaggcuggcuuggcuggacuuagagguggaaaagagagugagcaucugucucuccuuggaggaugagcuuuggguu

SEQ ID NO: 4186690 - RNA, 69 nt, Human
aaccugaaauuugaauggcuuaacacaacgaaaguuuccuuuuugugugcauaaauucugauguagguu

SEQ ID NO: 4186691 - RNA, 62 nt, Human
aaccugaccuggaaauacaagaaguaugucauugacauaucuuuaugauauucaagcagguu

SEQ ID NO: 4186692 - RNA, 69 nt, Human
aaccuggcccuaaucccaguaggaugagguuacucuuugccucuguauuugcuucuuagggcuaugguu

SEQ ID NO: 4186693 - RNA, 66 nt, Human
aaccugucaauuaugccauugcaauauuucagaagcuuuaacugaagugucauauagugucagguu

SEQ ID NO: 4186694 - RNA, 81 nt, Human
aaccuguucucuaguuuugacgaggauuaguuuaaguguuaucuuaagaaaagucuuugccaagucucugagaccaguguu

SEQ ID NO: 4186695 - RNA, 79 nt, Human
aaccuuuggucaauuaaauuucucacuuaggguauuugaacgcaaaaagcuuaaaugagcaguucuugguggcuggguu

SEQ ID NO: 4186696 - RNA, 58 nt, Human
aaccuuuguuguuuauagugguugaaauuaucuucucgaauacuguggaucagggguu

SEQ ID NO: 4186697 - RNA, 89 nt, Human
aaaucucucugcugcugagacuggcuuugugucccuucuucauacacagggcacaauggaccgugugcucugcucuguuuuagagauuu

SEQ ID NO: 4186698 - RNA, 81 nt, Human
aaaugaaaaaaugucgaauuugccucuagccuuuccugacaaccuuagaaagcacugaggaaaaauuugauagauucauuu

SEQ ID NO: 4186699 - RNA, 59 nt, Human
aaaugaaagguuuuaggacagcaauuuaacacucagcaauucccaggaaccuuuuauuu

SEQ ID NO: 4186700 - RNA, 129 nt, Human
aaaugaagcaaaguauuaucaaccaaauuuacagcaauaggaaauacuugcaacuguguguuauguaagauuugcuauguguugucacagauuuaugacaccagcaacuuaauacugugaaaguuuccu

SEQ ID NO: 4186701 - RNA, 84 nt, Human
aaaugaaugauggccccuucuaaacguaaacggagcugcucauccuucagggcuguuuauaaauagaggggaguccauuuguuu

SEQ ID NO: 4186702 - RNA, 83 nt, Human
aaaugacuaagcaguaaguuaguuccuguguuaguuuuuuacauaggacugacaaugagauugauuuaaaugaccugucauuu

SEQ ID NO: 4186703 - RNA, 65 nt, Human
aaaugagggagcauggucaaaagccuuugguaaauuuuaaagugcuuuacaaaugucuguuguuu

SEQ ID NO: 4186704 - RNA, 106 nt, Human
aaaugauuacaagaaauacaguguggguuugggaggaguagauauuaaagugguguuucuucuauuucuuuauauacuuacaugcuauuuuuuuaaaacuuuguuu

SEQ ID NO: 4186705 - RNA, 91 nt, Human
aaaugauuggagaagggaguugugcucacauuuagaauuaggguguuuuguccugucuacugcugacacuaacaguacuauccauuuauuu

SEQ ID NO: 4186706 - RNA, 80 nt, Human
aaaugauuuuuuucugugggacuucaaugcaaugagguagaaaugacuaccguauuaggauucacagacuucuuucauuu

SEQ ID NO: 4186707 - RNA, 67 nt, Human
aaaugccauucaaugaggcaucuggaaauuuguaugagcauuuuguugucacauguggaugguauuu

SEQ ID NO: 4186708 - RNA, 77 nt, Human
aaaugccucugcuguacacaaucuucacaacucuaaaaaugacauugucauggccauuguuagcagcaaaggcauuu

SEQ ID NO: 4186709 - RNA, 88 nt, Human
aaaugccugucaguguguacacuuuccaagaaacacaccaggauguaccaggauagugaugucacacccuugauagaagcuagcauuu

SEQ ID NO: 4186710 - RNA, 73 nt, Human
aaaugcuggcacaaaagaaaacugccaaacaccagcuggucugguagucaacauuuaugagcucuuggcauuu

SEQ ID NO: 4186711 - RNA, 123 nt, Human
aaaugcuucucccaccaaaauauaauaugcuugguugacagaaugguugugugguuaaaacgcagaagaggaagccaaucuuugacuauauguguauuaucuuuauggauccaacuagcauuu

SEQ ID NO: 4186712 - RNA, 92 nt, Human
aaauggaaguuucucuguccuaugcuugauagaaccaugucgguugagacacguuucuaucaugcauagggcaggguauaagaaaucuguuu

SEQ ID NO: 4186713 - RNA, 62 nt, Human
aaauggagggccuggucaucucaggaucugauuuguccuugaaagauuuggccucuguguuu

SEQ ID NO: 4186714 - RNA, 60 nt, Human
aaauggauggguuucuagaugugauaauaaaugcuaacguuuagagaauacucacuauuu

SEQ ID NO: 4186715 - RNA, 129 nt, Human
aaaugggcgguggagaaugcucugugcuggaggacagagccuccuggagguauaggcugcaaggugcagggccaggaagccugugucucuggacaucagggaacagcucucccacaacuggucauucau

SEQ ID NO: 4186716 - RNA, 58 nt, Human
aaauggucacuauguaaggugaugaauauauuaauuaucaugauuguggugacuauuu

SEQ ID NO: 4186717 - RNA, 103 nt, Human
aaaugguuuuaacacagguaucagcaucaguauuguuuaggaauauaaaagaguaauauuucaggagcuuuugcugguuuugccuuacuaaguggcaccauuu

SEQ ID NO: 4186718 - RNA, 63 nt, Human
aaauguacaacauccauauauaaauauaaauaauaugugugguuucugugguguuguacauuu

SEQ ID NO: 4186719 - RNA, 59 nt, Human
aaauguagaucucccuucuggaccuaaucuaaggacuuauaggaaggaagaaugcauuu

SEQ ID NO: 4186720 - RNA, 88 nt, Human
aaauguaggugcuaugaauauuucucuccuguagaaguaauguagcuaugucaauaccaacuucagagacuuuaugguccaagcauuu

SEQ ID NO: 4186721 - RNA, 107 nt, Human
aaauguuuacuaaaauguagcuucuuuguuuaucagacgaacugugguaacagcaguuaugaaacuuaucacaguucaucugauaaacuacauuuuaguaaacauuu

SEQ ID NO: 4186722 - RNA, 72 nt, Human
aaauuagucauguuguauuacuucuuuuuauggcaaugcucugaaagucugcaaaugucagcauguuaauuu

SEQ ID NO: 4186723 - RNA, 59 nt, Human
aaauuauauuugaaagguuggaagucauauuuggcugagcuuuauaucaaauguaauuu

SEQ ID NO: 4186724 - RNA, 59 nt, Human
aaauuaugaauacgagcaacuagcaucuaggcaacugggucugcucuguuuaaugauuu

SEQ ID NO: 4186725 - RNA, 86 nt, Human
aaauuccuuuuagucucuugaguaaugcaagccuuuguauuacauguuaauuaaagaguuuauuacuuguaagacuaguuguguuu

SEQ ID NO: 4186726 - RNA, 93 nt, Human
aaauucuacucuaaauugguauguauucugaaaacugauuggaaaguaagauaaucccccacuuuuugaguauaacuaauuagacugguauuu

SEQ ID NO: 4186727 - RNA, 55 nt, Human
aaauucucuucagaggaaccagguggguaucugaacuuccuuugaaguaggauuu

SEQ ID NO: 4186728 - RNA, 64 nt, Human
aaauucuugggcaccagcccagaccuacugaaucagaaguucugggaguggcgcccuacaauuu

SEQ ID NO: 4186729 - RNA, 108 nt, Human
aaauugccuuuucuuggagaaaaaaauacuuacagauuguggcuguggucuauuaugcucaaguaaaucacaucgaaaucuggguguguuuuauccaaaagacaauuu

SEQ ID NO: 4186730 - RNA, 70 nt, Human
aaauugcugugacugugcagcuagagccucucaauauuuucaaugcucuagaacuccaguuaggcaauuu

SEQ ID NO: 4186731 - RNA, 56 nt, Human
aaauugugcuuugacuccugccuguuuaggucccuggaaaauucagagugcaauuu

SEQ ID NO: 4186732 - RNA, 94 nt, Human
aaauuuagaacugaaauaauaucuggaucaaucccuuaguuuaacagcuaaggacacugugggacaauccagcuauuauuucaguucuaaauuu

SEQ ID NO: 4186733 - RNA, 63 nt, Human
aaauuuaggaagcacucauuuaaaggagccacagcucugagaaugaguguuuucuuaugauuu

SEQ ID NO: 4186734 - RNA, 56 nt, Human
aaauuugaagugccaauuuugugcuaaacguagguagaaaauggcguuuuagauuu

SEQ ID NO: 4186735 - RNA, 128 nt, Human
aaauuugguaaauuuguauaaacacuguagcauaugguuaggugagaugauauuauaaucacauacucaucacucugauagauaagcuaacuauauuagucuuuuguacaaaauacacuacugaguuu

SEQ ID NO: 4186736 - RNA, 105 nt, Human
aaauuuucugggucagcugagauacucaguguaauugaugaccaaggcuagaagguccaaguugcugauuaacacuuugagugcucagugcauucuagaauuuuu

SEQ ID NO: 4186737 - RNA, 129 nt, Human
aaauuuugugguaauucaguuuugaauagucagaacagcuaggagaaaagguguuuucguuuauucuuaaaaaggaacauuuaaauucuuauuugaucauuugaaagcuauuuuuauaccauaaaacuu

SEQ ID NO: 4186738 - RNA, 104 nt, Human
aacaaaaaagagaauauauaauuuuuuggccacauccuuuugaguauuggcuuuuaaaauuuagaacuuuguuugccaauuuacuaauauauuaauauuuuguu

SEQ ID NO: 4186739 - RNA, 76 nt, Human
aacaaacuacagggcucuuccggagcagggagaguaucacacucaucuuuguauccccagggucugguacaguguu

SEQ ID NO: 4186740 - RNA, 67 nt, Human
aacaaacuguguucuuugcuuuuagggaauugcuuuccccccaaaguuagucagaaccagccauguu

SEQ ID NO: 4186741 - RNA, 65 nt, Human
aacaaagaugcauuuuguugccugcuaagucuccuuaaaauuuggcacagcaggugugcuuuguu

SEQ ID NO: 4186742 - RNA, 61 nt, Human
aacaaauguuauguuuuuguguccagcuauucagcugggaugucuauagaacacuuuuguu

SEQ ID NO: 4186743 - RNA, 84 nt, Human
aacaaauuaaagaacacugugagguaaugaccuaagacgauauucgucugucuuuuccaugccuuuuaugauucucugaauguu

SEQ ID NO: 4186744 - RNA, 130 nt, Human
aacaacuauuagcauacaauugguuaaauccauuucaaagauaauuaccaaacauaaaguaaaacuuuauuuggaaaugcaucucuugagaugguuggggcuguuauuuuucuguuugcuccugguucuu

SEQ ID NO: 4186745 - RNA, 62 nt, Human
aaauugugcucacacugauauuguaacuacuguugcuuaucaucuguauguggcuauaauuu

SEQ ID NO: 4186746 - RNA, 70 nt, Human
aaauuucacauucuucugaaucuacaucuguuuuucagucucaggacaguagaugaagaguguguaauuu

SEQ ID NO: 4186747 - RNA, 78 nt, Human
aaauuugaaagugcagucagacaaggcagucacuuaaaagcaacuaaacugugauuugcuugacuuaguuucucauuu

SEQ ID NO: 4186748 - RNA, 125 nt, Human
aaauuuggaagaaagaucaaaauugacuuuuuaaugggguggcuagaaugagugucaguuacagugcuagacacuagggauuuaguacugaggaaaguuggucguggucuuuauaacucaguguu

SEQ ID NO: 4186749 - RNA, 94 nt, Human
aaauuuguuuaauucaagaauguaaagcucaggucaggagauuuuauuauagauucaagcuucuagcuuuguauuuuaaaaauuuaauaaauuu

SEQ ID NO: 4186750 - RNA, 83 nt, Human
aaauuuuuaccacauggauagauagggacauagcuauaaauauguagauacagaugugucuuauuugauuccacaaaagauuu

SEQ ID NO: 4186751 - RNA, 77 nt, Human
aacaaaaacucccuugacuccucagauggccuauguagacccaugauguccuugaguaagucauggugguuccuguu

SEQ ID NO: 4186752 - RNA, 63 nt, Human
aacaaaccuggguggagaaaggacgcccucccugaacugguccuuucugugcccaggucuguu

SEQ ID NO: 4186753 - RNA, 63 nt, Human
aacaaagaagacugguuauuuuuggucccacagaaaauccgagaauagcuuaucaaucuuguu

SEQ ID NO: 4186754 - RNA, 128 nt, Human
aacaaaguguauuuacauugaaugcaucucacuugucccauggacacaacuucuucuaaaaacuuggaaaggauuuauugccuguggaacaugagguguuauguuuaauuuugcacauacauuuuguu

SEQ ID NO: 4186755 - RNA, 84 nt, Human
aacaaauagcuuugcccaguauuaaagcaucacacuauuaauuaguucucugcuaggugugguguuucuugauaguuauuuguu

SEQ ID NO: 4186756 - RNA, 75 nt, Human
aacaaauuaacuguagagaaucugagaaaaaggauaguuuaucauuuugucucauuagguuuucuuugauuuguu

SEQ ID NO: 4186757 - RNA, 59 nt, Human
aacguaagucucucaagagggucagcauuuacuugcuguccugaaagggagauuggguu

SEQ ID NO: 4186758 - RNA, 76 nt, Human
aacgugcucccuccuuguuacucucucuaaaugcuuuacaguagccagggaaggauaacaagaagaacagcguguu

SEQ ID NO: 4186759 - RNA, 93 nt, Human
aacuaacuccucucccugccugcucuauccaggccugcuuaccuuggccccuggagccucccagagcagaggcugggacuuggacaauuaguu

SEQ ID NO: 4186760 - RNA, 62 nt, Human
aacuaacugcucauuugagaguaugcuggugacggcaggcaucugggaaugaggcagaaguu

SEQ ID NO: 4186761 - RNA, 62 nt, Human
aacuaaggcccuugcagucauugggcaucaccuugccuuguuccuucauguggucauugguu

SEQ ID NO: 4186762 - RNA, 66 nt, Human
aacuacaaccauagacauauacuaggcaguacugcaagagccuaaacagugcauauggguguuguu

SEQ ID NO: 4186763 - RNA, 87 nt, Human
aacuacaucuaaccucaguuauuggguugugggaguaaaauaauuuaagguuuacauguaaucuaaaauaauugaggaucuauaguu

SEQ ID NO: 4186764 - RNA, 63 nt, Human
aacuacuuuucauaaugaagcagcauauuuucuugaugugucuuuuuaccugugaugaguguu

SEQ ID NO: 4186765 - RNA, 66 nt, Human
aacuaugccauuauucauuucagugggggcauguaaccucaaagaauguuaugaggguagcucguu

SEQ ID NO: 4186766 - RNA, 94 nt, Human
aacuauggcauaauuaaggaggcucaauacaagguuguaugaaaacaauugcauaaacaauaaguauugggcuuuugaggauuguuacaaaguu

SEQ ID NO: 4186767 - RNA, 130 nt, Human
aacuauguaguuaucgcugaaggucuuuuccaucaaguuauucugacuuauuuguccuugguguccauaagccauguuggccacaggaauaagucaaacuucacucugggaaagcgaaugauuuauaguu

SEQ ID NO: 4186768 - RNA, 93 nt, Human
aacuauucuuagcucauaggacaaacuaaaacauggaugagcuagauuuggcuugugcaucauaguuugccaauuccuguucuaaaguauguu

SEQ ID NO: 4186769 - RNA, 58 nt, Human
aacucacagaugagcugaauagcuuuaacaauagcagcuguacuuucaucuguuuguu

SEQ ID NO: 4186770 - RNA, 85 nt, Human
aacuccagcuauguaaacuguagggaucugucuuagucagcucaagcuguuacuaacaaaauaccauagauuggguagcuuaguu

SEQ ID NO: 4186771 - RNA, 78 nt, Human
aacuccccuuuccugagucccuucccugagucccuuggagguccaggccugggcuucggggcugagggaaggggaguu

SEQ ID NO: 4186772 - RNA, 61 nt, Human
aacucucuugggaguaccuggaguaagacaauaagcuccugcuauucaacaagaggaaguu

SEQ ID NO: 4186773 - RNA, 87 nt, Human
aacucugagaagcacugccauaauucagaccuuucauuuucucuguguguauguguguuuuaauuguggggugcucauaguggaguu

SEQ ID NO: 4186774 - RNA, 60 nt, Human
aacucuuaauuuucaugaaaugagguaaacuuucucagggacaugaaaauauaaugaguu

SEQ ID NO: 4186775 - RNA, 103 nt, Human
aacugaggcuucagaagguuaaauaaauugcugagagucaccuagugaguaaaugguagagcucagcuuugaucucaggcaaucuaccuccaaaguccauguu

SEQ ID NO: 4186776 - RNA, 76 nt, Human
aacugaguagcaaucuacaaaaacugucucaggaaucaagaaucgguuugugcuauauuuauggguugccuugguu

SEQ ID NO: 4186777 - RNA, 55 nt, Human
aacugauagauucauguaacuguucagcucaucgaacauggaucaaaugucaguu

SEQ ID NO: 4186778 - RNA, 57 nt, Human
aacugcagagaacaucuggguuagcucaccguuucuagacccagaaauuugucaguu

SEQ ID NO: 4186779 - RNA, 78 nt, Human
aacugcagcagaagcauguccuuaaggcacagaucacucaugauauuguuuguggcuuaagaaugccuuuaagcaguu

SEQ ID NO: 4186780 - RNA, 61 nt, Human
aacugccuggccaggcugcaacagcuucccauuucacguugcaguuuaacuuugagcaguu

SEQ ID NO: 4186781 - RNA, 121 nt, Human
aacugcuauuugacuaguagacaaggcugacaaagacaauacagaaagggacaugcauuugguaauuccagaaagcuuuuguggcugucuucauuguccuuacuucaaaugguuagcaguu

SEQ ID NO: 4186782 - RNA, 58 nt, Human
aacugcugaucgaaucagucacccucauggacagagggacagagcacaucagcauguu

SEQ ID NO: 4186783 - RNA, 55 nt, Human
aacugcuucuuacugcugggcaccacauaggcuggugcccagcaagagugcaguu

SEQ ID NO: 4186784 - RNA, 59 nt, Human
aacugguauuucccaugaauuuguaugguauaguacaaguaacagggauaauagcaguu

SEQ ID NO: 4186785 - RNA, 109 nt, Human
aacugguccaagaacuugagguaggccugacgcuggggugcagcugcuggaaugaaguggccaccagagugggugagggugauggcuccgggaaauuggcuggccaguu

SEQ ID NO: 4186786 - RNA, 61 nt, Human
aacugucaguguuuggcuuucaucagacugaacauuuugguguacacuugaacugacgguu

SEQ ID NO: 4186787 - RNA, 61 nt, Human
aacugucuacucuagcuaugagcuuggugaagguuguucugcaacucagucuggagcaguu

SEQ ID NO: 4186788 - RNA, 87 nt, Human
aacugugcccagucugugccaguguauuccugugacauugcucauugauggucauggugaggacacuggagcaggaguggcaugguu

SEQ ID NO: 4186789 - RNA, 57 nt, Human
aacuguggacuugagacugaugaaauccgaguuuuauuucugucucugccacuaguu

SEQ ID NO: 4186790 - RNA, 60 nt, Human
aacuguuuuccuggguuccaugagcuguucuagcaaauguucaaaccugaggagggaguu

SEQ ID NO: 4186791 - RNA, 85 nt, Human
aacuuacaucaguaucucaaagugguuuauggcccuaaaacuuggaguuauaagaaauaccugggguuacuccugauguguuguu

SEQ ID NO: 4186792 - RNA, 67 nt, Human
aacuucaagauauuucuagaaucagauuguucaucuccauucuugguucuguuauuauuuggaaguu

SEQ ID NO: 4186793 - RNA, 56 nt, Human
aacuucagggggcacauucaagcagacugcaaugagaauggugcccccuggaaguu

SEQ ID NO: 4186794 - RNA, 68 nt, Human
aacuucaugcaucccacucccuccacuuuauuuagaguuuuuugugcagggagcuuuagguagaaguu

SEQ ID NO: 4186795 - RNA, 62 nt, Human
aacuuuaauuauuuuucacuuagagaucauacaguucuagaguagugugaguaauuggaguu

SEQ ID NO: 4186796 - RNA, 78 nt, Human
aacuuucaugugucuaaagaucauuuaguaugcuuauuccaaaugcagauaaauugcugauuuuagaugcuuugaguu

SEQ ID NO: 4186797 - RNA, 62 nt, Human
aacuuuggcagguggucuaugugauaagucaccuuaucauuuaacagaaucauugcuagguu

SEQ ID NO: 4186798 - RNA, 88 nt, Human
aagaaaaacacugaauuaagcauuacauacauuccucucuggaugagaacuggguguauggauucuuggguucaugauugaaauucuu

SEQ ID NO: 4186799 - RNA, 66 nt, Human
aagaaaagcaucuuuguaguagugcuggaaaacuauucagaauauacagauaaaaaugcuguucuu

SEQ ID NO: 4186800 - RNA, 78 nt, Human
aagaaaaggcagcaucccaggccacauucugggaggugcaguauucccucucuggcuggggugcggagccugguucuu

SEQ ID NO: 4186801 - RNA, 98 nt, Human
aagaaacuugucaucuggaaacaggaaaaaucacaugaaguaauuuuauuuguaucauggcuuuuucacuguucgcuacauuugugacagcugauuuu

SEQ ID NO: 4186802 - RNA, 83 nt, Human
aagaaagugcggucuguagugaauucuaauaaaaggaauuagauuacccauccccaucuuauuguuuacuacagcacuuucuu

SEQ ID NO: 4186803 - RNA, 129 nt, Human
aagaaaguguguggguuuagcuguuuggugaaacaggaugagaagggcucuuacguuacucaucaacugagaaacauauuuccaucuauuuauacuaacacaucaaucuggaugcauacacugugacuu

SEQ ID NO: 4186804 - RNA, 118 nt, Human
aagaaauaggagagagaaauggaugaggagaggaaaagcgaggcuauuauugaauaguaaaauggaagccauuguugucuucaucuucagcccauccccaacacuccuuucauuuuuu

SEQ ID NO: 4186805 - RNA, 63 nt, Human
aagaaaugcagaaaugugcuggaagacaauucucugugggacucuaguauuucugcaugucuu

SEQ ID NO: 4186806 - RNA, 92 nt, Human
aagaacaugaaaguuauuacugaugaugucccgcaaucugaucaaacacuuaagggacagccgucacguuaugauuuuaccgcacuguucuu

SEQ ID NO: 4186807 - RNA, 63 nt, Human
aagaacggacagauuuugcuuacauaaaaauuauacaguaaaaugcaucauuugucucuucuu

SEQ ID NO: 4186808 - RNA, 65 nt, Human
aagaagagaacugccaaacacuuaagcaaacagaaacagcugaagaagagguagugucuuuucuu

SEQ ID NO: 4186809 - RNA, 56 nt, Human
aagaagauaaugcaacuaacauugcccaacagugcaagauuaggggcuuucuucuu

SEQ ID NO: 4186810 - RNA, 70 nt, Human
aagaagcauaauguuguaacacauagaggacugggguaguuugcauccagguuuuggcaauauucuucuu

SEQ ID NO: 4186811 - RNA, 75 nt, Human
aagaagccuguuuagacucaaaauugaaaggcaaagaguuggcauuuuuaauaggucuagacacaguuauuucuu

SEQ ID NO: 4186812 - RNA, 72 nt, Human
aagaagucaacacugugugucaggcugccuuuugaagcaugguuccugacccuuuccaguguuggcagucuu

SEQ ID NO: 4186813 - RNA, 130 nt, Human
aagaagucaaguuuuuugaagauuggaguuaguuauauuagggaaugcugaauuuaguauuuaugugaaauucuauguaaguuuucuuguauuuuuaauguguuuucucuuguuaccaguuuuugugugu

SEQ ID NO: 4186814 - RNA, 96 nt, Human
aagaagucaucauggaagaaucuuauacugcagcauagauuuaaaguuggagauccauggcuaaguauauagagcuugauucgagauugauuuuuu

SEQ ID NO: 4186815 - RNA, 68 nt, Human
aagaagucugauuuuuagagguggccugcuauaaaauaaacacaaugcuucuggcaaacagaguucuu

SEQ ID NO: 4186816 - RNA, 85 nt, Human
aagaagugggaggguggggugcauggcuuagaaacuaucagacaccagagauuaaguucuaacuccacuucccacucccaaucuu

SEQ ID NO: 4186817 - RNA, 60 nt, Human
aaccugcuuucucagagaagggaaaaauagcucccuaacaaagcacugaaaaguaugguu

SEQ ID NO: 4186818 - RNA, 81 nt, Human
aaccuguaaauccaaacaaucucacaguuaugaaauggaaaauuuguggggaaaaacaaaugcuuugguuauuacaguguu

SEQ ID NO: 4186819 - RNA, 76 nt, Human
aaccuuuccugugaauuuauaacaucauagagucuuagaaccugagaucauuugacuuuauaaggcuuuaaagguu

SEQ ID NO: 4186820 - RNA, 90 nt, Human
aacgcuaaauuuauaauaacucuaauggauacaaaagagaaaacacuccucauuacuuguacugcuugguguuguuguaucuuuauuguu

SEQ ID NO: 4186821 - RNA, 67 nt, Human
aaaguucauucagagucuuggcaauagguuacucucccuugucacuuaaugccagcucuuguccuuu

SEQ ID NO: 4186822 - RNA, 63 nt, Human
aaaguucuuugcaucuuugcucuacacuagaaugcuccuaggccagggaugguaaaugacuuu

SEQ ID NO: 4186823 - RNA, 70 nt, Human
aaaguugagguggauacauuaaauaaugcucacuuuauuugagcaagauuuaagagucagccuugacuuu

SEQ ID NO: 4186824 - RNA, 79 nt, Human
aaaguuggaagcacauugauuuauuuuggagcaguccgaacaguuucuuugauaauaaauucaaucugcgcucaacuuu

SEQ ID NO: 4186825 - RNA, 64 nt, Human
aaaguuggggugggaauaccagguuucuguucaagaaaccuuucaauuauccucaucuuacuuu

SEQ ID NO: 4186826 - RNA, 57 nt, Human
aaaguuuccugcuaagugcuauaaaggaagauauccauaauguacaguggaggcuuu

SEQ ID NO: 4186827 - RNA, 58 nt, Human
aaauaaaaggcagaggaaggaagaauuccccccccuuuuuuuuccugccucauuguuu

SEQ ID NO: 4186828 - RNA, 82 nt, Human
aaauaaagcaggcagcuacuugcacuguuucagguuuuucuuuaaauccuguaaacugaggguagcugauuggauuuuauuu

SEQ ID NO: 4186829 - RNA, 87 nt, Human
aaauaaaucuacacaauuaguugcaaagugaaugguauagauaaucugaucacuucuuggaaaugaacaugugagauagauuuguuu

SEQ ID NO: 4186830 - RNA, 72 nt, Human
aaauaaauguauaggcacuaaaccucaaggugguuacuaagaccuccagauuuagugccuauacauuuauuu

SEQ ID NO: 4186831 - RNA, 58 nt, Human
aaauaacagucagggacaacauugauccuacacuuguaugugccugugcugugcauuu

SEQ ID NO: 4186832 - RNA, 78 nt, Human
aaauaagcuaguuaaagcuacacauuauuaauccagauuaccuggguucuaugccuggcuuugccacuaaauuuguuu

SEQ ID NO: 4186833 - RNA, 81 nt, Human
aaauaauuaggucauuuuuuuaagagcuuuguuugaaugggaaaauauuuacauggauguaaaaaaguuauuuaguuauuu

SEQ ID NO: 4186834 - RNA, 83 nt, Human
aaauaauuugaaagacaauauggccaaagaauuuuaucuggaccuuucuuacaggacuuugucauuuugucucucaguuauuu

SEQ ID NO: 4186835 - RNA, 87 nt, Human
aaauacuaaggcaagguauugcauuauuacaagguaagacuagagggacuagagacuuacuuuugaugcaugagugucuuauuguuu

SEQ ID NO: 4186836 - RNA, 60 nt, Human
aaauacuagaauucagaguugacuuguuuuucagguuaucugaaauauuuuuuaguguuu

SEQ ID NO: 4186837 - RNA, 95 nt, Human
aaauacuauuagagcacaauggaaaaggcagugugucuauguguaauauggcguaauagacauggucuuuugucauugaaauaauaauacuguuu

SEQ ID NO: 4186838 - RNA, 92 nt, Human
aaauacuuuuguuagcauuuuguacaacuuugcuggaaaauuggagcacaguaaugugagcguuggacagugcuaggugcuaagaaagauuu

SEQ ID NO: 4186839 - RNA, 65 nt, Human
aaauagaacaaaaucaaaggagugauucaguuuaucacuguccugcuuugauuuuguauguauuu

SEQ ID NO: 4186840 - RNA, 81 nt, Human
aaauagaguccuugggaaaagcuugauuucaugcucucaaguggaaaacauaaagcuuuuccuucaggcacaacccuguuu

SEQ ID NO: 4186841 - RNA, 126 nt, Human
aaauagaugccucuuauagauaacaaagcucucauugcauuuauucacuggcaguauuuauucauuuagcuccaacugugugugaggcacugacaaugcuggguauggggcuggcuggcacuauuu

SEQ ID NO: 4186842 - RNA, 100 nt, Human
aaauagcuguaucauuuguaccagcaauguaugaguguuugaguuuuuccauaucuucaccaacacucaguauuguuagucuuuuugauuauagacauuu

SEQ ID NO: 4186843 - RNA, 65 nt, Human
aaauagggccaguuagggaagcuuugcaaucgugcaaaaugucugccccuugcuguauccucuuu

SEQ ID NO: 4186844 - RNA, 105 nt, Human
aaauauaaauauaugguugaugacuuguugcuuccaguuuuugaugguuugaugaaaaugcacgcuggaaagcacuuauuggaaugaauuuuauagacuauauuu

SEQ ID NO: 4186845 - RNA, 125 nt, Human
aaauaucauugguuuccuuucucuuuuuagauucaaagugaagaacuuaaaugucuauggaaaaugacaaauucuuaauacguucugaacuuuacugaagggagaaagauuuccaggugcuguuu

SEQ ID NO: 4186846 - RNA, 88 nt, Human
aaauaugagacauaccucuuaauuguacuccuucagcaaguugacuauguauuuguugucucuucaguuaagagaaggucuuauuuuu

SEQ ID NO: 4186847 - RNA, 56 nt, Human
aaauaugcuguacuagguguagcauaacauuguuacugccuuguucauguguauuu

SEQ ID NO: 4186848 - RNA, 75 nt, Human
aaauauguagauauuaagucuuuugcugucauagguguuuaaaauauauguguauguagauguaucuguauauuu

SEQ ID NO: 4186849 - RNA, 91 nt, Human
aaauauuuuggaguuuguaugccauuugcuuaguugucuuuuacauguaaaauccacaauuccacauggcaugcagguuuucuguguguuu

SEQ ID NO: 4186850 - RNA, 57 nt, Human
aaaucaaccaaccacuccagcuagcacuggcuaggcagaguuuaaugguuaagauuu

SEQ ID NO: 4186851 - RNA, 92 nt, Human
aaaucaggaggcaagcagcuauggugacaaggucagguccagggucucuacuguucuccuggccuuuucucaugcuggcuacuucaggauuu

SEQ ID NO: 4186852 - RNA, 66 nt, Human
aaauccuaccaagaaauucccucuuuccuuuaugggauuugcuugguggauuugcuugguggauuu

SEQ ID NO: 4186853 - RNA, 86 nt, Human
aaaucucccucagacacacuauguccuugccugccaaccauggucacucacauugaggacugaggagguaagguuugaagagauuu

SEQ ID NO: 4186854 - RNA, 60 nt, Human
aaaucucuugugguccacacuguuggcuggcuaagccagcaucuguucccaacgagauuu

SEQ ID NO: 4186855 - RNA, 58 nt, Human
aaaucuguauuguuaacaaguaaucaccuccuggugauccuuguuaucaagcagguuu

SEQ ID NO: 4186856 - RNA, 119 nt, Human
aaaucuguggucuuccuauguacauguguguguacaugcuuaaaaugcaauguuauaguuaaauguaauucauuaaaaguauguaacuccaguggcuacuuaguuuggcuacuugguuu

SEQ ID NO: 4186857 - RNA, 71 nt, Human
aaaugaaaaucccuuuagaaaacugccagacauucagcccuggccaaauggauuugaaaggauuguuauuu

SEQ ID NO: 4186858 - RNA, 81 nt, Human
aaaugaaaugguuugucuuaaaugaaaguguaucugugguagcauaguuauauccagucuuuaaaauggaucauuucauuu

SEQ ID NO: 4186859 - RNA, 90 nt, Human
aaaugagaaugucuuccauuuggcacuucacugaggcaucccaagguaccuuagggcacuuccaguggaguaaauggacaauuaguauuu

SEQ ID NO: 4186860 - RNA, 89 nt, Human
aaaugagcccaaagcauccauuuuuucagaaugcucucagggaaugcaugccugaucuguagaagguggcugcauagaugguaucauuu

SEQ ID NO: 4186861 - RNA, 56 nt, Human
aaaugauaguauggaacuaggauggagacuccauccauacucuaaacauguuauuu

SEQ ID NO: 4186862 - RNA, 91 nt, Human
aaaugaugugcacaugugaaauuuagaaauuucuuuucauaaggccuucuucccuuaaggaguuucaaagcuuccauguguuaucucauuu

SEQ ID NO: 4186863 - RNA, 66 nt, Human
aaaugcaaauugcuggauccuacucccagagauuuguaaauuccuggggucagauaauuugcauuu

SEQ ID NO: 4186864 - RNA, 61 nt, Human
aaaugcaagaucaaaucuaacacaaauugugauggcacguguuuggugugaucuugcauuu

SEQ ID NO: 4186865 - RNA, 57 nt, Human
aaaugcagagauuuggauucaaacuuggucugggaugaggcucacaaaucugcauuu

SEQ ID NO: 4186866 - RNA, 57 nt, Human
aaaugcauuuuuaauuagacccagcagaucugggcuaggagucugaaauuugcauuu

SEQ ID NO: 4186867 - RNA, 74 nt, Human
aaaugcucagcaggaugggaagaacucaagaagaucuucaguuuauuucuuguuccacauucuguuaacuauuu

SEQ ID NO: 4186868 - RNA, 57 nt, Human
aaaugcugcagcuaguguguuuuuuaaaaauagacauuuuauuacacugcagcguuu

SEQ ID NO: 4186869 - RNA, 80 nt, Human
aaauggacuuugcauaaauaugucuuuguccaugugcagucuuugggcgcacgucaacaagggcagcaaggcagccauuu

SEQ ID NO: 4186870 - RNA, 86 nt, Human
aaauggagacauaagacaauaaucaaggagguaauuuucauuagcacaguuauugccugucauuauugaaucauaugugccuauuu

SEQ ID NO: 4186871 - RNA, 62 nt, Human
aaauggagcugcauuuagggagccuuuuuacaguggaguguaaggcugcuauguaucuauuu

SEQ ID NO: 4186872 - RNA, 98 nt, Human
aaauggccaaaggaagggaaauagugaugucgcuuugugcaacuuuuagaguaguuuguuucaugccagacauuacuuuuauccuuucugccccauuu

SEQ ID NO: 4186873 - RNA, 57 nt, Human
aaauggcuaagcagggguucugacucagaucugucagcaucuacagcuuugcuauuu

SEQ ID NO: 4186874 - RNA, 76 nt, Human
aaauggguuccacuggguuacaguccaagugccugagggugguauccuuuccgaaggcaguaagccaaauccauuu

SEQ ID NO: 4186875 - RNA, 71 nt, Human
aaauguaacuuauuuaaguuguuuauccuuuggcuuuguaggucgaagguuaguuuucaauaauuacauuu

SEQ ID NO: 4186876 - RNA, 75 nt, Human
aaauguaagaagggauaaaagcagauuucacagauucuucagcgcuuugaaaauaggcugcaucuccuuccguuu

SEQ ID NO: 4186877 - RNA, 67 nt, Human
aaauguaauaugcuuuuagugcuaccucugcaagaauuuugugagcauugaaccagauguuacauuu

SEQ ID NO: 4186878 - RNA, 119 nt, Human
aaauguagacaugcuaagagcaggaauuaaacucaaguuucuuaaugucagaucugauacucuugacacuugcccuuagaaacauguaguugauuauuuuuguuuuucauguuauauuu

SEQ ID NO: 4186879 - RNA, 77 nt, Human
aaauguaugugcgaagcuggcucugaugucagaaugaaccauuuucacaggauugggucagcucccacucaacauuu

SEQ ID NO: 4186880 - RNA, 84 nt, Human
aaauguggaggaaaaauguauacaugugugucugggaagcauauacacuuguacauuuuuuaauacucugauucuguaacauuu

SEQ ID NO: 4186881 - RNA, 59 nt, Human
aaauuaagacuccaugcugggcuaauucauuagauuagcagcuguggaguuuugcauuu

SEQ ID NO: 4186882 - RNA, 130 nt, Human
aaauuaaguggaaaaugaguauauuuggauugcccuuaaugacuguaccaaggcuucaugugcuaaacagaguggcuggucuuguggggucaccugggccuuguuuuucagccucccuuucuuauaacuu

SEQ ID NO: 4186883 - RNA, 75 nt, Human
aaauuacaauaauacaugcucauuguaaaauauucugaguauaggaguagaaaauaaguguguauuaugugguuu

SEQ ID NO: 4186884 - RNA, 68 nt, Human
aaauuagaaauacuuucaaagcuaccucacauacuaaugguagaguuguuugaguauuuaggugauuu

SEQ ID NO: 4186885 - RNA, 79 nt, Human
aaauuaucauguuggugguuucgguaaguguguaauauuuuaaacauuacauguauagaggccaccaacaugaaaauuu

SEQ ID NO: 4186886 - RNA, 81 nt, Human
aaauuaugcugggcuucacagagccuuuaauauguuagucuacauuguaaagcuucgggaggagagauaauagcauaauuu

SEQ ID NO: 4186887 - RNA, 63 nt, Human
aaauuauuauaggcagagcugaauuuaaguguucagaagaaucuuucucugucucuagaauuu

SEQ ID NO: 4186888 - RNA, 85 nt, Human
aaauucaccuagauucauuaucuucuuuguacagaaaaaacucgaccauggccacagaguuuaauggguacuagaggugguauuu

SEQ ID NO: 4186889 - RNA, 72 nt, Human
aagacgacaccugcucccucaguuccagcagccccuaacacugcgcugacauuuagguaguagcagcguuuu

SEQ ID NO: 4186890 - RNA, 57 nt, Human
aagagggagagccaggaguggcuacucccagcuguggccugccugcgugacccucuu

SEQ ID NO: 4186891 - RNA, 66 nt, Human
aagagggaggugcgggugcagacuggguucuaaaccccagaguucauauucugcuucucuucucuu

SEQ ID NO: 4186892 - RNA, 97 nt, Human
aagagggaugccaucaugauuauuugauucugcagaguucaaugucaacuuggccucuguuuuucaauaguucuugaaaugucuguguauuccucuu

SEQ ID NO: 4186893 - RNA, 58 nt, Human
aagagguacgugccccaaacaagaaaauuauuuuuuggcuccagugguuugugcccuu

SEQ ID NO: 4186894 - RNA, 71 nt, Human
aagagguuccucaugguuuuacccccuuguauuuucuaaagccuggaaguagaaacaugagagaaacucuu

SEQ ID NO: 4186895 - RNA, 71 nt, Human
aagaguaagguuuuaaaaaucaaauacagggcuucaaauuugggguuucugauguuuaauacuaugcuuuu

SEQ ID NO: 4186896 - RNA, 81 nt, Human
aagaguacucuggguaaagaaggcaaccugguuauguuaucuuaaauauggauuccuacugccuucuguuacucguaccuu

SEQ ID NO: 4186897 - RNA, 129 nt, Human
aagaguggaauuauuaaaucuuacaguagguguagguauaauauuuugaagaaaccgacaaacuguuuugcaaagugguuguacuauuuuacauucccucccagcaauauacauguguuccacuuccuu

SEQ ID NO: 4186898 - RNA, 114 nt, Human
aagaguggagaggcuccauuugguuugaauuugaaccauuauuuggaguauucaaccaacugaguacuucaaacaaugguacaaacugaaaccaaauggagccucucaacucuu

SEQ ID NO: 4186899 - RNA, 106 nt, Human
aagagugggcauccagcacuuauuucccagggcccucauaguugccacaauaccauacaugggaagcugaaaaguuuuguggaaaaagauguuuaaaccuauucuu

SEQ ID NO: 4186900 - RNA, 91 nt, Human
aagaguggggagaggaauuugaaugauuggguaguuuucauuauauaguagccuuuuaaaaaauccuuuaacuuucuucuuuuuuucucuu

SEQ ID NO: 4186901 - RNA, 76 nt, Human
aagaguuguaggaaagguaaaagugagagaaacagguaacuucugugcuaaguucaaugccuuucucuaagcucuu

SEQ ID NO: 4186902 - RNA, 71 nt, Human
aagauaaacaaaggagagacuuugguuucucauucagcaugaaagaagcuuggaagucuuccuuucaucuu

SEQ ID NO: 4186903 - RNA, 73 nt, Human
aagauaaacauguaugcuuuccuucuuucuggcuaggccuagcuugcaagcugagaaacagagcauaugucuu

SEQ ID NO: 4186904 - RNA, 63 nt, Human
aagauaacaggaggaguuuguauagcagaagaaaauagguaaggcucucuucuucugugucuu

SEQ ID NO: 4186905 - RNA, 57 nt, Human
aagauaguagaucugaacagguuuaagcggggguaugaugugucagauuugcuccuu

SEQ ID NO: 4186906 - RNA, 81 nt, Human
aagauauuucauauacagauaaugaagaccaagcuaguggcugcacuguaggucugcugcuuauuuguauuuguugugcuu

SEQ ID NO: 4186907 - RNA, 66 nt, Human
aaggugacaaaaauucugaaugguucgaaagagguagaauauauuucuagaauccuugucuacuuu

SEQ ID NO: 4186908 - RNA, 78 nt, Human
aaggugacugaacaagaggaaggguaggugaaauagaggucauaaaaucauuacaggaaccagauuguucagcaucuu

SEQ ID NO: 4186909 - RNA, 60 nt, Human
aaggugagccucaagugaccuuugcccacuugggaucggguuuccuucuggcuccuccuu

SEQ ID NO: 4186910 - RNA, 80 nt, Human
aagguggauauauggagagagaacuuuguaaaggcuuccugaagcccaauaugaacaucucauuucccuugaucuaucuu

SEQ ID NO: 4186911 - RNA, 61 nt, Human
aagguggauguaagcggcaauguuugggugccaaauauuacugcugcccuaagaccaccuu

SEQ ID NO: 4186912 - RNA, 62 nt, Human
aagguggcagacuacggaacacauucauagaguguguuacaaaucaccugugcugucacuuu

SEQ ID NO: 4186913 - RNA, 58 nt, Human
aagguugcuguuuugcuucaaaucuuauuuuagauaccagaagcugaauauuaacuuu

SEQ ID NO: 4186914 - RNA, 75 nt, Human
aagguuuguuugauuucccucaucauaacagaagucuucugcuuuuguuccuuaggggagauguucuugaacuuu

SEQ ID NO: 4186915 - RNA, 90 nt, Human
aagguuuuugauaccaagcaggugcguccucagcagcaucuaaagacauggcugcugcugaggaugcaccugcuugguaucaagaaccuu

SEQ ID NO: 4186916 - RNA, 87 nt, Human
aaguaaaaaauccuguucucauaguggaaaauaggucaaauaucuuguuuugaaccugugcccccuauagaauagaggcacauacuu

SEQ ID NO: 4186917 - RNA, 66 nt, Human
aaguaaaaaguucagauuagacucaagagcucugguuugcucuugauucuucugucacuucugcuu

SEQ ID NO: 4186918 - RNA, 62 nt, Human
aaguaacacauguuacuucugccuacauuucagugguuauagcaagucacauggucaugcuu

SEQ ID NO: 4186919 - RNA, 74 nt, Human
aaguaauaucuguuggcuuuggaaauaauauuauauuuaguauuauauuuaauggaaguuagcagauuuagcuu

SEQ ID NO: 4186920 - RNA, 74 nt, Human
aaguacaccagcagcugacuccaagagagccuauguuaucugugcucaaggccuuuucagcucuuguuguacuu

SEQ ID NO: 4186921 - RNA, 63 nt, Human
aaguacagaaggagcgaacaauuggugcuuagcaggagcccuaccuuccuccucucuguaguu

SEQ ID NO: 4186922 - RNA, 61 nt, Human
aaguacagauuccuagugagauauuggaucuacugacuugaaaucuuuagggauguggcuu

SEQ ID NO: 4186923 - RNA, 130 nt, Human
aaguacagccacauccccucugauccuuuuggauucucacaguguaauauugaacccaaccuuuggaacuggguuaucagauguugucaucagugugucuuccaggauuuuaaacucugcuggcuugccu

SEQ ID NO: 4186924 - RNA, 70 nt, Human
aaguacagggguagaguugcuuuguggaguccccuuguuggcuuccuggagaauccugccaccuguccuu

SEQ ID NO: 4186925 - RNA, 61 nt, Human
aaguagacagucaucuacuuugggaagacuaauagguccuuagguaacggcucuucugcuu

SEQ ID NO: 4186926 - RNA, 81 nt, Human
aaguagcagagaaaauuagagauugguugacagauuugggaauuuuaauuucuucuuaguuuuuaacuuucaucuuugcuu

SEQ ID NO: 4186927 - RNA, 129 nt, Human
aaguagcuuagaacagcagauauuuguugucuuacaguucuggaggcuccacaucugagaucaagaugucuguaggguugguuccuucugagggcugugggagagaaucgcuuuugugcuuuugcucuu

SEQ ID NO: 4186928 - RNA, 84 nt, Human
aaguaguauacauucauggguuuuacauuauaagggcuguuuaacagacaaauaaaauguaaaugcccgugaucuaaauuacuu

SEQ ID NO: 4186929 - RNA, 96 nt, Human
aaguaguccucgggaauuauaugcaauuugcagauucugucagguuucucaggaagacgugcucaauuuguaaauuuaugugaccagggaauauuu

SEQ ID NO: 4186930 - RNA, 55 nt, Human
aaguaguuggaaauaagacagagucucaguaccugacuccuaguccaacaugcuu

SEQ ID NO: 4186931 - RNA, 90 nt, Human
aaguaugugugcccuagcauuuauaaucauguguucauucacaugaucauaaguggacacaugaccauaaaugcuaaagcacacuuacuu

SEQ ID NO: 4186932 - RNA, 100 nt, Human
aaguauguuuauuuugccaugcauuuuaaguuuacuguugauauuuagucuacauaugguauauggacuuaaaauuugaugugggcauaaaaauauauuu

SEQ ID NO: 4186933 - RNA, 57 nt, Human
aaguauuagacagccugugggcguaagaucuuguagcccacuguuguccuaguacuu

SEQ ID NO: 4186934 - RNA, 106 nt, Human
aaguauuuuuaccucugagucacauacuauguaauagaguuauagacagguuaaugacuauuucaaucuguguaaagugugcaaugaucaugccuaaaagucacuu

SEQ ID NO: 4186935 - RNA, 108 nt, Human
aagucacagcguaucugucccgugaaacaaauaugugauaucuaggaauuuaaaauaaagauguuacauuucucuuucuuggacaaugaacagaaauuucugugacuu

SEQ ID NO: 4186936 - RNA, 69 nt, Human
aagucacauggcagagagaaguuaugaauuacgaaucaggggcaauaaucuacucugccacugugguuu

SEQ ID NO: 4186937 - RNA, 81 nt, Human
aagucagaagcauuuguggcugaacacuccugucugucugugccaaaggaauuuuccaagcuacagugcuuuuguuagcuu

SEQ ID NO: 4186938 - RNA, 57 nt, Human
aagucagacagcugagcugccuaccagcugugcagcuuugggcaaguugccuggcuu

SEQ ID NO: 4186939 - RNA, 56 nt, Human
aagucaggagaaaauaucaggaagugggggcucugcauuuccucuuucucuuacuu

SEQ ID NO: 4186940 - RNA, 59 nt, Human
aagucauagggaaauggguauacacagcuaaauaagaguauccaucauguccaugacuu

SEQ ID NO: 4186941 - RNA, 55 nt, Human
aagucauuccugcuuguugcccauucaaaauuagggagugagcuggacuugucuu

SEQ ID NO: 4186942 - RNA, 60 nt, Human
aaguccagaacuccugugauagcagagccuucuccaccugcucccaucaggaacuggcuu

SEQ ID NO: 4186943 - RNA, 56 nt, Human
aaguccagggaucaaaguaggcaaaaauauaaugcccaacuuuauuuccuugauuu

SEQ ID NO: 4186944 - RNA, 65 nt, Human
aaguccaguaugagaaaccugccuucuggggauuucuucauauagcuguucuuucagcuggucuu

SEQ ID NO: 4186945 - RNA, 71 nt, Human
aagucccucccaagaguagccauuuaguuguguguuuuggaacacagcucagacaucacugcucuggacuu

SEQ ID NO: 4186946 - RNA, 77 nt, Human
aaguccuuuaaagcuuucaaucagacugggaggaacuggucuuucccagggcugcagauggaggcuaacugggaguu

SEQ ID NO: 4186947 - RNA, 57 nt, Human
aagucggagugguacagagcgaugcauccucuuacacaauuacucacuccuggacuu

SEQ ID NO: 4186948 - RNA, 83 nt, Human
aagucgugcucugcugcccacuguauuucuccaugcucguguccuggagugaacgcugcagugauggcagcacagaaccacuu

SEQ ID NO: 4186949 - RNA, 82 nt, Human
aagucuauggucaaagauaaagugaucuuagaaccaagccuuuaaacuacugagaucacugaaauacuuugcccuccuucuu

SEQ ID NO: 4186950 - RNA, 106 nt, Human
aagucucauuugauguuuuuccucucaaggaauuuaguuuaguaaagcacaaauacuuugcgauauuguuuuucuucagaggguaaaugaguaaauaaugaggcuu

SEQ ID NO: 4186951 - RNA, 75 nt, Human
aagucucuuuuaugagagguuucgucagaggaagagcucaagugauucuaucugacggcuucuuuuucuaggcuu

SEQ ID NO: 4186952 - RNA, 78 nt, Human
aagucuguggcucauucuuuagaauauacuuauuacugacaaauucaagauugcugaagaaagugagugauaaggcuu

SEQ ID NO: 4186953 - RNA, 67 nt, Human
aagucuuugcuacugugaauagugccacaauaaacauacgugugcaugauuuauaguagcaugauuu

SEQ ID NO: 4186954 - RNA, 70 nt, Human
aagucuuugcuacugugaauagugccacaauaaacauaugugugcaugugucuuuauaguacaaugauuu

SEQ ID NO: 4186955 - RNA, 70 nt, Human
aagucuuugcuauugugaguagugccacaauaaacauacgugugcaugugucuuuauagcagcaugauuu

SEQ ID NO: 4186956 - RNA, 70 nt, Human
aagucuuugcuauugugaguagugccgcaaaaaacauaugugugcacgugucuuuauagcagcaugauuu

SEQ ID NO: 4186957 - RNA, 70 nt, Human
aagugaaauuacagccuuggguagcuucuuacuugggaggcuaggaacagcccggcccugugcaucacuu

SEQ ID NO: 4186958 - RNA, 81 nt, Human
aagugaacugucugaggccugaagcagcagaguggcuugaccagagcagccugcagagggagggccuuauuuaguucacuu

SEQ ID NO: 4186959 - RNA, 56 nt, Human
aagugaccucaugguuucuccugauacgaaacacugggaagggcaccaugucacuu

SEQ ID NO: 4186960 - RNA, 102 nt, Human
aagugacguggaaggauuugagugugguuucuauguggcaagaucaaaaauuguuuuugauaaacauuuuaggaacuaacaagaugaugcuuuuacuugcuu

SEQ ID NO: 4186961 - RNA, 62 nt, Human
aagugacucguugcugacacauggcauuucuugagcagccauuaauuagcaaaauagcacuu

SEQ ID NO: 4186962 - RNA, 80 nt, Human
aagugagaugugaggacguggaggcaguggcuauuggcccaucuaccaagagcuucugcucuucauggaaacauguacuu

SEQ ID NO: 4186963 - RNA, 123 nt, Human
aagugagcugggucaaccaucaguuuggcuuucucucuauccugugguuuuuuuccccaucucagcaggaaguagaguuggccagccaugaugauaaacaaagaaggauucagcauuuuacuu

SEQ ID NO: 4186964 - RNA, 60 nt, Human
aagccgggccugagaaaugacagcagcuuccuccugcgguuuauucuuccugccuugcuu

SEQ ID NO: 4186965 - RNA, 71 nt, Human
aagccuaaagcuguuuucugccacccaagggauauuuuuuucucuucacugugcuucaagcagcuggguuu

SEQ ID NO: 4186966 - RNA, 129 nt, Human
aagccucaccacuguauccccagcgaggucucucuuacaugcaagcuggaaggaggcuugcuaaugucagucucugaauucugaugcaagugagaggcagcccauagugauauagguggaaacagacuu

SEQ ID NO: 4186967 - RNA, 67 nt, Human
aagcaggagauagaauugaggaaguuccuggcuaguuccuucuccuugcucagucugucuccagcuu

SEQ ID NO: 4186968 - RNA, 109 nt, Human
aagcaguaaaaugauauggacuguuagaauguaaaauauaugaaauaagucauuauauguuagugcugcucugacauagggacguauuauugagaaucaacuuuugcuu

SEQ ID NO: 4186969 - RNA, 83 nt, Human
aagcagugacauugugugcauuuaaaguuucauauguggcucucauguguggcuugaauacaaaugcucacaguguuucccuu

SEQ ID NO: 4186970 - RNA, 62 nt, Human
aagcagugccuggauagcaacaugagugaugcucacuucauguggucuggccgguacuucuu

SEQ ID NO: 4186971 - RNA, 71 nt, Human
aagcaugaaauuugaccaauuauuuacugauagaguuauggaaagaugaagcuguggcagauuucaaguuu

SEQ ID NO: 4186972 - RNA, 56 nt, Human
aagcaugcaaucugugauaaggaugauuuccuuccugcaucaacggagugguguuu

SEQ ID NO: 4186973 - RNA, 73 nt, Human
aagcauuuaaguccuucuuuauaucugcucacauuccaaguaaauuguagagaucgcuuuguguagagugcuu

SEQ ID NO: 4186974 - RNA, 67 nt, Human
aagccagaacuauugggaaauuacaguuugcuggagcaaacugcuguggccuaguacuuacugccuu

SEQ ID NO: 4186975 - RNA, 72 nt, Human
aagccaggacagcaagaagcgagcagaaccaggaacgccugucugacccguggcucugccuccaaguggcuu

SEQ ID NO: 4186976 - RNA, 92 nt, Human
aagccaucagagguguccuguuuaucugugugacucggcccucuuugggucacaaaggccagaugauccagcagcuaccuggagggugguuu

SEQ ID NO: 4186977 - RNA, 124 nt, Human
aagcccaccauucauuauacugcucuuucuuuuucucacugaggcaucccauuacugcuuguuuucaucaguaagauucuucugaaaaauuacaaggaaagguagccagugacauuuauggcuu

SEQ ID NO: 4186978 - RNA, 61 nt, Human
aagcccgguugggaacgugguguccgagaccgucugggauccccgcgcgcacggccggcuu

SEQ ID NO: 4186979 - RNA, 129 nt, Human
aagcccuaugugcuucuccuucagccaaccuguuucaacucacacuagucuauccauuagcugguaaacacugagcaccggcuggguacagggcagugugcugggcaugaugggugggugauaugcacu

SEQ ID NO: 4186980 - RNA, 85 nt, Human
aagccggggaucauuuuugaccauggguaggaucagggagauuaaccuuguuuuacaggugaaaaaugaagauccagagaggcuu

SEQ ID NO: 4186981 - RNA, 81 nt, Human
aagccuaguuuuggaaaucauuucuugccaagugaaaaggugcuaagcuucucagcaagaagucauuuguagcacaggcuu

SEQ ID NO: 4186982 - RNA, 76 nt, Human
aagccucaacgacuacuuagauucgaagagaaaugcuuucccaagguucuucuucauuucugacgaugaguugcuu

SEQ ID NO: 4186983 - RNA, 64 nt, Human
aagccucuggaaauggccauagucauccuuuugggugauaaguuaugggauuucuguucggcuu

SEQ ID NO: 4186984 - RNA, 73 nt, Human
aagccuuugucagacaaauuggucguuuggagcagucauuauaucuccaaaugccaggaaucucugaagguuu

SEQ ID NO: 4186985 - RNA, 57 nt, Human
aagcuaagacuuagugacuuagugucuuuccaggaaguacaagcuaagacuuagcuu

SEQ ID NO: 4186986 - RNA, 127 nt, Human
aagcuaaguagucuuaaaauagacaaaauagaaaagcuauuugcucaccugaucauguuucucaauauggugucaggaugacaagugcuuucaugcaucucauuugaguuuuaaguugucucagcuu

SEQ ID NO: 4186987 - RNA, 57 nt, Human
aagcuacugagcagauguucgccccugaagccugggagagacagagcucaguggguu

SEQ ID NO: 4186988 - RNA, 60 nt, Human
aagcuagggcuccuucccacucugccaacauuguaggagugcuggagaagcuucuggcuu

SEQ ID NO: 4186989 - RNA, 73 nt, Human
aagcuauuuuaaaacagagccaguuuuugcaaacagggguacuguuuacaaaaccgugguacugggguaguuu

SEQ ID NO: 4186990 - RNA, 71 nt, Human
aagcucagcagccaggcccugucaauagcugugaauaacugacuucugggcauucagcugcacaugagcuu

SEQ ID NO: 4186991 - RNA, 61 nt, Human
aagcucaugggugcuguacuuucugaguuccugagaauauuugccuguugccuuugggcuu

SEQ ID NO: 4186992 - RNA, 72 nt, Human
aagcucugacacuaaaguauaggguaucucgccauucagcuaauugcuaggcggcuguacuuuugagaguuu

SEQ ID NO: 4186993 - RNA, 62 nt, Human
aagcucugcucagcagacuaggcagcaggaaagagucaagcaucugucucugagcuagacuu

SEQ ID NO: 4186994 - RNA, 66 nt, Human
aagcugauuucaggaacuacgaggggguuaugaugguucuaccucagaauaguccucagaucacuu

SEQ ID NO: 4186995 - RNA, 74 nt, Human
aagcugggccauauacccacugucuccauuucccguuguuugggaagcaugcacggggcauaugggacaggcuu

SEQ ID NO: 4186996 - RNA, 74 nt, Human
aagcugugagggcagggaccagagguuagggguccucucucccugguugugcccuccccagccccucacagcuu

SEQ ID NO: 4186997 - RNA, 55 nt, Human
aagcugugcugcuuaguagcuguguaagugacaagacugcacugagccacaguuu

SEQ ID NO: 4186998 - RNA, 100 nt, Human
aagcuuagauguacuggaguauugacuuaauggggaaaaaagcaucacuugaagcaagacaugcaguuuguuccauucaccaaugcucugcccacagcuu

SEQ ID NO: 4186999 - RNA, 84 nt, Human
aagcuuagugauuaaauggcuuggccuuugcuguuaaaaagucuugauuucacaucagagcccggcaauuuauuuguuauguuu

SEQ ID NO: 4187000 - RNA, 62 nt, Human
aagcuuauuuuggcaggaugugcaaaaacacaaacuacaugccuggccaaucugauaggguu

SEQ ID NO: 4187001 - RNA, 79 nt, Human
aagcuucugcccgauucucaugucuugcuucaccugcuauugcaaacucagaggucucaaguugagaaggcagagccuu

SEQ ID NO: 4187002 - RNA, 57 nt, Human
aagcuuucagagcagaaugugagcacucugcacccagucacuuugugcuccagguuu

SEQ ID NO: 4187003 - RNA, 60 nt, Human
aagcuuugauaauuggauuacucacacacucugugaguagcucuuagaagucagcaguuu

SEQ ID NO: 4187004 - RNA, 62 nt, Human
aagcuuuuuggauuugcuucagaucuuuauuuccaagcucaguagcaaacuccugaaagcuu

SEQ ID NO: 4187005 - RNA, 59 nt, Human
aaggaaaggaugagcaugcauucuuauuaccuaugagaaugaagugccuuccuagucuu

SEQ ID NO: 4187006 - RNA, 56 nt, Human
aaggaaccauuugugugcaugggcauaguaugagccauaguaucaguugguuucuu

SEQ ID NO: 4187007 - RNA, 62 nt, Human
aaggaaguuaguucuuggcaaaggcauuucaugcaguguacuuugucauucuaaccuuccuu

SEQ ID NO: 4187008 - RNA, 73 nt, Human
aaggaauaagaauguggauaagugaaacaaaguaccaguuuggaacuacaguacuauaucuauaggcuuccuu

SEQ ID NO: 4187009 - RNA, 56 nt, Human
aaggaaucacuucuuuaaaugaaaccuggguggcauuugagagacauguauuccuu

SEQ ID NO: 4187010 - RNA, 102 nt, Human
aaggaaugcuguauggaugacaucuaacugguuuggcucagggucucauugcagcuuugugagaacuucagcaaaaccaguuagguuguacccagaauccuu

SEQ ID NO: 4187011 - RNA, 71 nt, Human
aaggacugcgcuugaucauguaccuaauacuucuccucacucggaaguugauagaguacaugauuguucuu

SEQ ID NO: 4187012 - RNA, 59 nt, Human
aaggagaaacgucagcaauaagaguaaagucuauaaacuuggcuggcuuguauuuccuu

SEQ ID NO: 4187013 - RNA, 62 nt, Human
aaggagaggggguuggggcagugggcucaguggggcaggcagccacgauucccuugauccuu

SEQ ID NO: 4187014 - RNA, 61 nt, Human
aaggagauugguuguuuagugugaauuagaugcaguuuuguacuuugcaauguaucuccuu

SEQ ID NO: 4187015 - RNA, 72 nt, Human
aaggagcagauugguaagaucauugccucugggaaguuaguggggaaaaaaauggucuuaugaaacuaccuu

SEQ ID NO: 4187016 - RNA, 105 nt, Human
aaggagcucugucaaggauccuuaaacacuacacauuuauuucuugugagaaaaugcuuuaacucauugaagcacaggggaaauaaguuguugauagaccuucuu

SEQ ID NO: 4187017 - RNA, 126 nt, Human
aaggagggauaagcgucagaggaaauggaaaaggggaaauagaaaagaggaaguaugguccaugcugcccaaaccgcugcuucuuauuaauccuucucuguccccucagcaguuuuucucuaucuu

SEQ ID NO: 4187018 - RNA, 62 nt, Human
aaggaggguucccagguccuggaggcaccaguggccccugcagcuccugggaucucauucuu

SEQ ID NO: 4187019 - RNA, 99 nt, Human
aaggaguccauuuguguuguauuggcuucuaguuugaggaaaaacccaaggugcuucucuggcuggaaacuugaaacaucacaacuaguggcauugcuu

SEQ ID NO: 4187020 - RNA, 76 nt, Human
aaggauaaaacucaggaguuucagguguaagugaacugaaacaacgcggcccauuuauucucagauccuuguccuu

SEQ ID NO: 4187021 - RNA, 92 nt, Human
aaggauaguucuaagucauaggauguuuguuugaagacauaaaauguaacuugauuguuagaaaacaggcgcuuacuaagaaaaauauccuu

SEQ ID NO: 4187022 - RNA, 74 nt, Human
aaggauguauuauuauggaacauuagaaccagaagaaagguuauauaguccuacuguccauaaaguauaacuuu

SEQ ID NO: 4187023 - RNA, 61 nt, Human
aaggauguggcauuuuucauauauucaguacaaaauuaauaugauagugaccgucaucuuu

SEQ ID NO: 4187024 - RNA, 69 nt, Human
aaggauuugaucuuuauaauaguuuugaucuuuauuuaggguuaggauuagguuaagguuuugaucuuu

SEQ ID NO: 4187025 - RNA, 91 nt, Human
aaggauuuuugcagaaaucacauuuaacccuuucaauguguaguaugaaggaagguuuuguaaaaaugaaaugauuaacugauagauccuu

SEQ ID NO: 4187026 - RNA, 61 nt, Human
aaggcaaugggauggaucauguaacaaaguugguuugggacuccacauccuccucuuccuu

SEQ ID NO: 4187027 - RNA, 58 nt, Human
aaggcacaacacaagagggugacacaugacugugacacucuuugucugcugugcacuu

SEQ ID NO: 4187028 - RNA, 66 nt, Human
aaggcacacuuucacaccgcucacauugugcauuacauuuuggaguccuuguuggaagugaacuuu

SEQ ID NO: 4187029 - RNA, 74 nt, Human
aaggcaccaguagauuugguaaacuaggaagcggugagggcccacuuccugguuuauagacugauggcugucuu

SEQ ID NO: 4187030 - RNA, 58 nt, Human
aaggcacuguacuaguuaguuauugcuauauaacaacugccgcuaaacauagugccuu

SEQ ID NO: 4187031 - RNA, 79 nt, Human
aaggcagaauguccuuccaccuguuuuaugcuguaagacaaacuuccaagugcgaggcaguguggagggcuguugccuu

SEQ ID NO: 4187032 - RNA, 77 nt, Human
aaggcagccugguuuaguagucgcauaucaucuauaagaccuguaggcuuuugugagauuaagcuacucaugaccuu

SEQ ID NO: 4187033 - RNA, 75 nt, Human
aaggcagcuggucaauaaucauguaguacaauggcuuggaauuguaaccacuaugguuauugauuguccuguguu

SEQ ID NO: 4187034 - RNA, 59 nt, Human
aaggcaguccuccuagguuauggaauuuccccacuuucucaucuuuggcaggacuccuu

SEQ ID NO: 4187035 - RNA, 71 nt, Human
aaggccaaaaagacaaugugccaguuucaauuuauguuauuaaggggcuuuuauauuuucucuuuggccuu

SEQ ID NO: 4187036 - RNA, 86 nt, Human
aaggccagagcacagauugauuuaaaauauuugcuacuuauuguuuucuaaaagcuuuuauguuuauauuaauuuguugcugucuu

SEQ ID NO: 4187037 - RNA, 74 nt, Human
aagcugacagaauuagguaaguucaucugaaauucagggcagaauucagaacuauaguaguuucaugucaguuu

SEQ ID NO: 4187038 - RNA, 70 nt, Human
aagcugacaucuggagucugggcuguugcuaaguaguucagcacagcaugcccacuuucagaguuagguu

SEQ ID NO: 4187039 - RNA, 66 nt, Human
aaguggugguaugaaccgagggaaaaggcguccaaagaggccacgacuugcuuucaaacuccacuu

SEQ ID NO: 4187040 - RNA, 76 nt, Human
aagugucaccucagagauacaaaccauggcuauuccaacuagagaagccaggguuggucucucugaggucacgcuu

SEQ ID NO: 4187041 - RNA, 89 nt, Human
aagugucagauuugauaaaguagauuuguucuagaagaaaacacucccuuucuauuuucuaguauacaucuguuugccagagugcauuu

SEQ ID NO: 4187042 - RNA, 61 nt, Human
aagugugaagucaaucaauacauuggggcaagcaguuuauuucaauguuaauuucacauuu

SEQ ID NO: 4187043 - RNA, 128 nt, Human
aagugugagcuccuguggucaugcaagucuuucuucagccccagggcccuggacagcuacagucuggagggcugucuuuguaguccagagcccuguuucuggaggaagguuccauggagcucacacuu

SEQ ID NO: 4187044 - RNA, 59 nt, Human
aaguguguauuuuucuucagugguucacuguugccuucugggugaauaauacagcauuu

SEQ ID NO: 4187045 - RNA, 60 nt, Human
aaguuaacucugaggaggcagaaaacaugauuuguuaacugcuggccucaagggugacuu

SEQ ID NO: 4187046 - RNA, 103 nt, Human
aaguuacagacuucaacugcagaauugcuuaucuaucuuuaaguccuuucuuccaaggauuucuaagcauucgaugggcaccauaauaguuuguuauugacuu

SEQ ID NO: 4187047 - RNA, 95 nt, Human
aaguuagcuaggugagaugauagaugugcuaauuaaauagauggugguaaccauuuuguaaucguauguguaucaaaucaucacauuguagacuu

SEQ ID NO: 4187048 - RNA, 91 nt, Human
aaguucaaucaccuaaucccauggcagagaagaaccaggcccaggagaaaagcucaagccccuucuucucucauagauuaagguugagcuu

SEQ ID NO: 4187049 - RNA, 76 nt, Human
aaguucauugcaucaugaucauauggguugcuuaauuauuacucuuuaguggugaugaugcuauucacauggacuu

SEQ ID NO: 4187050 - RNA, 59 nt, Human
aaguuccuaaagcaucugggcaaagccaggaaacaggcagggcucagcuaugggagguu

SEQ ID NO: 4187051 - RNA, 103 nt, Human
aaguuccuauggcaccugucccauauuagccuccacugggacaccuaacccacuggguaguuucuaguuugagaguuauuuuggauggugcuucucugaacuu

SEQ ID NO: 4187052 - RNA, 76 nt, Human
aaguucuaaaccauuuuugacagaaggccuaaauaaugauuuuuaugucuucaggucagaaauucuaggggagcuu

SEQ ID NO: 4187053 - RNA, 56 nt, Human
aaguugauagcauguuaagcucucaagugccuuuggguuuuaugugcuuucaauuu

SEQ ID NO: 4187054 - RNA, 56 nt, Human
aaguuggauuugaugacugauacgguuuggcuguguccccacccaaaucucaucuu

SEQ ID NO: 4187055 - RNA, 79 nt, Human
aaguuguauuauuuucuguuguuggugucuggcuccuuuuggggguaggaguauuuugcagcagugugauaauuaauuu

SEQ ID NO: 4187056 - RNA, 75 nt, Human
aaguuuauguucuuugaaggcaggguccguaugauucaucuuaguaccuagauuaugccuuagagauaaaggcuu

SEQ ID NO: 4187057 - RNA, 67 nt, Human
aaguuucuguaugcucuucuguaaaacuuugaagugcuuguuccuagaagacuaugcaggagugcuu

SEQ ID NO: 4187058 - RNA, 55 nt, Human
aaguuugagagccuuuaguauagugguuaggauaguaaucuuuggcuccaaacuu

SEQ ID NO: 4187059 - RNA, 57 nt, Human
aaguuuggaaugauagagaccugaguucaagcucuggcucugccacuuaccagauuu

SEQ ID NO: 4187060 - RNA, 66 nt, Human
aaguuugggaaguucuaggguaaacaaagcaaagcuaguuucugugcugcccaacuucucaaacuu

SEQ ID NO: 4187061 - RNA, 106 nt, Human
aaguuuuguucuggagacccuguguauugcaaaggucccauucaagaagaggacuuccucucuuuuggagagcaccugugcaguaaaggguuaaccuagcaagcuu

SEQ ID NO: 4187062 - RNA, 80 nt, Human
aauaaaaugucuuagaaauauggugcugccgccguauguaaggugcaggguggcagcaccauguuuccaagauuaguauu

SEQ ID NO: 4187063 - RNA, 130 nt, Human
aauaaacugccuuaucuuuuguucauucacuuuaugaacauacaauuauuaagaaccaacuauuuuuggcauuccauaaauguuuguggauaaauguguggaugaauggauauuauaugcaagucagagu

SEQ ID NO: 4187064 - RNA, 125 nt, Human
aauaaacuuauuugggaaguuugcaaacauggagaugucuugggcucuagaguuucugacuuaguaagucuggaguagagccuagaaaucugaauuuuuauaaaauuuccuaaaguuauucuguu

SEQ ID NO: 4187065 - RNA, 71 nt, Human
aauaaagcaugaggcauuuaucauuucaugagucaucuugacauaaaaggauaaaugccucaugcuuuauu

SEQ ID NO: 4187066 - RNA, 92 nt, Human
aauaaagcuguacuuaucuaugaauguuaguauguguggguguacacauauacacccauacacacauauuuaugugauaaguaugccuuauu

SEQ ID NO: 4187067 - RNA, 71 nt, Human
aauaaagggagggcaccagaagagccagaugaguuacucaugagcucuuuucguggcuucuaaucuuuauu

SEQ ID NO: 4187068 - RNA, 83 nt, Human
aauaaagugucagcaucagaagacugucuuuuccauguuaacaucaacauggguaagacucuuuugcccaagacaaucauauu

SEQ ID NO: 4187069 - RNA, 80 nt, Human
aauaaccacaaaauugugugugugcauguguguguguguguguguguguguguguguuuacaguuucucauguggcuauu

SEQ ID NO: 4187070 - RNA, 70 nt, Human
aauaaccacaaaauugugugugugcauguguguguguguguguguguuuacaguuucucauguggcuauu

SEQ ID NO: 4187071 - RNA, 108 nt, Human
aauaagaaacgccugugaaauuaucuuaguaccaaccuaaaaacaacauauaucacaucaggugauucacucauauuuuacguuuacuuuucacauucaauuucuauu

SEQ ID NO: 4187072 - RNA, 84 nt, Human
aauaagaaagcaaugcuuguggaauguacagugcauauuggcagcacaugccucauuacgauucaccagcuugcuucuccuguu

SEQ ID NO: 4187073 - RNA, 121 nt, Human
aauaagagcaaacaauaaaauuggaccugaauaguuugaauuuaucagaugucaaugaauaauuucacuuaauagcacuggugaaaguuuaauuguuccuuucuagccuuuggcuuuuauu

SEQ ID NO: 4187074 - RNA, 83 nt, Human
aauaagcuugauaguaaagguggcuuacuugauaguccacagaaagauagccaagucaagcaugcccuuauuuauggcuuauu

SEQ ID NO: 4187075 - RNA, 55 nt, Human
aauaaguacuuggggauaacuugggcaucacccaaguuauauacuaguauuuauu

SEQ ID NO: 4187076 - RNA, 87 nt, Human
aauaaguuauuaucaucucagcuuugauucaccaggcaauugaaucauaucuugaugagucagaacugaaggaauaauauauuuguu

SEQ ID NO: 4187077 - RNA, 69 nt, Human
aauaaucaauuccacgccagugacgagacaggaggugauucagcuagcuggcuggcaguaaagguuguu

SEQ ID NO: 4187078 - RNA, 83 nt, Human
aauaaugggaaaaguuuaaaguaagauuucaugguuuuuuauuaugcaguaaaaagcagcugagauuuucuauuucuauuauu

SEQ ID NO: 4187079 - RNA, 99 nt, Human
aauaauguugauauguaaaauccauuuauucuguguaauccugagagaaauucuuacacauguauugcagaagaaaugaaugaauauauccauauuguu

SEQ ID NO: 4187080 - RNA, 83 nt, Human
aauacaacaguuuuuucaacauuggaauguaauuucuguuuaaugucaagcuaauacauuuaaugucgagcuauuguaguguu

SEQ ID NO: 4187081 - RNA, 63 nt, Human
aauacaccuuaaucauaugugucugguauauuaugugccaagcauauaguguuaagguguauu

SEQ ID NO: 4187082 - RNA, 129 nt, Human
aauacagcaucaucauugauuacugccgcauguuagagcaaacauauuuauuucucuuuuuuucucccaaagaaauaaaaucuuuaugugcucugcacguggguuagggaagcuaauaauggucugauu

SEQ ID NO: 4187083 - RNA, 74 nt, Human
aauacaugcccaggggaguagucaauuuauuuuuauucuuguuguuaugaguugacuauucugggugcaguauu

SEQ ID NO: 4187084 - RNA, 100 nt, Human
aauacaugcuugcuaugacauaauugugaugauugaaauacugugugugacaugacuagcacagugcuuggcacacaguaauaacauagcugccaguauu

SEQ ID NO: 4187085 - RNA, 86 nt, Human
aauacuacagaaaaacuggcauugaagacaguaggugugcaagccacuuaccuccuugccuucagcgucgauuucuguccuguguu

SEQ ID NO: 4187086 - RNA, 71 nt, Human
aauacucuccccauuccuugggcugccuuauuauggccauucuauccaaauuggcaguucagggaauuauu

SEQ ID NO: 4187087 - RNA, 86 nt, Human
aauacuucacgaugaugcauccguuaauaaaaagacaguguguaugaagcaaacuguuauugugaacgggcaauggugagagaauu

SEQ ID NO: 4187088 - RNA, 61 nt, Human
aauacuuccagggauacuuuuguaccugaaaguccuaagguaauaaagagcuuggaguguu

SEQ ID NO: 4187089 - RNA, 75 nt, Human
aauagcccauuuguugauggcccacaaguacuuucucguaacuagaaagaugugcuaucaacuggagaagcuauu

SEQ ID NO: 4187090 - RNA, 68 nt, Human
aauagcugcauaaaguauagaaggcuauaaagaauugccuggacuaucauaucucugugcagacuauu

SEQ ID NO: 4187091 - RNA, 78 nt, Human
aauaggucacacaugauaagaaaguuuaaaccagagcacagaaaagcuugauuuuaaaauugucguuguguauuuauu

SEQ ID NO: 4187092 - RNA, 98 nt, Human
aauaggucauuuuuugauguacauauuguuuuguaaaguguggagauuauuuaauugauaagucacauucugaaauccauguggguagaugauguauu

SEQ ID NO: 4187093 - RNA, 82 nt, Human
aauaguaaaauuguaacuacauugagaacauguuaaggaaauggucauauuucuguuccuagaaagauacauaguugcuauu

SEQ ID NO: 4187094 - RNA, 99 nt, Human
aauaguaaugauuaucauuugcaaagugcuugcagaguauuaagcauuugcuaagugcuuuacauacagcaaccuuuggagcugauuucuauuauuauu

SEQ ID NO: 4187095 - RNA, 121 nt, Human
aauagucauuagucaacuuuuguugugucauugaaauucuaaacggcuucacaggaauuuaacaaauuuaauuugagucuuggaaguuuuuuacaacaaggaugaaaaaagauugauuguu

SEQ ID NO: 4187096 - RNA, 117 nt, Human
aauauaaacauuaagagguuggggaauuuugucuguuuuuguucacugcugaaucccuaguguccaggacagugcgagacacaguaacccagagugggcaccuaaugaauguauauu

SEQ ID NO: 4187097 - RNA, 79 nt, Human
aagccucccuggagcaggucguucaggugcuggcaucucagggagcaccugagggcgccgagcucccaggaggaggcuu

SEQ ID NO: 4187098 - RNA, 74 nt, Human
aagccugcauucuuacaacuuucaaugguuuucaaucccuuuccauauuaaggucuguaaggggucaugggcuu

SEQ ID NO: 4187099 - RNA, 76 nt, Human
aagccuggcauauuugguauaacuuaagcaccagguaaaaucuggugcuuaaguuguaccaaguauagccaaguuu

SEQ ID NO: 4187100 - RNA, 62 nt, Human
aagccuucccuuuuugagcucagguccaaaaaagcaguuuuggcauuaaagagaaaagguuu

SEQ ID NO: 4187101 - RNA, 72 nt, Human
aagcguaguagggcaauauuucccagaaaaaucuaugaagugauuuguuuuguccugcccuuucugcaguuu

SEQ ID NO: 4187102 - RNA, 55 nt, Human
aagcuaagauuacagauuugggucaaugguuaucccaaaucugcaaucuuggcuu

SEQ ID NO: 4187103 - RNA, 63 nt, Human
aagcuacgugaauucucccaguaacagaugaggaaauugaggcucagagauguucaguagcuu

SEQ ID NO: 4187104 - RNA, 84 nt, Human
aagcuacuagaauuaucuaguucacaguuuuucagccucuaugcuauuaacacuuugggcuggauaauuauuuauuuguggguu

SEQ ID NO: 4187105 - RNA, 64 nt, Human
aagcuaggccucaguuuccugagugcaaaaaugaguggcagaaaugaacugaggucugaggcuu

SEQ ID NO: 4187106 - RNA, 129 nt, Human
aagcuauuacagaacugaauacgaauaaaauucugccugguuuaugaagauuuuaagagaaguucacauuuaaauuucuacgugauccaggggaccuauuguaaacagaaaaaaaugccacaauagcuu

SEQ ID NO: 4187107 - RNA, 59 nt, Human
aagcucugggaccacgugacucugcuggacacagcaggggaaggcagugguccaggcuu

SEQ ID NO: 4187108 - RNA, 57 nt, Human
aagcugaggucaaguagcuaguaaguaguagauuuacuagcuacugaaucuuaacuu

SEQ ID NO: 4187109 - RNA, 82 nt, Human
aaggggauugaggccagugguucucugugucccagaggugucccugggagauguagugucacuggacuagagauucauccuu

SEQ ID NO: 4187110 - RNA, 107 nt, Human
aaggggccgauuuagcugguaggacuggcagaacgugaugcggguguggcagaacuugggcuggaacgucuugcacaucuucacuguuagacuugagcuaguuccuu

SEQ ID NO: 4187111 - RNA, 73 nt, Human
aagggggagaauaugugaagggggcuuccaugggaggcuucgauggcccacccacccuuccauucuuccucuu

SEQ ID NO: 4187112 - RNA, 73 nt, Human
aagggggguaggagggacuucaagucuacuuaauacagacuccuggggauccauuccuuuauaagacccacuu

SEQ ID NO: 4187113 - RNA, 63 nt, Human
aaggggucaguguuggucuaaauuucugacuggucacacauucaguagcagcacuggccgcuu

SEQ ID NO: 4187114 - RNA, 69 nt, Human
aagggucagggaauaaaauuguaaauuguagcaauagcagagaaauacaauuuugucccagcuucccuu

SEQ ID NO: 4187115 - RNA, 86 nt, Human
aagggugcuggacuggcuggcgggugacacaccugggguuccugggccccuccuggccacacugucagugggccucaagcucccuu

SEQ ID NO: 4187116 - RNA, 56 nt, Human
aagggugcugugagugaauuccagggccaauuuguugacuuuacaucagcacucuu

SEQ ID NO: 4187117 - RNA, 77 nt, Human
aaggguucuguuugauuuuuaaaaagguacuuucuuuuguaauuaggugcaaaaaggaaagcacagaaaggacucuu

SEQ ID NO: 4187118 - RNA, 62 nt, Human
aaggguugguucugaaacccagcuuccuccccuagcugaaaacacuucugagccacuuccuu

SEQ ID NO: 4187119 - RNA, 103 nt, Human
aagguaauggauuguuucacaaguaaaguccuaaguguucagcuauuucagcucuucuuugccauuuggggcuucuuacuuguuaggugauuucuccggccuu

SEQ ID NO: 4187120 - RNA, 78 nt, Human
aagguacagauaauccaaguaguuuucaagguuguagagaaugccauuugaguaauuuuuugguuuuauuucuaccuu

SEQ ID NO: 4187121 - RNA, 61 nt, Human
aagguaguuuucuuuaaugcuggaauuucaggcaauggcagcccaaagagagagcuacuuu

SEQ ID NO: 4187122 - RNA, 122 nt, Human
aagguauaucuggaguuauuuugaauucuauggucaucuguaauucuguuccuuuuucuucuacuaaaggaggauauuagaaugcaggugaauaagagcaacuucacucuaggaacauccuu

SEQ ID NO: 4187123 - RNA, 58 nt, Human
aagguauaucuuuaaaagugaaugcaauuuuauuugcuuuuuauuugagacaugccuu

SEQ ID NO: 4187124 - RNA, 86 nt, Human
aagguaugaguugaagaagaaccagcacagcagaggaagcagauaugaagucugagccaccugccagugcuguuuacucauuccuu

SEQ ID NO: 4187125 - RNA, 90 nt, Human
aagguccccaggaauuacagagcucauuucuaaggggcucaaaauuagcaaagagacuuuuggagauguuuucugagcuuuagggaucuu

SEQ ID NO: 4187126 - RNA, 64 nt, Human
aaggucucaaguuuuccaaagugugagagaggcaccaugaauuaguggagaaaacugggacuuu

SEQ ID NO: 4187127 - RNA, 58 nt, Human
aaggucuuauggugucuuaguuuugguuugccuggaagcagggcaugaauaaggguuu

SEQ ID NO: 4187128 - RNA, 86 nt, Human
aaggugaaaaauaagcuuuuaggagaaaaacuugaaauuccuuuucuaggauuucuguaacuuaugaaaguucacuguuuucccuu

SEQ ID NO: 4187129 - RNA, 84 nt, Human
aaggugcaacucagcaggcugcuggcguugaagucguucauucgauagaguucagugugugguagaaucugaaugaggcacuuu

SEQ ID NO: 4187130 - RNA, 106 nt, Human
aaggugccuaccuagguccuggggagugguggucaggccauggcugaaaaauuggucuugguuugagggccaccacauuuuucuaaggguuugugucaucaaccuu

SEQ ID NO: 4187131 - RNA, 60 nt, Human
aagguggaguugggaagugacuuucuauuuagucacuugaccucuugaacuccuuaccuu

SEQ ID NO: 4187132 - RNA, 67 nt, Human
aagguggcagcagggcugugcuccuuccgaucauuuggaacaaucacauccuugcuucuuccaccuu

SEQ ID NO: 4187133 - RNA, 106 nt, Human
aagguggcuaccuuggauucccagucucauuggugguuuucaaggucucugaugaagaucuuggaagccucaagauacucuuuggaagggaaucucucaacaccuu

SEQ ID NO: 4187134 - RNA, 91 nt, Human
aaggugguuauuucuguacuguggccuuuaagaaacaggaaugaugccuggaauaacuuuaguagcuacaguuagaagguagcagagccuu

SEQ ID NO: 4187135 - RNA, 60 nt, Human
aaggugucggcagagccgcuucccucgggggcucggggggagcgugcacuccaggcccuu

SEQ ID NO: 4187136 - RNA, 57 nt, Human
aagguguggaguggugcgacuggcauuuccauuccagagugcaucacuucaaaccuu

SEQ ID NO: 4187137 - RNA, 89 nt, Human
aagguuaccuagaaaguagguggaggaggagggauuugaaauccagagcccuugcccucagucacccugacuuuauccugguuaaccuu

SEQ ID NO: 4187138 - RNA, 129 nt, Human
aagguuuugacuuuuauuuuccuguauuuaaguguguauuucuuguacuuccuugucuauaauuuauugugauucuggaguuaaggaugccuuacuuuaauauuuuuggaaaauuuuaagacauuauuu

SEQ ID NO: 4187139 - RNA, 58 nt, Human
aaguaaacucaguggucauucaguuuaaccauuuuuggucugaaauacuggguuucuu

SEQ ID NO: 4187140 - RNA, 66 nt, Human
aaguaaagcaaggcgucggggagcuauucuuagauagaugcucacacuccugagcccugcuuacuu

SEQ ID NO: 4187141 - RNA, 95 nt, Human
aaguaaauaggaagcaaaaauggaguaauauuaacauguuaggucuauguggcaaguaacuuguguuacauuacucuuuguauuuuaaaauacuu

SEQ ID NO: 4187142 - RNA, 107 nt, Human
aaguaagcuacuuuguggcuaucuuuguaugcaccauuguauuaccuuguucaacaaggaagagcccgggugacauaacaaaauaaauagacacgaugcugcugcuu

SEQ ID NO: 4187143 - RNA, 71 nt, Human
aaguaauaggaauuagauaauguagagauaugagcucauggaguuuauggaauaguuauuuuucauuacuu

SEQ ID NO: 4187144 - RNA, 98 nt, Human
aaguaauauguauaaaacuaaaagauagcugugaggcuugaaguaauuccaacagaucuuguaugcuuccuguccuuacuuagauuaaugcauugcuu

SEQ ID NO: 4187145 - RNA, 61 nt, Human
aaguacuucuagauggauaaucaccaaauagaaauggugcaaaauauucagaggaguauuu

SEQ ID NO: 4187146 - RNA, 74 nt, Human
aaguaguaagagaacagggaguacggcacauuuagucaaaggcuaggcuggcugaaaaacacccuugacuacuu

SEQ ID NO: 4187147 - RNA, 62 nt, Human
aaguaguguuggugucuguuucauaugauuuauuauuuuugugacagugacaauacugacuu

SEQ ID NO: 4187148 - RNA, 63 nt, Human
aaguaguugucccugaggaacgagacuugaaauggggaaggaugaacccagggaccacugcuu

SEQ ID NO: 4187149 - RNA, 94 nt, Human
aaguauaaugugguauaccuggcuuuaagagacuuucagucuagagaguaggcagaauguauucucauaaagccacugguauuacaguguauuu

SEQ ID NO: 4187150 - RNA, 74 nt, Human
aaguauauauauguacuggcuaaagaccuauccaaaagaggaaauauuucuagaaaguucauguguuuauacuu

SEQ ID NO: 4187151 - RNA, 80 nt, Human
aaguauccuuauagcaaugcuccauuucuuggcaccaauuuucuguguuagucucuuugcauugccauaaaggaauacuu

SEQ ID NO: 4187152 - RNA, 80 nt, Human
aaguauuuccuccuagcuuuguuuuguuuuguuuuguuuuccuuaagacaucuugccuugggaaagugggaggagaacuu

SEQ ID NO: 4187153 - RNA, 80 nt, Human
aagucaaagguugccauccuggcuuugguuuuaaauuguauuccccagaaauccagcuacggggcaacaugaaaugacuu

SEQ ID NO: 4187154 - RNA, 73 nt, Human
aagucaacuggaaagaucaguaggaagagacugagccagaccuucucaugcugaucuucuccaccaaacacuu

SEQ ID NO: 4187155 - RNA, 104 nt, Human
aagucaauugguucuguuuuauuugacuuugcaaaauaaugcugauuugagaaaagucaucacaauugccuaaaguucugugaaauaaugaugugguguggcuu

SEQ ID NO: 4187156 - RNA, 57 nt, Human
aagucacagcagggucccuccacgaugacaaaguugggagccacucagcugagaguu

SEQ ID NO: 4187157 - RNA, 57 nt, Human
aagucacccacaggcagcagaaacuaaugcaaugugucugcagcuauuuugugacuu

SEQ ID NO: 4187158 - RNA, 73 nt, Human
aagucacugguuuuuuuguagagcauuaguuagcagcugccguacaauaaaucaugccaaaauccaguggcuu

SEQ ID NO: 4187159 - RNA, 73 nt, Human
aagucagaugcauuaacuugagaagcagagucauucuggugaaugggaauuuucauguuggcaugacugacuu

SEQ ID NO: 4187160 - RNA, 67 nt, Human
aaggcagcaggauuuggugacugaaguggcugaguaggaggcaagaaaucaccaaacuccuggcuuu

SEQ ID NO: 4187161 - RNA, 60 nt, Human
aaggcagcuuuguaguaaagcuagucaauuuuuguaugguuggugcucaaagcaugccuu

SEQ ID NO: 4187162 - RNA, 66 nt, Human
aaggcaggaugggaaaagauuuacagcuguugaaggguuaaauuaauuaguucacguccugugcuu

SEQ ID NO: 4187163 - RNA, 67 nt, Human
aaggcauugagcaguuacaguaaagggcagacaucaggccucugccaguauguaccugcugugccuu

SEQ ID NO: 4187164 - RNA, 72 nt, Human
aaggccaaaaaagaucugguagcucuugguggaccucacagaacgugagucagccagagcugccauggcuuu

SEQ ID NO: 4187165 - RNA, 60 nt, Human
aaggcccagggauuggaggucaccccucagucaugggcagaacuugaucccgugggccuu

SEQ ID NO: 4187166 - RNA, 55 nt, Human
aaggcccaucugucccguccuggcccaggcuggugcagggacagcaguggguuuu

SEQ ID NO: 4187167 - RNA, 63 nt, Human
aaggccuucccuuugagccgcagguauggcacacacaacucugcagcucugggcaagugccuu

SEQ ID NO: 4187168 - RNA, 58 nt, Human
aaggccuugaagaaaaauccaaugagcuaugagacgucacucagggaaucuuggccuu

SEQ ID NO: 4187169 - RNA, 74 nt, Human
aaggcuaagguuuuucagguuguuaauuccaaagucaaauaauuugaaacaaauuuggaaaaucuaacagcuuu

SEQ ID NO: 4187170 - RNA, 74 nt, Human
aaggcuagggaccugccagaacucaggcuaacugugauguugagcacaggaguggcagguucugacuuggccuu

SEQ ID NO: 4187171 - RNA, 73 nt, Human
aaggcucaauaguagcaugcaauauuauagagaugguuuuacaucuguuuugcauaauguucuuuugguccuu

SEQ ID NO: 4187172 - RNA, 68 nt, Human
aaggcucagagguggaugccuuguggggugccucagcacaugccaagggccauccuaucacuugccuu

SEQ ID NO: 4187173 - RNA, 72 nt, Human
aaggcugaguauuucuucauaugauuacuagucauacaaguuaucccuugcaggaaugccuuuucaugccuu

SEQ ID NO: 4187174 - RNA, 67 nt, Human
aaggcuucuaugagaugauaggcguucuaacaggugaacugacucccuggacaucacucuaagccuu

SEQ ID NO: 4187175 - RNA, 55 nt, Human
aaggcuuguugucacgcucuuguauagccagaaugggaggugagaauuuggcuuu

SEQ ID NO: 4187176 - RNA, 120 nt, Human
aagggaaaucauuuucaugaaauuuuauuugaaucuggcuagagaaaaugcucaccuucuuccuuguguuuugcuuauuugauuaaaugucuuugauuucugugaugugugaagucccuu

SEQ ID NO: 4187177 - RNA, 84 nt, Human
aagggaaauguccuauuuuguaaagagcagcauuucuacauuuuaaaaaucagauguucucaguggggagcaggguuuucucuu

SEQ ID NO: 4187178 - RNA, 57 nt, Human
aagggagagaggucaagguggggacucccgcaagcccacccuggccgacugccccuu

SEQ ID NO: 4187179 - RNA, 75 nt, Human
aagggagguggaggggaaaaauagauaagaauuuuaagaccuugauaaaaauuuguuuaucuucuagcuucucuu

SEQ ID NO: 4187180 - RNA, 80 nt, Human
aagggagguuauuacuacaacaguucaugaaaugaaagcuaccugcuuuuacccagggagcucuugaaaauaacccucuu

SEQ ID NO: 4187181 - RNA, 122 nt, Human
aagggcaaagaggagggguggagagaggggugggagcaggaugggagcuggggccagggaucuggccugaggcgucccagcuguggcugacuccugguccccacuugcuccucccugccuuu

SEQ ID NO: 4187182 - RNA, 84 nt, Human
aaugucaugggaauuuauucauauuucaaagcaaauucagaggaaauauguagaauagcuuccuuuuuuccaaagggugacauu

SEQ ID NO: 4187183 - RNA, 87 nt, Human
aaugucccagccuucucuugccagagaugagacucuggggaagguaacgagagaguccauaugugggaggaguggcuuaaaaacguu

SEQ ID NO: 4187184 - RNA, 127 nt, Human
aauguccucacuuucauuuucugagcuuaguuauuugugucuucucuuuuuuuggucaguguagcuaaauguugguccguuuuugaagacaguggcugagcauggagauaccaaguggcagggcauu

SEQ ID NO: 4187185 - RNA, 79 nt, Human
aauguccugugguuucauucuuacaauguuagaaauucuuuaauuaguuacagguguugaaugaugucacaugggcauu

SEQ ID NO: 4187186 - RNA, 55 nt, Human
aauguccuuuaugaaaugguguuuucaaaacacauugaauuucauaggggaaauu

SEQ ID NO: 4187187 - RNA, 106 nt, Human
aaugucuaagaaucaauguuugaauuacagaugaauuuauggauggaacacuuuuguuuucaaacauaucuucauuacuaguuaugagcuagaggucuggggcauu

SEQ ID NO: 4187188 - RNA, 94 nt, Human
aaugucugagccaggucuuccaugacugaagcaggggcggguaugagcagaguccugcccugugugagugcaugggugcuguggcuuggggguu

SEQ ID NO: 4187189 - RNA, 61 nt, Human
aaugucuuggauacagagguuggggacaauguuugauucaccacuguaucuccagcacauu

SEQ ID NO: 4187190 - RNA, 58 nt, Human
aaugucuuuucccuuacuuuccacuaaaacauuuacgaagguaaugggagaaaauguu

SEQ ID NO: 4187191 - RNA, 65 nt, Human
aaugugaugcuggaggcgccccucguuauagccgcgaggaggucauuggcuccugugaucacauu

SEQ ID NO: 4187192 - RNA, 55 nt, Human
aaugugcccugagagugaggaggacagcugcaucuucuggacucuaagguauauu

SEQ ID NO: 4187193 - RNA, 66 nt, Human
aaugugggcauuuaggaucuuuaguugaccaauccuucuugcuuaucuaaccuagaugucuguguu

SEQ ID NO: 4187194 - RNA, 70 nt, Human
aauguggguaaaucucuuuucauggcuuucagcucugaaggccgucagccccgauuugccacuccacauu

SEQ ID NO: 4187195 - RNA, 101 nt, Human
aauguguuuauuuaauuaugcugugcuagauacaauauucagcuguucccaacacaucuguagaaugauuauauagucaguuauaguaauagaaacacauu

SEQ ID NO: 4187196 - RNA, 91 nt, Human
aauguuaagugagcauaguaauaucuaucuuuuagauuuggggaggauaaaacuacugaaagauaaaucaguuagcaugcauacuaacauu

SEQ ID NO: 4187197 - RNA, 61 nt, Human
aauguuauuuccucucugugaguuauuuucuaaucuagaacucagagaagggacugagauu

SEQ ID NO: 4187198 - RNA, 88 nt, Human
aauguucauccccugcugaauguggccugcaaagcgggugaaugaagcaauucaaaguaaggcagcauccagaggagaaugaagcauu

SEQ ID NO: 4187199 - RNA, 77 nt, Human
aauguugucccuggccaaucuagggcuguuaugagauugcucauaacaguugcuacuuaaauuagcuagaaugcauu

SEQ ID NO: 4187200 - RNA, 84 nt, Human
aauguuguuuugccccagcugguuaaaauagagaaaugagugcaguuuuuguauucuggcaagcuguaugggcaucaugguauu

SEQ ID NO: 4187201 - RNA, 59 nt, Human
aauguuugcucuguagguucauggcaggaaaaccuuuagacaugaucuuagcaaauauu

SEQ ID NO: 4187202 - RNA, 85 nt, Human
aauguuuuggaacuggauagcaguggugguggcacagugcugugaauggacuaaacaccacugaauuguucacuuucaaaugguu

SEQ ID NO: 4187203 - RNA, 67 nt, Human
aauuacauagaacuucgaugucuuuuguuucaucaucauugggcauuuuaguugcuauggaauaauu

SEQ ID NO: 4187204 - RNA, 82 nt, Human
aauuacucuugaacuuacauugaggaauucuuacuuuuucauuuucuugaauagaaauccugauggagucugaagaggaauu

SEQ ID NO: 4187205 - RNA, 69 nt, Human
aauuagggagagguagcuaggugguauggcgaggccaagacaaggacaccuuaucucaagucccugauu

SEQ ID NO: 4187206 - RNA, 76 nt, Human
aauuaguuaugcccagagcugaugaccugcaaaaacuucuacuuauuuagcuguuacaguuugggcuugauucauu

SEQ ID NO: 4187207 - RNA, 83 nt, Human
aauuauggaagaaucaggagagcugcgaacguugcaaaauuccaugcuaucaaugaaauguaguuucugaucuucgcacaauu

SEQ ID NO: 4187208 - RNA, 104 nt, Human
aauuauuguugcuguuguguugcuguugguaguagcagugauguuguuaucucaaauauaauacauuccuacugacuagcuagauaauagugcauuugauaauu

SEQ ID NO: 4187209 - RNA, 84 nt, Human
aauuauuuccuuugaaagcugaggacaggagggucaaauaacuuguaucauuucccaaagucuugcagcugauaagugaugguu

SEQ ID NO: 4187210 - RNA, 103 nt, Human
aauucaauagagucuuuuuaaaagguucugguuuuguuuggcauauagauuuugcagucuggaauaggacaaaaccaaaauuucaaaggaaguuuaaugaguu

SEQ ID NO: 4187211 - RNA, 65 nt, Human
aauucaaucugcauuuaguuaguguagcuuuuuucugaguuacacuuaggguuugucagagaauu

SEQ ID NO: 4187212 - RNA, 69 nt, Human
aauucaccuaauugaagucaggaguaaaugcacuauuagcuccugauaacuuuagguuuggguugaauu

SEQ ID NO: 4187213 - RNA, 67 nt, Human
aauucacuugugcacgcuauggagguucucggggagagaucuuugcaccuaagucugucaaggaauu

SEQ ID NO: 4187214 - RNA, 65 nt, Human
aauucagaaagaaguaaggcugaccagcaagacuugggagggcacaaauuacauccuucugaauu

SEQ ID NO: 4187215 - RNA, 89 nt, Human
aauuccagcuucagcucuuggauagugaggucauugaauacagaagagaaauugagaaaauuauucugagaguugaaguaaugugaauu

SEQ ID NO: 4187216 - RNA, 82 nt, Human
aauuccaguggcacacaguggcaucacucuugacgauccacccuacaucaccugcuuugauguccuggugcuucuugggauu

SEQ ID NO: 4187217 - RNA, 59 nt, Human
aauucccucuuuugcuugcaucuccccaauuagacugaauucuguaaaggcagggaauu

SEQ ID NO: 4187218 - RNA, 61 nt, Human
aauuccuaaguaacuuuccuagugagcucaucuugcuucacugaaaguaauucuagugauu

SEQ ID NO: 4187219 - RNA, 60 nt, Human
aauucuccucucaccccuacgauaugaagaauaucuuauaggcucagugaguagggaguu

SEQ ID NO: 4187220 - RNA, 58 nt, Human
aauucugaggccauuuauuuccucucuuaaagagaaucugcaaaugguccuagggauu

SEQ ID NO: 4187221 - RNA, 57 nt, Human
aauucugauuagaugccuuuguuccagaaaacuuggugaaaggcuuuaauuaaaauu

SEQ ID NO: 4187222 - RNA, 55 nt, Human
aauucugcauaagguggcucugauuucagauaaaguugcauaccuugguagaauu

SEQ ID NO: 4187223 - RNA, 80 nt, Human
aauucugccauggguuauaucaucagcugaacucauaguggguuugaaaaaggccuuugguauguucucaggccugaauu

SEQ ID NO: 4187224 - RNA, 56 nt, Human
aauucuguaaagcuugucaugcuagaugucuuugugugacauagcuuugcagaguu

SEQ ID NO: 4187225 - RNA, 67 nt, Human
aauucugucuuuuguaugcaugucagaguuauaaaauuauagcuaaacauggauauaggacugaauu

SEQ ID NO: 4187226 - RNA, 89 nt, Human
aauugaauaaggcaacauauauguaaaguacuuuguaugguaugaacuacacauugagugcuccauaaaucauagcccuuguuauaauu

SEQ ID NO: 4187227 - RNA, 97 nt, Human
aauugcagaguuccaggaaugaaauguagauaaaugugucuucaauaauagugacaauauuuuguaguauauuuaacauuugugaacaucugcaauu

SEQ ID NO: 4187228 - RNA, 101 nt, Human
aauugccuuuguccaagaacauuccugaaugggcacauuuacuuaugaaagugaagucaccuggguucuggcuggauggcuuugagauagaaaaaucaauu

SEQ ID NO: 4187229 - RNA, 90 nt, Human
aauugcuacggggagcggggaggaagugggcgcugcuucugcguuaucuggaaggagcagcccacuccuguccugggcucuguggugauu

SEQ ID NO: 4187230 - RNA, 61 nt, Human
aauugcuagucagcucaagguaguugugaauaacuugcuacugcugugaucugauguaauu

SEQ ID NO: 4187231 - RNA, 71 nt, Human
aauugcugggaauauuuagcccauguccagaccaaguacuguuuucucuggguuaaauacuuccaguucuu

SEQ ID NO: 4187232 - RNA, 59 nt, Human
aauugcuuugaagaagggagcgccuugacucuugcgcaccggccauuuucacagcaguu

SEQ ID NO: 4187233 - RNA, 59 nt, Human
aauuguacaagccuugugccauaguuaccagcuuugugcaugucugggccuguaagauu

SEQ ID NO: 4187234 - RNA, 87 nt, Human
aauugugaugauagcagcucacuaacucugcguuuguggugugaugagcagcuaguguagaguagcugaaugcuaauaauuaugguu

SEQ ID NO: 4187235 - RNA, 69 nt, Human
aauuguucaugguuguaaguuugaacccauuuaaucauucagguucauauucuuaaccacugagcaauu

SEQ ID NO: 4187236 - RNA, 73 nt, Human
aauuguuuaauaucgugaaguacuugggacuguuacugaaauguaguaaguacuauaaaaguguuaaauaguu

SEQ ID NO: 4187237 - RNA, 90 nt, Human
aauuuaacagaugcuuacuaugguuguauguguagauguguacaugugagcauacccauuuguuucaggagcacaaauuucuauuaaauu

SEQ ID NO: 4187238 - RNA, 95 nt, Human
aauuuacucauucacauugugcagauuauggucgcucuucucucacaauuauuuugcaaccuuguuuagcauaugugacugauaguggguaaauu

SEQ ID NO: 4187239 - RNA, 95 nt, Human
aauuuacucauucacauugugcagauuauggucgcucuucucucacaauuauuuugcaaccuuguuuagcauaugugacugauagugggugaauu

SEQ ID NO: 4187240 - RNA, 64 nt, Human
aauuuacugagguguaacacaaauacagaguacuccguaucccacguguacagcucagugaauu

SEQ ID NO: 4187241 - RNA, 76 nt, Human
aauuuagagaaacgggauuuugaugguagugcuacuaauuaugcuucaucacuaucuagauuucuuucucuguguu

SEQ ID NO: 4187242 - RNA, 81 nt, Human
aauuuagauuguggugauaguugcacaauucugugaaaauacuaacaauuuuuaaugggcgacuauuauggcaugugaauu

SEQ ID NO: 4187243 - RNA, 79 nt, Human
aauuuauaagcuuguuuuacaguagucuggaagaggcuuugaggccaauuuuguagaacuguagaacaaugcaugaguu

SEQ ID NO: 4187244 - RNA, 62 nt, Human
aauuuauauuguuuuccagagagaauguacuucuugcugcucucagagugacaaugagaauu

SEQ ID NO: 4187245 - RNA, 67 nt, Human
aauuuaucuuuaguaagcuucuacuuaacuagaggaaagaguaucuggccauacuagagaauagauu

SEQ ID NO: 4187246 - RNA, 64 nt, Human
aauaauaaugaaagccacugugugacuaugaggacacagaagcaugguggcucucaugauuauu

SEQ ID NO: 4187247 - RNA, 63 nt, Human
aauaauagcagaguuuacaaucacugaagcuaggagacuggccacggagacucguuacuuguu

SEQ ID NO: 4187248 - RNA, 88 nt, Human
aauaauucuggggauaauauugucaaaauggauuccacugcaaacaggcaguaggauuuacuuugacaauauucuccccagaauuauu

SEQ ID NO: 4187249 - RNA, 129 nt, Human
aauaauuuccuuucuuguugcaauuuuuaaaauuaagcauguguaaauuuuaauaugcugucagagagcguaggcucaguauuuggaauauagcuaagucuuaagaaauguguuggauggauagauguu

SEQ ID NO: 4187250 - RNA, 59 nt, Human
aauacaauaguauguauaaauaccuagaccuuugcuggguauauaggaaauauuguguu

SEQ ID NO: 4187251 - RNA, 59 nt, Human
aauacacuuggaaauggaccauauaaggagaaugcuuuauaaauauuuucagguguguu

SEQ ID NO: 4187252 - RNA, 55 nt, Human
aauacagacauuuaauaaaugcugagcaaaugcucagagcauagagucuuguguu

SEQ ID NO: 4187253 - RNA, 68 nt, Human
aauacaguaaacaugugagugugcauauauguguaaauaugugugacacauugauaugugcauguguu

SEQ ID NO: 4187254 - RNA, 90 nt, Human
aauacagucaugugucacuuaaugacaggauaggcucugagaaauauaucauuaggcaauuuugucauugugugaaccucagaguguguu

SEQ ID NO: 4187255 - RNA, 69 nt, Human
aauacaucuagccuuacaauuauuuuggcuuguaaauggguuucaguaagaagugaggcaagauauguu

SEQ ID NO: 4187256 - RNA, 74 nt, Human
aaugagcucugaaggaaggaucuggacaugugccacuauaucuaccacauuacucuauccaacuaucgcucauu

SEQ ID NO: 4187257 - RNA, 87 nt, Human
aaugaggcuacuaggagucaggaguggcuuuaguuuugcuuugccuuugcaggcaggcagagucaauuugauccaaguagccuuauu

SEQ ID NO: 4187258 - RNA, 74 nt, Human
aaugagguucacuuccugaaauagcucuugaacacaggagugaaugggcuguggauucagguggaauauuuauu

SEQ ID NO: 4187259 - RNA, 67 nt, Human
aaugauggcucagcagguuagaaacuaugacaucaucuugguucaaaaauaaccuucugaguucauu

SEQ ID NO: 4187260 - RNA, 62 nt, Human
aaugcaaaugaacauguugcuaguuccauaaaucugguacaagaauauuuuauauuugcauu

SEQ ID NO: 4187261 - RNA, 64 nt, Human
aaugcaagucaaugcuauacccagagauguucuaucagucccugauguaguuuggcuaugcguu

SEQ ID NO: 4187262 - RNA, 59 nt, Human
aaugcacaggucucguaaugaguagcccauugucccaggcuacuugggacuuuugcauu

SEQ ID NO: 4187263 - RNA, 68 nt, Human
aaugcaccuaccuugauucugcagcuuauauccucugcagaauucggcauuuaagguaggauugcauu

SEQ ID NO: 4187264 - RNA, 75 nt, Human
aaugcauauuuccuagcuuauugcuacuuaguacuaaauuuagaaccuggaguuaaggccuaagaaauaggcauu

SEQ ID NO: 4187265 - RNA, 92 nt, Human
aaugcauucuggaggugguguuuaaaagcuauuagaguuuccuggccucuuuuuggcuggcccuguauuuuuuaagaauaucucuauguauu

SEQ ID NO: 4187266 - RNA, 69 nt, Human
aaugcauuuuugaguaugaaugagucaucuguuucucugggugcuucauuuuuaguuauaaagugcguu

SEQ ID NO: 4187267 - RNA, 86 nt, Human
aaugccaccgugugccaggcacaguaguaggggguuacaaaaacuagcucauuuccugcacaggccaggcaucugagguuggcauu

SEQ ID NO: 4187268 - RNA, 62 nt, Human
aaugccauuccaucacacaccucaguaaauauguaacggugugugaaagcucugggagcauu

SEQ ID NO: 4187269 - RNA, 60 nt, Human
aaugccuucccauuuauacuuucauucaguccugaaagugcacuggaaaugaaggacauu

SEQ ID NO: 4187270 - RNA, 83 nt, Human
aaugcuaggugcuccucccuaauucaucaaucaguuaaguuucuccuuuuuucugcgggagguuggggagaagcacuaguguu

SEQ ID NO: 4187271 - RNA, 60 nt, Human
aaugcugcauaacaacaaugcaaucccacacaauugcaguaguguacaguuaugagcauu

SEQ ID NO: 4187272 - RNA, 60 nt, Human
aaugcuugaagucagggcaauggagguaaauacaguccauuugugcuucuucaaagcauu

SEQ ID NO: 4187273 - RNA, 130 nt, Human
aaugcuuugaaaugugaccugcaggauaaguacugaaagaggcuagauuucuuuucagugugaacucaaaccaucauugccucaggccuuucuucagagcuucaaaguucugcaagucacuaucacaucu

SEQ ID NO: 4187274 - RNA, 61 nt, Human
aauggagugggcugacagagauaugauccuuuucuccccuuaucuccugcuaccacccauu

SEQ ID NO: 4187275 - RNA, 129 nt, Human
aauggauauuuugcuaugaaauugauauucccugauaagaauugcaagugcuagcuaaaauauuuguucuaaauguucuuuaaacuucaguuccuuugcugagugucuuauaaaccaaauaucaucauu

SEQ ID NO: 4187276 - RNA, 69 nt, Human
aauggaugaaggcauuuuuguugccugcgucucaucccucugcacuuuccaagauugccuuguuccauu

SEQ ID NO: 4187277 - RNA, 76 nt, Human
aauggaugcuaacuucucucaaagccaaugcucaguuacaacaaagcugagcugguguuucagggucacauucauu

SEQ ID NO: 4187278 - RNA, 81 nt, Human
aauggcaaaauuacugaucugaaggacaugggacccacacuaugauuucuguaacacuucagauauugauauauguccauu

SEQ ID NO: 4187279 - RNA, 55 nt, Human
aauggcauauucuguagggugauuuauuuuaauugucacucugggaccuguuauu

SEQ ID NO: 4187280 - RNA, 64 nt, Human
aauggcauguuaaaguaguauuaaaaggcugacuuaccauuagcaugcuauuuaaugugucauu

SEQ ID NO: 4187281 - RNA, 65 nt, Human
aauggccacagauguuaguaucugaaguuaauaauuuucaaaagagaaaaauaucugggcacauu

SEQ ID NO: 4187282 - RNA, 58 nt, Human
aauggccuggagggaauacagauacauacauugaaguuuuugccuucccuuggucauu

SEQ ID NO: 4187283 - RNA, 89 nt, Human
aauggcuaacaaucaccuuccccaugcugccuucucagugcuucuuauaaccaggaggccucaggcgugggaagggugugggggcuauu

SEQ ID NO: 4187284 - RNA, 81 nt, Human
aauggcuacauuuguuuuucauugugagacugugccguaauuuauuuaaucagugccauauugaaagacauuuggaucguu

SEQ ID NO: 4187285 - RNA, 57 nt, Human
aauggcugaggcuggagguggcagcuguuuucacgguuccuaccuuccucuguuauu

SEQ ID NO: 4187286 - RNA, 60 nt, Human
aauggcuguucucugugauugggcauagaagguuuguaaguuuuagagacugcagcuguu

SEQ ID NO: 4187287 - RNA, 129 nt, Human
aaugggagggcuguguguuauuguugauuguguuuugcagcgaaacaugaguuuaauguuauagagaacauaaauuuauaauuguuuccuguuaaagagucugagaauaagaaaugaguucuuuccauu

SEQ ID NO: 4187288 - RNA, 74 nt, Human
aaugggcaccuuaaaacauguguuugaaugagggucucugaacucugacuccuuauucauucauguagcccauu

SEQ ID NO: 4187289 - RNA, 92 nt, Human
aauggggaacucauaauaaaacugguaauaaaauggauuauucaggugaugcuguuuuauuacagucucauuaugauuauauaauccuuauu

SEQ ID NO: 4187290 - RNA, 66 nt, Human
aaugggguaagggaccccaagugaacaauaagucuccucuuagaacuugguuggucucacccuguu

SEQ ID NO: 4187291 - RNA, 129 nt, Human
aauggguguuacauuaagaugcuaauuuugugguaauuuguuacacagcaauauaaaauauaguguauuaguuuguuaggccugcuguaacaaagugccacaaaaugggugguuuaaacaacauaaagu

SEQ ID NO: 4187292 - RNA, 60 nt, Human
aauggucugaagguggauuugagacucaagaaagguaucuacuccucuuucagaugcguu

SEQ ID NO: 4187293 - RNA, 68 nt, Human
aauggugaauguggacaucuuugccuuguuucugauuuuagggagaaagcacucugucuuuuaccauu

SEQ ID NO: 4187294 - RNA, 130 nt, Human
aauggugggaugcuagaagugaugguaguaagaguuauauaauguguaguucauuggacaauaguguaugagcaguauaacuaugcauuuauauaauuauauuauuuuugaaacauagcguccuauugau

SEQ ID NO: 4187295 - RNA, 71 nt, Human
aaugguguagucacuuugaaaaaacguuuggcgguuccucacaaagguaaaacuagaguuacuacaugauu

SEQ ID NO: 4187296 - RNA, 58 nt, Human
aaugguguagugaccaggaacuccagaaaucuggggaucagcaagccacugcaccauu

SEQ ID NO: 4187297 - RNA, 125 nt, Human
aauguaaauuauuuugugagcuagaacucccuacauuucagagcuccucucugagucuugguguggauguggagaaggacagccugagaaaauaagauaagggacucuaguucuucuuuuacauu

SEQ ID NO: 4187298 - RNA, 63 nt, Human
aauguaaauuuuagaugagccauuuucugccacgauuguggauuugaaucuaagaugugcauu

SEQ ID NO: 4187299 - RNA, 81 nt, Human
aauguacacauaguuaggcaugaguguguauuaaggaauaauauguccuugagagcaaaauuguguuuagguagguauauu

SEQ ID NO: 4187300 - RNA, 89 nt, Human
aauguagcuauaauggugaagagcauggauuuccaaauuggauagccccacgauugaauucuggcuccaccuccuuuacuagcuguguu

SEQ ID NO: 4187301 - RNA, 66 nt, Human
aauguaggucaaaaucaggcagggaaguuccuugaauuucaagcuuagaaauuuugacauuauauu

SEQ ID NO: 4187302 - RNA, 76 nt, Human
aauguaguugccagaucuuccacauggcuguaucaaugggcuugacucuggagccuuagauuugggcaagaacauu

SEQ ID NO: 4187303 - RNA, 57 nt, Human
aauguaugacaguucuaguggugccacaucuuuggcaacacuugguucucauacguu

SEQ ID NO: 4187304 - RNA, 95 nt, Human
aauguccuuaguauguuuggaaggugaggcaugaaggagcccagcuuauuugggggccugugggucauuuuaucaggugcaguacaagguauauu

SEQ ID NO: 4187305 - RNA, 79 nt, Human
acaagauguuaaaccaguuuugcaucauagggauaaauuccuuugaucaugguguguaacugguuuuguuuuguuuugu

SEQ ID NO: 4187306 - RNA, 59 nt, Human
acaagcugcucuccaagaacacgugcuaggaaaagugcuugaucagagugucagcuugu

SEQ ID NO: 4187307 - RNA, 88 nt, Human
acaaggcucaacccaguuuaggcaggggcuauuucuuuuaaaaauagaggagacagacaaaauuccugccugaaucuguuaguccugu

SEQ ID NO: 4187308 - RNA, 81 nt, Human
acaaggguggagacgggacagaagcuaacucacugcuacuggguuuuguuuguuguuuccugucccuugcucuauuucugu

SEQ ID NO: 4187309 - RNA, 93 nt, Human
acaaggucauuuuaauucauaguuuccuuaaaagaacuaucucuucugagcuuucauauuuuguucagaaaggucgucucuuuuaagccuugu

SEQ ID NO: 4187310 - RNA, 61 nt, Human
acaaguaccaaaugcucaaguauaucugacaugaugcauuugaagcauuuuguaucuuagu

SEQ ID NO: 4187311 - RNA, 62 nt, Human
acaaguauguaagaucaguaggauuccugccuggagucagauggauucauuacaugacuugu

SEQ ID NO: 4187312 - RNA, 59 nt, Human
acaaguccuucaaguaaccugggacccauuuuggccccagugaauuuggguggaacugu

SEQ ID NO: 4187313 - RNA, 57 nt, Human
acaagugacaaggcaauagaugcuguuaucacaugccaugaguucccuuucacuugu

SEQ ID NO: 4187314 - RNA, 56 nt, Human
acaaguggccgagagucaucucuacuuuggaguuagucaagaugcuggccacaugu

SEQ ID NO: 4187315 - RNA, 88 nt, Human
acaagugguuauugagcaguuaaaaugugcuauaagaaacugaauuuuuaauguuauuuaaguaauuuaaauguaaauagccauuugu

SEQ ID NO: 4187316 - RNA, 78 nt, Human
acaauagcaguuuucuauucuccuugggauauucugcaacauccuaaguuuagcuugagauggaaagccugugugugu

SEQ ID NO: 4187317 - RNA, 81 nt, Human
acaauaucugcauauaugcaaguccucagggcauuugugcacacaacugcuggcaugcauauacaaagcucuuauauuugu

SEQ ID NO: 4187318 - RNA, 89 nt, Human
acaauauguuugggauuaacaaguuucauuuauagaaugaaccacaugguuuggagguagaauuugaauuuguuucauucacguauugu

SEQ ID NO: 4187319 - RNA, 82 nt, Human
acaaucagauuuuuauuucaaauggaucccucagccuguaaucuggugggaagacagggacagaccauugagaugugauugu

SEQ ID NO: 4187320 - RNA, 74 nt, Human
acaauccacucucauugaaaugugacugagugaaauauuuucacugugcuaagucacugagauuuuggaauugu

SEQ ID NO: 4187321 - RNA, 90 nt, Human
acaaugauuucuaaacagaaccaugcaucugaguggucaauuauuuuauaagaaggcacucugaugguuucuguucaauaaucuucuugu

SEQ ID NO: 4187322 - RNA, 80 nt, Human
acaauggccucuaguucuauccaugucgcuacaaaagagauuauuucauucuuuuuuauagcugaauaguauuccauugu

SEQ ID NO: 4187323 - RNA, 79 nt, Human
acaaugggggaggcuccagggagcuguggagguuuccagaaccggagcacagccuuggaacucagccacacccuacugu

SEQ ID NO: 4187324 - RNA, 85 nt, Human
acaaugguuugacuuaugguuuuucaacuuuauaauggggcaaaagcaauacacauucaguuaaaaacuguacuucaaauuuugu

SEQ ID NO: 4187325 - RNA, 74 nt, Human
acaauguagcccagcaugagcagagcugguuaccuacaaauaaaccugcuuuugcuuuuuugggugucaccugu

SEQ ID NO: 4187326 - RNA, 119 nt, Human
acaaugucaaguauaucaugaccucugaaaucaauaauuggugauugguaauuauaaugguacagcacuuaauaacaguagcuaaauuauuuucauggugagugcacuacuagacuugu

SEQ ID NO: 4187327 - RNA, 98 nt, Human
acaaugucuuagacaucuuucugaaucaggacacauagaucuaucucacucuuuuuaauggcugugugguaauuuaguguaugaaugugucuucaugu

SEQ ID NO: 4187328 - RNA, 62 nt, Human
aauuguucaagugugugugugugucuacaguggggagggauuuaccacuuauuugaauaauu

SEQ ID NO: 4187329 - RNA, 58 nt, Human
aauuguucuggaccuuuugggucuuucuauauuaagaccgaaggaaacuggaaccguu

SEQ ID NO: 4187330 - RNA, 88 nt, Human
aauuuaacucuucuuccagcaggugaggagaaacagaacauuacuuucucaucuuuccuuccccuagcugagaaacaagacagaaauu

SEQ ID NO: 4187331 - RNA, 65 nt, Human
aauuuacauuucuagagcucacuuuuggguuguuuccaaaacagcuuguuucaggaaagugaauu

SEQ ID NO: 4187332 - RNA, 125 nt, Human
aauuuagcagcauaugacaaugaaugaacuuauuuauauaauagugaacaucaucaugacuucauuaaaugacaaaaggaugaguuaacuaaacugugaguaaaucugucucaucuuucuaaauu

SEQ ID NO: 4187333 - RNA, 73 nt, Human
aauuuagguaagauguuugaugugcgucaguggaauuauuuugaauuuuuacauagaauauuucacuuaaauu

SEQ ID NO: 4187334 - RNA, 79 nt, Human
aauuuauauguugaaauccuaacccccuaguaccucaaaaugugauguauuuggagguaggacuuuaaagaauuaaguu

SEQ ID NO: 4187335 - RNA, 59 nt, Human
aauuucagggugaauggacugauucagcuccugaguucacugcuacucagccugagauu

SEQ ID NO: 4187336 - RNA, 82 nt, Human
aauuuccuacuuaaagauuugugguuuaggaacaugagaucacaauucaaggugacugaacuauaaacuaucuguggaaauu

SEQ ID NO: 4187337 - RNA, 64 nt, Human
aauuucugcagcuaaggggguuaaggaaccagcggugccugcccacuauguugucauggggauu

SEQ ID NO: 4187338 - RNA, 62 nt, Human
aauuucugggauuuuuuaaaaaagggaugccaaucucugagugggaaggaaugucagaaguu

SEQ ID NO: 4187339 - RNA, 77 nt, Human
aauuucuuuccgcaagaguuugcugcccucugguggguguuauugccauauugcacaaacuuuuccuggaaaagauu

SEQ ID NO: 4187340 - RNA, 90 nt, Human
aauuugaaacaacguuuuaucgugugcucuucccauaaaaagaguugaaacagguuaugaagagcauaugaagagcauaugaaacagguu

SEQ ID NO: 4187341 - RNA, 75 nt, Human
aauuugaguuggcuucccauagcuugcuaguaaaauaauuugaacaauacagcgacacagggcaagccucaaauu

SEQ ID NO: 4187342 - RNA, 59 nt, Human
aauuugauaggcuauaauuuaaaguaugacuuuaaguucaaauuggggccugugaaauu

SEQ ID NO: 4187343 - RNA, 73 nt, Human
aauuugcuuuccuucugggccucaguuucucuaucugcacaaugaaggagcuggccuagaaaggagacggauu

SEQ ID NO: 4187344 - RNA, 99 nt, Human
aauuuguauuguucugaaaauugggucauacuuacucugcaaguggcuuuucuuaauaugucauagguauaacucagucuuuagauauaaagucaaauu

SEQ ID NO: 4187345 - RNA, 88 nt, Human
aauuuuaugccaagauccaacaggacaaagaaaggacauguuagcccacauuuccuuugcucuugguuggauuuauagguguucuauu

SEQ ID NO: 4187346 - RNA, 89 nt, Human
aauuuuuaaauuuuuuuucauguuaggaagacaggcuuuguagguauaaccuuuguaacauuuucuuggcaucaugaaaaauuaaaauu

SEQ ID NO: 4187347 - RNA, 64 nt, Human
aauuuuuccauugcucagccaguaucgugucuaucacaaaauaaaggcagaguagggaggaauu

SEQ ID NO: 4187348 - RNA, 87 nt, Human
acaaaaaucgaggagagagaugcuguggguagaggcauguggguugccccugcauguguucugagcaguuuccuccucgcuuuuagu

SEQ ID NO: 4187349 - RNA, 77 nt, Human
acaaaaccacacagagccaggcucccauggggcagcauucaauguuucccuacuuuuggcugcuuagugguucuugu

SEQ ID NO: 4187350 - RNA, 67 nt, Human
acaaaaggcccagugccauuaguuuuggucauacacuggccuauggugcuauacugggcugcuaugu

SEQ ID NO: 4187351 - RNA, 129 nt, Human
acaaaauaacccagccguccuccacugcagccucuggggaccggggacacggcaguuuuauuuguugacuuccaacuucaguccugagcggugggcuuuagaacgagccuggcugucuuuuauucuugu

SEQ ID NO: 4187352 - RNA, 114 nt, Human
acaaaauauuagcuugguguggugacaugugccuauagucccagcuaguccggaggcugaggcggaaggauugcuagagcacaggaguucaagccugcagugagcuaugauugu

SEQ ID NO: 4187353 - RNA, 62 nt, Human
acaaaaucacuuucuguugcaguagaucaaagaucuagcugugcccagggaaguuguucugu

SEQ ID NO: 4187354 - RNA, 70 nt, Human
acaaaauccaagaggucaaucacuuagaagggaaaaacaaauuucugggucuuaguuuucuugauuuugu

SEQ ID NO: 4187355 - RNA, 81 nt, Human
acaaaaugccaccuuguguauuuuuugauacuaacuugccuuguaaguacacacuauguauuguacacaguggcgugaugu

SEQ ID NO: 4187356 - RNA, 93 nt, Human
acaaaauggugccagacuacuugccuuugaaucccagcucugccacuuaauuaauugcagggugacuuugggcaaguuacuuaaauuauuugu

SEQ ID NO: 4187357 - RNA, 56 nt, Human
acaaacaucuugaccucagauuucuagucuuuagaacugaggcaauggauuuuugu

SEQ ID NO: 4187358 - RNA, 80 nt, Human
acaaagauuucccacucuacuacaugcuuguuccaugcugggaguuaaucagaguaggaggaauauggaguggccuuugu

SEQ ID NO: 4187359 - RNA, 69 nt, Human
acaaagccaaaguccuagaaauucaacagaggcaaauccauguaguauuauuaaggacauggacuuugu

SEQ ID NO: 4187360 - RNA, 61 nt, Human
acaaagcccggacucacaggcaggcuguauguggcugugucugagugugccugggcauugu

SEQ ID NO: 4187361 - RNA, 105 nt, Human
acaaaggcccggaugagccuuggcagccaggacccgccuggaaagcggccacccuugccaguagcagccggccaggcgcccugggcuccauccccugcuuuaugu

SEQ ID NO: 4187362 - RNA, 63 nt, Human
acaaaguacaaugcaccuauuuuaaaacuuggagccagguuucaaagguguuuuguguauugu

SEQ ID NO: 4187363 - RNA, 62 nt, Human
acaaaguaggaagauuagcugagugaugcuuaaaaucucuucuaguuauaucucuucuuugu

SEQ ID NO: 4187364 - RNA, 113 nt, Human
acaaaguucuuugauuaugacacaaagccacugcauguguaguauucaucuggacucaguacaaacaagaugcucaugcugcgugcugugcugugaguaauaaaguccuuugu

SEQ ID NO: 4187365 - RNA, 130 nt, Human
acaaauaagauaguuuauaaguagagugguuaucaggcucuguguuuugcccaggagaguccuaguuuaucccuacuguccuaggccaaacaugaauaguaaccucuuucacuuucagaagugucuuggu

SEQ ID NO: 4187366 - RNA, 63 nt, Human
aaugugaaucuuccuuuuugaucuugcaguaaucaagguuuaaaaaguauuaggguucagauu

SEQ ID NO: 4187367 - RNA, 68 nt, Human
aaugugcauaaaaauccucauccuccuugaaauauuugaggaguuaggauguuuauauguugcccauu

SEQ ID NO: 4187368 - RNA, 101 nt, Human
aauguguuauuugacuuugcaucuggcuagcuuauggaaauuaaauguauuaucucugaaguacauguaauuuucauaguaagcuaguagcuuaauauauu

SEQ ID NO: 4187369 - RNA, 63 nt, Human
aauguguucaguuaaaugaacuugauuugaauggaaugagaguucaaugaaacuguauauauu

SEQ ID NO: 4187370 - RNA, 56 nt, Human
aauguuccaccaacauuugggaagaaucguauucuguuuauguuggguggaauguu

SEQ ID NO: 4187371 - RNA, 80 nt, Human
aauguuccccaggugauucucauggcccuuguauauugcugcuuuccaagccaugggcaucguccuagguaaugggcauu

SEQ ID NO: 4187372 - RNA, 63 nt, Human
aauguucuguggcuuguagaugcaucacuccaaaaaucucuaucuacaacaucacauggcauu

SEQ ID NO: 4187373 - RNA, 79 nt, Human
aauguuguucucacaagucaguggaauuaauauuauacuuaguauccugguuacuggucuugcacagggacaucacauu

SEQ ID NO: 4187374 - RNA, 59 nt, Human
aauguuguuggcucuucaugauuuaguuucuucuuugguaaaauaaggccaauaacauu

SEQ ID NO: 4187375 - RNA, 83 nt, Human
aauguuuaacagcucaucagaggcaggguaacuugaacuucauuugguaaugcuuuugcucuacccugaucaguuaaaacauu

SEQ ID NO: 4187376 - RNA, 64 nt, Human
aauguuucauucuugcccauugcuccuauucccuguuaagaaucaaggguaagagugguauguu

SEQ ID NO: 4187377 - RNA, 129 nt, Human
aauuaaaagaacugauuagugugaacaucuuuguggcuaguucaaauuguuguguugucauuuuagugaaccacaugcaaagugaauaacacagccugaaucuguuuauaaaacaugguucauuugauu

SEQ ID NO: 4187378 - RNA, 86 nt, Human
aauuaaguuuagguuugacaaugauuagguagcuucucaucucuuguagaaaaguauuucaaucauuuguguuccugagaguaauu

SEQ ID NO: 4187379 - RNA, 60 nt, Human
aauuaauagcaacacaugcugcagggugcauacccaccaguacuuaguguagcguuaauu

SEQ ID NO: 4187380 - RNA, 56 nt, Human
aauuaauuugguuuggaggcacuguguuaaugguggcagccagacgggauucaguu

SEQ ID NO: 4187381 - RNA, 95 nt, Human
aauuacaauuucacuaaagcauucucagauuuugcuacccuuucaaaugguuagaaaagucuagaagaggaauguugcuuuuuaaaaaaugaauu

SEQ ID NO: 4187382 - RNA, 66 nt, Human
aauuacagaucaguuauuuuguagacugucccucaauuuaggguugucugauaacugguugugauu

SEQ ID NO: 4187383 - RNA, 107 nt, Human
aauuacuuagucugugguauuuuguuacagcagcagggacagacuaagauaccauguguauuaguauccuguggcugccauaacaaauuacuacaaacuugguaguu

SEQ ID NO: 4187384 - RNA, 67 nt, Human
aauuagcuuuccgccaucacacaauuaugcaguuccauccaucaaggguguggugggaaaguggauu

SEQ ID NO: 4187385 - RNA, 58 nt, Human
aauuaggggaggacguaucauaccugcuuuaucaggcaugauuuuucucuuacugguu

SEQ ID NO: 4187386 - RNA, 74 nt, Human
aauuaguguguuguugugggcgauggugcuguugguaaaacaugucuccagauauccuacacaacaaacaaauu

SEQ ID NO: 4187387 - RNA, 82 nt, Human
aauuaucgccucuuguuuaaugccucauacaucuuuacuaccauuaaagauggcgugcaggcuagacaaaggggacagaauu

SEQ ID NO: 4187388 - RNA, 130 nt, Human
aauuaucucuuucugucucuaaaacuaugaugauguuuagaguuagcuauguaacaaguaucucucuguucuucggaacacagaguaucuuuugccuaguuuucaagauccuaauguuuugcccgacauu

SEQ ID NO: 4187389 - RNA, 92 nt, Human
aauuauuaucauuguguguuauuuauagucaccuuuuuguagcagauggcucucucccauuuccacaaggcuggcucacaauaaugaugguu

SEQ ID NO: 4187390 - RNA, 65 nt, Human
aauucaagccauugaggguuuucccugagaaaaggaauuagaggagagcccuuagguuuagaguu

SEQ ID NO: 4187391 - RNA, 75 nt, Human
aauucaauacugcagccaggaaauauuugcugaaaggggauucuaugcagucauauuucuucugcaacuugaauu

SEQ ID NO: 4187392 - RNA, 69 nt, Human
aauucacaaaaccagauugcuuuaucaguuuauuucaagauaagcacacaguucugguauuguagaguu

SEQ ID NO: 4187393 - RNA, 64 nt, Human
aauucagacagugugaucagucucugcaauucaaugagagcuauaacagcacuguacaugaguu

SEQ ID NO: 4187394 - RNA, 66 nt, Human
aauucagcaauucugcuagcuuaagcugcuagccucaggcagcuagagaaugacagagucugaauu

SEQ ID NO: 4187395 - RNA, 62 nt, Human
aauucagggggaacacaggguugccaggacaccuggaguccagcccugcuuccccgcuaguu

SEQ ID NO: 4187396 - RNA, 64 nt, Human
aauucagucaaaccacuggucauucggucacacauucagaucaaaugguuucuuugacugaauu

SEQ ID NO: 4187397 - RNA, 89 nt, Human
aauuccuugauacuaccagagacccuucucaguggccaugacucacuguggcugucccuggggaaggggccucuauguggacaggaguu

SEQ ID NO: 4187398 - RNA, 55 nt, Human
aauucgaugcuuuucacuuuguggcuugguuccacaaagugaauugcaucgaguu

SEQ ID NO: 4187399 - RNA, 61 nt, Human
aauucuacucugucuugagugacaguguggcuacauucuagugucaagagggaguguaauu

SEQ ID NO: 4187400 - RNA, 62 nt, Human
aauucucauggaacucugaugggaugauugguuaacacuguuagagugucugugugggaauu

SEQ ID NO: 4187401 - RNA, 60 nt, Human
acaucacuuacucagagauccgaggacaggagggagucugaacuuggcugaugggggugu

SEQ ID NO: 4187402 - RNA, 111 nt, Human
acaucagcaucaucauguaggauccuguuagaaauguagacucucaaaucccauccagaaccugcugaaucagacucugcauuuuaacgagauccccaggugaucugaugu

SEQ ID NO: 4187403 - RNA, 109 nt, Human
acauccccucuccccacugagugugcaucuucugcugggauaacgcauuaaugagcaagccauucauuauccaagcagaagcugcacacacaauggggagagggcaugu

SEQ ID NO: 4187404 - RNA, 59 nt, Human
acaucccucagucagacuguaaacugcaugaggcaggcugcaucugccuuggggacugu

SEQ ID NO: 4187405 - RNA, 124 nt, Human
acaucccuguuucuuguuuuucaugauucuuugcagcuggugguggccgugugaccuaguucuagacugugaaacauaggagcaaucagcuaggaaagaaaacauauggggcuucugggaaugu

SEQ ID NO: 4187406 - RNA, 82 nt, Human
acaucgccgcacucauccucgaugggcaggaagaucucagggaccacgaugaggauccugcgcuuugggggaggcgcgaugu

SEQ ID NO: 4187407 - RNA, 60 nt, Human
acaucuauauuucucaaguauaagaugucacugagugcucacuugagagauauuagaagu

SEQ ID NO: 4187408 - RNA, 78 nt, Human
acaucucgauggaauuggaaagaggaauguuagacguuuuccuaguuuucaucguuuuucuuccauuccaugaagugu

SEQ ID NO: 4187409 - RNA, 88 nt, Human
acaucuggaacucagcuggucuucugugagcucacgccaauuucauauugaguccaguuguucacagaggcuuuucaguccuagaugu

SEQ ID NO: 4187410 - RNA, 57 nt, Human
acaucuuccuuguuccaauuugggcuuauucaaccaaggaguagagcaggaagcugu

SEQ ID NO: 4187411 - RNA, 84 nt, Human
acaucuuggcauccacaugcuguugaauaugacauuguaccuucugcauggcacagugcucuccucacagaugggcccaggugu

SEQ ID NO: 4187412 - RNA, 116 nt, Human
acaucuuuaugccuugcccacuuuucugucuucugaauaguucuauuuuaaaggaaugcugguuccuuaaacugggcauucagagaacugaagacuagucuccauggcacugaugu

SEQ ID NO: 4187413 - RNA, 76 nt, Human
acaucuuugaaaugagagcacagaauaaaaggugucaaugccuuuuauugugcauuucauuucauuuggaagaugu

SEQ ID NO: 4187414 - RNA, 67 nt, Human
acaugaaacuguugcauuagaacaucuuuaaggucuuugccaauucuagacuuguauaguuucaugu

SEQ ID NO: 4187415 - RNA, 71 nt, Human
acaugaacaccaggcaugaacaaacauuuuuuacuuucaaguuuggccaucauuuagccuggucuuuaugu

SEQ ID NO: 4187416 - RNA, 63 nt, Human
acaugaacauuauaucagcaagucauuuaauuucuuuuugucuuguagauaagaaguugaugu

SEQ ID NO: 4187417 - RNA, 128 nt, Human
acaugaaucuuugaggauaagaaaaagcguuuaaaacacaggucucaaacuggcacccugugggccccaucuggccagcagauguguuuuguuuggaccaugcuuuguuuuucuaacucugaauuagu

SEQ ID NO: 4187418 - RNA, 102 nt, Human
acaugacagugcauacacagaaaauaaaguuucuacgcaugauggauucuucccaguugauggagaauauuuuguauuuauaguggcacuaagacgucaugu

SEQ ID NO: 4187419 - RNA, 59 nt, Human
acaugaguuaguuucuugucuagaaaagagccauaucucaucagaaugacuacucaugu

SEQ ID NO: 4187420 - RNA, 61 nt, Human
acaugaucauacauacaugguccucagucacagagacaagagagguccaauguugagaugu

SEQ ID NO: 4187421 - RNA, 86 nt, Human
acaugcaauuaaauguacuugugagcacauauacacaggaucuuccuaggauguugugaugguucacugggcaugacuuugugugu

SEQ ID NO: 4187422 - RNA, 64 nt, Human
acaugcacugguugagggguuugucacagaggugucucucacagagcccuuccauuagucuugu

SEQ ID NO: 4187423 - RNA, 73 nt, Human
acaugcagcagaauaaugacuauaaaaccuuauaauuauacagcacuuggauagucaggaacuguuggugugu

SEQ ID NO: 4187424 - RNA, 59 nt, Human
acaugcaguuucucuaugcguagguuuucaauuuuuccuagggcuagacagacgcaugu

SEQ ID NO: 4187425 - RNA, 59 nt, Human
acaugcauaagccuagccaucaaugcaaugugugcgugugugugugugugugugugugu

SEQ ID NO: 4187426 - RNA, 60 nt, Human
acaugccuguggacuuacgagaauggucacuuuccuuuucauguggaccuagaggccugu

SEQ ID NO: 4187427 - RNA, 57 nt, Human
acaugcuuucuagguccuucugaguuuuaggauccugagggauuugguugguauugu

SEQ ID NO: 4187428 - RNA, 67 nt, Human
acaugcuuugacagagucacuaaauccuugucuguuuauuucuggaaugaucaugugaaagucaugu

SEQ ID NO: 4187429 - RNA, 76 nt, Human
acauggauuuuggggaaagugucuaauaauuugugcucacuuuaaaacagaauaaagauguucccaaaguucacgu

SEQ ID NO: 4187430 - RNA, 90 nt, Human
acauggcugccagaagucugggacuuacaaucaaccaccuuggagauccagcauccuggggaggaaugugaggucaggucugggccaugu

SEQ ID NO: 4187431 - RNA, 60 nt, Human
acaugguauagagccacauguauuguguauacuuagaguagaugauguuucuuugccugu

SEQ ID NO: 4187432 - RNA, 58 nt, Human
acauguacgugcugcucucuguguguccuugaacauucauagaaguauuauguaaugu

SEQ ID NO: 4187433 - RNA, 57 nt, Human
acaugucuuguggcuuugaucuaagccucuguguaugguucauaagccucagacagu

SEQ ID NO: 4187434 - RNA, 66 nt, Human
acauguggcauaaaauagguuacugugaauugguuaucacacaaaguguuagaugccacucuaugu

SEQ ID NO: 4187435 - RNA, 56 nt, Human
acauguguuggauauucuaggauacaauccacuguccugggaugcauaaaauaugu

SEQ ID NO: 4187436 - RNA, 55 nt, Human
acauguuugauaaauauuugggaguguuuauuaacuucauauuuaucguauaugu

SEQ ID NO: 4187437 - RNA, 61 nt, Human
acauuaacacuggugcugguguaauggaagcaugagcaguagcauaaauagugguaguagu

SEQ ID NO: 4187438 - RNA, 91 nt, Human
acauuaaccaggcauauguuuauuccaaauugcauuguuuuaaaacucucaguggcaaugaauaaauaauguuuagacaaaacguuauugu

SEQ ID NO: 4187439 - RNA, 130 nt, Human
acauuacaaagauguggaagcauauugccaaguaguucuccagaaaguacaugggauucauuuacccaaugacaggugccuguuucccuccauuuuuacuaacuugauguuuucauucuuucaauucuuu

SEQ ID NO: 4187440 - RNA, 59 nt, Human
acauuacauuuagcacaucugggauguguucacaugaagacauuggcuaaaaguagugu

SEQ ID NO: 4187441 - RNA, 130 nt, Human
acauuagaaucaccucggggagguuugugaaaaugcagauugcuggucuccacucccauccaauucaguagguccgagcugaagucugagaauuugcaauuguaacaaccucccagaugacacugcuggu

SEQ ID NO: 4187442 - RNA, 72 nt, Human
acauucaaggcagcacugaguguuggacaggacacauuaauuccuuacaugucucagguguuccuucagugu

SEQ ID NO: 4187443 - RNA, 75 nt, Human
acauucaagggcucaaacggugguugccucccacuagggagggcagggggccgccagagagagccuugauuaugu

SEQ ID NO: 4187444 - RNA, 72 nt, Human
acauuccacagcucuggggcagagugacuaaggcucaccuguaguccuuaaauggagagcaauuugggaugu

SEQ ID NO: 4187445 - RNA, 55 nt, Human
acauugaugaucccacuuacagugggacuaacuguaucccuuggguuauuugugu

SEQ ID NO: 4187446 - RNA, 55 nt, Human
acauugcaguuaucagauugccucugugaucccugcagucugguggcgugcaugu

SEQ ID NO: 4187447 - RNA, 63 nt, Human
acauugcucaaaggaaugcaauuaaaaccuaacugcuauugcauuuaauccauagaggaaugu

SEQ ID NO: 4187448 - RNA, 83 nt, Human
acauugcucuuuugugcucuuuaugcugugcauuuggacagaggucagaacugcagcagguaagagcauuuggcauuucaugu

SEQ ID NO: 4187449 - RNA, 92 nt, Human
acauuguacagugauaaucauggaaucugcuauguuauuucccacuuagguagggggaaaaauguaggcagaugauuaucuauuuaaaaugu

SEQ ID NO: 4187450 - RNA, 63 nt, Human
acauuguucuacuucuaguuagcuacagugagaaugcuagcuguucugugucuaggacaaugu

SEQ ID NO: 4187451 - RNA, 66 nt, Human
acauuguugacauuuugucauauugacauuuugugugugugugugaggagauguccugugcauugu

SEQ ID NO: 4187452 - RNA, 78 nt, Human
acauuuaagggcuggcaagggauugaaauuguuggagacuauuaugguuugaauugagugcccccagccccaauaugu

SEQ ID NO: 4187453 - RNA, 68 nt, Human
acauuuacagcccaagaaguuuauacguacggaugagucccuguagcuacauuuuugacuguguaugu

SEQ ID NO: 4187454 - RNA, 69 nt, Human
acauucugugagucauguuuuauuacuuuagggccuuuuguaaaauuucugagcugauuucacagaagu

SEQ ID NO: 4187455 - RNA, 64 nt, Human
acauucuucauuuacuguuacuugucauuuugcaaacugauuaguuaacuugaaugaggagugu

SEQ ID NO: 4187456 - RNA, 57 nt, Human
acauucuuucucuucaggaaacugggaagacaacacccaaagccagagaaagggugu

SEQ ID NO: 4187457 - RNA, 130 nt, Human
acauugagcaaauuuggcugcauuggggcauucacuugguuucuucaaagaugucuguuggagcuauucccauacccacugaaggaucuguagucuugucuucauucuauguagccauguucaaggaugu

SEQ ID NO: 4187458 - RNA, 56 nt, Human
acauugugacucugagcauuggggucugacuccugagugucucuggaagcacgugu

SEQ ID NO: 4187459 - RNA, 83 nt, Human
acauugugaucugcccaauucuaggaaauucauacgcacugccauaugaauggugcuuccuggaguugugcagugcacaacgu

SEQ ID NO: 4187460 - RNA, 65 nt, Human
acauuguuguuugcagcacagguacuaugcuggagcaguuaacuguguuacaaacugcuagaugu

SEQ ID NO: 4187461 - RNA, 61 nt, Human
acauuuaaugugcaaagagauagggcauuauaaaguuauaugucaugagcauauugaaugu

SEQ ID NO: 4187462 - RNA, 90 nt, Human
acauuuacuguaugagaaaauguauacuucauagccauauagacaaauauaucagugcagaauagugaugcauuugaauuagugaguagu

SEQ ID NO: 4187463 - RNA, 114 nt, Human
acauuuauuggcugugauguguccacugcaaucguguaugggugcuggccugaguagagagcacuugccaggucaccucacucauccagagacagccucaugguggaugagugu

SEQ ID NO: 4187464 - RNA, 72 nt, Human
acauuucacuccccuccccacugcacccuggcaacagcucugcaggacuggggagcggaaggugagugaugu

SEQ ID NO: 4187465 - RNA, 66 nt, Human
acauuucccaacaaggaaacguguaagauguaaacaguuuacaaaguuucacuguuccuuagaugu

SEQ ID NO: 4187466 - RNA, 63 nt, Human
acauuucuugcauauucucugaggcaggagagaccuucucuuauucuggauaugcagagaugu

SEQ ID NO: 4187467 - RNA, 83 nt, Human
acauuucuuuuguuagguacagcuaaaaauuaucugucuuuauagaaaggauucuugacugcuuuguugauuaaaggaaaugu

SEQ ID NO: 4187468 - RNA, 68 nt, Human
acauuugagucauauuugcuuagucuucucagacuucuucacgaggagagcaaaucugaccaaauagu

SEQ ID NO: 4187469 - RNA, 56 nt, Human
acauuugccuguauaaccuuguguguuaccacugccaagcaauauagugcaaaugu

SEQ ID NO: 4187470 - RNA, 66 nt, Human
acauuugucucugaaauauguggcuccaguggcccagcaggauagcagccuuucagagccagaugu

SEQ ID NO: 4187471 - RNA, 95 nt, Human
acauuuuaaaaguuaauauuguaaaauaggaauaauaggagcuaacauuucuauguuagccauuaauguccugugcacaauugcauuugagaugu

SEQ ID NO: 4187472 - RNA, 88 nt, Human
acauuuucauaauaauuuacagcccaugauuuguuauuuauauauaauuaauaugugaagaauuaaugugaaucauuauuuuaaaugu

SEQ ID NO: 4187473 - RNA, 82 nt, Human
acauuuuugguaagggugcuucauaggugaugcuguguauuucauacugcaucacagcaggaggcacauaauauuaguuugu

SEQ ID NO: 4187474 - RNA, 99 nt, Human
accaaaaacauggggaaaauguaaggugcucauguauuucuauguuuguuuuauucuauaaaggaauuucuaacuuuuauuuuccucaugguauguggu

SEQ ID NO: 4187475 - RNA, 70 nt, Human
acagaugauuuucuguguuagaagaugcuaucggcucaccuggccucuuagugacagagaaauccuuugu

SEQ ID NO: 4187476 - RNA, 63 nt, Human
acagaugcugaagguuauagcaugaaggcagacauuucugccuucaccaggccuucagccugu

SEQ ID NO: 4187477 - RNA, 59 nt, Human
acagaugguacuaaacccauauaacuuauauaacuguuaucauggggucaagccgcugu

SEQ ID NO: 4187478 - RNA, 79 nt, Human
acagauggucccacugcccccacucugagaaaagcccucuggcuguuuggaugagggugguggcgaugaggacauuugu

SEQ ID NO: 4187479 - RNA, 92 nt, Human
acagauguauuccugaaugaguugaucacaaucugaauuuuuguaaaccaugccagaguugcgauucacaacauuucugggaauacuacugu

SEQ ID NO: 4187480 - RNA, 58 nt, Human
acagauguuagcaaugaugaugauguuuaaaaacacacaggucauugcaacauacugu

SEQ ID NO: 4187481 - RNA, 106 nt, Human
acagauuccacaguuucucauaaugauaaugcaaauggcaaugagugaccuuaaacugaggugccauuaauaguuguggugauugugaguuuuugugguauuuugu

SEQ ID NO: 4187482 - RNA, 81 nt, Human
acagauuuuccuggaaaacaugggaaucacacugauuauuucacauaugugucaaauuguuuuacacaggaagaggucugu

SEQ ID NO: 4187483 - RNA, 59 nt, Human
acagcaaagaagacacaggcuucaucaucaagcagaccuggaccuguccuucucgcugu

SEQ ID NO: 4187484 - RNA, 74 nt, Human
acagcaaucagauaccaagcuccagaauaugcuccacacuguuauuuucuggcugaaaguuuauuugaagcugu

SEQ ID NO: 4187485 - RNA, 68 nt, Human
acagcagagggcuguccaccuaccaugccggcggugcccugccgagcggcucuggacagcacugcugu

SEQ ID NO: 4187486 - RNA, 66 nt, Human
acagcagaugacaacuauuuauguggagaguacuuuaauccggguaaugagucagcaucuaucugu

SEQ ID NO: 4187487 - RNA, 69 nt, Human
acagcagauuuggagccguggaagaacagcgagaaaucucuucacaugaccuucaugucuuccuccugu

SEQ ID NO: 4187488 - RNA, 64 nt, Human
acagcagcccucagaugggaaaggaggggcuuggggcucugagcuucccucugaggcaggcugu

SEQ ID NO: 4187489 - RNA, 91 nt, Human
acagcaggaaucgccuaaaccagugaaacaccaggcaagugcucuucuuuaugcuucuuagucuugaguguuugcacuaauuucugucugu

SEQ ID NO: 4187490 - RNA, 60 nt, Human
acagcaggauuuggcgauguuggcacuguugacauuuuggacucguuaauucuuuguugu

SEQ ID NO: 4187491 - RNA, 57 nt, Human
acagcagggcaugagaggcaggcaagugagcauuacugccugagcucugccuccugu

SEQ ID NO: 4187492 - RNA, 92 nt, Human
acagcaguuauuuuccauuccauuugccugcugagugagcuuccagggacuaaugccuacuucagcaaggcagaagggagguaagcugcugu

SEQ ID NO: 4187493 - RNA, 58 nt, Human
acagcauccuucuaaaguagcugucucagugaaaaaucacuuuagggaagguugcugu

SEQ ID NO: 4187494 - RNA, 61 nt, Human
acagcaugcccagacugagcuaaauggaaaaagacuacuuggaaagugugugugugugugu

SEQ ID NO: 4187495 - RNA, 79 nt, Human
acagcaugugcagacagggaccagccugcccagggcuagagcauggcuggagcccuggggcuggucuuggaaaugcugu

SEQ ID NO: 4187496 - RNA, 90 nt, Human
acagccaguuggaaggagucuuuaacacccaugaccuugauggucaacaaauuggaguuuuagugcauacuucuaccacaaauuaacugu

SEQ ID NO: 4187497 - RNA, 128 nt, Human
acagcccuauccuccucagcuuuaagaaguuaccauuaaucuauguucugucuguacagauuugccuguucaggacauuucguaugaacggaaucauacaauaguguggcauuuugggacuggucugu

SEQ ID NO: 4187498 - RNA, 59 nt, Human
acagcccuucuuuucuguagugauugcagauuugagcgcauuucaguaaggaagccugu

SEQ ID NO: 4187499 - RNA, 80 nt, Human
acagcccuugcuuggcugugcagucagaugggugagaagaaggauccacagaagcaaagacucaggcaagcccaggcugu

SEQ ID NO: 4187500 - RNA, 83 nt, Human
acagccgugcucacagagccucugugucuucaucgcuagaauggggaugggaguugcuuugagacugcaguauugaagguugu

SEQ ID NO: 4187501 - RNA, 79 nt, Human
acagcgaggugacagagauuaauagcuugguauugacugagcaacuucgaguuccuuaucucugucaagucaaggcugu

SEQ ID NO: 4187502 - RNA, 90 nt, Human
acagcguaguuaaauuuuaguggauauuugguuuuuuaaaaauguuauuuccaauaugucgcuacaucauuagauuuuaaacaauguugu

SEQ ID NO: 4187503 - RNA, 72 nt, Human
acagcuaagaagugcagagcugcaauguaaacacaacugugcuuuauuccaaagcuugcacuuuugcgcugu

SEQ ID NO: 4187504 - RNA, 56 nt, Human
acagcucagcuuguggugaugguauuagcuucacaacuccaaacaaguuaagcugu

SEQ ID NO: 4187505 - RNA, 55 nt, Human
acagcucucccucagagaaaugcgcacauuuucuacacagaaagggcgaagcugu

SEQ ID NO: 4187506 - RNA, 81 nt, Human
acagcucugcccuccggaggcuuggcagacacugagcagcugcuccuggggccaggcaccucuggcugugccagcagcugu

SEQ ID NO: 4187507 - RNA, 65 nt, Human
acagcucuuaggcagaaccaacccugcugaaagguugauuuuggguuucuagccuccagagcugu

SEQ ID NO: 4187508 - RNA, 69 nt, Human
acagcugcuuugucuggugauuuuguguguuucuauaaaaugcgcacaaaguuggacaacgcacccugu

SEQ ID NO: 4187509 - RNA, 56 nt, Human
acagcuggacaggggagaguuuaaguaaacagacacucauccacugcuggggcugu

SEQ ID NO: 4187510 - RNA, 59 nt, Human
acagcuggaggggcugcagagggagcagaucccuuaguggaggcagccccagcagcugu

SEQ ID NO: 4187511 - RNA, 55 nt, Human
acagcuggccgaggcucagggauagagacggcugcuccagcuaaaggucaguugu

SEQ ID NO: 4187512 - RNA, 86 nt, Human
acagcugggaagugauggagccaggauuuaauuccagacaaugaggcuuugggauccuggagcuccaucacuauuucaucugcugu

SEQ ID NO: 4187513 - RNA, 60 nt, Human
acagcuguggggacucuugcccaugguuugguguuugcaggguuauucucggcaugcugu

SEQ ID NO: 4187514 - RNA, 95 nt, Human
acagcuucuguguuuuucaguauuuuuuucuaguucuaaacuaagagaauguccuuaaggagcuuagaagugugcugagaggauacuuuuacugu

SEQ ID NO: 4187515 - RNA, 56 nt, Human
acagcuucuuagucuuuccuuguuuauucaugagcuuggcagucuugaggaguugu

SEQ ID NO: 4187516 - RNA, 63 nt, Human
acagcuucuuggcuugggcucuugaaaucuagaagucuuugggacugaaagcgaagaauuugu

SEQ ID NO: 4187517 - RNA, 62 nt, Human
acaggaaaugaaaugguaucuaaaauaaacaagcugugguaugaugauuauucauuuucugu

SEQ ID NO: 4187518 - RNA, 97 nt, Human
acaggaacgcuguuugugcauuuaugcaucccagcaugugacaaagcguuugucacacauuguugcuuaaguugcauauauuuccagucccaccugu

SEQ ID NO: 4187519 - RNA, 67 nt, Human
acagagcauauaaagugcuuugcauagacuuuguacaaugucuguauuaagcaguuuauauauuugu

SEQ ID NO: 4187520 - RNA, 75 nt, Human
acagagcauuuucugggccugcaggagauggucagucagacuuuucacaggaauacccggcuuucuaauuucugu

SEQ ID NO: 4187521 - RNA, 60 nt, Human
acagagccacuuuggugccuaccccuccacaaguagguaggcacauccagguagcucugu

SEQ ID NO: 4187522 - RNA, 60 nt, Human
acagagcuagaaaaaggcagaauugggaccuauacccagaauuucuaacucuagcucugu

SEQ ID NO: 4187523 - RNA, 122 nt, Human
acagaggacauuucccagagacagguucagggugccaggucucgggucugcucguggccuuguguuuucuggccaggggacuggagaaccucacagccagggacuuuggggaaauccucugu

SEQ ID NO: 4187524 - RNA, 71 nt, Human
acagaggcucagaguuaggacccauguagcagagaucagcuuuacugggaaaaacugcuuugaggcucugu

SEQ ID NO: 4187525 - RNA, 55 nt, Human
acagagguaggacaugagauaucuauaucauguaucucagugaauguaucucugu

SEQ ID NO: 4187526 - RNA, 68 nt, Human
acagaggucucaguuauguuuaaaauguguuaccaauggugacuaucauuuaggcauuacucuuuugu

SEQ ID NO: 4187527 - RNA, 73 nt, Human
acagaguaggugcugucgacuggcuuccugacuacucacagaccacagucuugccaguaccaaugccaucugu

SEQ ID NO: 4187528 - RNA, 67 nt, Human
acagauauaacugguccagaggucgguagucaucaugaguacuaagaccuagauacuaggggucugu

SEQ ID NO: 4187529 - RNA, 55 nt, Human
acagaucucaaagccuggaccccaccagagggagguguuggcuggccagaucugu

SEQ ID NO: 4187530 - RNA, 76 nt, Human
acagauggcacuuuuuaggacucaaauuggacacaauuucuucuaguuguaaaauccuuaacaagauggcauuugu

SEQ ID NO: 4187531 - RNA, 62 nt, Human
acagauggcagucagcuuagacuguagugugaagcccuacaggcugacuuccugccaugugu

SEQ ID NO: 4187532 - RNA, 96 nt, Human
acagauuuuugugaccagacuucauagcacaauauuaccuuuaugcuaguguuguacuauaaugguaacauugugcuacgugguauaauagucugu

SEQ ID NO: 4187533 - RNA, 57 nt, Human
acagcagacagucggcuuccugggaucaagggaauuuucugagccugcucugcuagu

SEQ ID NO: 4187534 - RNA, 83 nt, Human
acagcagcaaauauguggguggcuauuuggcugcagcucuauguagcuauagaggcuguaccuuugcauugugcccgugcugu

SEQ ID NO: 4187535 - RNA, 76 nt, Human
acagcaggccucucuggccccauggcugagcuggccucucaguuggccaauguggccagguuuaggccaccccugu

SEQ ID NO: 4187536 - RNA, 94 nt, Human
acagcaggguguggccgaugugagcuggcaggagaccauacccuacugagaagauggugguuugaccucccgcuagggcucaucacccugaugu

SEQ ID NO: 4187537 - RNA, 58 nt, Human
acagcagguagcuuugugccucugcaaugcucccuugagguugcaagauuccugcugu

SEQ ID NO: 4187538 - RNA, 106 nt, Human
acagcaguucuuggugauguuaauagcacaauugugaagaccaacauaagagcuagaguugauuucacaguacugugacuauugacagggacagugaugaugaugu

SEQ ID NO: 4187539 - RNA, 130 nt, Human
acagcaugcagcauuggguuuugauguuugugcuauaguguucuguccuguagguuuauuugugucugagaaugacauauuucaauccaagacgugauuagcauuaagaugagccuugugcugcuacugu

SEQ ID NO: 4187540 - RNA, 59 nt, Human
acagcauucaauaaauaauaacuacuuucacuaugacuguuauuaugugugguugcugu

SEQ ID NO: 4187541 - RNA, 63 nt, Human
acagcauugcuccaucucaagaccucacagaaaaucucucucugagaggaauguaauguaugu

SEQ ID NO: 4187542 - RNA, 78 nt, Human
acagccaaugagcuagaaaaccauguggacuccuaugaagccauucuaagucaccugguccuauagcugaaggacugu

SEQ ID NO: 4187543 - RNA, 63 nt, Human
acagccacuguggucuagcugcacugucuggcagucagcuccagaguugcacagugacccugu

SEQ ID NO: 4187544 - RNA, 64 nt, Human
acagcccaggacuccagugggcuugcgucgccauaacaacagacggcuccgagucuugggcugu

SEQ ID NO: 4187545 - RNA, 80 nt, Human
acagccccaccgugucaguagauuauuacaauaaaggcccacaucucacucuuguugcuggugaugugcuauuggguugu

SEQ ID NO: 4187546 - RNA, 61 nt, Human
acagccuguuugaucuggugcuuguuggcuuuaacauccacaaugaauacaagcauguugu

SEQ ID NO: 4187547 - RNA, 59 nt, Human
acagcgagaaggacagguccaguucugcuugaugaugaagccugugucuucucugcugu

SEQ ID NO: 4187548 - RNA, 67 nt, Human
acagcucugcauggcaguuauuucaucaauuacuuaccaagcaaugaaacggcugcuuugggguugu

SEQ ID NO: 4187549 - RNA, 87 nt, Human
acagcucugcgauuauacuaaaacgcauugaauugucuucagacaagcaguguauauaguaugugaauucugucucaguauagcugu

SEQ ID NO: 4187550 - RNA, 78 nt, Human
acagcucuuagcaauguaugauuaaaauagguuuaagcuugauaucuuaguauaugcauagcauaggaaaaaugcugu

SEQ ID NO: 4187551 - RNA, 64 nt, Human
accagccuggccaacauggcaaaacucaucucuacuaaauaugcaaaaauuggccaggcauggu

SEQ ID NO: 4187552 - RNA, 69 nt, Human
accagccugggaguggugacagcucucgguggaugguaaccuccagggugcugcaccaucccucauggu

SEQ ID NO: 4187553 - RNA, 61 nt, Human
accagcugauuuaagaauaaagagagcacuuaaacucagauuuccuuucuugucagcuggu

SEQ ID NO: 4187554 - RNA, 55 nt, Human
accaggagacaugaccaaugagacuagagagaguuuggugucauuuccuccuggu

SEQ ID NO: 4187555 - RNA, 87 nt, Human
accaggcaagaggugugaaaauaggaccuggagccaggaacguccagugucucaaguuccagcccuguggcuuccacccuuccuggu

SEQ ID NO: 4187556 - RNA, 70 nt, Human
accaggcacaggaaugucauccagugccauucgcaagaacagaggacuggggaucguuccaaguguccgu

SEQ ID NO: 4187557 - RNA, 79 nt, Human
accaggcaccccucugugggccugugcuuuaguccuuuuucacucuagacccugguacuacugagguggcuugcguggu

SEQ ID NO: 4187558 - RNA, 64 nt, Human
accaggcaguauggugcugcaaaaggugcuucaggcgcugcaugcagacaccaauuuccugagu

SEQ ID NO: 4187559 - RNA, 70 nt, Human
accaggccucuagcucuuagacuagcugugcuccauggcagaucugagccaagcucgauguugcucuggu

SEQ ID NO: 4187560 - RNA, 62 nt, Human
accagggcugacaaucugauggcauaggcugacagagccauauugguuggucagcccauggu

SEQ ID NO: 4187561 - RNA, 68 nt, Human
accaguaacuuucuaauuuuggcugagcuuuccauggaguucugccaacaaggagagcauguacuggu

SEQ ID NO: 4187562 - RNA, 55 nt, Human
accaguaagauccuguacauacuguacauacuccagguccaggguacuuccuggu

SEQ ID NO: 4187563 - RNA, 93 nt, Human
accaguaauugacagagcugcaacuugaacauaaaucuggauaauaauaaagucuguguuuauucuaacuugcugcucuaguggaauacuugu

SEQ ID NO: 4187564 - RNA, 63 nt, Human
accagucauagaaagcaguggugcccaagagcauggcacucacgucucugucuauaaacuggu

SEQ ID NO: 4187565 - RNA, 72 nt, Human
accauacauacugaguggacugauaaauguuuaauuuuaaugcagcaaauuggcuauugagugugugcuggu

SEQ ID NO: 4187566 - RNA, 72 nt, Human
accauagacugugaggcuuacaaagaaucgacaucuauuucucacaguucuggagccugggaagucuaaggu

SEQ ID NO: 4187567 - RNA, 77 nt, Human
accauagucaaggcacguuaguagguauuauuagugaaaggcacuuuauuuacugugcagcugugcuuugggguggu

SEQ ID NO: 4187568 - RNA, 76 nt, Human
accaucaaguaagugccagagaaugaaaaucagauuuuugacuaaaaauuugauaugcuuuucacuauaccguggu

SEQ ID NO: 4187569 - RNA, 64 nt, Human
accaucuaagagagagagcaugucuuggcuagcuuaaacaagcauugucacucucuuggcaggu

SEQ ID NO: 4187570 - RNA, 68 nt, Human
accaucugagccugcaaccauagaaccguguacaaggggcacaggagcuguggggcaguguaugaggu

SEQ ID NO: 4187571 - RNA, 58 nt, Human
accaugacacaugacaagcucaugaacucuuaaaugaguuuuaaaugauggugguggu

SEQ ID NO: 4187572 - RNA, 86 nt, Human
accaugaccucaagaacaguauuuccaggaauccccaucuuagcaucuaagggauuccugggaaaacuggaccgugaggacaaggu

SEQ ID NO: 4187573 - RNA, 63 nt, Human
accaugcuggcaccuugaucucagaaaauaaaugucuguuguauaagccauccagccuguggu

SEQ ID NO: 4187574 - RNA, 60 nt, Human
accaugguauugcaacaacugucauucaauaugaagauaucucuguccugguacuguggu

SEQ ID NO: 4187575 - RNA, 58 nt, Human
accauguccugugcuuugugccaccuguuuaccuuuguacauggcauucccacguggu

SEQ ID NO: 4187576 - RNA, 56 nt, Human
accauucugaguacauuuccucagcugugaaagaggaagagcugacucacaguggu

SEQ ID NO: 4187577 - RNA, 63 nt, Human
accauuuacuuuggaaaagcauaccaaggagaaagcuucauccuuugucuuugcauagauggu

SEQ ID NO: 4187578 - RNA, 100 nt, Human
accauuugaucggggaggucugagcuccuuccucugaacgcugugucuucaggccuuguguauucagaggagggacucagacccaggauugggcaggggu

SEQ ID NO: 4187579 - RNA, 92 nt, Human
acccaaaaccagucacuggaacaguguuggagcuugauuuuuugaucuuugaaucaaaguauuuuaacuguauccaccugaccuggcugggu

SEQ ID NO: 4187580 - RNA, 67 nt, Human
acaggaagugcuggcacuuacacaggcuggagugaagaugucaaaugaggaugucagcauuuuuggu

SEQ ID NO: 4187581 - RNA, 126 nt, Human
acaggacucaagccaagacaaugagaauagagaacagaaauuggaaaaguagcuuccuugcuuuucugagaaugcuucuggaaucacuuuucuuugucucucucugucauggacaaggacuucugu

SEQ ID NO: 4187582 - RNA, 68 nt, Human
acaggagcucuagggacagcacagugaggggucuacuccggagcagugcgagcucuaucugcuccugu

SEQ ID NO: 4187583 - RNA, 62 nt, Human
acaggaggaacaagagguucugguugccacucuucaaugaguucuucuuuuuccuugacugu

SEQ ID NO: 4187584 - RNA, 65 nt, Human
acaggaguggcucuaccagacccaaagggaauuuaauuucuucaaucugucuuugcuacucuugu

SEQ ID NO: 4187585 - RNA, 70 nt, Human
acaggagugugcauuccucuccucaggucucucucuuuugggggucugaaugucuagugcugauuccugu

SEQ ID NO: 4187586 - RNA, 58 nt, Human
acaggauaguuuuuaaucuuccauguaguucugaugcccugguugaaaucuguucugu

SEQ ID NO: 4187587 - RNA, 123 nt, Human
acaggauccuuauggucuuuauucucuuuucugggggcuaugauuuucuacaaauuauuggggaagauucucacugcucaacuuucagaggagcuagaaugcccacuuacuagcaucuccugu

SEQ ID NO: 4187588 - RNA, 71 nt, Human
acaggcaaagggucaguagcagggcaggaguaagauaagucucaggccgggugugguggcucaaagccugu

SEQ ID NO: 4187589 - RNA, 55 nt, Human
acaggcauugggauggagguuguggugcccaagugccaugcgucacaaugcuugu

SEQ ID NO: 4187590 - RNA, 129 nt, Human
acaggccaagggaaccagugcaaguuagaacauuuggacaugggcucucugagcuccagggcacacagcucaccccugagguacccugagccuguguccacaugcacuugaagauggcggcucuucugu

SEQ ID NO: 4187591 - RNA, 57 nt, Human
acaggccuagcuaaugcuuuccuuuccauacagaauugcagucuagccaggcucugu

SEQ ID NO: 4187592 - RNA, 58 nt, Human
acaggccugauguuauccuauuuacuucccauugaguuggaauauccgucuggccugu

SEQ ID NO: 4187593 - RNA, 83 nt, Human
acaggcgggaugggaggcaggcucagaaccggaaacuuccaaguuccuguucccucacugucuccugucuaacuacacaaugu

SEQ ID NO: 4187594 - RNA, 65 nt, Human
acaggcgguggcuccuggcugagugcaacauucuccgaggugcucaccaagcgccgccgcugugu

SEQ ID NO: 4187595 - RNA, 68 nt, Human
acaggcuccaggagggccuuggccaucccugagggcaggaggcuuggccggggugcugcugagcaagu

SEQ ID NO: 4187596 - RNA, 55 nt, Human
acaggcuuuuuuagaaugacauuugguucuuaaagucugucuacuuaaagucugu

SEQ ID NO: 4187597 - RNA, 55 nt, Human
acagggaacaggaauauacaaaaguaaaagaagguuuuuguaauguguucucugu

SEQ ID NO: 4187598 - RNA, 59 nt, Human
acagggaaggacaugacuuggcagugguccaaccagguggacagucugucuuuccuugu

SEQ ID NO: 4187599 - RNA, 114 nt, Human
acagggaggcaucaugcaggguauguauaccaggggauggaaauguuggggccaucuuggacuccucucuaacccacuggagcacaagcccauugccauucugccuggcucugu

SEQ ID NO: 4187600 - RNA, 79 nt, Human
acagggagucacccuuucuccagaacugucugaagcuuuagugagcucgggcagaggauggaaaaggaauggucccugu

SEQ ID NO: 4187601 - RNA, 65 nt, Human
acagggcagagggcaguugguagccacaagacgccagguagcccccaugcuccccucuuuucugu

SEQ ID NO: 4187602 - RNA, 63 nt, Human
acagggcccuugccagcacaaggucuagggaaagagcaaugcuggagguguggcaaggucugu

SEQ ID NO: 4187603 - RNA, 69 nt, Human
acagggccuggcucaauaaauauuagcugcuggcuucugcucacuuacuguuuauugacuggcuacugu

SEQ ID NO: 4187604 - RNA, 121 nt, Human
acaggggcaugaugacuggacuuggucacuccuggcuugaagagcugggucugcagucaucucugcaagaaagccucaaucuucaggccuaggaugcaaucuaguuucauucugccccugu

SEQ ID NO: 4187605 - RNA, 68 nt, Human
acaggguaaagggaaucugcucuggagucauacuugagcucaauuccuggcacaacccuuuaccaggu

SEQ ID NO: 4187606 - RNA, 60 nt, Human
acagggucacuguagacucugaucuuacuccccaaggaucuagaaaccugaugacucugu

SEQ ID NO: 4187607 - RNA, 62 nt, Human
acaggguuuggagaucaucagagguugauuccaaauuuaccucugccacuuucuaacucugu

SEQ ID NO: 4187608 - RNA, 61 nt, Human
acagguagguuaaaaugugucaagauccaaugacagggaacacuauuuaaaucuaaccugu

SEQ ID NO: 4187609 - RNA, 57 nt, Human
acaggucagauaaaggcuggugguuuucuccaacaggccucauuauacugaucaugu

SEQ ID NO: 4187610 - RNA, 63 nt, Human
acaggugagacaucuugggaagugaugugagagcaauuauucuuuuuaaaauguuuugucugu

SEQ ID NO: 4187611 - RNA, 81 nt, Human
acaggugccuguaucacaugacucugcacuaggcuaugguuucccuucuuacaggagcugcucugugauacuuguauuugu

SEQ ID NO: 4187612 - RNA, 65 nt, Human
acaggugguagaguggaaagaggcuagccagagugggucugaauucugucuccucuacuuucugu

SEQ ID NO: 4187613 - RNA, 130 nt, Human
acagguugaucauaccaaauacaaaaaucccagaauccaaaacguuuugaguacccacauaaugcuaaaaggaaaugcucauuggagcauuuuggauuuuggauuuucucauuugggauguucaacccgu

SEQ ID NO: 4187614 - RNA, 65 nt, Human
acagguuggcugugagggguugcacaggccucaguuggcccugugguaaugcgcacagucacugu

SEQ ID NO: 4187615 - RNA, 73 nt, Human
acagguuguauagucuucugugcucaaaacuuuccaagaaagcaauucuuugagaagcauggcuguauucugu

SEQ ID NO: 4187616 - RNA, 101 nt, Human
acagguuuaagcugcaaaacauugucaauugaaugaaugaggaggcauuggcucccauuguuucugcuuuauuuagggcuuguguuuagcuuguacucugu

SEQ ID NO: 4187617 - RNA, 91 nt, Human
acaguaaaauggccaagcaggauauucugugucaggaucagcugguucuucccuggcauucuggugcuugcuucuuccauuaauguauugu

SEQ ID NO: 4187618 - RNA, 89 nt, Human
acaguaaguuauuuuuggguuguugaaagcugugucucuguucuaaauuugagcgcagaaaucaugccacuuacaaaauaaugcuuugu

SEQ ID NO: 4187619 - RNA, 57 nt, Human
acaguaauuguguacgaggacacauuuccaaugggguuuuuguucagcaggugcugu

SEQ ID NO: 4187620 - RNA, 68 nt, Human
acaguauuagcaagguucaugagaagacaguaggccagugccucggaugugucaaucuuggugacugu

SEQ ID NO: 4187621 - RNA, 67 nt, Human
acaguauugucagccagauuggcuguaaccauuauuauaaccuuuacuauaucugcugacauucugu

SEQ ID NO: 4187622 - RNA, 69 nt, Human
acagucacggguugcuuaacaaugggaacauguuguaagacaugcauugucaggcaauuucaucauugu

SEQ ID NO: 4187623 - RNA, 75 nt, Human
acagucagucagccaaguacucucaccaaagcuuguuggggcaagauuggucuucaguauugcugcccagacugu

SEQ ID NO: 4187624 - RNA, 102 nt, Human
acaguccacgucccgggaagggguagacacagcuaugagcagccuagcuugccgaagcagcagggcuucugugccugugcaccucugucaugccuggaaugu

SEQ ID NO: 4187625 - RNA, 62 nt, Human
acaguccuugauccaauagugggagaaagaaguaucuuccauuauaaaauucagggaucugu

SEQ ID NO: 4187626 - RNA, 61 nt, Human
acagucugcaggcaaguucuacacuccugccucuuauggcccugagcuuccugagacaugu

SEQ ID NO: 4187627 - RNA, 76 nt, Human
accucacuaaaauuucguaucugauacaacagaauaacauuugcagaauguaauauuguagugacaguacugaggu

SEQ ID NO: 4187628 - RNA, 93 nt, Human
accucacuuuuagaaguauuucaaggcuauuaauauaaaugcuuuuuaaagguugcaucuauuagcucugaaaauuucauugacuugugaggu

SEQ ID NO: 4187629 - RNA, 69 nt, Human
accucaggauguggacacagaaauccuuggccuuuuuguugugcccugaugucccaagcauucgcaggu

SEQ ID NO: 4187630 - RNA, 83 nt, Human
accucaggggaccaaaauguccugccuacaaggcuuaugguauuaaggccacaaggggaggaauuuuggucuguuuuaucggu

SEQ ID NO: 4187631 - RNA, 63 nt, Human
accucauggggcugaaguuacuuugccaagacuuuucuguaauugacucagcucuguucaggu

SEQ ID NO: 4187632 - RNA, 79 nt, Human
accuccauguggcucaguuaacuuccauguagcugccugguuauaaauugaggauaacugugguauuccacucgggggu

SEQ ID NO: 4187633 - RNA, 95 nt, Human
accucccaaaaggcaagagguggccaugggcgcuggaacugggacacagcccccgccuccgcccugcccuggcuacacucaccugccaaggaggu

SEQ ID NO: 4187634 - RNA, 91 nt, Human
accucccaaauuauuuauccucuuggucuauaaaccaaggucucaaucucagaugguccagggaggaggugaauauuucugcugaggaggu

SEQ ID NO: 4187635 - RNA, 81 nt, Human
accucccaagccuuguccccagcagguugguuuuguuuucuugaagcuugucugaaggagauaagucugcaccugggaggu

SEQ ID NO: 4187636 - RNA, 62 nt, Human
accucccagcacgucugcuguuucuguuagucacauagaggaacggggauggugugggaggu

SEQ ID NO: 4187637 - RNA, 59 nt, Human
accucccaguauuucagcgguguuguuuacaagggugucccgguggcuugcagggaggu

SEQ ID NO: 4187638 - RNA, 55 nt, Human
accuccggggccugaugaauuuccaaauucagaacauuugggacuuugggaaggu

SEQ ID NO: 4187639 - RNA, 61 nt, Human
accuccuggugcccaaguguuugaggugagaaaaacugaaacaugaaaagcccagagaggu

SEQ ID NO: 4187640 - RNA, 57 nt, Human
accuccuucuuucuguugugaucagcauuuguugcaucuagaggcaaugaaggaggu

SEQ ID NO: 4187641 - RNA, 77 nt, Human
accucuccaguuuucuuuucuuuucuguggaggagaauauucucugguaacucagaagaaaggaaugaagaugaggu

SEQ ID NO: 4187642 - RNA, 113 nt, Human
accucucccuucuacuugaauccacaaugaccugggaggcuacaguuuugccguacaucaggcacacaauuccaagagcuuccuaagugauucaguggggggaguuaucaggu

SEQ ID NO: 4187643 - RNA, 97 nt, Human
accucucuacugaucacugaagaaccuauagcaugagugagaaauaaaccuuauuguuucaaaccacugagguucugagguuguuuguuagguaggu

SEQ ID NO: 4187644 - RNA, 77 nt, Human
accugaauugcacaucuaauaaugcuagauaaagacugucucaagcuuguugguauguuuacacugcuugauuaggu

SEQ ID NO: 4187645 - RNA, 57 nt, Human
accugaauuuuggaugagcuguccaagcagacaguauguaauaucuagaguugaggu

SEQ ID NO: 4187646 - RNA, 60 nt, Human
accugagaauuuucuaguaguuucauccauuuuggaagauaacuaauuaaauuccugggu

SEQ ID NO: 4187647 - RNA, 59 nt, Human
accugagcucugcacuuuuuagagccaguuucuaaggccugcaaagaguuuggacaggu

SEQ ID NO: 4187648 - RNA, 57 nt, Human
accugagggaaggcagucaguugguuugugucuaucguggccugccaucccuucggu

SEQ ID NO: 4187649 - RNA, 77 nt, Human
accugaugugggccagcuuuucuccugggugugugacugaauccuucuucccagagcaugugcugccuuuguuaggu

SEQ ID NO: 4187650 - RNA, 56 nt, Human
accugauuacuugucuucccagguggucucugggcucuaucaggaacaagccaggu

SEQ ID NO: 4187651 - RNA, 76 nt, Human
accugcccucauggcacuuagugucucaaaaguaauuuugccaauuacauuugggaugagugucaugaggaagggu

SEQ ID NO: 4187652 - RNA, 99 nt, Human
accugcuauggcucuguuggcaucccugggcgggucuccaagcuuguggucgcaugccugcccuggagauuggccuggcuugccaacaggaaggcaggu

SEQ ID NO: 4187653 - RNA, 69 nt, Human
accugcugcuuugacagugggaacaguggaaacauccuuugcuccaggcuaucagaaagggcaucaggu

SEQ ID NO: 4187654 - RNA, 57 nt, Human
accugcugucuugggggaaugcgccuccugaaaaaagccauuuccacggacggaggu

SEQ ID NO: 4187655 - RNA, 86 nt, Human
accuggaggauauuguuaaaaugcagaaauaauugaggaacucuggauggggccuaagauucugcauuucuaauaaguucccaggu

SEQ ID NO: 4187656 - RNA, 110 nt, Human
accuggcaccagcuggauguccugucaaugcuugcugacucccugucugaauccaugggcaaaugaguggguguguuguauggcgucccaaagcacuagugugccuaggu

SEQ ID NO: 4187657 - RNA, 73 nt, Human
accuggccucgcugcaggaacagguggcugugcucaccagacagaaccaggaacugauggagaagguccaggu

SEQ ID NO: 4187658 - RNA, 66 nt, Human
accuggcuggccaugcagcgccagcuguggguacauaccuaggcgcugggcaaggccaguagaggu

SEQ ID NO: 4187659 - RNA, 85 nt, Human
accugggcaucaguuaaaaugcagauucuuauucuguaggucugaguggggccucagagucugcauuucugucagccucccaggu

SEQ ID NO: 4187660 - RNA, 101 nt, Human
accugggguggcauuuggaaaguacagauuccuggccagguucugacucagaaaguuugguagauugcccagaaaucuguauaccuuuaaaguccccaggu

SEQ ID NO: 4187661 - RNA, 129 nt, Human
accuggguacacccuucagaagugggcaccugccucuaagcagcagguggggucagagggaaagucaguucucaaagguuguugagagugcaggguucuagccucacuucucagggauugcuuguuggu

SEQ ID NO: 4187662 - RNA, 70 nt, Human
accugguagcuugcaguuccugcuccaugcucugcccugggcaaugagcuguggaaggcagggaccaggu

SEQ ID NO: 4187663 - RNA, 87 nt, Human
acuccaaaggccaguggccagcuggaugugggugacgggaagacucucacucagguuucuagcuugggaaacuuggcgagugguggu

SEQ ID NO: 4187664 - RNA, 56 nt, Human
acuccagcucugugcagcagggggacugguguuuauucccuguuacacacuggggu

SEQ ID NO: 4187665 - RNA, 122 nt, Human
acuccauccaaaaaugcugauuucacugacauaaauguugagucuagaugauccuaggaauauaucaauauauucccuccaggguaucuaugcucauuuaggggugacaguguauauggagu

SEQ ID NO: 4187666 - RNA, 56 nt, Human
acuccaucugcuccugaagccauguagaaugucggucuugcaggaguggguagagu

SEQ ID NO: 4187667 - RNA, 86 nt, Human
acuccauggguuagcuugagugguuccucaguugacuguuuuuacaauuacacagggaucacuuuuuaaaacuaaacugugagagu

SEQ ID NO: 4187668 - RNA, 60 nt, Human
acucccacuccuggcucaccacagaggacgaguugcugguaucaucagggguggcggagu

SEQ ID NO: 4187669 - RNA, 71 nt, Human
acucccagcaucccagugggcagcagguagggaccugcugccaugcugcccccaacagggaaguugugagu

SEQ ID NO: 4187670 - RNA, 55 nt, Human
acuccccaaaacuaaccaugcauauuggcaaagugugguuuaacuuuuggugggu

SEQ ID NO: 4187671 - RNA, 89 nt, Human
acuccccaaacaguaaacagcagugauucauuagcauaagggcguagaaaaacagaacugugugaauggauuauucuauugcugggagu

SEQ ID NO: 4187672 - RNA, 63 nt, Human
acucccugaaaucuccucuuuauauaucucagcguuuuaugcuuuugaugugaggaagggggu

SEQ ID NO: 4187673 - RNA, 74 nt, Human
acucccugcaggguugccaugccaaaaccaacaacuccacggugaacauggcuggucacaccacugcagggugu

SEQ ID NO: 4187674 - RNA, 57 nt, Human
acucccuggcaggucuuuaucugacaucguuuggaaauggugaucugccaguggagu

SEQ ID NO: 4187675 - RNA, 62 nt, Human
acucccuugugaacucauucuuggugcaucucuagcuuccauacacugugggcacagggagu

SEQ ID NO: 4187676 - RNA, 129 nt, Human
acuccucaguccgacacaggcccuuggaccauggugggugugguaguguguggccuguggucacuucuuggcuggccucuucugcucauacuuucacuggucuggguucuugugcugcuaguaucgagu

SEQ ID NO: 4187677 - RNA, 66 nt, Human
acuccucccucacuacggccuagcaggguggggaccccaaugcagggcaguggagguugagugagu

SEQ ID NO: 4187678 - RNA, 130 nt, Human
acuccuggguucuaucugaagucaaauaccaaggagaaggugcaagcuucgccuucuggaauaaauucagugaacugccaagcuuccauucucucuccuugguacuugacuucagacaggacccgggagu

SEQ ID NO: 4187679 - RNA, 59 nt, Human
acuccugugggcauggcacccccuggaguugugcaagguggcaacccugcccauggagu

SEQ ID NO: 4187680 - RNA, 64 nt, Human
acuccuguuguuugcuaguguacucucauuaagcaaugaggguauaaagagcaagcagaagagu

SEQ ID NO: 4187681 - RNA, 57 nt, Human
acuccuucaagauugcuguugacaaguuaaguuuuaaacaguucucuuugaaggugu

SEQ ID NO: 4187682 - RNA, 124 nt, Human
acuccuuggugcacuguuucuacuuugggugcugaucuggagugguugcuauguuuugugcucgccuguccuccaggugcagaaggacucaggguggaauuugaccggcagugcuccucagagu

SEQ ID NO: 4187683 - RNA, 88 nt, Human
acucuaauaccugacaauagcuccauggagaauucacagccagcaaaccucuacuguguugucuucagcuguagucauuguucacagu

SEQ ID NO: 4187684 - RNA, 124 nt, Human
acucuaccauuuuugcugcaucuacuagaaaaugucuauggaauuuccacacaaccauaagggauggguugaaauuccagagaagaaacauagcuaauacauacagaucccuucuuggcagagu

SEQ ID NO: 4187685 - RNA, 65 nt, Human
acucuacugcuggacagugaaugagucuuuguauuccagguucauucacugcccagcaguguagu

SEQ ID NO: 4187686 - RNA, 101 nt, Human
acucuaggauggagaauaaagagucuuagugccagguuuucaguuccugauuccaaaucaccugaaacucaacuuuaucuccugcccccuauccuaugagu

SEQ ID NO: 4187687 - RNA, 81 nt, Human
acucuauguguuuccuguggcugccauaacaaauaccacaaacuggguggcucaaguaacaaaaauauaucaucucagagu

SEQ ID NO: 4187688 - RNA, 130 nt, Human
acucuauuauuuguaucucugaagaauauugauuguugcauguuaauuuuaaauccuggcaccuuacugaauuuuguuaauagugaaggcagcaugcacacuagugaauugaaugcaauguuaccuggau

SEQ ID NO: 4187689 - RNA, 77 nt, Human
acucuccuucuuggcacaagcuguaauagcuucuacauucgguagcaaauggcuuuugaugcuaagccaaggaaagu

SEQ ID NO: 4187690 - RNA, 58 nt, Human
acucucuguaugaaucauauggagugaaaauugcuacucagugaagcaaacagauagu

SEQ ID NO: 4187691 - RNA, 85 nt, Human
acucugaggagguggcauguggggcauggccuaaaauuguuggggcuacaguuuaggcaggcuccuaugguagaccuuggauggu

SEQ ID NO: 4187692 - RNA, 64 nt, Human
acucugagggguauguuccuauguaaauccccauacaucaagauaaaaauauacuucucagugu

SEQ ID NO: 4187693 - RNA, 83 nt, Human
acucugcaucagcuucuguccuagaaacugggcuuacauccaugaacaaggccguuuuugcucacacgaagcuucaucauugu

SEQ ID NO: 4187694 - RNA, 56 nt, Human
acucugcauucacaauaucuuggcccauuagcagcuaggacuuguuugggcagagu

SEQ ID NO: 4187695 - RNA, 60 nt, Human
acucugcgaggccagagagacguguugcaauuuacaaugugcuuugcucguucccagagu

SEQ ID NO: 4187696 - RNA, 65 nt, Human
acucuggcacuggguaccucagggagcaugcaauauuguuuucuggagguacucaggcacagagu

SEQ ID NO: 4187697 - RNA, 55 nt, Human
acucuggcuauucacuauaauacugcuucuuaucagacaugugcguggccggagu

SEQ ID NO: 4187698 - RNA, 123 nt, Human
acucuguaagguucagcaggaauacaaaacaagggaagaaucacugggauguuuaucuuaacugagaaauaauauuuuguuccuuccacaugauuuguuaagauuguaucugcccuuaaaugu

SEQ ID NO: 4187699 - RNA, 60 nt, Human
acugggaagauggaggcaagcaguggguagaaaauggugacuuucccccauguuccuggu

SEQ ID NO: 4187700 - RNA, 107 nt, Human
acugggacacugcggcgagcaggggcauggagcagcagaaggggcuuggucaccguucauggcucugugucuguggcuccgguggucucagauuccgagugcccggu

SEQ ID NO: 4187701 - RNA, 56 nt, Human
acugggauuuaauuagugaauugccuccuucagugcaguucucuuagauuuccagu

SEQ ID NO: 4187702 - RNA, 119 nt, Human
acuggggggugcacauguggcaccugcaaugcaggguuccuccaguuccuagagccauaaacaccugagcuauuaggaagguggaggcauucaggaccaaacauuuccuccaccccagu

SEQ ID NO: 4187703 - RNA, 85 nt, Human
acuggggucuucuuggcuuaccgcuucugauauggaaccaucaccccacaagcuguggugggacaagagugaucagggcccuagu

SEQ ID NO: 4187704 - RNA, 119 nt, Human
acugggucuuacgaaagacaauaauagauuucauaagugacaauccugggccuaaaugucucagagauuuugggaauaauugcacagauuucucaccuuguuguuuuucucuuccuagu

SEQ ID NO: 4187705 - RNA, 65 nt, Human
acugguaacaauggaagcuucuauggauaucaugucucuacucaaaagagucuauugauaucagu

SEQ ID NO: 4187706 - RNA, 74 nt, Human
acugguccagacgucuuagauucucuaggggcggccagccuggccucuacccaggagacugagcuguaaccagu

SEQ ID NO: 4187707 - RNA, 60 nt, Human
acugguucaucgcggccacuuaugaaucagcuggcucugccugucaugccgcgaaccagu

SEQ ID NO: 4187708 - RNA, 102 nt, Human
acugguugcuuugaggaggagcugcuuugauaugcaaggaacugucuuguuuagcaaguuguuaaugccuacauauuaagcaucuuucuuuuuuuuuccagu

SEQ ID NO: 4187709 - RNA, 74 nt, Human
acuguacauccugguuucagacuuuguugugaacacagauuucauuucaaguucugacagcuaguaaacucagu

SEQ ID NO: 4187710 - RNA, 70 nt, Human
acuguaggccuagcuacuugggaagcugagguggaagcaucucuugaauccaagaguucaaggcuacagu

SEQ ID NO: 4187711 - RNA, 69 nt, Human
acugucucccaguaagccugagaaacaccaccuccccagcuuggacggucacaggcauauugguguagu

SEQ ID NO: 4187712 - RNA, 121 nt, Human
acugucucgggcccaaauucagagcuuccuuccugaaccguggcuggccucucuguuccucugcugguucagcuguccagcccuuguucaccuucuggaaaaaggaaugugucugcgaagu

SEQ ID NO: 4187713 - RNA, 60 nt, Human
acugucuguagacauuuuugguugucacaacugggugggaggcaaggugcuacagacagu

SEQ ID NO: 4187714 - RNA, 56 nt, Human
acugucugugccagaugcugggcuggcucaugugcaaaguucuugcaaagacuagu

SEQ ID NO: 4187715 - RNA, 65 nt, Human
acugucuuucaucuuucaugcaggguaaaagaagacaccuuggcuacagcaagaggaaagaaggu

SEQ ID NO: 4187716 - RNA, 65 nt, Human
acugugagagggguguccuugcuuuguuauuauuaauggcagcaguagccaccccagcuuacugu

SEQ ID NO: 4187717 - RNA, 59 nt, Human
acugugauguucucuaucuuggcuccuuccagaagaagaagaagagaaguuaucucagu

SEQ ID NO: 4187718 - RNA, 68 nt, Human
acugugcaucauguuuguauaggacaguucagguuuauaucaauugucuuggugcaaucaugaauagu

SEQ ID NO: 4187719 - RNA, 81 nt, Human
acuguggcugguacugugggccuuuccuuugacccugccauggaagcaaggucaaguauuuuggccccagcagugagcggu

SEQ ID NO: 4187720 - RNA, 77 nt, Human
acuguguaagaaggaaaggccucagcagaaaccagucucuugaucucuaggucucuguagucuuuccuccucacagu

SEQ ID NO: 4187721 - RNA, 78 nt, Human
acccacagacauuuagaagucuaauggccagaacgaaauaaccgagguugguuuucggggcuguugaguguugugggu

SEQ ID NO: 4187722 - RNA, 64 nt, Human
acccacauuuugggguggcagaaagcucauugagaaagaaagcagcugucccuuaacaucaggu

SEQ ID NO: 4187723 - RNA, 61 nt, Human
acccaccacaguggcuggcacauaguagaugcucaauugaugauggucauguuauuugggu

SEQ ID NO: 4187724 - RNA, 81 nt, Human
acccacucucaggagacugaacuuuugcaccacugagagucauaagaaugggcucagaagauaguuuccaaagaggagggu

SEQ ID NO: 4187725 - RNA, 68 nt, Human
acccacucuggcucccuucuaguuugagcaaaggcccugguucuuauugaaggaguaccagagugggu

SEQ ID NO: 4187726 - RNA, 92 nt, Human
acccagacaucuuuucuagaaaccaagauauuguuugcuuccuugaauugucuuuagaagugcagaauuuaggaauuaggaaagugaugggu

SEQ ID NO: 4187727 - RNA, 75 nt, Human
acccagcauuugggcauuuuauuucuucggauuccagaucaucagaaguuaugucaauggucaugcuggcugggu

SEQ ID NO: 4187728 - RNA, 70 nt, Human
acccagccugcccuggaagcccagccugcaccccaccugcggguuuuagacugacccagggcugcugggu

SEQ ID NO: 4187729 - RNA, 60 nt, Human
acccaggacacagagaugacccaugagucaaagaucaagagaucaucuacugguccaggu

SEQ ID NO: 4187730 - RNA, 59 nt, Human
acccaggaggcggagguugcagugagccgagaucgcgccacugcacuccagcucugggu

SEQ ID NO: 4187731 - RNA, 59 nt, Human
acccaggcgggagugcagugucaugaucucggcucaccugcaaccucugccucccgggu

SEQ ID NO: 4187732 - RNA, 58 nt, Human
acccaggcuagggugcaguggcacgaucuuggcucacugcagccuccgccugccgggu

SEQ ID NO: 4187733 - RNA, 58 nt, Human
acccaggcuggagugcagugaugccaucucggcucacugcaacuccugucucccgggu

SEQ ID NO: 4187734 - RNA, 58 nt, Human
acccaggcuggagugcagugaugggaucucggcucacugcaagcuccgccucccgggu

SEQ ID NO: 4187735 - RNA, 59 nt, Human
acccaggcuggagugcaguggcgccaucuccggcucacugcaagcuccaccucccgggu

SEQ ID NO: 4187736 - RNA, 58 nt, Human
acccaggcuggagugcaguggcguguucucagcucacugcaaccuccgccucccgggu

SEQ ID NO: 4187737 - RNA, 58 nt, Human
acccaggcuggagugcaguggggccaucucggcucacugcaagcuccgccucccgggu

SEQ ID NO: 4187738 - RNA, 58 nt, Human
acccaggcuggagugcaguggguccaucucggcucacugcaagcuccgccucccgggu

SEQ ID NO: 4187739 - RNA, 58 nt, Human
acccaggcuggagugcagugucuugaucucagcucacugcaaccucugccucccgggu

SEQ ID NO: 4187740 - RNA, 58 nt, Human
acccaggcuggcgugcaguggcaugaucuuggcgcacugcaaccuccgccuccugggu

SEQ ID NO: 4187741 - RNA, 62 nt, Human
acccaguggugggugugucaguagggucuuggcaaggaucagauggaacacucaaacugggu

SEQ ID NO: 4187742 - RNA, 63 nt, Human
acccaugaguguaucuuuaaaaaacucuugaacuuauuuaagagaggaagcauuacauggugu

SEQ ID NO: 4187743 - RNA, 63 nt, Human
accccaugguuaaccaagccugagaagagagcccaguuuuuaaggauggaaaggacuaggggu

SEQ ID NO: 4187744 - RNA, 86 nt, Human
acccccaacccuaagacagucugucaagccagcuuucaaguaucagagaaagcugcagauucuaucuagaaggugaaaugggaggu

SEQ ID NO: 4187745 - RNA, 57 nt, Human
acccccaacucuuacacugccaaggcaacuuccuggcagccaucugagggugggggu

SEQ ID NO: 4187746 - RNA, 66 nt, Human
acccccacauuuuugagucuucauccuuuauguuaaacauuggggugaagaauaaggagugggggu

SEQ ID NO: 4187747 - RNA, 70 nt, Human
acccccagcacagccuaggcugggacugccacccacugcgcacuccagaggcagcugugcugaguugggu

SEQ ID NO: 4187748 - RNA, 108 nt, Human
acccccucaggucccguugccuccugguccuuucagggauuccugguccuuccuucccacacuagccucccugggguaucgcugaggcagccuggccugcacccaggu

SEQ ID NO: 4187749 - RNA, 73 nt, Human
accccgacccuacagacagugcugagcugccucugaagaccuggggcuuggcuuugggaaguaggggggaggu

SEQ ID NO: 4187750 - RNA, 78 nt, Human
acccuaaaauuauaccaaaaaauuaaugugauuaggaugauaauucacagucacauaguguuuuggaaucuuuguggu

SEQ ID NO: 4187751 - RNA, 81 nt, Human
acccuaagguauuauugucaugaaauaauauuucucuaguacuugggcuauauuaacauuuuaugaaaauaaacuuggggu

SEQ ID NO: 4187752 - RNA, 78 nt, Human
acccuaugccuauuuugcucacuucccuauucuggugcuuugguugguccuuugagcaagauccccggggcuaagggu

SEQ ID NO: 4187753 - RNA, 73 nt, Human
acccuccuacacucacugaaaugucuucagccccuaaccucuagaagagcugaggacaucauggaaggaaggu

SEQ ID NO: 4187754 - RNA, 61 nt, Human
acccuccuggugacaaggcaaagccacacccuugagcuuuguuugaucauacaggcagugu

SEQ ID NO: 4187755 - RNA, 59 nt, Human
acccuccuuagcaggcagaaaggagaaaggguuuucuucuuuucauggcuugggaaggu

SEQ ID NO: 4187756 - RNA, 57 nt, Human
acccugagaugccacagcaugacuugaaggugacccagacugaccacaucucggggu

SEQ ID NO: 4187757 - RNA, 67 nt, Human
acccugauauagguccaagagcaaugagguaggucucugaaacucaagguucuuucuauucaugggu

SEQ ID NO: 4187758 - RNA, 56 nt, Human
acccuggacaucuugucauagcagacaacaaagacgcuauuacaggcuacuagggu

SEQ ID NO: 4187759 - RNA, 58 nt, Human
acccuggcaggcucucuggucgguuuccagcaaaguaaacggacucgguuugcugggu

SEQ ID NO: 4187760 - RNA, 69 nt, Human
acccugggcuugguagcagagacuccguuggguagcccuuaugaagucuauuuaccuaagcuucggagu

SEQ ID NO: 4187761 - RNA, 126 nt, Human
acccuuccuucugggucuuuguuucgaguauuauucucuggaggaaagauucugagauagagauaaccaggcaggauauuuucgcagggagaauucuuaggauaagcaucugagaaagggaggugu

SEQ ID NO: 4187762 - RNA, 58 nt, Human
acccuuugacaacaaggauccugccuggccccaaaggccacagcuugucuguuagggu

SEQ ID NO: 4187763 - RNA, 105 nt, Human
accgagaauauagaaagcugccuuugacuuacagugaaaggcccauuuggugaauaagaaaccuucaacuaacuuuucauaagggcaaauuuauauguucuuagu

SEQ ID NO: 4187764 - RNA, 72 nt, Human
accgaggaguaaaugguuuuuuauaugcugccaaguuuacuuuggcaauguaaauugaacuagaacuagggu

SEQ ID NO: 4187765 - RNA, 82 nt, Human
accgaggauguuuagcuuuugagaaugauuucuguacaaaaugguuaaaagaaaacaaagcaauaagucaaaacauuuuggu

SEQ ID NO: 4187766 - RNA, 58 nt, Human
accgcccugccgccugcauaugggaugaguccucucaaauagcagaagcagagggggu

SEQ ID NO: 4187767 - RNA, 83 nt, Human
accgggcugugcggaccaaaugcuuuuuaauugaaaauuuuuuuaauucaaaaaggauuugcuguuuguucgcaagugcaggu

SEQ ID NO: 4187768 - RNA, 87 nt, Human
accgucugccuggcagcuggggccacacuuaggcagcugccccagcaugcacuaaaauuagguggcccauuagacccaggacauggu

SEQ ID NO: 4187769 - RNA, 61 nt, Human
accgugguugccaaaacagggcucuggguguaccaagcucagagcugguagguagguaggu

SEQ ID NO: 4187770 - RNA, 79 nt, Human
accuaaaaucuucucucugcugcuccagcagcaccaaccugcucuccccaguggcacagcagagagcagaccuuugugu

SEQ ID NO: 4187771 - RNA, 97 nt, Human
accuaaacuauucaggauuuuccauugaucuugugauaguucaacuuuuucuagguguguaucuucacgagauggauggacauccaaauaauaaggu

SEQ ID NO: 4187772 - RNA, 56 nt, Human
accuaaccaucauugugcugguauuaggaggugagaccagugggaagugauuaggu

SEQ ID NO: 4187773 - RNA, 77 nt, Human
accuaauugggcaggcuggcagacugcuguucaaagacagaugaauuacagcagcuaucauuuugucccuuuuaggu

SEQ ID NO: 4187774 - RNA, 76 nt, Human
accuacagcuuuugaaaaauuacuggcagcuuuucuuucaucacagccaguucuuucagcagaguugagucagggu

SEQ ID NO: 4187775 - RNA, 66 nt, Human
acuuuucugggcaucuccaugauauccucauucagagauugagacaauucagagguacagaaaagu

SEQ ID NO: 4187776 - RNA, 68 nt, Human
acuuuugaacaaacuccucugucuuggauacauuuuucuuaaaaccaagcaguuguaaauucagaagu

SEQ ID NO: 4187777 - RNA, 67 nt, Human
acuuuuggcagacugacaaucuguuuuaccaaaucuauguaaugcauuuugaaggucuguuuagagu

SEQ ID NO: 4187778 - RNA, 64 nt, Human
acuuuugguucuguaacugugauucuuuacugcagucuucuacagcuuuuacagaauuaauggu

SEQ ID NO: 4187779 - RNA, 57 nt, Human
acuuuuuacaggguguauaccaccugcuggaagaugaggagguagccaccaagaagu

SEQ ID NO: 4187780 - RNA, 83 nt, Human
acuuuuucugggauauacagguguucgcucaguuagacacaugcgugaguucauuugagugaacacuuccugagagcuuaagu

SEQ ID NO: 4187781 - RNA, 129 nt, Human
acuuuuuuuuuuuuucccgagauggaguuucgcucuuguugccaggcuggagugcaauggugcaaucuuggcucacugcacuccagccugggugacaaaguaagacuccaucucaaaaaaaaaaaaggu

SEQ ID NO: 4187782 - RNA, 76 nt, Human
agaaaaacagugaagauuuauaaggaccuuauuaguauagugagauuaaccuuuggaucucuuacucuguuuuucu

SEQ ID NO: 4187783 - RNA, 74 nt, Human
agaaaaagaggaaauugacccaauaucuugugaugaggaaagucauuagauaauuaugucaauuucuugcuucu

SEQ ID NO: 4187784 - RNA, 72 nt, Human
agaaaaauaugucugcagaaaccugcagcauuagaaaaccuauucuuugcugcagauugcagauuaacuucu

SEQ ID NO: 4187785 - RNA, 66 nt, Human
agaaaaaugcugggaaaguuggaauuccagauuaggaacaaguucacaugcucucaugcuuuuucu

SEQ ID NO: 4187786 - RNA, 75 nt, Human
agaaaaauuuuugagguauugauaaaacauuuauguuuaugcaugggugcauguguguauacucaaaaacuuucu

SEQ ID NO: 4187787 - RNA, 83 nt, Human
agaaaagagagaccuggagccagaagagccaguucaaguuccaccuuggccacuacuuacuuggcuucauucccuuguuuucu

SEQ ID NO: 4187788 - RNA, 56 nt, Human
agaaaagaggcugugauccuuucuauagugaugaggaagagagagugccucuuucu

SEQ ID NO: 4187789 - RNA, 58 nt, Human
agaaaagaggcuuucuaagcauuccuuccucugcaggauauuugggauccucuuuucu

SEQ ID NO: 4187790 - RNA, 71 nt, Human
agaaaagguugaaaguaggauuauugccuuacccacagucuagcuugugucuuuccuuucacacuuuuucu

SEQ ID NO: 4187791 - RNA, 77 nt, Human
agaaaauagccuggagcugucgacccaccgaggcaaggaggacuguuuccagaggggagguggcagcccaggugucu

SEQ ID NO: 4187792 - RNA, 67 nt, Human
agaaaauauuugaaugguguaagaugguggaaggaaagccaucccacaccccuacaacauauguucu

SEQ ID NO: 4187793 - RNA, 129 nt, Human
agaaaaucaucuuauuuucauaacacuaaauguaucauguuugucuuugugugagggcaauuagcaaaacuagugcaacuucacguagaguacaauuauauggaacauuugaaaauaaugucucuuucu

SEQ ID NO: 4187794 - RNA, 64 nt, Human
agaaaauguguguguguuuguguauguguguguacaugugugcauaaacagauacuucaugucu

SEQ ID NO: 4187795 - RNA, 121 nt, Human
agaaaauuuuaaauaacauugcauuuacuuuuauaugcuuugaugguugucaccaaguauaguacagcuguuacucugaguaaauggcaaaguaaauuaguaauauuuauugaaacuuuuu

SEQ ID NO: 4187796 - RNA, 125 nt, Human
agaaacaccaagaaaaugcuacgauauauuacaguucgaguuucuaggcacugugaugacauuaucuguaagcucuggcauuuggaccacugugauacuauaggguaguguugagaauaacgucu

SEQ ID NO: 4187797 - RNA, 58 nt, Human
agaaacacugggguaggcccuggagagcaguacucuuaacaagcuccucagugcuucu

SEQ ID NO: 4187798 - RNA, 64 nt, Human
agaaaccacaguacccaggaaaauuuaauuuauuuuauggcauuuuccaaaggacuggguuucu

SEQ ID NO: 4187799 - RNA, 67 nt, Human
agaaaccguggucuccucuccucgaucccguucacagccauugaucuccagaggagucauggucucu

SEQ ID NO: 4187800 - RNA, 61 nt, Human
agaaacuucucuagcaugugauaagcauaccagucugcucaacauguacagacagguuucu

SEQ ID NO: 4187801 - RNA, 62 nt, Human
agaaagaacgcacuugugcugcagaaaccuugaaacaaucaaaggcacaaaugccucuuuuu

SEQ ID NO: 4187802 - RNA, 83 nt, Human
agaaagaucugaauucaaagacuagaauuuugccaccuugacuggguucuguaaagaaguuuuugaaugcaugggaccuuuuu

SEQ ID NO: 4187803 - RNA, 67 nt, Human
agaaagauuaaaggggagacaagcucaguuauuugagucuuuccagcugccccaauuucauccuucu

SEQ ID NO: 4187804 - RNA, 64 nt, Human
agaaagauuuagcaggaugauuaguccuacagaaaauccucaccuagcauucuguaaucuuucu

SEQ ID NO: 4187805 - RNA, 65 nt, Human
agaaagccaugggucuuuggcauauuuaucuuaugauuagcuauguuucuggacucauuauuucu

SEQ ID NO: 4187806 - RNA, 59 nt, Human
agaaagcccaguguaaauggaacucaacuuuaauuugagcagagaugacugggcauuuu

SEQ ID NO: 4187807 - RNA, 107 nt, Human
agaaagcuguccuauuauaaaucuuugcauacaugagaaugucuuuguuauuuuaacaugcaaaagacaauuuugaguaugcacacaauuugagggccacaauuucu

SEQ ID NO: 4187808 - RNA, 76 nt, Human
agaaaggacaucucccuuuaaggcuuaguaggagaaaauaccuguuuucuguucuauagagaguugugucuuuucu

SEQ ID NO: 4187809 - RNA, 64 nt, Human
agaaaggagaaggguuucccaccaaagccgggccaucugugcugccagaauccuucucuguucu

SEQ ID NO: 4187810 - RNA, 61 nt, Human
agaaaggauauggcaggaucuguuguucauuuguguuuauuagaaugcuauugucuuuucu

SEQ ID NO: 4187811 - RNA, 64 nt, Human
agaauggaggcaucugcaaauaaggagggacuucccaagacaccaauugcagguaccucuaucu

SEQ ID NO: 4187812 - RNA, 130 nt, Human
agaaugugaguuuucuuguuuuaaaucagcacuuuguguguuugauguauugcauagauuuaguauaaauauguguacucguuaaauauuuauuaaaauguaaaggauuaugaaucaauacccauauugu

SEQ ID NO: 4187813 - RNA, 79 nt, Human
agaaugugcauuugaguuaggguauauauuugcaaucgauucccauucaaaguuugucacuuggcuagaauuacauuuu

SEQ ID NO: 4187814 - RNA, 74 nt, Human
agaauguucaaauccaucaaaucuucuagaacuuuacacacagguacugaaagagugguggacucuggcauuuu

SEQ ID NO: 4187815 - RNA, 107 nt, Human
agaauuagauuaagcuauguguuaugggagaaaugagugauucacuuuucaucaaaugaagaaaucauaucauuucuugguucaaaacauucagugauucccauucu

SEQ ID NO: 4187816 - RNA, 76 nt, Human
agaauugccagccuauucaucugaucuugaaaguguacaaacuuaccuucaaacaguguagaauauaugcaauucu

SEQ ID NO: 4187817 - RNA, 84 nt, Human
agaauugcuugaacacaggaggcggagguugcagugaacugagauugcaccacuacacuccagccugggugacaaagugagacu

SEQ ID NO: 4187818 - RNA, 57 nt, Human
agaauugggaguguccugauaucccgauaucuugagaacagaagcauuccuaauuuu

SEQ ID NO: 4187819 - RNA, 107 nt, Human
agaauuguuauuggucuuuugccagucuaauguuuguaaaaucauaacucauuguuggauuaguuguucacacguuccugacugguagagauuuuaagccuuuuucu

SEQ ID NO: 4187820 - RNA, 57 nt, Human
agaauuguucuguagcuuggcugagacacaaucacacucugggcuggagaacauucu

SEQ ID NO: 4187821 - RNA, 79 nt, Human
agaauuugaauggauauaacaacaguguagacugacuuggguugcgagcacugagcauuguuauuuccagcaagucucu

SEQ ID NO: 4187822 - RNA, 56 nt, Human
agaauuugagugcuuucugugugcugaguacacagaaguuaaagaauuuaaaaucu

SEQ ID NO: 4187823 - RNA, 76 nt, Human
agacaaaaggaacaaaggccguuaauaaccaccuugucuaguagguggugaaaauagccuuugaaccauuuuaucu

SEQ ID NO: 4187824 - RNA, 72 nt, Human
agacaacagaacuccugggauuuuucuuuaaccauuuuuuaucauggaaacauuuccggccuuuuguucucu

SEQ ID NO: 4187825 - RNA, 69 nt, Human
agacaagagaggcaacauggggaacagauaugggugugucagcauuuuacaugugucaucugcaggucu

SEQ ID NO: 4187826 - RNA, 61 nt, Human
agacaagagaugcuuuacaucggauggcgguucugcugauccauaggacauuucauuguuu

SEQ ID NO: 4187827 - RNA, 64 nt, Human
agacaauaacacaaaagaauaugugugucuaacuucaggaaacauuguucuuuguguuaaugcu

SEQ ID NO: 4187828 - RNA, 74 nt, Human
agacacagacacauuagugcucugucucauauuuuuuuccaugguuugugaauacacaaauguguuuagugucu

SEQ ID NO: 4187829 - RNA, 57 nt, Human
agacacagguguaauuucugcuuaguuguuucaugauguagcucagugucugugucu

SEQ ID NO: 4187830 - RNA, 56 nt, Human
agacacaucuuagguugucagguggcagggaguugguugacagguuuuauguguuu

SEQ ID NO: 4187831 - RNA, 88 nt, Human
agacacucagugcagugguaggagccugagucacagugccuggguucacauccagcaccaucggguucuugcuuugggaugggugucu

SEQ ID NO: 4187832 - RNA, 59 nt, Human
agacacugaauguuugguggucuuuuugugauacuagcaaccacugacggucauugucu

SEQ ID NO: 4187833 - RNA, 75 nt, Human
agacacuguaaauugagugcgugaagcugugagaauaaacccaucucauuagucauugugucaauuauaguaucu

SEQ ID NO: 4187834 - RNA, 59 nt, Human
agacacuuggaaggcuggccugagcucuccgagaggcgguggucagcaguuuagggucu

SEQ ID NO: 4187835 - RNA, 56 nt, Human
agacacuuggcagagagcuguuggagcaggccagcggugagaucauucgcgugucu

SEQ ID NO: 4187836 - RNA, 76 nt, Human
agacagaaccccgaccucagagaagauggaugagguaccaccgugucuguccaucugucugggacugguuuugucu

SEQ ID NO: 4187837 - RNA, 89 nt, Human
agacagaagaaugugcaaaggcuaguggauucauugauuccagaacuucacuggaacacacugucuuaugccauuuaccucauuugucu

SEQ ID NO: 4187838 - RNA, 75 nt, Human
agacagaaguggcucugaagcaaucagcccagguaaucuucaggggcugagcuguucugaguuuaagcuuuugcu

SEQ ID NO: 4187839 - RNA, 88 nt, Human
agacagacaggaagagggcccaggagcaggagcuggacagagcagagcugcuccuguccugaggcuccaggcccauuccuuucugucu

SEQ ID NO: 4187840 - RNA, 102 nt, Human
agacagacaguagacuuguagccucagcugucuuuuccgaggugacugaauuaaucauuuggauauuucaguugauagcuacaugguauauuuuucaagucu

SEQ ID NO: 4187841 - RNA, 68 nt, Human
agacagaggugucccugacccuuugcaacacuucugaaucauugugguuacucgggacaccuguguuu

SEQ ID NO: 4187842 - RNA, 57 nt, Human
agacagccagggacauacaaugguacccaauccuguaccauuaacacccagguuucu

SEQ ID NO: 4187843 - RNA, 60 nt, Human
agacagcugaaccuuucccuggagcugcgcuguugcucaaggcgaauguucaaugcguuu

SEQ ID NO: 4187844 - RNA, 90 nt, Human
agacagcuugccuucuacaacgugguacuaugaacagcaaagaacaugacugcccucugaccuguuggcauguugagaggcaagauuucu

SEQ ID NO: 4187845 - RNA, 74 nt, Human
agacaucaucuugaaugacugugauuuucuugaacugaucaccaggcuauuauagucucucaagaaugauaucu

SEQ ID NO: 4187846 - RNA, 67 nt, Human
agacaucauguuacagauuaagacaucaggcacucuguccuggguaauugguuuguaauuugacucu

SEQ ID NO: 4187847 - RNA, 73 nt, Human
agacaugauuuuuugagaagaguuugagguauuaguucaacaaauaucuaucaagucuuuuugucuuauguuu

SEQ ID NO: 4187848 - RNA, 100 nt, Human
agacaugcacacgacagggggucucccuguauuuucaggaagacgauggcuucuccauauuccugaaaauacagggagagacccuggcgugugcaugucu

SEQ ID NO: 4187849 - RNA, 66 nt, Human
acugaaauuuuuauucuuugccuuucgugccagggagggcacagguuugacaaggauaaaaucggu

SEQ ID NO: 4187850 - RNA, 68 nt, Human
acugaagcacauuugccaugaaaauaacuguuauugcuguugccacucaauggucaaugccuuacagu

SEQ ID NO: 4187851 - RNA, 88 nt, Human
acugaauacucaucugaacagucauauauuuuguuugugcaugagacugugugugacagugugugugagugugugugugggugugugu

SEQ ID NO: 4187852 - RNA, 78 nt, Human
acugacucugucucaggucucagcuucaguuuaaaguucugguaaagaaggcuagaucugauaucagacaaugugggu

SEQ ID NO: 4187853 - RNA, 66 nt, Human
acugagaaggucacauggugcaucacugccgcucagucuccccaagcccagugauuucuucacagu

SEQ ID NO: 4187854 - RNA, 77 nt, Human
acugagaguagcuggagaacauuuguaaugguaagaaauaguuccauagugagucauuuacccagcuacuuuccagu

SEQ ID NO: 4187855 - RNA, 63 nt, Human
acugagcagcaggaucuucugguauauuuuacuuauuauaucaagagccuuugcuggcugggu

SEQ ID NO: 4187856 - RNA, 57 nt, Human
acugagcuuggauagggcaaagccaucaucuuugaugagcugccugucuuagccagu

SEQ ID NO: 4187857 - RNA, 77 nt, Human
acugaggaauguagaggaguuucuggucugaggguaggcuuuucagaucuccaaggugaagcauccuguagcucagu

SEQ ID NO: 4187858 - RNA, 61 nt, Human
acugaggcaugucuuauucucaguacuuaguauaguaccuggcacagaguaugcucucagu

SEQ ID NO: 4187859 - RNA, 120 nt, Human
acugaggccuauuuuugacuucugaucuccagaacuguacgauaauaaauuuguguugauguaagccacuaaguuuaugacaguuuauaguagcaauaggaaaucaauauagguaauagu

SEQ ID NO: 4187860 - RNA, 59 nt, Human
acugauauacagagcauucuuugauguuaaaacaucaaaaaauggcauuguauuauugu

SEQ ID NO: 4187861 - RNA, 110 nt, Human
acugaucugugugcuggagcagaugguuaaguguucuccaugaguuccgcccacuaggggcuugggcuguggggaagauagaaccgacacaugugaagcagacaucaugu

SEQ ID NO: 4187862 - RNA, 64 nt, Human
acugcaaaaguugagggggauucuuacaucuucagaagccaacuaauuaaacaacuuuugcugu

SEQ ID NO: 4187863 - RNA, 81 nt, Human
acugcaaacaaacuuuggacaauuuauuacuguuuugucuuuguuagauuacaguccuguugucaaagcaauguugacagu

SEQ ID NO: 4187864 - RNA, 88 nt, Human
acugcaagaacaauaaggauuuuuaggggcauuaugacugagucagaaaacacagcugccccugaaagucccucauuuuucuugcugu

SEQ ID NO: 4187865 - RNA, 108 nt, Human
acugcacaggaacagugucaacaauuguuagccuugggagggauuuccauuaucuucaaaaauaaugagacacucucgggcacauuugaggacauuuucauuguuagu

SEQ ID NO: 4187866 - RNA, 68 nt, Human
acugcagacacucacagagcacccacucugaggcaggcuacagcagaggcacgucugugaauggcagu

SEQ ID NO: 4187867 - RNA, 74 nt, Human
acugcaggcucaugacaaaauaaauggucucugucuuacgccgcuaaguuuagaguguuuuguuaggcagcagu

SEQ ID NO: 4187868 - RNA, 62 nt, Human
acugcaucugaacugugaauggacugugaauacuuuuuaagaugucauaguucuggagcagu

SEQ ID NO: 4187869 - RNA, 69 nt, Human
acugcaugcuuuacaugacauggcacagcuuccacgccagcagcuucaaucauguaaagcgaaugcagu

SEQ ID NO: 4187870 - RNA, 64 nt, Human
acugcauuggagagcaugaauuuuuucaaaccuauuugacacaggucuuuguuuuucaaguagu

SEQ ID NO: 4187871 - RNA, 63 nt, Human
acugcauuugguaaagucaagaacaaaauaaagauggcccucuugcuguuuucccaaugcagu

SEQ ID NO: 4187872 - RNA, 99 nt, Human
acugccaacucaguuaagaagaacacauagagaaguuuuaucagcagccucuguucccaauggaagucucuguuaaguuucucuggcugaggacuuagu

SEQ ID NO: 4187873 - RNA, 69 nt, Human
acugccagaagagaacaccaguucaaaaaaaaccuagcuaauucugaaauuuggggcuuuucuaguagu

SEQ ID NO: 4187874 - RNA, 61 nt, Human
acugcaugcugagccaacagugacaggcaaguacuggcucaauguuuaacccagcaucagu

SEQ ID NO: 4187875 - RNA, 55 nt, Human
acugcauuuaguuaugagaaaaaccccuuuaggguuguauuugccugaaugcagu

SEQ ID NO: 4187876 - RNA, 72 nt, Human
acugcccagaacuuggcaaagccgacugacguuuuggaugacgcagagggcuuggggucaggugggggcugu

SEQ ID NO: 4187877 - RNA, 55 nt, Human
acugcccagcucugcaaacauucuguggagagaagguggagaagagaugggcagu

SEQ ID NO: 4187878 - RNA, 72 nt, Human
acugccccuugaaggcagggaguccugaggcuguuucuagcaugacccaggccaggccuuccagggggaagu

SEQ ID NO: 4187879 - RNA, 60 nt, Human
acugccuugauugccaguuucccuuuccugaaauaggggaauugcauaaauaugaggagu

SEQ ID NO: 4187880 - RNA, 64 nt, Human
acugcggcuuugagucaguaauuccugcuccccuuucugcagggucuaggcugggggcuguagu

SEQ ID NO: 4187881 - RNA, 77 nt, Human
acugcuccggggccacagaucucuugcucucugucauuccuuucugggacaggagacccugcugguucuggaggagu

SEQ ID NO: 4187882 - RNA, 62 nt, Human
acugcucuuuuauugcuguuuuccuauuuacaugugagaaauaacagcucuggaagaguugu

SEQ ID NO: 4187883 - RNA, 77 nt, Human
acugcugauuagcauuucuggaaucacaagaaguuaguaaaagcuguuugccauuaaagaaagaccuuuuuagcagu

SEQ ID NO: 4187884 - RNA, 76 nt, Human
acugcugcaacgguuucuugauguuuuacaggcagccacuguaaggccaccguuauagaaccaccguuuccuaagu

SEQ ID NO: 4187885 - RNA, 68 nt, Human
acugcuuauuauuaugcauagcaugaaauaugcaaguguauaugcauaugcauaauggaugugcaagu

SEQ ID NO: 4187886 - RNA, 72 nt, Human
acugcuucacugcgucuuaucuuuccaugccuguucuugcuaaacagauuuaagauaagagcaacuggcagu

SEQ ID NO: 4187887 - RNA, 66 nt, Human
acugcuuuagaccuagagcucuugccucacacucacuggcuaaaguugagcuuucucuaaaguagu

SEQ ID NO: 4187888 - RNA, 56 nt, Human
acuggaaauugagaggucacugcuuugugaggaagguagucacuucaguuuucagu

SEQ ID NO: 4187889 - RNA, 61 nt, Human
acuggaagaagcaggaauucuuuggcuucauggucagggaaccucuccuguuucucacagu

SEQ ID NO: 4187890 - RNA, 65 nt, Human
acuggaagaauauggcucucagcaauauuccuuugaguauuacucuagaaauauauuuauucagu

SEQ ID NO: 4187891 - RNA, 58 nt, Human
acuggaguacaguggcgugaacacggcucacugcagccucaaccuacugugcucaagu

SEQ ID NO: 4187892 - RNA, 55 nt, Human
acuggaguuauuauuugcagcucuuguuaacuagggcgugaaaaugcauaccagu

SEQ ID NO: 4187893 - RNA, 60 nt, Human
acuggaguucuaugugcuugugaccauucuugguuucuccgaauauccuagaacuuuggu

SEQ ID NO: 4187894 - RNA, 87 nt, Human
acuggcccuaauacuucauucaaguucgcuauaguuuuggccccucaaucccagacauaugcauaauuggauaaguagaagggaagu

SEQ ID NO: 4187895 - RNA, 81 nt, Human
acuggcucagcuagcagggauugggcacugggauaaagccucccauuuucugcuuucuuugcuauucuucucugaguuggu

SEQ ID NO: 4187896 - RNA, 65 nt, Human
acugggaaggagcaggaucugugcagagcagccucuccugaccucagcccagcuucuuccccagu

SEQ ID NO: 4187897 - RNA, 63 nt, Human
acugggaggcuucauacaacagaaguuuauucucuuacugcucuggagauggagccuugaggu

SEQ ID NO: 4187898 - RNA, 58 nt, Human
acugggcagggaaggagaccgaugaaaaaguugagucagucucucucucucucucagu

SEQ ID NO: 4187899 - RNA, 70 nt, Human
acugggcaguaaggugccgcuaagagucagaaaaaauugacaaagcuuuggcauccuuaccaagccgagu

SEQ ID NO: 4187900 - RNA, 75 nt, Human
acugggccuggaaacacaugaugaugaacuguccucuugauuauaguuucaaaauaugucuccaguuuccccagu

SEQ ID NO: 4187901 - RNA, 85 nt, Human
acuggguaggaaauuauuccaucauacgguauuauucaagcaauuagaaaucacauuguguggugaaugaucagcucuucuuggu

SEQ ID NO: 4187902 - RNA, 77 nt, Human
acuggguuagucacaaauagcuauauuaaggauguuuuucacauuuuuuaaacacuagcaauuuggacccacccagu

SEQ ID NO: 4187903 - RNA, 66 nt, Human
acuggguuuaggccaggcaggcccaggccugguuuuuggccuggcgccgggcugccugucuuuggu

SEQ ID NO: 4187904 - RNA, 72 nt, Human
acuggucccuccgagaagcauaaagcaggaaugccgucauuuuuauuuauguuuguuuguuuacuaacuagu

SEQ ID NO: 4187905 - RNA, 70 nt, Human
acuggugcccacccuucagagugacauugaucuguuaaccgucauucucuggugugguuguuuaaccagu

SEQ ID NO: 4187906 - RNA, 79 nt, Human
acugguggauuuagagaaggaguagaaugccgggagaguagaauuucacccagcagcugcuucugcuuguaauaugagu

SEQ ID NO: 4187907 - RNA, 129 nt, Human
acugguggccagggcaugucucccccagcccugagucuccgcaguggugaccagggcaugucucccccagcccugagucucccggcaguggaggcagcgugggcacaggguuugucacagccuguaagu

SEQ ID NO: 4187908 - RNA, 74 nt, Human
acuguaaaauuuucauguaaauuguacugacacacgcccaguaguguuuguugugcagguuuauuaaguacagu

SEQ ID NO: 4187909 - RNA, 63 nt, Human
acuguacuaaugcauuuaacuaacacagauauggagacacuguguugaugccagaguaucugu

SEQ ID NO: 4187910 - RNA, 55 nt, Human
acuguagccaucacgucucuauugaguagcagaguagaaaugugaaaggcugagu

SEQ ID NO: 4187911 - RNA, 62 nt, Human
acugucaauagugcugagcuugaaaaaccugguagagagcaaggggccaagcacgugacagu

SEQ ID NO: 4187912 - RNA, 95 nt, Human
acugucaaugaaggaggaugucagcagaguggaacauugucauagauaaagaucagugaaaaugugcucuggcugagguaggguuuucuggaagu

SEQ ID NO: 4187913 - RNA, 90 nt, Human
acugucagguagaguaggugcuuuaguaaauaauuuuuguguaguugaaaugauaaaguguuuacauauaaggcccuuuccccugacagu

SEQ ID NO: 4187914 - RNA, 75 nt, Human
acugucauguauggcuauagaaauuuguuuaacuaccccaaaguguacacuuuguuguggcauauacgcuucagu

SEQ ID NO: 4187915 - RNA, 67 nt, Human
acuguccuuccagggagcaggcagugugcacucucaggcugugcauuuuggagggccuguucgcagu

SEQ ID NO: 4187916 - RNA, 62 nt, Human
acugugaauggguuauuuuuagggaaagcuauuaagcuguucucuaagccacccauuuuggu

SEQ ID NO: 4187917 - RNA, 72 nt, Human
acugugagcuccuggaggauagugacugggagaggacgaccccucccaacuacucucaggcagcuuugcagu

SEQ ID NO: 4187918 - RNA, 58 nt, Human
acugugauguuugugaucaucuccuaggugccugguaguuugaucaagauaguacagu

SEQ ID NO: 4187919 - RNA, 59 nt, Human
acuguggaauagauuuucaacaaauaaauuuugggagacacaaacauuuauuccacagu

SEQ ID NO: 4187920 - RNA, 57 nt, Human
acuguggggacccaugccaugggcaguaggcugcugugugugcaugguugccaccgu

SEQ ID NO: 4187921 - RNA, 57 nt, Human
acuguggguuaacuucuuucccaucuguaaaaugggcaugauauuaguaccuagggu

SEQ ID NO: 4187922 - RNA, 72 nt, Human
acuguguauaagugagaaugcuguuuuaguuuuuuaaaagacaguccuaagauaauugucucuugauacagu

SEQ ID NO: 4187923 - RNA, 56 nt, Human
acugugugugugugugugugugugugugugcguacacguguguguacauagauagu

SEQ ID NO: 4187924 - RNA, 89 nt, Human
acuguguuaguccguuuucacacugcuauaaagaauaccaccugagacuggguaauuuauaaagaaaggaaguuuaauugacucacagu

SEQ ID NO: 4187925 - RNA, 85 nt, Human
acuguuaaaaaguuggguuauauaccaaaguuuauaauauguuaauaaugugucuaaacuguggaauguucucuuuuuuaauagu

SEQ ID NO: 4187926 - RNA, 67 nt, Human
agaaggcccugguugcucacccuuccagcaaaggcuuuugcuaggagaggcagcacagcggccaucu

SEQ ID NO: 4187927 - RNA, 62 nt, Human
agaagggcagagggaaucccacauggacugguggaucaugugugugcauuucucucccuucu

SEQ ID NO: 4187928 - RNA, 119 nt, Human
agaagguccaaaauuugugugucuuuuuaguggaauuguuauuguuuguugugucacaacaaacaaaugauaccaguucucaaauauuaagauuauauugcuucaaauagugacuuucu

SEQ ID NO: 4187929 - RNA, 58 nt, Human
agaaggugaugaguuccagcauuuuuucagacuuggaucuggcuuucauuccccuucu

SEQ ID NO: 4187930 - RNA, 90 nt, Human
agaagguguacuaaggguucauuccauguacagaaguuaaccuaaugcuuuguuuugauaaggaaaugaaacucuaauauuaugcuuuuu

SEQ ID NO: 4187931 - RNA, 56 nt, Human
agaaguaggcagggcuguaucaucaucaccuugauagaugcagccagguuuauucu

SEQ ID NO: 4187932 - RNA, 78 nt, Human
agaaguauguacaguuuauugcacagguaaccagaacacauuucugcgucccacaagccauaaauaauauauaguucu

SEQ ID NO: 4187933 - RNA, 83 nt, Human
agaagucugauaugagagauuuaguagaugcagcauuauuugcagucucacugcaagcauucugcucauuucaucaaacuuuu

SEQ ID NO: 4187934 - RNA, 61 nt, Human
agaagugaucugacacauauucaugggaaauuacauuuuauauguguauggauuucuaucu

SEQ ID NO: 4187935 - RNA, 56 nt, Human
agaaguggaaugagaugccuggguccgccccugccuuagcaagucuacccauuucu

SEQ ID NO: 4187936 - RNA, 112 nt, Human
acuuagugauccacccgccucggccucccaaagugcugggauuacaggcuugagccaucgcucccggcugaguugcagcauuuucuugccuagggugggcagacucacaagu

SEQ ID NO: 4187937 - RNA, 60 nt, Human
acuuauacguucuccaucaaggauauacgauuucuguuaggagauggaaaguguaugagu

SEQ ID NO: 4187938 - RNA, 67 nt, Human
acuuauagcaagcaggacagucucagaaagagcacacuccauauguuagacucugugugcuaugugu

SEQ ID NO: 4187939 - RNA, 75 nt, Human
acuuauauuuguguggaaaaugcuucuuaauugaacaaagauuaauuaccaggauuuuucaguaugaagauaggu

SEQ ID NO: 4187940 - RNA, 97 nt, Human
acuuaucacuaaaacauccucuauaguucauugaccuguuagacauuugauacaaauuugcugaaucaaugaauuuuaggauguuuggaauguaagu

SEQ ID NO: 4187941 - RNA, 81 nt, Human
acuuaugccccuuuuagugauucauuuagaaaaauauauuuuuaagacauuuuucagaauacuaagggaggguuuuuaggu

SEQ ID NO: 4187942 - RNA, 59 nt, Human
acuuaugggaauaaucaccaaggcccacaaaggagaccugggccuuggggucccaaagu

SEQ ID NO: 4187943 - RNA, 73 nt, Human
acuuauuccagcagucugccccgcuauaacuggucaaaguaaagcuguggcagcacuuuggaguuuaugaagu

SEQ ID NO: 4187944 - RNA, 81 nt, Human
acuuauugcgauuacucacaacuuaguccucuauuuauagaacugcacagaggauuaaguugugaauaauccagucacagu

SEQ ID NO: 4187945 - RNA, 62 nt, Human
acuucaaaaugaguuuccugguuuacaacaagcauuaaugucaggaaagucaauuaagaggu

SEQ ID NO: 4187946 - RNA, 63 nt, Human
acuucacagguuuucauaaaaccccaaauacaacugauggaauauguaugaaagcuguggagu

SEQ ID NO: 4187947 - RNA, 62 nt, Human
acuucacuggaagacagccuacuuugggaugcuaaagaaggcugugaacucuaugcugaagu

SEQ ID NO: 4187948 - RNA, 80 nt, Human
acuucagacacagugagaaauggaacuucauacgcuugcacuguaauugaauaugguuccauuucuccaauaucuauagu

SEQ ID NO: 4187949 - RNA, 66 nt, Human
acuucauuacuaauuugccaauugaauaucccauaagauauuggaaggcauuagugaauauagagu

SEQ ID NO: 4187950 - RNA, 102 nt, Human
acuucauuuauaaacagcacaguaggcacuggucuaccccuuaguuauacccagugacaagcaucaguauccacugccuaggcugugaguaauuacugaagu

SEQ ID NO: 4187951 - RNA, 64 nt, Human
acuuccagagaucucucuucccugugacaggauaacuggcaguacugaagaugggucucuaagu

SEQ ID NO: 4187952 - RNA, 61 nt, Human
acuuccagcugauuggcauccaggauggguaccuaucacugcuccaggacagcggggaggu

SEQ ID NO: 4187953 - RNA, 84 nt, Human
acuuccagcugcuguucagaugcgauucaggaaugugacuuccccaagguuccaaaugacaucggacaguaaugggcugggggu

SEQ ID NO: 4187954 - RNA, 130 nt, Human
acuucccuggucacuccagccucuaggggcuuaagggccagaguggcaaaagccugaacagucauuaaauaacugaccauuaacuggugucacucugaggcccucagcccaacagugaccaucuaacagu

SEQ ID NO: 4187955 - RNA, 63 nt, Human
acuuccguuauguaccauagggaaauuuugguuuugguuucuuuguaguagcauaaucauagu

SEQ ID NO: 4187956 - RNA, 74 nt, Human
acuuccucauugcucugugguugguggugguggucagcaggcugcaggcgucacugccacggguaucuggaggu

SEQ ID NO: 4187957 - RNA, 57 nt, Human
acuuccugacuucuggguuggaaguuauucugccaacuuucuccaaguacaagaagu

SEQ ID NO: 4187958 - RNA, 59 nt, Human
acuuccugguuuucuggcggugcuucacauuggcugaagccaucaggaagccagcaggu

SEQ ID NO: 4187959 - RNA, 79 nt, Human
acuuccuuuuagcuuuaccucauagauuuguuuagaaccucaaauaaugagcacguuugugcuuuguaaacugugaagu

SEQ ID NO: 4187960 - RNA, 70 nt, Human
acuucgcaccuagcagaacagaggugcuggccuaguugugccaggccuugaaccuugcugggugugcagu

SEQ ID NO: 4187961 - RNA, 55 nt, Human
acuucuauguguccguuggguggggugggucccaccagagcagacuacuggaggu

SEQ ID NO: 4187962 - RNA, 100 nt, Human
acuucucuccucuugauuuugccauuaaaacauguuaucuccucauaauaaaucacuggagagguuguuagaauaguggaggaaaacaagggagaguggu

SEQ ID NO: 4187963 - RNA, 61 nt, Human
acuucugcaggcccugucugaccgugacucagagucaggucgaucagucaucugcagcugu

SEQ ID NO: 4187964 - RNA, 57 nt, Human
acuucugcuuuguuuucugggaaaaucaacugagcucucucugaguugagcaggagu

SEQ ID NO: 4187965 - RNA, 57 nt, Human
acuucuugggacccuggcaccgauccacuguccuuggugguugggguucagagaagu

SEQ ID NO: 4187966 - RNA, 97 nt, Human
acuugaacauuguacaugugaugugggcauagauaguauauauguauuuauaauauacauacauguaugcacauacaugcauguacacacacagagu

SEQ ID NO: 4187967 - RNA, 102 nt, Human
acuugagcaagaaaaucaauauuuuugcauuucagcuauuuauuugcaaaacaguauagugaaaugaaucuggaaauauuguaagacuaaugcaaauuaagu

SEQ ID NO: 4187968 - RNA, 69 nt, Human
acuugagcccagguugaggcugcagugagcuacaaucgugccacugcacuccagcccgggugauagagu

SEQ ID NO: 4187969 - RNA, 87 nt, Human
acuugaguucuaaguaggucacucugccaaaggauaguaaaauuaccauguuccucugaguacagugauggauuuggaaaaucaagu

SEQ ID NO: 4187970 - RNA, 116 nt, Human
acuugauaaucauauuggagcauuuaugacuaauguaaaaugcagaaaauacacaaaggaguaaagcaugauauuugacaugaaguagcuuauaaaugcauaauaauuagucaagu

SEQ ID NO: 4187971 - RNA, 80 nt, Human
acuugauggccucaagcaacagaacugugagaccucgcuuagauuuggucagcuaugucuguuguugagguggaccaagu

SEQ ID NO: 4187972 - RNA, 63 nt, Human
acuugcaggagggcaagaauuguucugaaaacugauaugagaacacaggccagccugugcagu

SEQ ID NO: 4187973 - RNA, 77 nt, Human
acuugcaguuggugucagaaguaaggccaaucuuagguacuauguccuugagccucacaguuuggcuaacugugggu

SEQ ID NO: 4187974 - RNA, 64 nt, Human
acuugccaguccucuggucccagaacuggggugagcugaaggugaccagagacuggggacaagu

SEQ ID NO: 4187975 - RNA, 114 nt, Human
acuugcuucucaccaauagaauagggcaaugguggcaggauguaugugauuauacauacauguuuacauuacauaagauuguaaccuagucuugcuagcuuugagaaagcaagu

SEQ ID NO: 4187976 - RNA, 58 nt, Human
acuugcuugggccaucucgcuuggcagcgucaaggcugauaucugggcccaggcaggu

SEQ ID NO: 4187977 - RNA, 77 nt, Human
acuugcuuuugucuacuagucuucugcuauucccugguuuccaaauaacacugaugagacaguaguauaaugcaagu

SEQ ID NO: 4187978 - RNA, 61 nt, Human
acuuggaauguugucauuuacauuauuucuaaagaagcaguguguuuggauaacacacagu

SEQ ID NO: 4187979 - RNA, 92 nt, Human
acuuggaguuaauuuaaggugagccuccuucaagcaguaaaaauaacaggguuuuuauauugagugagaguucccauggaaccacucugagu

SEQ ID NO: 4187980 - RNA, 72 nt, Human
acuuggauccguuuauacugaguuugaugaaguggauaggcauugagaaguaugaauggauuuuuuaaaagu

SEQ ID NO: 4187981 - RNA, 63 nt, Human
acuuggaucucaauuucaguggagaccuuacuguuuuugucugcccugaucuugaucuauugu

SEQ ID NO: 4187982 - RNA, 55 nt, Human
acuuggcuuuaguaguaacugaaaaugguuuggagagcugaauuuagagcuaagu

SEQ ID NO: 4187983 - RNA, 79 nt, Human
acuugucacaugccccugccugauuccaggauggcuggggaguguauugagcuguaugugcaggcggguaagaacaggu

SEQ ID NO: 4187984 - RNA, 89 nt, Human
acuugucagcuuccuguaugaggaucagacuggacgacuucaaccugcuuagcccgucuucugaggccucacccuaguaguuggcaagu

SEQ ID NO: 4187985 - RNA, 79 nt, Human
acuuguccacaguaaugcauacaaguuagugaguggaccaagaucugcugcuaauuaguuugcauuacuuuagacaagu

SEQ ID NO: 4187986 - RNA, 63 nt, Human
acuugucuuuaauccgaauguaacagaaauguacacgacguuauauuaggauuagagaggagu

SEQ ID NO: 4187987 - RNA, 79 nt, Human
acuugucuuucugcacuuaguggggcuucauuuuauuuagaaagcccgaugacauuacuauuuguacuuugaagaaagu

SEQ ID NO: 4187988 - RNA, 76 nt, Human
acuugugcaaaaucagugucucaagggauauucugcuauuuggauucuggacaaugagaaacuggugggaacaagu

SEQ ID NO: 4187989 - RNA, 57 nt, Human
acuuuacaagcuuauagccuaggaacaauaggcuauaccaucuagguuuguguaagu

SEQ ID NO: 4187990 - RNA, 118 nt, Human
acuuuacuaaaaauuuauacuauacugcuuacuacugcauguguuugaugauggcugggaacauuauucucauguacugcaguaaaagcagagcuuccguaagauuaauuucaaaagu

SEQ ID NO: 4187991 - RNA, 130 nt, Human
acuuuacugauacuccaaaacacauuucaaaccaauuaugacugucuuuugaauaaaaaugguaauaaugugcuauaauuuaacaugagggcauuuuucuugauugagguguuuuuguuuguuuguuuuu

SEQ ID NO: 4187992 - RNA, 105 nt, Human
acuuuagugaagacuucauccugcgcauucuuauuuuaaaaguugauuaauuuuuuuagaauuagcuuccuauaguaaggggaugggguggaguaauugcuuugu

SEQ ID NO: 4187993 - RNA, 126 nt, Human
acuuuauacuguguguggaggaguucaguuguaacugguggugccuaauaauucuauugcaauaauuaaaguucauggagagcuguuagguuauuaguucauagaagcugcuucagaaaacggagu

SEQ ID NO: 4187994 - RNA, 61 nt, Human
acuuuaugacacccuuuagugauggauuucuacgcuuucagugauuugggugucagaaagu

SEQ ID NO: 4187995 - RNA, 60 nt, Human
acuuuauggauaugcaacauuuuguuuaucgauugacaaacugaaguauauuuagaaggu

SEQ ID NO: 4187996 - RNA, 79 nt, Human
acuuucaacacugagcuauuacgguggaauuaaaauuuccauguagaaguauuagugcagaauuacaaaauugaaaagu

SEQ ID NO: 4187997 - RNA, 77 nt, Human
acuuucauugccuuuggaaggucuuagucagcaucuugccucugcucaaagacucaaaccaagagugcgaugagggu

SEQ ID NO: 4187998 - RNA, 66 nt, Human
acuuucauuguugaaaacuaccuauauauacggacagcuggguauuagguagauuuuacugauugu

SEQ ID NO: 4187999 - RNA, 70 nt, Human
agaacucuuaggaaugacagguuucuucugguuuugaccagaaaguaagugccuuuuauucuuauguucu

SEQ ID NO: 4188000 - RNA, 79 nt, Human
agaacugcaaagcccccacgcaggcucccgcugcuucuaggagccuggagcccaguguggggcucugcaaauguguucu

SEQ ID NO: 4188001 - RNA, 92 nt, Human
agaacuuaagagcaucacuacuaaagucagacugcauugauuucaugcugacuuucaauuaauuagaugacuuugggcaugauguuuagucu

SEQ ID NO: 4188002 - RNA, 70 nt, Human
agaacuugcuucccaguuuagcucuggcauaaauccagaguccauauauugauuuguugagcaauguuuu

SEQ ID NO: 4188003 - RNA, 64 nt, Human
agaacuuggguguggggguguggccugggguguuagaccccucccagguuccgacgccucuucu

SEQ ID NO: 4188004 - RNA, 80 nt, Human
agaacuuuauaucaggauagucuguaaauugucuuggaaagcuuucauuucaauaaguugcagacauccugagaaguacu

SEQ ID NO: 4188005 - RNA, 74 nt, Human
agaagaaaccaugacaaaccauagacaugaugcuuuaaaauaauggcccugcugguuugaucguugauacuucu

SEQ ID NO: 4188006 - RNA, 56 nt, Human
agaagaaagauugaagguuccuuuucagcaugaggucauucuuccuccuuucuuuu

SEQ ID NO: 4188007 - RNA, 83 nt, Human
agaagaaagccaagaauccugaugaaguuagaagagaagcuuaacaauuugccuccaccuucugcauuggagucuauucuucu

SEQ ID NO: 4188008 - RNA, 66 nt, Human
agaagaaguugaggcuuccccaagggcugagggccccauagcucugggaaguccuuuaccauaucu

SEQ ID NO: 4188009 - RNA, 73 nt, Human
agaagaauuagcuauaggugcauccuguuguugugcaaacaaaacuacagguggcuuauuggcugauuuuccu

SEQ ID NO: 4188010 - RNA, 65 nt, Human
agaagaggggacaugugagcugggucuuagaaaaggcaggaaguagcuuaaaaucucuagauucu

SEQ ID NO: 4188011 - RNA, 78 nt, Human
agaagaggugagggucuuuugggggucucuuuuauccuauuccugagggcucugcccccuugaccuaaucaccuuucu

SEQ ID NO: 4188012 - RNA, 63 nt, Human
agaagagucucuuccaccugcucauuccagaggacccgcucagguggcaaggggcgccucucu

SEQ ID NO: 4188013 - RNA, 59 nt, Human
agaagauaagaaaguuugugauaauacuuaugcagguaugaguggucuuucugucuucu

SEQ ID NO: 4188014 - RNA, 84 nt, Human
agaagcacugcugggagcugucaggagcguguuucagaaguaaagggacuuggcaggcaguugcaguuuucuagagugguuucu

SEQ ID NO: 4188015 - RNA, 77 nt, Human
agaagcacuguguuuucugugcagcuuaaugagagggagcauaucauuucaggacucucacaggaugcaguguuacu

SEQ ID NO: 4188016 - RNA, 76 nt, Human
agaagcaguagauuccuacucauuccugacucuuuuagccacuugucguauggcaugagcaggugucuuaacuucu

SEQ ID NO: 4188017 - RNA, 83 nt, Human
agaagcauaggcacuuuccuccuccuuggauauaagaggagacugaagcugaagaagaggaggggauaggccuguggacuucu

SEQ ID NO: 4188018 - RNA, 86 nt, Human
agaagccacaacccagccccagcacaggcuccucagauuuaucuggagcaaggauuuagggacacuguucugggggugaggcuucu

SEQ ID NO: 4188019 - RNA, 106 nt, Human
agaagccucuggaaauucaaucagauaugugacauauuugucugaaucaucaaagcuaagaaaauguaauaaauauggucacuugauugaaggacaguugcauucu

SEQ ID NO: 4188020 - RNA, 68 nt, Human
agaagcuaaugagauaaaugccaucacaggcuuaauucauuguaggugguaacuaguccuuaguuucu

SEQ ID NO: 4188021 - RNA, 55 nt, Human
agaagcugaaugugggcuuuggagcuggucagaucggagcuggcauccagccucu

SEQ ID NO: 4188022 - RNA, 61 nt, Human
agaagcuguugcauuccuggcgcucugucuuugagcuggagcuuaccugcggcagcucucu

SEQ ID NO: 4188023 - RNA, 128 nt, Human
agaaggaaacgucaccacccacugaaggauuauuguuggcaugaugacugaggcguggcgccugugcacauggcagugucaguugccuugucauaaguggcaguaaugcuaggggauacuuuucuucu

SEQ ID NO: 4188024 - RNA, 69 nt, Human
agaaguggacacucucuuccucucuucacgucccagaguucugaagcaguggaccucagugcuauuucu

SEQ ID NO: 4188025 - RNA, 61 nt, Human
agaaguucuggagacggaagugucagcaggguuggcugacacuuccgucuccaggauuucu

SEQ ID NO: 4188026 - RNA, 90 nt, Human
agaaguucugguuuugaauucuucugucuuuaacugaccccaguggcuuccuucugguuucaucaaagucaaagaaugacuacuacuucu

SEQ ID NO: 4188027 - RNA, 58 nt, Human
agaaguuugguccuauaaacucacaguaaaauuaggccuugaaaaggaccaaacuucu

SEQ ID NO: 4188028 - RNA, 66 nt, Human
agaauaacagcaaguuugcaggcaaguuggaaaagagaucagaagcccucagcuugauguuguucu

SEQ ID NO: 4188029 - RNA, 61 nt, Human
agaauacgacauucuuucagucugcucauguccuuggguuaaauggcagagugucuguucu

SEQ ID NO: 4188030 - RNA, 59 nt, Human
agaauagcuagaacaaaagaauugauggcauggucaauuccaguuaaggaagcuauucu

SEQ ID NO: 4188031 - RNA, 60 nt, Human
agaauaucugggagugggaagcuauauacuuguauuuucauaaaguccccagaugauucu

SEQ ID NO: 4188032 - RNA, 79 nt, Human
agaauauucaucuguauucuuauccccauuuucguacuuacuuuacccgacugcugggaguagaagcagguaaaauucu

SEQ ID NO: 4188033 - RNA, 85 nt, Human
agaaucacuugaacccagaggcggagguugcagugaguugagaucgcaccacugcacuccagccugggugacagagcaagauucu

SEQ ID NO: 4188034 - RNA, 87 nt, Human
agaaucacuugaaccugagagguggagguugcagugagcagagauugugccacugcagcacuccagccugggcgacagagugacucu

SEQ ID NO: 4188035 - RNA, 112 nt, Human
agaaucacuuggaagguuuguuaagcuguagauuccuaggccucaccucagaaucaaaaccucuaggaacaguccuagaaaucuguauuuuaaccagcacccaguugauucu

SEQ ID NO: 4188036 - RNA, 86 nt, Human
agaaucccuugaucccaggaggcugagguugcagugagcugagaucacgccacuguacuccagccugggugauggagugagauucu

SEQ ID NO: 4188037 - RNA, 81 nt, Human
agaaucucaucaggcacacauccgugagagaucacaugaccuucgcgucagaugugugugcuguguggaaaagaagauucu

SEQ ID NO: 4188038 - RNA, 78 nt, Human
agaaucuggggauguuuguuacagcacuuaaccuuuuuugacauaagaagccaaaugccagugaccucucuacauucu

SEQ ID NO: 4188039 - RNA, 80 nt, Human
agaaugaagcuuaggucuguuuauaaaacagucaucagaucaugugcuuccacugcuuauagacagaucaugcucauucu

SEQ ID NO: 4188040 - RNA, 63 nt, Human
agaaugaauuaaucaacuggaagacaagauucaggaagucuuccagaggaagaagucaugacu

SEQ ID NO: 4188041 - RNA, 68 nt, Human
agaaugacuugcuuucugaguaaacauagccuagggaaauguuuuccugggagagcacucuccauucu

SEQ ID NO: 4188042 - RNA, 57 nt, Human
agaaugauggacucuccuugaguuuuguuuuagcucacacaggaguuucuucuuucu

SEQ ID NO: 4188043 - RNA, 93 nt, Human
agaaugccauuuguauucuacuuaaauuggcaucacugggaguuuaaaaagagggugagagaaugcuuauuuagguagauauuaauggcuucu

SEQ ID NO: 4188044 - RNA, 69 nt, Human
agaaugcuacagagcucugugaagagaccacuuugugugucuguuuuaaaaucaggcucuguuuugucu

SEQ ID NO: 4188045 - RNA, 93 nt, Human
agaaugcuguagaaucccccaguucuggaguuucauucuuuagcagccaugaggagaaggggcuucagagccaggcuucuggguucagauucu

SEQ ID NO: 4188046 - RNA, 88 nt, Human
agaaugguguucaauauagcacauauucaguucauacaaaugccaacauuuauaugaaauagugugugcccuuuugaagcaugauuuu

SEQ ID NO: 4188047 - RNA, 67 nt, Human
agaauuaaggauguccauuagaaggucaaggucagcauccaggccagaguugauggcaucuuggucu

SEQ ID NO: 4188048 - RNA, 82 nt, Human
agaauuauuucaauagauccagaaaauuuauuauugaucucaguugccugaggugguaccuuucuggguuugaagagauucu

SEQ ID NO: 4188049 - RNA, 69 nt, Human
agaauuccauaaucaccuuauucuuuguuaggacccuucagagagucagggaaggugguguggacaucu

SEQ ID NO: 4188050 - RNA, 86 nt, Human
agaauucugaaaucaagguguuggcagggccaggcucucucuguagccucuaggagaggauccuuccuugccccuucccagcuucu

SEQ ID NO: 4188051 - RNA, 88 nt, Human
agaauugaagugaauggcuuuuauuagaagaaaauccauauugcuuuuaaagauaaugugccgauaauuucuagcccacuuacaaucu

SEQ ID NO: 4188052 - RNA, 55 nt, Human
agaauugugauuauggaauuaggcugaaacagugucuacauuccacacaaucucu

SEQ ID NO: 4188053 - RNA, 63 nt, Human
agaauuguugggguaauaaaagaggugaauagauuuucauucauuuuaauucucaggaguuuu

SEQ ID NO: 4188054 - RNA, 56 nt, Human
agaauuuuaucuaaagggaguacaaaggccaugaugccuuuuccagguaaaauucu

SEQ ID NO: 4188055 - RNA, 59 nt, Human
agacaaauaagugcugggauuucugagucucaauuccaaaucuuagggcuuauuagucu

SEQ ID NO: 4188056 - RNA, 59 nt, Human
agacaauggagggaaauacuucagcucccuuuugcugucuuuuguuuucauucauugcu

SEQ ID NO: 4188057 - RNA, 67 nt, Human
agacaaugugagccaaugcccgugggagccacaccaccaaccuccaccaagccggggccacuucucu

SEQ ID NO: 4188058 - RNA, 72 nt, Human
agacacaaauggaaaggcuuaaaggacauggcauacguuuuuggacccaaguccaguuuuuccagguggucu

SEQ ID NO: 4188059 - RNA, 70 nt, Human
agacacacagggagaaagaaagccugcuuggaggggaugagguuuaggagcuauuagucuuugugugucu

SEQ ID NO: 4188060 - RNA, 73 nt, Human
agacacggugaaaugucauccuuuagccauuuauuuccuaaaaggccucaaaagaucauguuuccauguguuu

SEQ ID NO: 4188061 - RNA, 56 nt, Human
agacacugaaucagagggacaucagccugcagcaugcugucccagacuccgugucu

SEQ ID NO: 4188062 - RNA, 73 nt, Human
agacagaaacacuuugggcacagugaggccaggagggaccccacuuggcgcugcaaauggucagagucugucu

SEQ ID NO: 4188063 - RNA, 85 nt, Human
agacagaaugcccaggcugcugccuagaaugacaggaagcuggacugcccuuucaguuuauacaugcaauggccugggacugucu

SEQ ID NO: 4188064 - RNA, 101 nt, Human
agacagaauuguuuacuucugaguggcucaguugggucucuuguuuuucccaguaaccaagucuagcuuggucacuuggagccccaugcaguccuuuguuu

SEQ ID NO: 4188065 - RNA, 55 nt, Human
agacagaggcugguguggguuccauguuuggggcccaggagaccuagaucuguuu

SEQ ID NO: 4188066 - RNA, 65 nt, Human
agacagcuaaauuccaccagaaucaguaaugcccagcagcugguuaaggguggaguuaagugucu

SEQ ID NO: 4188067 - RNA, 55 nt, Human
agacaggaauuuccuaauauucgaagacauuugaggcuuugggaaauucucugcu

SEQ ID NO: 4188068 - RNA, 71 nt, Human
agacaggaugacccuuguggcagaaaacaguuucagggagauugacucugaacugaaggguaaagauguuu

SEQ ID NO: 4188069 - RNA, 67 nt, Human
agacaggcaugaggcuggauugaaugucuaccucuuacuagcugugucuuucagccucaguuucuuu

SEQ ID NO: 4188070 - RNA, 58 nt, Human
agacaggcuuggaaaaaaccuccccuucccaccacuggcagagcccaagcagcugucu

SEQ ID NO: 4188071 - RNA, 80 nt, Human
agacauagggaggcauauaaauauuuugaccuucaaugauaaaauggguagcugaucuuuuaagugucauuuuuauguuu

SEQ ID NO: 4188072 - RNA, 115 nt, Human
agacaucuuugccugguuuugguaucagaauaauauuggucucauagaauggguggagaacaacucugucacuagaacuaguauuauuucuuccuucaauguuugguagaauucu

SEQ ID NO: 4188073 - RNA, 57 nt, Human
agacaugcuuggaggagaaggaaacuguguugguugauauuuuuccucaaaguugcu

SEQ ID NO: 4188074 - RNA, 99 nt, Human
agauaauauggacauuuaugaaggagauaugcaagggcacagcaagccaugugcuuucaguauuuaagcauccuccuacaugacauguugaauacuucu

SEQ ID NO: 4188075 - RNA, 68 nt, Human
agauaauuuuucgggcacacacuugacagguuccaaaggaguggcauaugugccugugaaugaugucu

SEQ ID NO: 4188076 - RNA, 56 nt, Human
agauacaaaggccuacagagcaaugcccacugcccugugaauggggccuuuguucu

SEQ ID NO: 4188077 - RNA, 59 nt, Human
agauacacagcccugccaucaccuugauuucaguccagugaaacacagguuguguuucu

SEQ ID NO: 4188078 - RNA, 59 nt, Human
agauacagaaguuuuucccuauuaggcaguaggcuuccugggggcaggguucugucucu

SEQ ID NO: 4188079 - RNA, 67 nt, Human
agauacauucugaauaguuucuucugaccugucuuccaagucacaguguaucucuucagcuguaucu

SEQ ID NO: 4188080 - RNA, 62 nt, Human
agauacucugguaaugugcacguggucaccaaaagacauguacaaggaugcucagagugccu

SEQ ID NO: 4188081 - RNA, 74 nt, Human
agauagagcugccugacaagugcugcucauggugauuagccauguaaaugaguacagucaggaagcugcugucu

SEQ ID NO: 4188082 - RNA, 129 nt, Human
agauaggacuuugauauauucuucauucugugacuugauggguagccuuucaauagcaguuuuaauacaagguacuguuaauauauuuucugccauuagguugagguggagaguucuaugguucuguuu

SEQ ID NO: 4188083 - RNA, 76 nt, Human
agauauaaacucuugaauucccuugaagagaaggaaaacguaccaaucuacaugggggauuuaauuguggaugucu

SEQ ID NO: 4188084 - RNA, 101 nt, Human
agauauaacuuugaguguuaaauacuguaucacuugugagugaaauggaauuuaaauauuuuauuacagaaugcauguauuuaguaaucgaguuuauauuu

SEQ ID NO: 4188085 - RNA, 61 nt, Human
agauaucaauugcagucuacguuuacaucauugaggauguacacauaguguaguuauauuu

SEQ ID NO: 4188086 - RNA, 104 nt, Human
agauaugaaaguguuggccucauauugcuuuagaaagaaaaauauaauauuuauucaguguauuuuuacaauuugaaacaaaaggugggcaaauuuuacauucu

SEQ ID NO: 4188087 - RNA, 123 nt, Human
agaucaaagugcgagcuuuccuuaauuugcuaacuguauggugguuauguaagagaauauccuuguucuuaggaaauauauacuaaacuauuaauagguaaaggaacaugguauacgugaucu

SEQ ID NO: 4188088 - RNA, 92 nt, Human
agcacaggggagaaugguaggagaugaggucagaggggugugugugggaggagacaacaugucuccacccaucuuaaagauuucugugugcu

SEQ ID NO: 4188089 - RNA, 56 nt, Human
agcacagguacggagaugcuacccucuucuagguggucaucuggagaagcugugcu

SEQ ID NO: 4188090 - RNA, 63 nt, Human
agcacagugcugucuaucucacuaagccacauguuccaggagggguaggcaguauguuaugcu

SEQ ID NO: 4188091 - RNA, 57 nt, Human
agcacaucuuuugggaccccugaggcucuaaucaggcaucucagaauuaagagugcu

SEQ ID NO: 4188092 - RNA, 116 nt, Human
agcacauucaucugaaaaggcucggguugaugaauauuuuccgcuguccgguaaccauggcaauagggucagcagauaugauacuuaauuuaaucuuccagcugccucagugugcu

SEQ ID NO: 4188093 - RNA, 61 nt, Human
agcacauucuugccuuaaccuccaagucagaucucuccaugguaacgcaggaauguuugcu

SEQ ID NO: 4188094 - RNA, 75 nt, Human
agcacauuucucagguaagucauuucucuucccaaggggaggauugaaugaguuuauggugagaggcugaaagcu

SEQ ID NO: 4188095 - RNA, 88 nt, Human
agcaccauuuugcaggacacgucuaauaacuuucagucauuuaucacuauucccaaaugccaggauuauuagaggcaaaucagguguu

SEQ ID NO: 4188096 - RNA, 77 nt, Human
agcacccaguaggucuguggaugggagaaggugacagaaaguugcaccaggcagucaccguccaggacccggcugcu

SEQ ID NO: 4188097 - RNA, 70 nt, Human
agcacccccucacagucuaggagcagcuucucucucccccacauuuugagcuguuccccuugagguugcu

SEQ ID NO: 4188098 - RNA, 66 nt, Human
agcaccuucuuggaguuuacaugcugguaauuaugccagacaguaauaaaauagguaagaacggcu

SEQ ID NO: 4188099 - RNA, 72 nt, Human
agcacgcugaggccagagugggccucuuccuauuucaggcucugaaaguggcccagucuugcccugggugcu

SEQ ID NO: 4188100 - RNA, 129 nt, Human
agcacguucgcgucccagguuucuguccgcuggguuuuccuccgccucacucgccuucuccccagcggcgcgcggaggagcugggcugagagggucgcggggagccgggucggccgcggcugggacgcu

SEQ ID NO: 4188101 - RNA, 67 nt, Human
agcacuaaaaagacauggcaagagauggggcucucaagagccagaaaaugaucuugcaugcugugcu

SEQ ID NO: 4188102 - RNA, 83 nt, Human
agcacucagagcacagcagaucucugaugggggccccccaaaucucuuccucccugagucagaucaggcugugacaugguguu

SEQ ID NO: 4188103 - RNA, 57 nt, Human
agcacuccugucuuuccccuuugaaacauaaaagguaaagacugcaaggagaaugcu

SEQ ID NO: 4188104 - RNA, 66 nt, Human
agcacugcugaccuucagggcugcuuccaucccuggugggggccguccuggggauuauagaguguu

SEQ ID NO: 4188105 - RNA, 69 nt, Human
agcacuguccauucacucauauucaggcauugaaguguaugcaugaaggugauuaugaauguauaggcu

SEQ ID NO: 4188106 - RNA, 62 nt, Human
agcacuuaugugauuaggacagguccacuagauaaucucccugucuuaaaaucaucugugcu

SEQ ID NO: 4188107 - RNA, 84 nt, Human
agcacuugucaagcuuuuuuggagaauguuuuggucagaaugacaagauaauuugugacugaggcuccaagcuagagaaguguu

SEQ ID NO: 4188108 - RNA, 108 nt, Human
agcacuuuuggcauuucuauuaaagacacaggcugucuggaacagaugacuuuaccauaaauacuugucucugagccguauggcuuggcuaguggcuuggcaagugcu

SEQ ID NO: 4188109 - RNA, 62 nt, Human
agcagaaaacuuucaugcucugaacccugaagagaaagaauuugccuaugaggguuccugcu

SEQ ID NO: 4188110 - RNA, 57 nt, Human
agcagaaacagccagucuggacucuucuccguccccgagccagauggccagucugcu

SEQ ID NO: 4188111 - RNA, 72 nt, Human
agcagaaagcccggucccaggugccccggugacgccccugcuugugucuggcuccaggaccgggcacaugcu

SEQ ID NO: 4188112 - RNA, 61 nt, Human
agcagaacugaugagacuugagggaaggguccagggccuguauucagucagagucacugcu

SEQ ID NO: 4188113 - RNA, 59 nt, Human
agcagacauaucucaugucacaucuuuuuagaccaggcugagcuuauauaugugcugcu

SEQ ID NO: 4188114 - RNA, 60 nt, Human
agcagagcagcaaauggaaaggaaggaaaauuacuauccuccuccuucuguugcuuuucu

SEQ ID NO: 4188115 - RNA, 58 nt, Human
agcagagcccagguccuggagagggaggugccucccguccccauucuuggguuccccu

SEQ ID NO: 4188116 - RNA, 81 nt, Human
agcagagcguuucuaagcacaugugaguguuucuaccuguggaauggcacacuuuauguagccuuggaguuuagauuugcu

SEQ ID NO: 4188117 - RNA, 91 nt, Human
agcagauaaccacacuuuauggaaaacuccagagaguagaugauucuuuaucuauucucuucagggacuuugcuauuagugucuuacugcu

SEQ ID NO: 4188118 - RNA, 75 nt, Human
agcagaugucuuugcuuuuuaaaaaccucucagacauuuguagugagggugcaaaagcaaggacaguaaacugcu

SEQ ID NO: 4188119 - RNA, 75 nt, Human
agcagauuugugucuaugguuugagcauccccugccuagaaagaagcaaaagaucucaaaucagggacaucugcu

SEQ ID NO: 4188120 - RNA, 55 nt, Human
agcagcaaagaauaggcccucugcuaauuaccccaggggccagcuuucugcugcu

SEQ ID NO: 4188121 - RNA, 65 nt, Human
agcagcaagggauaaacaaggacguugcuucaugaauggcagaguuguccugaguucuagcuguu

SEQ ID NO: 4188122 - RNA, 71 nt, Human
agcagcagccucugggcacgcaggaagagccauauggccagcuccauccagcugcaaggggcacagcuguu

SEQ ID NO: 4188123 - RNA, 57 nt, Human
agcagcagggacaaaggaacagguaacuucauagccuuguucacaguaguugcugcu

SEQ ID NO: 4188124 - RNA, 62 nt, Human
agcagcaguguucuggaauucuaugugagugacaaacacucagaacccagcagcacuguucu

SEQ ID NO: 4188125 - RNA, 81 nt, Human
agcagcaucuucuguucuccgccuuagagagauucacuuaaaaucccgaagucccagauguggacgacaauggaagcuguu

SEQ ID NO: 4188126 - RNA, 57 nt, Human
agcagccagagaaugaugcaguaugauuaacuguuggagaagaucucucuagcugcu

SEQ ID NO: 4188127 - RNA, 59 nt, Human
agcagccuuugaucaucugggaagucauugacuuugauccuuauccuaucaggggcucu

SEQ ID NO: 4188128 - RNA, 57 nt, Human
agcagcuauugccaggcaugagcaaaacacagacucaugugcagcaagcagcaugcu

SEQ ID NO: 4188129 - RNA, 66 nt, Human
agcagcucuggcacuguagcauuucuguggucagggaagaguuugcacaguguccauacagguguu

SEQ ID NO: 4188130 - RNA, 61 nt, Human
agcagcugagaaucuuccccaguguuguguagcacuugguaggacuucagugaaaugugcu

SEQ ID NO: 4188131 - RNA, 56 nt, Human
agcagcugauggggaaggaguugcuauuagcuuaaccuuucgggacuggagcugcu

SEQ ID NO: 4188132 - RNA, 59 nt, Human
agcagcugccacuggaauaggagccuucagacguugguuuuaagccuaguucagcuguu

SEQ ID NO: 4188133 - RNA, 56 nt, Human
agcagcugcuuuucuucauugguaaguuagaaagcauuaaaagaagaguauuugcu

SEQ ID NO: 4188134 - RNA, 57 nt, Human
agcagcuuucugggacagaaaggaaucaaagcuucuucucugagcuaggaaugcucu

SEQ ID NO: 4188135 - RNA, 76 nt, Human
agcaggaacagauuucaucagcaccuugaucuuggacuucccagacuuuuagaauggugaggaauaaauuucuguu

SEQ ID NO: 4188136 - RNA, 91 nt, Human
agcaggacgguuaagguuucaagggaacuguuuugguuaccugaaaggcaaccccccagauaaucccuugaggugucuuugcuguuuugcu

SEQ ID NO: 4188137 - RNA, 64 nt, Human
agcaggacugauguuccuccagcccccuuggcccauuugguggcugcaaaacuucaguccuacu

SEQ ID NO: 4188138 - RNA, 58 nt, Human
agcaggagaacacuguggcucucggauccaggagaggcaggccacgagggcuccugcu

SEQ ID NO: 4188139 - RNA, 56 nt, Human
agcaggagcauuuccaugauucuuaauuaaauccaguaguuuuuggaaauccugcu

SEQ ID NO: 4188140 - RNA, 70 nt, Human
agcaggaggcauauuuaaauccaaugguauuuuuuaccuccguuguauuguuauucugugcucuuuuguu

SEQ ID NO: 4188141 - RNA, 56 nt, Human
agcaggaggccagguaugcuuuaucccugugggugcaagcccgucugccaccugcu

SEQ ID NO: 4188142 - RNA, 73 nt, Human
agcaggcugcagaggacagggauuuagauugggaaacucuuuguauucuaucaagcugucuucuuuacuggcu

SEQ ID NO: 4188143 - RNA, 66 nt, Human
agcagggaccagggccagauccaucuucgagucugucagaacaaugggcaagucuuguucccugcu

SEQ ID NO: 4188144 - RNA, 58 nt, Human
agcagggacuagccguaggauggaaaagcacucaggccuuucugucucuguccuugcu

SEQ ID NO: 4188145 - RNA, 93 nt, Human
agcagggagcaaaguugcagaaaauuaauauuugccacaaagaaguccuuuucuuccugugccuuaugaauucuuucuguacaagcaccuguu

SEQ ID NO: 4188146 - RNA, 98 nt, Human
agcagggagggggugacaaauauuugaagaggcuguccagauacaggcguuucccuaaauuucagucagccuguuuguuuaucgcugccucuaaagcu

SEQ ID NO: 4188147 - RNA, 69 nt, Human
agcagggccagggaaacgaucagcagaacuggugggaaagaucugggcuaaugguccuggccucaggcu

SEQ ID NO: 4188148 - RNA, 55 nt, Human
agcagggcucacauuaguggauaaaagcaggugugcgguugacuauggccuggcu

SEQ ID NO: 4188149 - RNA, 63 nt, Human
agcaggggcagcagcacugacugguccgcuaauuccucucgaccuuggcugcugcuuccugcu

SEQ ID NO: 4188150 - RNA, 88 nt, Human
agcaggggcagccugagcagugacuggagcaugagaagaaacucacaauaucuucucucucugcucuauuacucuuugugcaucugcu

SEQ ID NO: 4188151 - RNA, 89 nt, Human
agaaggagaagcacacaccaguuuguaaccuguuuucaucuaaaugauaugguagacauuucuacauagcuuuuguaauucucucuucu

SEQ ID NO: 4188152 - RNA, 66 nt, Human
agaaggcaacuguaaaacaugcacaauuucacaauguaccuggcauuuuuuaguauagugccuucu

SEQ ID NO: 4188153 - RNA, 59 nt, Human
agaaggcagaugggacggagcagguggagagacgagagcuuggauucguccagccuucu

SEQ ID NO: 4188154 - RNA, 60 nt, Human
agaaggcucacuaagagugacugcauuagcauaaauucagguaugguuauugggccuucu

SEQ ID NO: 4188155 - RNA, 62 nt, Human
agaaggcuccagugaaugcuggcacguucagccaggaugccuccgugaagcuggagaccucu

SEQ ID NO: 4188156 - RNA, 57 nt, Human
agaaggcuuuucuaccagaucuuuacauggcaggauccuccuuagaaaagaccuuuu

SEQ ID NO: 4188157 - RNA, 76 nt, Human
agaagggaaauguaguauguugcauguaucaaacuaccuugucugauuuauguccaaaauacuuauuuaccucucu

SEQ ID NO: 4188158 - RNA, 65 nt, Human
agaagguauagcuaauugagcccugaaugcauauagacugggguuuacuuuagaaauugccuuuu

SEQ ID NO: 4188159 - RNA, 98 nt, Human
agaaggugcaacuuuucuuaaguauuucagagacugaugauuuaucagcuucgccuucauuagauuuauaugguacauaggauuuguuugucacuucu

SEQ ID NO: 4188160 - RNA, 65 nt, Human
agaaggugcacacagccccacggugagcaaagggaaaccucagagcuccuaagggcugauuuucu

SEQ ID NO: 4188161 - RNA, 65 nt, Human
agaaguagaaagccucguaaauauuuugucugcuaaucauguguuuacagggugauuuuaccucu

SEQ ID NO: 4188162 - RNA, 73 nt, Human
agaaguagugggagguaagcuggaaaaguuggugcccuucugugaacuuccccagcauccucagcucacuucu

SEQ ID NO: 4188163 - RNA, 63 nt, Human
agaagucaauuagcuaaaauuugguaaucauguuuuugauaucaugugcgcuuauugauuuuu

SEQ ID NO: 4188164 - RNA, 57 nt, Human
agaagugagacucaguugaugaacugaaauaaaagagaaaauugagucucaacuucu

SEQ ID NO: 4188165 - RNA, 59 nt, Human
agaaguggggaaaacaugcuguguaguuaauuaggcccagcagaguaauucucaccucu

SEQ ID NO: 4188166 - RNA, 71 nt, Human
agaaguuugaaauauuucuacaaugaaaacaccagaccaugugguuuuuauuggagugauaccaagcuuuu

SEQ ID NO: 4188167 - RNA, 58 nt, Human
agaaguuugguccuuuucaaggccuaauuuuacugugaguuuauaggaccaaacuucu

SEQ ID NO: 4188168 - RNA, 90 nt, Human
agaauaacaugcuccaccacagucuacuaaacaucaucagcgaucacgucccugagagguaagcagcgcaguggugaagagguuaacucu

SEQ ID NO: 4188169 - RNA, 64 nt, Human
agaauacaguaggagccugggcaucuguugacuuuuucugccuugcucacuuucacuguauuuu

SEQ ID NO: 4188170 - RNA, 83 nt, Human
agaauauaucucagaguuuugggaagccauaaggauacuuaacaugcccuuucaucuggcuucuggcuggugagaaauguucu

SEQ ID NO: 4188171 - RNA, 79 nt, Human
agaauauccacacugaggagauugauauucgaaugauuaacuuucuuuaaaauguuaaaaccuucagugcuuaguaucu

SEQ ID NO: 4188172 - RNA, 86 nt, Human
agaauauuccauagacuuuccuuuucucuaguaagcuuuauauuguggagccuagaaagagaaaagacucuaaguuuguauauucu

SEQ ID NO: 4188173 - RNA, 102 nt, Human
agaauauugucuaaaaauuagauucaauggaguauuuuucaagcuguauuaugaaacugauuucuauuguuaaaacuccauugguuuggaaagauuuauucu

SEQ ID NO: 4188174 - RNA, 130 nt, Human
agaaucaccuggcagcuuucaaaaaacucugaugucugccccucaccuccucuugccgagguccacagaaucuccaagguggggcccuggaaucagcauuguuagagguuccagugugaugccgaagucu

SEQ ID NO: 4188175 - RNA, 74 nt, Human
agaaucauguacuucuuaaauuaggaucaaaaguuuuacuucuuuggaccugaagaauaggaaguauucguuuu

SEQ ID NO: 4188176 - RNA, 79 nt, Human
agaauccaagccucaucugugcccaugcuggcauucagauauaucuggacauggcuaugguauugauggguuuguuucu

SEQ ID NO: 4188177 - RNA, 83 nt, Human
agaaucgcuugaacccuggaggcggauguugcagugaccgagaucgcgccacugcacuccagccugggugacagagcgagacu

SEQ ID NO: 4188178 - RNA, 79 nt, Human
agaaucuauugaacacucacaaucuugccuuauaaacagauuguaaacaugcugaggcuggagaugaucaugugauucu

SEQ ID NO: 4188179 - RNA, 97 nt, Human
agaaucucaguuucucuuccagcuaacucacaucccuuccccuuccucggaucuaagaagaaaugcugauguuggaugggugggaaccuggguuucu

SEQ ID NO: 4188180 - RNA, 60 nt, Human
agaaucucuggggauggaccugggagauguauauuuuuuaacaaguccccuagagguucu

SEQ ID NO: 4188181 - RNA, 79 nt, Human
agaaucuugcucugaggcuggagugcaguggugcuaccuuggcucccugcaaccucugccuccugguucaagugauucu

SEQ ID NO: 4188182 - RNA, 71 nt, Human
agaaucuuuccgagaaacugcuuugugauuagugcauuuaucucacagaguuaaaaguuucuuuggauucu

SEQ ID NO: 4188183 - RNA, 62 nt, Human
agaaucuuucugaaugacuguguuucccuucaagguggguuggauagcaugcagaagaaucu

SEQ ID NO: 4188184 - RNA, 58 nt, Human
agaaugcagaagcaccaggauucaagacuagaauaucugaccucguuugcuguguucu

SEQ ID NO: 4188185 - RNA, 60 nt, Human
agaaugcaguuugaaauaagguagcguggaauugggcuauuuuccuuuuaacuguguucu

SEQ ID NO: 4188186 - RNA, 59 nt, Human
agaaugcuuguaccuuuguuuuguuggggaauucacugaagagggagguacaagauuuu

SEQ ID NO: 4188187 - RNA, 76 nt, Human
agaaugggguagugggcagccuggcaggcagggugccaggcacagaggccgaaacccaggcagccugcuccauucu

SEQ ID NO: 4188188 - RNA, 56 nt, Human
agaaugucaacagccucucaagcuggguccugcguugauugcuuuugugacauucu

SEQ ID NO: 4188189 - RNA, 110 nt, Human
agaaugucuuagguggagguuaaguagucuuugaaagugauggggaagauggauuugugcugaaccucuucuaccauuuacauuuuguguuuuaaccucacagauauuuu

SEQ ID NO: 4188190 - RNA, 89 nt, Human
agaaugugggugaaaagacugagaguaauuuucuacuugaagcagagucuucacugaaaaccauacuucuuucugcaugcccacacucu

SEQ ID NO: 4188191 - RNA, 60 nt, Human
agaauguugaaaagggagauggugacacugcagacaaacuuuucucucugauaacauuuu

SEQ ID NO: 4188192 - RNA, 116 nt, Human
agaauguuugguaaauguuuggaaaaugcagacuuccaaagaagugauuacagagccuuaugcuuggauggugucuuuuuucugggagcgucuucaagcauuuuacaaacuuaucu

SEQ ID NO: 4188193 - RNA, 73 nt, Human
agaauuagauucuguggauuacagauuuguaaguaggaaacugacaaaucuguuuuauagacuuuuaaugucu

SEQ ID NO: 4188194 - RNA, 57 nt, Human
agaauuagcagagaaggugucuucgaauucccagaggagcuucuucugucuaauuuu

SEQ ID NO: 4188195 - RNA, 118 nt, Human
agaauuagcuggaacauuugguaaagguuuagaucucagacccaacaccaggcugaauuagugggucuggaguagggucugggaauugauauuuuuagcagauguuccaggugauuuu

SEQ ID NO: 4188196 - RNA, 69 nt, Human
agaauuccacacagugcuguuuguaaagagaaaugaaucauuuuuucccauuuaggcauugggaauuuu

SEQ ID NO: 4188197 - RNA, 100 nt, Human
agaauugaauacaggcagccuuugcuuugcacagugcuguguuaacugaaacucauuuguaucagaagugugcaaagcaagggcugcuguaugcuuuucu

SEQ ID NO: 4188198 - RNA, 60 nt, Human
agaauuggcugaggcugccaggcuggcaucacagcuuggcuucucccucugccugauucu

SEQ ID NO: 4188199 - RNA, 98 nt, Human
agaauugggaaaaugaucauacagagcccugguaacagucaucaucaucauccauugcuguuuacaaaggagacucuguauuuaaccacccaggaucu

SEQ ID NO: 4188200 - RNA, 94 nt, Human
agaauugguguauaucacaucucuggcuuggauuaugguuggaaguggcccagugccugucaaaccucaucucucacugaauauaacaccaucu

SEQ ID NO: 4188201 - RNA, 87 nt, Human
agaauuucugccuuggucaaaaacucucaguggacuguagcccaggccuuuggucugcugagaguuucugacugaggcggaaaggcu

SEQ ID NO: 4188202 - RNA, 59 nt, Human
agaauuugacaaauauuuauuggcacauauuuuaagugccaggccuauuguuaaacucu

SEQ ID NO: 4188203 - RNA, 79 nt, Human
agaauuuugucagaaauguaagcugaugacugcuauaugauuacagugaagucaucauuuauaucaagucuguuauuuu

SEQ ID NO: 4188204 - RNA, 130 nt, Human
agacaaagccuuacuagcuuuaggaucuuggcuauaaaugguaaauuaguaguagcuuuugaaauccuugggcauucaaguuggcuaauuuuuucauuuuauaagaggaagguugggacagcugauaucu

SEQ ID NO: 4188205 - RNA, 72 nt, Human
agacaaaggagauguuugacauaaacacuuugguagcagaauuuacaguguuuauuagauuucccuuuguuu

SEQ ID NO: 4188206 - RNA, 71 nt, Human
agacaaaucagauaaaaaauugaggcauuaacugguaguuagguguguccaguuuuuucucugcuguguuu

SEQ ID NO: 4188207 - RNA, 79 nt, Human
agacaagagcugaggacauauucuagcccccaagaagugcuggaguauucccacuccucagcaauuuuuacuuuugucu

SEQ ID NO: 4188208 - RNA, 56 nt, Human
agacaaugcaagcagggaguggggaaaauuauccuucccuucuccugcauuggucu

SEQ ID NO: 4188209 - RNA, 66 nt, Human
agacacacacauacauaugacaacuuuccuguaaagguacagcuguguguguaugauaucuugucu

SEQ ID NO: 4188210 - RNA, 85 nt, Human
agacacagcucugagcuaaaauguguuuuucucagccuuaggucaucgggcucaguugcauauuuuguguucucugucuuguucu

SEQ ID NO: 4188211 - RNA, 67 nt, Human
agacacaggcucagaagccaguggagccuuucaggguggggaccucacugguuuuagggucacgucu

SEQ ID NO: 4188212 - RNA, 63 nt, Human
agacacaggcugccacuugcauccaaaacguuugggugccuuaagugagugccucacuugucu

SEQ ID NO: 4188213 - RNA, 78 nt, Human
agacacugauuucagggaugagaagaaacaggugucuuagaaacacgguacucuccacucauccucuggaauccuucu

SEQ ID NO: 4188214 - RNA, 112 nt, Human
agacagacgcaggaacagcauggcccuaagguaugugcuggguguucucuuagccugcggcagacauccuggggagggcaaugccugggggagcugaugccugggugagucu

SEQ ID NO: 4188215 - RNA, 110 nt, Human
agacagauacucagugggcuggggucagccagcauuaccccugacuugaacuguggaacaauucagccaagugauguggcugcacccuggcaucacccuaaccuuugucu

SEQ ID NO: 4188216 - RNA, 68 nt, Human
agacagcauggauaacaaggcacuacacauuugcccaaggauguugaguguucccuguucaugcugcu

SEQ ID NO: 4188217 - RNA, 59 nt, Human
agacaggccaaaauucaggcauucuggggucccacaugugcuuguuuuggcccuuguuu

SEQ ID NO: 4188218 - RNA, 87 nt, Human
agaucaacagaucguggguagaaagauggaacguugaagccaggcaaccaaacuugaauuuucuucuucuugccagaugugugaucu

SEQ ID NO: 4188219 - RNA, 63 nt, Human
agaucaacucagaauccugcugauaugguuugaauaccuggauccaguugagacugaagaucu

SEQ ID NO: 4188220 - RNA, 58 nt, Human
agaucaaggacaugaagaggcugagugccuccaugagcuucauuauuuuccaugaucu

SEQ ID NO: 4188221 - RNA, 58 nt, Human
agaucacagagccaagauuccacuugaggcagcauggcuauggcuggcucugucaucu

SEQ ID NO: 4188222 - RNA, 61 nt, Human
agaucaugcagcuaauccaauucaguaguuaagaaaauugaaaagaccagcugugugguuu

SEQ ID NO: 4188223 - RNA, 108 nt, Human
agaucaugcuuaagcaacauguagcagcaacuuauuuuucuuaucuuuauauagauuuacugaaggguagguuguuugaaaauggauguagcuuuggggcacaagucu

SEQ ID NO: 4188224 - RNA, 127 nt, Human
agauuuagaaggaaccugguaguguuccugggagacagaagacagaguguucaucuuugccauaugcagagugucucuugcaguuuucucuuuaccucacuggcacugcugaaauccuucuuagacu

SEQ ID NO: 4188225 - RNA, 105 nt, Human
agauuuauuuucauuauuuuuuuaagucagggaguaagaccuuuaccagaaauuauccccccagcagacuuuuucugggucuauuccuacugugaaucaagauuu

SEQ ID NO: 4188226 - RNA, 69 nt, Human
agauuucacaugcaggagccaauguacauguauuuacuuugcuguauucuguuuuuuugugugguuuuu

SEQ ID NO: 4188227 - RNA, 87 nt, Human
agauuucagaaguuuuguguacaguauguucuugaauuugggcuuaagcucagacugacauauaguauuucaucacuaaugugaucu

SEQ ID NO: 4188228 - RNA, 75 nt, Human
agauuucagggcuacugcugugacaacaggguagggcagaaaggguacugcucugggauucagcagccuggaucu

SEQ ID NO: 4188229 - RNA, 58 nt, Human
agauuucuuugaauuagagagguuacuuuucagugaguuuuuuaauucaggcagaccu

SEQ ID NO: 4188230 - RNA, 66 nt, Human
agauuugccgacugcuuugccucacucugaaauccuuaggcagugcaugcaaaggucggugaauuu

SEQ ID NO: 4188231 - RNA, 57 nt, Human
agauuugcggcuuuacuuugcacgcaugcugcguagaggggaauuugcugcggguuu

SEQ ID NO: 4188232 - RNA, 98 nt, Human
agauuuuccaaugugugcuuacaggccaguggcaucauccucagucacagguuaaagggcagcuagggcuggccugcugggcaccaccgugagaaucu

SEQ ID NO: 4188233 - RNA, 83 nt, Human
agauuuugccucggguuuuuaaagauguuuuauaaguuaugggucucuuuaaaauuuuuaaucaucuuaaugagguauaauuu

SEQ ID NO: 4188234 - RNA, 80 nt, Human
agauuuuguugguuauguugaggaccgguacacaaacauuucaauuuguacacaauucuuaacauacauaugaaaaaucu

SEQ ID NO: 4188235 - RNA, 89 nt, Human
agauuuuuauugguuuaauuuauuuggaaauuuucauccagacauguaauuuaugucuauuaauuccacauaaaauaacuuuaaaaucu

SEQ ID NO: 4188236 - RNA, 66 nt, Human
agauuuuuuccguuugguguuccgcuagucuuugaacccugguggcauggaccuuggaagaauucu

SEQ ID NO: 4188237 - RNA, 55 nt, Human
agcuuugcaaccugaggccaguuacuuuccucucuuggcuucaguuuagcaggcu

SEQ ID NO: 4188238 - RNA, 61 nt, Human
agcuuugcucugugaauaaaagagguuguuccucaugcugcuuuauucacagagaagaguu

SEQ ID NO: 4188239 - RNA, 60 nt, Human
agcuuuuaaagacuuugaauccagggaaaugucacuucugggcauggagcuucagaggcu

SEQ ID NO: 4188240 - RNA, 78 nt, Human
agcuuuucccaggcaguagaaagaagaggaagauggccuauguuuugcccaaggccucauucuuucugugccgaagcu

SEQ ID NO: 4188241 - RNA, 56 nt, Human
agcuuuucuauggucuuaggaaagggcacaugugacuccugagaccugggaagguu

SEQ ID NO: 4188242 - RNA, 86 nt, Human
agcuuuuguuugucugggaaagucuuuauuucucuuucauguuugaaggauauuuuuaccagauauacuauuacaggauaaaaguu

SEQ ID NO: 4188243 - RNA, 84 nt, Human
agcuuuuugaaauaaaguagcguuuaaggugcacagauuuauccuuucuuuggggcaucuuaaggucuacugauaucaaaugcu

SEQ ID NO: 4188244 - RNA, 88 nt, Human
aggaaaaagauagaaauaaagguacuaagggaauauagauaggaaguuguaucuuucuguacuuuuaugauugacuacauuuucuccu

SEQ ID NO: 4188245 - RNA, 70 nt, Human
aggaaaacugaggcauuaaagggaaucuucuuuggagacagaaaguguuccuuugauccuuauccuuccu

SEQ ID NO: 4188246 - RNA, 56 nt, Human
aggaaaaggugccuuuugcuaauucauacaaagacuagcagagaucauuuucuccu

SEQ ID NO: 4188247 - RNA, 89 nt, Human
aggaaacaugagcucuaguccugauaucacuguugaguaggcccaugagguuuuuccagugaauuagucuguuuuggcuucauuuuccu

SEQ ID NO: 4188248 - RNA, 62 nt, Human
aggaaaccaggacugcaccgucuccuucaaaaacagcagacccgugccacucguggcuuccu

SEQ ID NO: 4188249 - RNA, 86 nt, Human
aggaaacuaagacugagagacuaagugcuuugcccaagcucaccuggugugccaugcagcugccacuugcucucggcucccuuccu

SEQ ID NO: 4188250 - RNA, 59 nt, Human
aggaaacuguccccucauccuaggaguuggaaacugugaugaugaggaacagucauccu

SEQ ID NO: 4188251 - RNA, 75 nt, Human
aggaaagagcccagaguuaggagguggaauguggggucccacagcugcccccucucuaacucccugcuuccuccu

SEQ ID NO: 4188252 - RNA, 82 nt, Human
aggaaaggaagaggaaggucccaucagaauuugggcaaaggcucauguguuuugguggaucauucaagcaagucuguuuccu

SEQ ID NO: 4188253 - RNA, 119 nt, Human
aggaaaggggacauauguuuggcuuccuucaaggcaguauucaaagaagccuguaggcagugaguuacaggaguuuaagaaauauuuccuaagggaaacuaugaaggucuuuauuuccu

SEQ ID NO: 4188254 - RNA, 72 nt, Human
aggaaaggggcaacaaggagggaaaggggguaagauuuauuaccuucaauuauuuuuguuccaaacuuuccu

SEQ ID NO: 4188255 - RNA, 56 nt, Human
aggaaaguagauuguaguacuaguacuacugcuaguacuacguuuucuacuaucuu

SEQ ID NO: 4188256 - RNA, 68 nt, Human
aggaaauaagcuggagcuauauugagcacguagagccugcuccguuuggaaagccagcuugaaguccu

SEQ ID NO: 4188257 - RNA, 55 nt, Human
aggaaauauugucauggugauuuuuacaagccagucaccugcaguaauaauuccu

SEQ ID NO: 4188258 - RNA, 65 nt, Human
aggaaaucacauuguucuuaguuuaccuucccuuuaaaggaaagcuggggaauauguuaaauccu

SEQ ID NO: 4188259 - RNA, 60 nt, Human
aggaaaugcaggcaaauacucuuccuugaguuaaaucugaugucuguuuccugcuuuccu

SEQ ID NO: 4188260 - RNA, 81 nt, Human
aggaaaugugugacaacuaaauauagucaaaucaaggcagcagcagugaguucuauuuuggcugauucaucaugugaaccu

SEQ ID NO: 4188261 - RNA, 60 nt, Human
aggaaauguuuagcauccacuuuuaaaagcaugaggagaggggagagcuaagcaauuccu

SEQ ID NO: 4188262 - RNA, 68 nt, Human
aggaacaacugauucagucaacccauaucaucuugggucaggauuggugcugauucauuuugauuccu

SEQ ID NO: 4188263 - RNA, 90 nt, Human
aggaacacagccauacuuacuuauucacauauugucgguuguugcuuugaggcugcaguagcagagcugaguaguuguggcaaagacccu

SEQ ID NO: 4188264 - RNA, 82 nt, Human
aggaacacaggccaaacuuucugucugagcugcagaguauugaaacuuagauugugagcugggcaggaauuccuguggcccu

SEQ ID NO: 4188265 - RNA, 67 nt, Human
aggaacacaucuuuguagcagggcugcagagcaugcagccuggccuagaccgcaaggauggagucuu

SEQ ID NO: 4188266 - RNA, 62 nt, Human
aggaacacccccuuccuaccagcaucuccccucaggcugauaggugggagagguggugcccu

SEQ ID NO: 4188267 - RNA, 67 nt, Human
aggaacagccaggggcuggcguguugaugguagaaaccauuacagaguucgcaccugguggguaacu

SEQ ID NO: 4188268 - RNA, 70 nt, Human
aggaacauguaaauaucauuguacugggcuuugcauucuggcugaacagcacaguggcuuacguguuccu

SEQ ID NO: 4188269 - RNA, 60 nt, Human
aggaaccagacagaacugaauggagaaagcagaacaagacgcaugguucgugugguuucu

SEQ ID NO: 4188270 - RNA, 66 nt, Human
aggaacggacaaaccuuguaaaugccaaacuaguugaucccaaagcuagcuacuagguuuccuccu

SEQ ID NO: 4188271 - RNA, 82 nt, Human
aggaacugugagacugaguccccaacuaugauguauuucaaaugcauuccacacccauagagauuuugaucucaucaguccu

SEQ ID NO: 4188272 - RNA, 83 nt, Human
aggaagaaauaucgcauuuguuaaagcauguuggcacugcauucaacaucauugauuaguaaauugugaucauuuucucuccu

SEQ ID NO: 4188273 - RNA, 79 nt, Human
aggaagaagcugaaggaggcucugguacuacucaacauuguacuccagguagaaccaccuucuccuuuaccaccuuccu

SEQ ID NO: 4188274 - RNA, 62 nt, Human
aggaagaauguuuacauaucaaaguggauaacauuucaugcugguggaaggcgcuucuuccu

SEQ ID NO: 4188275 - RNA, 129 nt, Human
aggaagagaaggguuuguggaaguaaaucuguccugugacagugggaggaccagccagcugaccuggucaccguuucuucuguucuagagacaugcugaucuagauuuuaucagguacccuucucuccu

SEQ ID NO: 4188276 - RNA, 66 nt, Human
aggaagagagguauagaagcaacacacuuuucugaggaagaaaagucucuuuacaugucucuuccu

SEQ ID NO: 4188277 - RNA, 55 nt, Human
aggaagagcaucuuugggucugcauaaauuuacacaggccauggugaccuuuccu

SEQ ID NO: 4188278 - RNA, 56 nt, Human
aggaagagguagcugucaaggggaaaggacaagguccuugaagauacaaguuucuu

SEQ ID NO: 4188279 - RNA, 96 nt, Human
aggaagauuaucuauguggauuucaccugaucuugucaucuuacuauuuaauaggagagguccccuugugaaaugggcauaguuuuggguuucccu

SEQ ID NO: 4188280 - RNA, 65 nt, Human
aggaagcccagagucaagcuuaccauuaaauuuuuguguaacgguaauaaagacuuugcuuuccu

SEQ ID NO: 4188281 - RNA, 65 nt, Human
aggaagccucaccuuuuagaagcuacucagguaaaucuguacaugguaguagggugagguuucuu

SEQ ID NO: 4188282 - RNA, 81 nt, Human
aggaagcugggaaacugacauugauauuuauacaauccaucaaucuuuuucauguuucaccaguuuuauaagaacgguccu

SEQ ID NO: 4188283 - RNA, 72 nt, Human
aggaaggaaaggaaguguuaccuguaaaaucuucacgauuucaacagcauaaucacuucuuucuuaaauucu

SEQ ID NO: 4188284 - RNA, 120 nt, Human
aggaaggacagaguguuuccagacuccauacuaucagccacuugugaugcuggggaaguuccucuacacaaguuccccuggugccacgaucugcuucacgagucugggcauguccugacu

SEQ ID NO: 4188285 - RNA, 81 nt, Human
aggaaggaggccaggcccucaagccugagguuggaaggaaggggcagcguugaguagggugagggucuggccuugaguucu

SEQ ID NO: 4188286 - RNA, 99 nt, Human
aggaaggauugggucauuagcuuggccuuucacacucccaaauuguuggguuaggcaaggacuggcagugugaggggucagaccacagcaauuucuccu

SEQ ID NO: 4188287 - RNA, 56 nt, Human
aggaaggcaugagguguucacagugggcuucgugaguuuugcuucaucccgauccu

SEQ ID NO: 4188288 - RNA, 59 nt, Human
aggaagggaagagggcuuuggaguuugaagaacgacauuccaagcucaacucccuuccu

SEQ ID NO: 4188289 - RNA, 62 nt, Human
aggaaggggcuuaugaagacgugagguccuugggcccuugaaagucacaugcagcccugccu

SEQ ID NO: 4188290 - RNA, 81 nt, Human
aggaagguaagcagagagaagaaagccaugguccuugucacaguugugcuuaguacccuuuuauuuuauguauacauuucu

SEQ ID NO: 4188291 - RNA, 59 nt, Human
aggaaggugacaguguccaccuacccauuccccaguagcuggccacauugugccguccu

SEQ ID NO: 4188292 - RNA, 61 nt, Human
aggaaguaaggcagguagaugacuacggagaaagucaguagaaaggaucuggcuucuucuu

SEQ ID NO: 4188293 - RNA, 77 nt, Human
aggaaguacuuggaaaaaugcccacuccaguuguuauuuguaaaauguccaguuggcauuuuauuuaaguauauucu

SEQ ID NO: 4188294 - RNA, 107 nt, Human
aggaaguauggaggcugcucugugacucccucuuccucucuuccccgcucuaugugugggaaugacgaggaagaggaaaggaguaagaggccuggcucauucuuccu

SEQ ID NO: 4188295 - RNA, 67 nt, Human
aggaagucucucaaaacuggaagggaaagguguuuucuccacaucaauccaguuuuggagacauucu

SEQ ID NO: 4188296 - RNA, 67 nt, Human
aggaagugcggaaggucagaggccgggcucagcugaccgccuggucccuggaccucccuggaccccu

SEQ ID NO: 4188297 - RNA, 76 nt, Human
aggaaguuggcaaggaggcagugggacuugaauauccgagaaaagccgguuucuccucuguuaccuugcaaauccu

SEQ ID NO: 4188298 - RNA, 106 nt, Human
aggaauaagaucaucggaaauuaucauagaaucuuuguaaaacacuuggaaaauccaugguguuuuacugggugcucagaugaugcucaauauucauuaaguuccu

SEQ ID NO: 4188299 - RNA, 130 nt, Human
agccuuagaagcaccuguagagcuuggagauggaagggggugcuacuuccagaguuucugacuuuaguaggucugggaugaggaccugagaaucuguauuuccuacaaguuucuaggugaugaugauaau

SEQ ID NO: 4188300 - RNA, 83 nt, Human
agccuucacuuuacauuugaucucucuaaaguuuuugaagguuucgagauguucuuuauuuggggagaaaugaaaugaagucu

SEQ ID NO: 4188301 - RNA, 61 nt, Human
agccuucagcaguucaggugccuggugguagauggggcugacuggaugauugagaaaggcu

SEQ ID NO: 4188302 - RNA, 63 nt, Human
agcaaaagccaauguuuaacuuaguggcaaagguuacgaagcuauuaguuaaggcucuuugcu

SEQ ID NO: 4188303 - RNA, 85 nt, Human
agcaaaaguggauucugggagaguucuauacucuauaggucuaucaagauuuaguuucuguuuaaguucucccagaauucaugcu

SEQ ID NO: 4188304 - RNA, 89 nt, Human
agcaaacauuuuacaaguagcuuauuagggauaauagugaaggaagucacuuaaacuagaaaauuccuagaaacuauguguuguuugcu

SEQ ID NO: 4188305 - RNA, 87 nt, Human
agcaaagaccacccagccaacacacagcauugagagcuaaauuuaaaaguaauuguuuuaagccacaaaguuguggggugguuugcu

SEQ ID NO: 4188306 - RNA, 55 nt, Human
agcaaagcugauuaagagcacagacuuuggaaaaggcaguuuugguggcuuugcu

SEQ ID NO: 4188307 - RNA, 76 nt, Human
agcaaagggauguuaguugugagcucaguuccccaccgggccugguguuuccaaauagcccgucacugucccugcu

SEQ ID NO: 4188308 - RNA, 80 nt, Human
agcaaaguuagcuucagcuuaaucucuuagcaaauuaaugaagguuuuuuccuuuaagagauucuaaagcuacugguguu

SEQ ID NO: 4188309 - RNA, 64 nt, Human
agcaaaucaguuaagcuugaauguuggggaagugauuucucuucucccaacuugacuauuuucu

SEQ ID NO: 4188310 - RNA, 79 nt, Human
agcaaaugggccgccagccugugcuuggccaggcggacaugacgagccgccuguggggcugaggcugccuggcccugcu

SEQ ID NO: 4188311 - RNA, 59 nt, Human
agcaaauguugggugaacggcuguuuccucuuauucaagccaugcaccuuacucuugcu

SEQ ID NO: 4188312 - RNA, 95 nt, Human
agcaacauacgaaaacuguucuucauuuucaguauguaucagacacccaaaauacauacugccaaugggguggggaaaggggagcauauguugcu

SEQ ID NO: 4188313 - RNA, 98 nt, Human
agcaaccauuugaucccggcuucauuucaggcugaagaauaauuucuucugguuguuuuucuucggugcuggguugauccuggggccgaguggcugcu

SEQ ID NO: 4188314 - RNA, 65 nt, Human
agcaagaaaauagcuauggaaugucacuucucuuguggaaguuacaagcuauuuuacuuaaugcu

SEQ ID NO: 4188315 - RNA, 127 nt, Human
agcaagaaagcuaccagauaccccucacagcaucuguguguugaguucucagcucugaguaauugucuaaagaauuaagcaaugcuagggcuagauauauaaugucuaaauauguagaguagcugcu

SEQ ID NO: 4188316 - RNA, 61 nt, Human
agcaagagcugcccaaggugaacaguccaacacuugggcuuccccuugggaagcucuugcu

SEQ ID NO: 4188317 - RNA, 130 nt, Human
agcaagaggaauagcagccacaagacucuacucauguacauguaagucagaaaaagaaucccaguucauauuucugugccuacauuugggauuugagaaguaacaagagucaugugcucaaccccuuguu

SEQ ID NO: 4188318 - RNA, 78 nt, Human
agcaagagugagcucgcaugcaugugauuuaggugacguuggugacagaauauuuggcaugcgucuccuacaucuguu

SEQ ID NO: 4188319 - RNA, 55 nt, Human
agcaagauuuuccuugaauguuauuaaugguguucuuauuuaggaaaauguugcu

SEQ ID NO: 4188320 - RNA, 80 nt, Human
agcaagcaaguggcugagcagagauuugaacucgaaagucuagcuccaaagcucaugcucuuagccauguuacguuuccu

SEQ ID NO: 4188321 - RNA, 75 nt, Human
agcaagcauuuugaucagucauaaauuggauccuuuuacaaaaaaggcuuagauugacacugaucucacuuugcu

SEQ ID NO: 4188322 - RNA, 78 nt, Human
agcaagguuaacaugguuguuuacgaaauaaauacaaacuucaguuaguauuucaucuugaaaaccaguuuaagugcu

SEQ ID NO: 4188323 - RNA, 89 nt, Human
agcaaguuguagcugaacugcauuguacuaaacuugucguuaaaauauugauaacaggcaauguaguuguguuauagcuauauuuuguu

SEQ ID NO: 4188324 - RNA, 65 nt, Human
agcaauagacacaagauggauaauauauaaacuucauucguguccuacuuuugugaucuauuguu

SEQ ID NO: 4188325 - RNA, 94 nt, Human
agcaauagcaagaagcccucuuaaugccgagauuguaguuuuucuaaguagaauuucaaacuaauaggaaccaggacuucuuggacaaauagcu

SEQ ID NO: 4188326 - RNA, 80 nt, Human
agcaaucacuuaguauaugacgcuuucaagggccuuucuuggaauuuuccaagucacaaagugcuguacaugggauugcu

SEQ ID NO: 4188327 - RNA, 56 nt, Human
agcaaugaacauauaaagagaucuugaacacaaaagauugaaauuauguucaugcu

SEQ ID NO: 4188328 - RNA, 57 nt, Human
agcaauggccagccacuccugauggcagcccaagcccagccccaguggcugccagcu

SEQ ID NO: 4188329 - RNA, 56 nt, Human
agcacaauauaaagugaacgcacauuucucaaugugcguucacuuuuuauugugcu

SEQ ID NO: 4188330 - RNA, 129 nt, Human
agcacacaguaaagacccuaagcgugaauugguuugcuuggagucagaaggcuugucaauagcuucucuaugauuaaguuuccagauuguaaguccacuacucuuuccucucucuaccuuaugcugccu

SEQ ID NO: 4188331 - RNA, 67 nt, Human
agcacacagugacauuagugagaaaacuagggcugucaguuuucucuauauugucugugaaguugcu

SEQ ID NO: 4188332 - RNA, 70 nt, Human
agcacacgacuuuuguggagucugcggagcaaauagaaaaaugauuccacagcuucgaggucuuuuugcu

SEQ ID NO: 4188333 - RNA, 65 nt, Human
agcacagagcucggggaauggaagaaaggaaggaauauuccaugacaucgccaggcucugcugcu

SEQ ID NO: 4188334 - RNA, 59 nt, Human
agcacagcauuuaaagaaaaugaacucaucuagucauuaaagguuuuaaaugcucuguu

SEQ ID NO: 4188335 - RNA, 55 nt, Human
agcacagcuuagcaccuggcaccucacgggugcuugugaaacugcagcugauguu

SEQ ID NO: 4188336 - RNA, 78 nt, Human
agcacagucugcagggugaacaugugacauccaugcauuaacuaugauuuucaaaugcucauugaugcuacuguaguu

SEQ ID NO: 4188337 - RNA, 67 nt, Human
agcacaguuugggucuccggggcauugagaaagaauuagaaaguguguggggagcuagacuggagcu

SEQ ID NO: 4188338 - RNA, 58 nt, Human
agcacauguauucuccuugaauuauuguuucaggcaaaacaggaagaauacaauggcu

SEQ ID NO: 4188339 - RNA, 56 nt, Human
agcaccaagcaggcucaagcacggcugaaccaagcacugugacccuguuggguguu

SEQ ID NO: 4188340 - RNA, 55 nt, Human
agcaccaggcaguauaucaaaggguggucuacuuauuguguuauuuucugguguu

SEQ ID NO: 4188341 - RNA, 70 nt, Human
agcaccuccaagaagcuuucccugcuugcaccugccccaggcugcauuaggaauugcuccaugaggugcu

SEQ ID NO: 4188342 - RNA, 58 nt, Human
agcaccuggauuugauagucagugagccuugguucuugucugugcuuuuccaguugcu

SEQ ID NO: 4188343 - RNA, 58 nt, Human
agcaccuuguuguagguacaaaagagaacauuucuauuauauuuacacgagaguugcu

SEQ ID NO: 4188344 - RNA, 103 nt, Human
agcacuauaccaacaaauggaaggauuuccaagguaauuuugaguauaaacaauguuugcuuuacucaucgacuuugaaauccuaacaccugggugaaaugcu

SEQ ID NO: 4188345 - RNA, 94 nt, Human
agcacuauuuguuuuccugucuggaacauggccuguucuguugacccgauuuggguuaugauucauguuauagagagucagacaaauaaguguu

SEQ ID NO: 4188346 - RNA, 57 nt, Human
agcacucuuaauucugagaugccugauuagagccucaggggucccaaaagaugugcu

SEQ ID NO: 4188347 - RNA, 57 nt, Human
agcacucuuucagagccagggcuauuuuuuaaaaagcauuuggcacucugaaguguu

SEQ ID NO: 4188348 - RNA, 61 nt, Human
agcacugaaagaaccuuccuguugcuucacauuuuuacaagcauuugguuuugucaaugcu

SEQ ID NO: 4188349 - RNA, 108 nt, Human
agcacugaucaauuagggaaauuguuuuaaugagggagguugauuuugucauguaugcguuaucuuucucuuuucuugaccacauuauccucugggaaucagaaugcu

SEQ ID NO: 4188350 - RNA, 60 nt, Human
agcacugcuuuagagccucugcgugucuggcuguggccucaggggucuagcagcagugcu

SEQ ID NO: 4188351 - RNA, 67 nt, Human
agcacuguauauaaauugucaguuguguauuauauuuaucacuaauggcauccuuuaucugcaggcu

SEQ ID NO: 4188352 - RNA, 85 nt, Human
agcagaaucugaguaaggacauggagaaggaucaucugguuagcacugauucauucugcaguucucagcucagacgucaccugcu

SEQ ID NO: 4188353 - RNA, 69 nt, Human
agcagacaauuuauuagcagauucuguaggcugcaggguugucauuugcuguuauagugauugucuguu

SEQ ID NO: 4188354 - RNA, 94 nt, Human
agcagagccucagauucauauaaauucagaacucagaaaucuuggagaacaucaaggcacugauucucagaguuacugucgugaggaaacuguu

SEQ ID NO: 4188355 - RNA, 60 nt, Human
agcagaggcacaguuuucuacauaugcucccauggagucaaguaggaccuguucuaggcu

SEQ ID NO: 4188356 - RNA, 64 nt, Human
agcagaggcaggcaggagcuggaacacaaucccagcauuuuagcuccugaggccagccucuccu

SEQ ID NO: 4188357 - RNA, 62 nt, Human
agcagagggagccagcagcccgcgguuggcgcugaggcccggcuucugaaaucccaucuguu

SEQ ID NO: 4188358 - RNA, 86 nt, Human
agcagagugauaccgucacauuuaaugauccuacugugaauucaagaauucacgaugaaaguuggauugagcgguauuuugguguu

SEQ ID NO: 4188359 - RNA, 78 nt, Human
agcagcaaauggcuggauuugauccaugggcuguaguuuccugaccccugguauaaaccauuauuuuuugugcaugcu

SEQ ID NO: 4188360 - RNA, 59 nt, Human
agcagcaccuggcuaucugaucccaucuuauggggucaaguaacaaaucaggagcuguu

SEQ ID NO: 4188361 - RNA, 69 nt, Human
agcagcacgggccagucuucuagaaagauugucuuuccgacgcuuccuguaggcagguccaaggcuguu

SEQ ID NO: 4188362 - RNA, 58 nt, Human
agcagcagcucuguugcccuacuccugggguacacuuauuugcagagccuuuguugcu

SEQ ID NO: 4188363 - RNA, 58 nt, Human
agcagcaggaggccauugucuuuaaaagagaaaugaauggcccaggccuccuguggcu

SEQ ID NO: 4188364 - RNA, 58 nt, Human
agcagcagguccagcuuaggcuccagagccuccugcuccucaagugccuccugcugcu

SEQ ID NO: 4188365 - RNA, 66 nt, Human
agcagcaugauuggcauacuuucuauauucaaugcauauugcauugauauguauaauuauauugcu

SEQ ID NO: 4188366 - RNA, 55 nt, Human
agcagccccucggcgggugcgcccggcaaaacccaccagcccgccgggggcuacu

SEQ ID NO: 4188367 - RNA, 69 nt, Human
agcagcccucauggaguucuuuaaauucacagagcucugugccaccugagggacucuagacuugcugcu

SEQ ID NO: 4188368 - RNA, 68 nt, Human
agcagcgggucugcaagccuucccuggggccugcagagcuagaaagggaggcccagcagacuggcgcu

SEQ ID NO: 4188369 - RNA, 61 nt, Human
agcagcuacacaucugugcucugcuagcaagcaugugggcucuguggaugugagagcugcu

SEQ ID NO: 4188370 - RNA, 62 nt, Human
agcagcucacaggauuccugaagauguaacaauuggcucuagggcgccugugcaugcugacu

SEQ ID NO: 4188371 - RNA, 74 nt, Human
agcagcucaggucuucagcagaagcagggagguucucccagugguuuuccuugacugugaggaacuagccugcu

SEQ ID NO: 4188372 - RNA, 77 nt, Human
agcagcuuuaaacccuccagccucagaugacgguacugguacuuugguauugaagcaucuugguggauuaagguucu

SEQ ID NO: 4188373 - RNA, 82 nt, Human
aggaauuuuuaucuggaagaguaauauaaauuagcuuugacugccaguuuccacugauuauuacuuuccaggcggaauuccu

SEQ ID NO: 4188374 - RNA, 70 nt, Human
aggacaaagcccuggaaagaugaagauggauucucagcccggcucugucauccucccagggcugugaccu

SEQ ID NO: 4188375 - RNA, 118 nt, Human
agcgacucuuggggacccuccaccuggggucacacacagccuggcuucaagucuuggccacggcuuaccagcugugugaccuggggugagauagcugggcuuuucagccugagucucu

SEQ ID NO: 4188376 - RNA, 127 nt, Human
agcgagaagcauuuaguacagaauuuaagguggcacucacucucagagucugcaaaugccauccuacucucuugcaagacccugagagugagugacuccuuaaauuuucuguauuuggccucucacu

SEQ ID NO: 4188377 - RNA, 59 nt, Human
agcgagagagagccagcagccaagugcauccccuguaucccagcuggcuucuccuugcu

SEQ ID NO: 4188378 - RNA, 101 nt, Human
agcgagaggccaucucuuccugccuuuguaugggcccucacagagccaaucucccagggccaccagagcagggcaguaagacagcacgaggccgguaggcu

SEQ ID NO: 4188379 - RNA, 101 nt, Human
agcgagucucaugagaucugaugguuuuaaaaaacgggaguuugccugcgcaagcgcucucucucuuugccugcugccauccauguaagaugugacuugcu

SEQ ID NO: 4188380 - RNA, 100 nt, Human
agcgauucuccugccucagccuccugaguagcuggaauuaaaggcacucaccaccaugccuugcuaauuuuuguauuuuuaguagagacaggguuucgcu

SEQ ID NO: 4188381 - RNA, 86 nt, Human
agcggaaagauguuaaauugggggcauuuuaugcuucuugugaaauggcacgaaugauguucucauuuuaaaacaaaguuccugcu

SEQ ID NO: 4188382 - RNA, 93 nt, Human
agcggaugggcuagauauuggcuuucuggcugaauugggcugggccucucuaauaauagcucucagagggaaaggccaauuugcucuccugcu

SEQ ID NO: 4188383 - RNA, 88 nt, Human
agcgguagugaucuggcuugaaggggcaguaacaagacaugcccagguacugggccugcuucucagucagcuuggucaacuucauguu

SEQ ID NO: 4188384 - RNA, 123 nt, Human
agcguaggauaaaauuauacugcuguagguacuuuggaaugacagauaucaauaacaauuuagauaaugaaguguauuccagcuuuauuucaauuuucuccagcuguaaaauucuuguaugcu

SEQ ID NO: 4188385 - RNA, 81 nt, Human
agcguccagucagggcaggagccugguauaggccacugaccacaggacacagccaggucuccugacucacgggaaggcgcu

SEQ ID NO: 4188386 - RNA, 73 nt, Human
agcguuaaggguucacuguaggaaauuuagaaaccucuauucccacuacccagagugaaucucuuaagaugcu

SEQ ID NO: 4188387 - RNA, 68 nt, Human
agcguuagagagcucuagggguggaacugagcaccugcucaugacagccagagcucugaccucgugcu

SEQ ID NO: 4188388 - RNA, 64 nt, Human
agcguugagaauaaauuagcagacauaguaaaaauccaucuacugucugugcuuuuuuagggcu

SEQ ID NO: 4188389 - RNA, 62 nt, Human
agcuaaacauguuggugcuuuaaauugggaaacccaauuuuaaagcauuacaaguuugaguu

SEQ ID NO: 4188390 - RNA, 71 nt, Human
agcuaacugaaagcccugagugccuguguaagaauacuggauuugaacaucacuguagggugaucaggccu

SEQ ID NO: 4188391 - RNA, 68 nt, Human
agcuaagaaacuauugucucugaacuguguuggcucuccacguucagugagacacugguucuauuguu

SEQ ID NO: 4188392 - RNA, 71 nt, Human
agcuaaggaugacuaguacuucugagaaaacagccuagacucaaucagaagaaaaugggcauucauuaguu

SEQ ID NO: 4188393 - RNA, 64 nt, Human
agcuacacugucuuagaaaggggcaugcucaugggcauuuuguucaaaugaagauuguguaguu

SEQ ID NO: 4188394 - RNA, 70 nt, Human
agcuacccgaggacaggcuaaggagugaucauaguuaggagcagcccaauagcacugucaucuggcagcu

SEQ ID NO: 4188395 - RNA, 71 nt, Human
agcuagaaagaucaugcagguuucuccuuucugaaugaacagagugagagaaucugaugcauccauuagcu

SEQ ID NO: 4188396 - RNA, 67 nt, Human
agcuagaacuagggagugaauauuaaaggcaguuggcauuugaauuuaccuugccuauauuuuaguu

SEQ ID NO: 4188397 - RNA, 56 nt, Human
agcuagccagauucuugggcuaaagaguuauguuuagcccaggagucuggcugguu

SEQ ID NO: 4188398 - RNA, 63 nt, Human
agcuaggaaguagaagcuucuggacuugaaaccagauuuugacuggcuuuaacucuuguagcu

SEQ ID NO: 4188399 - RNA, 68 nt, Human
agcuagggaguggcagagcugggauucaaacccagguagucuggucccagagccucugccacucugcu

SEQ ID NO: 4188400 - RNA, 71 nt, Human
agcuaguguuuauggagugcuuaccugccagacacuguucuaauaagcauuuuauguggauucacucagcu

SEQ ID NO: 4188401 - RNA, 57 nt, Human
agcuaucuccuuuucucacccuauaaucacgggcaucaaagggaaguggagaaagcu

SEQ ID NO: 4188402 - RNA, 64 nt, Human
agcuauuguaaggauguuuauuguuauaucacuguggccuuaaucuguaauuuuugcaauagcu

SEQ ID NO: 4188403 - RNA, 84 nt, Human
agcuauuuggucauguucaguguagacagagcauugcauuaagacacaaguuaaugguacugccuggagaugaaucaauuugcu

SEQ ID NO: 4188404 - RNA, 57 nt, Human
agcucaaaccuuuggcacuauuaaauccuaaaagucaucugccaggagguuugagcu

SEQ ID NO: 4188405 - RNA, 60 nt, Human
agcucaaacuucagcuaugccuugaaaggcauuaaggcauaaggaagauuuggauaggcu

SEQ ID NO: 4188406 - RNA, 83 nt, Human
agcucaaacuugaagacauguuuuuaauauguaaauguguaugaauggauacauacaagauguguuuaaaaucuguuugagcu

SEQ ID NO: 4188407 - RNA, 55 nt, Human
agcucagaacugcagacaugugcgugcucauguuuaugucaguagccuuuguucu

SEQ ID NO: 4188408 - RNA, 84 nt, Human
agcucagaacugcaggguggagcggaagcggagacaaugcugacuguucucugucaucucaccuccaaucccugccccugugcu

SEQ ID NO: 4188409 - RNA, 62 nt, Human
agcucagccacuucccucuggucagaggcuuggcuacugaccagaccccaggaggcugagcu

SEQ ID NO: 4188410 - RNA, 64 nt, Human
agcucagguuuaagcgacuggaaucauuccaacaugauuccugguggcagaaacaugacaagcu

SEQ ID NO: 4188411 - RNA, 64 nt, Human
agcucauuaaggcuggacaaggcuuggggacuguauuaagcugcagguuugucuagucugggcu

SEQ ID NO: 4188412 - RNA, 71 nt, Human
agcucauuuuaccuucuuguacaagaaagaagugcauuucuacaucugaagagcuuugcaagagggaaguu

SEQ ID NO: 4188413 - RNA, 56 nt, Human
agcuccagaagccugcaagguacuuggcccgaguaccguggcaaacucugugggcu

SEQ ID NO: 4188414 - RNA, 73 nt, Human
agcucccaaacuauaaacaaguguccuuuucacagucuacuuaaaaguggcacgcuuuuuggaguuuugagcu

SEQ ID NO: 4188415 - RNA, 74 nt, Human
agcucccaggaccaaggugcacagaacucugucuccuagagcacagacugagucaucuucuuaaaccuuaggcu

SEQ ID NO: 4188416 - RNA, 58 nt, Human
agcucccggguagaagccacucaugagacacagcaguguggccuuuuggcuuggagcu

SEQ ID NO: 4188417 - RNA, 91 nt, Human
agcucccugcuuggcccugcuguaucaucugcuucuuugggggguaguaaagauggugcagugggcuggaauaucagcuggaaguagagcu

SEQ ID NO: 4188418 - RNA, 66 nt, Human
agcuccuagguagcaggaauaaaaauguacccaguuuccugacucagggguuccugauugccugcu

SEQ ID NO: 4188419 - RNA, 61 nt, Human
agcuccugucucuguuaccacauuugugcacaugcaugugugugugcaggagagagaggcu

SEQ ID NO: 4188420 - RNA, 60 nt, Human
agcuccuugguuggcccugcaugaaggacaguggccuucggugggguaccuaagguagcu

SEQ ID NO: 4188421 - RNA, 56 nt, Human
agcucgauggccugaauagggggucuaacucucccccugcuuucaaccuucuagcu

SEQ ID NO: 4188422 - RNA, 90 nt, Human
agcucggugaugauaauuagcuauaguaugucugcuuuucgcauagugaacgcauccauuucuaaugguuccuaauuauugugacaugcu

SEQ ID NO: 4188423 - RNA, 58 nt, Human
agcucuagaccuguucccuaaagaaaacuaaguucacagggacacacaggauggggcu

SEQ ID NO: 4188424 - RNA, 58 nt, Human
agcucugagaaaguuagaaaguguagggaaauacacuuucuaacuuugcucuuaggcu

SEQ ID NO: 4188425 - RNA, 125 nt, Human
agcucuggcauccaggagccucaagggccuuuuaagccacuucccagugauugaacaucccugggcauacagcacaggaugaggcacugggggaagcugguccuggcccaggccacaaaagagcu

SEQ ID NO: 4188426 - RNA, 67 nt, Human
agcucuggggccugucccacauuaggugauauccagacauccccagugggagggagcccccagugcu

SEQ ID NO: 4188427 - RNA, 56 nt, Human
agcucuguguccagugcucgcuccccacagcgccccgcaacucacccacagcagcu

SEQ ID NO: 4188428 - RNA, 71 nt, Human
agcucuuguuuuauuugccuauuacuuugaaccauuucuguaucaaagucauggcuaguaaugaaagagcu

SEQ ID NO: 4188429 - RNA, 120 nt, Human
agcugaacagggaaggagaaguagccuagcaagauuauaacuucaggcacaguuucagaacauguagcuucagucugaucucauaggagauuucuggauuuugccucaucccagucugcu

SEQ ID NO: 4188430 - RNA, 63 nt, Human
agcugaccauauuguguuguaacuguguaggccaauauagcaaggacauaauaugcuacaguu

SEQ ID NO: 4188431 - RNA, 57 nt, Human
agcugacugaugaagaggccuucaggagaacuugauagaauucuauucauguuaguu

SEQ ID NO: 4188432 - RNA, 63 nt, Human
agcugagacacggagaggcugugugauuuuuggcugaucacacagccucucugugucucugcu

SEQ ID NO: 4188433 - RNA, 95 nt, Human
agauaguguguugguggaaaaguaauugugguucuugccauuagguaaugguaaaaacuguaauaacucuugccccaaucuaauagauacagucu

SEQ ID NO: 4188434 - RNA, 69 nt, Human
agauaguuuuauugagcagcagugcuucuagaggcaucacaggauccucugauaauuguuaaauuauuu

SEQ ID NO: 4188435 - RNA, 80 nt, Human
agauaguuuuuacuuaguguggccccaagaggaucugggggacccuucaggaacccugcgccauacuuugaggccuaucu

SEQ ID NO: 4188436 - RNA, 70 nt, Human
agauauauuugucaagagagggggauagaacauauguaauaucacuuagcucucuugauugaugaugucu

SEQ ID NO: 4188437 - RNA, 72 nt, Human
agauaugcagagugaggaagaacugcaugaauacugaucauuggugccgaggacgucuuuacucuggaaucu

SEQ ID NO: 4188438 - RNA, 67 nt, Human
agauauuacuugugaaauaguaucugagugcuugcuguaugccagggacuguuucaccagauuguuu

SEQ ID NO: 4188439 - RNA, 56 nt, Human
agauauuccucagacccucauugugagugcuugcugagugucuguggugaaugucu

SEQ ID NO: 4188440 - RNA, 78 nt, Human
agaucaaggacaaauuggguaugagcuaagaaggccgugggugaucucagcaaauaccuaguuuggccucuguggucu

SEQ ID NO: 4188441 - RNA, 57 nt, Human
agaucagaaauguaauggcagugccuucaaagaacauagugccguauauucuguucu

SEQ ID NO: 4188442 - RNA, 57 nt, Human
agaucagugcuucauagcccugguagcacauuacagucaccaggggaagccugauuu

SEQ ID NO: 4188443 - RNA, 98 nt, Human
agaucaucucuacuucagguuuuaccauguaaugggcacucucaaguuuauuccugcccuaaaaaugcaugcagcuggugauaagaagagacugauuu

SEQ ID NO: 4188444 - RNA, 123 nt, Human
agaucaugguucaguuucuugcagauaaauauuugaguucuaguggcugcagauugaaggaauaccauucauacuuaucaaauguaauuuuuagaaagaucucaaguauuaucuaccacaucu

SEQ ID NO: 4188445 - RNA, 58 nt, Human
agaucauuaaccaccuguucugccugggagcugauggcagcagcagcuggguugaucu

SEQ ID NO: 4188446 - RNA, 130 nt, Human
agaucauugcugcugauugggauuugcaucauguggggcuuaccagagugaugugauagaaaguuuuuguucuagagcuguucacaugcuacugagccagaccuugcagcccccgaggcaguuuccaucu

SEQ ID NO: 4188447 - RNA, 60 nt, Human
agauccacucgaauccaggaauguguauuuuauuauuaaucuuuggucuugagugcaucu

SEQ ID NO: 4188448 - RNA, 72 nt, Human
agaucccaagagcuacucaauggaaucagcuaguuaccuguuuuuccgaguguggccuuauggcaaagaucu

SEQ ID NO: 4188449 - RNA, 57 nt, Human
agcaucagcagacucucagcuaaaagauaccauuuaaguugaaaguaauaugaugcu

SEQ ID NO: 4188450 - RNA, 62 nt, Human
agcaucagucucagcaccuagucacauguguuuuucguguuuucguggaugaggcugguucu

SEQ ID NO: 4188451 - RNA, 82 nt, Human
agcauccucaggaguuuuaaaucuagcauggcauucuguauccccuucuagcaaaucaacauaaagaacuucugagauugcu

SEQ ID NO: 4188452 - RNA, 67 nt, Human
agcaucuauauauacguguccaguagaagauauaucuucugcauccuaugaucgcauauguagagcu

SEQ ID NO: 4188453 - RNA, 97 nt, Human
agcaucuggaaaauaccuagauuuuggugggacuggguggggcccuaggugggcucccagcccccgagugucuggaaaugaugguaugagggaagcu

SEQ ID NO: 4188454 - RNA, 75 nt, Human
agcaugaaacaaugugaaguugcugagauggguaacuagucuuuuuuauguuguuuauuguuucacuccccugcu

SEQ ID NO: 4188455 - RNA, 69 nt, Human
agcaugaugaaguggaaauccacggauugaaggaauucucuuuucuuccuggauuccuacuucagugcu

SEQ ID NO: 4188456 - RNA, 59 nt, Human
agcaugcaauuaugguauuagauaaagcauacaguuuggucuaaaaccaagaugcagcu

SEQ ID NO: 4188457 - RNA, 57 nt, Human
agcauggacaguggcagcaguggcaacugugauggcugcugauguucgcugcaugcu

SEQ ID NO: 4188458 - RNA, 55 nt, Human
agcauggcauggggucuguggaugcauacggugcaguagacucuaauguuaagcu

SEQ ID NO: 4188459 - RNA, 61 nt, Human
agcauggggcagguggggggcugcagccccagggaucugagcuuccucccugcauccaucu

SEQ ID NO: 4188460 - RNA, 56 nt, Human
agcauguaaagcucuuagcaccaagcuugguguauggugugugcuccaugcaugcu

SEQ ID NO: 4188461 - RNA, 65 nt, Human
agcauguaacagaguucuuaggguggaauauguuuuguuuaauaccuugaucucucuugucugcu

SEQ ID NO: 4188462 - RNA, 82 nt, Human
agcaugugaaagcacagguugaggauuauucuggaauuuucuucaggucuuuguuguuugcuugguugcuuguuugcuugcu

SEQ ID NO: 4188463 - RNA, 93 nt, Human
agcauuaauaguggcuugcuauggguauaaacagguccuaaauccuuuaaacaaaugguuacaaucugauugucucaucuacuuauuggugcu

SEQ ID NO: 4188464 - RNA, 61 nt, Human
agcauuccacacugaagucugcuuuucuugaagcaaaaauucuaguguccuuggacuugcu

SEQ ID NO: 4188465 - RNA, 72 nt, Human
agcauucccuucugggaaaagggagccuuauguaguucacaaaaguccuuuauccuaaaagguccaaaggcu

SEQ ID NO: 4188466 - RNA, 62 nt, Human
agcauucucgucugaaucuggaaggggucuucuuuauccccagauuugccacgagagaggcu

SEQ ID NO: 4188467 - RNA, 57 nt, Human
agcauugguggccagagugccugguuccaaguguggcucugcugucuaccagcuguu

SEQ ID NO: 4188468 - RNA, 60 nt, Human
agcauuguccauaauuugaaagguaaaccuaguuguugaguacuuucagauggauaugcu

SEQ ID NO: 4188469 - RNA, 56 nt, Human
agcauugugagcucaagaguacccaagaaagauguggccucuaagcucacgaagcu

SEQ ID NO: 4188470 - RNA, 70 nt, Human
agcauuuagcagcccaguuucuggccaaugugugugcaaguugguuuuguagugacugggcuguuaagcu

SEQ ID NO: 4188471 - RNA, 56 nt, Human
agcauuuagucuuuauugcagcucaaggaaauuuucugcugugguuaggccaugcu

SEQ ID NO: 4188472 - RNA, 62 nt, Human
agcauuucuacugugucagaaauucucaaacuuuagaguguaacugaaacacagagagggcu

SEQ ID NO: 4188473 - RNA, 55 nt, Human
agcauuuucugagaguauagaucucaugaaucagauuugcugugcagaugaugcu

SEQ ID NO: 4188474 - RNA, 77 nt, Human
agccaaaacacagagauguaaaguuaggcgauuauguuagguuguccuauguguuauauuaguaucuguauuugucu

SEQ ID NO: 4188475 - RNA, 56 nt, Human
agccaacauaaaaagcuuucaauuuuccuugaagauucuaagugcuuguggugguu

SEQ ID NO: 4188476 - RNA, 59 nt, Human
agccaacuuggaaagucagauuuaauucuucugugguuauuugacuuuccagguuuacu

SEQ ID NO: 4188477 - RNA, 130 nt, Human
agccaagcaggccggacuuuucccuggcaacccucucgccucaauucuggcagcccugugcgcuagagugaaccaagugugggcuggggagucagguuuaauuucuaguuuuuuaccaucuauguagcau

SEQ ID NO: 4188478 - RNA, 61 nt, Human
agccaaggcagcuagagcucugcagagcacgugccuucuugcucucagcugccugcugguu

SEQ ID NO: 4188479 - RNA, 60 nt, Human
agccaaugccagagcccaaguauuuccaguucagauguguuuuuauucuggcaugugguu

SEQ ID NO: 4188480 - RNA, 69 nt, Human
agccacagauuuggaggccucaccccagacugaacagucucugaggguggagcuccagaaucuggaguu

SEQ ID NO: 4188481 - RNA, 60 nt, Human
agccacuugugaugcuggggaaguuccucuacacaaguuccccuggugccacgaucugcu

SEQ ID NO: 4188482 - RNA, 88 nt, Human
agccagagauaccauugcuaaaauuuugggcauauaucacauccuucuagaguuuugcuauuuguauuuuuaaaaauuaaagggggcu

SEQ ID NO: 4188483 - RNA, 71 nt, Human
agccagagugcccuucaugaagcaagaggucaauagcuuuugguugaaugaaugaagugguaccuauggcu

SEQ ID NO: 4188484 - RNA, 107 nt, Human
agccagcaagaaagcgucuucuggaaucagccugagcacaaggccaggcuuuauugcuucuggcugugcggccucgggcagagcuucaguuucuugccaucauggcu

SEQ ID NO: 4188485 - RNA, 106 nt, Human
agccaggagggcugacagugcuggaguggaccaguccgcggagcuccgggggucugaaugcuccagggguguguggauggcaauggccaggauggcccuccugguu

SEQ ID NO: 4188486 - RNA, 55 nt, Human
agccaggaucacccggggcugucugcauacagacuucucaggggaguucucagcu

SEQ ID NO: 4188487 - RNA, 57 nt, Human
agccaggauuggcugagccuuagccaggauaccaccuggcauucagccacaucggcu

SEQ ID NO: 4188488 - RNA, 57 nt, Human
agccaggucaggaaaggucccagggcgcagggguggcugcuuuuccucaucauggcu

SEQ ID NO: 4188489 - RNA, 58 nt, Human
agccagucagaggcucccccaagccccuuuuucuucuuuggggccuguuucugugguu

SEQ ID NO: 4188490 - RNA, 82 nt, Human
agccaguucugaggcuccugcuguccuuugaagccucugcagggcaguagcagggaggagggcaggcagagcaggccugguu

SEQ ID NO: 4188491 - RNA, 129 nt, Human
agccaucaucuuagaaaguaagacuggaaaaacggagucagaacugggaaugcugucccaucagagcuuguuggggggcacucacgugcucuguuuugccuguggagacugcugguaggaaugaugauu

SEQ ID NO: 4188492 - RNA, 92 nt, Human
agccaucuaacugcaaaggcaucugggaagguucuuugaugccaaugaagaaaacuaaauacgcuuugccucaugucuuuagcguuauggcu

SEQ ID NO: 4188493 - RNA, 77 nt, Human
agccaugaaaacagcuguauacuguagcuguaaauaguguuuacaguuauauacauguagcuguuuguaacauggcu

SEQ ID NO: 4188494 - RNA, 93 nt, Human
agccaugcaagguaugggauugaaggagagaaaggcaauucuggcuucauggacuuucaaaugcaugucuuuccucaggccuugaacguggcu

SEQ ID NO: 4188495 - RNA, 65 nt, Human
agccaugccuuuuguaaaagcuggaucucuuauuaagaagaucauagcacaaaagugacagggcu

SEQ ID NO: 4188496 - RNA, 56 nt, Human
agccauggugggaguguuuacaugacagaaaucaguaaacacuacaaaucaaggcu

SEQ ID NO: 4188497 - RNA, 103 nt, Human
agccauguguuuuccuuugauauccuuauucauuaggguagugggaagauccagcccagaaaugaaaggaugauuuuuuaaaguuaccagacucaaccuggcu

SEQ ID NO: 4188498 - RNA, 82 nt, Human
aggagugagggccuuggagcccagcaggccuggaguggaaucccugcuugguuacugcauagcuccaaguugcccccauccu

SEQ ID NO: 4188499 - RNA, 55 nt, Human
aggaguggguggcaggguuguagugcuaagugcaccauucuuuacacuuauuucu

SEQ ID NO: 4188500 - RNA, 78 nt, Human
aggaguugaagcuugaggugggccuugaaaaauggugaguacauuuguuauucucugccuacaagucuacaaccuccu

SEQ ID NO: 4188501 - RNA, 59 nt, Human
aggaguuuagucacuugugccugagggguggcacagcccucccugggugacgggcuccu

SEQ ID NO: 4188502 - RNA, 65 nt, Human
aggauaaaggucauuauucccauuuuacagcugaagaaauuuauaagggagaaaaucuuuauccu

SEQ ID NO: 4188503 - RNA, 87 nt, Human
aggauaacagguguauagucacuguuuucucagagcuggucacaugaaaggagaaagcagugaugcauacagcuguauuuauauccu

SEQ ID NO: 4188504 - RNA, 130 nt, Human
aggauagaugaaauuuuuuaguagcuuguuucaagcaauauuuuagaaagguaucuguggaagucaagaaaacagauuuaccauugaaugaauaugcugauuaaucugcuguuuaauuauauauagacuu

SEQ ID NO: 4188505 - RNA, 84 nt, Human
aggauagcuguuggagagaacagugucugaaagcguuaagagaauaugccaugagaaaaugcucauuuaagaauuaguuauccu

SEQ ID NO: 4188506 - RNA, 60 nt, Human
aggauauaaaguagucuugcugcuuaagcaaaugaggcauuaaggcuguuuuguauuccu

SEQ ID NO: 4188507 - RNA, 74 nt, Human
aggauauuuugggggguugaggaguagauaguagucuaaauaugcuuacuaauuggcuuacccaaaggaaaccu

SEQ ID NO: 4188508 - RNA, 84 nt, Human
aggaucacuugagcccaggaguuggaagcugccaugagcuguggucacaccauugcacuccagucugggccauagagugagacu

SEQ ID NO: 4188509 - RNA, 58 nt, Human
aggauccagccaaaauguaccagaagaagcuggcagagcaugugugggacuggauccu

SEQ ID NO: 4188510 - RNA, 69 nt, Human
aggaucuucaaguaaguugugguuuccuucaaaauuaauuuagaaaucacaaacgaauugauggaaccu

SEQ ID NO: 4188511 - RNA, 66 nt, Human
aggaugacuggccacucagggaugcaggaaguggcuuuucugcauggccugccuggugagucaccu

SEQ ID NO: 4188512 - RNA, 65 nt, Human
aggaugaggauggggcguggugugccucugggcgaggauggcagcccaccagcccacgucuaccu

SEQ ID NO: 4188513 - RNA, 62 nt, Human
aggaugauaaaauuauggcacuuugaauggugacagacacugagguuucauuuuaucgcucu

SEQ ID NO: 4188514 - RNA, 57 nt, Human
aggaugaugucaaaacagucacagaaaagaugucaguggaaauauuggcagcauccu

SEQ ID NO: 4188515 - RNA, 59 nt, Human
aggaugauuggaugccugcucaaacacauguuucucugucugcacccaaucaauauccu

SEQ ID NO: 4188516 - RNA, 60 nt, Human
aggaugcaguugugguuuuaucucuagaaagggcaugugucccucagucugugcaauccu

SEQ ID NO: 4188517 - RNA, 58 nt, Human
aggaugcugggcauagucugauucuggcuuguagaagcacgguuuugucuagcacacu

SEQ ID NO: 4188518 - RNA, 86 nt, Human
aggauggacagagggcagugauggggaucucacuggccagagacaucucucuagugcucuaugcugacuugacucuguuccaaacu

SEQ ID NO: 4188519 - RNA, 58 nt, Human
aggauggccagucugacuaguuuccucauaaaaagaaagcagucugacugguccuccu

SEQ ID NO: 4188520 - RNA, 87 nt, Human
aggaugggugaugggcuggggagaaagcaugccugugaccugcagcuucacaaguucucacuuuagccuugaccaccgagacauccu

SEQ ID NO: 4188521 - RNA, 60 nt, Human
aggauguauaaguuuuaugagagacuuugcuaaaagccuugcugaaaucuaugacauccu

SEQ ID NO: 4188522 - RNA, 119 nt, Human
aggauguauugauguuucauguuguaagugcuuucagugugcucuuuuaacauuacuuaguuuaaaaugaaaagauaaaaugaaaagauacugcaaacauaguaaucaaguuaacuccu

SEQ ID NO: 4188523 - RNA, 84 nt, Human
aggauguugaguaucaaugcuuuaacagaaaucaccaccugcaugaggaaaagguaugacaugaagcauggauaacucacaccu

SEQ ID NO: 4188524 - RNA, 57 nt, Human
aggauguugcuauuggcagucuagcgaguagaggccggggaugccacugaacauccu

SEQ ID NO: 4188525 - RNA, 81 nt, Human
aggauucagcucaggcucuccaugcuccaaaaccuucccaaggacaggggcccuggauggggagcccuccucugugauccu

SEQ ID NO: 4188526 - RNA, 96 nt, Human
agggcccuguccugccuacuccuguucccgccaggcacucgagcgagagcucuguggcugagcagcagagagcuggguuggacuucaaggggcucu

SEQ ID NO: 4188527 - RNA, 67 nt, Human
agggccguguugggugucuuugugucaucccaugaauaauaucacagcuacaccccuuuacaguccu

SEQ ID NO: 4188528 - RNA, 74 nt, Human
agggccugcaggccuuauguaaacacucaggugccugucuguacaaauguggggccucgacaccggcaggcucu

SEQ ID NO: 4188529 - RNA, 55 nt, Human
agggccugggaagaggaacccugacugagcaacaggaauccauuccuaaggcccu

SEQ ID NO: 4188530 - RNA, 79 nt, Human
agggcggcaggaacucagagucuagucucuuggcucgggcgagacacagagaccccuucuggggcccagucuguccccu

SEQ ID NO: 4188531 - RNA, 57 nt, Human
agggcuacuuuccugagucccuguucacaaaaucgcccggacccaggaaagaguccu

SEQ ID NO: 4188532 - RNA, 55 nt, Human
agggcuaggaauggaacuggagugccgaacgacagcugucauacucuuagcuccu

SEQ ID NO: 4188533 - RNA, 57 nt, Human
agggcucagcaucucauucuguuuagcaacaguugagagacaugggaucuggguucu

SEQ ID NO: 4188534 - RNA, 55 nt, Human
agggcucauaauuccugacuucaaaggcuacaggaagcaggacauaugaugcccu

SEQ ID NO: 4188535 - RNA, 80 nt, Human
agggcuccagagccuuuccacccacuuggcuuacaggaaccgcaacugggagaaagaggugccagggguuuuguagcucu

SEQ ID NO: 4188536 - RNA, 60 nt, Human
agggcucuggggccuccucccuugggcagcccaggggauacuuggcugccccauggcccu

SEQ ID NO: 4188537 - RNA, 57 nt, Human
agggcucuuuaggccgaggccaggcuccugucugcuggccucaagucugagggccuu

SEQ ID NO: 4188538 - RNA, 72 nt, Human
agggcugagggagccgccacagacugggacccaaucccacguuuguugcgugcucucaacuuuuuagccucu

SEQ ID NO: 4188539 - RNA, 65 nt, Human
agggcuggaggguacuaguuuaugcucuuuuuucuuauguuaaauuuuuuuugcccuucugccuu

SEQ ID NO: 4188540 - RNA, 55 nt, Human
agggcuggaugcucuggucuucuaaaagaaagcugggcagggcaucaacagcucu

SEQ ID NO: 4188541 - RNA, 130 nt, Human
agggcugggaagcaccucccugagaugcaggcucccacccuccugcagcugcaguaccugaugagcaggauggcagugucaugcugcagggggugggcgucucccuucauguugaugcuuuucugccacu

SEQ ID NO: 4188542 - RNA, 57 nt, Human
agggcugggaauguguuaggagaaacuguccuggagacucuguaacacucuagccuu

SEQ ID NO: 4188543 - RNA, 86 nt, Human
agggcuggucugaggcgggcaauggggauccugaugagcagaauaagagcuuagcagcaugaucccaguugauugcccauagcccu

SEQ ID NO: 4188544 - RNA, 62 nt, Human
agggcuguggaaaugaaauaggucugggugacaccugaggucaugcauuuccaacaaguccu

SEQ ID NO: 4188545 - RNA, 59 nt, Human
agggcuuguuuccuguuucauagaaggugucacaugguggaaggggcaaacaagcuccu

SEQ ID NO: 4188546 - RNA, 76 nt, Human
agggcuuuuuguuuaugaacucuauuuacccuacuaaaccacagguuggguagucuaaucuagaguuaaacaccuu

SEQ ID NO: 4188547 - RNA, 80 nt, Human
aggggaaaaguaagcuggggcaagacaacguuucucaucccugauugaaauguuccuauuuacccccuaacuuauaccuu

SEQ ID NO: 4188548 - RNA, 117 nt, Human
aggggaacagguuaggaucccgcuugauggccucagcauggagcuucggggauuccaguugcaguuccuccagagcuuccugcugggcuucuagcauagcccugauggugucccucu

SEQ ID NO: 4188549 - RNA, 73 nt, Human
aggggaagcugcucucacaacacuguuaauguuucauuaccaagacagaugugggugacagcagcauucucuu

SEQ ID NO: 4188550 - RNA, 88 nt, Human
aggggaauugcuugaacccaggaggcagagguugcagugagcugagaucaugcuacugcacuccagccugccaacagagcaagacccu

SEQ ID NO: 4188551 - RNA, 65 nt, Human
aggggaccuuugucucaugucacauuaaaugucuugcuuggugguccaucaugcagagcuccccu

SEQ ID NO: 4188552 - RNA, 59 nt, Human
aggggaggguguucucccaagaacacaggcauccugguucugaaaaagcagccuucccu

SEQ ID NO: 4188553 - RNA, 70 nt, Human
aggggauccuugggcuggcagagguggucuuuggauaugcaacggcuacgugcuggccuacagagccccu

SEQ ID NO: 4188554 - RNA, 73 nt, Human
aggggaucgaaggacaagcuuaguccacugguccagagggaaucaguacagcuuagucuucucaaaacccccu

SEQ ID NO: 4188555 - RNA, 57 nt, Human
aggggcacgcgcguuucuuggcuuagaguugugagaucuaagauggcaagugucucu

SEQ ID NO: 4188556 - RNA, 59 nt, Human
aggggcacuggcagucggggacgcugggggucagcuccuggcguccugccccugccccu

SEQ ID NO: 4188557 - RNA, 65 nt, Human
aggggcauguggcagcauggugggaugcuuugguaaugaguucaccacugaggccacguggcuuu

SEQ ID NO: 4188558 - RNA, 58 nt, Human
aggggccauguaaguguaucacauccaacauaaaagaugcguaccugcaugugccuuu

SEQ ID NO: 4188559 - RNA, 71 nt, Human
aggggccauuuguccagggaauagaauuaaaaucaauaauuauuccuuucaccuggcacaugugagccucu

SEQ ID NO: 4188560 - RNA, 84 nt, Human
aggggcccccucuacuuuaacauggaggcacuugcugugacaugacaaaaauaagugcuuccauguuugaguguggugguuccu

SEQ ID NO: 4188561 - RNA, 56 nt, Human
aggggccucuuuguugcccagguuaguacugaacuccugguucaagugaugccccu

SEQ ID NO: 4188562 - RNA, 89 nt, Human
aggggccuucuguuuuccacaccucagucacccuacuaggaguagacaaaacuucucaguguguugagaggucuggagaaauggccuuu

SEQ ID NO: 4188563 - RNA, 61 nt, Human
aggggcggccugccugaagcagagcuccaaaauuggcaaccuaggccucgcagccgccuuu

SEQ ID NO: 4188564 - RNA, 80 nt, Human
aggggcuaagaaucaagaaauagggaucaaaacaauaccaggaauuugaaauuccuugaaaaucuugguuuagagucccu

SEQ ID NO: 4188565 - RNA, 80 nt, Human
aggggcuacagaaaggcauaggacaaaucagugauguugaaccacaucuuacuaagaugcuuugcuugcuguggcacucu

SEQ ID NO: 4188566 - RNA, 96 nt, Human
aggggcuacuucugugucauguuucugagucugguuagaguggugauuaaucaccuggcucuggggcggacagcuggcauuugaauccuggcuccu

SEQ ID NO: 4188567 - RNA, 69 nt, Human
aggggcuaggagugacacaauggggcagagccaguaggcuguguccccagcacucacucuccagugucu

SEQ ID NO: 4188568 - RNA, 62 nt, Human
aggggcugccuggcuuggcacucucggggccgaggggaaaguacagcagccagggggccccu

SEQ ID NO: 4188569 - RNA, 123 nt, Human
aggggcuggccuccagcuggugcaauacagaugcucugaugucugggugcuuugauaaaauggagaggcaugccagaauugucagugcaucuggacuagguauugguaaacuauugggccccu

SEQ ID NO: 4188570 - RNA, 55 nt, Human
aggggcuucccuuccuggguagcaagggaaagacuagccaggaggaggggucccu

SEQ ID NO: 4188571 - RNA, 121 nt, Human
agggggaaaaugcaaauaauuggaaauaaauguucggugcucuaaauucaggagaggcuucuuccaccacuuaauugugcccgugacauuucauuucgaaugcagaauuuauuuucucucu

SEQ ID NO: 4188572 - RNA, 85 nt, Human
agggggaaauuucucuagaggugggacucaggaauuuugaaaucucccuucacaaagucucaucuuuaaaugaaaauuuccucuu

SEQ ID NO: 4188573 - RNA, 60 nt, Human
agggggcauuaugaggcuuuuccacaccaucuaugugccugagcacuugugguccucccu

SEQ ID NO: 4188574 - RNA, 56 nt, Human
agggggcuggagacaccuccucagggaagcuuuccuucuggugucccacacucccu

SEQ ID NO: 4188575 - RNA, 69 nt, Human
aggggggagcuaggagggaggucucuucugucucccuaugaccucuucaucucuccuggccaccccucu

SEQ ID NO: 4188576 - RNA, 130 nt, Human
aggggggcuauuccugggguucugggcccagaugggcaaaugggucuguaaggcagacuuuuccaggaggagggugcagacccuuugcaaguuguuuggggacagagcuuaguuugcaucuggccuucuu

SEQ ID NO: 4188577 - RNA, 75 nt, Human
agggguaaagagggcugaaguguuuuaugaguuagcccauuccuugauaacuucagcuuuuaaguuuugccagcu

SEQ ID NO: 4188578 - RNA, 61 nt, Human
agggguauugaaaguucacagggcccuuccucuauucuuccuguauuaacuuuugcaccuu

SEQ ID NO: 4188579 - RNA, 67 nt, Human
aggggucaagcucagaauccuagaaugccauaccuggggauugucuaggcauuugaguuugccaccu

SEQ ID NO: 4188580 - RNA, 78 nt, Human
agggguccauuuuuauauguuacucccucuagcaagguugaauaaauaugccagugaaacauggaagaauggauuuuu

SEQ ID NO: 4188581 - RNA, 83 nt, Human
aggggucgguccaugaguauuuucccuaucaaugucacuggucuccaaggaacaauaggugaaugugcuugaaaggcuccccu

SEQ ID NO: 4188582 - RNA, 127 nt, Human
aggggugaaagcuacucagagucagcccaggauccuaggaggcuggcucuugcgacucagcuuggcugccauuaaggccaaggagaaaggccagacucacuaaggaccugcuggcaguaccauccuu

SEQ ID NO: 4188583 - RNA, 63 nt, Human
aggggugagcucucuggguccucuuuuauaggggcacuacucccacucaugaggguucccccu

SEQ ID NO: 4188584 - RNA, 130 nt, Human
aggggugaggcaagugaggugcuuagccuauaaaauuuaagguagcacucacucucagcuguggacccugcacuuguaggacccugagagugagugccaccuuaaacugugucccagaugcuuugcuccu

SEQ ID NO: 4188585 - RNA, 61 nt, Human
aggggugagugucaggccgggauuccucuguacucagggcuccuggcuuuaugcuaccucu

SEQ ID NO: 4188586 - RNA, 58 nt, Human
agggguggccugccuuacucccugaggagcuaccaugggcugggcaggacccaccccu

SEQ ID NO: 4188587 - RNA, 109 nt, Human
agcugauuaucauagauaaaugugucuaauuagucucauuugcugacacacaagccuuuaauugcaaguugaauaauuagacauaucugcauauguaaaugauacaguu

SEQ ID NO: 4188588 - RNA, 65 nt, Human
agcugauucugcuuugauccuugugcuuguugucaaagcgcuugggauugaagagacuguuggcu

SEQ ID NO: 4188589 - RNA, 61 nt, Human
agcugcagagaaaagaggcuggguuuaaugcuccaggucuccucauauucugccucuagcu

SEQ ID NO: 4188590 - RNA, 58 nt, Human
agcugcagagacagcugccgaugcuccgggggcagguaucaguguugucucugcaacu

SEQ ID NO: 4188591 - RNA, 58 nt, Human
agcugcagcccuccugcauggcugccugucacuccagcuaagcagaggagcugccguu

SEQ ID NO: 4188592 - RNA, 58 nt, Human
agcugcaggagucgccuaggauauggcccgucacgucuggggaugacccugcacugcu

SEQ ID NO: 4188593 - RNA, 66 nt, Human
agcugcaggccagggagaauaugaagccacagauggcucaucccaccccugcccuggccgauggcu

SEQ ID NO: 4188594 - RNA, 70 nt, Human
agcugcaggcgccggggccgauccgacuucccgcuuccguccggcuugcggccccucgccuugcccggcu

SEQ ID NO: 4188595 - RNA, 55 nt, Human
agcugcauuuuccuuuuaaucacagcuuaccuccaggcagagggaaaaugcgguu

SEQ ID NO: 4188596 - RNA, 55 nt, Human
agcugcccagguucauugggccauaucacuuuggccaugagugacugaggcagcu

SEQ ID NO: 4188597 - RNA, 111 nt, Human
agcugccggaggccacacagcaugucugaggcauacccaggcccccuaaucaguuucucucuccugcaggggacaggcaaagguaugcuucagucaugaacucaagcaguu

SEQ ID NO: 4188598 - RNA, 82 nt, Human
agcugccucgugaaauggugacagagaggggcuugguauugauuuugcugccuguuccugaucauucuauuaggaggugguu

SEQ ID NO: 4188599 - RNA, 59 nt, Human
agcugccugaagaauuguguugcaaaagauuguauuugcaaucccaguuuugggcagcu

SEQ ID NO: 4188600 - RNA, 61 nt, Human
agcugccuuuugagaaagcucaauuacuuuugaacaaccuaaucauuuccaaagggcagcu

SEQ ID NO: 4188601 - RNA, 65 nt, Human
aggaguuugcaaguuuaacaagccacccaauuauccuggugcaggugguccauuugggaacuucu

SEQ ID NO: 4188602 - RNA, 83 nt, Human
aggauaaauguacuccugucuccacuggcugaaaccaucuggaugguaucacauugucuguagaauaaauaugaguacuuccu

SEQ ID NO: 4188603 - RNA, 63 nt, Human
aggauaaccuaggauuuggaacagugcuguuguuagacagacagugugaguucaggguggccu

SEQ ID NO: 4188604 - RNA, 83 nt, Human
aggauaagagaugauuagaaguacagccuguuuguaaugauaauacucaccagcugugugacuuuuaaugagccucuugaccu

SEQ ID NO: 4188605 - RNA, 113 nt, Human
aggauaauauccaaauuuuacccauguuuaagucuccagaaacugaccuauaguugacccccacuaaauguuucuggagugacuauaacugguagauuuuggcuuaaaauuuu

SEQ ID NO: 4188606 - RNA, 63 nt, Human
aggauaccugcuuaacauugccaugacauuuguaaagugucauggugcuguugggagugucuu

SEQ ID NO: 4188607 - RNA, 61 nt, Human
aggauauaaagguuagaaaaauuggcaaagggcacacuuuguuucauaacuuuuauauccu

SEQ ID NO: 4188608 - RNA, 79 nt, Human
aggauaugugaauacagcaugugcuucuucgcaugugcgugcucauacaaguagaugcacaugcuuauucacguguuuu

SEQ ID NO: 4188609 - RNA, 58 nt, Human
aggaucaagaggcggccggaacccucccugagccgaggguccagaacugcccuggccu

SEQ ID NO: 4188610 - RNA, 69 nt, Human
aggaucaagcagcaacauauaugaaacugugcuucagcaggggaaauacaguuauguuccugggucacu

SEQ ID NO: 4188611 - RNA, 67 nt, Human
aggauccugacuauugaucaucacucaaacaugagccaugcaggagagugagucaguaggguguccu

SEQ ID NO: 4188612 - RNA, 63 nt, Human
aggaugaauauuuagugggauagauggauggauguccuugaccuacccgugaauguuuauucu

SEQ ID NO: 4188613 - RNA, 67 nt, Human
aggaugacuccugagauuucuggcaauugguauuuauucagcagaucagagacuguaggagcagccu

SEQ ID NO: 4188614 - RNA, 56 nt, Human
aggaugaggcuggcaggucuugcagcaaccuugcaagccaggaccaaacucauccu

SEQ ID NO: 4188615 - RNA, 76 nt, Human
aggaugaucuuuccuaacugaauauucuuucaccaacaacagaggaaggagaucagcuuagggaagguuuauuccu

SEQ ID NO: 4188616 - RNA, 59 nt, Human
aggaugcugaagccugggaagugagguacuuauuuggaaauauggcuucuggcaggucu

SEQ ID NO: 4188617 - RNA, 65 nt, Human
aggaugcugcucuagcccauuuccugcuugccacgggguauguggauggggcuggaggucauucu

SEQ ID NO: 4188618 - RNA, 56 nt, Human
aggaugggggaggaaaagagaaaauaaacagaagucgcucucacucgccacauccu

SEQ ID NO: 4188619 - RNA, 64 nt, Human
aggauguaaugcacucccaaagauccaagggaagcccuuggaauaugcaauugcauuucauucu

SEQ ID NO: 4188620 - RNA, 92 nt, Human
aggauguccgagaauggcugugaugccaggcuucuggcagguuccagacuccaucacaagcccagcaucccugcaccagaucugacaucgcu

SEQ ID NO: 4188621 - RNA, 113 nt, Human
aggaugugggugugcuggggaaccugaguucccacuguggauucaucugccaaguggcaggguuugaacgcagguccacauggcucagagcuuuccuccacgccacaaugccu

SEQ ID NO: 4188622 - RNA, 79 nt, Human
aggauuagaauuguagacugauuguugguccuuuaaguaugcuuggaagaaaauucaaucgaguuucaaggcuuuuucu

SEQ ID NO: 4188623 - RNA, 84 nt, Human
aggauuuagggaauaggacuuugguccuagcucuguuaucagcuagcugagcuggacacuaaaggucccuggucuucaaauucu

SEQ ID NO: 4188624 - RNA, 84 nt, Human
aggauuucucuccugcucagaacagccucacaguugugcgaagucagacgugagccuggggccugggcagcggucaucaauccu

SEQ ID NO: 4188625 - RNA, 59 nt, Human
aggauuugaaccuaggcaaucaugagaauggaaguccaugaagccaggaucacgauucu

SEQ ID NO: 4188626 - RNA, 58 nt, Human
aggauuuggaagaccgggucacaagguuuuugcuuugugacuaauaauccacaauccu

SEQ ID NO: 4188627 - RNA, 112 nt, Human
aggcaaacauaguuucacuguucuacugcauuucauaaauuacaauaauuuaugauuuacaaugugcuuaugaaggcagugaucuuuagaagagcuggcuguuauauugccu

SEQ ID NO: 4188628 - RNA, 76 nt, Human
aggcaaauaaguaaauaguucugucaaucucaggggacccuagggugugauuauauuguaguacauuauagugucu

SEQ ID NO: 4188629 - RNA, 68 nt, Human
aggcaaauccuuggcacaguggaauucaacagucaguugacauccugucugaguucaaggugaugccu

SEQ ID NO: 4188630 - RNA, 93 nt, Human
aggcaaaugagaggggcauggggagagaagggcugagcugggcggcagugcacuggggccuccuccaugcucugucuucuguaguguuugccu

SEQ ID NO: 4188631 - RNA, 58 nt, Human
aggcaacaugacucacuugcacaaaucuacaagauaaguuuauuugauuuaugugccu

SEQ ID NO: 4188632 - RNA, 69 nt, Human
aggcaacauuucauaggaucaugggcuuuuugagcuggaagggacccuggaucaaauggaccgaugcuu

SEQ ID NO: 4188633 - RNA, 102 nt, Human
aggcaagagagguaguaaagugcaaauuuaagaaggcauacuugcaugaccuugggagugagugccuccuuaaauucugcaccuagacaaccucuccugcuu

SEQ ID NO: 4188634 - RNA, 92 nt, Human
aggcaaggcaggauagccagaggucaugagcacaggucuuagagucaaauugccuguauuugcaucuggccucucagccuccugucuuuacu

SEQ ID NO: 4188635 - RNA, 68 nt, Human
aggcaaggccauuucuguuuccugccuuucuccucccaggggcaugagaggcucagaggccugguccu

SEQ ID NO: 4188636 - RNA, 65 nt, Human
aggcaauccucuuacagaugggggagaggcucaggcccacccaucagagucuagaggaagugccu

SEQ ID NO: 4188637 - RNA, 119 nt, Human
aggcaaugggcgcggggguggcgcgggggcggcgcagaccucagugugagccaggaggcaguagcuguggaguuuguggcgcugacugggcgccgggugcccuguugcguccucugccu

SEQ ID NO: 4188638 - RNA, 66 nt, Human
aggcacaauucagauggaagauucuggcuguccaaggccaacuguaaguuuaacugaauccugccu

SEQ ID NO: 4188639 - RNA, 79 nt, Human
aggcacagauuuggggaaagcaaugaaucaucugacuacgacuucuaauuggauuuggaguguuauuccguuugugccu

SEQ ID NO: 4188640 - RNA, 97 nt, Human
aggcacagcacacacagugggagagagagugggagccggcccccuccucgccuuggccucugcccucacuccugucugcagugcacccucugugccu

SEQ ID NO: 4188641 - RNA, 68 nt, Human
aggcaccucauagccagcccccacuacaucucucucccugaugucucucuggcuguggggaaaugcuu

SEQ ID NO: 4188642 - RNA, 57 nt, Human
aggcacugaaagguggccagagccugaacauaaauggccuggcaccuugaggggccu

SEQ ID NO: 4188643 - RNA, 69 nt, Human
aggcacugagggcagguacaagaugcuucuucgacugugaagaagagaaaugugcugcuggccaggccu

SEQ ID NO: 4188644 - RNA, 111 nt, Human
aggcacugcugccuguugguauccaggauaucccagaguucaaugggaagguccagcagaagagcuucccaggagaaucagggaauucgggauaauaucacaaguaugccu

SEQ ID NO: 4188645 - RNA, 57 nt, Human
aggcacuguucucagagcauuagauacauuauauuggucuaaucaugagaacaaccu

SEQ ID NO: 4188646 - RNA, 67 nt, Human
aggcacuuuuugcauuuuagaaaugacuguaacccccuaagucgguuuugaaauuuguaaaaagccu

SEQ ID NO: 4188647 - RNA, 63 nt, Human
agcccugccuucuuggccuuuaaagacuuugcuuuggcuuugacuuuaggagggacaggagcu

SEQ ID NO: 4188648 - RNA, 96 nt, Human
agcccugcugcccugggugagcugaagcagucaguucagcuuggagcugccgguuccagcugaguucagugacuucagugacucaggcguuggguu

SEQ ID NO: 4188649 - RNA, 66 nt, Human
agcccugguugagaaccacugguauagaauuuacuccuccaggaagguguuuaacuagagauggcu

SEQ ID NO: 4188650 - RNA, 59 nt, Human
agcccuugaguguaucucaaauaucuuucauuguuaaugagccaaauucuccaagggcu

SEQ ID NO: 4188651 - RNA, 78 nt, Human
agcccuuggaggccacuuggcagauggcagcuggcccauagcugcaaagaucugucagucaugaggcaccucagggcu

SEQ ID NO: 4188652 - RNA, 81 nt, Human
agcccuuuagauaaccauggaacucaguaaauuauagguagucaaauguaugauuuuagguuuagugaaggcuggagggcu

SEQ ID NO: 4188653 - RNA, 68 nt, Human
agcccuuucuucuucuggacuggaacagagggcacccccugcauugcuguacaggugaggagggggcu

SEQ ID NO: 4188654 - RNA, 64 nt, Human
agccgagauugguaccuuuucaggaagccaucgcauugguuuccugcgugugccacucauggcu

SEQ ID NO: 4188655 - RNA, 57 nt, Human
agccggggaccucuaucgcuuguauuuuaaugcgcugcaguuuauguguuccugguu

SEQ ID NO: 4188656 - RNA, 57 nt, Human
agccguguccagcuuuucccaccaaguacuaacugggguuuaggccugggcaaagcu

SEQ ID NO: 4188657 - RNA, 74 nt, Human
agccuacauguuuacuccaagucaggguuucucaagcuugacaccacugacuugcgaauggauaauuguuugcu

SEQ ID NO: 4188658 - RNA, 76 nt, Human
agccuaguucucgcuucucuagagcuggggaucaggaaguguuucucaguccaaaugagagguugagggccuggcu

SEQ ID NO: 4188659 - RNA, 78 nt, Human
agccuaugaugaaaacuguauuccauccucaucaacauaguuauggguucagauauggaaacaggacucacguagguu

SEQ ID NO: 4188660 - RNA, 74 nt, Human
agccuaugcugaacugagauguaacuuuucucauugcuagaaaaagucauguaaaccaguuugcucccaaggcu

SEQ ID NO: 4188661 - RNA, 74 nt, Human
agccucaggaugccuucaucaccuugcagcuccucuaaugagagagcuacagucggaaggacagacugcaggcu

SEQ ID NO: 4188662 - RNA, 68 nt, Human
agccuccagagucccuguucucggccuccacauauuuggcuuugcagguggagaaaggacuuugggcu

SEQ ID NO: 4188663 - RNA, 129 nt, Human
agccucccaaggacaguaaaauccuuuugaaaaaauccuuagccgagugagguggcuacaggcgugagccaccacacucggugaaggguuuuuucaaaaggacuuuacugugauuuuuuuggcagugcu

SEQ ID NO: 4188664 - RNA, 92 nt, Human
agccucccuaaggggcucagagagagugggguguggauuuggcuggugaaugggagucccccacuccauuucucacuuugccuggggaggcu

SEQ ID NO: 4188665 - RNA, 74 nt, Human
agccucccuugucucaagguuacucuaugaugccauuuacaucccagagcuccccaugggaucaggcugaggcu

SEQ ID NO: 4188666 - RNA, 62 nt, Human
agccuccucaggaagccacagugccugagcccggaaggugcgagugguuuucugaggagucu

SEQ ID NO: 4188667 - RNA, 66 nt, Human
agccucgguaucuucauguguaucugccucuuaaaguuguggaggcucagugaggaaauggaaguu

SEQ ID NO: 4188668 - RNA, 67 nt, Human
agccucucagagugcugggauuacaggugugagccaccacacccggcccaaaaguucugagauggcu

SEQ ID NO: 4188669 - RNA, 64 nt, Human
agccucucaggugccacucggagggaagcgcuggcugcuuccuccuggaggucacucaaaggcu

SEQ ID NO: 4188670 - RNA, 61 nt, Human
agccucugucaagcuuuucaaagacacccacaaacugucaccaagagcuuguacagggguu

SEQ ID NO: 4188671 - RNA, 85 nt, Human
agccucuguuugcugucugugaggagccacugagaucaagcaggucuagucuccacccaugacaguacacagcacuucauaggcu

SEQ ID NO: 4188672 - RNA, 56 nt, Human
agccugagcccugugacugcuuugaggagguccucuggcuguuugcagcucaagcu

SEQ ID NO: 4188673 - RNA, 107 nt, Human
agccugcagcaucuccgcagcucuucuggcuuguguccuuccuugcuagggguccuuucuuggggaaggguggacacaacgugggaacagaaggggaaaagcagguu

SEQ ID NO: 4188674 - RNA, 65 nt, Human
agccugcauuucaaggucucauauuguagauggaauacugcugcaagucauggcuuuugcagguu

SEQ ID NO: 4188675 - RNA, 60 nt, Human
agccugccaggagcuggugcugcaacucugucuuagugcccaucauucuccugguuggcu

SEQ ID NO: 4188676 - RNA, 78 nt, Human
agguaaaugaaacaagguccuucugugacauugaaagaagcaaugaccuucacagagggagccugugcgaauuuaccu

SEQ ID NO: 4188677 - RNA, 67 nt, Human
agguaagaguugauguugcagucuugaggagaauuccuucuccuucagaaaaccucagucuuugccu

SEQ ID NO: 4188678 - RNA, 102 nt, Human
agguaagcacagggggcaucaggaaaggaauguuccugaacacaagaucaccuuggagcugccaucuguguguucaggaaguccuggggcucccuccuuccu

SEQ ID NO: 4188679 - RNA, 58 nt, Human
agguaagugucugcuggcucuacccuaaguacaagggcuacaacuggcuggcacuccu

SEQ ID NO: 4188680 - RNA, 64 nt, Human
agguaaguguuauuauucucacuuucuacauaaggaaagcucagaagaaauaagcaacuugccu

SEQ ID NO: 4188681 - RNA, 56 nt, Human
agguaauacagaugagcuucugccucccacaagagagcaaccacaucuguuuuccu

SEQ ID NO: 4188682 - RNA, 72 nt, Human
agguaauagaauauuaauacugaaaggaguaucagcuaauacauagagauaaaaaucaguaguauucugccu

SEQ ID NO: 4188683 - RNA, 55 nt, Human
agguacauaggaaaguggagcuggaaguuucccacagcuuuguuccauauugccu

SEQ ID NO: 4188684 - RNA, 85 nt, Human
agguacauguauuuguauuaggcccuagggaguuucaagacaagcugaauuuccuucaguguuuaauacuucauaaauaaagccu

SEQ ID NO: 4188685 - RNA, 55 nt, Human
agguaccauaugcgggagcaaccuuagaaugccaggugugcccgcaucaggaucu

SEQ ID NO: 4188686 - RNA, 103 nt, Human
agguaccuggggccuuacugaaaugcuuguauauuucuugguccuugugaggaugaaagagcaggacaaugcauagacuuugggggcguccaggucaggaccu

SEQ ID NO: 4188687 - RNA, 96 nt, Human
agguacuggacacaguggaaaaacacuuccuguaacaugacaguggucugacuuaacccuuccaaguucccaggagauguacacguguauguaucu

SEQ ID NO: 4188688 - RNA, 80 nt, Human
agguagagagccaagcaaaauggacccugggcugaaaauggagauucuguaaggcaccuguccaggcugggcuucugccu

SEQ ID NO: 4188689 - RNA, 59 nt, Human
agguagagcaccuggcugcccaauggauaaccucaguugcugccuggaggccucuaccu

SEQ ID NO: 4188690 - RNA, 56 nt, Human
agguagagccacugucagcaucaugauugaaguacuggccaguguggcucugaucu

SEQ ID NO: 4188691 - RNA, 130 nt, Human
agguagcccugagacacuucagaggcaaauuucacugggagcggcugucacugguuugcuuucaccauccgcaaaucugcccuuucccagugguuuuucucaucuacaaucccaugucucaaaguugcuu

SEQ ID NO: 4188692 - RNA, 57 nt, Human
agguaggaaagucuccuuguauugaccagcgacaggcgcaagaggauguucuggccu

SEQ ID NO: 4188693 - RNA, 61 nt, Human
agguagggaaaagacuucacuguuuauauguuaagugaacauuaguuucuuuucccuggcu

SEQ ID NO: 4188694 - RNA, 70 nt, Human
agguagugcguguggaaugagaguguggagagguuggcugugucacacuucagcuccacaaacauuaguu

SEQ ID NO: 4188695 - RNA, 77 nt, Human
agguaguuuccugugcuuauucuucucugaugcuccuagcagcccucugaggcagaaaaagcaaggguuguuaaccu

SEQ ID NO: 4188696 - RNA, 79 nt, Human
agguauaacccacuucaauuaacuucagcauuacaguaaugagugauuacaaagaugauugagggggcaaaacguacuu

SEQ ID NO: 4188697 - RNA, 58 nt, Human
agguauaagucucauuucuguuaccuugaccaaguuauuuaacaugggucuuauaccu

SEQ ID NO: 4188698 - RNA, 61 nt, Human
agguaugacaaagagaggcccaugcaguguuuucuaaccuugcacucucuuugguauaucu

SEQ ID NO: 4188699 - RNA, 76 nt, Human
agguauggcaaaagcaaagucccugaaugugucauuagaagugaugguaaguguggguacucuugcuuccacuccu

SEQ ID NO: 4188700 - RNA, 73 nt, Human
agguauuagcacaaagcaagguauuaacagggcccaaucucuaccaaauaccaaguuucuuugucuacuaccu

SEQ ID NO: 4188701 - RNA, 75 nt, Human
agguauuuauagcagcacaaauggacuaugacagaaauugauacugagaaugggauguugcuauaacuaauaccu

SEQ ID NO: 4188702 - RNA, 95 nt, Human
aggucacagagucagagagucagagaguuaggcugaauccuggguucugccagcacagucuguguaccuuuggccuucuaccauuuuuguaacuu

SEQ ID NO: 4188703 - RNA, 95 nt, Human
aggucacugucagcugggagacccucagaguaggcacugcugggcagaucucccagugccuaucuccucugggaacuucccggacugaucgaccu

SEQ ID NO: 4188704 - RNA, 61 nt, Human
aggucagauggcuuauuggggguuccagaauccauuuuauaucuuccaagccagcuugccu

SEQ ID NO: 4188705 - RNA, 84 nt, Human
aggucagcuggauccacagugggcuuuguaugaucaaaaaauaagcuuuuaauuauguuaagccacugagauuugguugugcuu

SEQ ID NO: 4188706 - RNA, 67 nt, Human
aggucaggauccaagucugugcuugcagcuguuucucuguccagcuacuugaccuugggcuuggcuu

SEQ ID NO: 4188707 - RNA, 60 nt, Human
aggucauuuccuuagaggcagaaaucacaacuuauuuuucuuucauucagggccugaccu

SEQ ID NO: 4188708 - RNA, 93 nt, Human
agguccaagcagucugagggguucaggggcccaaggucaccagaaagaaagagaacccaggguuccugggucccagugugcuguucugcaccu

SEQ ID NO: 4188709 - RNA, 56 nt, Human
agguccaucguggaugaacugcuccccaagaaaagugacagaaacacgcugggcuu

SEQ ID NO: 4188710 - RNA, 64 nt, Human
aggucccauauacuuuuucugguccaugugcagaguaaugguccaaaccagugcuguggucccu

SEQ ID NO: 4188711 - RNA, 59 nt, Human
aggucccauauauguuuauauuggaaaaaauaauacuuucuaaagcaaaagugggaucu

SEQ ID NO: 4188712 - RNA, 119 nt, Human
aggacuucaauauuuacagguguauuaggauguuccuaugcacauuaaaaacagaaaaccauugcucuaggaaccaugcacauaggaacauccuaauaugccuguaaauauugaagccu

SEQ ID NO: 4188713 - RNA, 60 nt, Human
aggacuuuaucuucuagaccucauuuagcaugaggauagagaaacacagauaaaugucuu

SEQ ID NO: 4188714 - RNA, 81 nt, Human
aggacuuucauuaagaaaugaggaguccccaaagugaacugcugcagagugguggaucuuuauauuucuuauggggugccu

SEQ ID NO: 4188715 - RNA, 61 nt, Human
aggagaaagucaaguuggucuucauucucaguccugaggcagacaacugugacuauucccu

SEQ ID NO: 4188716 - RNA, 59 nt, Human
aggagaaauccaucgagaaugggccguuugcuaguucauucguuuggugacuuuuuccu

SEQ ID NO: 4188717 - RNA, 86 nt, Human
aggagaaggacaggagcaagugggcugcauguuuacuauucagaaucuggacauuggcuaaugggccccuuugacugucaucuuuu

SEQ ID NO: 4188718 - RNA, 62 nt, Human
aggagaagggcugaaagaccuugggcaacauagcuaaccugucuaagccucagucuuucccu

SEQ ID NO: 4188719 - RNA, 56 nt, Human
aggagaaguagaagagcccuggacuuggacugacaaguccugcuuucuacucugcu

SEQ ID NO: 4188720 - RNA, 57 nt, Human
aggagacaguuuggacguguagaauauaaauuucuacuuuggcuagaguugucucuu

SEQ ID NO: 4188721 - RNA, 63 nt, Human
aggagacauaacuaugaugagagagucccuugaggccaaggguaauuucaagguagagucccu

SEQ ID NO: 4188722 - RNA, 84 nt, Human
aggagacccugaggccguuggugggccuuaccugcugccuucucucccugccagggucaggccaguccuauugccucuucuccu

SEQ ID NO: 4188723 - RNA, 70 nt, Human
aggagagcuggggugcugcuuguugaaguagaaaaacgaggugcuggacaugcaaaaaucacagucuccu

SEQ ID NO: 4188724 - RNA, 58 nt, Human
aggagaggcaucaagaaaaucgcuaaaggaaaugugaugagcuugagggcuuuuuccu

SEQ ID NO: 4188725 - RNA, 92 nt, Human
aggagagucuugcucuauugcccaggcuggagugcaguagcacaaucuuggcugacuacaaccuccaccucccggguucaagcaauuguccu

SEQ ID NO: 4188726 - RNA, 81 nt, Human
aggagaguuguauguguuuaucugagcugaaauaggagcacuugucuacccaguuuauauauaagcacauugcucuugccu

SEQ ID NO: 4188727 - RNA, 77 nt, Human
aggagaucauguagcaaaagcagccacucucucugccucagcccaaggcuagggaggaugggcuuuaucuggucccu

SEQ ID NO: 4188728 - RNA, 66 nt, Human
aggagauggaggagcuauaggcaauaucauugcaagagcacugcugaagagcuucugcccuuucuu

SEQ ID NO: 4188729 - RNA, 61 nt, Human
aggagauggggucagcugggacauugauaggcuuucagaguuuggagggaccuuaucaccu

SEQ ID NO: 4188730 - RNA, 64 nt, Human
aggagcaaggaagcuacaguuuacuggaagccucagccccagucuuuguggguucauuguuucu

SEQ ID NO: 4188731 - RNA, 61 nt, Human
aggagcaggcuugacagccugggcaccugcaccugccacagcuaccugcaugccugcugcu

SEQ ID NO: 4188732 - RNA, 56 nt, Human
aggagccagaugcuauugcuggaaagaaaauuuucucagcucagcaucugggucuu

SEQ ID NO: 4188733 - RNA, 62 nt, Human
aggagccugacuccacacuaagggcgagaagucccaggcccagagugaguggggaaggcccu

SEQ ID NO: 4188734 - RNA, 68 nt, Human
aggagcgagggcucuuaauucucaaguaacaaucccauugucccagaggauagaagccccauguucuu

SEQ ID NO: 4188735 - RNA, 85 nt, Human
aggagcucccucagggaaugggcccagucccuuacaaaucaagccugggcuugggguucagggacuggcucucugagcaggccuu

SEQ ID NO: 4188736 - RNA, 70 nt, Human
aggagcucuaucugggaguucuuuguagucaauacaaggaggaaagaaggcccccagcagaugugcuccu

SEQ ID NO: 4188737 - RNA, 80 nt, Human
aggagcucugaggacaggguccaaaggcaggggaggcagauucuccaccgucucccuggccuugccuucaggggccuccu

SEQ ID NO: 4188738 - RNA, 65 nt, Human
aggagcugcucuucuagguggaucuucaggagugaaaggaagaaggaacacacugagcaacuccu

SEQ ID NO: 4188739 - RNA, 72 nt, Human
aggagcugguggcuccaggacccaguggcuccaggacccagucuacagccacggucuauggaggcggcucuu

SEQ ID NO: 4188740 - RNA, 62 nt, Human
aggagcuucugcuuagauaggaaugcugagaaccaucagaaucuuuucucugcaggauuccu

SEQ ID NO: 4188741 - RNA, 69 nt, Human
aggaggaaaugacagaugagaauaauccauuuaugagauggaaacauauucugaugugcauucaauccu

SEQ ID NO: 4188742 - RNA, 64 nt, Human
aggaggaagcagagugggguaguggggaauccaggcccagaaccccaggcaucgcauuccucuu

SEQ ID NO: 4188743 - RNA, 56 nt, Human
aggaggaaguauuugaaaagaggacugacccauauucucuucaaauauuuuauucu

SEQ ID NO: 4188744 - RNA, 55 nt, Human
aggaggagcaguuuugggaauggcacaacaagcucagaaguugaaggcucuuuuu

SEQ ID NO: 4188745 - RNA, 74 nt, Human
aggaggagguguggaugcuuaaugacccaacaggagaugugaccccuugggaggcuuccagaccuugcuuuccu

SEQ ID NO: 4188746 - RNA, 117 nt, Human
aggaggcagugaaccucuccugcccuuuccuuccaucuccaucaccuugagcaucuucugggcagcugaggugaccgcagaugggaaggaagggcgcagagaugagcauuuucuucu

SEQ ID NO: 4188747 - RNA, 67 nt, Human
aggaggcauucugacaguaaucaguuugcugcuaagcagcacugguuuuuggcggaaguauucuccu

SEQ ID NO: 4188748 - RNA, 65 nt, Human
aggaggcuccgccggcucccagcaucccagcauccuccgugccaugugggccgugcggguguccu

SEQ ID NO: 4188749 - RNA, 61 nt, Human
aggaggcugugggcaucgggauccuguuuguucuugcuggcacugccuggcccggcuuccu

SEQ ID NO: 4188750 - RNA, 62 nt, Human
aggagggaggaaugcaacuuauuuagcuaucggauuaguuauuaugccauuaccucccugcu

SEQ ID NO: 4188751 - RNA, 56 nt, Human
aggagggcugcuugcuguguggugucagagacugaacaggauaggacaguguuccu

SEQ ID NO: 4188752 - RNA, 65 nt, Human
aggaggggcaggcuuggaaauaaccuggggggucuguucccagugagguccuggcugucuccccu

SEQ ID NO: 4188753 - RNA, 78 nt, Human
agggaaaauuacaaguuucaguguuuugcaagguguaacggcauauuuuauggcaauacugagauuauuguacucccu

SEQ ID NO: 4188754 - RNA, 77 nt, Human
agggaaacguggccagacacaugcagaccuggaaugagcuuguucaguuagcaaugaaaucuggaugcuguuucuuu

SEQ ID NO: 4188755 - RNA, 129 nt, Human
agggaaagccuagaaacagaggagccuaagcagaagaaaaggcagaaauucaacuacuggucagcaaaaccuggaacugagaauuccaguauaaggauacuucugucuucucugcuuccucuuuccacu

SEQ ID NO: 4188756 - RNA, 79 nt, Human
agggaacacuauaagacagauacagcacauguagauuuugagucuuuugcgaguguuuguacuuguagacauuuugccu

SEQ ID NO: 4188757 - RNA, 92 nt, Human
agggaacugcgucuuauagucuuacacuuaccuguccauugaauguagacuuccccaggaagggagugugaucuuggauaagccaguucucu

SEQ ID NO: 4188758 - RNA, 57 nt, Human
agggaagagccaauguugcagaugaauuccaagggccaucugcuggcagaauucccu

SEQ ID NO: 4188759 - RNA, 55 nt, Human
agggaagaguaacuagcccaugugcaccuagacgcacaguguuagguuuuuccuu

SEQ ID NO: 4188760 - RNA, 55 nt, Human
agggaagcaaugauuauuauucauuuguacuauaaauauggauuguugcugcccu

SEQ ID NO: 4188761 - RNA, 68 nt, Human
agggaagggaaaugaaggaagcuauuguucaguaguuuacacuuuugauucuuauuguuuuccucucu

SEQ ID NO: 4188762 - RNA, 78 nt, Human
agggaaguauuugaacaggcuggccuugaagcagugguagacacuguugaagugccagcuugauugagucauuuaccu

SEQ ID NO: 4188763 - RNA, 125 nt, Human
agggaauauuuggauugguguggccuauugauguuauuuauugaaacacuuuggaacaaauucuauaggcugaguugauaauuuugaugugaguaugccaaaggggcaucaguuacuauuucccu

SEQ ID NO: 4188764 - RNA, 60 nt, Human
agggaauguagcaagaugccaacuccuaaugacggagcuuggguggguuggugguucccu

SEQ ID NO: 4188765 - RNA, 74 nt, Human
agggaauuaaaauccaguguugguggauagagcuauuucuguggcguucucuugccuuuggauuucaguuuccu

SEQ ID NO: 4188766 - RNA, 55 nt, Human
agggacacuggacccaguguccaccugacucaggugauauggggcuaguguucuu

SEQ ID NO: 4188767 - RNA, 66 nt, Human
agggacagcaguggugcacugagccaaggguggguaccugggcagugccuaccauggcugaucccu

SEQ ID NO: 4188768 - RNA, 68 nt, Human
agggacagucuacuguucacugaauguaugcuuacaaaaagugacaugugguaggcauaguuguccuu

SEQ ID NO: 4188769 - RNA, 60 nt, Human
agggacaugauuucagggaauucucacugggguccauugugaaauuugaggucagugcuu

SEQ ID NO: 4188770 - RNA, 55 nt, Human
agggaccugcucacugccuggcuucagccaccugaggccagguaccagguacccu

SEQ ID NO: 4188771 - RNA, 69 nt, Human
agggaccuguugaggccaugacacuuuagaaaacaauauuucaaaucacuuuggagcuuaaugggcccu

SEQ ID NO: 4188772 - RNA, 76 nt, Human
agggacuagaccugccaggacaagagugaggucugaucagauuaagacucccagguugccuggcaggcaaguuucu

SEQ ID NO: 4188773 - RNA, 60 nt, Human
agggacuaucauucaaucucuucccugcaaaggguaaggccagcccuaaugaugcucucu

SEQ ID NO: 4188774 - RNA, 128 nt, Human
agggacucuguuuuuauucacaaugaauuuuauucauuaaguucccaugccuaaaacauuguucuaguaggugcucaggaaauaguuuaguguuaagugaaugccuuuugugagauuacacuguuuuu

SEQ ID NO: 4188775 - RNA, 55 nt, Human
agggacugagcuaggaucuagugacugcauugucucugagaugccuuccagcccu

SEQ ID NO: 4188776 - RNA, 56 nt, Human
agggagacaaaagcagcugccauggagucuucuaugauucagaggcuauucuccuu

SEQ ID NO: 4188777 - RNA, 69 nt, Human
agggagaccacaguuucauucaugcaggugcuuucuauagauuuguaguuuaaauuguggauucuuucu

SEQ ID NO: 4188778 - RNA, 63 nt, Human
agggagagaacaagucauauuuuuauuagucuauguggagaaucuggcugauguuuuuucucu

SEQ ID NO: 4188779 - RNA, 83 nt, Human
agggagagguggggugagcugcagacuacacccacauggcuauaaauggggagccucuggcugcugcucacucagccucccuu

SEQ ID NO: 4188780 - RNA, 68 nt, Human
agggagcgaaaggaugaaugagugggccgaucacuugccgguggcuccagaucugucuccuguucccu

SEQ ID NO: 4188781 - RNA, 128 nt, Human
agggagcggggugagacagggccuagaagcagaaaggcccccaguggaugauuuggcugcuagggggugggcgccccuggggccucaucccacugcucugcagaggccguuaaaucaccccacucccu

SEQ ID NO: 4188782 - RNA, 86 nt, Human
agggagggccggaggaggacugggaggcaccgcgucgugcucgcgagagaacagaaaugcgcuucccccagcuuuggcgccuugcu

SEQ ID NO: 4188783 - RNA, 94 nt, Human
agggaggucucagcuguuggaguaugggugcuucuaguuuuaaagaggugugggcucugcuaaaguuuccgucuuucauucagucacacucccu

SEQ ID NO: 4188784 - RNA, 71 nt, Human
agggagguguggcaggagugcaaaaggcucuguuuuuaucuugugcugaccccuccuggccacacuaccuu

SEQ ID NO: 4188785 - RNA, 69 nt, Human
agggagucaaggguucacuguuaucuaugagauguacaugauauggguagaaguggcccaagcuucccu

SEQ ID NO: 4188786 - RNA, 64 nt, Human
agggagugcucggguugucugaagcugguaguggcagccagcaaagauguccggggcaagcuuu

SEQ ID NO: 4188787 - RNA, 80 nt, Human
agggagugggcucccugucuggaacuggacuccaaugguuggagguggauuuaaaaucagaugggaguuggcugcucccu

SEQ ID NO: 4188788 - RNA, 62 nt, Human
agggauaaugucuuagcccacaaaaauucacuuuuuugacaggauauaaagacauaaucucu

SEQ ID NO: 4188789 - RNA, 100 nt, Human
agggauagggaaggcauuguuuuugagaauguucugggaguggcugaaggacuguacuggcagagcacccaaggagcauuuggacugucuucucaucucu

SEQ ID NO: 4188790 - RNA, 63 nt, Human
agggauccacagaacaaccuccccagcuauugucugggcccaggcugccucugcaggaucccu

SEQ ID NO: 4188791 - RNA, 69 nt, Human
agggaucucagggauggagcugggccucagguuaaggaauccugggcucucgucccugcagaagucucu

SEQ ID NO: 4188792 - RNA, 75 nt, Human
agggaugagcugcacgcagcauccaagagagcagcccagcucuuaaagcaccuccuuggauguguggggcucccu

SEQ ID NO: 4188793 - RNA, 72 nt, Human
agggaugcuucaaaauaagcacuuaacuguaucaucuugaugggagguucuuuggugcuuguagcaauuucu

SEQ ID NO: 4188794 - RNA, 58 nt, Human
agggauggaucuuggcccuggaagcuccuggauuuaagcuucugcccugccauucacu

SEQ ID NO: 4188795 - RNA, 71 nt, Human
agggauggguauuggcagaagagggcaaggcuuagccgcaaagcuacucucgccacauacacaccaugucu

SEQ ID NO: 4188796 - RNA, 114 nt, Human
agggaugugguuugagauucugcguuucuaucuggcuuucagaaaaugugaggcugcugguuagagacccacacuuugaguagcaagauucaaauguggcuuuaacccaucccu

SEQ ID NO: 4188797 - RNA, 75 nt, Human
agggauguguugaaagagaacacacauguaaaaugcuuaauuuguaacauuguaaauaccuuuaucaccaucccu

SEQ ID NO: 4188798 - RNA, 83 nt, Human
agggauugauaacagaaucagcagugaguggcuuucauggugguagugauggaagccacucauucuggcucuuuuuuaacccu

SEQ ID NO: 4188799 - RNA, 84 nt, Human
aggcuagucagugaggauaugagagcuuuuuggagcacuagcagcaucagauuggagugugaugagaagcugcugacuuagccu

SEQ ID NO: 4188800 - RNA, 104 nt, Human
aggcucaauugcugccuuuguguacagauugaucauggagaggggagguuuuuucaaguggauuuucuaaugaaaucuguacaguagggacagaaguuaagucu

SEQ ID NO: 4188801 - RNA, 62 nt, Human
aggcucagauccuuguguccugccacaagaccagguuggggcgggaaggagguucugacccu

SEQ ID NO: 4188802 - RNA, 61 nt, Human
aggcucagcagcuuaucuuggagaggcaauuagauugcccuugagaaagaugcuucagcuu

SEQ ID NO: 4188803 - RNA, 56 nt, Human
aggcucaucugagcagaaaccugagcuaacagcaaagagaacugucuugauggccu

SEQ ID NO: 4188804 - RNA, 85 nt, Human
aggcuccagggcagggguguaagaauggugguggggccagcagguuacagccucagggcugacugcuacucuccccugcuagccu

SEQ ID NO: 4188805 - RNA, 58 nt, Human
aggcucccugaaucgcccguucccagagcuaccaggcagacacggcauucaagggccu

SEQ ID NO: 4188806 - RNA, 56 nt, Human
aggcucccuugccauucccaggagggcaagccgcagccuggguggcuagggaguuu

SEQ ID NO: 4188807 - RNA, 74 nt, Human
aggcuccucgcuauuuaaagagcuugcaaaagucuaaggaaagccaguuucuuaaguaggaagaaaaggagucu

SEQ ID NO: 4188808 - RNA, 59 nt, Human
aggcuccuggaaacuucagggaauaaaagaguauauguuacauuuucugaagugagccu

SEQ ID NO: 4188809 - RNA, 88 nt, Human
aggcucgaguaggaauguucugccaucuugggaagaccacuggucccacuagugaaguagauggcagaugcuuccuggcuuccagucu

SEQ ID NO: 4188810 - RNA, 61 nt, Human
aggcucuauaccgcugggaguuggaacacaaaagaugucuuugcucccaugucuggagucu

SEQ ID NO: 4188811 - RNA, 61 nt, Human
aggcucuccagagagcugcuuuucugcacauauuuuauaagaaucagcucucuaagagucu

SEQ ID NO: 4188812 - RNA, 60 nt, Human
aggcucuggaguuagccaggcauugucccaacccaaguucugucacuuuuuccugagccu

SEQ ID NO: 4188813 - RNA, 55 nt, Human
aggcucugggcucuagauuuuggggacaccccugccaucguggagguuacagucu

SEQ ID NO: 4188814 - RNA, 61 nt, Human
aggcucuguaauccguacauuauucugaacuuuuccagagacagagaaaacggaagagucu

SEQ ID NO: 4188815 - RNA, 56 nt, Human
aggcucuugugagguagcugcaaccaaaaaagagcugcaagccaagcugagagccu

SEQ ID NO: 4188816 - RNA, 84 nt, Human
aggcucuuuccuagaggguaaaacaagaucaagugguauuugauugaaaauaaggccagaaacaaaaacucuaagaaacagccu

SEQ ID NO: 4188817 - RNA, 70 nt, Human
aggcucuuuggggucacugaagugucauuuggaaaaugacuucccaaugcauaaugauccccuaaagccu

SEQ ID NO: 4188818 - RNA, 81 nt, Human
aggcugaacauucuugaacaucuguccaaaagacucuccuccacauguguaccaggacacauguucaagaauguucagcuu

SEQ ID NO: 4188819 - RNA, 62 nt, Human
aggcugaagacaauggaauugacugugccaggcacacuucucaccagacugucucaucgccu

SEQ ID NO: 4188820 - RNA, 129 nt, Human
aggcugaagugggaggaucgcuugaccccaggagguugaggcugcagugggcugagaucacaccacugcacuucagccugggugacagcaagacccugucucaaaaaaaaaaaaaaaaaacuuuaguuu

SEQ ID NO: 4188821 - RNA, 71 nt, Human
aggcugaaguuaucuuuuuguucaucauucacuaaaguuugaccugaaacaugaguuaaaaguaacugccu

SEQ ID NO: 4188822 - RNA, 61 nt, Human
aggcugagcaggagggcaaaauucagucuggguacaaucugggcugcuccuguggcagccu

SEQ ID NO: 4188823 - RNA, 60 nt, Human
aggcugagggccgaggagcuguggguugguugcagggacccugguaucuggcucucuccu

SEQ ID NO: 4188824 - RNA, 62 nt, Human
aggcugauugagauauucaagaggaccaaaucuuuauuuggucauuuuuauuucaguugcuu

SEQ ID NO: 4188825 - RNA, 92 nt, Human
aggcugccaggggacgcuggggcaaggcuggguaaccuguccacugccugaugucagaguggcagagaccccagccagcccucucuggcccu

SEQ ID NO: 4188826 - RNA, 58 nt, Human
aggcugcccugccgccagugggccucccaagcggcccugcccacagcagggauagucu

SEQ ID NO: 4188827 - RNA, 76 nt, Human
aggcugccugcacagagcugcuuuuuaaucacaagauguucaacuaaaagugcagccguguugucagcgcaugucu

SEQ ID NO: 4188828 - RNA, 129 nt, Human
aggagggaaagcagugugaauguagauggagauucuggcaaaauccuggcuuuuaaccuacaaagacugggaaugaaguuauauuuuguccuagacuuuuuauucuuuauguugaaauuuccauauccu

SEQ ID NO: 4188829 - RNA, 65 nt, Human
aggagggaaggaguugaauggccugcuccugucuuucaggaaguccugaaacuucuuucugaacu

SEQ ID NO: 4188830 - RNA, 65 nt, Human
aggagggaagucagggacuggaauuagaauaacaauggguucuucuuucuacuuuguuucccccu

SEQ ID NO: 4188831 - RNA, 98 nt, Human
aggagggauucuccccaagaggcucagagggagcauggucuggccaacaccuugacuuugcaauucuagccucuugaacucugggagaauaaaugucu

SEQ ID NO: 4188832 - RNA, 83 nt, Human
aggagggccagagguaggguuggcccaggaauaccauucccugugauccucuuggccccaacccucuauuuuuggcuucuucu

SEQ ID NO: 4188833 - RNA, 59 nt, Human
aggagggucuguuuaccaccucuuucagaaaaugaaccugagagaccacagagcugccu

SEQ ID NO: 4188834 - RNA, 56 nt, Human
aggaggugauuuucaaaagaacuuuccagugugaagauuuuuaaaaauccccuccu

SEQ ID NO: 4188835 - RNA, 56 nt, Human
aggagguguagauuuccugucacuguuccuuaucaacagagaaagagcagccuccu

SEQ ID NO: 4188836 - RNA, 76 nt, Human
aggagguugggacguggaauacugagugacuagagaaauagacugaagucauacacuguucugacaccaauauucu

SEQ ID NO: 4188837 - RNA, 69 nt, Human
aggagucugccagagaucugggcagaguuuauacacagaaucuggggcucuuuucucuggcucucuccu

SEQ ID NO: 4188838 - RNA, 123 nt, Human
aggagugcgcauugaguuuuaaccaaggaaagauauuuucacacaaggugauaaguucagcacaggcuguaaggacucuggaacucuugguaagagaauguuacaggucucaggcccauucuu

SEQ ID NO: 4188839 - RNA, 58 nt, Human
aggaguuaagguucaauuaaaguuacuuaaaugugacuaaaauaggacauuaacuuuu

SEQ ID NO: 4188840 - RNA, 92 nt, Human
aggauaacgcccagcccuccccuugcccccuguggcugccuccccuuuccgucuguugagagaggaagccaggggguguugggugcaacccu

SEQ ID NO: 4188841 - RNA, 56 nt, Human
aggauaaggucaaaggcuaggcaaggguagaccauguagagcuuagguuuuauucu

SEQ ID NO: 4188842 - RNA, 58 nt, Human
aggauaguucuggacuauguuagcaggauauuacgucuaacaaucuagaagcuauucu

SEQ ID NO: 4188843 - RNA, 56 nt, Human
aggauaugaagucagacaaacugggauucaaucccagcucuaugcuucaauauccu

SEQ ID NO: 4188844 - RNA, 82 nt, Human
aggaucagaggcuuuaaauggcuugcccaagucagaaaacuaaguggcugaggcaagauuugaacccaggcaaucugguccu

SEQ ID NO: 4188845 - RNA, 57 nt, Human
aggaucuuagcacaagacgugcucauuguuacuagcgugucauuguuucuaggaccu

SEQ ID NO: 4188846 - RNA, 55 nt, Human
aggaucuugcuauguuggccaggcuagucucagauuccuggccucaagcaguccu

SEQ ID NO: 4188847 - RNA, 76 nt, Human
aggaugaaugaugaugaccgccaacguuuagguguccgcagauuuuacagaagccuuuggccauuugacuucuccu

SEQ ID NO: 4188848 - RNA, 77 nt, Human
aggaugcuugaaguuuaagguuagauaaguaucaagaagcugaaugcuuaucuggaaacuuugaacuuucagugccu

SEQ ID NO: 4188849 - RNA, 82 nt, Human
aggaugggggaugcacagggagggggccagcuccauucugccuugagaggccugugcuuucuucccuccugccaccccaccu

SEQ ID NO: 4188850 - RNA, 86 nt, Human
aggaugguagagauacgagaggcagggguuuggagaaugucccuuagcagcaacuuuacagccccacuuccgggcucugcuguccu

SEQ ID NO: 4188851 - RNA, 67 nt, Human
aggauguuugcucugcucugcauuucagaacauuuaaucugaaauucacaguugagucauucauccu

SEQ ID NO: 4188852 - RNA, 65 nt, Human
aggauuacuugauuuuaguuuuaucuagaacacucuggaaagcaguucuuagaaucgggaauccu

SEQ ID NO: 4188853 - RNA, 65 nt, Human
aggauuccuagaucuccccuuuagagauucugauuccacaggucuggagugaggucugggagccu

SEQ ID NO: 4188854 - RNA, 56 nt, Human
aggauuggcuuuggaggcggcgguccucacucagaccugugccuccugcuaguccu

SEQ ID NO: 4188855 - RNA, 70 nt, Human
aggauugggcuugggccugggucuuugcugccagguggcccugcgguaaucauccaggccucccaugccu

SEQ ID NO: 4188856 - RNA, 76 nt, Human
aggauuugaauguuucagaguccacaacuuuuaacuauuauccagagagcuagucucugaacaacauacgaaucuu

SEQ ID NO: 4188857 - RNA, 59 nt, Human
aggauuuggaguuuaacaacuugaagauggugaaaauuuuaaagugcugcuccuauccu

SEQ ID NO: 4188858 - RNA, 113 nt, Human
aggauuuguuggugaauggaauguaaagcgugugauaaaggauaguuacagcauugucuuauagcaauuuuaucauccagcuuguuauuuuauccaucucaccagcccagccu

SEQ ID NO: 4188859 - RNA, 107 nt, Human
aggcaaaccaguaaggcccggcuaacagauauuuucagaacauucauucacuucaaaaucagaucagugaaagguugagaauauucucugggaaaucuggucugccu

SEQ ID NO: 4188860 - RNA, 65 nt, Human
agggaagaggcaagguuuauggaacacuggauucuuuccagagacccaacuuggcacucuuuccu

SEQ ID NO: 4188861 - RNA, 69 nt, Human
agggaagauugcuuaacuaauuaauuauagauuuguuaauugcaguuaaagaguuuggcuuucuucccu

SEQ ID NO: 4188862 - RNA, 69 nt, Human
agggaagcagaauuuaauagaaaggucuggcuaacaaugugcuacauuuggaccagauucugcuacccu

SEQ ID NO: 4188863 - RNA, 88 nt, Human
agggaaggugggauuugaguauucacagaucacucuguaggggauaccauuuauagaaccuguugugaaauucaguccagcucuccuu

SEQ ID NO: 4188864 - RNA, 60 nt, Human
agggaaguuuaucauauccucacagagacgugagcauauugucuuuggugucucuuccuu

SEQ ID NO: 4188865 - RNA, 67 nt, Human
agggaauaaaugggggaauccuguuuugguauuuggcuaggccagagagaccucaugaaauuucccu

SEQ ID NO: 4188866 - RNA, 113 nt, Human
agggaaucggauaaagaacaccaauuucuguaggaauaguuggccagggugcaauagcccaagccugcuguuaacugcaggaauucauugugccuugggucaaauuuuucccu

SEQ ID NO: 4188867 - RNA, 99 nt, Human
agggaauggcucauggagucugauggccaggguuugaaaacuggcuuugccauuugugaacuuaggcaauuagguaaccucccugugccuggauuuccu

SEQ ID NO: 4188868 - RNA, 71 nt, Human
agggacauugucaauggugguagauuucagacaguccugcucauuuuuuuacaacuauuugccauguuguu

SEQ ID NO: 4188869 - RNA, 57 nt, Human
agggacucccugggccgacacgggccagccuuucccuguguuggcucugggaucccu

SEQ ID NO: 4188870 - RNA, 98 nt, Human
agggacuccuuggacaaaauuucaagucuugaagaaguagguuuacucaagcaaaacuaaccuccuuuccaagucuggaauagguaugagauguccuu

SEQ ID NO: 4188871 - RNA, 81 nt, Human
agggacugacuuaccgaagcugcuuuugcauguguugaagggcugcaugcaggaagggcuuggggacguucacagauuucu

SEQ ID NO: 4188872 - RNA, 86 nt, Human
agggacuggggacagugaauagucguguuguguuagggcucagaccgagacacuucaugcauucuucacucucaccucguguuccu

SEQ ID NO: 4188873 - RNA, 84 nt, Human
agggacuucaucuuucugagccucaguucccucaucugugaaaugggguuaaucagaaggcugacaagauauggguuagucccu

SEQ ID NO: 4188874 - RNA, 82 nt, Human
agggagagacuucuuaauggcaaaggauuuuauguuuaucuuuaucaugaaaaacuuuaauccauaaaguagaauguuccuu

SEQ ID NO: 4188875 - RNA, 65 nt, Human
agggagagagggaugucaggggaccuuggcuggguguccgcucaauguccacauccccucugccu

SEQ ID NO: 4188876 - RNA, 77 nt, Human
agggagagcaacuagucccagaugacccagcuacuaauugacaaagcagaaaacuggagucugggacuuucuacccu

SEQ ID NO: 4188877 - RNA, 62 nt, Human
agggagagccuggccuccaaaggacuucguuauuaucuguuuuauaggcugggguuugcuuu

SEQ ID NO: 4188878 - RNA, 69 nt, Human
agggagcacaguaaguuagucucccaagauggugccauuuaauucagacuguacuuucugcagcucucu

SEQ ID NO: 4188879 - RNA, 66 nt, Human
agggagcaugccaggaacaaacaguggugcccacucacugggcccauuucuugaguucagcucuuu

SEQ ID NO: 4188880 - RNA, 59 nt, Human
agggagcuucuacuucaaggcauuuacauuggcuguugccuuagcuuagaacgcucuuu

SEQ ID NO: 4188881 - RNA, 102 nt, Human
agggaggaacaaaggcagucauguauggagcucugccugccccaggccuggaucagggcaguagcuucguaggcaucaguuuucuuucccuguuccugcccu

SEQ ID NO: 4188882 - RNA, 75 nt, Human
agggaggcacagggccgcccucugugcugaggccguggaggaagccaggaggaggguggcuugcuuugcuuccuu

SEQ ID NO: 4188883 - RNA, 55 nt, Human
agggaggcauuagcuacugcgauuuaauucguaucgcuggguguaaugccccucu

SEQ ID NO: 4188884 - RNA, 55 nt, Human
agggagggagaaaggagauaaagggcagguauuuuauuucuuugacucucucccu

SEQ ID NO: 4188885 - RNA, 71 nt, Human
agggagggccucugugggugcucacccuuggagagggucugucaaaaaaaggccccagggaggcucucccu

SEQ ID NO: 4188886 - RNA, 79 nt, Human
agggaguaauguuuccuggaauuuuugacuuuucagauaaauaagcuuagaauguguuaggaaagcuauuugacucucu

SEQ ID NO: 4188887 - RNA, 93 nt, Human
agggaguagcggggcagaagccgcaggaagucagugcaggacgccggaggccacuccuaauugcuucauguguuguugccgugcugaugaccu

SEQ ID NO: 4188888 - RNA, 65 nt, Human
agggaguggaaggcacuuaaacuaagaugcaguuuuggaugaagucuagcuuuagucuauucccu

SEQ ID NO: 4188889 - RNA, 84 nt, Human
agggaguggccaaagauguauagauagaaaggcaccaaaaucaaaccuuguuacauuucuaaacauaacuuugugugauuuccu

SEQ ID NO: 4188890 - RNA, 65 nt, Human
agggagugguuaagaaggugcagagaaaagcgugucugacauugauaaggugcuuaacccucucu

SEQ ID NO: 4188891 - RNA, 60 nt, Human
agggaguuccuguugcucuagggugccaccugcaauaccugggcucuaggaaccauuccu

SEQ ID NO: 4188892 - RNA, 77 nt, Human
agggauagagccagagagccccagguucuacugccagcucugucgcuguaugugugaccuugggccucaguuuccuu

SEQ ID NO: 4188893 - RNA, 58 nt, Human
agggauauguaugcauauguauaugcauguguauguauacauaugugugcauaucuuu

SEQ ID NO: 4188894 - RNA, 57 nt, Human
agggaucacgguggacuuggauaaccuucuccucaaaggguccugacuuggucuccu

SEQ ID NO: 4188895 - RNA, 55 nt, Human
agggaugaucaggguagaggcucaauccugaugaugggccauucagauucucccu

SEQ ID NO: 4188896 - RNA, 80 nt, Human
agggaugcugcuguguuugaguaauacagaugcugccccauucccaacucagcagcugcuaugacaacaccagccucucu

SEQ ID NO: 4188897 - RNA, 60 nt, Human
agggauguagacuuuguaacucaggaacucuuuuggguaaacaauguuugccuaaucucu

SEQ ID NO: 4188898 - RNA, 88 nt, Human
agggaugugugcuaaagguagauggacagagggugggaagucccuuauuauuuccacuuuuuucuccaucucugacucugccaucucu

SEQ ID NO: 4188899 - RNA, 68 nt, Human
agggauugcuguauaaauaaugaccucugcuuguauuuucugaguaguuccaauuuuacccagucccu

SEQ ID NO: 4188900 - RNA, 93 nt, Human
agggauuucaggacucacuaugcccauugguugucauggcaggagggucagagauccuguugucagagaccagucaugacccugaaucucccu

SEQ ID NO: 4188901 - RNA, 102 nt, Human
agggcacaaaagauuugaauaagcagacaucccauacuuuugggugggaacaucuaauaguauaaggauguugaugcucccccaaauaaccuaaaacacccu

SEQ ID NO: 4188902 - RNA, 93 nt, Human
agggcagggcuucaagaauggggaaaacguguuuucaauucaaauuaaacaaggaguaacaggcaccgcuccucaguccagaggccuggcccu

SEQ ID NO: 4188903 - RNA, 86 nt, Human
agguguuucuauuuucagguucccagggaaggacuuauuaaacaacuaugucagcagagccugcaggccugaaaaagugaaugcuu

SEQ ID NO: 4188904 - RNA, 91 nt, Human
agguguuuggaaugaagaaugcuauucauuaagccuacuuugugugaggcauuaaguaggcuuuuuagauacauucuuauugaauuugccu

SEQ ID NO: 4188905 - RNA, 58 nt, Human
agguguuuuuccccacugaguccugauccuagguccagauucacaggcacaaaacccu

SEQ ID NO: 4188906 - RNA, 79 nt, Human
agguuaaaacuugguaguucuuaaaaggugauaauaagaaagugaucauuagagaaauguugccaagauuuaguuuccu

SEQ ID NO: 4188907 - RNA, 56 nt, Human
agguuacagucaucucagaaucacuagcacaugugcuuuuagagagacauuagccu

SEQ ID NO: 4188908 - RNA, 76 nt, Human
agguuacucaccugugugagaugcaacccaaggaaagagcacucacuccuuggagcucuccaagggauggugacuu

SEQ ID NO: 4188909 - RNA, 56 nt, Human
agguuauauuguuaaguggcagagccaguguacugaacugucauaauauaucaccu

SEQ ID NO: 4188910 - RNA, 83 nt, Human
agguuaugacagaaaacugcugacaggauggaaauguaccaaagauguguuucuucuguuuguaguuacacugucauuuuucu

SEQ ID NO: 4188911 - RNA, 62 nt, Human
agguuauugacuucugcucugagcugagccuacaggggcccaggagacauauagaaggaccu

SEQ ID NO: 4188912 - RNA, 66 nt, Human
agguucaacuauggauggugugauggguuuaauuguguccuuccaaaauuuauauguugaaauccu

SEQ ID NO: 4188913 - RNA, 70 nt, Human
agguucacaauggcaaauguaauuuuacugugaauggcaaauguaauuuugcugugaccauugaaaaccu

SEQ ID NO: 4188914 - RNA, 61 nt, Human
agguuccagccguuccgugacucacccaggucacugaggagcaccuggagggcugggaccu

SEQ ID NO: 4188915 - RNA, 58 nt, Human
agguucccaggaucugucugggcuggggcagccuggagaggacagauugugggguucu

SEQ ID NO: 4188916 - RNA, 60 nt, Human
agguucuugacucuaccuuccaguaaaauauuccuauggaaacugaagagacaggaacuu

SEQ ID NO: 4188917 - RNA, 90 nt, Human
agguucuugcuguaaacacugggcagaguagcucagaagaagacugugguucuuggaugcccucaugccuuuguuccagugcaggugccu

SEQ ID NO: 4188918 - RNA, 57 nt, Human
agguugaccaggcuggucuugaacuccuggccucaagccauccucccaccucagccu

SEQ ID NO: 4188919 - RNA, 129 nt, Human
agguugagagguaacagauauucuuuugguuuguaguaaagaaguuagguguaacaauaugaucucuuaauacuuucauuugcugaguauugauuucuuucuugcgaguauccucauuccucucucucu

SEQ ID NO: 4188920 - RNA, 71 nt, Human
agguugggcugugggguaccccugagucugcaaguuggcccaggccaggugugucaccauugcccaggccu

SEQ ID NO: 4188921 - RNA, 74 nt, Human
agguuguaggugagcucauagucugaauucacaaacagaauauuuucaggcuugaggucuguaugugucagcuu

SEQ ID NO: 4188922 - RNA, 56 nt, Human
agguuguccugguggaaggagaaaccauggaccaggaccuuugaaucaggacacuu

SEQ ID NO: 4188923 - RNA, 99 nt, Human
agguugucguugcaagucaaguuucccuagaaagcagacuuugucauggaaacugcauguaugaaguuuacuggggagaucaccugggaucaacaaccu

SEQ ID NO: 4188924 - RNA, 75 nt, Human
agguuguguggaggggcagcccaaagcgacugauucucuuuugucuuaucagucuggguccccgacacgcuaccu

SEQ ID NO: 4188925 - RNA, 57 nt, Human
agguuguuuugccucauuauccaaggaauucuguggacagaggggcagugacaaccu

SEQ ID NO: 4188926 - RNA, 129 nt, Human
agguuuaauuuuccauggguugccuauuuuaaaacuaugcagacaagauuaacuuguggauuuuuuccaaaagaagcugcaaaaaauuucugucucauggaagaaucaucccugaaaaguuucuugccu

SEQ ID NO: 4188927 - RNA, 55 nt, Human
agguuuaucugaacccggggaaugcuuuggucagcaaaacuggacagaaaaaccu

SEQ ID NO: 4188928 - RNA, 108 nt, Human
agguuuauguccgagacuaaacugugcaugaaccgaaacaaaaagcaaguucauaccgcugcauucuguucucuuguucugacgguuaauucacuggacaucaaauuu

SEQ ID NO: 4188929 - RNA, 105 nt, Human
agguuugagacauuugagguaaacagcuuugagcaguucuguaucaacuaugcaaaugaaaagcuccagcagcaguucaacucgguaggcuugguuucuagaccu

SEQ ID NO: 4188930 - RNA, 80 nt, Human
agguuuggacacaccuggagagcucgggccaggcagggccacaccugugagccugagcucauccaacaccgcccggagcu

SEQ ID NO: 4188931 - RNA, 84 nt, Human
agguuuucagcacuguagcagccauagucccuggggucucugcagaauccaggcacuuguuugccaggcagaccugaaauaacu

SEQ ID NO: 4188932 - RNA, 85 nt, Human
agguuuugagcagaggugacauaauaaucugaccuagauuuuaaaaggaucacuuuaguuacuauguugccacuagccugaaccu

SEQ ID NO: 4188933 - RNA, 64 nt, Human
agguuuuggaauauuaaaaugucucacugcaucggcacuguuacuuugauugguauucuaaccu

SEQ ID NO: 4188934 - RNA, 66 nt, Human
agguuuuggcucugcagguuugcacccagcucugugguguaugcccucacaggucacccaggaccu

SEQ ID NO: 4188935 - RNA, 71 nt, Human
agguuuuggggguuguuuguuacaguaguuagccuaugcugacuaauacauuaccuaaccucucugaaccu

SEQ ID NO: 4188936 - RNA, 85 nt, Human
aguaaaacaucuucaaguucaacauuuuuucaaguagacuuaccuacuagugaagaagauuugacugaaauggaugugguuugcu

SEQ ID NO: 4188937 - RNA, 101 nt, Human
aguaaaaugacuccuaauaaaagcucuguauauugagugcuuacuauguuccaugcauccugguaagcacuucauguacaugaucuaauuuagcacuuacu

SEQ ID NO: 4188938 - RNA, 70 nt, Human
aguaaaauuggagggguugcuauaggaacacacaaagugaugcagagcaauaaccacucuaauuuauacu

SEQ ID NO: 4188939 - RNA, 58 nt, Human
aguaaacaguaucuuuagugucugagcaaauuuuuugugguaacagaugcuguuugcu

SEQ ID NO: 4188940 - RNA, 82 nt, Human
aguaaaguaaauucaaggaucuguuaaaucugguaaaaguagaucaaaucagagaucgacagccuguggagagugcugaacu

SEQ ID NO: 4188941 - RNA, 79 nt, Human
aguaaauacccagugagacugucuuggugaauggauaauaguagcuaacauuuaugaagcucucacugugugucaggcu

SEQ ID NO: 4188942 - RNA, 60 nt, Human
aguaaauauuuuaggcuuuccaggcuguaauauuacagucugugccugaacuauuucacu

SEQ ID NO: 4188943 - RNA, 129 nt, Human
aguaaauguaacuuuucuuuagacuaacaccaguuuauuuagugcuuucuguagccauugcucccauaugugaaauguggugguaaugagccagaugauggauauggugguggaauuguuuugguuacu

SEQ ID NO: 4188944 - RNA, 59 nt, Human
aguaacauuuagcuucucacugaagaggguccccuuuggaaggcuuggcuagauuuacu

SEQ ID NO: 4188945 - RNA, 57 nt, Human
aguaacuuaggagauacaugggugaaaaauccauuaagcucuuaucucuagguuacu

SEQ ID NO: 4188946 - RNA, 77 nt, Human
aguaagauaguuaaagagauccacauuccagagcuguuuaacuuugggcaaguuacuuaaucucucugacccuuacu

SEQ ID NO: 4188947 - RNA, 90 nt, Human
aguaagguuuggugcgguacagugauuugcccacagucccccagcccaugacugacagggccaugcugcacugcccucgaccucuagacu

SEQ ID NO: 4188948 - RNA, 90 nt, Human
aguaaguauuugaaaaauugauuaauguuagggucugaguuuauguaucauauucagaauucuacaauagaucagguaacaaauacugcu

SEQ ID NO: 4188949 - RNA, 56 nt, Human
aggucugggauugaagacaucaagggggccuccucgcugucccccaaccccagccu

SEQ ID NO: 4188950 - RNA, 56 nt, Human
aggucuggugggcuuuagauuggggucacagggagacccaaagcccacuagcgccu

SEQ ID NO: 4188951 - RNA, 61 nt, Human
aggucugucuggccccaugaaucuuuuggugagauaaaugcaagggaaaggcaagagaccu

SEQ ID NO: 4188952 - RNA, 56 nt, Human
aggucugugugugucucuccucaagcuacucaagcugaggcuuugugugcaugccu

SEQ ID NO: 4188953 - RNA, 70 nt, Human
aggucuuuuuccaccuggggcucuguuguucuaaaucccagacgucuagucucaagcuggagaauuaccu

SEQ ID NO: 4188954 - RNA, 74 nt, Human
aggugaaaguguuuugcguacugaagaaugcaauuguauuuauugcauucaucuucaugaaagcacauucauuu

SEQ ID NO: 4188955 - RNA, 76 nt, Human
aggugaacuggacacuagaaugaaucuggaagauuuuaauugcucuaggaauuucaucuaguucucacagugacuu

SEQ ID NO: 4188956 - RNA, 74 nt, Human
aggugaaggcccacuaaucuccagaaagaauuuuuguuugcuucuucuaggcuucucagggggcacuuucaccu

SEQ ID NO: 4188957 - RNA, 67 nt, Human
aggugaauaccgacaguguaaggugcucuuccucaggccaugccguuugcugucguguuuucugcuu

SEQ ID NO: 4188958 - RNA, 60 nt, Human
aggugaauugauugacucuggguuauauuacugagcacugggaauacaaguuauucaccu

SEQ ID NO: 4188959 - RNA, 72 nt, Human
aggugacugcacagaaaugucuacacauguguuuucacauacauaugucuacccaugccuguguggacacuu

SEQ ID NO: 4188960 - RNA, 101 nt, Human
aggugagaaaaauguaccugguccuuacgucauugcuuuaugucaaauugaaaugagaaguaaaacgcuaaggaaacuaaguaaacaucagaaagucaucu

SEQ ID NO: 4188961 - RNA, 100 nt, Human
aggugagagggucgcuugagcccaggaguuuaaggcugcagugagccaugaucucaccauugcacuccauccugggcaacagagcuagacccugucucuu

SEQ ID NO: 4188962 - RNA, 67 nt, Human
aggugagcaccucuccagcuggaacaugaaguuaguuaaacauuuccaguagggagucugcuuacuu

SEQ ID NO: 4188963 - RNA, 68 nt, Human
aggugagcuucucagaacauuauucaaguuucugcccuugaacacaguucugaugagcuuaauuaccu

SEQ ID NO: 4188964 - RNA, 85 nt, Human
aggugaggcugggaaguccaagaccaagaugccacagauucaguucuuggugagggccuucuucccaguuugcagauggacaccu

SEQ ID NO: 4188965 - RNA, 64 nt, Human
aggugagucaugcuaaagugagagucaggauucugucugguuuucacaauagcuggcaucaucu

SEQ ID NO: 4188966 - RNA, 64 nt, Human
aggugauaaaauauguugugugacaugggaaaugccuaugauacauugcaaaauuuuaaaaucu

SEQ ID NO: 4188967 - RNA, 105 nt, Human
aggugaucggacucccacaugcuggaauuguggcaucaggcugguagcugcugacccugagcagcugggagcagagccacagccuggugggaaagaugaguaccu

SEQ ID NO: 4188968 - RNA, 66 nt, Human
aggugaucucauggcuuguaggaggugagaaguagcucucuuucagaaaggccagugauaucuccu

SEQ ID NO: 4188969 - RNA, 76 nt, Human
aggugauuaagucauucccacucagaagccacuucaugugagcauuagaguuacuggguggaaggcacuuucaccu

SEQ ID NO: 4188970 - RNA, 60 nt, Human
aggugcagugguguggcaaagggcuucacaacuagguuuauuugugacaccauuguuucu

SEQ ID NO: 4188971 - RNA, 71 nt, Human
aggugcugaguucagcugccaggacacccuggggacaagugucccugauccacuggaccccuucagcauuu

SEQ ID NO: 4188972 - RNA, 84 nt, Human
aggugcuuggaauaauggucaaaaagauacguaaagcaucuauguguauauuuuguguaucuuauugcaguauuuuuugucccu

SEQ ID NO: 4188973 - RNA, 119 nt, Human
agguggaaaggcaaaaggaagacaggccagcuaguucccuccugcccuuuuguaagacacgaaucccauccaugaggacagagcccugguggccuaaucaucuccuaaaggcuccaccu

SEQ ID NO: 4188974 - RNA, 128 nt, Human
agguggagacugagaaaggaaguccucagcagugucaguucccagagcuuuggaagaaggaccagcagcucugucccugggaaccaucaaaaaaugcuguugauguuuucugugucugucugucaccu

SEQ ID NO: 4188975 - RNA, 55 nt, Human
agguggcagagugacaggcugauaugaauuacauuaagguuucuggcugccaucu

SEQ ID NO: 4188976 - RNA, 70 nt, Human
auaugcaaaguuuggcucucaugacauuuuggugaccuuaaguugaugucagagaucaggcuuaauuuau

SEQ ID NO: 4188977 - RNA, 70 nt, Human
auaugcaacuauaugauguggcauaguuuuaggcuuuccugaauauggcaacucuuguaacuauguaugu

SEQ ID NO: 4188978 - RNA, 82 nt, Human
auaugcauggauacacguauaugugugggccugcauauccuggauauccaggauagucacaagugugugugugagugcaugu

SEQ ID NO: 4188979 - RNA, 74 nt, Human
auaugggcugaggaagcuccugaggauagagaacacuaucaaguagaaagacucaggaagccaucagccuauau

SEQ ID NO: 4188980 - RNA, 84 nt, Human
auauggguccacuuuguuccuuucacaaagaaaauggucugcauugagguuucuuuucaagaggggcaaggaggaaucucguau

SEQ ID NO: 4188981 - RNA, 104 nt, Human
auauguaagagaaaguaguuguucauuaaauguuuguugugccaggggaaacaaucaaucaaaacauucucuuuuuaaacauucuaacauuuucuuaagcauau

SEQ ID NO: 4188982 - RNA, 63 nt, Human
auauguacacugugacaaucaugacagcuccuuaagcugaugaauaaaaacaguaguauauau

SEQ ID NO: 4188983 - RNA, 107 nt, Human
auauguguguuucugauuuuguaauuugauacucauuguggugcucagauguuaacuggguggauuaggauaggguauuuuaauuugguggauugggauacauguau

SEQ ID NO: 4188984 - RNA, 67 nt, Human
auauguuauguguauagguaugcacacguguguaugcagguguguauauaugugcacauguauguau

SEQ ID NO: 4188985 - RNA, 77 nt, Human
auauguuguuucugggagauucauaugaaaaaggauuuuuuuucaucuccguuuuuauguuguccucaguguuauau

SEQ ID NO: 4188986 - RNA, 65 nt, Human
auauguuuuucacagguuuaagcuaaaauauuguuuuagaaggcaaauaaaccugagaagcgugu

SEQ ID NO: 4188987 - RNA, 95 nt, Human
auauuaaaauggauguguaaaguuagaugucugauaaauaguauuuuuuuagauagaguuuuuuggcuuaauacauauucagcaguuuuuaauau

SEQ ID NO: 4188988 - RNA, 57 nt, Human
auauuacuugcauuuauugaauguacuucauguggcaggcauugaugcgaguucugu

SEQ ID NO: 4188989 - RNA, 56 nt, Human
auauuauauucaaagaaagagaggagacagagccucucuaguauuaaauauagugu

SEQ ID NO: 4188990 - RNA, 130 nt, Human
auauucagccuccagaauaaugauguauugauuggauaaggacaagaaaaugguauauuugcaaggaaguagccuagucaggcaauuacuuucagaugugcuguaaaacaguuaaugugaggcaagaugu

SEQ ID NO: 4188991 - RNA, 80 nt, Human
auauucuuaggauuucucucuucaggucucuaucugaauaccuagagcuaugaugacaagggaggguccugcuagaauau

SEQ ID NO: 4188992 - RNA, 99 nt, Human
auauugauaucaaaggagaaguaacucaggaaaugaagacugguuauggacucauggccuggcuuuccuggugguucucuaaacuuugaagauuuuugu

SEQ ID NO: 4188993 - RNA, 69 nt, Human
auauuggauccagcagcuccaaagaauagccagaaaacugauacucuaaugggcugcugcacacgguau

SEQ ID NO: 4188994 - RNA, 71 nt, Human
auauugguuccaauauuucucacauauggaaaaugucauuuucccugggaauuaauauuuggaacuggugu

SEQ ID NO: 4188995 - RNA, 58 nt, Human
auauugugaugguuuaguaucauuguuaauugcaucuugguaucaaacuauacaauau

SEQ ID NO: 4188996 - RNA, 64 nt, Human
auauuguuagugcaauguuuggugaacagcaaaauguucaacagauguuagcucuaauuuuuau

SEQ ID NO: 4188997 - RNA, 126 nt, Human
auauuuaauuucucaaucuguuguugucuuguaauuacaugaguacuguaagcuuagggaagcuacaccuaguuuuaugguuacauauauuuaacauuauaauaaaauucaggaagaauucaaugu

SEQ ID NO: 4188998 - RNA, 88 nt, Human
auauuuagugagaaaaaggcugguaguauuuagucacagcauguagacacugcuggugacugacuacuucaguccagaacacaaauau

SEQ ID NO: 4188999 - RNA, 130 nt, Human
auauuucuugguauuuuucacugcucucuccccagcaccaggcacauaguaggcacucaguagauaguuguccagugaauggauguguacuggauguuugggacugugcugagucccuuauaggggauau

SEQ ID NO: 4189000 - RNA, 64 nt, Human
auauuugauuauauuaacuauguuccuuaacuagugugaggaacuggugaaguguagugaauau

SEQ ID NO: 4189001 - RNA, 127 nt, Human
auauuugggaauaaauuccagaucauugcugcuguugcagcugcuguuccucaugguagacaaaucuuuccaaggcagagggagggcagcugaggguagcaccucugguaagaaaguuuuaaaaugu

SEQ ID NO: 4189002 - RNA, 79 nt, Human
auauuuuugugacuaaaugcuuugugcaugcagccauugagugaaaggguguguguguguguguguuuaguugaaauau

SEQ ID NO: 4189003 - RNA, 110 nt, Human
auauuuuuuuguaucaccccuuauauauguauacaaaugcauagauacauauucuuugcacguauguguguguuuaugugugugcauauauauauugauuagagaagugu

SEQ ID NO: 4189004 - RNA, 79 nt, Human
aucaaacuggcuuuaaacacugaaauugcauguaacuggaaaaugccagauguagagcagucuuuggguuaggcuugau

SEQ ID NO: 4189005 - RNA, 62 nt, Human
aucaaagagugagauuuuuacugguuauuuaggaucuaggcauccaguaaucuccuguugau

SEQ ID NO: 4189006 - RNA, 59 nt, Human
aucaaagguaucuaugcugucugauguacaaucaguuacauagccgcagugccauugau

SEQ ID NO: 4189007 - RNA, 86 nt, Human
aucaaaggucugauuuuuuauucccagacugagauauuauaauaugaaaguacaggugaauuggggauaaagaaugaagacaggau

SEQ ID NO: 4189008 - RNA, 65 nt, Human
aucaaaguugaccacccaguauaaacaccacuuuuuaggcuugugcaaaggggguuaaucaugau

SEQ ID NO: 4189009 - RNA, 71 nt, Human
aucaaaucaucgcaaguuacauuacacuuuugaagaaggaaguguuucuuggaauguugcgauuauaggau

SEQ ID NO: 4189010 - RNA, 55 nt, Human
aucaacauagccacuccuuagagcagagugauugguucagggaugaauaugugau

SEQ ID NO: 4189011 - RNA, 86 nt, Human
aucaacugcucagaguggugacagggacgaggcuucaggcauuggaaggaggugcuggcuuucugucccuggcauuugauagugau

SEQ ID NO: 4189012 - RNA, 77 nt, Human
aggcuuggcucuaggaaccaaagugauuuguucuuguuccaaccugggcuuugugacuuugguuagugccacuaccu

SEQ ID NO: 4189013 - RNA, 55 nt, Human
aggcuuugugguaguggcauuguuccuaaagagugcaugaaagcauacaaggccu

SEQ ID NO: 4189014 - RNA, 118 nt, Human
agggaaaaauggaaccagccagaggccuuggcaugaagucagcagcugggaggaaggggccuccacaaaguugcugaguuucugaaaucccaggcacuccauggugcaauuuuuuucu

SEQ ID NO: 4189015 - RNA, 60 nt, Human
agggaaacuagacugccuuucuguuccuucuaagugaggccuucucagugugguuuccuu

SEQ ID NO: 4189016 - RNA, 55 nt, Human
agggaaagaggugaauguuggaaggagccagcuguucacauccugcuuuuucccu

SEQ ID NO: 4189017 - RNA, 97 nt, Human
agggaaaguguuaaaauuaggucuggguuuuagacuggcgaguuuuaaguguaaacauguugauuagagagcuuagagucuaacccacgcugucccu

SEQ ID NO: 4189018 - RNA, 60 nt, Human
agggaacagagguagcgccagagcuggagcccacaccagccccgcccugccugcugcccu

SEQ ID NO: 4189019 - RNA, 72 nt, Human
agggaagacguaucucuuuuaaagaacugagaaaugcuccuuagaaggcuuugagagauacuugacuucccu

SEQ ID NO: 4189020 - RNA, 77 nt, Human
agggaagaugaugaauguguccagaagacuugaggugacuaaggaacacuuguggaaacauucgcugacacuuuccu

SEQ ID NO: 4189021 - RNA, 80 nt, Human
agggaagcucugacuuggugcuaccagccagaguuucaaacauuuuucuuuacuuuguugggcccaauuagacuuucccu

SEQ ID NO: 4189022 - RNA, 62 nt, Human
agggaaggcuuuuacuauuuguuaacucacuugagggacauaaacugucaaaagccagcccu

SEQ ID NO: 4189023 - RNA, 64 nt, Human
agggaagggcacaggcuggcaggaucuggcuucaaauccaggaccuguccccuggcccacuccu

SEQ ID NO: 4189024 - RNA, 116 nt, Human
agggaaggggcaggggagcagcagcagcugucuaggccccuaaagcaucuccuggcucuucagcaggaggagcuggccgccucauucagcucccugcugaccuacggccucucccu

SEQ ID NO: 4189025 - RNA, 74 nt, Human
agggaaguuuaaaaacuuugugaaauaugauaccaggcaaagguucacagguucuuuuuaaggcugacuucccu

SEQ ID NO: 4189026 - RNA, 61 nt, Human
agggaauugggcaguauggaugaccucgaguuccgccuucucuuuccugcccaguugcccu

SEQ ID NO: 4189027 - RNA, 83 nt, Human
agggaauuguggaaggcacuagcaagcugccuggcccagagugggcaucugguaaucagcggcugcugcugcuacuguucucu

SEQ ID NO: 4189028 - RNA, 72 nt, Human
agggacaaguaauuuaugcaaacggaccagaauauuauaucaucuacuucuuuugcacugaugcaucucccu

SEQ ID NO: 4189029 - RNA, 58 nt, Human
agggacaccauuauggcaguggcugugcccucuacccacagccacagcugggugccuu

SEQ ID NO: 4189030 - RNA, 63 nt, Human
agggacacuugcuuucaggcccaacacauaguccuuccaaggcccaucuugagagaagacccu

SEQ ID NO: 4189031 - RNA, 61 nt, Human
agggacagcugaaaccagggaucuggguggccccugggcucuguguuucaguuucuucucu

SEQ ID NO: 4189032 - RNA, 88 nt, Human
agggacauuaaagauaauuaauuuuguucauucagucaguucucauacuaggauugaguaauauaaaguucaugaucauugauuccuu

SEQ ID NO: 4189033 - RNA, 81 nt, Human
agggaccaauuagugucaacugugaugucaacacuugccugucaaguccugcauccaguuacaucuuccuaaugaagcccu

SEQ ID NO: 4189034 - RNA, 78 nt, Human
agggaccugacugauucacaugaccaugauggaacuugaggaaaacuauuuugcuggucugaauuacuuucagccccu

SEQ ID NO: 4189035 - RNA, 55 nt, Human
agggacugccugccuuccuccuaggcaaaggccacgaagagucacaggcagcccu

SEQ ID NO: 4189036 - RNA, 89 nt, Human
agggacuguagagcaccaagcuagaggugagcugugauucaaacuccaaguccucgcuucuagcugugucccagugcaggcaguccacu

SEQ ID NO: 4189037 - RNA, 61 nt, Human
agggagacacaugaggaagucauuuaacauccuugagucccacuuucucgguuucucaccu

SEQ ID NO: 4189038 - RNA, 79 nt, Human
agggagaggagggucuuguugaacuugaaaaaacuaaauaagcaaaguugauacauaaggacacccuucucuuuacccu

SEQ ID NO: 4189039 - RNA, 65 nt, Human
agggagagucaauucugcuguguggccaaaccucuccaccacgcuccauggcacagucuuucccu

SEQ ID NO: 4189040 - RNA, 67 nt, Human
agggagauauguccugagacauugacaacuccccaaagucuugaauaugucuaugacauauuuccuu

SEQ ID NO: 4189041 - RNA, 70 nt, Human
agggagaugagcuaaguucucacagcaagucagugacagaucugcugcuggaucuuacucaucuuacccu

SEQ ID NO: 4189042 - RNA, 66 nt, Human
agggagaugccagaccauccaguugggacuugcugagaauggucccucacugguucugcauccccu

SEQ ID NO: 4189043 - RNA, 112 nt, Human
agggagauggguagagauugauggcaccaggcucugagaggaaugugagaucugguuucguguuuaacuccagagaccugcugacccagcauuguccugaggaauucucccu

SEQ ID NO: 4189044 - RNA, 75 nt, Human
agggagauuaaauuauagcugucguaguacaaaauucuaguaccagguaccacacagaugcuauuuagucucucu

SEQ ID NO: 4189045 - RNA, 108 nt, Human
agggagcaaagguccucucuggugagggcagggaguguggggagcagcuguccaagaacagcccuggcaccucguugcccagccacagcccaggauuccauguuuccu

SEQ ID NO: 4189046 - RNA, 75 nt, Human
agggagcagugccaaagaauuugcggacauguuucaaaacauacagccccugcucuguggacacugauuauccuu

SEQ ID NO: 4189047 - RNA, 66 nt, Human
agggagccagagauccaggauggcucauucgucucacuuuugaccgcccugcuucucuaguuuucu

SEQ ID NO: 4189048 - RNA, 56 nt, Human
aguacuuuaaaguuucagaagcaagaugcugucuugcugcugaucauuuauagucu

SEQ ID NO: 4189049 - RNA, 63 nt, Human
aguacuuuguccauuugcaggcagauguuaaauacagcaguuggcucguguggauacaguacu

SEQ ID NO: 4189050 - RNA, 80 nt, Human
aguagaaauuuucugagcuuugccuaaaacuagaaucuguguugagguuuuucaaaauuaaguaacgccagagacauacu

SEQ ID NO: 4189051 - RNA, 113 nt, Human
aguagaaccaccagcuaugauuuucaaauguuacggguuaucuuuuauugaugcauuuucaagugucagucucauuucuguacaugaguugagaaucauguuaguuauuuacu

SEQ ID NO: 4189052 - RNA, 58 nt, Human
aguagagcugcauaaaacucugaccuaaccagccuuaccaucagagagcagcuuuauu

SEQ ID NO: 4189053 - RNA, 77 nt, Human
aguagaggaaagugguaggaagagagcacugaguuugggaaagaaccaguaagcuguauuuacucacccccuuuacu

SEQ ID NO: 4189054 - RNA, 79 nt, Human
aguagaggaagcugcuggaguagugugccaggaccacucugagcuccaacugaucucacagcagaaagcuuucuuugcu

SEQ ID NO: 4189055 - RNA, 57 nt, Human
aguagagggcucaaagccaguacuaccuuucucaaguacauuugaguaucaucuacu

SEQ ID NO: 4189056 - RNA, 122 nt, Human
aguagauauaaccugagaugauagauuuaaacaggauauuuacguucugcuacaauugacugauaacacuugaaguguagucugaacaguaauuuuguuaaucauuucaacaaguauuugcu

SEQ ID NO: 4189057 - RNA, 72 nt, Human
aguagaucccacauggagaaauguaccacugaaccuguguaguuugcugaguacucuccuguguaguuugcu

SEQ ID NO: 4189058 - RNA, 56 nt, Human
aguagcaauguuugagaagcacugacauacagcaaggcuucucaaagggugcuccu

SEQ ID NO: 4189059 - RNA, 78 nt, Human
aguagcgcgccacguagauuccuccaugcgcaguucacaguaggguuugugcuccuaugagaaucuaaugccgcugcu

SEQ ID NO: 4189060 - RNA, 72 nt, Human
aguagcugcucucuagcuaaccuguagcauuggcauucagcuccagugcauagauccugaggccuagcugcu

SEQ ID NO: 4189061 - RNA, 128 nt, Human
aguaggacuuucagugucuuccucccaaaaacuucuaagcugauuccacuuuuuccccagagcugcugcagugcgguguggguggagggagggaucaggagguacagaaggaaacagugaccccugcu

SEQ ID NO: 4189062 - RNA, 61 nt, Human
aguaggagcucauggggccaggaggguugugggaugcccucugggcucugucagcaccucu

SEQ ID NO: 4189063 - RNA, 87 nt, Human
aguagggcagaaacauguagcucugccagguauggagcacauggcccgucccugggcaccaggccugguaaacagccugcuccugcu

SEQ ID NO: 4189064 - RNA, 102 nt, Human
aguagggguaaauucugugugcuguuagggagcugcccugacaacccaggcuguagcuagacuccagacaagaccacauccugccagaauucuucccuugcu

SEQ ID NO: 4189065 - RNA, 56 nt, Human
aguaggguuuuucagccucaauauuaucaacauuuggggcuggauaauucuuugcu

SEQ ID NO: 4189066 - RNA, 77 nt, Human
aguagguagaauugaguuggaaguuuaagaaaacccaaucaaggucaucaaugagcaguucgacuucuuccccaacu

SEQ ID NO: 4189067 - RNA, 63 nt, Human
aguagguuuucagccaacaaguugacaucggaaccugugaggcgguuggcacugaaaauggcu

SEQ ID NO: 4189068 - RNA, 82 nt, Human
aguaguaaauauuucaaaaggaaacacaguuuauuaccuaggaaaauauucugguuguguuuucuuauggcauaaaauuauu

SEQ ID NO: 4189069 - RNA, 59 nt, Human
aguagucucaguuucucuagguggguccccuaccuccugcccaggacuuugcagacacu

SEQ ID NO: 4189070 - RNA, 73 nt, Human
aguagugauugguugaaaguagaauacuauauuaacauuuuagucaauucuuuucaacucaagcaaaacuacu

SEQ ID NO: 4189071 - RNA, 55 nt, Human
agggcaggagcuggggugggcaggcccugaggucagccaguaccauucugccacu

SEQ ID NO: 4189072 - RNA, 55 nt, Human
agggcaguguggugggacugacucaacagacauaguuucaucuccacccugcccu

SEQ ID NO: 4189073 - RNA, 58 nt, Human
agggcaguguuaggacugucuggcucugaaguccaaauuccuucuaaaacgcugcccu

SEQ ID NO: 4189074 - RNA, 57 nt, Human
agggcaguugcaguggugggcagcaccccccaugcccacaugagcuggcaaugcccu

SEQ ID NO: 4189075 - RNA, 126 nt, Human
agggcauacuuugccacagaggacagucuuggaccucaguuauucuaucauaguucaugaccccauuauaaucagaauacacugggagugcuggcuguaucuuuuguuuguggcuuuauuugcuuu

SEQ ID NO: 4189076 - RNA, 62 nt, Human
agggcauagcagaaagagcucuggacugaaagucaauaaacuugaguuuaucuccuagcccu

SEQ ID NO: 4189077 - RNA, 57 nt, Human
agggcaugcuggaggagagacagggcacuagcccugccucuauuccugccugcuccu

SEQ ID NO: 4189078 - RNA, 59 nt, Human
agggcauggaaggaaaaagucaggaggcaagauuucucuuuauuuccaguccagguccu

SEQ ID NO: 4189079 - RNA, 59 nt, Human
agggccacaugacuagguucuagcuaagacaauguaagcagaacuguuguuuggguccu

SEQ ID NO: 4189080 - RNA, 92 nt, Human
agggccacgccuuacacaaggugacaugaaaaauguugagguguagcaguuuauucccuuagguuaaucaugaaccuuucuguuaggccccu

SEQ ID NO: 4189081 - RNA, 68 nt, Human
agggccacuguguuucauucucucugaauggccccuggagcugagcagggaggagauacuguguaucu

SEQ ID NO: 4189082 - RNA, 55 nt, Human
agggccacuuugaggugaaauggcuuuuuuacauacucagcaucaauuugguccu

SEQ ID NO: 4189083 - RNA, 63 nt, Human
agggccagaugaagccacaagccuccuccaccuugagcacugauggcagaucagcugggcccu

SEQ ID NO: 4189084 - RNA, 76 nt, Human
agggccaggugaccacagguaugggcuuggcagggagaaccagccugcuaggcagagggcuguggagcugagcccu

SEQ ID NO: 4189085 - RNA, 75 nt, Human
agggcccaagcaacauucucuguggcauuagugccugaaacggcagcaaguaaaagcaggugugcugggcgcccu

SEQ ID NO: 4189086 - RNA, 60 nt, Human
agggcccacaguuccuauggccguuaccucucucagaagccaggcagagcugugaguucu

SEQ ID NO: 4189087 - RNA, 73 nt, Human
agggcccaugugaggaggcccagguuggggcugugaggaggaagagccccccaagggccuucucuuggauucu

SEQ ID NO: 4189088 - RNA, 59 nt, Human
agggccccaguaagauuacaugcucaacaaaagccuacuguauuucuggcuggggcuuu

SEQ ID NO: 4189089 - RNA, 80 nt, Human
agggcccccaggcccggcccucugcccucagaacucagcccagugugaucuggugacacgaggagcugggauggggcccu

SEQ ID NO: 4189090 - RNA, 107 nt, Human
agggcccugugggcacauuucugcaucucagagcuagguggucuccauggucucuuuagcucuguggaucuuuuuaagcugaaacccugugauaacccuagggccuu

SEQ ID NO: 4189091 - RNA, 76 nt, Human
agggccucccguaguuuucucaguuugcuguaagaagaaugaaaagaaagcagagguguuuauuaugggagguacu

SEQ ID NO: 4189092 - RNA, 107 nt, Human
agggccucucgcuggggucaaacuaagcuggaaucucuuuggggacugaagaucguuuccuccccuagagagguuugcuccauugugcuuccaggggaugcugcccu

SEQ ID NO: 4189093 - RNA, 78 nt, Human
agggccucugccugggccucugaggaaggccuggcuccgcuccccccuugccuuucucuacccccagcucaagguccu

SEQ ID NO: 4189094 - RNA, 78 nt, Human
agggccuugcugucugaagcuggaaaugaaaucaacaacacaacaacauccuuggguucuaagggacagccaggcccu

SEQ ID NO: 4189095 - RNA, 62 nt, Human
agggcggaggcguuaccaugauguccgcguaguccgugggcaucuggaucugcuucuccccu

SEQ ID NO: 4189096 - RNA, 55 nt, Human
agggcuagaguuugagaaaggguucugaacuggaaucaguuuaaauccuggcuuu

SEQ ID NO: 4189097 - RNA, 68 nt, Human
agggcuagcccagcuuucuucaucaagugccacgucccgugaugucccgggaugaagaagggcucccu

SEQ ID NO: 4189098 - RNA, 62 nt, Human
agggcuaguuggaaggcaaaaauacaguuggaauuuguaaccaacugcuuucuuccugcccu

SEQ ID NO: 4189099 - RNA, 75 nt, Human
agggcuauaauucagguuuucuggcacagugguuuugauccugaauguguuugagggccugggucacagagcucu

SEQ ID NO: 4189100 - RNA, 88 nt, Human
agggcuccaaggccauguucuuggccaccagaucucacugccccauaaacagagcaggagaggugaggccaggcaaggccugggcccu

SEQ ID NO: 4189101 - RNA, 56 nt, Human
agggcucccgugaggugacugcagccaguuucuuguacauaucaugguagaguccu

SEQ ID NO: 4189102 - RNA, 55 nt, Human
agggcugacacaccuuauccuccagaaagauuuggaccauuuggugagucacccu

SEQ ID NO: 4189103 - RNA, 78 nt, Human
agggcugauaauccauuacaacaguuacuaaauccucuuugggaauuagcuaauuaauuguagcccuauacagcaccu

SEQ ID NO: 4189104 - RNA, 57 nt, Human
agggcuggagauuacccuggagcccuccggcuucaucugaccaggucuccuugcuuu

SEQ ID NO: 4189105 - RNA, 56 nt, Human
agggcuguugugaggguuauagagcuaaugcuuguaaaaugcuuaggacagugccu

SEQ ID NO: 4189106 - RNA, 105 nt, Human
agggcuucuuuugagggccacuggccaggaucuaagacauuaauucugggaugucucaaacccucgacauuucuuagaaauuccccaguggcugaaggauucucu

SEQ ID NO: 4189107 - RNA, 115 nt, Human
agggcuuugugaaaucagguauugcuggcugcaguagcaagagacuccuaauccucacugcaggacugccucuaaaaucugcucacgucugugucugccugguuuucacucaccu

SEQ ID NO: 4189108 - RNA, 77 nt, Human
agggcuuuugacauuuguuccaugauguaauagaggauuuaaccaucaaauuaugugucaaagcauauucaggcccu

SEQ ID NO: 4189109 - RNA, 62 nt, Human
agggcuuuuuccuucacugauguggggcccacuuggcuccaucuggguggggagaaggaucu

SEQ ID NO: 4189110 - RNA, 73 nt, Human
aggggaaaaagaauguuuucuauagaagaacaguugauagaauuaacugucuaaggagaauaugaaauacccu

SEQ ID NO: 4189111 - RNA, 88 nt, Human
aggggaaaaauggacucuuuccagcucuucuguccuuuagagaggaccucagggugacagcuccuugguuagaugccguuuuuacucu

SEQ ID NO: 4189112 - RNA, 55 nt, Human
aggggaaaguaguuuaauaugggaguucugcugauucucacaggggcuuuucucu

SEQ ID NO: 4189113 - RNA, 67 nt, Human
aggggaaaugccuuggugguaccaugguccaugaaaaccaagaggucucaggagggcgguuccaccu

SEQ ID NO: 4189114 - RNA, 72 nt, Human
aggggaagaggaaggaguacccagcaacucgcucucacaguggcccaugcuccuggcuccuucccuaaccuu

SEQ ID NO: 4189115 - RNA, 71 nt, Human
aggggaaggaagaggcugguagugcccguggcccuggcgggacuggcuuugccucugccucucaguucccu

SEQ ID NO: 4189116 - RNA, 77 nt, Human
aggggaauuccaggaggaaaguuuggguguuuagcgucucaugucugccuggagcuuuuccauccuggaaaccugcu

SEQ ID NO: 4189117 - RNA, 89 nt, Human
aggggagaauauaugacugcaagacuaaacaggccagugaaggaagccaugaaauagguucuugcuguaccauaccauuauuuuucccu

SEQ ID NO: 4189118 - RNA, 56 nt, Human
aggggagccgaggggcaucugucggcccaagucagccacagcccucugcucugccu

SEQ ID NO: 4189119 - RNA, 75 nt, Human
aggggauaaagggggacuuccuggugcuggcuagaaagggugaugcucuucagccaggcagcccccugguccucu

SEQ ID NO: 4189120 - RNA, 83 nt, Human
aggggauagugcuaauguuguuguaccucaagcagaggauggguacauuucuugauuacaaauaacaucauaaccuguuuccu

SEQ ID NO: 4189121 - RNA, 79 nt, Human
aggggauuaggaaggaacaaacccugugugguggcucaauuucuuugccucaaucacaccaguuuccuuucaauucuuu

SEQ ID NO: 4189122 - RNA, 124 nt, Human
aggggauuucaugcgacggucagggaccagagcuggugcauauucagaaaaugcaggcaaauucucuguuaguuucuucauaugucaggaguacuccuuccucuuauguuuguuuuuuuccccu

SEQ ID NO: 4189123 - RNA, 62 nt, Human
aggugacggaagucuuguuccgggggcccacuuguucccauucauccucgcuuccuucaccu

SEQ ID NO: 4189124 - RNA, 111 nt, Human
aggugaggaaagaguaugccugcaggugagugaccugcucaaggccacacaggccaggccaggccuaggccuuggacucggguggacucacagccaggucuuucucucccu

SEQ ID NO: 4189125 - RNA, 77 nt, Human
aggugaguaaguucugaugucuguugccagcccuucucccucgggcuugucucucauucaugagaacacacucauuu

SEQ ID NO: 4189126 - RNA, 58 nt, Human
aggugauccucccgccucagccucccaaagcgcugggauuacaggcgaagguucauuu

SEQ ID NO: 4189127 - RNA, 87 nt, Human
aggugauccuuagacuuagaacaggcagaauuccaaagagcaucaaagcauuuggggaaguuugguuuaagaagauaaggacucccu

SEQ ID NO: 4189128 - RNA, 99 nt, Human
aggugauguacucaaaaaacagggcuuguugaaagcggagacaggaugggauuccagcugcucugcucaccagccaugugauuuuugaacaagucacuu

SEQ ID NO: 4189129 - RNA, 102 nt, Human
aggugauuagcaaaguuaaucagaauucugaagggcacaaaaaacaauaugaauguaauagaauuguacuuugugcuacucagaucagaugugcugucaccu

SEQ ID NO: 4189130 - RNA, 58 nt, Human
aggugauuucucaaagcacucagagcacaauaucugacuuugcaaaaggaaaucaccu

SEQ ID NO: 4189131 - RNA, 59 nt, Human
aggugcagcuacaccucagugcuguggguacagacccacugccuucaguugcuucaccu

SEQ ID NO: 4189132 - RNA, 100 nt, Human
aggugccuguucucuaugugccuauguuuccucuucuauaaaguggucugaauaauaccuacuucacagaauugacaugggaaucagagagauggcacuu

SEQ ID NO: 4189133 - RNA, 60 nt, Human
aggugcggagggagcagucggcugugggcgcucggaccacaggcugcccgcuccccaccu

SEQ ID NO: 4189134 - RNA, 74 nt, Human
agguggaugagauuaaagugagguucccucuggaaauauucuaauguaaccauccagccuccuuccucuccccu

SEQ ID NO: 4189135 - RNA, 79 nt, Human
agguggauuuaauugacaaacucuguugagauaauauuuucuuugaaagaauuaagcucagggguucacaauuucacuu

SEQ ID NO: 4189136 - RNA, 55 nt, Human
agguggcagacuaacagaaggauguguguaucccacugcuuugcucugcucaccu

SEQ ID NO: 4189137 - RNA, 70 nt, Human
agguggccacaagguggcuggccaggguuagagcugaacuucaggaagacaagccaugguugugacaccu

SEQ ID NO: 4189138 - RNA, 122 nt, Human
agguggcugucuucaaggaacucacagucuguuggguguuucagucaugugaacaaauaaauuguaauacaagacacuacauguaaaagacccaugggauuucaaagagagacaaucuaccu

SEQ ID NO: 4189139 - RNA, 63 nt, Human
agguggcuguggcuucccuuguuugcaagaucucuagcaggggagauugcauagcccucuccu

SEQ ID NO: 4189140 - RNA, 62 nt, Human
aggugggaguccaagguuuuuauaguucuucucucgaauuagugccugcagacucuacagcu

SEQ ID NO: 4189141 - RNA, 99 nt, Human
agguggggagaugagugagguagcugguacauguuuaggugugaguuuuguguacuacuuaggcuugguucagcuagauacaguuucccauauucaccu

SEQ ID NO: 4189142 - RNA, 79 nt, Human
aggugggggcuccugauggaauguuggccugucuuucauccggcaaggucacuuccugucuggauaagccaucccaccu

SEQ ID NO: 4189143 - RNA, 66 nt, Human
aggugggugcauuauuugaggucaggaguucaagaccagccugaccaacguggugaaaccccaucu

SEQ ID NO: 4189144 - RNA, 70 nt, Human
aggugguacaagaggcuuaauguuggcaaacaugcagcugauugcuaacgcucacccuuugccaccaccu

SEQ ID NO: 4189145 - RNA, 66 nt, Human
aggugguauuauucuggaggaagcaaaugggugauaucuaugcuuaccucuauggauaccucacuu

SEQ ID NO: 4189146 - RNA, 75 nt, Human
agguggugggcuggauuugcuugcagaucacaguuugcugaugucugcaagucuaaacuagccaugucaauuccu

SEQ ID NO: 4189147 - RNA, 94 nt, Human
agguggugugugcgccuguagucccagcuauuucugaggcaggaagaucacuugagcccaggaguuugaguucagcaugggcaacaugagaccu

SEQ ID NO: 4189148 - RNA, 72 nt, Human
aggugguuaguggcagagcaggugcuggaacucaggccucugcauuuccagcucucuccgccucccccaucu

SEQ ID NO: 4189149 - RNA, 57 nt, Human
aggugguucacgccuguaaucccagcacuuugggaggccgagguggguggaucaccu

SEQ ID NO: 4189150 - RNA, 86 nt, Human
aggugugagaacauuugcagggagaguagugcuggauaaaggucauugcaccaugaaagccuuccuuuauaugucuccagcuaccu

SEQ ID NO: 4189151 - RNA, 64 nt, Human
aggugugaguaucugcuauuccagauuaaaauagaaaucguuggcaauggcagaugccauaucu

SEQ ID NO: 4189152 - RNA, 87 nt, Human
agguguucguccuuggaaagucuaaucucuaagcacugcucagaauauagcuucagagaugguauuuauccauuggggugaccacuu

SEQ ID NO: 4189153 - RNA, 77 nt, Human
agguguuuacaguaggauuuucagggucuucaaucugucauauugcuagacauagacuuucuacugugucaucacuu

SEQ ID NO: 4189154 - RNA, 78 nt, Human
agguguuuucucuucuccaaacucagacuaaguauccuuccauuggcaaaugcuugguuuguuggguccuuuacacuu

SEQ ID NO: 4189155 - RNA, 78 nt, Human
agguuaagggggcucagcaggcucuggaugaucaugacagcugugaugccuccgauacugcuggcccugccauagccu

SEQ ID NO: 4189156 - RNA, 78 nt, Human
agguuaauggggcucagcaggcucugguugaccauuacagcagugaugacuuccaugccgcuggccccaccauagccu

SEQ ID NO: 4189157 - RNA, 76 nt, Human
agguuacauagcugguagugguucagccagauuuggaacccaaacagucugaugccaucugccaugugcuuaaccu

SEQ ID NO: 4189158 - RNA, 60 nt, Human
agguuagauuguauguggucauucuuuuaauaagaauggauaagaacaaauaucugaccu

SEQ ID NO: 4189159 - RNA, 70 nt, Human
agguuaggaaaauggaguccuuuuaucauguuacauaaugcaaagucaaaagaaacaccauguuccuccu

SEQ ID NO: 4189160 - RNA, 57 nt, Human
aguguuuuguuguuaccagugccuugacugaauggcuuaggaacaguguaagacacu

SEQ ID NO: 4189161 - RNA, 129 nt, Human
aguuaaauguucugcuuaaggcuacuuauugauuggaaggcaggguauagucuuggggagcccugagcuccuagaaugcaccucugcugucacaagcuauagccauguggucugugaauauuauguccu

SEQ ID NO: 4189162 - RNA, 75 nt, Human
aguuaagagaucuuucuggagaagaaccccugaaaugauucaggguuucggcucaacagaauuggauuauuggcu

SEQ ID NO: 4189163 - RNA, 70 nt, Human
aguuaaggaggugggaacauaguccuguucgaaguacauuucuuacaugauuggacuccuuccccuugcu

SEQ ID NO: 4189164 - RNA, 67 nt, Human
aguuaaggggguucaucuguaagagacauuugucuauuaucucuuauagcaauaauauccuuuaauu

SEQ ID NO: 4189165 - RNA, 64 nt, Human
aguuacauaaaaguucacguaggcuggaaaaagggggaaccagccuaccugaacuuuauggauu

SEQ ID NO: 4189166 - RNA, 89 nt, Human
aguuacauuugcuaccugggcaccuuggacuucuuccacccagggaacagcaggcaauaaaaggugucaccagauuggcagggguaauu

SEQ ID NO: 4189167 - RNA, 71 nt, Human
aguuacuauucagcaugaaaggauuugagugcaauuugcaugucucuuucacauuguuguuuuaguaaacu

SEQ ID NO: 4189168 - RNA, 61 nt, Human
aguuacucaaccucucugagcuucaguuuucuucauuagugugucagagagaauaguaauu

SEQ ID NO: 4189169 - RNA, 60 nt, Human
aguuacuugcugagaugcaauuccucauucacacagaaaaccaaauugucagcaguagcu

SEQ ID NO: 4189170 - RNA, 77 nt, Human
aguuagaccaagaaagggguguuuagagacuuccaagcaaucaugaaacauuccauuucuauguaagccguuugacu

SEQ ID NO: 4189171 - RNA, 63 nt, Human
aguuaggaaaagauauguagucauuggaagauauccagaauacaucaaucuauuuucugcacu

SEQ ID NO: 4189172 - RNA, 129 nt, Human
aguuaggaagccagugugguauaaauggacuaguucacuauagaagacaguguuuaaggaacugaauugauuggcauugugaaacuguaggugaguuccuuagucuuucuagccugugguuucuuuacu

SEQ ID NO: 4189173 - RNA, 81 nt, Human
aguuagggaguuagggaggaugaguggcaucuguugaacacaccagagugcuaaaaucuuaucuuugcugauuuccuaacu

SEQ ID NO: 4189174 - RNA, 129 nt, Human
aguuaggggaugaucugaaauucaaccugugcccugugugcaguggagcacagaggucuggucacuacccuguacugccucugccuccauuguuagucuaucugcuuugaagccugguuguccccugcu

SEQ ID NO: 4189175 - RNA, 68 nt, Human
aguuaguaaucagagguaaacuuuaauaguacaagguaagaacuaaagccuuauccugauugguagcu

SEQ ID NO: 4189176 - RNA, 96 nt, Human
aguuagugagacuuguguugaaagaaguaguuuuaugugucuaaaauguagacucauagacaagccucuuuuaaaccaaaugugcauacacuaauu

SEQ ID NO: 4189177 - RNA, 91 nt, Human
aguuaucuuugaguuacaauguccuuacaugaaaacugugaauaauaauugaccuuuccugcuaggaacauuguauuagugaagguagacu

SEQ ID NO: 4189178 - RNA, 81 nt, Human
aguuaugaaggguugagacaaggguuucuaugcagagcugacuuuguauauugccugagucuuuccucuaauucuuuagcu

SEQ ID NO: 4189179 - RNA, 67 nt, Human
aguuauggacauuuugugagaaaguugaagcaucuguucuuuccucuuuuucugauguuccaugauu

SEQ ID NO: 4189180 - RNA, 63 nt, Human
aguuauguaaucuaacacucaguuuaccaaguuagaaacugaggauggauaggucauaugauu

SEQ ID NO: 4189181 - RNA, 61 nt, Human
aguuauuucacagcuaagagcuaaguaacgacuucguuacugaguuagguuggauaucacu

SEQ ID NO: 4189182 - RNA, 93 nt, Human
aguuauuuuguagacgugcauuuuucaucccucuuggguaaauauuuacaaguaggauuuuugggucauggauaaguacguguauguuuaacu

SEQ ID NO: 4189183 - RNA, 95 nt, Human
aguucaaagcccaaaaugacgauucauagagcagcucacugaauacauguuacauggagauuuauacugagcagcucauggucagggaaagaauu

SEQ ID NO: 4189184 - RNA, 82 nt, Human
aguucaacaguuuugaaucugauggacuuggaaaugcauggugccaucacagagaaaagcuaucacaaagcacaguuggauu

SEQ ID NO: 4189185 - RNA, 60 nt, Human
aguucaaccuuuggaccuggggcuuaccaucacuccagaauccacaacagaaguugaacu

SEQ ID NO: 4189186 - RNA, 60 nt, Human
aguucaaccuuuggaucuggggcuuaccaucacuccagaauccaugacagacguugaacu

SEQ ID NO: 4189187 - RNA, 76 nt, Human
aguucaagaguaacuaauuucaggucuggcaggauccagagucugaaauaaugucacuaagguuuaacuugucacu

SEQ ID NO: 4189188 - RNA, 77 nt, Human
aguucaaggauguguguaagaaugugugugugugugugugcguguguguacucuguauauaaauaaaccuaugggcu

SEQ ID NO: 4189189 - RNA, 98 nt, Human
aguucagauuagcuguggaagcuucagccauuucugcauggagaugcaucugugaaaccuguggcuaggcuccaagagcuggaauacuacucuguacu

SEQ ID NO: 4189190 - RNA, 57 nt, Human
aguucagugcuuacagguuucuuuggaaccuuuucagaagaaucuacagucugaacu

SEQ ID NO: 4189191 - RNA, 76 nt, Human
aguuccagcugacauguccucccucugauguuucugcaguguuaccucuuugaggauggaggugugagcuaugacu

SEQ ID NO: 4189192 - RNA, 77 nt, Human
aguucccaaacagaaauuccagagaugucuuaaacauuguggucaucauugagauagguggaaucucuuuggugacu

SEQ ID NO: 4189193 - RNA, 68 nt, Human
aguucccaagugcacagcaggaguagugauguccucacuggcuucucauuugcauuaaacugugagcu

SEQ ID NO: 4189194 - RNA, 82 nt, Human
aguucgccaccccuaccgggcagcucugccccugccagggauuggccggcagguggcacugcugcucccucugguggccgcu

SEQ ID NO: 4189195 - RNA, 57 nt, Human
aguucguauuuauugagucccugcugugagcccagcagaugcgucugagugggagcu

SEQ ID NO: 4189196 - RNA, 85 nt, Human
aguuuuucaccuggaaauggauccagaugguuuaggaaaauuucuauuggaucugaaaguaucuggaucuuuuuggcaaagagcu

SEQ ID NO: 4189197 - RNA, 59 nt, Human
aguuuuucuuaacuuuaguuuacucaucuauauugagguccugauguuccagagaagcu

SEQ ID NO: 4189198 - RNA, 82 nt, Human
aguuuuugaugaucuucugcuaucauuuuugcuauguuaucugaauagccauccagaucuguaguaaaagaucucguuagcu

SEQ ID NO: 4189199 - RNA, 56 nt, Human
aguuuuugcugauagcaugcuuacgugguaguguagcuuacugggcaguaaagauu

SEQ ID NO: 4189200 - RNA, 64 nt, Human
aguuuuuuaggaugaucuuguagagagaucagcuugcugggguuaccaaggucauucugugacu

SEQ ID NO: 4189201 - RNA, 55 nt, Human
auaaacucaugcugaaaacccaggagaguacccuggguuuuuagcaugaguuugu

SEQ ID NO: 4189202 - RNA, 72 nt, Human
auaaagauauugagaugaggauauuaaccugaauuauccagguuggcccuagauaaucucaaggauacuuau

SEQ ID NO: 4189203 - RNA, 56 nt, Human
auaaaguagaagaguuaagcaggcuucuuuaaagccugcuuuaugcuauacuuugu

SEQ ID NO: 4189204 - RNA, 130 nt, Human
auaaagugaaaugucccaugugaaauguagacuagcuagagaauggcaaagauuagauuugggucuguuucuaauaccuguucuuaagaaccuagcuguauuucucuccauaauuguuuuucauuuauau

SEQ ID NO: 4189205 - RNA, 126 nt, Human
auaaauaacaaaaugugccucugcaucugcuaacucaugcuuuuugacaacaagcugugcugaaagacagucaguugauauugcagacaagcacugugggcugagcaguugcaauuuguuuauugu

SEQ ID NO: 4189206 - RNA, 112 nt, Human
auaaauaauccaaacuaacccuaaaauuauaccaaaaaauuaaugugauuaggaugauaauucacagucacauaguguuuuggaaucuuuguggugaaaauaaauuguuugu

SEQ ID NO: 4189207 - RNA, 76 nt, Human
auaaauacaaagaaauggcuucaucugaguaacugauacuuccaagacuuggccauugcagucuuuuguagauuau

SEQ ID NO: 4189208 - RNA, 69 nt, Human
auaaaucaacuugugacguuagguacuuuaucagguaguacagcaccagauguuucaagcauuguuugu

SEQ ID NO: 4189209 - RNA, 58 nt, Human
auaaaugggccucuuucuuauuccucuaccuggaaugaggcaaucaugguccaguuau

SEQ ID NO: 4189210 - RNA, 100 nt, Human
auaaauuaggcuuguucuaaauguuugccuaauucuuuuagaauauuagaauuuaacuuauuagcuguauguuggguaagcauugcaagaguuaacuugu

SEQ ID NO: 4189211 - RNA, 63 nt, Human
auaacaaacaucagcgcauuuacagucucagcugcagggcggcuggugcucuaugucuguuau

SEQ ID NO: 4189212 - RNA, 81 nt, Human
auaacaacaaaauccuaagcagaggaauuuacuauccuugggcuaauaaagguaaguuccuccuguugggucuuguuuuau

SEQ ID NO: 4189213 - RNA, 130 nt, Human
auaacacacuuagcaaacugauacagaugcacucaguccugugaagugaccucugcagaucucaaggaagaggcugcagaggucacuuuauaggacugaacgcuucugcauuccuuugcuauggcacuau

SEQ ID NO: 4189214 - RNA, 129 nt, Human
auaacagcauuuuguaauacuauuuuuuauuggaagaauauaaagauaauucuguuuuccucuagaggggccgauugauacuuuuuuguguuuuugauaauaauaaauauauagacauacucucuguuu

SEQ ID NO: 4189215 - RNA, 89 nt, Human
augaugguuacauucaaaggcauguccuauuuugcucucaaacacagcaaaauagcaaaauagaacaugccuuugaacauaagcaucau

SEQ ID NO: 4189216 - RNA, 57 nt, Human
augauguaacauaaagaugucuguggauuuugcuauagaacucuuuuguuaggucau

SEQ ID NO: 4189217 - RNA, 67 nt, Human
augaugucaugaauauauuagucuuacucccccuauucacuauggagacuguguaaacaugauucau

SEQ ID NO: 4189218 - RNA, 90 nt, Human
augauucuacuauuucauacauuuccaagaagucaacagguaguaacagaugcagccugauugauuucuggaagggaaaugacagagcau

SEQ ID NO: 4189219 - RNA, 57 nt, Human
augauucuuucauucucuuacuuuaugacaagacaugauggagagugacagagucgu

SEQ ID NO: 4189220 - RNA, 83 nt, Human
augauugguaaaguugcuguugaagacacugccuguuauguucuucaauaacaaaggcagagaauucaacauuuucuuuucau

SEQ ID NO: 4189221 - RNA, 61 nt, Human
augauuuauguguaaccuugugauuuauugagagacaguggauuauuugacacauuaucau

SEQ ID NO: 4189222 - RNA, 127 nt, Human
augcaaauagacuuugauccaugacuuuucuuccacuggccaugaccugugauuaaauuccagcauaaaagggcauagcacaauaucaugucugugaggaguaaagccaugcauuaaagggcugcau

SEQ ID NO: 4189223 - RNA, 78 nt, Human
augcaaauauuucucuugcuauucuguggccccaaauuuugcuggaccagaugagggugucucagaauggauuugcau

SEQ ID NO: 4189224 - RNA, 67 nt, Human
augcaaauuccacagaugucuaucugucugggaaccugggauagaaaugggcuugugggaguaaaau

SEQ ID NO: 4189225 - RNA, 74 nt, Human
augcaaauuuccagaccccauccacagagauuuugauuuugagagggucugagguguggucugggaguauguau

SEQ ID NO: 4189226 - RNA, 75 nt, Human
augcaagcuuuagcaaagcccaaagugacugaaaagagaguuauaauaauguggccuuuguugauagcuaugcau

SEQ ID NO: 4189227 - RNA, 55 nt, Human
augcaauauaugacaauggagcaaagcuccacuguacuuacgcauauacaggcau

SEQ ID NO: 4189228 - RNA, 58 nt, Human
augcacaaguguguguguguaugugaauuuauguauucauacacacacaccuguguau

SEQ ID NO: 4189229 - RNA, 56 nt, Human
augcacagaacaauuuuaagagugguacugaacuguucuucagguuguuugugcau

SEQ ID NO: 4189230 - RNA, 94 nt, Human
augcacauauacauacaaacacuuacacauugcagaucaaaaugagcugucuacauuuaucugacagauggucugugugucuguacguguguau

SEQ ID NO: 4189231 - RNA, 85 nt, Human
augcaccuuccugggcucccacccauagggcgaguccauacuucccuuggacucgcccugugggugggaggccagaaaggagcau

SEQ ID NO: 4189232 - RNA, 61 nt, Human
augcacuguaggugccaucugcaccauauauuauaauacagaguuuagcaccaucgugcau

SEQ ID NO: 4189233 - RNA, 64 nt, Human
augcacuuauuucuuuuguguagauacccaguaguggaauugcugggucagagggaaaguguau

SEQ ID NO: 4189234 - RNA, 77 nt, Human
augcagaguccuaggcccugcuccagaucuauggaaucagaaucugcacuuaagcgaggccugcaggggaucugugu

SEQ ID NO: 4189235 - RNA, 60 nt, Human
augcagaugaaucauugaggcugaaucauguuaacaauaagcguucaaugauuaaugcau

SEQ ID NO: 4189236 - RNA, 71 nt, Human
augcagcacucaugcaagaagauagauuaaaugcaauguugcaggaauaagcugacuguugcaggcugcau

SEQ ID NO: 4189237 - RNA, 130 nt, Human
augcagccauacuucucuagacagccccaugaaugaacauagagaggacauuccagccacaguaggguugugacuucuuuuugaguucaagaaugaauccaugcaagccaauuagaaaaauggcucccau

SEQ ID NO: 4189238 - RNA, 88 nt, Human
augcagccuuguagaccauuuuaaggguuguuuuuaaauucuagaaucaaugggaaguccuugaaauguucucacugggguacagcau

SEQ ID NO: 4189239 - RNA, 63 nt, Human
augcagcucauuuguuuaaaaguucauucgcuucagugugauuuagacagaugugaggugggu

SEQ ID NO: 4189240 - RNA, 55 nt, Human
augcagcuguaacagaggccucagacuuuccuaugagacaguucugcagcugggu

SEQ ID NO: 4189241 - RNA, 88 nt, Human
augcagggaggauggagcacacgccaucacauacuguugugguuacaguaguggguaacaagccugugccauagaucuucuccuguau

SEQ ID NO: 4189242 - RNA, 57 nt, Human
augcagggagguaagaggugccauaagaggcuuuacucauugcuaccucugugucau

SEQ ID NO: 4189243 - RNA, 55 nt, Human
augcaggguuauuucaaaaauaacagcucuucugcuaucaccagugacucugcau

SEQ ID NO: 4189244 - RNA, 55 nt, Human
augcaguccaagcucuagaguuuuacauuaaaauaauagaacugaggacuugcau

SEQ ID NO: 4189245 - RNA, 70 nt, Human
augcaguuagugugacugaggaaugcaguuuccacuuuuacugaauugcaauuaguuuuacuaacuauau

SEQ ID NO: 4189246 - RNA, 56 nt, Human
augcaguuggucauacuacauaccccaugguugcaguuuugacagaccaaaugcau

SEQ ID NO: 4189247 - RNA, 82 nt, Human
augcauauuccccccacauuucugucacguucuuuuauuuccacaauauuuuggggcuacagaaaauucagggaaugcgcau

SEQ ID NO: 4189248 - RNA, 56 nt, Human
augcauauuucuuggagcaccugguaacauuccuguauuucuacagaaauaugcau

SEQ ID NO: 4189249 - RNA, 111 nt, Human
augcaucccuacauuuucaugggcagcaagguggcggaaaugaguaauguagcaauugaaugggcagauaauuuuuucggccaucuguugugcauaugucuagcggaucau

SEQ ID NO: 4189250 - RNA, 67 nt, Human
augcaugcacacacugcauugcacccuugguuuuuauuuaguuccaguaauguaggauggccuguau

SEQ ID NO: 4189251 - RNA, 58 nt, Human
augcaugugccugguaagggggaagaggaccuguucacuccuguuucuaagccagcau

SEQ ID NO: 4189252 - RNA, 74 nt, Human
augcauuugcuugauuuaaugcuaguugucuucuacuucuuagacugagcuaaccagcaugaaaucugcagcau

SEQ ID NO: 4189253 - RNA, 78 nt, Human
augccaaacugcauuagcuaacgugaguugucccccguuuucguaggagggucguguugcuaguuuaguuuccggcau

SEQ ID NO: 4189254 - RNA, 64 nt, Human
augccaagugcaguuggcugaaggaagagcagauccccuuccaucucaccugcacucugcgcau

SEQ ID NO: 4189255 - RNA, 66 nt, Human
augccaagugccaagggguagacaaccuggcuguuuaaucugcauucuacacuuggcaccuggcau

SEQ ID NO: 4189256 - RNA, 80 nt, Human
augccagguacagggguaggguaugggcauuagaauaaacacauaaaugaaaauacacgauuccuuccucauguacgcau

SEQ ID NO: 4189257 - RNA, 64 nt, Human
augccaguaaaaauguugucaaggcaugagaugaaugcaagauauuaucuuugcugcuaugcau

SEQ ID NO: 4189258 - RNA, 99 nt, Human
augcccagcccguggguguuacuuuauucaaaguaccuucauugccacuguaucuucaggccaugauuguccuugaaaaauguuauauuuuggcuucau

SEQ ID NO: 4189259 - RNA, 66 nt, Human
augcccaucccagaauuguuugcaugccuccaaauacaaaauacaugagaacaauaggauguguau

SEQ ID NO: 4189260 - RNA, 66 nt, Human
augccgugugcucccucugucgucauaacucaggaauaaaugcugugauuauuugggaacuggcau

SEQ ID NO: 4189261 - RNA, 81 nt, Human
augccuaaacuauauagcuaauguagugaguggagcucacgcuucgaaggcugugcccuuucgcugcacuguguaaugcau

SEQ ID NO: 4189262 - RNA, 122 nt, Human
augccugucuuguuggugaaaucauuaggaagcaaugcauuauuaaagaguuuuucagacacagaggguuuggaauugcuauugauaacaaauguugcuaauguuuuccugcaaaauugcau

SEQ ID NO: 4189263 - RNA, 72 nt, Human
augcuaaguccuuugcugaacugucacauuucaaauuauccuauaauguuuuaaagggaaagggcuaugcau

SEQ ID NO: 4189264 - RNA, 70 nt, Human
augcuacuauccuucugcuuaaacugcucacauucuagacuacacagaccaaagcacaaggugguugcgu

SEQ ID NO: 4189265 - RNA, 99 nt, Human
augcuagggccuucaggcaggaggugguguggaaguaacauuuuguaacauuuaucugggacucuauaaagauaccucaauugugugaaacucuggcau

SEQ ID NO: 4189266 - RNA, 64 nt, Human
augcuccacuaggaaucugcucuucucugugaggcacugcugaagagcauuccuaaaggaccau

SEQ ID NO: 4189267 - RNA, 64 nt, Human
augcucuccugggauuuugauaugugaguaaagugacacaaggauggaaaaacagguagagcau

SEQ ID NO: 4189268 - RNA, 76 nt, Human
augcucuuaccauuagaagagcuggaagaaggcugagggagaugccuucuuccagcccuucuaaugguaggagcau

SEQ ID NO: 4189269 - RNA, 130 nt, Human
auagagucacucagggagcuauugagaaacaggauucuagggcccccuguaccugagguuuggauuaaauaggucugggggaaagcucaggagccuguauuuucuaaaaguccucuguugauacugaaau

SEQ ID NO: 4189270 - RNA, 81 nt, Human
auagagugacagugaaguguuuaaaggcaugguuucuaggaucagacuucuugagcuggcacuucuccauacugacucugu

SEQ ID NO: 4189271 - RNA, 90 nt, Human
auagauagaugaaaauuauagguccaaugcuugagaaugaugguaucauguuaaaagaaaacauugcacuucugcuuuuccucugucuau

SEQ ID NO: 4189272 - RNA, 78 nt, Human
auagauaucacuguuaucuagaagcacauuaauaugauuuuaaaaaaugguuugguuucuagauauauagugaacuau

SEQ ID NO: 4189273 - RNA, 85 nt, Human
auagaucaaggaacugcagcuuucuaauagggccucaaggagauuuugacaaucccuguuagaagugaacaguuuguugaggugu

SEQ ID NO: 4189274 - RNA, 112 nt, Human
auagaugaguaaagaaauuguguuguguauauauguguguguauauacguauauauguguguauauguauguacgcacauauucucuacauaguagaauaauacucagcuau

SEQ ID NO: 4189275 - RNA, 65 nt, Human
aguguccuuucuguuccagccacacugagcuccuugugguugguucccuuagcaagccaugcacu

SEQ ID NO: 4189276 - RNA, 61 nt, Human
agugucugccugggaggagcauaucucauacccacagggagaguuucucaaggcugacauu

SEQ ID NO: 4189277 - RNA, 58 nt, Human
agugucuggugagggcucucucuuuugguucacagacagagccucuucacugcauacu

SEQ ID NO: 4189278 - RNA, 63 nt, Human
agugucuguccuuguuugguaucagguuuauauuaauuugacaaaacauuuugggagagcauu

SEQ ID NO: 4189279 - RNA, 65 nt, Human
agugucuucaucucagauuaacaggauucaaugaaauuauuauguccugaaucuagaaggaugcu

SEQ ID NO: 4189280 - RNA, 86 nt, Human
agugucuugcucuguggcccaggcuggagugcaguggugugaucauagcucaccacagccuccaucuccugggcucaagugacccu

SEQ ID NO: 4189281 - RNA, 60 nt, Human
agugugacaaaucuauggcucaaaaaugaaauagggagcuagccaagagauuuguuaacu

SEQ ID NO: 4189282 - RNA, 119 nt, Human
agugugacaugugcaggugggaggggcagagggacaagaccagcagggagggugcuccuggggacaguauccuccccgcuggccuucacuucuuggccuugcccugggcagccacagcu

SEQ ID NO: 4189283 - RNA, 63 nt, Human
agugugaccuuauuuggaaacagggucuuugaagaugugaucaaguucagaugaggucauacu

SEQ ID NO: 4189284 - RNA, 67 nt, Human
agugugcugacuucuguaauauuuuugcugcucgaagaaaacaaagaauuucaaaguccagcacauu

SEQ ID NO: 4189285 - RNA, 63 nt, Human
aguguggaccgugacauugguggaagaaaugaaaaccccacuagggaaaguuauguucacacu

SEQ ID NO: 4189286 - RNA, 55 nt, Human
aguguggccaaugaggaugggcgaaggguugcugccaucuugaaccaugcccacu

SEQ ID NO: 4189287 - RNA, 80 nt, Human
aguguguaauguugucagcaucaucacacaaaaccucaauuuauuuggaugaugacuuauguuuacaaauguuacagucu

SEQ ID NO: 4189288 - RNA, 88 nt, Human
aguguguccauguuaaaugcagauuccuaggccccauugacuagcccaggauguggguggaccugggaaucugcauccuuagcacgcu

SEQ ID NO: 4189289 - RNA, 69 nt, Human
aguguguguguguguguguguguguguguguguguauuuaugcagaugauguagacagacagugacacu

SEQ ID NO: 4189290 - RNA, 56 nt, Human
aguguguguugaagcagugucuguugcaagaaaacagugucugcugcaagauaucu

SEQ ID NO: 4189291 - RNA, 71 nt, Human
aguguuacacaggacuguauccuuggagaaaacucucaguucuuucuucaauucacagucccuuguauauu

SEQ ID NO: 4189292 - RNA, 96 nt, Human
aguguuccauguugcuuaaacaggaaagagccaggucauccugcuacuugggguaaauuugguguguuuuuucuuguguugccgauauuagucauu

SEQ ID NO: 4189293 - RNA, 70 nt, Human
aguguugaucaguguacuucuuaccagaacuugggccucucuaaggugguaauagugcaggauuaucacu

SEQ ID NO: 4189294 - RNA, 65 nt, Human
aguguugugugcuuugguaguagaagugugcaaaaaacacaaaguuagcaaagcaaacacaugcu

SEQ ID NO: 4189295 - RNA, 59 nt, Human
aguguuguuuacauauuaugcaugggucacugacaaucaaugugucuguaaacaacucu

SEQ ID NO: 4189296 - RNA, 130 nt, Human
aguguuucacaaugcucgauguagacacaccccuaauguccuuguuuucuccacugcaucuuauuuccuaaugaggucuaggcaggaaacucuggauguggagguccaucgcuuggugguugagaauacu

SEQ ID NO: 4189297 - RNA, 57 nt, Human
aguguuucuucucacacaaacucaccuggaugugaguccuguaggauggagagcauu

SEQ ID NO: 4189298 - RNA, 67 nt, Human
aguguuugagacacauuucacuuaucucugaauacuaaguaaaaaagaagugaggugguuugacauu

SEQ ID NO: 4189299 - RNA, 102 nt, Human
aguguuuggaagguggugcuuaaucuggagccuuguugauauaaauuuaucugaacuucagggcuugguuggaaccacccaaauaagaaacuccuuagcacu

SEQ ID NO: 4189300 - RNA, 72 nt, Human
aguguuuucuguuaggcaucauuuuaacugagacucuuucuugaaaauuugguguuggcagaaaagaacacu

SEQ ID NO: 4189301 - RNA, 66 nt, Human
aguuaaaacacaugaguagcuaguaccaaaaugucccacaucgugcuguacuucuguguugaagcu

SEQ ID NO: 4189302 - RNA, 90 nt, Human
aguuaaagugaagauuaaguuacaguuauuauuuaaaauguagauaucauuuuagguagucauuucugaauggaaucacacugaugagcu

SEQ ID NO: 4189303 - RNA, 57 nt, Human
aguuaaaucauggccauuggaagcacuacgguguuucuuacuucucugauuugcacu

SEQ ID NO: 4189304 - RNA, 126 nt, Human
aguuaacuauaagccauaaaaguaucuaggagcagaccugagugaagcacguguucaguuaguuauugaaacaaaaguauguagcuugucucaaguuccugguaacuacuucagggcugauugacu

SEQ ID NO: 4189305 - RNA, 63 nt, Human
aguuaagggaauccuagguaggcuguauguuuugcuucccuuucuggugacuucucuggugcu

SEQ ID NO: 4189306 - RNA, 82 nt, Human
aguuaauggggccuuggcuauaugaaagcuuccuauuuuagccucuuaaaauuggaugcacauuuagaaaaggcucuuagcu

SEQ ID NO: 4189307 - RNA, 73 nt, Human
aguuaauuuccuuagguucagcuuccacugccuauaaaaauaggggugggguugaaaucucuggaacuggacu

SEQ ID NO: 4189308 - RNA, 56 nt, Human
aguuacaaacacuaucaguucugauggacuucaguaaugggaauagugucugugcu

SEQ ID NO: 4189309 - RNA, 81 nt, Human
aguuacaagagguauuuuaaaugucaguggguuuauuguucuauaccauagaaccaugaguuugaguaucuagacuugacu

SEQ ID NO: 4189310 - RNA, 62 nt, Human
aguuaccgagaacaugacuggaauucaggaaaugcuaaagguccugucuuaucucuguaacu

SEQ ID NO: 4189311 - RNA, 72 nt, Human
aguuaccguuacagcuugacccauaaugucucacaaauagauguugccguuaaguuguguaggcaggaugcu

SEQ ID NO: 4189312 - RNA, 71 nt, Human
aguuaccuguuuuaaagcuaaaaggggucaugacuaucuauaauuaucuauuuuaucuaagauaggugacu

SEQ ID NO: 4189313 - RNA, 61 nt, Human
aguuagucauuuagaaugcagaguucauuuucaugaacaaucaaguuucuaaaugacagcu

SEQ ID NO: 4189314 - RNA, 74 nt, Human
aguuagucccugagccuggcauuucccccuaaguaagaggucgggggaaacagcccaggcucaggggcuucucu

SEQ ID NO: 4189315 - RNA, 89 nt, Human
aguuauaauauaucuucucaaaguauuuguuuaaauaugguaagaaauuuucacaaggaggaggugcuagagaagauguuguucuggcu

SEQ ID NO: 4189316 - RNA, 95 nt, Human
aguuauuagguuggugcaaaagucauuguaguuuuuguaauaauuaguugguacaaaaguaauugcgugauaacuuuugcaccaaccuaaauacu

SEQ ID NO: 4189317 - RNA, 55 nt, Human
aguuauucauuucuucuaaugggaugguuugcuaucucagaggaauguaguuacu

SEQ ID NO: 4189318 - RNA, 75 nt, Human
aguuauuuacuccuuugucucugaguugaucggaucuauuuccaagagcagauuuuauaggggaaacagauggcu

SEQ ID NO: 4189319 - RNA, 58 nt, Human
aguuauuuuugguuguuucuaggucuggaggccaggaaaaugucaauggaaagcagcu

SEQ ID NO: 4189320 - RNA, 66 nt, Human
aguucaacaaggggucugcuucauagacauuuucugugguuuugaggcaauauuccauguggaacu

SEQ ID NO: 4189321 - RNA, 56 nt, Human
aguucaagacaagaucuaagcaugcugaucacagcugggaggauuuguuuuguucu

SEQ ID NO: 4189322 - RNA, 78 nt, Human
aguucacgugaccacucccauaauuccaugcaccuggcccucaggaugcaggaggucggggagcacucacccugagcu

SEQ ID NO: 4189323 - RNA, 93 nt, Human
aguucaggaagaguuuagagauauccuugcuguccccagucucagacuagguugcacugggcuccaggaaggaggcuacacauuuauugagcu

SEQ ID NO: 4189324 - RNA, 93 nt, Human
aguucaugcagccagugaguaguggaggcgggguaagaacucaggcaguuugauucccagaguuuccugugucccaaaugcuuugugugugcu

SEQ ID NO: 4189325 - RNA, 117 nt, Human
aguuccaucaugaauguuauuuugcaucuaugaccacuauguagaauuuagaaccauucugauguagaaaguucauagaugcgauauagaaagauaauuguuuauguugauagaauu

SEQ ID NO: 4189326 - RNA, 70 nt, Human
aguuccucccgugccugcugcagagucgcuguggggacagggccucgaaggcagagggauggagugagcu

SEQ ID NO: 4189327 - RNA, 65 nt, Human
aguucgcacaggcacagacacugggaugaugagggguaccaucccacugucuucucgugcucgcu

SEQ ID NO: 4189328 - RNA, 82 nt, Human
aguucuaaacugaguuuucugaaccccacuccagauauacugaaucaaugcuuugggggcagaggauucaggaaugaggacu

SEQ ID NO: 4189329 - RNA, 82 nt, Human
aguucuaggguacauaugcacaacaugcagguuuguuacauauguauacaugugccauguuggugugcugcacccauuaacu

SEQ ID NO: 4189330 - RNA, 82 nt, Human
aguucuaggguacaugugcacaacgugcagguuuguuacauauguauacaugcgccauguuggugugcugcacccauuaacu

SEQ ID NO: 4189331 - RNA, 82 nt, Human
aguucuaggguaccuaugcacaacaugcagguuuguuacauacauauacaugugccauguuggugugcugcacccauuaacu

SEQ ID NO: 4189332 - RNA, 57 nt, Human
aguucuaugccgauagggaaguugaucaauucuuucauuuccacuuggguuagaauu

SEQ ID NO: 4189333 - RNA, 80 nt, Human
aguucuauucaguuucuucauccaaaaaauggagcuaauuauaccuccuucauaaucuuuuggggaggaauuauagaacu

SEQ ID NO: 4189334 - RNA, 78 nt, Human
aguucuauugauuuucuguaugugaaauuugccuuaauuuuuguuucaguuucucauguggauaugaauuguagaacu

SEQ ID NO: 4189335 - RNA, 66 nt, Human
aguucucuauucacuuauguuucaggcuccaaaugacaugguauugaaauacugagugaaagaauu

SEQ ID NO: 4189336 - RNA, 106 nt, Human
aguucuggaaggaauaacugagagucaguagcagcagcagcaucagcagcauccuaauccuauuagcagcugcuguugacggacuggcugcucccugccaggcacu

SEQ ID NO: 4189337 - RNA, 66 nt, Human
aguucuggcuuugaccaaguucaaguuccuguuccuuaagccccuagaacuguccaagucugagcu

SEQ ID NO: 4189338 - RNA, 81 nt, Human
aguucuuccuccugaggucagccauucuugcccuugggugauccugcccugguaaugagccuugaucucaggaggugagcu

SEQ ID NO: 4189339 - RNA, 70 nt, Human
aguucuugacaacuauacuacuuacugggaaaauaucugcgcugugagcuuuaugguuaucuaaagaacu

SEQ ID NO: 4189340 - RNA, 94 nt, Human
aguucuuuagaaacuauccugaguagcaaaucucaaucccgaucaacuguuugcucucuuuaaugucuuaggcauaguuucuucaaauugaacu

SEQ ID NO: 4189341 - RNA, 62 nt, Human
aguucuuuguaaaaggucucuaagagccuuucaccucucugaaagugccuuuuaucaagacu

SEQ ID NO: 4189342 - RNA, 59 nt, Human
auccaggcuggguguggcuacuauuuaauacaaaauguggaaguauauugaaccuggau

SEQ ID NO: 4189343 - RNA, 129 nt, Human
auccaugugauguuggcugggauaauuggagauggaggaugcacuuucaaaaugacuucuuuacucucauguuugacaccucaguguuucuuuuccucucucuguauggauccucacaaaucguggucu

SEQ ID NO: 4189344 - RNA, 81 nt, Human
auccauucaguaauucagucaguuaacaacuauuuauugagcaccuguuaugugcuaaguguugaucugagugcuaaggau

SEQ ID NO: 4189345 - RNA, 105 nt, Human
auccauuuauauaaaaaauguuuucgcaccucucuuggauguggaugggugcccagggguaacacuuucuagacaagggaauaaguguggacacagacauuggau

SEQ ID NO: 4189346 - RNA, 76 nt, Human
aucccagcacaucauguuaauucauuacagagacagaacuucucaagcauacucuguaagcaugugagcuugggau

SEQ ID NO: 4189347 - RNA, 81 nt, Human
aucccaggggagauguguccccagaggauugaaggggagaugguccaauuuaccuguguaagggauuacuuacucugggau

SEQ ID NO: 4189348 - RNA, 65 nt, Human
auccccaaccucucuccccugugaagagcguacguaagcaucuacaucucaguggguugguggau

SEQ ID NO: 4189349 - RNA, 56 nt, Human
auccccgucaugggugaaagcuuuagcaacugcugcucucuuuccauguggaggau

SEQ ID NO: 4189350 - RNA, 130 nt, Human
auccccuguggagucucccugaggcuguccuccccugcagacauggcauucuguuccugaggguggggaggagaaagcagugauuuguggguacagggguucuagccaggggggauuauggggaggggau

SEQ ID NO: 4189351 - RNA, 114 nt, Human
auccccuucuugguagccauuacuuugauugugcuuugucuucaggaucauaccaguaaagcuguguuucaucuccuaucacaauccuucaaagaaaagcuuuaagaccuugau

SEQ ID NO: 4189352 - RNA, 78 nt, Human
aucccucaucuaagacaaugagugagacucaugaaaggcuuuuuauguggcaugggcuccucaucuaagaugauggau

SEQ ID NO: 4189353 - RNA, 129 nt, Human
aucccugauggcuguguguccugggggaauguuaaugcugauggggugggcaaggaguggugaccacuggcuucuagagcccauccuuccucuuuaccucuccccucagaccccauacccuccagggau

SEQ ID NO: 4189354 - RNA, 69 nt, Human
aucccuggggugguggcaggaagucuugaagaaagaagccaguggacugcugcccagccacugagggau

SEQ ID NO: 4189355 - RNA, 80 nt, Human
auccuacagggcuggcaucucuaaugcugaaaguacaacaaagugcagugguagucacugaguguucagccaugcugggu

SEQ ID NO: 4189356 - RNA, 78 nt, Human
auccuagaagccuuuauacuaaaggaaucugcugacauaaauagugucaauucaacggguagaagggucuuggaggau

SEQ ID NO: 4189357 - RNA, 79 nt, Human
auccuagcuuccuucuuuaauucaugauauguaguaaggaaauucacaguaucuagaaaugaggguggacacuggagau

SEQ ID NO: 4189358 - RNA, 55 nt, Human
auccucacaaauuguuaaacagggaaauagacucuggcaauggauuuuugaggau

SEQ ID NO: 4189359 - RNA, 70 nt, Human
auccucauaugcuagcguuuuuauuucuguaagauagauucccaggaaagagacugcuggguugaaggau

SEQ ID NO: 4189360 - RNA, 67 nt, Human
auccucucucccauaccagucuugccuucuaggcaccaccauuggaucuguagggacuucagaggau

SEQ ID NO: 4189361 - RNA, 59 nt, Human
auccugggaggcggagguugcagugaguggagauugcaccacugcacuccagccugggu

SEQ ID NO: 4189362 - RNA, 71 nt, Human
auccuggugcucuguggcugaaucuggauggcucaguggccuaacagaaacagacaugacgcaguaaggau

SEQ ID NO: 4189363 - RNA, 56 nt, Human
auccuggugguggggucuguggguggaggggucuccagguguccacguggcagggu

SEQ ID NO: 4189364 - RNA, 62 nt, Human
agugauagcacagauauaccuauacugugguucaaaucauguauagcaaauauuuguucacu

SEQ ID NO: 4189365 - RNA, 98 nt, Human
agugaucaauuaaauggaaacuauuauuagcaaaagguggaucuggcagccuauguuaauccauguagcuauaauacaaucauccaaacugacucauu

SEQ ID NO: 4189366 - RNA, 58 nt, Human
agugauccuccugccuuagccucccaaagugcagaaauuacaggcaugaggcaucacu

SEQ ID NO: 4189367 - RNA, 66 nt, Human
agugaugaggccuucaacggacacacuaucaagaagcucaggauguccuuuuugaggccuccuccu

SEQ ID NO: 4189368 - RNA, 58 nt, Human
agugauggcauauauagaugugggccugggaggaauagucuguaauuaugccaucacu

SEQ ID NO: 4189369 - RNA, 75 nt, Human
agugauguaaaucaagcagugcugguuuuguccagaugcuuucgcgucagccggcacugcugauuucaaauagcu

SEQ ID NO: 4189370 - RNA, 58 nt, Human
agugauuucuagucuuggcuccgcagaugugaccugugguacucagaucaagucagcu

SEQ ID NO: 4189371 - RNA, 59 nt, Human
agugcaaagcagccuguacaccauccucucgggcaacgagggacaggccugcuugcacu

SEQ ID NO: 4189372 - RNA, 63 nt, Human
agugcaaagccgagguuucuugggccucucacaucagcaccucccagaccucgguucuguauu

SEQ ID NO: 4189373 - RNA, 74 nt, Human
agugcacaaguccugcagucuacccaaugugugcugaccggcuuacuggggcacuaguugaaacaggauguacu

SEQ ID NO: 4189374 - RNA, 83 nt, Human
agugcagaagacuuuuaaggcagugaaacuauucuguaugcuaguacaauagucaaugcacgucauuaaugucuuuacgcauu

SEQ ID NO: 4189375 - RNA, 60 nt, Human
agugcaggaagaucggacucauuagaacuacaaaccugcugaacucuggucaucuucauu

SEQ ID NO: 4189376 - RNA, 57 nt, Human
agugcagggggaaagggugucuuaucagcaagggacaacaguuuucucaucugggcu

SEQ ID NO: 4189377 - RNA, 55 nt, Human
agugcaugcgcuugggaggggucggccugcccacuccaaaccaagugugugcccu

SEQ ID NO: 4189378 - RNA, 87 nt, Human
agugccagguggugccuccaggcugguuaucagcuggacugcaagaaagugccagguggugccuccaggcugguuaucagcuggacu

SEQ ID NO: 4189379 - RNA, 55 nt, Human
agugccagugagacacuuucagaaacaugucugaggguuacuuuauuaggcagcu

SEQ ID NO: 4189380 - RNA, 61 nt, Human
agugccauggaggaacagaugccaaagaaagcuuauucaaguccuuuccuccauggcgacu

SEQ ID NO: 4189381 - RNA, 58 nt, Human
agugcccuggaugacuuuggucuguaacaacaaacaguaccucauggcgccggggccu

SEQ ID NO: 4189382 - RNA, 90 nt, Human
agugccgcaugcccccagauuacauuuguggagugaaggcuuugaucucugcuuccuacaugugucugcgaggauugguacuaugguacu

SEQ ID NO: 4189383 - RNA, 80 nt, Human
agugccucacugucaccucauuuaaucccacucaacccuccaagguggguggugguccacaaauggguacacugaggccu

SEQ ID NO: 4189384 - RNA, 72 nt, Human
agugccugccucauaggcuuaucgugggcuuaaaugagucaacauguauaagcgcuaggagugccuggcacu

SEQ ID NO: 4189385 - RNA, 77 nt, Human
agugcuaucgaguucuaaugcuggcucuccuuauuucacaguggcaauuagcacagcuuuuagguggaaauggcacu

SEQ ID NO: 4189386 - RNA, 69 nt, Human
agugcuccaggagcccugccacaaugguuucuuugugagaucaucuuugcagcgguuuccugaagcucu

SEQ ID NO: 4189387 - RNA, 65 nt, Human
agugcucugauucagugcauuuuaguaaguuuuuaaacaauacaugaauuugagucagaggaacu

SEQ ID NO: 4189388 - RNA, 112 nt, Human
agugcugaugaugcaacaaguaauuaacuuucugugacgcaaagcugggaaggcagcuguggcuauuuuccaguuguucuagaaagcuagcgccuaggccuuugucagcgcu

SEQ ID NO: 4189389 - RNA, 74 nt, Human
agugcuggaggugguacuggaauccaggcaucuggcucuagagccuggcucccagcuaccguguccuuaggccu

SEQ ID NO: 4189390 - RNA, 65 nt, Human
agugcuggauaaauggugucuuuucucauccucuuggaguauuagaaacaucauuguuugguauu

SEQ ID NO: 4189391 - RNA, 63 nt, Human
agugcuggauccaaggggccuggggccaaggugugugccaggcaggacccuagaaccagaacu

SEQ ID NO: 4189392 - RNA, 95 nt, Human
agugcugucugaagggcuuuauauagacacucaaucuuuacaacaaucugaagaagcagguauuugucucagauuggguuccuucgaaacagacu

SEQ ID NO: 4189393 - RNA, 62 nt, Human
agugcuucuuaaaccuuucuacuuauauuccccuuaaaaguagaagacaagaggaaggcauu

SEQ ID NO: 4189394 - RNA, 62 nt, Human
agugcuugcuuugccaccagaagucuaugcuguagcuauaacuucgugggcaaaugcacacu

SEQ ID NO: 4189395 - RNA, 76 nt, Human
agugcuuggagagaccaugacauguaaugacaugaaaguaauuucggugucacaauuuauuucucuugaauucacu

SEQ ID NO: 4189396 - RNA, 73 nt, Human
aguggaauugaggcagacugccggcagaacugcuuaaauucaacugucacaucacccugcucuuaauucuguu

SEQ ID NO: 4189397 - RNA, 57 nt, Human
aguggaggaaacagaggugcaagaauucaaccaacuugcaguucaagucaaucuacu

SEQ ID NO: 4189398 - RNA, 90 nt, Human
aguggagucacucuguugcucaggcuggagugcaguggggcgaucucggcucacugcaaccucugccuccccaguucaagugauucuccu

SEQ ID NO: 4189399 - RNA, 124 nt, Human
aguggauaauuucucccauaacacuuaccauaacuuuugcugagugcugaucuuuugaugaaggaccaugaagaggacaguauucaauaugaguucucacuugucuuaauccuuuuauccugcu

SEQ ID NO: 4189400 - RNA, 56 nt, Human
aguggcagacagagacaguaccuggacucuaaggagcugggcuccagucugccgcu

SEQ ID NO: 4189401 - RNA, 65 nt, Human
aguggcagagccaagauaugauccuggauguguaaauccaaggccuguauucuuugcucuccacu

SEQ ID NO: 4189402 - RNA, 55 nt, Human
aguggcagugugaggauccugcuuuagaagacuacagcguuuucaaugcuccacu

SEQ ID NO: 4189403 - RNA, 67 nt, Human
aguggcaguugugagguucauauuuucuuuuauaguaggaaaaguauaugcuauuacuacuguuauu

SEQ ID NO: 4189404 - RNA, 88 nt, Human
aguggcauuacauccggguccucugucucauuuucauucacagaucccugugggcugagcacugaggaaggaauucauuaaugccgcu

SEQ ID NO: 4189405 - RNA, 55 nt, Human
aguggcucaugccuguaaccccagcacuuugggaggccaaggcaggcagaucauu

SEQ ID NO: 4189406 - RNA, 58 nt, Human
aguggcucuugggucacugggccauuauuaagguuucuguccaucuccagaguacacu

SEQ ID NO: 4189407 - RNA, 80 nt, Human
aguggcuggaauugcaggugcgcccuaacacaugaggcuucugcagggcauggcgagugcaccuguaaauuccggcuacu

SEQ ID NO: 4189408 - RNA, 83 nt, Human
aguggcuuagaauuaaaccauuugaauuauuacugaaacauuucaaguggugacauuaaaugcuuuguuugaaauuagccauu

SEQ ID NO: 4189409 - RNA, 59 nt, Human
agugggaaauuucuggacuccugcacugcccaggguuaaguguccacagauucuucacu

SEQ ID NO: 4189410 - RNA, 63 nt, Human
agugggcagaaaucaguaucagauugucaacuugcaaauauuuggugaaauugcugaccuacu

SEQ ID NO: 4189411 - RNA, 71 nt, Human
agugggcccaguguugccagaccugaaauauaccucauguggguguuugucucugguacucuggguucauu

SEQ ID NO: 4189412 - RNA, 80 nt, Human
agugggcuuggaagguggugaucaucuugaaggcuguuaaauucacccugaagaugguugauccccuugaaggcuauccu

SEQ ID NO: 4189413 - RNA, 57 nt, Human
agugggcuuuuuuccguuccauguacuucauauggaaaagaauucaaaggcuccucu

SEQ ID NO: 4189414 - RNA, 95 nt, Human
agugguaaagggauuauagugaggucauauagcgaacuccagaaggaacacaggcaucuggacuccugucuggcuuucuuugagacugaacugcu

SEQ ID NO: 4189415 - RNA, 71 nt, Human
agugguaagagcacagugcaggauccccgugguggcuggcuaugcuggagaacugcucuguguucaucacu

SEQ ID NO: 4189416 - RNA, 77 nt, Human
aguggucagcuguguucagugcuacugaguugucaaauaagaugaagaaugaagagcccacugaauuuagcaacacu

SEQ ID NO: 4189417 - RNA, 83 nt, Human
aucuuaaauaagucacuugauucuccugagcucuguuucuuccucugaaaauaaagccauugaauuauggugguuugaaagau

SEQ ID NO: 4189418 - RNA, 126 nt, Human
aucuuauuuuuacucauauaucuuaccugauaaaggaagccauuagcugcaagauuccuauccugaaaauuagcagugauaacuuuacucuuuuuaggugcucauauuuguauaaaaagcauagau

SEQ ID NO: 4189419 - RNA, 59 nt, Human
aucuucaacugccuggaacuuuccugauuucaaaaugguaaguuucaugcucuggggau

SEQ ID NO: 4189420 - RNA, 88 nt, Human
aucuucagggaguuacaauccaggguguggccuuuccacaacacguaugugagugcaaacugcccacuacugggaaacuccugagggu

SEQ ID NO: 4189421 - RNA, 78 nt, Human
aucuucagucuggagagaauguggaaugauuugucucuuuuaauaagauuuccagaccaauuucucaagcugauagau

SEQ ID NO: 4189422 - RNA, 69 nt, Human
aucuucccacaacagcauccagagaaagagaaacaggcacucuuccucucagugugguugugggaagau

SEQ ID NO: 4189423 - RNA, 70 nt, Human
aucuuccugaguucuuauuuccagucagggaaacacauuuucuccucauuuaauuuggaacucagaggau

SEQ ID NO: 4189424 - RNA, 69 nt, Human
aucuuccuuugccaugggauaguguuuuuaaaaaaaucccuggagccugccccaauuauaaaagaagau

SEQ ID NO: 4189425 - RNA, 63 nt, Human
auuacugucuuugaggagauuuugauaagcauacagucuuuuagacaauccucaaaagguaau

SEQ ID NO: 4189426 - RNA, 87 nt, Human
auuacuuaaguuuaugaugaaaaucuugagaugucgacuuaaaaauggguaaagagguuacauggguuuucaaacuccuuaagugau

SEQ ID NO: 4189427 - RNA, 57 nt, Human
auuagaacuaggcuaaguaaaacgagauuucuuggucugauuguguguaguucugau

SEQ ID NO: 4189428 - RNA, 130 nt, Human
auuagaaucacuuguggagauuuauaaaaauugcugccugaaugaaccuuguucuuggagauucagauggaauuggccuggguggggucuagacagcaguaguuuuuaaaacucuccaggugaaucuaau

SEQ ID NO: 4189429 - RNA, 80 nt, Human
auuagagucagaguggucuuuaagauuuaauuaucucuccaauuagagauaacagacuuagaguuacaagggaccuugau

SEQ ID NO: 4189430 - RNA, 62 nt, Human
auuagauauuugcuguuggauuugguauauuuaggcaaauccuucuucugcuagugucuaau

SEQ ID NO: 4189431 - RNA, 127 nt, Human
auuagcgucaauggccccaucaggcucuagguuaguaggagaacauucucaagcauuucagagaguauaagggacgucucuucuaauuaggguccaugauguagucauacuuucuuauugaucuaau

SEQ ID NO: 4189432 - RNA, 103 nt, Human
auuaggagauugucuugggguaguuaucaguaugacaccagaggcaaagacacuagaagcuguuggaauuaaaaggagaacuucucaugagcaauauccuaau

SEQ ID NO: 4189433 - RNA, 63 nt, Human
auuagguugagguacucagagcucccccaucaugaggcugagcucuagguccuugcauuuaau

SEQ ID NO: 4189434 - RNA, 57 nt, Human
auuagguuggugcaaaaguaauuacaguuuuugcaauuacuuuugcaccaaccuaau

SEQ ID NO: 4189435 - RNA, 80 nt, Human
auuagguuggugcaaaaguaauuacaguuuuugccauagaaaguaauggcaaaaacugauuucuuuugcaccaaccuaau

SEQ ID NO: 4189436 - RNA, 106 nt, Human
auuaguacaagauuacuaacuggagcccuuuuccuagauacuguuacuuauaaauuguagguauaugguacguuagaagaagggguccuaguauucuugaccugau

SEQ ID NO: 4189437 - RNA, 68 nt, Human
auuaguugauacuaucuguacaggguuacaaauuaaccacuuucaaguuucagaggauaugaacuagu

SEQ ID NO: 4189438 - RNA, 82 nt, Human
auuaguuuauggauuaguuccucugggguuggauagcuucucuuggcucaaucagccaugucaggggaaugacauugcuaau

SEQ ID NO: 4189439 - RNA, 104 nt, Human
auuauaauacagucucuuuucuucuuaguaucucuccaagcccuuguuuuaaagguuuucacaggaaguauguuagagagaaaucagacuggaauuguuaugau

SEQ ID NO: 4189440 - RNA, 130 nt, Human
auuauaaugaaaucauguuaucagggaguaugucauccaaggauuuuauugcauauuuuauuauuagggagaaugacaauauagcuuugauuuuauacuuacagugcuugauauauagugauauuauaau

SEQ ID NO: 4189441 - RNA, 81 nt, Human
auuauacaagguuguacuuucucucuaagcaugaaggauuucccauggaaaaagaguucagaaagugcagguuuguguugu

SEQ ID NO: 4189442 - RNA, 96 nt, Human
auuauagacauuuucccuacccucauggggguugcaauuagcagcagggacauggugggguguacaauuaaaugggaaauuaggaugucaugugau

SEQ ID NO: 4189443 - RNA, 72 nt, Human
auuauauuaaauuaaguggcuaauuuauccaagugaauuaucugcauagauagccacuggagcuuaaguagu

SEQ ID NO: 4189444 - RNA, 68 nt, Human
auuaucauuauaaugguauaguugugcaguuauaauaauaauuacagucuuaugguuaugaugauagu

SEQ ID NO: 4189445 - RNA, 70 nt, Human
auuauccuggaugauccaugucauggaacauugagcugcguauccuuucauuuccaucauucagggugau

SEQ ID NO: 4189446 - RNA, 89 nt, Human
auuaucucuuagaaacuccagaagcuacugggauauuaauuaguucaguaguuaauaucaaggaaguuuagagaguugugaguuuuaau

SEQ ID NO: 4189447 - RNA, 87 nt, Human
auuaucuguuauccauagaauaagucaucuuaccuaccuuccgcaguagggaucuuuugaugaccauucauguggggcacaaauaau

SEQ ID NO: 4189448 - RNA, 55 nt, Human
auuaucuugauaaaauggcagugacacgcacucugccugccacaauuagggugau

SEQ ID NO: 4189449 - RNA, 72 nt, Human
auuaucuuugaugauuuuggugggggguuggggggugcucguugaauuuguuucagagucaucaaagauggu

SEQ ID NO: 4189450 - RNA, 65 nt, Human
auuaugcuuucuucuuuuuugaugcuuaggcauuugaaaggcaauucuuggagaagaagcauaau

SEQ ID NO: 4189451 - RNA, 116 nt, Human
auuauguucaagauuuauuguuuugguuuuaguuuucuucaucagugaagugacuugaauuagucucacguaacugucaaggaaacaaaauuacaggcccuaaugaccaacauaau

SEQ ID NO: 4189452 - RNA, 83 nt, Human
auuauucauugcuauauccccagcaucuagaauagucccugccacauaguagguggccaauaaauguuggaggaaugaauaau

SEQ ID NO: 4189453 - RNA, 106 nt, Human
auuauuguauuuauuuuuagguuguuaaauuauuuauguuaacagucgagagacuucucuguuuuuuaacuaaugaauguugacuucucuaaguaagguuaguagu

SEQ ID NO: 4189454 - RNA, 94 nt, Human
auuauuuaggacauuuagaacagaguauuuuuauguaaaaaauuuggcaaacauauuuuguuuucagguaccuugugaaaguguuuugaauaau

SEQ ID NO: 4189455 - RNA, 78 nt, Human
auuauuuauccauacuguaauaccuaaaugaacgcuaugacagaguucaguaagugauuacagugucaggauuauagu

SEQ ID NO: 4189456 - RNA, 128 nt, Human
auuauuuguuuacacaucugccuuccuuaugagaccaugggcucugaagagcaggaaucauguccuuguuuugcaaucucagguccuagcauagggcuccaggcauagcagaugcuuaauaaaaugau

SEQ ID NO: 4189457 - RNA, 67 nt, Human
auuauuuucaaaacaucugcuguguugguuguuuucccaaaaccaaugugggauuuuugaaaauaau

SEQ ID NO: 4189458 - RNA, 70 nt, Human
auuauuuuggcucugucuguaucuuugcucuauuccuauuugagcaaagacagagagaagccagaacaau

SEQ ID NO: 4189459 - RNA, 82 nt, Human
auuauuuuucuucuaccugcuguccaauacugaauaguaucaguuauuuuaagauuugccaguaggagcuaggaaaagugau

SEQ ID NO: 4189460 - RNA, 96 nt, Human
auucaaaaugugucuaauaagugagcuggugagacugaagguuugccccucaauuauccuaguccauugauuagcucauuuaaacauguguggaau

SEQ ID NO: 4189461 - RNA, 106 nt, Human
auucaagugauuuuguuugcaaaguuuuuaagcaagacccuuuuuuuaaagaaagguucuguuuuuaagaaagacccuuuguuuugaaugcaacucuuacucgaau

SEQ ID NO: 4189462 - RNA, 94 nt, Human
auucaauagaucuggguugggaccuaagagucuggguuucuaaccugcucacagaugaugccucugcucuugguccucagaccacacuuggagu

SEQ ID NO: 4189463 - RNA, 73 nt, Human
auucaauaucugguucugcaaauuugucccuaaagauuuuagggcuucauucaggcagaauuucauauugagu

SEQ ID NO: 4189464 - RNA, 55 nt, Human
auucacacacagcuuccuauugucuaugcuaauggagguaaaggcuggugugaau

SEQ ID NO: 4189465 - RNA, 62 nt, Human
auucacaguucauuagcuguaaguagccauaugccccagauagcugaaaggagcuggagagu

SEQ ID NO: 4189466 - RNA, 111 nt, Human
auucacucuuggaguccugagccaccaucuacaaugucuggcugcacugagaucaucaugcugcacaagccacauguaggugcucugcucaaccaacccuccuaaguggau

SEQ ID NO: 4189467 - RNA, 63 nt, Human
auucagaaaguugucauauuugaauuguuuuccuuuucagaggagggaugugcaauacugaau

SEQ ID NO: 4189468 - RNA, 69 nt, Human
auucagaagggcucucugcauugaaauugcaacuuuuucucaccuggcugcaaagagaacccacugagu

SEQ ID NO: 4189469 - RNA, 65 nt, Human
auucagcaggcaccggaaguguuuuugggacuucuugggaaaugcuucauaggaugcugaugagu

SEQ ID NO: 4189470 - RNA, 65 nt, Human
auucagcuaagugcuucaugcugugauuucuucagagaaagggcuuaaugaacacugagcugaau

SEQ ID NO: 4189471 - RNA, 62 nt, Human
auucagcucugaaucagcagacucucauuucucugagucaguuccucaugaucaggcugagu

SEQ ID NO: 4189472 - RNA, 70 nt, Human
auucaguacucuccuuuuccuaauucaucucauucauucaaggugaauuaggaaaugagaguauuugaau

SEQ ID NO: 4189473 - RNA, 94 nt, Human
auucaguggaaguaaccaguagcuauguauaaauaggccacuguagucaaagcucaguguaucuagguaucuauaguucuuuccagacuugaau

SEQ ID NO: 4189474 - RNA, 71 nt, Human
auucaguuauuggaaaagggcuguaauugaguaggguaguaaauacuaauugcuuguuucuuuaacugaau

SEQ ID NO: 4189475 - RNA, 68 nt, Human
auucaugcauucagcaaacauuuauuaucuguuaugagcuagauaguaugugaugcugauaaaugaau

SEQ ID NO: 4189476 - RNA, 79 nt, Human
auuccaaccgacuugugaggagaggcagcaucuuuccgagggaagagcagcacguuguccccacauagugggcaggagu

SEQ ID NO: 4189477 - RNA, 66 nt, Human
auuccaacucgaugcucucuuggguguggggaagccccaagcaggauggagguugaguuacagaau

SEQ ID NO: 4189478 - RNA, 81 nt, Human
auuccaagacaaaacacagcuuucaucaugacacaucucuguucagacuucuugacuggcuuugcuuuuuguguugugaau

SEQ ID NO: 4189479 - RNA, 100 nt, Human
auuccacaccaaggcucucagcaggcaggaaucuaacccaaggagaagauacagccuucagccaaggucagauuuuuguucacugugccaggugaugaau

SEQ ID NO: 4189480 - RNA, 65 nt, Human
auuccacaggacuaccaaugugcaauccucucuccuugagauuuucaacuuggaguucuuggagu

SEQ ID NO: 4189481 - RNA, 61 nt, Human
auuccacagugccuuccgugaacacugcacacagcagcucaucuguaaguaucuguggagu

SEQ ID NO: 4189482 - RNA, 61 nt, Human
auuccacaugaaaggagcugaagcuaauagcccaucuccagucucucuuaguuuguggaau

SEQ ID NO: 4189483 - RNA, 57 nt, Human
auuccacaugcucuuguuacaguguugcaucaacaugccuccauugagcuguggggu

SEQ ID NO: 4189484 - RNA, 57 nt, Human
auuccacuguuauaaaauguccagaacaagccaauuucuggagauaaauaguggaau

SEQ ID NO: 4189485 - RNA, 58 nt, Human
auuccaggcacaucccaacuccagggcuuuggcucuucuggguugcugugcuuggaau

SEQ ID NO: 4189486 - RNA, 56 nt, Human
auuccaggcaugcaggaacaaggggaaagaugaccccuccuuccaguuccuggggu

SEQ ID NO: 4189487 - RNA, 82 nt, Human
auuccaucuguacugagcuccuacugugugccaggcaccaugccaggcucaggacacagugguuuagagaaacagauggggu

SEQ ID NO: 4189488 - RNA, 69 nt, Human
agugucuuaguccauuugggcuacuauaaaaauaccauaaaaugaguggcuuauuggcaacaaagaacu

SEQ ID NO: 4189489 - RNA, 60 nt, Human
agugucuuugucaaauuacaggagccaaacgcugcuaucugagacugugacagagccauu

SEQ ID NO: 4189490 - RNA, 61 nt, Human
agugucuuugucucucaagcacucgcauaaguuccagagugcuucguugaagaauggcgcu

SEQ ID NO: 4189491 - RNA, 73 nt, Human
agugugaggugaggagagaagcauauuuagaccucugaucuuuuuccugugcuucucuuucucacuuaaaucu

SEQ ID NO: 4189492 - RNA, 71 nt, Human
agugugauuauccccguuguucuuugcuugauugggcacagaccucagagcagccugugaugaugcacgcu

SEQ ID NO: 4189493 - RNA, 119 nt, Human
aguguggcaccagugaccagagcgggagauuggggggguguccccuauggcccaggcacaggccuguuaagggggucaucucucuugcccgcugccacaagcacuguuguaaacacacu

SEQ ID NO: 4189494 - RNA, 65 nt, Human
agugugggccacgcagcugagcaaggacacauggugacauggcugaguguugcugaggcccagcu

SEQ ID NO: 4189495 - RNA, 96 nt, Human
aguguggguauugaggcuuaaagcaaauuuuauuugaaucuugauuccggcacuuguguauuccaguaaugugacuuugagccagguauuuacacu

SEQ ID NO: 4189496 - RNA, 91 nt, Human
aguguggugguuacaugaaugcauacauuugucaagacucaucaaaguguaugcuucagaucugugcauuuucuuacauguaaauuauacu

SEQ ID NO: 4189497 - RNA, 76 nt, Human
agugugucaggaggcccaaagggcgcagagacaaaagcacugggaauuugucuccucugggucugaugauaccacu

SEQ ID NO: 4189498 - RNA, 86 nt, Human
agugugucuucuuggccuuccuauggaauguaaucauguggugguuuuccaaccuuaugugauauauucauuccaggaugcccacu

SEQ ID NO: 4189499 - RNA, 71 nt, Human
aguguuaaaaccguuuuaccauuuguaacucuaaucugauuuggaagugugcaguuuaaaauguuaacacu

SEQ ID NO: 4189500 - RNA, 61 nt, Human
aguguuaggaauuaauguagggcacccucuuauugggaaugucacuguaauugccuacauu

SEQ ID NO: 4189501 - RNA, 63 nt, Human
aguguucccaggcguugccaaauguccucuggaaggcaaaaaucaccccugguucagaacacu

SEQ ID NO: 4189502 - RNA, 67 nt, Human
aguguucugggugucagcgugucccaggggauccuaagguccugggcuguugcaucauccuuaaacu

SEQ ID NO: 4189503 - RNA, 123 nt, Human
aguguuggugucuauaucugggcccuggauguacaggcauguuggguuguucaagaauaaugcagugcuucauaugccuguaauagcaacccagggcuggucuuuguuguucacacccacacu

SEQ ID NO: 4189504 - RNA, 66 nt, Human
aguguuucuggaaucaguguuuggccccaaagucucugguuugugcagagauucauagaaaagacu

SEQ ID NO: 4189505 - RNA, 60 nt, Human
aguguuuguaaacuacagaucugagguauuaccugggaauauguauuguuaacaaacacu

SEQ ID NO: 4189506 - RNA, 69 nt, Human
aguguuuuauugucguuguuuuugcuguuguuaaugaaccuacucagagagcaaugagauguaaacacu

SEQ ID NO: 4189507 - RNA, 67 nt, Human
aguguuuuggaggaaaaggaaggauaagguguauaucaugucuuguggauucuauuucccagaaccu

SEQ ID NO: 4189508 - RNA, 71 nt, Human
aguuaaacaucgauggauagagcuugcuuaguuguuuaucauuagcgaaauuuuucaucugaauguuuacu

SEQ ID NO: 4189509 - RNA, 76 nt, Human
aguuaaggaauuuauugccuauguaacuuuauauuuugggauagcacuaagaucagacauggcuggauucaaggcu

SEQ ID NO: 4189510 - RNA, 95 nt, Human
aguuaaggcuauuuucacuucuuuuguggcucuucaguugcuucaggccaccuggauguauacgugcaggucacaggcgauaugauggcuuagcu

SEQ ID NO: 4189511 - RNA, 62 nt, Human
aguuaauaauggaaagacacaugacauaucuaccacagauuauugugucaguccauucagcu

SEQ ID NO: 4189512 - RNA, 129 nt, Human
aguuaauagauagcaugaauauagugauuaaacacauggauugcuuagcuggacugcuuugauuuaaauauaagcucugcuauuuucuaucugugugacauugaucagguuacuuaucucucugugacu

SEQ ID NO: 4189513 - RNA, 82 nt, Human
aguuaauagugauuuucugaggcauagaggaugagacucagugucucuucccuguagccacggguuuuacuuucagaugacu

SEQ ID NO: 4189514 - RNA, 67 nt, Human
aguuacaaguacaggcuuuggaauugggcagauaguauuaaaaccccaacucugccacuuaguagcu

SEQ ID NO: 4189515 - RNA, 76 nt, Human
aguuacauuucaguuucaaugagcagagcauagucugaaaacaacuuauuguuaggcuuuuggaauuuuugugauu

SEQ ID NO: 4189516 - RNA, 60 nt, Human
aguuacugcaugguggaguggagcuuggcagggaacggguuuuaugccaucaugcaagcu

SEQ ID NO: 4189517 - RNA, 88 nt, Human
aguuacugugggauuauugcuaucaaauacaaagggcauaaggcuuagcugagugaauuaugcuuguauuuuauucccuucacuaauu

SEQ ID NO: 4189518 - RNA, 65 nt, Human
aguuacuguuauauuccaggcaaucugcuagguauugaagauaaaaacuggauuaagacagugcu

SEQ ID NO: 4189519 - RNA, 58 nt, Human
aguuacuguuucccgugauacucugucuggacugaauucaucuugggaaaugguaacu

SEQ ID NO: 4189520 - RNA, 125 nt, Human
aguuagccuaaguuuuaaugauauauuuuacuagaaauguucugcaacuguuuucauccuaauguuuuuugaagaggauauugugagagcccucugccucuaaauguauauuacccugguuugcu

SEQ ID NO: 4189521 - RNA, 72 nt, Human
aguuagggaaaauuagcaucaaauaaagcucauuaauaaacuuugauauuugguggcugauuaucuuugauu

SEQ ID NO: 4189522 - RNA, 69 nt, Human
aguuagggucucaggccccauacagcaucuguguuuagcacagugugggcauggugccugcuccuggcu

SEQ ID NO: 4189523 - RNA, 75 nt, Human
aguuauaaacacagcgucccagaagccugccccgggcccgcgcaccccgcuucugggugccugugaguguucacu

SEQ ID NO: 4189524 - RNA, 95 nt, Human
aguuauaagaagcucuggcuaaagagcaagaagauggaucagcugacuucucagaccacuacuauuguuacuuuucuagaauauuuuuauuuacu

SEQ ID NO: 4189525 - RNA, 71 nt, Human
aguuauagaaccagguccucacucugcacaaaaaaauuaccucccagagguggaacugacuuucuaaagcu

SEQ ID NO: 4189526 - RNA, 60 nt, Human
aguuauagccauauucuaagauugucauuucuugcuaagacuuuggaaaaggcuaugauu

SEQ ID NO: 4189527 - RNA, 62 nt, Human
aguuaucagagcuaguacuugcaggugagucucucuuuacuucaggagcagucucuggaacu

SEQ ID NO: 4189528 - RNA, 55 nt, Human
aguuauggagcagaguuuguguuucauaagaaaacauaggcagagcuuuaaagcu

SEQ ID NO: 4189529 - RNA, 73 nt, Human
aguuaugguagcuuaauuugccuggugauauugauuuucugcugccagcugugcuguauuaagcucuauaccu

SEQ ID NO: 4189530 - RNA, 70 nt, Human
aguuauuaguuuaggaucuuuuuugugccagguauugugcuaggcacuggaaauaccuagaugaauagcu

SEQ ID NO: 4189531 - RNA, 111 nt, Human
aguuauuuaguuuuucugcaguggaaugugaauauccaugauuaguaggauaaagucuacaaguagcuucacauuaguuuggaucaaauuuugccauuaaauuaguuaacu

SEQ ID NO: 4189532 - RNA, 62 nt, Human
aguucacauuccgagguacuggggguaaggacuucaacauacuuuccuuggaguguacaacu

SEQ ID NO: 4189533 - RNA, 67 nt, Human
aguucagaacaauuccuuuauaacaaaagucuugaccauuuguugugagguugaauuguguuggccu

SEQ ID NO: 4189534 - RNA, 57 nt, Human
aguucagcaaauaaaacauaguucagagucgaguuaugugguaaaaaugcaugaacu

SEQ ID NO: 4189535 - RNA, 79 nt, Human
aguucagccccucagaguucaguaucaggucacauuuguagguggucuggccccaucuggagucugaguucuuguaacu

SEQ ID NO: 4189536 - RNA, 130 nt, Human
aguucaucccuaaccaacaguuuuccuugaaauuagcuguuagagaagaguguagacagaauaacauuuugcuuuauucccuucugauguguaagaggaggaaaucagggcuuuacaaugauugauuacu

SEQ ID NO: 4189537 - RNA, 58 nt, Human
aguucauggaccaguuguguucuauuaauuuccagaggacauccuggugacuagaacu

SEQ ID NO: 4189538 - RNA, 56 nt, Human
aguucauggagaggagaccgggaacuaacaguccagacuucagcaucuccggagcu

SEQ ID NO: 4189539 - RNA, 81 nt, Human
aguucauuacauuguugcauagguuuugaaaacauuauuaauauuaaacaagucaacccuugugcaacagugaugagaacu

SEQ ID NO: 4189540 - RNA, 97 nt, Human
aguucauucaacuagguaaguggcagagcugggcugcgacccaggugugucugagacugagcccaugcucuuucuacgauauuugcugguauggauu

SEQ ID NO: 4189541 - RNA, 96 nt, Human
aguuccaucaccaaaaagcucagagauauguuuugugaucaaagguacuaauuauaugagccuaagguaauaaucucccuuuuuguaugugugacu

SEQ ID NO: 4189542 - RNA, 90 nt, Human
aguuccucaagauguguuaauuagaaauaaaaugcagcaugguuaucggcugcagagcuuucugaaugaagcagacucugaagagggacu

SEQ ID NO: 4189543 - RNA, 59 nt, Human
aguuccugaaagaugaguaauuaauugugugcugaacugauugcugaauuuuaggaacu

SEQ ID NO: 4189544 - RNA, 57 nt, Human
aguuccugaacuucuuaaugacuuaaguuuucuugaacauuaagguauucagugacu

SEQ ID NO: 4189545 - RNA, 88 nt, Human
aguuccugucgcaguguugagugguggcugaaacaauggcagccacuaauguugauagcuaagcacuuacacuggaaggguagggacu

SEQ ID NO: 4189546 - RNA, 80 nt, Human
aguucgauaacacucucuguugguaaggcuguaaggcagcagaacuuuuacccauugcuagagagagugugaaucgcucu

SEQ ID NO: 4189547 - RNA, 60 nt, Human
aguucggugucuccucaaugagcucguguuuucacugaaguucucuugggggccugagcu

SEQ ID NO: 4189548 - RNA, 66 nt, Human
aguucuaaagguauuuugcagagauaguuacucugacugguaucugcaaguuuaucacuugggauu

SEQ ID NO: 4189549 - RNA, 64 nt, Human
aguucuacucucacucacugaagacgcccugugugcaagucccugaacaggugagaguaggauu

SEQ ID NO: 4189550 - RNA, 82 nt, Human
aguucuaggguacauaugcacaacaugcagguuuguuacauacguauacaugugccguguuggugugcugcacccauuaacu

SEQ ID NO: 4189551 - RNA, 82 nt, Human
aguucuaggguacauguucacaacgugcagguuuguuacauauguauacaugugcuauguugguguacugcacccauuaacu

SEQ ID NO: 4189552 - RNA, 82 nt, Human
aguucuaggguacuggcgcacaaugugcagguuuguuacauauguauacaugugccauguuggugugcuacacccauuaacu

SEQ ID NO: 4189553 - RNA, 89 nt, Human
aguucucauacccuugguuccuucucuguggggaaggcaggaggaagaugccccuccucgcccagagcagggaucagaaugugggaccu

SEQ ID NO: 4189554 - RNA, 59 nt, Human
aguucucuuuagcucauaugguuuucuuuaaaaauuagugauaucagcuaaauggaacu

SEQ ID NO: 4189555 - RNA, 73 nt, Human
aucuacaaauaguggaaaauauuauaaauggcaguaaaugaaguaaaugggaguuuccacuguaauguaugau

SEQ ID NO: 4189556 - RNA, 64 nt, Human
aucuacagcagugccagguagccuuaaguaaaaaaggaacauauuuuaggcacaguugcaggau

SEQ ID NO: 4189557 - RNA, 59 nt, Human
aucuacaggcugaggugggaggaucaacugggucucuccaguuaccuaggucugaaggu

SEQ ID NO: 4189558 - RNA, 57 nt, Human
aucuaccaacuccucucuggccaccaccagccuagguaggccacauggguuggagau

SEQ ID NO: 4189559 - RNA, 75 nt, Human
aucuaccuacuuacauuucuguaaucggcucuucaguuuuaagaagccgaacacauaaaugagagaagcauagau

SEQ ID NO: 4189560 - RNA, 77 nt, Human
aucuacuggcgacucuggucauuuggaagagcauguuuugaaaagaugagcuuuuugauggcuguauucggguagau

SEQ ID NO: 4189561 - RNA, 68 nt, Human
aucuacuucaacagcuuccaaaguguguuccuuggaauacuaguuuuaugggauguuguuaauuagau

SEQ ID NO: 4189562 - RNA, 99 nt, Human
auauauauuucacuauaucacacuucaaacuuuuguuuacuguuucccuucuccuacucuauuauaaaccuuugaggguggggacugugaguuauuuau

SEQ ID NO: 4189563 - RNA, 68 nt, Human
auauauguacacacacaugcauguaaauauauauagauguacaugcauacuuguguguguauauguau

SEQ ID NO: 4189564 - RNA, 61 nt, Human
auauauguguaacacacacacacaaacacacauauauauguguguguguuuauauauguau

SEQ ID NO: 4189565 - RNA, 63 nt, Human
auauauguucagaagaagaauggggaaaaaucuuccucuuuuauuuauucugaaagcauuuau

SEQ ID NO: 4189566 - RNA, 119 nt, Human
auauauuauauauaauauauauauauauaugcauuaacauuguaggaggaguaacuugaaccuuucuaacauagaugcaaguuugugcauauguguuuauguguguaaauaaaauauau

SEQ ID NO: 4189567 - RNA, 83 nt, Human
auauauuuagauuuauaugugagaaugggcaucuuacauauuuuaauacauguauacucauauucacagaugccuaaguguau

SEQ ID NO: 4189568 - RNA, 85 nt, Human
auaucaaagcuucuuaaaguauugguuuaaccaaaucuuuugauuuuuaggaccauuuuacuuguaggugagaauacuuugauau

SEQ ID NO: 4189569 - RNA, 70 nt, Human
auaucacagaugcagaaagagaaagagcuugaaaugggcuugaacacaguucuuucugaaucugaaguau

SEQ ID NO: 4189570 - RNA, 89 nt, Human
auaucacugcuccauggagagugaaagucucucuaguuuucaugccuaccaaacuaguagagauccagcuuuccuuccagaaguaauau

SEQ ID NO: 4189571 - RNA, 71 nt, Human
auaucaggcaaaccgaggagcagaauuauaguauuauaugauaaaaauacuucacuucugggugccgauau

SEQ ID NO: 4189572 - RNA, 73 nt, Human
caaaaaucagcuuucagugguggauugcuguuagaguuguuuaaguaauaccuugcucauagggcugaugcug

SEQ ID NO: 4189573 - RNA, 91 nt, Human
caaaaaugauuaaagugagcuguguagcccuguaaccauggaacagauuuccuguacaauguucauagcuuuggcaaaguaauuauuauug

SEQ ID NO: 4189574 - RNA, 70 nt, Human
caaaacaaugcacauacuacaaucucuguuaacuuggguuaucagagauuguaguaugugcauuguuuug

SEQ ID NO: 4189575 - RNA, 78 nt, Human
caaaacaggacaucacucgccgccugucucgaaguggugagcgccaccacaucgggcggacacugggguccuggugug

SEQ ID NO: 4189576 - RNA, 75 nt, Human
caaaacuuaugccaggucccauccccagagauccugauuuaaugggucuggggugcagccuggacauaagguuug

SEQ ID NO: 4189577 - RNA, 79 nt, Human
caaaagaaaagauccaguguuuugagaagggcacguccacugagcugcucuuugaaggacacuuucaaguuuucuucug

SEQ ID NO: 4189578 - RNA, 76 nt, Human
caaaagcucacuucugaagguaguuggcaggacuucaaggaauggucuugcacugcuuugcaaagcugagacaaug

SEQ ID NO: 4189579 - RNA, 77 nt, Human
caaaaggaucuuaaggcuuggucuagucaugccaggaguccugagugacuguggagcaagcugagaggucugcuuug

SEQ ID NO: 4189580 - RNA, 78 nt, Human
caaaaggcaguucaugcccagagcaguaaauuaggguuugucuuuccuagguuauuggguuuggguuugggucuuuug

SEQ ID NO: 4189581 - RNA, 56 nt, Human
caaaaggccaguacuuuguuugacauauuuggaaacugagguagcuggcucuuuug

SEQ ID NO: 4189582 - RNA, 103 nt, Human
caaaaggcuuuguuauuuggcuuuggggugaagacuguuauucucuuggccugaggaaacuuucuuuugcuucauagucaaaagaaugaucaaaguagcuuug

SEQ ID NO: 4189583 - RNA, 60 nt, Human
caaaagggaguucucuggaagggaaauaauucugucccuaccccugauugcuccuauuug

SEQ ID NO: 4189584 - RNA, 61 nt, Human
caaaagucccaaagucacucugcuugcauccacacugcauucuccugccuuuggacuuuug

SEQ ID NO: 4189585 - RNA, 62 nt, Human
caaaagucuuccuauucucuuaucauuccauaccuuggagccagaguagagguagauuuaug

SEQ ID NO: 4189586 - RNA, 69 nt, Human
caaaagugaagugacauggaucuaucagaaguugcaauuuugcaaaacuugucaguguacuuucuuuug

SEQ ID NO: 4189587 - RNA, 91 nt, Human
caaaauaaaagacaucacaggcaaaauuccuucucucucucccucuuuuuaacuagggaaggaaaucuugcuugugagcagcugaauuuug

SEQ ID NO: 4189588 - RNA, 57 nt, Human
caaaauaauugaguuaguuuucagggugggugcucauuagacagcucuauuauuuug

SEQ ID NO: 4189589 - RNA, 97 nt, Human
caaaaucaagcaacaauuuaacagcuacaucaaacucagaaguggguguuccugacuucuaccuuaguguuuagauguggcauugagcuucuuuuug

SEQ ID NO: 4189590 - RNA, 89 nt, Human
caaaaugggauucaauagaguguuuagcaugaaguucauuagguaguaccuuucuccuaauaaugcugggcauucuggaagucauuuug

SEQ ID NO: 4189591 - RNA, 118 nt, Human
caaaaugguuuaagacagaggucauagcaagcuucaguuuuuacuuuuuccccuugcaucugaacaauugcaagcagaaagaacaacugagugcuuuauuucugcaaccaccaugcug

SEQ ID NO: 4189592 - RNA, 64 nt, Human
caaaauuaguacauugcaaaguccaugcuuaaauccagggccccuggcaagagugcugagcuug

SEQ ID NO: 4189593 - RNA, 66 nt, Human
caaaauugaugaauguaugauuugaaaagaaaccucaaacuuaagauuaugcaagcaucaauauug

SEQ ID NO: 4189594 - RNA, 94 nt, Human
caaacaaauccacaugcuaugaugcaguguggacuaucuuuggucaccuacaugucaaagguggucuuaaacugcucugguuugguaaauguug

SEQ ID NO: 4189595 - RNA, 74 nt, Human
caaacauucccagaaguccagccaugggccugagagacuucuacuggacauggugacuuuuggggacuaauuug

SEQ ID NO: 4189596 - RNA, 56 nt, Human
caaacauuuguuggaaccccugaagcauauccuaggguuccuuggaacacuguuug

SEQ ID NO: 4189597 - RNA, 83 nt, Human
caaacccuaggucugcugacuccuaguccagggcucgugauggcuggugggcccugaacgaggggucuggaggccuggguuug

SEQ ID NO: 4189598 - RNA, 61 nt, Human
caaaccuugcagaacugggcagccaacuaauuaauuguugcaucaauaaagccaggguuug

SEQ ID NO: 4189599 - RNA, 97 nt, Human
caaacucugaugcauagccagcuaagggaagcaugauucuagcaacaaauuccuauccauguaucuuacuucucauuagcugcacagucagagggug

SEQ ID NO: 4189600 - RNA, 84 nt, Human
caaacuggcuuaucaacuuuggucagagaaauugugugggucaaaacuuguauuuuacaugauccagaguuguugcuauguuug

SEQ ID NO: 4189601 - RNA, 66 nt, Human
caaacuucuuuguaagacauguaagucccuucacaacugggggcuugccuugcuuuaaaaaauuug

SEQ ID NO: 4189602 - RNA, 85 nt, Human
caaagaaagucuaaaaguauuuugucaaugggaauuuguuuuagcacuuccaagauguuauuccauugucuuuugacuuucauug

SEQ ID NO: 4189603 - RNA, 60 nt, Human
caaagaaccaggccaauggagagaauucaguggaaguuucagacauagccugauucugug

SEQ ID NO: 4189604 - RNA, 80 nt, Human
caaagaauagcauggcauuuguuuuccaaauggccauuucaauuauuuaaugguuaauuuaaauuccaugcaauucuuug

SEQ ID NO: 4189605 - RNA, 73 nt, Human
caaagagaaaagucaacguacaguaagcaaauguauagcuuaauguggaaucauggacuuuauuauuucuuug

SEQ ID NO: 4189606 - RNA, 78 nt, Human
caaagagccuccuccuggugugccgauuauuaguugccacaauaauucuuuggaaaauaucugaggagaaaaucuuug

SEQ ID NO: 4189607 - RNA, 71 nt, Human
caaagauguuaauagcaccauuuccugucacuaaccuucaagccaagaaaggaaaaguuguuacauuuuug

SEQ ID NO: 4189608 - RNA, 98 nt, Human
caaagcaaugaaucaggaaucugaggcuuugaaauucaaucugcuucugauuuaccaugcagaaaggucacuuagccucagcuuccuuaucugcuaug

SEQ ID NO: 4189609 - RNA, 88 nt, Human
caaagcaccagggaaacggggcuggccuucccgggaggugacacccuccuggcacuuugggggcucgcccucuguugcccuagcuuug

SEQ ID NO: 4189610 - RNA, 116 nt, Human
caaagccaaaauguagguuaagguggcaaccggguaggugucaacucugauuuaagaccagugcagagugaagacaucaccccauagcuccuuaccugacucuaccccaagcuuug

SEQ ID NO: 4189611 - RNA, 61 nt, Human
caaagcuauaaauucagacagaaggauaccaagcucuggguuauucugaauuuauacuuug

SEQ ID NO: 4189612 - RNA, 130 nt, Human
caaagcuuuuauuucauguaacaugggcuguuguuaaguaccagauugucugaagccauucguuuuauguuuagagugcucuggucacuaaugccaucucaaaauguuccagggagauacggagugugug

SEQ ID NO: 4189613 - RNA, 76 nt, Human
caaaggaggcacugcugggccccuguauaagcacucguaggcguucaaagugcagaggcccagcgguucuucauug

SEQ ID NO: 4189614 - RNA, 94 nt, Human
caaaggaucuuuaaaguccuuucucuugagcaagagcuguguauuuauuaacaguguuuucuuaaggagaaaaaugggcaacugugaacuuuug

SEQ ID NO: 4189615 - RNA, 66 nt, Human
caaaggauggguuugagauguuuggguugguugagugggcauuuagacaacaagccuucuccuuug

SEQ ID NO: 4189616 - RNA, 93 nt, Human
caaaggcaacuuccuccuucucaugguguugcuguuugcucuugacaucaggguauucuuaggcuggcagugugagagagggaugugccugug

SEQ ID NO: 4189617 - RNA, 72 nt, Human
caaagggaaaagccaugugggccaaaguguaguagaaagcaggcacaagcucccacgugucuucucccuaug

SEQ ID NO: 4189618 - RNA, 107 nt, Human
caaagguuauguguagaaaaauucuuauuuguguggauggaaggcaguagggcuguggaugcuguguguuuccucuauagaaaaauauaucuauacucauuccuuug

SEQ ID NO: 4189619 - RNA, 77 nt, Human
caaagucaaucaaagccagauguccuuccucacaccucaccgugucugcagagggccauguggcuuuucugaaguug

SEQ ID NO: 4189620 - RNA, 69 nt, Human
caaagucauucuacacaacaugaugauggagccauucuucauuuuuucacuggucuggaaaagacuuug

SEQ ID NO: 4189621 - RNA, 63 nt, Human
caaaguccuggagaagugaagucugucugcagcugcuucucagccuucauucuucagcuuuug

SEQ ID NO: 4189622 - RNA, 74 nt, Human
caaagucuucaguugauucugauauauccaguuuuuggacuuacuguuugccuugagagucaauaggggcuuug

SEQ ID NO: 4189623 - RNA, 126 nt, Human
caaagugagaaaguguucuuugauuugacaauguguuuaugugugggccuuacuauagcuucuuugugaauguuugugcauaaauauguuuugaauauacuguuuaaauauuuccuuaauucuuug

SEQ ID NO: 4189624 - RNA, 55 nt, Human
caaagugcagaaggaacugggugugguggcucaccccuguaaucccagcacuuug

SEQ ID NO: 4189625 - RNA, 58 nt, Human
caaagugcuaggauuacaggcgugagccacugcgucuggccgccuggccuacauuuug

SEQ ID NO: 4189626 - RNA, 56 nt, Human
caaagugcugggauuacaggcuuaagccaccacgccuggccaaucuaugcauuuug

SEQ ID NO: 4189627 - RNA, 95 nt, Human
caaagugugauucaaguuccauaucacagcagacgaagagucauucagcuccaguuuacggacugcugggguauuuuacacuugagugcauuuug

SEQ ID NO: 4189628 - RNA, 74 nt, Human
caaauaaucacugcucgauaacaugauuaugagacaaauaaucauaaggcagaaauaugagcagggauuauaug

SEQ ID NO: 4189629 - RNA, 55 nt, Human
caaauacguuuggcuggagcacccugaagucucugcuaccauccaagcugguuug

SEQ ID NO: 4189630 - RNA, 104 nt, Human
caaauacugcucuacacugaauuacaguuauauacugauuucuguuguaaauucuuagagaagacagacauagaaauuaguaacuugagucaguagcggcuuug

SEQ ID NO: 4189631 - RNA, 80 nt, Human
caaauacuguugccuacauuauaugauugugcuuuaaaagucucaucguuacaguauacauugauuaggaccaguauuug

SEQ ID NO: 4189632 - RNA, 130 nt, Human
caaauagaugccaguacaguagccccucggaucacaggagguauuuuuggugcuggaagccagccacacuuuggcaggcuuucagcaucaagucuguucccuuuagaggcgggggguggcaagcuaucag

SEQ ID NO: 4189633 - RNA, 68 nt, Human
caaaugagccaucauggaaucagaucagcccaaguuaaaccuucagcuucuuggugauggcuuaccug

SEQ ID NO: 4189634 - RNA, 55 nt, Human
caaaugauugccauguagaugagauagaagucauccaugcuuaaguaaucauuug

SEQ ID NO: 4189635 - RNA, 98 nt, Human
caaaugcuaagaucugagaaaaaaaugaaucacauucaggcuuggaauaaauccacaugaauauguauuucuuauuuacuuggaaagucuuguauuug

SEQ ID NO: 4189636 - RNA, 56 nt, Human
caaaugcuauuuuagauggguggcuagggaaggccucucuuuuuaggugguguuug

SEQ ID NO: 4189637 - RNA, 59 nt, Human
caaauggcuggcauccuucuacaaagagaagauuaacagggaggguuugccauuauuug

SEQ ID NO: 4189638 - RNA, 64 nt, Human
caaaugugaacucuguacucucugacagucgcaaggaagacugucaaaucagguaucacuauug

SEQ ID NO: 4189639 - RNA, 82 nt, Human
caaauguuaaucugaagagcuggaauccagucugguguuuguaauaccacccaugugacuaccucaugcagauaugcauuug

SEQ ID NO: 4189640 - RNA, 73 nt, Human
caaauguuaggaacuguuaauucuagauggugaguguuugaugcacuuaucuuuuaacuuuuccauauguuug

SEQ ID NO: 4189641 - RNA, 58 nt, Human
caaauguuagugcccaucccucugcagagcauaaguagcauucuggggguagcguuug

SEQ ID NO: 4189642 - RNA, 55 nt, Human
caaauguugcuguaauguuugugaagcagacguuuuuccuccacaggagcauuug

SEQ ID NO: 4189643 - RNA, 55 nt, Human
caaauguuugguggcauuuuguucacaaaaggauagagugugugcaucauauuug

SEQ ID NO: 4189644 - RNA, 96 nt, Human
caaauuacguagcugauccugaggacagggacuguuucuaacuugguuuuauaaacuuugucuuccaggcacaguucuuuauacacaguagguuug

SEQ ID NO: 4189645 - RNA, 78 nt, Human
caaauucugccaaaaauuagcaaauauauuucauuuuuaauaauagacaugacagauaguugcuagcugguagguuug

SEQ ID NO: 4189646 - RNA, 82 nt, Human
caaauugaauucaucuuuguucuguaaacuuuucaaaucuguuaugaggaugaaaagacauaacaaauguggcagcaauuug

SEQ ID NO: 4189647 - RNA, 69 nt, Human
caaauugcgaauucugagauucacugagagucauccaagcucucaguggaucucagaauuuuugcucug

SEQ ID NO: 4189648 - RNA, 78 nt, Human
caacaagauguuuugauauauguguauauuaggggaugauuaaaucaagcuaauuaacauauucaucaccucauguug

SEQ ID NO: 4189649 - RNA, 69 nt, Human
caacaaugucauauagauauuagacaggguuuguuuuuacauguuuguugauucuauaugauuuuguug

SEQ ID NO: 4189650 - RNA, 57 nt, Human
caacacauuccauagacugcugugaguuggugccaacucaacagcagggaaguguug

SEQ ID NO: 4189651 - RNA, 60 nt, Human
caacagacagcucacagcucaguucugccucaacccauguuuagcuugggcugccuguug

SEQ ID NO: 4189652 - RNA, 64 nt, Human
caacagagacucuugggcuuuagagcuagacacaucccaguucaaacucugaguaguucugcug

SEQ ID NO: 4189653 - RNA, 88 nt, Human
caacagcugacaguauuuagaggaauugggagaacguuucuagguuuggaacacuuuuaagacuuuaaugaacacuuuguuguuguug

SEQ ID NO: 4189654 - RNA, 70 nt, Human
caacagcugggcaaaggugaaaggguggugcccugccccaaauuccuuauaccuuugcuccgcuucauug

SEQ ID NO: 4189655 - RNA, 57 nt, Human
caacaggcuggcccugggggcccaggguuauugggguuccaggaacacagccugaug

SEQ ID NO: 4189656 - RNA, 65 nt, Human
caacaguggacggggcacguugggaggaggcccugaaccucuggcucucauacucgccaguguug

SEQ ID NO: 4189657 - RNA, 84 nt, Human
caacauauauaaggauuuacuaucugaaaauagagaccauauaaauguuucuugaggucuccuuggggauuuuuauacuuguug

SEQ ID NO: 4189658 - RNA, 71 nt, Human
caacaucaauccucagaaacuaguacuccauggaauacauuuugagaaaugcuagcuuaggaaucauguug

SEQ ID NO: 4189659 - RNA, 60 nt, Human
caacauugcugaaagcugggacaggccucaggcuugugaauggcacuuuucgcaguguug

SEQ ID NO: 4189660 - RNA, 63 nt, Human
caacauuuggcagugacccagggagauggcucuugacauaaaccucaggauacugcaaaguug

SEQ ID NO: 4189661 - RNA, 130 nt, Human
caaccacaguaacuuccacggagguuucagcaguggcaucuggggcuggggucgcggccguggacagcaccggagccgggaccaaggccacggagcuugcagaggcaaggccgaggauaaggaguggaug

SEQ ID NO: 4189662 - RNA, 58 nt, Human
caaccacccaaggugaggguguccugugguccauagucaagcugccugagggugguug

SEQ ID NO: 4189663 - RNA, 57 nt, Human
caaccaccuccuucuccuguaugccaaggauaaaggugcugaggagcagugugguug

SEQ ID NO: 4189664 - RNA, 68 nt, Human
caaccagagucuaugaguccucauuguuuuucuaccccaagcauagaggacuccaugaauuuucuaug

SEQ ID NO: 4189665 - RNA, 66 nt, Human
caaccggagugauucccaccucuaccacagggcauacugggcagugucuggaggcauucuugguug

SEQ ID NO: 4189666 - RNA, 85 nt, Human
caaccuagaaauuucuuuggagucgauguuauguuauaaaacuguaugugaauuuugcauuuagcuuuaaaauauuucuguguug

SEQ ID NO: 4189667 - RNA, 68 nt, Human
caaccugagauuuauugacuuaacaguauuuuaaauagauuuguuaagaaaaauaaauaggcagguug

SEQ ID NO: 4189668 - RNA, 68 nt, Human
caaccuggugcuuugcucauuugauaugcccaauaaguguuuccugagugauaaggcaucaaaaauug

SEQ ID NO: 4189669 - RNA, 78 nt, Human
caaccuuagccaauagguuucuaauugggccauuuaucuggaaauaagugugacauaagagcccuggaggguggguug

SEQ ID NO: 4189670 - RNA, 70 nt, Human
caacgcacugugcugacuuccuugugaaacggguuguuucugagugugcagggaaguggcgggaggcuug

SEQ ID NO: 4189671 - RNA, 75 nt, Human
caacuaugucuuaucuuuucaaagcucugcugcuuguguuuccaacaaaaucagugcucauuugaaaggaaguug

SEQ ID NO: 4189672 - RNA, 63 nt, Human
caacuauuuguggccucuaggaguugaggauagucuccagcugaagagccaacaaaaagcuug

SEQ ID NO: 4189673 - RNA, 80 nt, Human
caacucauuuggacagauggucuguauuaaacagaugaugacuauuuggcauguacagcuauuccauacaauuugaguug

SEQ ID NO: 4189674 - RNA, 75 nt, Human
caacuccugagcauagcacagauuucucaaaugcauuucuucuaaucuuugagaauuuuuugucaugcauuguug

SEQ ID NO: 4189675 - RNA, 60 nt, Human
caacugcugacaccaucacuccagcagacucugacagcuggagaauugaguuaguuguug

SEQ ID NO: 4189676 - RNA, 76 nt, Human
caacuguuuguccguuucuuccuggcaaagcaaucagagccccaugucgggccuccaggaggaaauggaacacuug

SEQ ID NO: 4189677 - RNA, 82 nt, Human
caacuucauauucaacguuaauauuuuuugccuucucucagcuugacagagauucaggcugcaguggcaaaagacgugguug

SEQ ID NO: 4189678 - RNA, 77 nt, Human
caacuugagcaauugcacagagccugguaccgagaaggguccucugcuugguuuuauguucugcuguugccaucuug

SEQ ID NO: 4189679 - RNA, 76 nt, Human
caacuugccaccuagagaacuacugaucuguuuaggaauagacuuuaucagcaguagucucuguggcuuuagguug

SEQ ID NO: 4189680 - RNA, 115 nt, Human
caagaagcagucaaauucauccucaacagguuaguaaggucuacauaacuucaaaggacacaagagguuagugugugauagacagccgaaggauucauggagcaggcugcacuug

SEQ ID NO: 4189681 - RNA, 87 nt, Human
caagaaguucagagauuggcaguccaggauuaauauagcagcuucucgauguuaucagucaacaacaugccagcucugccuugcuug

SEQ ID NO: 4189682 - RNA, 71 nt, Human
caagaauaacuuaaugggucaugcucuggacucgauuaaagggccaaagcucaaguucuuuaagauucuug

SEQ ID NO: 4189683 - RNA, 59 nt, Human
caagaauauauauggaguggagaauugagcuuuagaaaugccauuucauauguauugug

SEQ ID NO: 4189684 - RNA, 64 nt, Human
caagaaugccuguguagugcuggagcaguuccucuucacugagcucccucugcucaggcacuug

SEQ ID NO: 4189685 - RNA, 72 nt, Human
caagaccaaagcaagauuacagaggcauagccccauggcgagguguaugcuguagcuaaaagcugggauuug

SEQ ID NO: 4189686 - RNA, 84 nt, Human
caagagacagcagagccagauggagccguguguugaaggcuuggugccuaugcggggagcuaugggcagccugccugucucaug

SEQ ID NO: 4189687 - RNA, 82 nt, Human
caagagaccuagcagaagcugcaaugccuuuuauagccugccauuagaagucacacacugucaguucugcugugcucuuuug

SEQ ID NO: 4189688 - RNA, 62 nt, Human
caagaggaggggagaggagaggagagugguagcuugcauucuucuugucugcccucacauug

SEQ ID NO: 4189689 - RNA, 56 nt, Human
caagagggaaccuaagauguaugccaauucacauacagaauuaggagauccucuug

SEQ ID NO: 4189690 - RNA, 69 nt, Human
caagagguuucaugauuuucuuacuauuuggaaagaauaauuuaggacugcaauggugauggccuuuug

SEQ ID NO: 4189691 - RNA, 57 nt, Human
caagagucaguuguuuauggaaaguacuuuuugguucuguaaacaauaguguucuug

SEQ ID NO: 4189692 - RNA, 121 nt, Human
caagaguugcuugagacagcauggugggagaggaucaggguagugguuaugugcaaaagcucugaagucagcuuccagaguucaaagccugcugggaucccuuaccagcugugugaccuug

SEQ ID NO: 4189693 - RNA, 67 nt, Human
caagaugacaagauuuagagucugcuaaauugcaaagcuugguaggauuuucucaaucuuauucuug

SEQ ID NO: 4189694 - RNA, 91 nt, Human
caagauugaaggccaacuggucuguuagguuacugguucugugagcagaucaaagaagauggagaccugacuaucagugggggcaguuuug

SEQ ID NO: 4189695 - RNA, 62 nt, Human
caagcaaugcuauacucauuaugcucauggaaaauuaugagacaaugagcuuaagcagcuug

SEQ ID NO: 4189696 - RNA, 81 nt, Human
caagcaauuuugguugaugugagggugauaggccacauuggcuucagugaccugacaugaauuaaaaacuuauuugucuug

SEQ ID NO: 4189697 - RNA, 58 nt, Human
caagcacuacugacucuuaguaaacauacaagucaacuguuggugcagaagugccuug

SEQ ID NO: 4189698 - RNA, 62 nt, Human
caagcagguggaguaguaacucucugaaacagccagagacugguuuuuaacuucaccucuug

SEQ ID NO: 4189699 - RNA, 83 nt, Human
caagcagugagugaauccuccugggugccagguauugggcuaggaacuucagcccugggcagccaaggaagcaugcuggauug

SEQ ID NO: 4189700 - RNA, 57 nt, Human
augcccucuguagccguucucagccuacaaccgcaaggcugaggccagagugggcau

SEQ ID NO: 4189701 - RNA, 69 nt, Human
augccuacuuguaaaucacaagauuugggucuuucaaauuaagccaacuucugauuagcaaguuuguau

SEQ ID NO: 4189702 - RNA, 106 nt, Human
augccucaaacaccuucacagucaucaucugcccucacuggggaugcaagacaccuggggaccucaguaaaggggaggugaugggaaugggaggagucuggaguau

SEQ ID NO: 4189703 - RNA, 68 nt, Human
augccuccauguuucagcaucuacgucaggggcuugguccuggagucgauuaaaaacaauggaggugu

SEQ ID NO: 4189704 - RNA, 55 nt, Human
augccuggacugacaugcacugcucacaagcugaagcacugucuucuucagggau

SEQ ID NO: 4189705 - RNA, 58 nt, Human
augccuggacuguaucccagaucauuaaaucagaaucucugggaguguauccaggcau

SEQ ID NO: 4189706 - RNA, 91 nt, Human
augccuugguuucuuuaccuguaaaacugcgauauaauaauaauaccuguaaacagcagacuuacaggugcauaggaaaucccauaugcau

SEQ ID NO: 4189707 - RNA, 69 nt, Human
augccuuuuguccuuccucccuccuccugccuggaacauggaugugagaccaggaaguacagcagccau

SEQ ID NO: 4189708 - RNA, 84 nt, Human
augcggaggguguuuucuaggaggaacuuuggaaggagcuauuuucagagucagcuccucucuauaaagccagaccaaucguau

SEQ ID NO: 4189709 - RNA, 66 nt, Human
augggagcuuaaauggcuaaauauaauuuguuuuucagcuuuguguuuuuagguuuggguuccuau

SEQ ID NO: 4189710 - RNA, 76 nt, Human
augggccacacugugagaaguuccugagucagcuuccauuguuagugcucagaaacuugcucauuuucuccuccau

SEQ ID NO: 4189711 - RNA, 78 nt, Human
augggcucugcacauuuuaccaauacucuggggcccaguuuggucauuuguaaaaugugaauaauucuuaguacccau

SEQ ID NO: 4189712 - RNA, 88 nt, Human
augggcuggugaccagcuuggugugauauaauagaacacuccagagacccgaguucuagucacaaccuucaaguugucacugccacau

SEQ ID NO: 4189713 - RNA, 76 nt, Human
auggggaugaagauauuuuugugcaaaguuuaucauuugucauaaaguucaagcucugccuaaaaucagcucccau

SEQ ID NO: 4189714 - RNA, 73 nt, Human
augggggaaauauucugaaauaggaaagcaaauggugauuuaucauguuccagauaucagauuuuuaccccgu

SEQ ID NO: 4189715 - RNA, 56 nt, Human
augggggcuauaaauagucagcacaccuugcuuuugugcugcugcuucacccccau

SEQ ID NO: 4189716 - RNA, 90 nt, Human
augggguacuguucaaugcauauagauauagaaauccagucguacaagaugaaaaguucuagauaucuaguguauaacauuguggcuuau

SEQ ID NO: 4189717 - RNA, 58 nt, Human
augggguuaugcagagaagucugugacuucacaguauacgacuaacgcaugaccuugu

SEQ ID NO: 4189718 - RNA, 57 nt, Human
augggucuccaguaucuuuccaaugaauuuguuuugccuaauuuagcuggaguccau

SEQ ID NO: 4189719 - RNA, 71 nt, Human
augggucuucuuuaaccuacuaaagccuaucaaaauauaguggguucaguauuaaugagaugauuucccau

SEQ ID NO: 4189720 - RNA, 59 nt, Human
augggugaugaggucaguaauugaucauuuuuaaaauaaugaauugucucuucacuuau

SEQ ID NO: 4189721 - RNA, 110 nt, Human
augggugucaccaauggguuaucaauuucagaugucauaaauauaaaggguuucacauaccucuaguauauuuaguguaucaugaaaauuagaugccucugguaccccau

SEQ ID NO: 4189722 - RNA, 60 nt, Human
auggguucaagugauucuccugcuucagucucccaaguagcuggaauuacaggagcccau

SEQ ID NO: 4189723 - RNA, 71 nt, Human
auggguuuauagguggacuuuuucuuuacaguuacuuuuaucaguaaagcaaaucacacauauaaaucugu

SEQ ID NO: 4189724 - RNA, 100 nt, Human
augguaaggcaagauugugcccugaaggauguguggugggaguggguaagcugggcucccaccuuaaccuucacaugagcauuuuccuuuccuucaccau

SEQ ID NO: 4189725 - RNA, 114 nt, Human
augguacaacccgcaaaccuugguagcauuuggacauugucaccuuuugauucuaggacacaggaggaaaaauguuccaaaauguuucucugggucuuagaggguguuaaucau

SEQ ID NO: 4189726 - RNA, 73 nt, Human
augguacuuuucuuuaucucugguguuaaaacucacaaaacuaugcuaccagaacagaaguaaaauuuaccau

SEQ ID NO: 4189727 - RNA, 91 nt, Human
augguaguacaggaacuguuaucucagauguugaagaagaugcuggggaaaugagcagagacaguaucugggaacuuuccugugaaacugu

SEQ ID NO: 4189728 - RNA, 74 nt, Human
augguauacuguuuuaaaagguacuugucuaaaacuuuaaguuggagaagcaucuuggaagucauuagauccau

SEQ ID NO: 4189729 - RNA, 63 nt, Human
augguauaucauacugcaguugcauuuuaacacccuuugcauugucaaaagugguaugaccau

SEQ ID NO: 4189730 - RNA, 86 nt, Human
augguauuacacugccugagccgcggggcagugcucugacuguagcuuccugcuucugacauguucuugguugguaguguugcugu

SEQ ID NO: 4189731 - RNA, 61 nt, Human
auggucaagauccucuaguuuagaacuuuuugcuaaacugcuaagcgggucuuacaaccau

SEQ ID NO: 4189732 - RNA, 74 nt, Human
auggucagcuucccaggcugggggccugaaguuccugggaggagguuuggaaggcacgguguggggcugggggu

SEQ ID NO: 4189733 - RNA, 130 nt, Human
auggucauacaugucggugcauccccauguuagggcacaugaucacgugugucggugugugcccaugguagggcauaugaucacgugugucggugugugcccguuauggcauaugaucaugugugucagu

SEQ ID NO: 4189734 - RNA, 72 nt, Human
augguccuugugucuuguaucuguauuuaaaauugcugggaggauacacaagaucaguauaauaaggaccau

SEQ ID NO: 4189735 - RNA, 86 nt, Human
auggucgccccacuggccucagaggcugucaggcagcagggauugugucccgagagccugcagccucaagggcugagcugcgccau

SEQ ID NO: 4189736 - RNA, 75 nt, Human
auggucucugagccuuccuguggccaccagcacauucugugcagccccaggaccacaugggaggcucauggccau

SEQ ID NO: 4189737 - RNA, 82 nt, Human
auggucuugaucuccucaccuugugauccucuugccuugggcucccaaagugcugggauuacaggccugagucaagacacau

SEQ ID NO: 4189738 - RNA, 56 nt, Human
auggugaugugacucuacguuaugauuaauggggcuguuggaaucauugucaccau

SEQ ID NO: 4189739 - RNA, 57 nt, Human
auggugccugucucacucccugugcacuccaaguauuucuugaggccauggcaccau

SEQ ID NO: 4189740 - RNA, 89 nt, Human
augguggcucauugacuagaaccaguccacagaauuugggauguuuuauuuugggcuuguguuccucaguuugucaaagacuccaccau

SEQ ID NO: 4189741 - RNA, 77 nt, Human
auggugggaaaguagccuuaagugugccuugacacaagcuaucuuggucauuuggggcugcuauaacaaaacaccau

SEQ ID NO: 4189742 - RNA, 75 nt, Human
auggugguuugggagaaaaagcagaucccauugacagccaguauuaugcuguguuuucuccccagagaccaucau

SEQ ID NO: 4189743 - RNA, 97 nt, Human
auggugugaauuuugacccuuggcuggaacuccugagaaagggaagcuccucuuuugcugggguggcuagcuuagcacugccgaaauucaucacugu

SEQ ID NO: 4189744 - RNA, 71 nt, Human
augguuaauaagaauacaguucaguaauggauagguuguacccaauccauccacugauguuucugaaucau

SEQ ID NO: 4189745 - RNA, 75 nt, Human
augguucggccaugcaugccugugguugacagacaucccaacauacaucacaaaaauguccagugacuggaccau

SEQ ID NO: 4189746 - RNA, 62 nt, Human
augguucugcuggguaaugcauucugaguuccaacucauuaugcaaaauaaggcagaaacau

SEQ ID NO: 4189747 - RNA, 125 nt, Human
augguucuuugugaucucccugauauagaaauacagguaugcaaggacaugugcacucauaaagagucuaucuuccuucuuugcauuccugugugcuuuagccagaagagauguuuuaggauggu

SEQ ID NO: 4189748 - RNA, 86 nt, Human
augguugcaccuguggucccagcuacucaggaggcugaggugggaggauugcuugagcccaggaguuggagaccgcagugagcuau

SEQ ID NO: 4189749 - RNA, 114 nt, Human
augguuguaaggcuuguaggggcuaaggcuaucugaguuuaugugauugcucacagagagcauauagauugagauggcaucuagaguggaaacuuuacaaguaugcagagccgu

SEQ ID NO: 4189750 - RNA, 77 nt, Human
augguuguacuuugaggcucuguaugaagguuugggucagaacugccuacuccaugcggaagucugagugccuucgu

SEQ ID NO: 4189751 - RNA, 93 nt, Human
augguuuuaaacaacaguauucaguuugggcagcaguuuuaagucuaacuagcuuaaaccaaucugaauaagucuggacaguuuuccuaccau

SEQ ID NO: 4189752 - RNA, 93 nt, Human
augguuuuugcucaagguguuccauguuuuuggcuguggaaucgacuagaacuucagcagucguccaggaaaagccugcagggcaaggacugu

SEQ ID NO: 4189753 - RNA, 110 nt, Human
auguaaaucugaacuugucagaccuuucaggauccccaccgcguuuaggauauaaucgcaaauccucccaauagccuaagagccuggcaaggucgaccucagcuuuaugu

SEQ ID NO: 4189754 - RNA, 127 nt, Human
auguaaccuucacacugcugguuuguugauuggccuauuuuggaagacuucuuagccaagguccaguugccagaauggccaagucuucauaucugaauuagcauuuguauucucccauaggucacau

SEQ ID NO: 4189755 - RNA, 89 nt, Human
auguaaguaagaccuuccuaaugucuaauacaaacugggcuccagcaaguggcccuauuuuuauuaggguuuugaagguuugugugugu

SEQ ID NO: 4189756 - RNA, 80 nt, Human
caagcaugcucugggucaacauaggccucagugaggcucucuggccucggcuucuguauugauaaaaggggauucgauug

SEQ ID NO: 4189757 - RNA, 86 nt, Human
caagccaaccuuuugucagcuucccuuugguuuauuaauacuacuuuuauuguugaacuaaaacagaggcuuuuuauggguguuug

SEQ ID NO: 4189758 - RNA, 57 nt, Human
caagccaggugaacauaacaaguagagaacauucuuguuguucaagaagcugguuug

SEQ ID NO: 4189759 - RNA, 66 nt, Human
caagccaucucuggccucacugcccuccccuuuagaaaugugggaaugaggcucagagagguugag

SEQ ID NO: 4189760 - RNA, 62 nt, Human
caagccauuagucauuuuagaauauaaauggaauuucauguuccuaugacugauuggucuug

SEQ ID NO: 4189761 - RNA, 86 nt, Human
caagcccuagacaaaaugauaaugucagcauaguuuauuuuugacucuuguuaauaaauagauuucugacgugcaugucuuucuug

SEQ ID NO: 4189762 - RNA, 83 nt, Human
caagcgugauuauaugugggauagaauuuauuaauuuguauuuaaaacguauuuuugccucucagauaaaauaaguaugcuug

SEQ ID NO: 4189763 - RNA, 73 nt, Human
caagcucaggggugcuuccucagggaaguguuuucuguuuccaaaggcacugaggagcccccucucagcauug

SEQ ID NO: 4189764 - RNA, 129 nt, Human
caagcucuagaaaguaacgggcaaagaguuuaggaaucugggcccaacugugccgagauaaucaaagccacagaggccuaagauucaaacaagacauuuugcagggauacuuuguauuaguuuuuaggg

SEQ ID NO: 4189765 - RNA, 109 nt, Human
caagcuggcuccugagugggcaacuugcuggggcucugaccacuccacuggcaagcagcugaauguggcuucuugguuagaccucugcugaccauuuaggaccaggaug

SEQ ID NO: 4189766 - RNA, 63 nt, Human
caagcugggugcgggcaguauagggacaaagacucugcccuugggaugccaaccauccacuug

SEQ ID NO: 4189767 - RNA, 59 nt, Human
caagcuuagugguaggacugauuuaguuuaaaggagauuucucaauccuaguacuauug

SEQ ID NO: 4189768 - RNA, 78 nt, Human
caagcuucuuguguacguuccacuccccuggguucacguucucagggagaaaauuggaugcacaaagaauggaguuug

SEQ ID NO: 4189769 - RNA, 81 nt, Human
caagcuuuuggugugggggacaucuuagcugaaguggucaaggaaggcacuuccaggaggugucacugaagcugagauuug

SEQ ID NO: 4189770 - RNA, 77 nt, Human
caaggaaaggaauauauucugcagaccuauggacauuaaaaguuacucugcuuuaauggaaaguguuuuuuucucug

SEQ ID NO: 4189771 - RNA, 56 nt, Human
caaggagccugugggccaagaggcugaacacuuagggaaauggcuuggguuucaug

SEQ ID NO: 4189772 - RNA, 69 nt, Human
caaggaggccugcgagaaggggccugggcacaggaaggcugcuccucugccagcugcagggcuuccuug

SEQ ID NO: 4189773 - RNA, 120 nt, Human
caaggauacaugugcagauuuguaacauagguauacugcaugacauugggguuugggcaauuaauaaucccauugcccagguaguguacauuauacaugauaaguacuuuuuaacccuug

SEQ ID NO: 4189774 - RNA, 71 nt, Human
caaggauguggaaaaagaggaacucuuauauacuguuggcagggauguaaauucuucuucuuaacuucuug

SEQ ID NO: 4189775 - RNA, 65 nt, Human
caaggauucucacuagacuagaaagcaguucucugcaacuggugggguugggugaagagucugug

SEQ ID NO: 4189776 - RNA, 85 nt, Human
caaggcagcagggcucagguggcugguugcuggcuacggcugugccuucagucuggcccaagccaucuggguauccugugcuuug

SEQ ID NO: 4189777 - RNA, 80 nt, Human
caaggcagcauauuugguuuauggguaguuuguguccuuagacagaacuuucugauccugagccuaaauuugccuucuug

SEQ ID NO: 4189778 - RNA, 59 nt, Human
caaggcauuguguaagcacuugauauccaugaucauguuuaauccuuaccauugccuug

SEQ ID NO: 4189779 - RNA, 58 nt, Human
caaggccagggaauuuuucuggaaucucagauucaaaagagaucaccugggaucuuug

SEQ ID NO: 4189780 - RNA, 83 nt, Human
auuagugugauaugauuugucuugcagcugcuucaaauuaagaacagguguagaaaacagauuaugcaaauacucauauuaau

SEQ ID NO: 4189781 - RNA, 69 nt, Human
auuauaaauucagcauccaguguccuaaaggaaaucuguuucuucugacacugaugcuguaaggauagu

SEQ ID NO: 4189782 - RNA, 80 nt, Human
auuauacacauaccucguguuuguauugcagcuucccccagggagcucaaagcacuuugcaaauaugaauugcgaauaau

SEQ ID NO: 4189783 - RNA, 70 nt, Human
auuauaucuguucauggaaaaauaguugggaaggugauuccagaguagaaugccugaacauugguauaau

SEQ ID NO: 4189784 - RNA, 70 nt, Human
auuaucaguaucaggcuggaauuaagucauaaaagauuauugacugauucauuagggcugaugcuguaau

SEQ ID NO: 4189785 - RNA, 56 nt, Human
auuauccauuaggucuauggucaacuauugguguggccaguucauuagugggaggu

SEQ ID NO: 4189786 - RNA, 89 nt, Human
auuaugauuugcuagggaagaccaauaaucacacaaauaaaagucgaauuugcaaaugugguuagggcuuugaaggggaggaccauagu

SEQ ID NO: 4189787 - RNA, 77 nt, Human
auuaugcucauagaugaagcuugcuuccaaauaaagaacauccuagagaaaugggacaggcugcaucugagcaugau

SEQ ID NO: 4189788 - RNA, 73 nt, Human
auuauggcucaguaaaagauggaaauagaauaagaaauaccguuuucucauucucucuucugcugcccgugau

SEQ ID NO: 4189789 - RNA, 69 nt, Human
auuauguguuuuuucgauauccacauuuguguauguguacaaaugucuaugaaaugaaagggacauagu

SEQ ID NO: 4189790 - RNA, 55 nt, Human
auuauuaggacuacugggguuggugguagguucugcuuuaccagguucugaugau

SEQ ID NO: 4189791 - RNA, 87 nt, Human
auuauuaguuugaacuauaaaaaguugugacguuguagaucaaaugcagucuaauauugacaauuucuuauaguucaauucaguagu

SEQ ID NO: 4189792 - RNA, 79 nt, Human
auuauucaacacuugagaaauugagaacaaggauucaaaucccaaagacuuaaaguuucuuguaaaaguguugagugau

SEQ ID NO: 4189793 - RNA, 75 nt, Human
auuauugugauacaguauggaaaauguauaguuccuuagagaauaauugcauuuugugcugcuuauggcuauggu

SEQ ID NO: 4189794 - RNA, 76 nt, Human
auuauuucucacauuugguucgguauaaaaagggauauuuacucaaauauauagaaaagcagauguuggagguaau

SEQ ID NO: 4189795 - RNA, 58 nt, Human
auuauuugaagggccgugaaagggaagaguuaguuccuaaucaugucucacaggugau

SEQ ID NO: 4189796 - RNA, 61 nt, Human
auucaaagaacaaauuagcuguuuuauacaaauguuuaauguggcugaguuguucuagaau

SEQ ID NO: 4189797 - RNA, 62 nt, Human
auucaaagauuuucccaaagcucaccuaaaucuuuaggaagggcucugacugaauauugaau

SEQ ID NO: 4189798 - RNA, 73 nt, Human
auucaacaaauguucccugagcacuuucuuugugcugaacacuguucuaagugcuagggauacaguggugaau

SEQ ID NO: 4189799 - RNA, 62 nt, Human
auucaagagaugcgaauuaaaauuuugcuuugauuucaagauauugauucaauuucuugagu

SEQ ID NO: 4189800 - RNA, 69 nt, Human
auucaagcugaauggugacagaucugugcaguauuaaguacaauuuucuguccuuucacucacaugaau

SEQ ID NO: 4189801 - RNA, 65 nt, Human
auucaaguacaguuuucuucuuugcugggagucauuguacacaugcuugaaaacucugcuuggau

SEQ ID NO: 4189802 - RNA, 58 nt, Human
auucaaguuuuuaaaggcaguuaccuugagagguguuguuuuauacaagaacuugggu

SEQ ID NO: 4189803 - RNA, 129 nt, Human
auucacuacuucuuaaaauauuguucuuaaauguguacuugaggggguuagcaguagauaaggaugugacuccgacucugagucuacauuaucaauuuugggaaaaaugauuuuuaagaaaaagaaggu

SEQ ID NO: 4189804 - RNA, 79 nt, Human
auucacugaacauugcauucucuaugagauggcauuugcaaaucucauaaauucagagaacacaauuaugucagugaau

SEQ ID NO: 4189805 - RNA, 110 nt, Human
auucagaaauacacauuuuguuccggaaaucaguuguuauauuaaagagccauuuuaaaugguuuuugauggugcauuugaauuucuggggccugauuuuuuucaugagu

SEQ ID NO: 4189806 - RNA, 59 nt, Human
auucagacucuugagcagucccguucuacauugaaugugacugauccugugauuugaau

SEQ ID NO: 4189807 - RNA, 59 nt, Human
auucagaugaaauucuuuggagacaacuuuguuuucaaaguaaggauuuucaucagaau

SEQ ID NO: 4189808 - RNA, 78 nt, Human
auucagauuauuuuauaguagugccuuuauugauagcagauaauucuuauuaauaagugacuacuagcugguuugagu

SEQ ID NO: 4189809 - RNA, 65 nt, Human
auucagcacugaaauucuucacauauuaauugaucaaacgaugcauguaguaucagugcuugagu

SEQ ID NO: 4189810 - RNA, 63 nt, Human
auucaggagugugccaggaaggguggggcaauucccacaggacuccuggggcacacucugagu

SEQ ID NO: 4189811 - RNA, 74 nt, Human
auucagguauugccuaaggagauaaaguggaaaacaguuaauuaccuccuuugacuucugggcagcacaugaau

SEQ ID NO: 4189812 - RNA, 63 nt, Human
auucaguggggucauggguaguuugcagugugaauggcagauggacuguaugaccugaagaau

SEQ ID NO: 4189813 - RNA, 76 nt, Human
auucaucccacagauuuccuaagcaucaaucuugggccaagcacugauugaugcuggggaacucuguggaaugaau

SEQ ID NO: 4189814 - RNA, 81 nt, Human
auucaucccuucuacaaauauuuacuguuccccuccccugcacugggcucaggaguagguacugaauauuugaugaugaau

SEQ ID NO: 4189815 - RNA, 72 nt, Human
auucaucucuguguccccagagcuuguucugugucaaacauuguccuggguucugaggacaacagagggaau

SEQ ID NO: 4189816 - RNA, 64 nt, Human
auucaugcaggauugucuccaauucuggauugaccauccacuggaagcaaucacuguagugaau

SEQ ID NO: 4189817 - RNA, 75 nt, Human
auucauucuuuaguuauuaguuuagaagaugcuucaucuuggaagccuucucugaucuugcuagacugagugaau

SEQ ID NO: 4189818 - RNA, 60 nt, Human
auucauugucugcauauaugaggaaguaaauggcuuuccuuauaucuucagagaagcagu

SEQ ID NO: 4189819 - RNA, 76 nt, Human
auucauuuaaucauucacaggauagcuauugcacgucauuugugucaggccuuaucgguggcuggagauaaugaau

SEQ ID NO: 4189820 - RNA, 74 nt, Human
auucauuucucauaauauuagcacuuguguuuuaagagcacauagcaaggagcuauuguuagagaagccaggau

SEQ ID NO: 4189821 - RNA, 58 nt, Human
auuccaaacgccucgcggacuuuucccuuuuacagcaagggccgcgaggcgugagaau

SEQ ID NO: 4189822 - RNA, 64 nt, Human
auuccaaaggcuggccuggaggaacuucugcacagaauuuauaauuagcccagcuuuguggaau

SEQ ID NO: 4189823 - RNA, 104 nt, Human
auuccaaagugaaaaauugggaaacuuuucuaguuguaguucucuuugaaacaaaagaguaaaugucuaauuaggaugguggucaggagguuaagcuuuggagu

SEQ ID NO: 4189824 - RNA, 83 nt, Human
auuccaagcaugcuucuggguucagggaaauuuccauguguuuccagccuggagacacuuucccuucccagaugcucuggagu

SEQ ID NO: 4189825 - RNA, 57 nt, Human
auuccacuuuaugucuguaugaauuugaugcuucuagguaccagauauaaguggaau

SEQ ID NO: 4189826 - RNA, 68 nt, Human
auuccagucagcucauugggauacaugguggcauguaccacagugugacuucugagcugccaugggau

SEQ ID NO: 4189827 - RNA, 56 nt, Human
auuccaguucacaucgaucucccagugcuggcgggcuccaacggugagcauggaau

SEQ ID NO: 4189828 - RNA, 78 nt, Human
auucccacuauauugccagagggccagaaauucacuucgugcacuggcauauuuaucuuugguaaauaaaguggggau

SEQ ID NO: 4189829 - RNA, 57 nt, Human
auucccagauuuauauugauagggacuagauuucuggaaaaccauaucacugggaau

SEQ ID NO: 4189830 - RNA, 130 nt, Human
auuccccagccuaacaugguguuuggcucacuguagaugcucaagaauugguuguuggauuggguaccccauucagcaacauuuguugagugccuagaaugcgcuuugcacugugcuggagucuggugau

SEQ ID NO: 4189831 - RNA, 69 nt, Human
auuccccucacuuaauauuaaauaguguuugacauaaaugucuugguuuguacauugaggaggcagaau

SEQ ID NO: 4189832 - RNA, 130 nt, Human
auuccccuguaucagugagaauggauuuuaaaaguucaagacuuguguggauauuaucucacugucuuccuucgggcagaugaaguauuacagacauuucuuugaaucuugucuauuggaauuagggagu

SEQ ID NO: 4189833 - RNA, 67 nt, Human
auucccuauggggauuuuuagcauucaucuucuuuugcucggauuuagugcugaaaucccugggaau

SEQ ID NO: 4189834 - RNA, 58 nt, Human
auuccuagggaacccugugcugugcuaaugaaaugagcaauagggcacccuaaggagu

SEQ ID NO: 4189835 - RNA, 80 nt, Human
auuccucccccucauucuuuccugggccccugguucagagcagucucaguuagaaggccagaaaagaagaggauaggaau

SEQ ID NO: 4189836 - RNA, 59 nt, Human
auuccugggucuccuuccuaaaauucuaauucauugagucagaagugcagcccaggaau

SEQ ID NO: 4189837 - RNA, 77 nt, Human
auuccuguuuucuugaacuuuggguauaauuguuagaaauucucuaaaguuguuguucacagguuauagauagggau

SEQ ID NO: 4189838 - RNA, 87 nt, Human
auuccuuuccugaauuugauccaaacuaugacuaguguucucaacagagggcaaguagggauguuugggaacgagugauggaggaau

SEQ ID NO: 4189839 - RNA, 68 nt, Human
auucuaagagcuguucagguacccaucugggugagcagaugauuuaaaacugaauuagcuuuuugaau

SEQ ID NO: 4189840 - RNA, 67 nt, Human
auucuaaugacauuuagaaguuagauucaaccggauugguggagugauaaacuaaguggauuagagu

SEQ ID NO: 4189841 - RNA, 72 nt, Human
auucuacuucugacacuguuuguaaacugguccagcuaacaucuagagauaagcaggagucaggggaggagu

SEQ ID NO: 4189842 - RNA, 99 nt, Human
augcauuaggaaaaagcaauaguaaugguaauagcuaaaguuaauugaacacuuaccguuuguuagcuaugcugugucuuacaagcacuuuauaugcau

SEQ ID NO: 4189843 - RNA, 57 nt, Human
augcauuuuaccugugauaaaucaccuugacuaggucacagaagaaguagauugcau

SEQ ID NO: 4189844 - RNA, 55 nt, Human
augccaaagggagcacuuugggcucagaagcagcucauuugcauucucuuugcau

SEQ ID NO: 4189845 - RNA, 66 nt, Human
augccacaggugccaucucuucauggaauauuggcaagggucuagaagagcaggcauuuggaaaau

SEQ ID NO: 4189846 - RNA, 78 nt, Human
augccagaaacuaacaaggcaaaaauuguuuugucaccaaucagugauguuucaauuucagcuuaaguuguuugguau

SEQ ID NO: 4189847 - RNA, 76 nt, Human
augccagacacacaagcaaucuaaguuccuggguaaauauuaaccaagugcuuaggucuuguugcaaucuaggugu

SEQ ID NO: 4189848 - RNA, 56 nt, Human
augccagcuauagacuuguuauuaguuauaaaaacauggacuguagagcugugcau

SEQ ID NO: 4189849 - RNA, 57 nt, Human
augccaguguuccacucagagauucacauuuaacuaaucuagagggggccugggcau

SEQ ID NO: 4189850 - RNA, 73 nt, Human
augccauuggaauagggacucaaugcucucaggacucuuucucucccuccauuuucucugcuucucuuggcau

SEQ ID NO: 4189851 - RNA, 68 nt, Human
augccauuggccucacucaucaucaugucaaggaccuggcaugcccauugagaagggccucugugcau

SEQ ID NO: 4189852 - RNA, 93 nt, Human
augcccccauucuaucuguaaacagacauauuuuuaauaugcuucucccuugugagucuugcaucauuugaaaaugucugugcagaguggcau

SEQ ID NO: 4189853 - RNA, 55 nt, Human
augccccuucuuacuuucuugaugcuuuuuugcauggcagagagaaaagggccau

SEQ ID NO: 4189854 - RNA, 72 nt, Human
augcccugggcguuuacacacaugguacaacaaacuaaccuuagagguacuugugugucaugugcagagcau

SEQ ID NO: 4189855 - RNA, 122 nt, Human
augccgcccaaggcucgcugagaaaucuggcuccacacagugggagaacccagggucaggcuuacugugagugaggccggcccagucuuucccgagccuuccucagggagaccuggggguau

SEQ ID NO: 4189856 - RNA, 64 nt, Human
cacagcauugccuuccaaaaggaggagcugaggccuauccgccuuuugcggcaggugugccgug

SEQ ID NO: 4189857 - RNA, 101 nt, Human
cacagccccacagggcacccgcgaggccagccccuccauccuguucaggaaaccuuggaaagaagguggccuggcacgggggugccagguggcuggcugug

SEQ ID NO: 4189858 - RNA, 55 nt, Human
cacagcccccuugacacucuggggcuuuccagagcagauggccagggggccugug

SEQ ID NO: 4189859 - RNA, 57 nt, Human
cacagccccucccucaggcaggugaaacaucugguucaucuagcauguggggcugug

SEQ ID NO: 4189860 - RNA, 80 nt, Human
cacagccuugugggaaaugugcacugugcuacgaguugcugagaugucauuacagugugugcuuucccuuacggccugug

SEQ ID NO: 4189861 - RNA, 72 nt, Human
cacagcgaaugugcccccucaggagccagcuaagaccuucugggggcuucuccuggaaguacagagucugug

SEQ ID NO: 4189862 - RNA, 76 nt, Human
cacagcgccuccacagagggcccuuauagggagauccaucuguaucuucuucagugccccucuaguagaggcugug

SEQ ID NO: 4189863 - RNA, 65 nt, Human
cacagcuauggggcuguagccucucugagcagagccaagugaggcuccagucuccucuggcagug

SEQ ID NO: 4189864 - RNA, 87 nt, Human
cacagcuauuuuuaagugucgucuuugcgagccauuugugugugcccacaggcauucuauacaaugggugcaaagaugugagcugug

SEQ ID NO: 4189865 - RNA, 63 nt, Human
cacagcugcacuugaagcagguugaauaaaaaccggacucagccccuuuaaguccggcugaug

SEQ ID NO: 4189866 - RNA, 66 nt, Human
cacagcugcagcacuccaguagccgccuccaucuccacauggcuccucccugugugugcgucugug

SEQ ID NO: 4189867 - RNA, 55 nt, Human
cacagcugccaugcagucagugcugaggaaaacagccuagacucagcagacugug

SEQ ID NO: 4189868 - RNA, 61 nt, Human
cacagcuggggaagcugaggccguguggcucacaguccuggccuugguggcuuugcugaug

SEQ ID NO: 4189869 - RNA, 58 nt, Human
cacagcuuagaaaagaagccauuccugcaguucaugcccauggcucugauuuaaugug

SEQ ID NO: 4189870 - RNA, 55 nt, Human
cacagcuugggcucugacaauaugaauucaguugugcugccagggccgaacuaug

SEQ ID NO: 4189871 - RNA, 61 nt, Human
cacaggaagagguauacaauucugcuagugcuguaaagagggaaaugugaccucuucugug

SEQ ID NO: 4189872 - RNA, 65 nt, Human
cacaggaccaauucacauuccagauuugcugcaaccugggauauggggauuucauugguucugug

SEQ ID NO: 4189873 - RNA, 67 nt, Human
cacaggagagccuuugaagggaagugaaaugauuggauuugaauuccuaaauaacggcugcccugug

SEQ ID NO: 4189874 - RNA, 64 nt, Human
cacaggcauuagaggccaaaauacccggcgacuucaccuugcagggccuuggcuucuuccuaug

SEQ ID NO: 4189875 - RNA, 65 nt, Human
cacagggaaaagagaaguuggaaaaagcaacaugauuuuuaauuuuucuaacuacucucccuuug

SEQ ID NO: 4189876 - RNA, 78 nt, Human
cacagggucugaugcauuuuaggaauugccuuacuuuggguuuccccagaagcagauucuaaagcaaggacucaagug

SEQ ID NO: 4189877 - RNA, 69 nt, Human
cacagggugcucucugacuuguguuuauaaauuucguaaaaauacauuagacggagaguuacaaugaug

SEQ ID NO: 4189878 - RNA, 59 nt, Human
cacagguauauguguauauacuguaaacauacagguuacguacuauacauauaucugug

SEQ ID NO: 4189879 - RNA, 97 nt, Human
cacaggugcuaaccuuucacuguuuggaugccauggucaaggaggcaaucaauucuuugaauauacuucaaacaaagaaauaagguuuaauucugug

SEQ ID NO: 4189880 - RNA, 104 nt, Human
cacagguuacucaauagcccagaggaggaaaugguuguucaggugggccggggaaggcuucccggaggaagcuguuucugugcuggguuccugaaggacaagug

SEQ ID NO: 4189881 - RNA, 80 nt, Human
cacagucuucaauuaucccugcaacugagcauaugauuaugaaauauggcccagaggugaaggaggugggagguacugug

SEQ ID NO: 4189882 - RNA, 101 nt, Human
cacagugagcaggcagucaccuacaagccaggaagagaggccucaccagaaaccaacucugguggcaccuugaucuuggacuucuagcuucuagaacugug

SEQ ID NO: 4189883 - RNA, 69 nt, Human
cacagugccugcagauuuggugucuggugagggcccacuuccuucauagauggacaucugcucacugug

SEQ ID NO: 4189884 - RNA, 89 nt, Human
cacagugucccucguucccugcccugcuugaugacagcgagcuggaagagucgcugaagcagugugcaggccaagcgaacgccacugug

SEQ ID NO: 4189885 - RNA, 91 nt, Human
cacaguucugauggcuggaaguccaagaucaagguuugguuuccccugaggccucucuccuuggcuugcacacggccaccuuauugcugug

SEQ ID NO: 4189886 - RNA, 55 nt, Human
cacaguugcugccaacuuggccuaaacacagagcccaguggugcuggcaucugug

SEQ ID NO: 4189887 - RNA, 103 nt, Human
cacaguuugcagcucagacguuguagguaugccaauuaggucaaguagcuuauaucuuuauuuuuguugguguguuauucuauaaauuacugagacaagugug

SEQ ID NO: 4189888 - RNA, 57 nt, Human
cacaguuugguuuugcuguaaucucagaauuaaagagcacaggcagaauugggugug

SEQ ID NO: 4189889 - RNA, 58 nt, Human
cacaguuuugcccagggcuucucuugauaucuaagaagagcaguguggggagacugug

SEQ ID NO: 4189890 - RNA, 87 nt, Human
cacauaacucuucaggaauaugucagucaagauccucuggaaguuuaagugcaggggcuggugacuguuccuggaggaaggagugug

SEQ ID NO: 4189891 - RNA, 101 nt, Human
cacauaauggcaugauaacaagcacaaaguucuaacaucuacguggaaugucaauuuuaaauaagagugaggacauggguguguuugugcauguguaugug

SEQ ID NO: 4189892 - RNA, 55 nt, Human
cacauacaaggcacacuggagggaauaaaaaagccuuucaugguggucagaugug

SEQ ID NO: 4189893 - RNA, 82 nt, Human
cacauagcaggauuugaagaagaucucauguagcauaaggagguagguuuauguaagaucuuugcaaauaccuugaaaugug

SEQ ID NO: 4189894 - RNA, 76 nt, Human
cacauagccacuuggaucuggguuuagagagagaaagugacucuggagucuaaagaaccaaaaaugugugugugug

SEQ ID NO: 4189895 - RNA, 59 nt, Human
cacauauaugggccccugaggguguaugggcucugggggucugcagcccagaaugugug

SEQ ID NO: 4189896 - RNA, 72 nt, Human
cacauauucacaggcacgaaauauugcauauacuuuuuuguguguuugguguauugugugugugaaugucug

SEQ ID NO: 4189897 - RNA, 71 nt, Human
cacaucuauuucuccugguaagcuuucucuagaaucaccuucucugaguuuauucaggaaauagccaugug

SEQ ID NO: 4189898 - RNA, 101 nt, Human
cacaucucuagcacuggcccuggucacuggucucauccagcaucucaugaugggugggcuuggucagguccaguagccacgggcuagugugcagaggggug

SEQ ID NO: 4189899 - RNA, 101 nt, Human
cacaucugucguugauggucuaaauauuugcauguuugcagguccagcgauggcacaaugccuagcagcagaagguuugcacccacugugcgacaugagug

SEQ ID NO: 4189900 - RNA, 65 nt, Human
cacaucuuuuuaucuguuuggaacauugggggcuucuuuggugauggugggggaggagagaugug

SEQ ID NO: 4189901 - RNA, 91 nt, Human
cacaugccagaggggcugacacccuuggccacacugaagaaugaucagcagcgccaacagcugggugcaugucccucugcacccagaugug

SEQ ID NO: 4189902 - RNA, 81 nt, Human
cacaugcucgaaaugcuuuagggugugcugucuguccuucuguucugcgcggacauacuucuuuagcauauugaacacgug

SEQ ID NO: 4189903 - RNA, 57 nt, Human
auucuacuuucuguuucucuggaguugacuacuuuagauacugcauauagguggaau

SEQ ID NO: 4189904 - RNA, 61 nt, Human
auucuagacaucugcaguuguuucuuagugggaaugguugcuuuaugucucucuacagaau

SEQ ID NO: 4189905 - RNA, 56 nt, Human
auucuaggcaggccuucaggaaauugugccugucaucuccugaaaacuucuggaau

SEQ ID NO: 4189906 - RNA, 87 nt, Human
auucuaguacaucuaacagcaacaccagaauaagauuugaccuacuaagugcucuguuacauuggaguuguuuagauucaccagagu

SEQ ID NO: 4189907 - RNA, 130 nt, Human
auucuauaauuuguaucuuuaucuuuaaugucuaucauaguagcugaaauguggaaugguuuaaauacuccacaugcuuuaacuuauuuugauuuggagacuuuaaggcauggagauuuuuucucugaau

SEQ ID NO: 4189908 - RNA, 129 nt, Human
auucuaucaauaccuuuccaucuggcagaggucugugguggugugggcaaggaaaagaaaauucuauucaucuucuuuuccuguccaggcaauuauugaccuucuuucaguccuucucuuugaugguau

SEQ ID NO: 4189909 - RNA, 70 nt, Human
auucuaucuuugguagcuuuccuaagaauggcaccacuuuagaaaaguuucaaagaguuguauuuagaau

SEQ ID NO: 4189910 - RNA, 58 nt, Human
auucucaauggcuacuuucauaccauaauggcacaguugaguaguugccacagagaau

SEQ ID NO: 4189911 - RNA, 60 nt, Human
auucucuagucucuuccauaaagugaaaucaggaagcuuugaaagaaggugguagagaau

SEQ ID NO: 4189912 - RNA, 59 nt, Human
auucucugaguaugguuccaggaucuguagcaucaguguccagggaacuucucaggaau

SEQ ID NO: 4189913 - RNA, 77 nt, Human
auucucuguuuauucagcauuuagaggaaggauuaaaaaugcucacuucuucauuuaaaugcuaaggauucaggaau

SEQ ID NO: 4189914 - RNA, 75 nt, Human
auucucuuccuuccuuucagggcuaugccuaggcagaaaagaagcaggcagaagccgagggggagguuucaggau

SEQ ID NO: 4189915 - RNA, 117 nt, Human
auucugauucccagagucucaaguuaugcagccagggagcaaagaguugagauccccuuucuucuuauuuuuauguuuccuggucuguguuggcccacggacucuccuuaucaggau

SEQ ID NO: 4189916 - RNA, 71 nt, Human
auucugcaguuauauuccauagauucagaaguaugauuccauaugucuaagucugugaauauaaacagagu

SEQ ID NO: 4189917 - RNA, 61 nt, Human
auucuggagaacagaggagagcuggguuugauagcuacuucagcuccuuuguguccaggau

SEQ ID NO: 4189918 - RNA, 106 nt, Human
auucuggguaaauguaaagaaaggucuggagaguggccaacucuggagaccugcuuuugcaggcugaguuucucauucucgcuccugucuuaucuuuacuaugaau

SEQ ID NO: 4189919 - RNA, 106 nt, Human
auucuguaucuuuaaccaguuauaggugacauugcuaggaacagauuuugacagcagacuugugcaagggaucuguuugccuagagauuuacuuaaaagguagaau

SEQ ID NO: 4189920 - RNA, 55 nt, Human
auucuuacaaaugaaacugcaaucacuggugauguguggguguaugugugagagu

SEQ ID NO: 4189921 - RNA, 68 nt, Human
auucuuacuccauagaaugaauacaaaaaagaagauguaugugaagaguuuucuguggaguuaagagu

SEQ ID NO: 4189922 - RNA, 79 nt, Human
auucuuaugguuucacauuguagauuaaagucuuuaauccauccuggguugauuuuuauauaaagugagaaacgagaau

SEQ ID NO: 4189923 - RNA, 111 nt, Human
auucuucaacagcuuuucaguuuggaguuaggauuuaauaaaagaauagauguacagcucuugacaauguauucuaaauacaucuuaccuuugguucagacuuuggaggau

SEQ ID NO: 4189924 - RNA, 64 nt, Human
auucuucucuggguuggguucagagacugacaguaagcuggacagcaguuacccagaaaggaau

SEQ ID NO: 4189925 - RNA, 67 nt, Human
auucuucuuuuacucauauguuuuauuccagggacugagaaaauagcagugaguaaacagauaggau

SEQ ID NO: 4189926 - RNA, 56 nt, Human
auucuugguccaguugaagaugcagacacauuuuagucuagacagggcacaggaau

SEQ ID NO: 4189927 - RNA, 60 nt, Human
auucuuguuuaauuugcauccccuauccccaaauuuaggacaguguggucaggcaagaau

SEQ ID NO: 4189928 - RNA, 77 nt, Human
auucuuuaucuuuguuuuguuuucuggcuuuugcaaagaauugugcaaaagguaguugccaaauaaggguaauuaau

SEQ ID NO: 4189929 - RNA, 55 nt, Human
auucuuuauugcugaugguuauugcauuagaugaugacccuuagcuauuaagagu

SEQ ID NO: 4189930 - RNA, 96 nt, Human
cacccacugauauauaaccugcuggaagguguuaucuguaucagucuucccauagagaccccauaccucagcagguauaauucaugagugaaggug

SEQ ID NO: 4189931 - RNA, 61 nt, Human
cacccagcacagagggaggcgaguccacaaccccucucccuccccuucccacagcugggug

SEQ ID NO: 4189932 - RNA, 71 nt, Human
cacccaggacaugggcacccgugacgauguccccgaagguaaggggcaccaugggaggccugcugcuggug

SEQ ID NO: 4189933 - RNA, 56 nt, Human
cacccaggcuggaaugcaguggugccaucucggcucacugcaagcuccgccuugug

SEQ ID NO: 4189934 - RNA, 60 nt, Human
cacccaggcuggagugcauuggcacaaucucggaucacugcaaccuccaccuccugggug

SEQ ID NO: 4189935 - RNA, 67 nt, Human
cacccccacgccccgacuuaaaugcaucagggaauuccugaggucuagagucagggugucuugggug

SEQ ID NO: 4189936 - RNA, 78 nt, Human
cacccccuggugcuguucugugguuuccaaguuuucugcauugagcaacuguuacaagaacaacacaagggccaggug

SEQ ID NO: 4189937 - RNA, 57 nt, Human
cacccccuucgcacacucuuucaccuugggaaggguaugggaaugaagaaaggagug

SEQ ID NO: 4189938 - RNA, 89 nt, Human
cacccgacagcuuguuagcaaugcagaaucuugggucucuucccugaccuccugaaccagaaucugcauuuuaacaagauauccaggug

SEQ ID NO: 4189939 - RNA, 76 nt, Human
cacccgauguuggugcucuaguaucugugauagcuccuuuugauccacaaguauuaguugcaaaacauugacugug

SEQ ID NO: 4189940 - RNA, 64 nt, Human
cacccuacucugaugugcuuuauuggccggaaaucuucuuuccauaaacugcaucaaguuggug

SEQ ID NO: 4189941 - RNA, 68 nt, Human
cacccuagcguagugugcugagacuguaauaguaaugauuauuacacucauauugcacuuaccgggug

SEQ ID NO: 4189942 - RNA, 77 nt, Human
cacccucucucagcacagcuggcucuggaagccacucuuggcccaacgagcagagcuggguucaagauggaagggug

SEQ ID NO: 4189943 - RNA, 60 nt, Human
cacccuggcaguucaucaaauggcagugccaaggcucugccucaguggaaugugagggug

SEQ ID NO: 4189944 - RNA, 61 nt, Human
cacccuguauguccccagcaaaccucucucccuguggucagcgcugugggacagcagggug

SEQ ID NO: 4189945 - RNA, 58 nt, Human
cacccugugaaauccauuaguagccucacuuuauauacuaggaaaucgaggcagggug

SEQ ID NO: 4189946 - RNA, 57 nt, Human
cacccuuaaggcuccugaaauacaaucauguauuuuagacuaauuccuaaagggcug

SEQ ID NO: 4189947 - RNA, 90 nt, Human
cacccuucucccaggacaugggcucugcucaccuaaccuuacacagccaugaggcacuuuuugggcagugccuuucugggugagagggug

SEQ ID NO: 4189948 - RNA, 81 nt, Human
cacccuugauuguuuuuucacacuugcagacuuugccugguuacacuccuaaccaagcagucuauggagugucgagaggug

SEQ ID NO: 4189949 - RNA, 59 nt, Human
cacccuuguguuuucaauccccauggacagcucuucagaacucaugaagacauaaggug

SEQ ID NO: 4189950 - RNA, 97 nt, Human
cacccuuuguggacacugcuucccagccuuccaggggcuucacggagacugcguucaugcaagggcuuagggggcugugcagugccacaaaaaugug

SEQ ID NO: 4189951 - RNA, 66 nt, Human
caccgaacuuugcaaaugcaauuuuaaaaaucccucccccuauugcaaaauuugcagaguucgaug

SEQ ID NO: 4189952 - RNA, 55 nt, Human
caccgagagccacuuccggaacaagcgucgcguuucugaggagaaacucuuggug

SEQ ID NO: 4189953 - RNA, 102 nt, Human
caccgcagcccucccuggaccacaaggagccaagggcaggcaagaaagcuucaggcucccucuggcuguuguuagguuccugggucaaaggcugaguuugug

SEQ ID NO: 4189954 - RNA, 80 nt, Human
caccgggaaggagccuggcaaugcugcguccuucuugacacugggucaccuugggguggauuucaggcuccucaccugug

SEQ ID NO: 4189955 - RNA, 68 nt, Human
caccgggaugcaggaggguguugucaguggguuucccucccucuuacacagauuccucuagcugggug

SEQ ID NO: 4189956 - RNA, 64 nt, Human
caccgugagcugcagaguaaccuuugcaguuacuaguuuaucuguaauuuugcagcucaaagug

SEQ ID NO: 4189957 - RNA, 96 nt, Human
caccguuacuagaagugguguguggccgagcuugugcagaauaucauaucaggacauaccugcaacaguuagucuaggccagaucuuuugacugug

SEQ ID NO: 4189958 - RNA, 75 nt, Human
caccuaacuauuccauuccauaguagaaaaugggacaccauuccauaguagaaaaugggacaggcuaguuuggug

SEQ ID NO: 4189959 - RNA, 75 nt, Human
caccuaacuuuccuuaauaccugguuaccacugguuaccaauuacagugcaaauaagcuauuauggaauagggug

SEQ ID NO: 4189960 - RNA, 57 nt, Human
caccuagccuucuugugccucuugauuggggcagcagguguauauaaggcugaggug

SEQ ID NO: 4189961 - RNA, 71 nt, Human
caccuaugccagguaugaggacacugacagcagaauugaaucagcugucaguuugucuugcugacaaggug

SEQ ID NO: 4189962 - RNA, 101 nt, Human
caccuauguggcuguuuguuuauggaguuuucgguggccuacuuuaccugucauuguagcccaugcauaaaccguuacuuguacuauauuauuugugggug

SEQ ID NO: 4189963 - RNA, 77 nt, Human
caccucaggucuccugcccccggugcuugggcucucucuguccaagcacagggguuaggggcauguggucuggggug

SEQ ID NO: 4189964 - RNA, 129 nt, Human
caccucauaaaauauguagcugcaauguuugugagaacuugaucauuagcaugcacuggaguguuucaggccugcuguaugauggaucugauuauauaacaauaugcuugcaauauuaaguaugaauug

SEQ ID NO: 4189965 - RNA, 79 nt, Human
caccucaugcugaaacaaguauguucuacugaccuacuugacccaaaggugagcagggcagcuuuuuucagaaguggug

SEQ ID NO: 4189966 - RNA, 55 nt, Human
caccucauuaagaccagaagcaaacucugagcaaaagcugagugaugauggggug

SEQ ID NO: 4189967 - RNA, 85 nt, Human
auggauucaguuucaagacauugauuuuguacagauuagaauguuuuauuuugguacauuuucaaguagucuagaaacaguucau

SEQ ID NO: 4189968 - RNA, 84 nt, Human
auggcaaugcagguuuauuucacucuccggauacugucacaaaaaucugguugugggugggauggggaaaaaaccaaaggccau

SEQ ID NO: 4189969 - RNA, 70 nt, Human
auggcacguguguggccaggacugcagcucacaaccuccgugugcagaacagggccaugucaccugccgu

SEQ ID NO: 4189970 - RNA, 80 nt, Human
auggcaggaggcccaggcccugcuuuccagagcucauccaggugggggugagagauguggagcagggccccuugugcugu

SEQ ID NO: 4189971 - RNA, 95 nt, Human
auggcaguguuuuaguuuucuccaacucaaaggaaaggucaacuuuuagugaccuuuccuuuauuuuggaagauaauuuggucaagcauuaccau

SEQ ID NO: 4189972 - RNA, 57 nt, Human
auggccaccauuuaaugaagcucacuuugugcccaaagccauccugaauggugccau

SEQ ID NO: 4189973 - RNA, 84 nt, Human
auggccaugucaguguaguauaagguuaaaaccuugcaugcgucaaugcucaguagguaccaauacugaaugacuaguggccau

SEQ ID NO: 4189974 - RNA, 55 nt, Human
auggcccaaaaccuccucccucaauagugucuugagugcggagucugugggcugu

SEQ ID NO: 4189975 - RNA, 65 nt, Human
auggccccucuagaaguuuauguuagguuuuuaaggccagaccagacugacuugagcccagccgu

SEQ ID NO: 4189976 - RNA, 63 nt, Human
auggccuaugaccguuauguugcuauaugcaaaccucuccacuacaugacagucaugagccgu

SEQ ID NO: 4189977 - RNA, 99 nt, Human
auggccuugaccgaccucacguuuaagggccugugcacaguucuguuaccuggaguaggugaucugugacaccggccuuugguugcuguguuuggccau

SEQ ID NO: 4189978 - RNA, 101 nt, Human
auggcgaaagaaaagaacaaacuuuaaaaaugucuuuuaaauguugaggugauuucauugaagauuaugucuaaaagauaaaguuuaacuuuggcguccau

SEQ ID NO: 4189979 - RNA, 64 nt, Human
auggcgacaaagcucucccaccuucuucuuaccugcuggaagacagaggugggggaggucccau

SEQ ID NO: 4189980 - RNA, 57 nt, Human
auggcgucgucggcggagugacaggggucccucugggccggagccgacggcaguggu

SEQ ID NO: 4189981 - RNA, 70 nt, Human
auggcuagggcucgcaagggcuggagcuguaggaucuggcuagcuccauaccuaccugagcucugguugu

SEQ ID NO: 4189982 - RNA, 68 nt, Human
auggcuccccacugcccucaugagaaaggccucaacacaaagccagccuucuccagugcgguagccau

SEQ ID NO: 4189983 - RNA, 71 nt, Human
auggcugauuucaugcuaucaauguuguaucacugaaugcagaguugagcagaaguacaggaacauaccau

SEQ ID NO: 4189984 - RNA, 58 nt, Human
auggcugugguaucagacgcagcugggaccugauccaguucugccacuguccagcuau

SEQ ID NO: 4189985 - RNA, 79 nt, Human
auggcuuaaaguaacugccacauucauuuugcucacuaaucugcaguuuggaagagcuggaaagaagguggcagcccau

SEQ ID NO: 4189986 - RNA, 63 nt, Human
auggcuuccucuggauuggauuucccuuggcuucccugagggcaaucccccgaggaagcacau

SEQ ID NO: 4189987 - RNA, 87 nt, Human
auggcuuuuagcuuaauggacuuuuuaacugauaggagcuaaaaggcugagcuccuacuaaugaaucuaugagcuaaugacagcuau

SEQ ID NO: 4189988 - RNA, 65 nt, Human
augggaaaugguccauuugaugguuuuauugauaacuaaaccauuugaaggaaucauugacucau

SEQ ID NO: 4189989 - RNA, 85 nt, Human
augggaagaaggcuggggccuucucaucucccuuuggcaaauguggcugacagguguggacugagaggagccuccaaccuccuau

SEQ ID NO: 4189990 - RNA, 60 nt, Human
augggaagguuuugagagcgggucaguucagggccggcagacuuuuuaaaauccucccgu

SEQ ID NO: 4189991 - RNA, 78 nt, Human
augggaagugaagucagggaggaggaagaugucacugauaacaccugaaaauucuaaucuuccgacuugauuucucau

SEQ ID NO: 4189992 - RNA, 60 nt, Human
augggaauagaacaagauagagauuuggggucccaugucugcuucuguauuuuuucccau

SEQ ID NO: 4189993 - RNA, 62 nt, Human
augggagaggguaggaauuacuuugcaguuccuggugcacuuaaaaucauacucuuucuuau

SEQ ID NO: 4189994 - RNA, 82 nt, Human
augggaggaauccugcucgaaucaaagcaguuuuaaaugggaagcaccaaaaacugaaguagauucugaaauuuccuccuau

SEQ ID NO: 4189995 - RNA, 115 nt, Human
augggagggaauuuuaacugggugugaauauugggaggugugguuaguugggggcuaucacuguaucucccacaggcugcuacuucucucuuaauaucucuuguccucuucccgu

SEQ ID NO: 4189996 - RNA, 116 nt, Human
augggcacuauccacacauugggaggauggcaacuaccaaauuucacaaaugagacagcagcugucaucagugcccuuggggaugccaugcuaacaauaguaaauaaggugcccau

SEQ ID NO: 4189997 - RNA, 56 nt, Human
augggcugagaaucaagaauauuccugguggccaccaggccugguucucaguccau

SEQ ID NO: 4189998 - RNA, 88 nt, Human
auggggcauuacacaguggaaguccaggauccccucauucuguuuacuugaacuguugguuuggauucuacuauguccucauccccau

SEQ ID NO: 4189999 - RNA, 56 nt, Human
augggggagcgacagacauaauucacacccugugaucaugccaucugcucccccgu

SEQ ID NO: 4190000 - RNA, 116 nt, Human
auggggucucaucuucuguuggcuuuucuuagguguaugucauuagggaacacuuuacaacaaggccuggaauccccuaauagaucauauacaacaaguagagccuuuggcccuau

SEQ ID NO: 4190001 - RNA, 122 nt, Human
augggguuucaccauguuggccaggcugcugugaccucaggugauccaacugccucagccucccaaaguguuggaauuacaggugugagccaccgcaccuggccccuccugugaagucuugu

SEQ ID NO: 4190002 - RNA, 68 nt, Human
auggguacaagaaggugcaaggaaguucccaaaucuagaaaugcagagcugauugcccacuuguucau

SEQ ID NO: 4190003 - RNA, 115 nt, Human
augggugccagcaguacaugugccaggugaggcaguucuuacuuguauuugucauaaacugauaccugccaagcugcacucaggcccuuggggcuguagcuuugcuggcauccau

SEQ ID NO: 4190004 - RNA, 128 nt, Human
cagaagccucagagggacgccugugacugugccuguaagguuuaacgcccugucucggaugaucauccgggccuacagagguauaaacugcacuguccaauaugguagcccccauucacaggcugcug

SEQ ID NO: 4190005 - RNA, 67 nt, Human
cagaaggcaccauugucaacgguaaaguccuaggagggacccauugccggugaggugaggcuuucug

SEQ ID NO: 4190006 - RNA, 71 nt, Human
cagaaggggucugucugagccagaccagggaaagcucagauccaugcgauggcguagacaaaucccucuug

SEQ ID NO: 4190007 - RNA, 92 nt, Human
cagaaggucaguaaauuauggauuaacauguuuaugguacuucuuguugaguugcagugauuaaaguguuaaauucuuuauugucccuucug

SEQ ID NO: 4190008 - RNA, 66 nt, Human
cagaagguuuacacuggacuguagugagaauagauaaaguaauaaggauccagugugaaguuuuug

SEQ ID NO: 4190009 - RNA, 64 nt, Human
cagaagucauuuuguggaaauugcuuuuuaguacuuuaagagcaucugcuuaauggcuuaacug

SEQ ID NO: 4190010 - RNA, 65 nt, Human
cagaagugagcaugugaccuaguucuuuuauuugagcuaaagaaaagcaugcuugguggcuucug

SEQ ID NO: 4190011 - RNA, 55 nt, Human
cagaaguggcaucauucaagagcuggaagaccgguauaggaaucagucacaucug

SEQ ID NO: 4190012 - RNA, 62 nt, Human
cagaauaaacagaaacguagcuguguaaagguaucacuuagaacuacguuucguuaguucug

SEQ ID NO: 4190013 - RNA, 63 nt, Human
cagaauaagccugugcaugggcagauggugcuuuauuccuaauuugcagggcauguacaucug

SEQ ID NO: 4190014 - RNA, 81 nt, Human
cagaauacgcuccaugugcacacugaggcugggggagaagguggcucccaccucccuggguuaucggggcaggggcgucug

SEQ ID NO: 4190015 - RNA, 82 nt, Human
cagaauaucugcaagcugaggcuccccugagggauucuguuccacuccaggucucuaggggagccccguuuguacaggccug

SEQ ID NO: 4190016 - RNA, 59 nt, Human
cagaauaugacucgggcacuacauuucaauuuacaggucuugcucugaguuacuuuuug

SEQ ID NO: 4190017 - RNA, 129 nt, Human
cagaaucaccuauagagcuuuuacaaaauucaaaugacuggucuccuaccugggaguucugguuuacaaaucagggaaaggggagagucauuuagauugauuuuuuuuaauguuccccaaaugauucug

SEQ ID NO: 4190018 - RNA, 55 nt, Human
cagaaucagugacacauguauaagaauguuuguaccauauauguuacugacucug

SEQ ID NO: 4190019 - RNA, 83 nt, Human
cagaaucugccccaggaccucuucuggagaaaaucccgucucuuguuccacuucucugaaugucucuguuggggcaaauucug

SEQ ID NO: 4190020 - RNA, 97 nt, Human
cagaaucugucccaugguuaagccaagaccaucucuuauugauuaaaggucaacaagaauguagauuaguuaagcuaugaagagaccuaacauucug

SEQ ID NO: 4190021 - RNA, 60 nt, Human
cagaaucuucuuaauuggcacagaucccuaaagggaacaaaugugacaauuagaagucug

SEQ ID NO: 4190022 - RNA, 92 nt, Human
cagaaugaaguggggucccaggaaggagcaguguucuuuuugugacccugucauuacaugcacucuucaccuggaaugcucugcuucuuuug

SEQ ID NO: 4190023 - RNA, 102 nt, Human
cagaaugugaauaguauuugccuucuugaauaugguucuuugaaaauacagacaggccucaaagacacuggacagugggagggauaaagcuauuucagucug

SEQ ID NO: 4190024 - RNA, 112 nt, Human
cagaauguuauaucaggcauuauaaauaauuccuaggcaauauuuagaauggcugcaagccauuuuuagaauuggcugagaauuauuuacaauacccugcucccacauuuug

SEQ ID NO: 4190025 - RNA, 76 nt, Human
cagaauuaaaaguagggaaaguucuauuuaccuuggaaguaagcaagaagugguccuuuucuuucuucauauucug

SEQ ID NO: 4190026 - RNA, 72 nt, Human
cagaauucugaguggcauuggaauuuguguugcaugaccagcucugugauacuugaauguguuagacuucug

SEQ ID NO: 4190027 - RNA, 98 nt, Human
cagacaaaaauaagugacuucauguuguuuacaacuuaggggagauugacaauaaucaaguaaguuauguaggauaucagaggaucauaagugucuug

SEQ ID NO: 4190028 - RNA, 82 nt, Human
cagacaauagagacucaaacagauggccaagugcaugggcugaaagagaguccaaacuaccuucugagguuucuuaugccug

SEQ ID NO: 4190029 - RNA, 89 nt, Human
cagacaaucaguuucuguuguauaaucaccucacucucagacaugcuguuucuguuggaauucuuuauuauggauggaaauugauucug

SEQ ID NO: 4190030 - RNA, 85 nt, Human
cagacacauccuguuucugugcagcaugaguuauucagcauuauuaguagacacauugcugcuuccaggcacaggagcauuucug

SEQ ID NO: 4190031 - RNA, 78 nt, Human
cagacaccaggcucagacucccaggcccucugucugccccgcacgccugccaugucugagcucuugagcaugggucug

SEQ ID NO: 4190032 - RNA, 81 nt, Human
cagacaccugcagggaugggaacuccuccagcagcuccaggaacguggggcuguuggugaacuuccacuugcuguacucug

SEQ ID NO: 4190033 - RNA, 60 nt, Human
cagacacugcagcagucucccagaucugccuucugggaacccgaauugcccgguagucug

SEQ ID NO: 4190034 - RNA, 71 nt, Human
cagacagaagugucuuuuucauucauuuucccuuuuaaagagugucaaugaaggaaagugccuacugucug

SEQ ID NO: 4190035 - RNA, 72 nt, Human
cagacagagugagggggcacugagacggcacuggauuugaucagauaccuucucugcaccccacuuuugcug

SEQ ID NO: 4190036 - RNA, 76 nt, Human
cagacagcgaggggccugggccagcagggccguucuccuccgugccagcucagugccaggccccucuggcugccug

SEQ ID NO: 4190037 - RNA, 60 nt, Human
cagacagcugcuuucuugcuguauccucacaugguagacagagagaaagcaaguucucug

SEQ ID NO: 4190038 - RNA, 57 nt, Human
cagacaggguccuguccgucacuguauauuucauggugccuaauggugcuuugucug

SEQ ID NO: 4190039 - RNA, 96 nt, Human
cagacagucuuaggcuguaagagagggcagagugcccuggaacacacacaagggaaggagcgcugcucucucuuggggucugugggaggcuuucug

SEQ ID NO: 4190040 - RNA, 95 nt, Human
cagacaucacagggaagguugguuuguucaccaucaagcaguucaaagucagccccucuguuuuugaaaugaacgaacuugccucucaccgucug

SEQ ID NO: 4190041 - RNA, 75 nt, Human
cagacaucuccucuagcuguuuuuagagcuauuuuuuucauggagaaaugccuacgagauagggagaguugugug

SEQ ID NO: 4190042 - RNA, 71 nt, Human
cagacauuuauuucugguaggucuggaggcugggaaguccaagaucaaggagcuggcagauauggugucug

SEQ ID NO: 4190043 - RNA, 74 nt, Human
cagaccacagcaccacugguccuuaagcauuccuccuaaaacauguugucacaucaggugguggcuguucacug

SEQ ID NO: 4190044 - RNA, 83 nt, Human
cagaccauacuuuuccagggcuggcugagccugggcuguucaugagcagacacuccugagccguccuggaaaagggagaucug

SEQ ID NO: 4190045 - RNA, 67 nt, Human
cagaccaucuugaagcaaacugcaugugccacauuuaaaagggaggcaugcuuccagggugugucug

SEQ ID NO: 4190046 - RNA, 69 nt, Human
cagaccccagccucugcgugcuguggcuucacucaacauuugggaccacugagaagggguuggggucug

SEQ ID NO: 4190047 - RNA, 79 nt, Human
cagacccucugcaacuccagagugcucacugaucuggagacacaugcacucugugaucugcagagccuacgaaggucug

SEQ ID NO: 4190048 - RNA, 63 nt, Human
cagacccugcauuuuccaggguuuccauaauggcuggaaauaaaaauggcagcagggaaucug

SEQ ID NO: 4190049 - RNA, 77 nt, Human
cagacccuggguccaguuuugucauaaagcacaugcuuuaaaauguugcuguagauggacuggcauccauuugucug

SEQ ID NO: 4190050 - RNA, 61 nt, Human
cagaccgugaagcugcagcagggccauggcggguaaagcauggcucugagccucauggcug

SEQ ID NO: 4190051 - RNA, 56 nt, Human
cagaccucaguccucaguaggaagaggauggaaacgcuauggggacuggaggccug

SEQ ID NO: 4190052 - RNA, 59 nt, Human
cagaccuucuguuggaggcauuuaggcaauucuggaagccuuucuggcagaaguguaug

SEQ ID NO: 4190053 - RNA, 82 nt, Human
cagacuacauggaugccccgaaggcggcccccugagcaugcccuggccucucuggcugccacuuggucaugucaugugugug

SEQ ID NO: 4190054 - RNA, 78 nt, Human
caacaaaagacuagaagagccauacaaguaaaagcaaaauaaaacauuuugcauguuuguagguucuucuaaauguug

SEQ ID NO: 4190055 - RNA, 60 nt, Human
caacaaauuucuauuugguuuugugugauuucacaucuaacuguuucagaaauauuguug

SEQ ID NO: 4190056 - RNA, 73 nt, Human
caacacaaaaccuaaacagacuguccaauaacuccugcuaccuggauccuuggagguguuuggcuuuuuguug

SEQ ID NO: 4190057 - RNA, 129 nt, Human
caacacucagaguuauguacaauaacacauauauuggugucagaaagaguucaccauacucguacgugguuaaugcagauuuucugggccagauaaaauuguggguuuuguaaagcaucuguaauguug

SEQ ID NO: 4190058 - RNA, 59 nt, Human
caacacuguugugaggauuaaaugagcuacuucauguaaaacacucagaacagugcuug

SEQ ID NO: 4190059 - RNA, 125 nt, Human
caacagaucuuaacaucucuugcugcaaauuuuccaguguguucuggucuaccuugguaucuuaaaaccaggcucacugacuaccacaugagaaaugacaguggggugucuuaaaugaucuguug

SEQ ID NO: 4190060 - RNA, 62 nt, Human
caacagcagcaugacagcuggguacagggcuccuaacccucgccugccccauguuucuguug

SEQ ID NO: 4190061 - RNA, 86 nt, Human
caacaggcauuccccaucaccugucuugucagucuggcacacugugcuuggagacaagacuaggcaguuguuggguaugaauguug

SEQ ID NO: 4190062 - RNA, 66 nt, Human
caacaggggagaugcugcaaggagaugucuggggauggaauucuccugagaggaucucuguuguug

SEQ ID NO: 4190063 - RNA, 56 nt, Human
caacagucucuauagcuccuuguccuguuucugacaaugguguuauaggaugguug

SEQ ID NO: 4190064 - RNA, 79 nt, Human
caacaguuuacugacccaucuucucuugaaccuccuuugccccaaaggugaaggguggaggcaagagagggaacuguug

SEQ ID NO: 4190065 - RNA, 66 nt, Human
caacauggugaaaccccgucucuacuaaaaauacaaaaauuagccaggcgugguggcgcacaguug

SEQ ID NO: 4190066 - RNA, 63 nt, Human
caacauugaauucaaaauuacugaauucaacaaucuggaaucaguuuuggcuguucaguguug

SEQ ID NO: 4190067 - RNA, 129 nt, Human
caaccccaaccaacccucaaguuccuucccagagcccucggcccuuggcucccuccccuguggcauuacacaggauggagagugaggggucacugccucuagggaggaaacagaaugucuggggaaaag

SEQ ID NO: 4190068 - RNA, 73 nt, Human
caacccuaguuggcuguuacuauguucuuaauuacgaaaaguaaugaagaugguucaacuggccuuuggguug

SEQ ID NO: 4190069 - RNA, 73 nt, Human
caacccucagcugcugcgggaaccucucagguaugcuccccuguagaccugggugcccugugcuuugggguug

SEQ ID NO: 4190070 - RNA, 55 nt, Human
caaccggguaguuucuuuuuagagaagcagaaaacugaagaggaggagcagguug

SEQ ID NO: 4190071 - RNA, 86 nt, Human
caaccugaaagggugauucucaauuuuagcuauaaggcugugaauucaguuugaagcagaugguuaagcuugaucauuacagguug

SEQ ID NO: 4190072 - RNA, 69 nt, Human
caaccuuauuuggaauggggucuuugcagauauagucaaguuaaaaagaggucauaccagauaagggug

SEQ ID NO: 4190073 - RNA, 82 nt, Human
caaccuucuucuauaaguauccugguaaaugcuuaggaguuuaaguguguauuguuuaugcugcaagaagcauaugagguug

SEQ ID NO: 4190074 - RNA, 69 nt, Human
caacgauccucuacugaccuccgggcuuaaugcuucgaguucgucuccaaggucaguagaaugauuuug

SEQ ID NO: 4190075 - RNA, 86 nt, Human
caacguauuuggcagucuuuguucccauuacugagcuccucuuuggagcugccaggcuuuggucaaaggcugcaggggguacuuug

SEQ ID NO: 4190076 - RNA, 56 nt, Human
caacguugacaguuguuuucagcaaauggcugcuuuacucuguacugucaauguug

SEQ ID NO: 4190077 - RNA, 67 nt, Human
auucagugggugcucagcacaaucucucucucuuaaaagacugucuuuauagagcauucauuuggau

SEQ ID NO: 4190078 - RNA, 62 nt, Human
auucagugugagguuuucaaguagaacacuuuaguuaguauugaaaacauuuauauuagaau

SEQ ID NO: 4190079 - RNA, 83 nt, Human
auucauacaguccaaaacucagaagguacagaagggaggugucuccaggcacccuguuacucucuccugaguuuuuuaugaau

SEQ ID NO: 4190080 - RNA, 110 nt, Human
auucauccaaguuguuacauggagcaaugaugcauucuuuuucauugugcuauacucauaugaugaaaugcuaugcaacaauguauuuauguauuuuacugcugaugaau

SEQ ID NO: 4190081 - RNA, 58 nt, Human
auucaucuaugacucuaaugugcuauggaaacaccacagcaacauucauguggugaau

SEQ ID NO: 4190082 - RNA, 60 nt, Human
auucaucuguacuucaauaucuaguuuccauagcaacugagaugcaguuugcaggugggu

SEQ ID NO: 4190083 - RNA, 70 nt, Human
auucaucuuaaauuaaagcuuaaggaaucuaccuuuaccuuguuucuuuugcugcauguuuuaggugacu

SEQ ID NO: 4190084 - RNA, 79 nt, Human
auucaucuuguaaucaugcauauuacuagcacagcaucuugcacaugguaagugcuuaauacguauuugcuggaugaau

SEQ ID NO: 4190085 - RNA, 70 nt, Human
auucaugaaacaaaccucuauggagucuuugcucuuuguaagggacuuuccguguguuuguucaugcaau

SEQ ID NO: 4190086 - RNA, 56 nt, Human
auucauguucggggccacguuguuguauguauugauguacagccuugaaugugaau

SEQ ID NO: 4190087 - RNA, 87 nt, Human
auucauugaauagggcaaguaucagaggguuuuaagcagaaagauguaauaauggaagaucacuuugaugcuaccuggagaaugaau

SEQ ID NO: 4190088 - RNA, 64 nt, Human
auucauugcuuacagcuauuucuguaugugucugauauaguagaaagaacgcugaaguaggaau

SEQ ID NO: 4190089 - RNA, 65 nt, Human
auuccaaguauacauguuuuacauaagugauuuauagauaagugacuuguauaugugacugggau

SEQ ID NO: 4190090 - RNA, 77 nt, Human
auuccacagugcugucaguuuuauagauacacaugugccugaaaaggaggaaugucauagugugguagcaguggagu

SEQ ID NO: 4190091 - RNA, 61 nt, Human
auuccacauuucuucacuugucccaguguuuuauugggaaaguguugaggugucuugggau

SEQ ID NO: 4190092 - RNA, 57 nt, Human
auuccaccuucuaccugggagagaggacauacuauaucgcagcaguggaaguggaau

SEQ ID NO: 4190093 - RNA, 56 nt, Human
auuccaggcagaccagagagaugcaauucaaagaaucauacuggaaugacuggaau

SEQ ID NO: 4190094 - RNA, 74 nt, Human
auuccagugauuaucuuaagagguuguaugcagcagaaauaaccauacuuccuugucaggugcaucauuguaau

SEQ ID NO: 4190095 - RNA, 110 nt, Human
auuccauguauuucuagggccuucaggaucacuaaacccuccaccaagagaaugcaauagaaguggcgguuaugaaaguuucuggaaguggcccaguaguacagaagaau

SEQ ID NO: 4190096 - RNA, 69 nt, Human
auuccccaagguuuacuuuaugauccaggccaaguuaggucaggaucaugcugaaucuggcacaggaau

SEQ ID NO: 4190097 - RNA, 77 nt, Human
auucccccaaucccccauggccaggcccagggcccaggagacugagcacugaggcaggccugagauugggauggagu

SEQ ID NO: 4190098 - RNA, 81 nt, Human
auucccucuucaccaguuuggcagucucaucuucagagcaaaagauacggugugaggcugaaacuggcgauagagugggau

SEQ ID NO: 4190099 - RNA, 64 nt, Human
auuccggauauguaaaucaugaaacgucagucacacuacaacucauugaauacauauuugggau

SEQ ID NO: 4190100 - RNA, 76 nt, Human
auuccucucaggugugagauauuuccuaugaaacaguccacuggcaggcuggagauaucuuacacuuugaaguuau

SEQ ID NO: 4190101 - RNA, 76 nt, Human
auuccugaaaugugagcuccggcagguggaagucuuugugugacuuacccuguaagguguucccagacuccggaau

SEQ ID NO: 4190102 - RNA, 74 nt, Human
auuccugaaggugcagaacugagugaacagaucauccuuuuuaaacucacucaggcugauuucuuuugagggau

SEQ ID NO: 4190103 - RNA, 59 nt, Human
auuccugacaauggcggagauagucgugggguguccaccgcuuugccacugauaggagu

SEQ ID NO: 4190104 - RNA, 55 nt, Human
auuccugacugcuagucauucagccucacugugaaugaccccaguagaaaggagu

SEQ ID NO: 4190105 - RNA, 62 nt, Human
auuccugcagggaaucgaggcagaagcauggaugcuuucuucauagaccuugucuugggagu

SEQ ID NO: 4190106 - RNA, 58 nt, Human
auuccuguuuugguuauccuugcaauuugaguacuaggcaaaccuauaaaauaggaau

SEQ ID NO: 4190107 - RNA, 57 nt, Human
auuccuuggaacagaugcgaaggauucauagugccuuucagcucugcuucagggaau

SEQ ID NO: 4190108 - RNA, 94 nt, Human
auuccuuucuugugauaauugaaaucauuucaauucauuuccuucuugguuggacagaaacauguuuucaguagugagcaaaucuugagggaau

SEQ ID NO: 4190109 - RNA, 70 nt, Human
auucgaagcuucuuagaaugcaugugccaaacaucuuauggaccaguguugcuaggaagcugcuuugggu

SEQ ID NO: 4190110 - RNA, 80 nt, Human
auucgucuaaacuuuggcccagauuucuuguguugaauggaguacacauugcaaauaguaggcuagguuuagaguugagu

SEQ ID NO: 4190111 - RNA, 55 nt, Human
auucuaagucuuguucacauucucucuucauagggaagcauugaaugcuuagaau

SEQ ID NO: 4190112 - RNA, 63 nt, Human
auucuaaucaguuuggauuguuccuccuuugaggcacaaauaaaaugcaaauagauuuggaau

SEQ ID NO: 4190113 - RNA, 56 nt, Human
auucuacagaugaaagcggcugaggcacagagcagugcagcagcucaucugagagu

SEQ ID NO: 4190114 - RNA, 63 nt, Human
auucuagaauuaggcuacauggacuggacuaccagcuauaugacauuggccaaguucuguaau

SEQ ID NO: 4190115 - RNA, 71 nt, Human
auucuagauaccuaggggauuuguccagauuucagauauauacuggaacacacuucuaagucauuuggaau

SEQ ID NO: 4190116 - RNA, 65 nt, Human
auucuauggggaauuuggaugcugauaugguuugucuguguccccacccaaaucucaucuugaau

SEQ ID NO: 4190117 - RNA, 105 nt, Human
auucucauguaugugccauggauguuaauagcugcauugauuuuaauagugaaaaauuggaaacaauguagauuaccauuuauauaugacauauuauguaagagu

SEQ ID NO: 4190118 - RNA, 65 nt, Human
auucucauuagagcaguguauuaugauacgacugucccagucuauuuaggcugcuguaauagagu

SEQ ID NO: 4190119 - RNA, 73 nt, Human
auucucuccugcugugagugguucuugccuuugcuaaggguuugaauaugcauucaaagugaaaggaguggau

SEQ ID NO: 4190120 - RNA, 81 nt, Human
caagccauuugaauuguucugugggaaauaaacucucuuccaaaacuggcugucucauuuccccagguuagaugcguucug

SEQ ID NO: 4190121 - RNA, 55 nt, Human
caagcccacguugaaccgcuuacagaugcccgcaucgugcagcagcugaggcuug

SEQ ID NO: 4190122 - RNA, 58 nt, Human
caagcccaggauuccccaguuacaucaguaccuacagguggccauguucuguggcuug

SEQ ID NO: 4190123 - RNA, 67 nt, Human
caagccccaaacaccaggauuacuguuuacagggguuccuguuuacaguaguuuagcacaggguuug

SEQ ID NO: 4190124 - RNA, 98 nt, Human
caagcccuuggcacuuucuucugccccuugccugacaguguuugccuuucuuuggaugauggagcagugagaucauccaggugccccccaggggcuug

SEQ ID NO: 4190125 - RNA, 98 nt, Human
caagccguuuuaaaaauguguuugauaggaauauuauagcuuagaauucguaauguagguaaauuucuguuauaauuuauuuuuggaaaaaugguuug

SEQ ID NO: 4190126 - RNA, 82 nt, Human
caagcuauaauugagaaacugucaagagauucaaauucauggaaaaccaugaaagaauaauguuugcauguuucagagcuug

SEQ ID NO: 4190127 - RNA, 96 nt, Human
caagcucaugaaaaguaugcuaaagaagagagaauguagaauagcaaaaccagcugggagccugucuacacuuucucugcauauuucauagauuug

SEQ ID NO: 4190128 - RNA, 69 nt, Human
caagcucucuuggugacuuaaaauguucccauuucucauaugaaacacagaagugccaagagccaauug

SEQ ID NO: 4190129 - RNA, 65 nt, Human
caagcuggcagaaggcaauuagagacugggaaaggacuuaggaaugaaaguguuuugaaagcuug

SEQ ID NO: 4190130 - RNA, 84 nt, Human
caagcuguguccuuuuaguuuaagaaucaccagagacuacauaauuuuaguuuuuacagagagagaacuggacuggcuaguuug

SEQ ID NO: 4190131 - RNA, 57 nt, Human
caaggaaaagaaguauuucagaagcauccugcuuuuuaaaugcuagaauuuucuuug

SEQ ID NO: 4190132 - RNA, 85 nt, Human
caaggaauaccuguccacugggggacuggcugaauuuugcaaggcaucugcagaacuagcccuuggugagaacagcgaagucuug

SEQ ID NO: 4190133 - RNA, 63 nt, Human
caaggagaguaauugaaugagaggcccugacauugcagaaagucuaaauuaauucuuuucuug

SEQ ID NO: 4190134 - RNA, 109 nt, Human
caaggagcaagcacggaaggggaaggccagccuguagagcuugcagccgucucuccugcuucgccacagcaccgcugccaguccccuucuuggguggggaagcuccuug

SEQ ID NO: 4190135 - RNA, 76 nt, Human
caaggaugcccauaagguuugaccugauauuuacauaguugcagaagaauuuaaacuaaccauaugggcaucuuug

SEQ ID NO: 4190136 - RNA, 80 nt, Human
caaggauguccauagacagguguuggcauagaaccugccuuacaaaggccucugccccagccacaccuggacucuccuug

SEQ ID NO: 4190137 - RNA, 62 nt, Human
caaggauuuucaguggcccgcacccagauagaaauuuggcugguggcugguucuggaccuug

SEQ ID NO: 4190138 - RNA, 82 nt, Human
caaggcacacaauauuaccaaugcuuggaaaaauuagauuugaauuucaaaagcguacguagugaaguggcucuaugccuug

SEQ ID NO: 4190139 - RNA, 74 nt, Human
caaggccaguuucuccuagucaaaaccaaauguaacaaguaacucaauuuuucacugggggacaauuuguuuug

SEQ ID NO: 4190140 - RNA, 63 nt, Human
caaggccauggguaaggcccaggucaaauguauaacccuugccugucuguuugcccauucuug

SEQ ID NO: 4190141 - RNA, 58 nt, Human
caaggcugggagaaagaacccugagugagguagaaaugaccuucuuuucugagccuug

SEQ ID NO: 4190142 - RNA, 85 nt, Human
caaggcugugguccugggguuuuauauuuuggaucagauugucugugagccuggauuagaauggauagauccccagagcucuuug

SEQ ID NO: 4190143 - RNA, 67 nt, Human
caaggcuguguuagcugcccuccucugagcuugcacaguuuccagggcaucugcuauuacagcacug

SEQ ID NO: 4190144 - RNA, 57 nt, Human
caaggcuuucucauuauccuuuaggcuacagagaaacaaggagacgggagagccuug

SEQ ID NO: 4190145 - RNA, 57 nt, Human
caagggagaaggaugcuuggucauuuugagugucauaguguccuugaucuugccuug

SEQ ID NO: 4190146 - RNA, 77 nt, Human
caagggagccuaacaaguggugugcuucuuucuuacaaguaggcagugaaagaugcagcaaacuacuuuuuacuuug

SEQ ID NO: 4190147 - RNA, 58 nt, Human
caagggagcugucaacccacauggucauccaauuucuguggcagagagagcuuccuug

SEQ ID NO: 4190148 - RNA, 83 nt, Human
caagggauuuuacaguuacccuggaaagaaaugaugugucccuagcaauggcauuuaaucuggguaauuuguaggucuucaug

SEQ ID NO: 4190149 - RNA, 68 nt, Human
caagggcaggagaggauggaugucucagcucaagcagagaaaacaaacucacccuuucucugccuuug

SEQ ID NO: 4190150 - RNA, 83 nt, Human
caaggguaugugaagcgaaguugcaccaagccagcaacugcaguugccgcuguucuagcuucaguuucgcgaugcuucccuug

SEQ ID NO: 4190151 - RNA, 77 nt, Human
caaggucacacaggugguacuuaaagucagaacucaaacccagguuuuuugacucccaaguauagcuaagacucuug

SEQ ID NO: 4190152 - RNA, 55 nt, Human
caaggucugguuccucugggugccuguuugcacggccagaggcugacagacuuug

SEQ ID NO: 4190153 - RNA, 73 nt, Human
caaggugacagaccacugcaacucugugcugguacaccucaucucuacacacagagacaaugguuucaucuug

SEQ ID NO: 4190154 - RNA, 56 nt, Human
cacaacccgaucuuaguuccucaucaguaaaaagaggaguguugaguuggguuuug

SEQ ID NO: 4190155 - RNA, 118 nt, Human
cacaagcaauucccaugacagcccaugcucuccaaacccuguggcuuugguuuucucauccagaauguuauacauuuggagacugugucagcucucucuuggaugggguuugcuugug

SEQ ID NO: 4190156 - RNA, 58 nt, Human
cacaaggagguccugaggaagcacgcuuccuugcugguguuucuuagguuuccuagug

SEQ ID NO: 4190157 - RNA, 70 nt, Human
cacaaggccaagucucugugaagacugcugauguuagagauauauuuauauagagauuugugcaugugug

SEQ ID NO: 4190158 - RNA, 57 nt, Human
cacaagggagcuuagaaaacaugugucacuuacuacuuucucaguaaguccuuugug

SEQ ID NO: 4190159 - RNA, 56 nt, Human
cacaagguuuacauuuauauuuuccugauuuucuaggaaaauuagauggaccugug

SEQ ID NO: 4190160 - RNA, 58 nt, Human
cacaaguaccagggauugccggaaccuucaggaggacuuugggcuuuuacuggacgug

SEQ ID NO: 4190161 - RNA, 93 nt, Human
cacaagugcauuugucauugaauguguacacgauuguuugaggaaaguauuugguuuaacgaauugugcauaauuccacuguuugcacuugug

SEQ ID NO: 4190162 - RNA, 78 nt, Human
cacaauagggucagagucaggugcaguauuauaacccagaaacagugcuucaaggacacugacuuuuuauucccagug

SEQ ID NO: 4190163 - RNA, 128 nt, Human
cacaauauauggaauauuuguuaauauaucaucuguguaucugugcuuagaugcugauacccaguugcucugaaauaacugaugccagaucaugucauguaauuaucuaguaggggccauauggagug

SEQ ID NO: 4190164 - RNA, 77 nt, Human
cacaaucaguuguauccugccaugguccaucuucauauguggagggaaccuuggcuggauuggacagaaugauugug

SEQ ID NO: 4190165 - RNA, 61 nt, Human
cacaaucucuggugcuucugagagcaacaugaaauuguucucuacuucacaagggauggug

SEQ ID NO: 4190166 - RNA, 69 nt, Human
cacaaugggaugguaccacugaggauuuuauaaaauugggggagagacacuggaaccauccacauagug

SEQ ID NO: 4190167 - RNA, 82 nt, Human
cacaaugugguugaaagagcauggacuugaaauucaggcuggucugguucaagucuuggcuuugccaccuacuaaccaugug

SEQ ID NO: 4190168 - RNA, 72 nt, Human
cacaauugcuacuucguguauaaggcaggcuaugauaaugauauaauugaaacauauacaaaguggugugug

SEQ ID NO: 4190169 - RNA, 57 nt, Human
cacacaagcugcagcuggucacuaaaacccauuugugacuugucaaagaaaugugug

SEQ ID NO: 4190170 - RNA, 67 nt, Human
cacacacacaaaggaaugucauaucagcagucagacucccugggugucaacacuuccugguggugug

SEQ ID NO: 4190171 - RNA, 61 nt, Human
cacacacacagacauuugcucacacgauuguauauugagaauacauuuguuauugugugug

SEQ ID NO: 4190172 - RNA, 80 nt, Human
cacacacagauagagcucucagggcaagcucggcgggccaggucgagaaggcugauccuuggaguuuuccugcuguugug

SEQ ID NO: 4190173 - RNA, 64 nt, Human
cacacacaguuuuguauucuguugguuuaaccucucauacccaugggaauauuucccuguggug

SEQ ID NO: 4190174 - RNA, 74 nt, Human
cacacaccagaaagccugggacaaagccugggcuagagcccucaggauucauucucaggcuuccuggugcugug

SEQ ID NO: 4190175 - RNA, 55 nt, Human
cacacacucauuauauguguauaaugcaaauguauaugcauauauguggugucug

SEQ ID NO: 4190176 - RNA, 56 nt, Human
cacacagcuagugacaggagaaugcuagaaaguugauucaugcagugguugcugug

SEQ ID NO: 4190177 - RNA, 77 nt, Human
cacacagcuggaggcagcaccccaaaggggccgagggacauccucccuuggggaugcugugucuggaagggcuggug

SEQ ID NO: 4190178 - RNA, 58 nt, Human
cacacauaugagacguuuguuugcuuucaaagugaaaaagugaacauucauaugagug

SEQ ID NO: 4190179 - RNA, 61 nt, Human
cacacaucuuaucccaguuauucaaacacugaauaguuuaagucaggggauucggugugug

SEQ ID NO: 4190180 - RNA, 58 nt, Human
cacacauggguggggagcuaagugaugagagauuuauuccaacucugcauguauggug

SEQ ID NO: 4190181 - RNA, 88 nt, Human
cacacccugcauucacguugcuuccuuucuguuacacuauugauucuuucucuuggcagcugaggggaggcuuugauguggggaugug

SEQ ID NO: 4190182 - RNA, 59 nt, Human
cagacugaaaaucccugguaguaccuguaguuuccuuccaggacacgauuuuuagucug

SEQ ID NO: 4190183 - RNA, 117 nt, Human
cagacugcgaaacugaaugcuaagguccacguagaggacucaauguaacacaagagcuuacauuuccuugacuccucaacaccaguggccuugccuucuuauccuccccugcagcug

SEQ ID NO: 4190184 - RNA, 78 nt, Human
cagacuggaaaaucucugcaggcaaaugugaugucacugaggaaaucacacacuuacccguagagauucuacagucug

SEQ ID NO: 4190185 - RNA, 67 nt, Human
cagacuggagagcgcugagcugcuaugggaagccucacccccauacagcacaaagggccuuuaccug

SEQ ID NO: 4190186 - RNA, 58 nt, Human
cagacuguggcgucaggaagaaauuacccugguacauuaauuacuggcccauggaaug

SEQ ID NO: 4190187 - RNA, 61 nt, Human
cagacuguuauaguuugcacugguaauuaauaauuaauacauuucagacuguuauaguuug

SEQ ID NO: 4190188 - RNA, 78 nt, Human
cagacuuaaagagguuaaauuucucaggggcauaguacgaauaacuggcccaaagagcuuugaucucagccuugucug

SEQ ID NO: 4190189 - RNA, 72 nt, Human
cagagaaagcucuauguuaugcagaauuaagugcuugcuuaagaccuugaaguugcaaaacauuaaucucug

SEQ ID NO: 4190190 - RNA, 71 nt, Human
cagagaacaaagcugaggguuuaagccaaucuauuguuaucagcucacaauaaacuccagucuguuuugug

SEQ ID NO: 4190191 - RNA, 77 nt, Human
cagagaaccaaaaccugcuacuaaaggaucagcaggaacugcgccugguuccuuuguuaaggagguuuguuuggcug

SEQ ID NO: 4190192 - RNA, 106 nt, Human
cagagaagcaccguugaagauaaagcacauucuuuguuguaaguagcaaaagacugauacauucagcaaaagaaugguucauagaauuuuuaaaggguuucauuug

SEQ ID NO: 4190193 - RNA, 75 nt, Human
cagagaagucugagugagggugugagauaucuuugcaaaauucauaucuauauauuuuuauucuauacaucuuug

SEQ ID NO: 4190194 - RNA, 56 nt, Human
cagagacacuuaacaggaauggucuuggaucaugugacuauucuuugaugucucug

SEQ ID NO: 4190195 - RNA, 58 nt, Human
cagagacagcaaguugauuuccuggagcaauaccuagggaauuauucuuuuggcucug

SEQ ID NO: 4190196 - RNA, 63 nt, Human
cagagacagcacaguugguaaaauuguuauaguugacaaguuggaaagcagugcaugucucug

SEQ ID NO: 4190197 - RNA, 58 nt, Human
cagagacaggcuugcccuccaccaaaaagguggagacuccaggcacagccuuucccug

SEQ ID NO: 4190198 - RNA, 63 nt, Human
cagagagugggccucagagauccauuuguucaugccagauuucaaucucaacccuacucucug

SEQ ID NO: 4190199 - RNA, 81 nt, Human
cagagaucuaauuuaccauuuacuuuuuaaugacaaugguaaguuuuucugucauguaaagaguaaauggugacuuuucug

SEQ ID NO: 4190200 - RNA, 62 nt, Human
cagagauucuaauauaaggaugggggugauuuuuccccauaccugcaugugagaauuuagug

SEQ ID NO: 4190201 - RNA, 110 nt, Human
cagagcaaaugucaccuugucccugcaucagcuccagaaagguacacacagugggaauuacuccuuuguugcaugcuuuuggagggggcagagggacuauuacugagcug

SEQ ID NO: 4190202 - RNA, 59 nt, Human
cagagcacagagcuugggacaaggccaacaguucauacuugucucuuaccugaguucug

SEQ ID NO: 4190203 - RNA, 69 nt, Human
cagagcacucuuccuaggaagucagacuucccaggaaucccuuggugcugagagccuaggagggcucug

SEQ ID NO: 4190204 - RNA, 64 nt, Human
cagagcacugcuuggaggauuugcagcuuacucaucuguuuaucaguucuucaguagugugcug

SEQ ID NO: 4190205 - RNA, 55 nt, Human
cagagcagaagguccaagccugacaaccuguccuggcacuucuggaccugcucug

SEQ ID NO: 4190206 - RNA, 63 nt, Human
cagagcagauggagcuggaagaggggaagacaggcaacagacucugccaguauuaucugucug

SEQ ID NO: 4190207 - RNA, 56 nt, Human
cagagcagauuucuaaguauuggguguauuucucuauauacaugagucuguuucug

SEQ ID NO: 4190208 - RNA, 56 nt, Human
cagagcagcagagcuuccauggacagccaagacaccccugcaggcacugcugccug

SEQ ID NO: 4190209 - RNA, 95 nt, Human
cagagcagccagagugauucaaugaaacuuauaagaauaugaauuaaucauuuuaggucauaaugcaaguucauaaaugugugcucucuuuucug

SEQ ID NO: 4190210 - RNA, 61 nt, Human
cagagccacugcauuuuacagccucccuuacaguuggguguagcaacaugccugaguucug

SEQ ID NO: 4190211 - RNA, 59 nt, Human
cagagccaggccugcccucuuuuaaaguuacaagcaaccagaggggcagucggcuucug

SEQ ID NO: 4190212 - RNA, 68 nt, Human
cagagcccaauauagucagugucuauaucguuguuaaguucucaauagauauuugcugacugccucug

SEQ ID NO: 4190213 - RNA, 63 nt, Human
cagagcccagguguucuuugucccuguucaugcaguuccuaugaauaugcaugcaccucucug

SEQ ID NO: 4190214 - RNA, 94 nt, Human
cagagcccauggcuggggccacaggccuugcccgcagagcgucuccacccucauacacuccuggggucuccugugccuuucaaagccaccucug

SEQ ID NO: 4190215 - RNA, 64 nt, Human
cagagccccucgucuccaccaccagcuucugcuccacggcaggguaauaggcgcggggcuucug

SEQ ID NO: 4190216 - RNA, 98 nt, Human
cagagccuacucccugggguuacuugagggcagagcacuggggagccuccccgaguggggcccccacucuucccuuugccccggaugaguguucucug

SEQ ID NO: 4190217 - RNA, 60 nt, Human
cagagccucaucauccacuccacagagagcccaucacaguggcuggauagaugggaacug

SEQ ID NO: 4190218 - RNA, 79 nt, Human
cagagccuggcaccuuaccagggcuuugaagggucugcucccagcugcacuucagguucuggcagggcgucaaguugug

SEQ ID NO: 4190219 - RNA, 68 nt, Human
cagagccugguguggggcugcagaggagccuggcucaccaggccucugcuuuccacugccaggguuug

SEQ ID NO: 4190220 - RNA, 66 nt, Human
cagagccuucaucgcagccuuguucaguuuuaccugcucaacaggggcugguugaaagagcaucug

SEQ ID NO: 4190221 - RNA, 77 nt, Human
cagagcuauuccagacguucuccaaugggccaggcuucauuccugccucagggccuuugcaguuguuuuucucucug

SEQ ID NO: 4190222 - RNA, 76 nt, Human
cagagcucccagcagaccgcugugauggccgcagugcuuucugaggccuaauuucagucucugcuguaugucucug

SEQ ID NO: 4190223 - RNA, 70 nt, Human
cagagcucucccucagugcccuccguugugguuguaucacccucccaccagcugaguaggggagggccug

SEQ ID NO: 4190224 - RNA, 60 nt, Human
cagagcucugacagcuacagcccugaacuaaaggcccacucuucagcugcagagccccug

SEQ ID NO: 4190225 - RNA, 125 nt, Human
cagagcucuggcaguguccuacugguuggugguuggguuucuuugcccugccaugcuuuaagguaaguguuggcagugccaggaaaggauccuaacucugacuucuucgaaccugucagguccug

SEQ ID NO: 4190226 - RNA, 60 nt, Human
cagagcuggacgucugagcccuaaggacggcuuuugggaucucaaauccagcuaugccug

SEQ ID NO: 4190227 - RNA, 76 nt, Human
cagagcuggugaguaggugggaaaggcagcugugcgguuggaaguagggcuccuucaagccugucacuggguucug

SEQ ID NO: 4190228 - RNA, 84 nt, Human
cagagcuguaauuugcuaaucauauuucaucacucaugacaaugacugcacagaauuaugguuggugaaauuguuaagcgucug

SEQ ID NO: 4190229 - RNA, 79 nt, Human
cagaggaaacacagagguggccacucuuuuuugccaaccacccuggaugaagaaaguggaaucucuguuuuuauagcug

SEQ ID NO: 4190230 - RNA, 92 nt, Human
cagaggaaaguauuagaucaaaaucaagauuagagagaccaaguaguuuucauuuaauuuguguauuaaccguugaucauaccaguucuuug

SEQ ID NO: 4190231 - RNA, 79 nt, Human
cacuaaguaauuuccacuccuacguauuuugauauagagauguugcuauuuuucuauuuacagugcuagguacauagug

SEQ ID NO: 4190232 - RNA, 86 nt, Human
cacuaauauaaaugaaggagguuggagacuagagcaucucuaaguggcuuuuccaacuuuaaaauucauucuauggcucuuuagug

SEQ ID NO: 4190233 - RNA, 129 nt, Human
cacuacaggcccucuuugcagaacaucucauuuuagggugccuccaagccccccagggcccauaaggagugcugaggaaggcugggggcaucccaguggaggggucagcuaggcagaggucagaggacg

SEQ ID NO: 4190234 - RNA, 89 nt, Human
cacuacagucccuuacagccacacagggucuuagagaucaccugagucacucuacaguuaaggaaacuggggcccugcugggggaagug

SEQ ID NO: 4190235 - RNA, 61 nt, Human
cacuacccagggccugcuccccucugaccuuggaaaucggcugugcagccucuugguagug

SEQ ID NO: 4190236 - RNA, 130 nt, Human
cacuagacuguaauuuauaguaugguaguggauguaggaaaaguauacaaauacauuauguugucuucaugugccguuuacucuugcuacacaacugugccagauuugagaauuaauuguugucucagug

SEQ ID NO: 4190237 - RNA, 76 nt, Human
cacuagaguacacuguacacacaauugacuuaaaaaugguggugugaauauguuuguguguaugugugugugugug

SEQ ID NO: 4190238 - RNA, 60 nt, Human
cacuagauaguggcugcuuggaguaccacaugaaacaugauccagaggccacauccagug

SEQ ID NO: 4190239 - RNA, 90 nt, Human
cacuaggcacuauucucgguuguggguacagcagggaacagcacagaccaaaaucuuugccuucacugagcuuaugggauagugcuggug

SEQ ID NO: 4190240 - RNA, 70 nt, Human
cacuagguugaccaggcuggucuugaacuccuggccucaagccauccucccaccucagccucccaaagug

SEQ ID NO: 4190241 - RNA, 77 nt, Human
cacuauauucaugccugguuaugaaacaacaaacaaaugguauguucauauucuaaguaacuggcauucugauagug

SEQ ID NO: 4190242 - RNA, 84 nt, Human
cacuauggagcuguucauuggcaaggaaauuaguucuccugccguaaccagcaaggaacugaagcucuugcuaacagcuaugug

SEQ ID NO: 4190243 - RNA, 58 nt, Human
cacucagccugcaacggucucugucaugccagguuagaggaaccaggcaggcugagug

SEQ ID NO: 4190244 - RNA, 73 nt, Human
cacucagcuccuuucugaaaguguccucccuuaggccucuagaaacgccauggacuuuaggaagggccaagug

SEQ ID NO: 4190245 - RNA, 65 nt, Human
cacucaggaauggggcugggacuccucugauguucgaggugacagucugggcucuguucugguug

SEQ ID NO: 4190246 - RNA, 71 nt, Human
cacucauacacaagagcauguaacaauaguaaggacucucugagugccuguugcuguuauugugaugauug

SEQ ID NO: 4190247 - RNA, 74 nt, Human
cacucauccaaaauagauguuaaccuggaaauggucugaauucucuaagacugacaacuauuuggggaugugug

SEQ ID NO: 4190248 - RNA, 92 nt, Human
cacucccaugaaggcagccaagggugcucccgcagcuugaagagggguaccuggcucaggcuugggaggcccagggcuugccagagggagug

SEQ ID NO: 4190249 - RNA, 75 nt, Human
cacuccuucuuugaugugguuaauuaugaccucuugggguacauaccaaccuuaucaaaauccaucuggguagug

SEQ ID NO: 4190250 - RNA, 79 nt, Human
cacucgauuuauucuccagauggcgagacugugccgcccugccgcgagggaccaccucuuccacuggaguguaaaagug

SEQ ID NO: 4190251 - RNA, 84 nt, Human
cacucuaucuuuugagcaaggagaccuacauuuuauauaaucaaaauguguuuagaugguuuauugcuuguuuaggauguugug

SEQ ID NO: 4190252 - RNA, 66 nt, Human
cacucugaccaauaaauucaguguuuagagaaagauaauucacaugauguauguagggccggagug

SEQ ID NO: 4190253 - RNA, 79 nt, Human
cacucuggagggaguuaggacccggagccuauuuuucucugugugcccuuaauucugggccucacuuuuuucaucugug

SEQ ID NO: 4190254 - RNA, 58 nt, Human
cacucuugcucucugaggugcguguuauauuccaguacauuucccagucccaggagug

SEQ ID NO: 4190255 - RNA, 62 nt, Human
cacucuuggcggacuuuggaucacauguuugucccccuaaugcugaagagcugucaaaagug

SEQ ID NO: 4190256 - RNA, 92 nt, Human
cacugaaaguacaaagcagugguuauucagucacuacagagacaguucugcaaaagugauaaugugguaauuauuuaagacugugcuaagug

SEQ ID NO: 4190257 - RNA, 62 nt, Human
cacugaacuccuuguuuguccucuaacgccacaaaaccaaggcuaaagaaaggggcacagug

SEQ ID NO: 4190258 - RNA, 80 nt, Human
cacugaagauugaggccuuuguucauuguuuuuccgauggaaaagaaaagaaaccugaggcuuugcaagauuuuucagug

SEQ ID NO: 4190259 - RNA, 55 nt, Human
cacugaaggacaguaggaagggagauaccuuccccagccuuacugcccuucagug

SEQ ID NO: 4190260 - RNA, 61 nt, Human
cacugaaugcagguaagugacucacaugcuuugaaaaguuccuugacucacccugucagug

SEQ ID NO: 4190261 - RNA, 62 nt, Human
cacugacuuucugacacccucugugcuaugaugaaaaaagcgagggucagagagcgugagug

SEQ ID NO: 4190262 - RNA, 83 nt, Human
cacugagcuuuuccugcacccgcugaugccaggccuggagcuggccauggaaggcccuguggugaugggagaggcucacagug

SEQ ID NO: 4190263 - RNA, 82 nt, Human
cacugaggcccaggaagguggucuguggcucguguguuguugcuggcuguugagcuaggccugcuuuccugcccccucagug

SEQ ID NO: 4190264 - RNA, 55 nt, Human
cacugaguugggcuuuguuuugcuuaccuagcauugggacagucucagccucaug

SEQ ID NO: 4190265 - RNA, 104 nt, Human
cacugauaauaauaaucauagcaaucauuugucauauauaauacucuuccauguccuauagaggaguuaugguauugguugaugcaugaauauuauuuucagug

SEQ ID NO: 4190266 - RNA, 130 nt, Human
caaccaacaaaacuaaacaaaaccuccugaaaacuaaagagucuuuaugauugucaaaguaguaaaucuuucuuagaguuauuugagaugcuuugacagauauagaggggcuaccauuucagucugggug

SEQ ID NO: 4190267 - RNA, 68 nt, Human
caaccagauugugagauaacaugguguggugguguacagccacauuuaaaaaauccacgaucuuguug

SEQ ID NO: 4190268 - RNA, 58 nt, Human
caaccaguuggcaaccagcaguuggacugccaauuguggaaauuuuguggacugucug

SEQ ID NO: 4190269 - RNA, 94 nt, Human
caacccauuuugaggacuucuuaaugggaaaugaaugguuucaaagaguauuguccaucuccacauuaaugcugauuuaucaaaaugucaguug

SEQ ID NO: 4190270 - RNA, 60 nt, Human
caaccccaggcuggaggagucucuguggacaccagagaccauugcuaggcuggcggauug

SEQ ID NO: 4190271 - RNA, 64 nt, Human
caaccuaguacuccuagcccugaagggcaggggaugccacaucagcagcagaagugcugggaug

SEQ ID NO: 4190272 - RNA, 62 nt, Human
caaccucauuugaacuuaauuuaggaccauguaacuugguucuggccaguagauguggguug

SEQ ID NO: 4190273 - RNA, 79 nt, Human
caaccuucccagggcaauaggaaccagaucugucucccaagcuccagacaaguccauccuacugccuucuggaugguug

SEQ ID NO: 4190274 - RNA, 92 nt, Human
caacucagggaaagugaaaauuccagccaaucaacuauuguuuggucgaagacaagccaaacaauggcucuggcugauuucucccagaauug

SEQ ID NO: 4190275 - RNA, 67 nt, Human
caacuccuuuggccugucauccuggcugucagauugggcuaggagcugucagagugccagaggguug

SEQ ID NO: 4190276 - RNA, 61 nt, Human
caacucucaguaaauuucugccccaggcuccuugagaauggguuggauauugaggauguug

SEQ ID NO: 4190277 - RNA, 73 nt, Human
caacucucuauagaaagcuugaaguguugcgccacaaauauuuccaggcuguuuugugaauguucgaguguug

SEQ ID NO: 4190278 - RNA, 64 nt, Human
caacucugccuauagaagcuguucccagagaaaaucugggacugcagugaaggcacauggguug

SEQ ID NO: 4190279 - RNA, 70 nt, Human
caacugcaaagauuuucagugccuaaaacaagcucaccugucuugguucuucugaaacacguagcaguug

SEQ ID NO: 4190280 - RNA, 61 nt, Human
caacugccuggguccaauucuggcuuguuuacuuacuggacaagugacccugggcaaguug

SEQ ID NO: 4190281 - RNA, 87 nt, Human
caacuggacauugaguauuucuuuucucugauauauggauugugaaaaucacagagagaaauaacaugagucuuaauguguauguug

SEQ ID NO: 4190282 - RNA, 93 nt, Human
caacugugggcacaucuuuuguguggugcuccucuuugucucugccagugacuagcagggauauuauauaagcagcaaaugugcucucuguug

SEQ ID NO: 4190283 - RNA, 55 nt, Human
caacuucacugugccucuaguuccuaugauuugaacaggagaaacagggaaauug

SEQ ID NO: 4190284 - RNA, 62 nt, Human
caacuucagcccaauggccuugaccucuggacccagaggucacagggcacuggcugggguug

SEQ ID NO: 4190285 - RNA, 87 nt, Human
caacuugaaacugccaguauucacguuccugccguucaacaaaacuugagacuuuucaggccugaguguggaagucuuuuuagguug

SEQ ID NO: 4190286 - RNA, 70 nt, Human
caacuugguugaaugcucucuugaaauucugaauaauucuagaacagggagccccagcauuuccauuuug

SEQ ID NO: 4190287 - RNA, 57 nt, Human
caacuuguucuugguagaucuauggugccccaguggucccugacagcgggcaaguug

SEQ ID NO: 4190288 - RNA, 67 nt, Human
caagaacgguacuguuaguccugcucacagcugcagccccagcacuuaggacagcagcugccacuug

SEQ ID NO: 4190289 - RNA, 66 nt, Human
caagaagaaaaauuaccugugauucuccucuggucagaaucuucagaugauuugucacucuuuuug

SEQ ID NO: 4190290 - RNA, 59 nt, Human
caagaagaagcuuccuuaagucuagaugucacugguggagugaggcaagcuuuuucuug

SEQ ID NO: 4190291 - RNA, 61 nt, Human
caagaagaugccccuguagcucuuggcuuaaggaggaugagagauacauggagcaaguuug

SEQ ID NO: 4190292 - RNA, 59 nt, Human
caagaagcagggucuuagacuuucuguguaaccagaaacaggcuuauauuuugcucuug

SEQ ID NO: 4190293 - RNA, 76 nt, Human
caagaagugcugaaacugagguuggagaaggcagugagaggcaaauucagagucuuaacuauucagagucuucuug

SEQ ID NO: 4190294 - RNA, 70 nt, Human
caagaauguauuugguaggaugguacaugguuaaugguauuguguaaucaccugcacaaauguguuccug

SEQ ID NO: 4190295 - RNA, 55 nt, Human
caagaccucaaaaugagagggggggacauaaugcuucucaauuucauagguuuug

SEQ ID NO: 4190296 - RNA, 69 nt, Human
caagacgcagcgaggugaaggguacaagcucauucauaccagggcuuuccccucuucucgugguccuug

SEQ ID NO: 4190297 - RNA, 78 nt, Human
caagagaggaagugacagccugaggucacucugggggucgucuagacaagacaccaggucuguuguccuccaaccuug

SEQ ID NO: 4190298 - RNA, 64 nt, Human
caagagcaggugcugcuuccaugaaucuggcgaagaauuuugagauauaguggccuaguuuuug

SEQ ID NO: 4190299 - RNA, 59 nt, Human
caagaggugguaggugcaggauucaaacuuaggggucuggcucccagccugcucucaug

SEQ ID NO: 4190300 - RNA, 93 nt, Human
caagaguaugugucaaauaaaugaaugggaauagauggauauuucuugugucuauuuuaacccucuuauauauaccaaggaacacaauuugug

SEQ ID NO: 4190301 - RNA, 76 nt, Human
caagaguugaaaagccagaggaacuugaugacuguaaaugcauuagaaucaucuucuuuuggguuuaguauccuug

SEQ ID NO: 4190302 - RNA, 104 nt, Human
caagaguuggugacuuuucauguuggcagauugucuaggguugcgcgguaaauggcagagccagauccgaacccaggccugccuaacccaaaagcccaagcuug

SEQ ID NO: 4190303 - RNA, 73 nt, Human
caagaugugcaguucauggcaggauuugcaggucaccauguucuaccucccauggagcucuguccauuucuug

SEQ ID NO: 4190304 - RNA, 71 nt, Human
caagauuacaugcagugccucuggauucuugcugguccuuacagcagaaaucuugucugugugucuccuug

SEQ ID NO: 4190305 - RNA, 65 nt, Human
caagauucauuuuguccuugucccuuugcaguuaaaugagggccacacauuggacauggaucuug

SEQ ID NO: 4190306 - RNA, 71 nt, Human
caauuacuuagcaaggcugccuggagaaucaugucuaccuuagcuuacuucuccggcuuuguagguuuuug

SEQ ID NO: 4190307 - RNA, 64 nt, Human
caauuaguucagagaccuuucauucccugcucagaggaaugaaacacuucugauucucaaguug

SEQ ID NO: 4190308 - RNA, 72 nt, Human
caauucaggcuucacagcuuggagccuauggaagccaggagggucacaaugugugaauugggccugguguug

SEQ ID NO: 4190309 - RNA, 76 nt, Human
caauucgcuggguucaggacuggggcccuugugucccccuuguggggcaugaggucauucuuggauuacagaguug

SEQ ID NO: 4190310 - RNA, 73 nt, Human
caauugaaauguuguccugucucuugaaguauaggauuuugugucaaaugaggcugaugaauguggucaguug

SEQ ID NO: 4190311 - RNA, 99 nt, Human
caauuuaaguaaaacaucuuuuaaagguagaaaaaucaauuuauugcccugcaaagggcaauaaaugacuucugcauugaggauaaaguacugaaauug

SEQ ID NO: 4190312 - RNA, 86 nt, Human
caauuuacaguuguucauugcugguauauaggaaagcaauugaccuuuguauguuauucuuguauacuacaaucuuucuguaauug

SEQ ID NO: 4190313 - RNA, 77 nt, Human
caauuuggguaaacaagugauacaucuagucuauaaacauauguugaugguguugguggucacuuuuaagaaaauug

SEQ ID NO: 4190314 - RNA, 96 nt, Human
caauuuguuuaugccacuuuggugucugaaaauaacaguaaaaauaaauuuaaaguauuuuugacaggcauuaccagagaaucauuaauaaguaug

SEQ ID NO: 4190315 - RNA, 71 nt, Human
caauuuuguugcucuauuaccauucuagauucaccagcuguuucuugauugguuguauagcuacuagauug

SEQ ID NO: 4190316 - RNA, 60 nt, Human
caauuuuuacauuggcguaucauaaugaauaucuaaauauuaugauacaggugaaaauug

SEQ ID NO: 4190317 - RNA, 111 nt, Human
caauuuuugauaucacuucaugucauuuuagagaguaaguuuuccuguuuuauuaauguuuauauuuaagcugaauuuucuaaaagaauugugaguguuuuuauucuauug

SEQ ID NO: 4190318 - RNA, 55 nt, Human
cacaaaccuucugcagccuguacugcuacagcacgaggcugcagaaucaguugug

SEQ ID NO: 4190319 - RNA, 110 nt, Human
cacaaagaaauauagcuccugucaagaaaaugccugcuggugucuucaagguuuugguugcagaagaauugggcaaauuucaaggacgcuggaaacuuugugacuuugug

SEQ ID NO: 4190320 - RNA, 129 nt, Human
cacaaagugauggauaaccccuggacugugauuugagggauucuggaaagaguaucuugaucaaaauaauaccaucugcccuaugucaggauguccaaaauccagccauugggguuauaguccuuuggg

SEQ ID NO: 4190321 - RNA, 65 nt, Human
cacaaauagauuuugaaaaguugcuuccaaaauuuuuagaagcacugcauuucaagaucagugug

SEQ ID NO: 4190322 - RNA, 61 nt, Human
cacaacuucagggaaacaugaagcauugcauucugugcuaacggugcccccuggaguugug

SEQ ID NO: 4190323 - RNA, 75 nt, Human
cacaagcauuuagugcaauucagagaacaauagauucuuucugauguaaaauucuugguugucauguugcuagug

SEQ ID NO: 4190324 - RNA, 95 nt, Human
cacaaggaaaaugauucuagaauuuaaauuugccaaguuaagcuaagcuaugugcaaauuaaguagauuuuccuguguauauuauuuuccaugug

SEQ ID NO: 4190325 - RNA, 66 nt, Human
cacaaggcauccaugguggucgcugaguacuugcuggucucagacucccacauggagccaucggug

SEQ ID NO: 4190326 - RNA, 83 nt, Human
cacugauggcaauuguaauuuuguaaagauuuaugaguuguaauuuuguaaagauuuaugaaguucaauuagagccaucacug

SEQ ID NO: 4190327 - RNA, 56 nt, Human
cacugauucccugugaagcagggcagcgcuucagcucucaugcaguggggggugug

SEQ ID NO: 4190328 - RNA, 104 nt, Human
cacugccuguggccccuucucuggagggcugcccggccagcagcaaccaacugacccggggccauguggcacccuccccggaggccaaggggccacagccagug

SEQ ID NO: 4190329 - RNA, 59 nt, Human
cacugcugggcagaggcugcaugacaauauggguaacacgcaggaucugccuagcauug

SEQ ID NO: 4190330 - RNA, 89 nt, Human
cacuggaugcuggcaggauuuauuggugggaaguuauggcaaacaucuugauggcuuuaaaucuguauucauagcuaguaucuuuugug

SEQ ID NO: 4190331 - RNA, 81 nt, Human
cacuggauuaggaguuggugagcaccaggcuuuuccacagacuagauggagacccugggcacaccauuuccccucacugug

SEQ ID NO: 4190332 - RNA, 60 nt, Human
cacuggauuuaggacuaguccaagaucuugaucuagauuuugaccuaggccuagacugug

SEQ ID NO: 4190333 - RNA, 80 nt, Human
cacuggcccuuuaggcugaaaggagaggugaaggacgugagucucccucccucucucuuuuugcugccagggguuuagug

SEQ ID NO: 4190334 - RNA, 85 nt, Human
cacuggccuguucugguuuugcauucacagaauuauuuucauggauuugauucuacaaucauguagauccuaguuuagguaggug

SEQ ID NO: 4190335 - RNA, 55 nt, Human
cacuggcuaaagauaagcucaauagaucugugggagcacagcuuuaagccaugug

SEQ ID NO: 4190336 - RNA, 129 nt, Human
cacuggcugucugcagugguaacaaccauggccuaguuccaggggcagcagugauggugcuggggcagcaucugaaguguugucaccuggguuugggcuaaugcuucaccacccaguguucagccucug

SEQ ID NO: 4190337 - RNA, 123 nt, Human
cacugggaacguuggaacuuuucagaaagcauuuuuguguaagauucugcaaggcagaucuuuagagaggugucauaaucaguuuugcauguguuuuguuugagucaaccaacguuauuugug

SEQ ID NO: 4190338 - RNA, 56 nt, Human
cacugggaauaucaaccauugagacuuucuccuuucuuuguggauaaucuccagug

SEQ ID NO: 4190339 - RNA, 61 nt, Human
cacugggcaggauacuucaugggacucugcuagcucaaguccugaagagcccugcucugug

SEQ ID NO: 4190340 - RNA, 130 nt, Human
cacugguuagagaaaggaaacguggcuggagguuaugguuauccucaaaagaggaaaggugaacuucuucuacaaaugagggucaucauaaaacauuuccagcggagcguuucuuuuuucuucuuccaug

SEQ ID NO: 4190341 - RNA, 83 nt, Human
cacugguugaacugagggguuggagagugaggugaaaggcagaucuuccacgcuuucauaccucuugaauuuugaaccaugug

SEQ ID NO: 4190342 - RNA, 73 nt, Human
cacuguaauucuuggggcugcucugacaauuaacaaacacaaauguccacguagcaccuuagcauuucuagug

SEQ ID NO: 4190343 - RNA, 69 nt, Human
cacugucacaccucuguggacaacucccagugaugucacugagcauggcucacagagaguggacuugug

SEQ ID NO: 4190344 - RNA, 72 nt, Human
cacugucccugccucacccuaggccaacuaauacaaaucucagggcagccaggguggggcaggcccacugug

SEQ ID NO: 4190345 - RNA, 125 nt, Human
cacuguccugucacagguuucauggguuuugagaggugaggcaugaggcauccauuuugcucaugcauguggucacggugccacagccucaugauuuuagaguccugguuguggcaguggcagug

SEQ ID NO: 4190346 - RNA, 76 nt, Human
cacugucugggucuacauccucuguucuggcuuuuaucacugugacuguggcuacucagagggucccuagauagug

SEQ ID NO: 4190347 - RNA, 62 nt, Human
cacugugauguggguuuuauuauuuccaguacagaugaggaagacugaggccugcaucagug

SEQ ID NO: 4190348 - RNA, 82 nt, Human
cacugugauuaucuacuggcuugacucucucccgucuagacucuaagcuccuagagagaagggccuguauguaaucacccug

SEQ ID NO: 4190349 - RNA, 67 nt, Human
cacugugucuggagugagcuggguuuuucuucugcuguuggccuggcucacucaugcagccgcagug

SEQ ID NO: 4190350 - RNA, 56 nt, Human
cacuguguguguacuuacaaagggcaugcuuuggagugcagaauagacaugcagug

SEQ ID NO: 4190351 - RNA, 72 nt, Human
cacuguguucuauuuaucuauuucugaaugaccaaagaccaccgguugacccaguuguaaaagagcucagug

SEQ ID NO: 4190352 - RNA, 103 nt, Human
cacuguuauuuuucuaugugucuuugagacucugcuacagugaaacaugaaacagaacaaauuagcaggcaucucagagauaauuaaugguuugaaugaugug

SEQ ID NO: 4190353 - RNA, 56 nt, Human
cacuguucaucaaaacugcucuuaaggaaauuaaccuggcaggaagaugaagggug

SEQ ID NO: 4190354 - RNA, 69 nt, Human
cacuuacaugcuggugacuguagacaaggcuucccuccugucuagcgcuggucuccugugugucaagug

SEQ ID NO: 4190355 - RNA, 57 nt, Human
cacuuagugcccuggcccuuacaccuauaaaaugagugucaugcuggggcaugggug

SEQ ID NO: 4190356 - RNA, 81 nt, Human
cacuuauguguuccaguauuuuuuauucugugguauauaauguaugucaaaguuaagaaauagggauaaaaacacugagug

SEQ ID NO: 4190357 - RNA, 83 nt, Human
cacuucaacaccuggugcauucaugugccggcacaaucagugauugguggguuaaugagugacugcgugagacugacuuagug

SEQ ID NO: 4190358 - RNA, 90 nt, Human
cacuucauucauucagucagucaaucaagguagucuagagccuuuauuuuguuccagacacaguguugaaggcuagugaaauaaacagug

SEQ ID NO: 4190359 - RNA, 119 nt, Human
cacuucucagauguuuguugaauuaaacauguugacaucuuaccuccuuuuuugauuucuaguuucucaaagauaggguaugugcacaugguuuaaaaaaaaaugaaaaucugaaagug

SEQ ID NO: 4190360 - RNA, 91 nt, Human
cacuucugggggaguugcauccuguucuagguuugggacacuggaguucuaauauuuuuaaggacacaaaagaugacucuucuagcaugug

SEQ ID NO: 4190361 - RNA, 91 nt, Human
cacuucuugaauaguccuguccauuucagugucuugugaugaagagauuuuauuugaagacuagugaaaauauagcgaaauucauucagug

SEQ ID NO: 4190362 - RNA, 80 nt, Human
cacuugaggaccuuauuaaagaccggacacuucuuuuugcuaggaaguuuagucuugucuuaguaaaucugucuccggug

SEQ ID NO: 4190363 - RNA, 64 nt, Human
cacuugauguugucacuauugccaugugacacuuugguuagucuaauagugacucaugaagcug

SEQ ID NO: 4190364 - RNA, 66 nt, Human
cacuugggugcaagcaaguggcacagaguccauuggcacucaggcagcuaguuuugcaccucugug

SEQ ID NO: 4190365 - RNA, 70 nt, Human
cacuugguuccaagagucagcugaucccaggcggacuucaaugucuagaggaagcuucaucuuucaagug

SEQ ID NO: 4190366 - RNA, 61 nt, Human
cacuuguauacaguguacacauugauguucaucaauggauaaacaaauugugguauaggug

SEQ ID NO: 4190367 - RNA, 71 nt, Human
cacuuucacagcugugcuuaugaugcuaaugccaaggugcuucagagaucaugagacacauuauggaaaug

SEQ ID NO: 4190368 - RNA, 63 nt, Human
cacuuucacuguacgccaggcucuccuuggagcacccgcuggucccugcaguucuagaaggug

SEQ ID NO: 4190369 - RNA, 107 nt, Human
cacuuuccaguccaugguuaaauacaguauaaugacugaccagcuguaucuugacuuuuacagcaggaauuaacauauaagcguguuuggcuauaccugagaaauug

SEQ ID NO: 4190370 - RNA, 57 nt, Human
cacuuugcaggguggugggaggcuaaauuauuccaccucucucacugcuguggggug

SEQ ID NO: 4190371 - RNA, 81 nt, Human
cacuuuguauuuauaaacaguaccacggugcuuaccauaaaguuggcaccccucagcuuguuuacuaaaugaauaugggug

SEQ ID NO: 4190372 - RNA, 70 nt, Human
cacuuugugaggccaaggugggcagaucacuugagaucaggaguuugagaccagccuggccaacauggug

SEQ ID NO: 4190373 - RNA, 61 nt, Human
cacuuuguuaauuugguaugguggugccacacauuaucacuguacagcauuaacaaggcug

SEQ ID NO: 4190374 - RNA, 86 nt, Human
cacuuuuauguuucuugcuguuuucuacccucaagaaguaccacuuauaauuugggggucggagggggcaaugaaaacugaaaaug

SEQ ID NO: 4190375 - RNA, 79 nt, Human
cagaaaaagauuugcuugugcuaugaaaguuggagaacucacuguuuugaauauucauuugcagaagaaguauuuuuug

SEQ ID NO: 4190376 - RNA, 57 nt, Human
cagaaaacaaaccuauccugagacccaagcuguguccuaggaugaaagugguuucug

SEQ ID NO: 4190377 - RNA, 67 nt, Human
cagaaaacuagucacaugaucacaggaucgugaagucucuugauccagaaauuauguaacuguacug

SEQ ID NO: 4190378 - RNA, 88 nt, Human
cagauguagagaaugaaauggauggaauugacauuuacaucugcggauguagagaacgggauuccauccguucuauccucugcaucug

SEQ ID NO: 4190379 - RNA, 65 nt, Human
cagauguugagugaugggccagucuguguuauugucagacuagaacugcccaccaguuaacgcug

SEQ ID NO: 4190380 - RNA, 110 nt, Human
cagauguuguaaagauacucuuucaaguuuccugugcacuaggaaucugcagauguacguuggcagggcuacagucagagugcagcgggaggcugggguuuacacaucug

SEQ ID NO: 4190381 - RNA, 65 nt, Human
cagauuacugggccucauccccagaguuucauauugaauaggucugaagugggcccacaaaucug

SEQ ID NO: 4190382 - RNA, 115 nt, Human
cagauuauuucuucuugcucauuaacauccuuuucuuucugacuggauaacuccuuuuaccaauucuuguaggacaggucugguguugaugaauuccucagguuuuguuugucug

SEQ ID NO: 4190383 - RNA, 63 nt, Human
cagauuggagauggaagaaaagucaguaagccuggacucugauuugagaaauuuuucaaucug

SEQ ID NO: 4190384 - RNA, 103 nt, Human
cagauuguaagucuuuaguaaaugucuuugucacguugggcugccauaacuaaauaucacagaugguggcgugaacaacagacauuuauuucuuauaguucug

SEQ ID NO: 4190385 - RNA, 60 nt, Human
cagauuuacucccugcuuccgcccaguggcaauaauuggguacugcagagggugagucug

SEQ ID NO: 4190386 - RNA, 74 nt, Human
cagauuucagcucauauauuaucuuugaucugcugcucuugccuuccagaagugauauauugagaaggauucug

SEQ ID NO: 4190387 - RNA, 68 nt, Human
cagauuucaucucucuaaaagacaguccaaagauagaauaggaaucuugaagagaguagugaagauug

SEQ ID NO: 4190388 - RNA, 87 nt, Human
cagauuucugaguaucaguuuaguaggugauaucaauugcaacuucgcagaauuaucacaaguauuaaauaaaggacuuaguaucug

SEQ ID NO: 4190389 - RNA, 69 nt, Human
cagauuuggcccaugggccacaguucaccaaucccugcuuuaggaauuuccuuuguggccccaaauuug

SEQ ID NO: 4190390 - RNA, 96 nt, Human
cagauuuugaaauuguauauuccucauauucagugguugaaugcaccugaaucccugcuguuccuugaccacugcauaaugaguuuucaagagcug

SEQ ID NO: 4190391 - RNA, 90 nt, Human
cagauuuuuaaauucuguauuuucuaugaggaugggcaaucauaauauagggaguguaaacuguagaaaauacuuucuuuugaagaauug

SEQ ID NO: 4190392 - RNA, 108 nt, Human
cagcaaaaugaaagagcagagccuacauggguuccuaggacaggaccuggcuucugaaccgugaaggaggcacaggaacuuacuggccacuuguggccugcgaugcug

SEQ ID NO: 4190393 - RNA, 65 nt, Human
cagcaaagguagaagcacaggacucaauauaaugguugccugaauaaaugcuuccacuuuuacug

SEQ ID NO: 4190394 - RNA, 92 nt, Human
cagcaaauguuuagugagaaauguaggcauaauuauuuuacugaaauauuuuacaaagaaaaaugugcuacuuuugugcuauuuuugugcug

SEQ ID NO: 4190395 - RNA, 130 nt, Human
cagcaacagaagaucagagcagagauguggcuaaacaguagcagguaugaaaagacuuagagguucugguuucuguaagcuucaaauaucugugaugcuugugccaaaacagcuuaaguagacuguauug

SEQ ID NO: 4190396 - RNA, 62 nt, Human
cagcaacccgggggaccuuucuucuccuuguuggccuugaccccaaguguucccgggugcug

SEQ ID NO: 4190397 - RNA, 57 nt, Human
cagcaacuggucauugcucuccugaaggcacagccauauggguaauggccacugcug

SEQ ID NO: 4190398 - RNA, 63 nt, Human
cagcaagagagcagcgugcaagggaaauacacagaucaacccuuggagcuguaaucuugucug

SEQ ID NO: 4190399 - RNA, 63 nt, Human
cagcaaggacugggcaugugaaaugccaaugguuuggcuaaucaacacgccacagcuuagcug

SEQ ID NO: 4190400 - RNA, 90 nt, Human
cagcaagugaauaacacagcuagugaguggcagagcugggcuuucaacucaggcucugggucccacgucauugcugucuaugcuaugcug

SEQ ID NO: 4190401 - RNA, 82 nt, Human
cagcaauaacaacuugauuguguagcacaauccuggagccugaacagccaaggauaugcacauucaaaaauugcuaaugcug

SEQ ID NO: 4190402 - RNA, 57 nt, Human
cagcaauaagguaagcuucuccuuauaaccuuuuuaggaagaagucccuuugugcug

SEQ ID NO: 4190403 - RNA, 57 nt, Human
cagcaauauacacagucuaugggagacauuuucucuauggguuaaaguaaguuguug

SEQ ID NO: 4190404 - RNA, 71 nt, Human
cagcaaugugauguuucccuauguuucuacaggccccgguaaaggucagggaaauucaagggagauugcug

SEQ ID NO: 4190405 - RNA, 61 nt, Human
cagcacaguacaaggcacggaugcggaaccggcucccaaaccccgugccucacugucccug

SEQ ID NO: 4190406 - RNA, 61 nt, Human
cagcacaguguaguaaguuuggaacaagacacaccugaaaucaaaucccugcucugugcug

SEQ ID NO: 4190407 - RNA, 66 nt, Human
cagcacauaaucagugauugugacuccaguccagguccacucaauacccacuuaucauaugugcug

SEQ ID NO: 4190408 - RNA, 90 nt, Human
cagcacaugaacguggaauccucacauuggcccagccaaggcauucucucacccuggcugcagugcuugagaugucacguucacacucug

SEQ ID NO: 4190409 - RNA, 57 nt, Human
cagcacccagggguccugcgcaggagaaaccgcugugcugugcucuuuaaggugcug

SEQ ID NO: 4190410 - RNA, 59 nt, Human
cagcacccucggaggcugccgugggccccccuggccacaaggcaguggaaagggugcug

SEQ ID NO: 4190411 - RNA, 60 nt, Human
cagcaccugcucuuagacacggagaucaaaugacaaacccuuggguuaggagcagggcug

SEQ ID NO: 4190412 - RNA, 84 nt, Human
cagcacgugcuacuggaagaauaaugggccuuagagcuagcaaaacugaguucaaauccugcuuaugcuaccaguugugugcug

SEQ ID NO: 4190413 - RNA, 70 nt, Human
cagcacguugugggagcuuugcuauuagauaucgucaacagcaucuggcaaaggcaaccacaguucuuug

SEQ ID NO: 4190414 - RNA, 64 nt, Human
cagcacucuggcuucguuaaguuguggguguuaugugguucgcguuuggaagcagaggguguug

SEQ ID NO: 4190415 - RNA, 79 nt, Human
cagcacuggggucaccaggauugggcuguaggccugcauggacgaugcgccgcguggcagucuuggugacugggugcug

SEQ ID NO: 4190416 - RNA, 68 nt, Human
cagcacuuaggaagcaggccuaaaauuuggcaauauauuaucaaaagagcucugcuuccuaggaaaug

SEQ ID NO: 4190417 - RNA, 62 nt, Human
cagcagacuguggcuucuuggagggcaggaacugauugccuuuuuccuuggccaaagugcug

SEQ ID NO: 4190418 - RNA, 78 nt, Human
caggaucuucuccugcuucaacugauggacacgcucaaugugucuaagagguguucagugcuguuggaggagacucug

SEQ ID NO: 4190419 - RNA, 78 nt, Human
caggaugagucugcucaugcuaccgcgggccgcccagcaaggaagcaggcugcccgccaggcuggcacgcgccucuug

SEQ ID NO: 4190420 - RNA, 96 nt, Human
caggaugccucuauguuuuccuaagaugaccuuauaaagagcauuuaaucugacugggaugcaaucuucucaucuggaaaacaaagugacaaucug

SEQ ID NO: 4190421 - RNA, 56 nt, Human
caggaugggauguagugggcccuucccagagaugccuagaacuaacccauguccug

SEQ ID NO: 4190422 - RNA, 106 nt, Human
caggauguagaucauugaucccuaccauugcugagacauugcuaaucugauauuuauccagagcgcacugucugcaggcaaauuaggguuuuaauucaccaucuug

SEQ ID NO: 4190423 - RNA, 84 nt, Human
caggauuaaggugaggggaguaaagccauguuacacagauacaaaaaacauucaguaaucgcaaugguucccucaccucaccug

SEQ ID NO: 4190424 - RNA, 72 nt, Human
caggauucuaauuaguucuacauguuucuuagaccccacugucucaaacauggcugcgcuauggaauaccug

SEQ ID NO: 4190425 - RNA, 69 nt, Human
caggauugagaaugaagggacauuuuggagcccuuguggugguacaguucuuuuuauaucuagaucuug

SEQ ID NO: 4190426 - RNA, 81 nt, Human
caggauugcuugauuuggcaguguauucauaaggacuuggguucuuuaugcccgaaugcacugccauuucagugauugcug

SEQ ID NO: 4190427 - RNA, 66 nt, Human
caggauugguuucauaggcaugugaccuauguuguugcauagguacccguacuuagaaagauccug

SEQ ID NO: 4190428 - RNA, 66 nt, Human
caggauuuuuuaaagucccuagacuggugaccugaaccacuaauuagagaugauuaaaaaaucuug

SEQ ID NO: 4190429 - RNA, 58 nt, Human
caggcacaagaucggcuagauaucauaucuagguguuuagcucugacuaugugaucug

SEQ ID NO: 4190430 - RNA, 76 nt, Human
caggcaccaagagaaucacuaauuuauucaaagaugauuuucauuuacgaauagauaagugacuauuuggaaacug

SEQ ID NO: 4190431 - RNA, 55 nt, Human
caggcacccucugaggggaagccaguccugggcaggguauccccaggguggccug

SEQ ID NO: 4190432 - RNA, 68 nt, Human
caggcaccuuugugcaugggcaccugcuaggugcggcggugagaguguaugugcauaguagguguuug

SEQ ID NO: 4190433 - RNA, 57 nt, Human
caggcagaagaaguggaaggacuugacuugcugagucuuccagccuucaucucucug

SEQ ID NO: 4190434 - RNA, 73 nt, Human
caggcagagcgguggccagcagugaaaggcagacccacggugggguugguccucuggccgcagcucagcucug

SEQ ID NO: 4190435 - RNA, 72 nt, Human
caggcagaguuagagcaacuggcucaucgcuucauucuaguguauaucauguugcauuuaguuaucugucug

SEQ ID NO: 4190436 - RNA, 56 nt, Human
caggcagcagccacucugguauuuguguguuucgcaguccuacaguguguuuccug

SEQ ID NO: 4190437 - RNA, 67 nt, Human
caggcagcugugccuugcugcacgguggcugcaccuggccccugcagugcuccgccagccccgccug

SEQ ID NO: 4190438 - RNA, 70 nt, Human
caggcaggagccagggauuccaggaauuuguaaccuucuguguguccuggccugcucugguucuuucuug

SEQ ID NO: 4190439 - RNA, 70 nt, Human
caggcaggcugcuuuuuguucaagguaaacaaaaauauuaaaauuguuuaacaucgagcuagucugccug

SEQ ID NO: 4190440 - RNA, 62 nt, Human
caggcaguggcucacagcaacccaugugauuccgugauacuugcaaggagccacucugccug

SEQ ID NO: 4190441 - RNA, 55 nt, Human
caggccagaagccagaaaugcuuuaauguugccaacaaaguaugcuuuuggcuug

SEQ ID NO: 4190442 - RNA, 78 nt, Human
caggccagagagggcucacugagaaagcaguucuugagcaaagacaugaaugugugcucuugagccuucacaugucug

SEQ ID NO: 4190443 - RNA, 56 nt, Human
caggccagcuggaggggcagcugcugccgacugaggagcuggcccccgguggccug

SEQ ID NO: 4190444 - RNA, 94 nt, Human
caggcccaucucuguguccagggccacacggaagggaacauucgcaucugcaugcugcccauguugccuucgcuguggucagagauguggauug

SEQ ID NO: 4190445 - RNA, 64 nt, Human
caggcccauucuaggcuugcuaaaauuaauccuugagcagcuugaaauauuaggagauggccug

SEQ ID NO: 4190446 - RNA, 62 nt, Human
caggcccucugaguagcugcaaacauucucaaaauguugaaacagaacucucaaagguccug

SEQ ID NO: 4190447 - RNA, 129 nt, Human
caggcccuggguaccuggucucugauggcauggggucugugcaggaggugagcagugggcagcaggcugaaguggcuuccugcauggauccucugaugggccagggcugagaccugccucuguggccug

SEQ ID NO: 4190448 - RNA, 101 nt, Human
caggccgggcccgggggccaggcaguuguccucuguggagccuuaucggggcccacaggcccugcugccuugaccccacccgggccccaaaacucggccug

SEQ ID NO: 4190449 - RNA, 66 nt, Human
caggccguccucucagaaguauuuccucacugccucgaaaauaacccucuggauaggacaggccug

SEQ ID NO: 4190450 - RNA, 78 nt, Human
caggccuaaucacaugcagggccuccacccaggaugcugggagccuggccuggcucuguguguucugguuagguucug

SEQ ID NO: 4190451 - RNA, 55 nt, Human
caggccucaggggcucaggcugggcacucccugcccugcccugcccuggguccug

SEQ ID NO: 4190452 - RNA, 72 nt, Human
caggccugcagguugcagaggcggaagcgcuuccgcuuacccacacaguaucugccuuuguaucugggccug

SEQ ID NO: 4190453 - RNA, 62 nt, Human
cacuuauagaauaugggcugguuuuuaauuuuugagaauugaguaccuccagauucauagug

SEQ ID NO: 4190454 - RNA, 73 nt, Human
cacuuaucugcccauauuuaacuaugaagcacuaaaaguugauuaggagcucuguguauguggcaggugcuug

SEQ ID NO: 4190455 - RNA, 63 nt, Human
cacuucaaauaagcucuucucagcguauacuaccccccugaggagaguauguucugugaagug

SEQ ID NO: 4190456 - RNA, 79 nt, Human
cacuucacacuccgcuaccugcuaauuuugauggaaauugcuuuugacaugugcaguugguggccaggagcuuggggug

SEQ ID NO: 4190457 - RNA, 129 nt, Human
cacuucagccuucugacuagcugggacuacaggcauguaucacuacaccuggcuaauuaaaaacgauuuuuugaaggccgggcaugguggcucacgccuguaaucccagcacuuugggaggccgaggug

SEQ ID NO: 4190458 - RNA, 57 nt, Human
cacuuccuuuccagaaacgaaccagaaauauuuuguucauuuguggugaaugaagug

SEQ ID NO: 4190459 - RNA, 81 nt, Human
cacuucuuuaaauuuauagauuuauuugcaaaaaugggguauuuucaauaucccaagauacgcuguaagaagaaaaaagug

SEQ ID NO: 4190460 - RNA, 97 nt, Human
cacuugaaagauauuaaagugaaguucucagaugcuugccagcccaugaguuuugucuuagaauuucacuuugaagacaaugaauauuuuacaaaug

SEQ ID NO: 4190461 - RNA, 66 nt, Human
cacuugauugaauuuugaaaaucuagucucaauaggaauagaggauggaucaagauuaaaucugug

SEQ ID NO: 4190462 - RNA, 65 nt, Human
cacuugcagggagcaugccucccaucccuuugcaaaaggaggcuucagugugggacugcagcgug

SEQ ID NO: 4190463 - RNA, 75 nt, Human
cacuugcucugcuggguccuggugcugaguucuccacgggaggugacagcagaggggcccaauugccagcuugug

SEQ ID NO: 4190464 - RNA, 130 nt, Human
cacuuggaacaaucacuacagcagaggaauaaagccaacacugaagccguuaaaccuugcaucguuucuuguguguugacucuuggacuucaaggguguaugguacuucucagcugaaucagucagggug

SEQ ID NO: 4190465 - RNA, 97 nt, Human
cacuuggaauuuaugacuuauuucaucaguucucccuuagacccuccuuuagaaagauggucaauaagacacuggugaagaaaucaggucccaggug

SEQ ID NO: 4190466 - RNA, 76 nt, Human
cacuugguuugggaguacauaacauuuuuuaauuaaauuuguguuauuauuguacuuacacucaaagggccaggug

SEQ ID NO: 4190467 - RNA, 78 nt, Human
cacuuuauagaaugcauugauugcuggaaauaucaucuuacucauuccauguguuucuagauuucaguuuucuaagug

SEQ ID NO: 4190468 - RNA, 96 nt, Human
cacuuucaggugucuuuagagcaaugcucuacuccuugguaccaauuuucuguauuaguaaguucucgcauuguuauaaagaaauaccugagacug

SEQ ID NO: 4190469 - RNA, 91 nt, Human
cacuuuccgcccagaaucgugccuuaguccuaaguccuggucaccuccuacugcuggaugguauuggaguaggacuugcauguggacagug

SEQ ID NO: 4190470 - RNA, 72 nt, Human
cacuuucuggaucuucagagaucaccagauugauguuuaccauacugagaucaaaaucugaagauaaaagug

SEQ ID NO: 4190471 - RNA, 56 nt, Human
cacuuuuccuuuucucacggggauccagcugauuuggaaggagacugggaagugug

SEQ ID NO: 4190472 - RNA, 74 nt, Human
cacuuuucuaacagaugacaagaguguucagggagagguguuucuucaccuuuuuuuuacucuucucaaaagug

SEQ ID NO: 4190473 - RNA, 70 nt, Human
cagaaaacauuugcuuaugaagagaagagcuuauauucugugagagcuucacuggagagcacauuuucug

SEQ ID NO: 4190474 - RNA, 80 nt, Human
cagaaaauggggcaaaggccacacagagcagggagccaaccaagugggguuucuuuugcccuguggguuaguguccccug

SEQ ID NO: 4190475 - RNA, 90 nt, Human
cagaaaauguuggcugaaggaauaaauggauggaucuagguuuaugugucuguuugcucacuuauuuauucauucagcucaugcuugcug

SEQ ID NO: 4190476 - RNA, 81 nt, Human
cagaaacguauuuagaaggcugcugaaaagacuggcaagucguuugauauuuuuaagugcaaucugaaugcgggaaaucug

SEQ ID NO: 4190477 - RNA, 67 nt, Human
cagauaagacacgcaaauagguacggccucucuuucucuuuucugucucucucugugugucuuucug

SEQ ID NO: 4190478 - RNA, 85 nt, Human
cagauaaggaaacugagguuacgggacuuaaccaugugacuuugggcaaguugcugaacaguucugugcuccguuuccucaucug

SEQ ID NO: 4190479 - RNA, 70 nt, Human
cagauauaccauccaugggaaucucuguauuuucacaaucuaacccagggcuucgauggauggauggaug

SEQ ID NO: 4190480 - RNA, 67 nt, Human
cagauauagaacaaguuauuuaugcucaguucucuaggaaaaggauggaggcuuguucugagaugug

SEQ ID NO: 4190481 - RNA, 90 nt, Human
cagaucaucacauaagagucagggcuguucgcuggggccuguggcguuggcagcaguguccucagccagcagcuacuguguacauggcug

SEQ ID NO: 4190482 - RNA, 109 nt, Human
cagaucaucaggcauuagauucucauaggcacacaaccuagaacccucgcaugcucaguucacaacaggguuugugcuccuaugagaaucuaaugcugcugcugaucug

SEQ ID NO: 4190483 - RNA, 129 nt, Human
cagauccgauaccgcaaggaccgugugguggcgcgacgugcccccugcuucccgacggugaccagccuccaggaccuggccaguggggccgcgcuggccgccaccauccacugcuauuguccccagcug

SEQ ID NO: 4190484 - RNA, 57 nt, Human
cagauccugccaggcugaguugcucccacugcuucuccagccacucagcagggauug

SEQ ID NO: 4190485 - RNA, 64 nt, Human
cagaucuggguaggcuccgcugccggggaguccuuccccagccagcaggaccucugagaagaug

SEQ ID NO: 4190486 - RNA, 130 nt, Human
cagaugacccucaggccucggguggccacuuucugggggagcccuccaucccuugcggcagcuuuuccgagagucggaguggaggcgcggggcuggagggcucuccggagccgcccaccaggguccucug

SEQ ID NO: 4190487 - RNA, 84 nt, Human
cagaugcccuccaguuguuuguauuaacucuuucccacaaucaccagguauaagaugauagaaacaaaauggaauauggcucug

SEQ ID NO: 4190488 - RNA, 85 nt, Human
cagaugcgucucuccuucuugugccaagugacccugcuccuuccccgcaaggagcaccuggucuccuggcgcuggaggaggucug

SEQ ID NO: 4190489 - RNA, 98 nt, Human
cagaugcucuccuuuaggaauucccuggguuaccuuucaaggucucugcuuaccaaugccccaagccagaccugguaacucuccaggggagagugcug

SEQ ID NO: 4190490 - RNA, 104 nt, Human
cagaugugcucucagaaauaaugaauucuuuugcaaaguccauugaaguuaugggagaugguugccuuaaugaugaacacuuggaagaacugggaggaauacug

SEQ ID NO: 4190491 - RNA, 62 nt, Human
cagauguguguguguguguguguguguguaguuguauguguaugcacacauguaugcaugug

SEQ ID NO: 4190492 - RNA, 58 nt, Human
cagauguuggagauaggccaucccagccugggauuacuuauuuguacuaauaaaucug

SEQ ID NO: 4190493 - RNA, 63 nt, Human
cagauguuugucuauaugcuuucuuguuuauuaacaacugggaguaaauuagacaaagcagug

SEQ ID NO: 4190494 - RNA, 57 nt, Human
cagauuaguugugcuauggccuguucauuucaccuucuauagauacagcucaaucug

SEQ ID NO: 4190495 - RNA, 91 nt, Human
cagauuaugaaccaagcaguuauauuacucucagguaagcuaagguauaaguuuacugaggguuuuuauacucuuuguucuauguaacaug

SEQ ID NO: 4190496 - RNA, 92 nt, Human
cagauucuuaguuacaucuucgaguuggcuuuauuaaacugagaaaaauugaaguuaugaugcagcugcuugauuucaaguaacagaaacug

SEQ ID NO: 4190497 - RNA, 59 nt, Human
cagauugagucugggaaaaggcucucaaaugucccccagcccccaccaugcucaaacug

SEQ ID NO: 4190498 - RNA, 74 nt, Human
cagauugaucccauggucuauauagaggcacacacacugcagugauguuuuugacaagacccaugguugauuug

SEQ ID NO: 4190499 - RNA, 55 nt, Human
cagauugcagcaguuuaaugcaggguuucuuagccuuguugcuguugacauuuug

SEQ ID NO: 4190500 - RNA, 129 nt, Human
cagauugcuauugcagaacacuagucuagauauauuuuuaauggaggggacaguguuuaacaaaauaauugcuuaauaaauacuuucugaccaauuaauugauagugucuauguuuucuauaauauuug

SEQ ID NO: 4190501 - RNA, 73 nt, Human
cagauuugcuaauugcugaacuacuaucccucagaagaugagagaaagaacacacagcuauuaguaagggcug

SEQ ID NO: 4190502 - RNA, 60 nt, Human
cagauuuuucaagucagccaugguucgaaacccagcuucaacaccuggcugugugagcug

SEQ ID NO: 4190503 - RNA, 99 nt, Human
cagcaaaugcaggccucugcaggugguuuuggcugacagcaauaucuagcauuggugcacaggugguccaucugcacccugagacccugcagugugcug

SEQ ID NO: 4190504 - RNA, 67 nt, Human
cagcaacaaugggcuguccauugcuggcugguuuauccccaugugugacaguccauuugcauugcug

SEQ ID NO: 4190505 - RNA, 81 nt, Human
cagcaacauuauacacaguaugcaucuagaaauuaugccuggguauaaucaguuaaauauugaguacaaaugugagugcug

SEQ ID NO: 4190506 - RNA, 83 nt, Human
cagcaagguucuguggagguuuggaacauuuuggccuugaccaggucacaaugcuccuauaaaucuuuaacaaaacauaguug

SEQ ID NO: 4190507 - RNA, 75 nt, Human
cagcaaguccugaggcaggauggguuucagaguugguuaauucagaggcucaguuaugucaucagggucuuaaug

SEQ ID NO: 4190508 - RNA, 83 nt, Human
cagcaagucucuucugagcucccuggugugcccaccuccaugugaacuucaguaagggggauacaaagggggaagagauucug

SEQ ID NO: 4190509 - RNA, 73 nt, Human
cagcaauagauguuuuugcuuaccaguccuugauuuggugaccuagucuuggcagaacgcauuucuauugcug

SEQ ID NO: 4190510 - RNA, 61 nt, Human
cagcacagaguauuuuauugaugccguucaaaaucauaggcauccagugagaaauguguug

SEQ ID NO: 4190511 - RNA, 67 nt, Human
cagcacaggaacaaagaagacaauuugugauugauuucaagaguugucaaaagguucugugaugcug

SEQ ID NO: 4190512 - RNA, 73 nt, Human
cagcacagggcagggccacacccccugcuucccccuccaggagagucaggacaugcuggccgcugcuccgcug

SEQ ID NO: 4190513 - RNA, 59 nt, Human
cagcacaguccuuugcuuacugaaagucaaggcuucuggaaaagccgaggcugaagcug

SEQ ID NO: 4190514 - RNA, 85 nt, Human
cagcacaugcgucgacagaaaagcggucaggacccucauuggggccacugaggagaucagcuuuucuggaacacauggugagcug

SEQ ID NO: 4190515 - RNA, 55 nt, Human
cagcaccaggcagaccuggagcucaucgagagugcacacagguacccuggcgcug

SEQ ID NO: 4190516 - RNA, 59 nt, Human
cagcacccuuuccacugccuuguggccaggggggcccacggcagccuccgagggugcug

SEQ ID NO: 4190517 - RNA, 76 nt, Human
cagcaccugggccuucucaaugcacuggaugcucaaggucuccagggauacaggugagagugaugguccgggguug

SEQ ID NO: 4190518 - RNA, 66 nt, Human
cagcaccuguagaaagcauguagccuguauccauagguggguaccacaauauguuuacugagucug

SEQ ID NO: 4190519 - RNA, 76 nt, Human
cagcacggauaugacuuauucuauguaacaauaccucagcgacuggauagucagcaugaaauaagcagcuguguug

SEQ ID NO: 4190520 - RNA, 87 nt, Human
cagcacucagaccgcaggcuggcucccugaagguucaccucacagcggcucuccuggaucuucagccagcaggugcccuuggugcug

SEQ ID NO: 4190521 - RNA, 56 nt, Human
cagcacuggcacagaccucgacugugcccuucacagugaugguucuuuccggguug

SEQ ID NO: 4190522 - RNA, 70 nt, Human
cagcacuuuagcggaggcaucaucacuucauuucagcuccagggaaggagucuugcuuucugaaguucug

SEQ ID NO: 4190523 - RNA, 93 nt, Human
cagcacuuuugugaaaucguagcuugaaucacugguagcauuugguaagcuucacagagcugauuugauuacagugcugacaucacugugcug

SEQ ID NO: 4190524 - RNA, 88 nt, Human
cagcagaauuuuggaagggaaagaaaguacuucucauuuuagagaagcaaguucucuacuuucuuaaguuuccucuuagguuuuacug

SEQ ID NO: 4190525 - RNA, 69 nt, Human
caguagggauggcaauuauuauggcagcggaggugaaguaugcuagugugucuaugucuguuccuacug

SEQ ID NO: 4190526 - RNA, 61 nt, Human
caguaucauucuuaggagaggcaucucaauguuucugagccgcuuucuaugagauggacug

SEQ ID NO: 4190527 - RNA, 118 nt, Human
caguauccuucuuagagaaacaaugucucaguagaauaucacauuuuuuacuggacuuaaggaaauagcuuuaauuuagagggggauguggaggaagaguuucucagaaggaaggcug

SEQ ID NO: 4190528 - RNA, 113 nt, Human
caguaugagggcaaggcucagugucucauucauuauguauccuuaugacuuagcucagagccuggcacaucagagguacuuaaugaauggauaugcaacccaagccuuugcug

SEQ ID NO: 4190529 - RNA, 91 nt, Human
caguaugcugcucaauuuuuauuccacuuccacuaguuucucuucaaagagggcucugucuggaagggaacccuggguuggugcauuucug

SEQ ID NO: 4190530 - RNA, 66 nt, Human
caguaugucuuuugcuugcaaauagauugcucauugccaacugcuuccaagaaagagauagggcug

SEQ ID NO: 4190531 - RNA, 58 nt, Human
caguauucugaguacuuguucuuuuuguuagagagaugaacauuaguuucagauauug

SEQ ID NO: 4190532 - RNA, 71 nt, Human
caguauucugguuuuucaggugguagggagaagaucugauuguaguaccuuuacuugggcucagaaugcug

SEQ ID NO: 4190533 - RNA, 83 nt, Human
caguauuuuaucaaugugguuaaaauuugguugucuguguuuauucagaaaacucaguaguggcaacagccagaaaaauagug

SEQ ID NO: 4190534 - RNA, 58 nt, Human
cagucaacagagagcccgucaggugcucuaagagaguagggcagaccuuuggugauug

SEQ ID NO: 4190535 - RNA, 57 nt, Human
cagcagagaccaagugauuugagugucauuaaauucauuauguggcuuuuucuguug

SEQ ID NO: 4190536 - RNA, 79 nt, Human
cagcagaggcccuggggggugcccuggcgaggugggcaugcucccucuccccagcugagcugcccuuggccucuugcug

SEQ ID NO: 4190537 - RNA, 57 nt, Human
cagcagaguauggcacucaacuacuaaugucuucuucauuagugccauauuguguug

SEQ ID NO: 4190538 - RNA, 64 nt, Human
cagcagaugccaaguuguagucuugagugaggugaacucggacucacaaagcaggaucauguug

SEQ ID NO: 4190539 - RNA, 99 nt, Human
cagcagcagacuggcagggacauguuugccugcaggcuuagugguaacccucuggggcugccaggcaaccaagaaaccaaggcugugggucugcuucug

SEQ ID NO: 4190540 - RNA, 56 nt, Human
cagcagcaguggcugcagaacagcagauauugguguacugcaaaugcugcugccug

SEQ ID NO: 4190541 - RNA, 56 nt, Human
cagcagcaucaggucugugguuaaaaaaugaccucaacagauacccugugcuggug

SEQ ID NO: 4190542 - RNA, 61 nt, Human
cagcagccacuagagggcucacgaagcugcagccgcgggcugcccucuagcggcggugcug

SEQ ID NO: 4190543 - RNA, 55 nt, Human
cagcagcccacgcgugcuguccagccgucccugggcaucccgcaugugguugcug

SEQ ID NO: 4190544 - RNA, 79 nt, Human
cagcagccccguuaccacugcucgggccaguagagcugcccaacugcccagcgagcagagguggacgaagguccugcag

SEQ ID NO: 4190545 - RNA, 61 nt, Human
cagcagcuccucugcggcuaugcauucgccauucuucccugugucagccguggugcuguug

SEQ ID NO: 4190546 - RNA, 130 nt, Human
cagcaggauguuguucaaaauauguuucuaaagaacaugaguuaugaugauuucacacuugccaaaaagaauuauaauuccuguuugaaagcuacuggaagcucaaauguuucugacugugucagaucug

SEQ ID NO: 4190547 - RNA, 55 nt, Human
cagcaggccaauagcagccaauacucucagccucuuggccuggcuaucccugcug

SEQ ID NO: 4190548 - RNA, 65 nt, Human
cagcaggcccaggugcuggugaggggcccucauuuuuguuccugcagcuggagccaacgaugcug

SEQ ID NO: 4190549 - RNA, 62 nt, Human
cagcaggccuuccuguuguguccaccguacuaaugaugcacuaaggcagggaggcaagacug

SEQ ID NO: 4190550 - RNA, 60 nt, Human
cagcaggcucugaguggcugccagcccagccugcuggcugccuccaaagcaggccugcug

SEQ ID NO: 4190551 - RNA, 57 nt, Human
cagcagggauuauugaggagcuuguuuuauuuaagagcuucuucauuaacccuacug

SEQ ID NO: 4190552 - RNA, 106 nt, Human
cagcagggucuucaugauaaguuuucacauaaauauuaugccuagaaauaucuuguggcuggaguagauuuguugaaggaauuauuuugcuggacagaacuuggug

SEQ ID NO: 4190553 - RNA, 55 nt, Human
cagcaggguuaagugacucaccugagggcacacaguggagucuuuguuacugcug

SEQ ID NO: 4190554 - RNA, 94 nt, Human
cagcaggugagaucggcacuggcuccaaggaagagguuuuccaugcagauguggaaacugccaaaagaccuuggaugugagcugccaccugcug

SEQ ID NO: 4190555 - RNA, 75 nt, Human
cagcaggugcugagauggugcuggagauggcacaccugcccuaucagcucaguuucccacccucucucauugcug

SEQ ID NO: 4190556 - RNA, 89 nt, Human
cagcagguguuauuuuggucuucagcuuugcaugucuucaaguuuagcacgaugccuugcacaguuugagcacugacauacaucuguug

SEQ ID NO: 4190557 - RNA, 96 nt, Human
cagcagucaauuuguccauguuggucagaauuaggucuagaguagcaauuucccggcuuacuuccucuauuuucugagaaacaaaauugccugcug

SEQ ID NO: 4190558 - RNA, 77 nt, Human
cagcagucuuuaaugugagucccuuucaaggccaacaggaugagccuugugaaggucuuuagcauucagagcccuug

SEQ ID NO: 4190559 - RNA, 78 nt, Human
cagcaguuugaauucuccuuuguaauucucauccaggcaagucacucuuuuuuccugguauaaaugaucagaucgcug

SEQ ID NO: 4190560 - RNA, 63 nt, Human
cagcauagccagccuuucuucaagccuguguguaccccaucugaagaaaaacugguacugcug

SEQ ID NO: 4190561 - RNA, 60 nt, Human
cagcaucucccaggcauuugccccuuccugccaggaacagggcagaggcggaggugacug

SEQ ID NO: 4190562 - RNA, 76 nt, Human
cagcaucuccugggagaggcugccaucuugcauagcccuugcugcugccuggaggcuucuucucucuaaacugcug

SEQ ID NO: 4190563 - RNA, 57 nt, Human
cagcauggacagggguggcguucucuaugguguugggaccccgccuuugcccugcug

SEQ ID NO: 4190564 - RNA, 58 nt, Human
cagcauggggcugcaagcugcaaucccuggguccaggcugcugcuuugccacuaguug

SEQ ID NO: 4190565 - RNA, 62 nt, Human
cagcauucaugcaaagccaauuccagcuacagacugcagcuugggguugucuucugcagcug

SEQ ID NO: 4190566 - RNA, 79 nt, Human
cagcauuugaaugagauugcuguaacuucuagucccuaacuuggugcuuuggauuuuacagggaucccauaaaugucug

SEQ ID NO: 4190567 - RNA, 105 nt, Human
cagccaacgagaaguugaguugucaauugccucuuaauuauaguuacuuggagaagucuggaagaugacccugagggcaauuggaaacacagauuuucuuugcug

SEQ ID NO: 4190568 - RNA, 67 nt, Human
cagccaagcccugggguugcacaaggccacuuuguggcauaaugcccuggcucuaagaguaagguug

SEQ ID NO: 4190569 - RNA, 70 nt, Human
cagccaaggcaacguuggugucaggaugcagcacccaggcggccuggccaucauuuugccauaugugcug

SEQ ID NO: 4190570 - RNA, 72 nt, Human
cagccaaugagguuaaugcugauagauaauguccuauggauauuuuagaagacaguauugauccauugucug

SEQ ID NO: 4190571 - RNA, 72 nt, Human
cagccaccagaccugauagagaaggaacacugauugaaccaaaaugguggagcuauacgggauggcuggcug

SEQ ID NO: 4190572 - RNA, 78 nt, Human
cagccacuggacucuggagguuucguauuucuacugagaccauuucucaaccuaugagcuuccaguguugcaugguug

SEQ ID NO: 4190573 - RNA, 104 nt, Human
cagccacuugguguccucuuugauuccaggcacauguuugaacaaauaggaaguugucaaaaauauguugauugguagguuugaauggcuaccaagagaggcug

SEQ ID NO: 4190574 - RNA, 61 nt, Human
cagccagauuuuuuuagcuagcauuguucuucaaugaacagcaguugaaauaauuuguuug

SEQ ID NO: 4190575 - RNA, 63 nt, Human
cagccagccucucaaccaugcagagccaauuacuucaacaugggcccgugagaggcagggcug

SEQ ID NO: 4190576 - RNA, 116 nt, Human
cagccaggcugcaggggcuggaagaaauuggacaccagcaaggcugugaggagggaugacucucccauagaccugcguggugggcccucucggccagccgcucccagcucugguug

SEQ ID NO: 4190577 - RNA, 78 nt, Human
cagccaggggcacccugcccagaaaagccuggcguggucccgcguccucaggcggugaggaggggccaccugcagcug

SEQ ID NO: 4190578 - RNA, 70 nt, Human
cagccagugcuccuccuccaugccacacugcaccuccuagcccuggcaguggauaggggagcgguugcug

SEQ ID NO: 4190579 - RNA, 82 nt, Human
cagccaugcccauuuguuuauauacugucuaaggcugcuuuugccauggaacaguacaguugaguaguuguggcagagacug

SEQ ID NO: 4190580 - RNA, 60 nt, Human
cagccauucuaacacugccagugcagaggggccucagacgcuggaguguagcaguggcug

SEQ ID NO: 4190581 - RNA, 91 nt, Human
cagcccacaccgaaaaccuugagcccugaucugcuuccaaccaaugggguggccaggggagcugucuggggacucuggguggugcagguug

SEQ ID NO: 4190582 - RNA, 62 nt, Human
cagcccagaacucacgucuccaguacuccacgcccuccaucuggacuggugaguuuaggcug

SEQ ID NO: 4190583 - RNA, 60 nt, Human
cagcccagcacugggggcccagcccacaaacgaagggaaccccuggaaggugcuggggug

SEQ ID NO: 4190584 - RNA, 90 nt, Human
cagcccagcucaacauagccuugugcugcccaucccugcuacuaaggcuugggauccauccgugcagcagagggaaugaggcugugggug

SEQ ID NO: 4190585 - RNA, 69 nt, Human
cagcccagcuccaggugaauccucucacccuuuguggggucggaggcccugccuuggagcaucuggcug

SEQ ID NO: 4190586 - RNA, 68 nt, Human
cagccccagagcccugugcccaaggauggucccgaacuaguggacagcaggggccagaggcggggcug

SEQ ID NO: 4190587 - RNA, 130 nt, Human
cagcccccggcggcccuugccgauggccaggcggggccgaccgcgguucaggccguccaggagggagcaggccuggcagagcgcgcggcuggccagcgccccacagcgggggcaggcgccggggcgcggg

SEQ ID NO: 4190588 - RNA, 77 nt, Human
cagccccggcccuguccuggcugucuccgggccuuuguuguucgaguuucgccuuaggacugaaggggccuuuguug

SEQ ID NO: 4190589 - RNA, 89 nt, Human
cagccccuaagggaguaauuacagauagacuuugaagcugcuuaauaacuggcagcaucauagauuuuuuguaaucaccugagaagcug

SEQ ID NO: 4190590 - RNA, 61 nt, Human
cagcccugcugccuuagugccugccugaaucucuugcuccaggcgccuggccucauggcug

SEQ ID NO: 4190591 - RNA, 80 nt, Human
cagcccuuccuuugcuuaggaguuucaggcucucaacugggauagguggguucuggucucuugaggugaggaagaagcug

SEQ ID NO: 4190592 - RNA, 69 nt, Human
cagccgccucuucugcauccugucaacucugauuaguuagaguuuaggcucaaaagaguugguggacug

SEQ ID NO: 4190593 - RNA, 117 nt, Human
cagccgcuuuccccucaggcccucuguuucauggccuuccugccgugguucucccuggggggccuuccaggucccagacugggcagcaggccuguagcacugacagacaggcggcug

SEQ ID NO: 4190594 - RNA, 74 nt, Human
cagccucccaaagugcuaggauuacaggcgugagccaccaugccuggcuccuacggguauuuugccagcagcug

SEQ ID NO: 4190595 - RNA, 75 nt, Human
cagccucccaaagugcugggauuacaggugugaaccaccgcgccuggccuaauuccagcauuuaaaaacaaucug

SEQ ID NO: 4190596 - RNA, 90 nt, Human
cagccuccuccaugagggacagaccuuauuucucuauuaauauaaggaaaauagagcacaaauuaguuggucuuuuagagaaacaggcug

SEQ ID NO: 4190597 - RNA, 73 nt, Human
cagccuccuuucuuccagcucuggccucuccuacacaccccagguagcucugccaagcuggaugaagagguug

SEQ ID NO: 4190598 - RNA, 61 nt, Human
cagccucuccacaauguguccugagaagagcuaggggaacuggacagaguggacgaggcug

SEQ ID NO: 4190599 - RNA, 56 nt, Human
cagggcaguaacgggaacaucuguguccucuccacagauccaccgugggcgcccug

SEQ ID NO: 4190600 - RNA, 60 nt, Human
cagggccacacagaaccuccuggugggacagggcccagacccaggcuucuguggucacug

SEQ ID NO: 4190601 - RNA, 68 nt, Human
cagggccaggggccgucacucaguccauggggcagacccauuggcaaggcugcggugucuguccccug

SEQ ID NO: 4190602 - RNA, 60 nt, Human
cagggccauuggcguggcugucugccagcuggcaggagcagcauguuaaaugccguccug

SEQ ID NO: 4190603 - RNA, 55 nt, Human
cagggcccaagacacaaugaggacguuuguuucugauguguaucuuagggcccug

SEQ ID NO: 4190604 - RNA, 63 nt, Human
cagggcccaggccacuggguuggcuucucuacacucuccccacaaccugccugaugggccuug

SEQ ID NO: 4190605 - RNA, 56 nt, Human
cagggccccagaaucccccagcaccuaccccugugggaaccugccccaggccucug

SEQ ID NO: 4190606 - RNA, 66 nt, Human
cagggccccagggaugucugcugaagugagaacaaggacagagaugcccccugggguuuccuccug

SEQ ID NO: 4190607 - RNA, 79 nt, Human
cagggcccugcgcuuagaagggcucugagcuugguuuaacuaugugaaacuguucauccuuuuugaacaaagggcccug

SEQ ID NO: 4190608 - RNA, 58 nt, Human
cagggccguguuacauguaacaaucuuucaagauucagugcuguaauacgcuaaacug

SEQ ID NO: 4190609 - RNA, 86 nt, Human
cagggccuuccauugcucuuuucuaggugggcagccuauaggaaaggggauuuacaacaguggaaaggagcaguaaaagugcugug

SEQ ID NO: 4190610 - RNA, 119 nt, Human
cagggcuaaccaaaaugauuugaaugcuagaucccguaaagcauggguuaugcuuuggcucuggucuuuagcaccaucacagcuguaugucucuguucugcauucagauuuuauuccug

SEQ ID NO: 4190611 - RNA, 62 nt, Human
cagggcuagugacaccccagucaaggugguccagagcaucaggagucgugucacaggcccug

SEQ ID NO: 4190612 - RNA, 58 nt, Human
cagggcucccaaauaucucuucuuuauacaauucaaggaccagaugacagggguucug

SEQ ID NO: 4190613 - RNA, 57 nt, Human
cagggcugcuguguggauucaauggcuuaucuauguaaguguccagcacaguaucug

SEQ ID NO: 4190614 - RNA, 57 nt, Human
cagggcuugaucugcauccugcuaguccgugcccucccauaugcaaaugaagcccug

SEQ ID NO: 4190615 - RNA, 98 nt, Human
caggggaagcggagggagccucgugcugggccugcuucuugggucuuucuucugggaggugugcacagcgugcugacagccuccuucaaacaucccug

SEQ ID NO: 4190616 - RNA, 56 nt, Human
caggggagugagucccucucugugacuccucagagcugguugacagcauuccuuug

SEQ ID NO: 4190617 - RNA, 55 nt, Human
caggggcaggugugagaucaucuuguaagaaaacaagcuucucccuugucaccug

SEQ ID NO: 4190618 - RNA, 64 nt, Human
caggggcgcuuggaaagcagcgugggccgucgucaguccugggcugugcagccaagugccucug

SEQ ID NO: 4190619 - RNA, 68 nt, Human
caggggcugcugcaguccagcauuugugccagcgaccgaggcugcagagaccccgcagugaggcccug

SEQ ID NO: 4190620 - RNA, 65 nt, Human
cagggggauuuuaugggcucacauuuggaaggcauuuugaaggucauccaggccaugaaccucug

SEQ ID NO: 4190621 - RNA, 75 nt, Human
cagggggcguuaugaaaggugcuaacagaugcggauuucagcuuugucauuaaaaugcuucucaaacgccaccug

SEQ ID NO: 4190622 - RNA, 70 nt, Human
caggggggaccucuccaggguacagcaggcuccauguuugggauccaucccuggagaggacucaccccug

SEQ ID NO: 4190623 - RNA, 56 nt, Human
cagggguauucaagguaguuuaccucaucaaguugugaauuaucuucugaccgcug

SEQ ID NO: 4190624 - RNA, 59 nt, Human
caggggucacugagugagccuccucugccccucaugggagagcuccucgugacucacug

SEQ ID NO: 4190625 - RNA, 82 nt, Human
caggggugagcugggguccagggguuugccggugaguggguggaugaagguggaacccgagggccccaggcucgggccgcug

SEQ ID NO: 4190626 - RNA, 76 nt, Human
caucaagccuguguuucugcuagucucaugugccacaagguaacaggccaggcuuggaagaacaguggcaucgaug

SEQ ID NO: 4190627 - RNA, 108 nt, Human
caucaaggcccucuaucacaggccuccaguguguguccagcugcugucagcuacacccugcuacucauagcuggagaucuacuguggguuuugcccgccugcuuuaug

SEQ ID NO: 4190628 - RNA, 90 nt, Human
caucaauugauuaguaguggcuuccuggagugcugacuugacaagaagucaugcugcguuggcaggaaagcacacuaugauugguuagug

SEQ ID NO: 4190629 - RNA, 73 nt, Human
caucacagaagagauauugacagagguuugugcauuacaagcacaucugauucuauugaugucuucugagaug

SEQ ID NO: 4190630 - RNA, 90 nt, Human
caucacaggauucagcuucugagcaguaauagauuuuauuacucuuauuauaaugcauauuuagaagcugaaagagaaaagcugaugaug

SEQ ID NO: 4190631 - RNA, 75 nt, Human
caucacaucccucccagagcaagccauugaaauagauauuuuaaagaagcuguggcucugggagguggaguaaug

SEQ ID NO: 4190632 - RNA, 56 nt, Human
caucacuggcaucaugggagggcucccauauggggugcugccaucaugcagagaug

SEQ ID NO: 4190633 - RNA, 85 nt, Human
caucagaaaccuggacaggaagaauugggagccugauccaauguagcaagacccauuaggcucugaucugugccagguuugugug

SEQ ID NO: 4190634 - RNA, 89 nt, Human
caucagaagacagcagguccaauugcgcuaaaaucuaaagucaaguuuagagcagcggggccguggacccaucagcugcugaucuggug

SEQ ID NO: 4190635 - RNA, 128 nt, Human
caucagaaucaccuuaugggcuugguuaaauacaaauugcugggucccacccaagauguuugauucaaugguugugagguggggccugauaauugacuauucuaacacauuuucaggugaaguugaug

SEQ ID NO: 4190636 - RNA, 121 nt, Human
caucagaaucacguggaagucuuguuaaaacacagauugcuugauccaugcccaagguuucugauucaguaggucuggaauggggcuuggauuuuuagcaaauuuccaggugaugcugaug

SEQ ID NO: 4190637 - RNA, 129 nt, Human
caucagagucaccuagaggacuuguuaaaacauggacugcugggccuaacccacagcguuuccgauuagaugggucuggggugaggcccgggauuugcauuucuaacaagcucccuggugacgcccaug

SEQ ID NO: 4190638 - RNA, 82 nt, Human
caucagccagcacuuuuaggagcuaccagggaagcaaaaugcuacgcuuugcuuuguggugguucuuccaagucuggaaaug

SEQ ID NO: 4190639 - RNA, 64 nt, Human
caucagccuuucuguuuccuaaggucagcugugugacaucuaaaccugggcacagagagagaug

SEQ ID NO: 4190640 - RNA, 127 nt, Human
caucagcgucaccaggagggcuuguuacaauacagauugcugggccucagccucuagucuuauuuagcuggucugagguggggcccaccaauuugcauuucuaacaagcuugugggugaugcugaug

SEQ ID NO: 4190641 - RNA, 104 nt, Human
caucaggugggagccagaaaugggguucuguggcuggcucagcuggugaccauuuggagguccuugagcaggucaagacuccagcuucagcuuuuucauuugug

SEQ ID NO: 4190642 - RNA, 130 nt, Human
caucaguaucacuugguaauuuguuagaaaugcaaauucuuggcccucaccccaagccugguaaaucagaagcucuggagguugagcccagcaagcuguaguuugauaaaaccuucaagugauucugaug

SEQ ID NO: 4190643 - RNA, 65 nt, Human
caucaguguugauccaccagcaauuuucaggaagcagauuuugcaaaggagaucaacucugugug

SEQ ID NO: 4190644 - RNA, 63 nt, Human
caucauaauggaaagacaugguaaugcugccugcagcuuuauauguuguuucuccauagggug

SEQ ID NO: 4190645 - RNA, 79 nt, Human
caucauacugugacagaguacuuaaacuaucuuaacuugggcaguuuggaagugcuugugauaggaaauauuuguguug

SEQ ID NO: 4190646 - RNA, 79 nt, Human
caucauauaugggaaauaauagaggcucuuuaugaugauacuguucuguagagaggauuuguuuuucuccucucugaug

SEQ ID NO: 4190647 - RNA, 64 nt, Human
caucaucugugcuggagagccuugaguauaucacuuuacuacggagauuccagccagguugaug

SEQ ID NO: 4190648 - RNA, 57 nt, Human
caucaugcaggcagccuuuaguaagcgucacaugcuaccuaaagugguuugcguaug

SEQ ID NO: 4190649 - RNA, 98 nt, Human
caucauuuaguugaaugcaauaaaaaaugcagcuaguaugagaaagucuugauucuuguguggaacugcuuuucuaggugcuuuaaaauugacugaug

SEQ ID NO: 4190650 - RNA, 64 nt, Human
caucauuuggcuuuagggccugugcucugaaacaugcaaaccccuugagacacagccaaagaug

SEQ ID NO: 4190651 - RNA, 69 nt, Human
cauccaauuacuaugauuugaucauuacacacugcauaacguguaaugaugucugagaaguauggggug

SEQ ID NO: 4190652 - RNA, 63 nt, Human
cauccagauggcugugaaggucacacccuacuccuucugggagaggacucacggccauugaug

SEQ ID NO: 4190653 - RNA, 59 nt, Human
cauccaggcugguucucucaguucacucaagccuaugucaugcuguggccaccuggaug

SEQ ID NO: 4190654 - RNA, 76 nt, Human
cauccaugaagagcugagucugcagucgccaugggggugaacuaggaaacugcagucucaguugaguccugagaug

SEQ ID NO: 4190655 - RNA, 86 nt, Human
cauccauguguguauguguaaaaucugauuaauacucaaaguuaaugaguauauggggaauugcauaaucucauaugccacugaug

SEQ ID NO: 4190656 - RNA, 62 nt, Human
cauccauuucuaucuugcugaggacgaaguacugugucucagcuagaauagacaauggcuug

SEQ ID NO: 4190657 - RNA, 69 nt, Human
caucccaaggcuuagguggcucccugucuuggacacuccagcaggagcaaugcuuugguccuggagaug

SEQ ID NO: 4190658 - RNA, 96 nt, Human
caucccaccuggccagagauguggccugggcugagccugggcugugucugcucacaugcacggcugcacagccaggcccuggggccaggaaaggug

SEQ ID NO: 4190659 - RNA, 85 nt, Human
cauccccccaaccuggagaagcagcuuagaaucuacccgccaccucuuaggugacucuggggcgcuacuccaacuuggggcugug

SEQ ID NO: 4190660 - RNA, 90 nt, Human
caucccccugcccuuuucuuuucuaccaauaggauucacguaacaagaaugccuuagaggauagugaagccacaaaagggaaggggucug

SEQ ID NO: 4190661 - RNA, 61 nt, Human
caucccugccugacucugacguacaaagguguaauuagaacaguguggagcaggcaggaug

SEQ ID NO: 4190662 - RNA, 85 nt, Human
caucccugggcccugccugucaucgccugcgcccgccucuucccuugaagucgguguccagauacggagcgguggcuuggugaug

SEQ ID NO: 4190663 - RNA, 62 nt, Human
cauccguauuuccauguuguauaauuuuccuuaacauuucuuauaguguggauaugcugaug

SEQ ID NO: 4190664 - RNA, 125 nt, Human
cauccuauccauuucauuucaugauuccauuacaucauuucacuuagaugaagugauaagguuacuugagaugagaugaaaugaugagaugaaaugaugaaaugaugagaugaaaugaugagaug

SEQ ID NO: 4190665 - RNA, 77 nt, Human
cauccugaacagauccaucucucagaaagagacucauauuuucugagcucaugagacugauguauuaaauuaggaug

SEQ ID NO: 4190666 - RNA, 61 nt, Human
cauccugcacauuaaacuucacgcuaaaauuggcuuuggaggaccuaugugcaauagggug

SEQ ID NO: 4190667 - RNA, 60 nt, Human
cauccugcuauuaaauugaugugguguccuucccaguaucacaucagagggcauaggaug

SEQ ID NO: 4190668 - RNA, 68 nt, Human
cauccugguuaccccauagucaugccaaucuaaguuuauggcacugacugacaguggugccaaggaug

SEQ ID NO: 4190669 - RNA, 77 nt, Human
cauccuuaguuaucacuaacuuuauuacagcuaauuuucaauauauuaucaggaggaaguuaguguaaugcagggug

SEQ ID NO: 4190670 - RNA, 60 nt, Human
cauccuucauacgacugacccuggagcugaaggccagguuuugcaguggucugagguaug

SEQ ID NO: 4190671 - RNA, 62 nt, Human
caucguggucaucauuaguauuauuacuauuuuggugaguugaucaaugaugcuacuggaug

SEQ ID NO: 4190672 - RNA, 66 nt, Human
caucuaaauuugacuccaaggagcaccagcacuauuaucaacucccacugcaguuaaauuaagaug

SEQ ID NO: 4190673 - RNA, 65 nt, Human
cagccucugaaagaguuuaguauuauagaauucuugagaaauaaucugagcuauuucaugagcug

SEQ ID NO: 4190674 - RNA, 77 nt, Human
cagccucugcaacuccgccuuggugcccccgcacguuccaggggcagccacacugauggauugcucagaacgggcug

SEQ ID NO: 4190675 - RNA, 86 nt, Human
cagccucuucucuguguaggauuuccuggagccuuccaguaagcuggugggcucauuaaagaaguccugcguugagcuagagucug

SEQ ID NO: 4190676 - RNA, 57 nt, Human
cagccugaaucacuucugagcccuuuggggauggggaucagcccugaguccaggcug

SEQ ID NO: 4190677 - RNA, 76 nt, Human
cagccugccaaagugcuaggauuacaggcaugggccaccaaacccggccaggucugucuucuuagcucacagguug

SEQ ID NO: 4190678 - RNA, 59 nt, Human
cagccuggcacccuucuucagagcuccucccaggagcccuggccuuggggcacaggcug

SEQ ID NO: 4190679 - RNA, 90 nt, Human
cagccuggcucaguucucugguaaccuguugagugacagcaucuuuauaugcucauuagacagguauacuuuauacaacgcagccggcug

SEQ ID NO: 4190680 - RNA, 55 nt, Human
cagccuggcuguaaccucauggucacaaagauggcugccguaacagcuaaggcug

SEQ ID NO: 4190681 - RNA, 61 nt, Human
cagccuggugggcaguccgacacguucgguaauguaccaagcucugccgccuuucaggcug

SEQ ID NO: 4190682 - RNA, 91 nt, Human
cagccugugugugucaugcccagcacaaacccucccgggcugaagccaguucccagaggcaaagucuggauguggaaaaugcaccaggcug

SEQ ID NO: 4190683 - RNA, 55 nt, Human
caggaacccaaugggccaggccuugcucugccaggccauccugcaugggguccug

SEQ ID NO: 4190684 - RNA, 85 nt, Human
caggaacuagggaucagcauguccuacccagugaagcccuccugggggucuucucugcccauaggaaaugccuccuucuauccug

SEQ ID NO: 4190685 - RNA, 64 nt, Human
caggaagcacagugaggagaccgcgcggcagagucggccccaucuguguucuccuggcuucgug

SEQ ID NO: 4190686 - RNA, 59 nt, Human
caggaagcaccagcccggccccaucccaccaucugcucugggugcccuucuggguccug

SEQ ID NO: 4190687 - RNA, 77 nt, Human
caggaagcuagauuuuguugcuuaacaaauagcucacaaaucucuaugucuuaaagcagcaaaaauuuaucuuucug

SEQ ID NO: 4190688 - RNA, 65 nt, Human
caggaagcucaggccagcaucugugauuuaugcugcaccagucuggaauuuggccugagcacuug

SEQ ID NO: 4190689 - RNA, 108 nt, Human
caggaagcuuuuauuuuagcagcuaaaaggaagagaaagauuuacuagcauaauagcuucuggacgagcuacuauuaauaguagauuugauuccugcugucuguccug

SEQ ID NO: 4190690 - RNA, 66 nt, Human
caggaaggcagguuggggccuggcuacaguacccacauagucaguggcuccgagccugguucucug

SEQ ID NO: 4190691 - RNA, 89 nt, Human
caggaagucccugugucucuuuguccuagagcucucauagaacuccagacggaucuggcugcugggucaugaugcagaaugcuaaccug

SEQ ID NO: 4190692 - RNA, 55 nt, Human
caggaaguggggucauggaguagggaucccuugccaguccagcccacauuuucug

SEQ ID NO: 4190693 - RNA, 67 nt, Human
caggaagugguguucuuauugggacuaauauguguuauggcccuagaaccagcagaagccacuccug

SEQ ID NO: 4190694 - RNA, 62 nt, Human
caggaaguuguguguucgaggcacccagcacaucagaauugccucccacaaauaccuuccug

SEQ ID NO: 4190695 - RNA, 60 nt, Human
caggaaucugggaaguagauaguuugucuccaguugccugccugcuuccuucccucacug

SEQ ID NO: 4190696 - RNA, 70 nt, Human
caggaauguacaaaguuaaaccuauauacacaccagguguaugcggucagggguacgcuuuguuuaccug

SEQ ID NO: 4190697 - RNA, 82 nt, Human
caggacauauuuguugggucaagaagcuaugcccuuggaaggaucaaaucaugcaggcuccuuaucuuacaacuuuguuuug

SEQ ID NO: 4190698 - RNA, 75 nt, Human
caggaccagaagcaguuauuuuuugcacauuauaacuggcuaaugucacaaaaaucaguaauugcugaaaucuug

SEQ ID NO: 4190699 - RNA, 89 nt, Human
caggaccauuuugucacccaggcuggagugcaguggcgcgaucucggcucacugcaagcucagccucccagguucacaccauucuccug

SEQ ID NO: 4190700 - RNA, 114 nt, Human
caggacgggucugcaguugggcagggagcuggaaccacacacccucucuccagacuucuuggucaagugaucuguggccuccuacucugcuccagcugcugauccugugucuug

SEQ ID NO: 4190701 - RNA, 79 nt, Human
caggacugagggauucagcguggccucaggcacuuugcuuccaguugguguaagaugucagcugagcaccuugguucug

SEQ ID NO: 4190702 - RNA, 71 nt, Human
caggacuggugggaggaugggcaucagccagggcugaacacugagucuaccucccucugggacacagccug

SEQ ID NO: 4190703 - RNA, 77 nt, Human
caggacuuguccaagggauaagggugggacacugagagcaucagcugcaauacccuucuuccuuccacagaggacug

SEQ ID NO: 4190704 - RNA, 86 nt, Human
caggagaaaguugugaugcagauaugcaaacuguaguuugacaaaguuauuaaaauugaguugcaaauuugggugcuaucuuccug

SEQ ID NO: 4190705 - RNA, 70 nt, Human
caggagaagaugcccagccaguuuagagaaaguggucccaacucaaggcuggcucggcuuuucuguccug

SEQ ID NO: 4190706 - RNA, 72 nt, Human
caggagaauaaaaccagcucugcaaaaugucaucuuauaggagcauacuguuugagcuggucuguucacuug

SEQ ID NO: 4190707 - RNA, 60 nt, Human
caggagacaaguuagcagcugauggggcagauauguuuguuuagcuagcgcuugguccug

SEQ ID NO: 4190708 - RNA, 90 nt, Human
caggagacuuggggauuuaucucacagccugagaagcacgugggaaaaauagcuacucaaaacuuugugaagaaaauuccuaauuugcug

SEQ ID NO: 4190709 - RNA, 77 nt, Human
caggagagaaaggcugguggugucauuuggccauggaguggcaggaacacagauggugccggcguuucagacuccug

SEQ ID NO: 4190710 - RNA, 82 nt, Human
caggagagaaaguguauauauuuucauggggaacacuuacuuuccuuauuacaugcuguguauuuuacucuuucuacuucug

SEQ ID NO: 4190711 - RNA, 71 nt, Human
caggagagaggggcugaggucccgaggcuggaacccacacuucugccuggaccggcagcccuccuuucuug

SEQ ID NO: 4190712 - RNA, 55 nt, Human
caggagagggguuccagacaaguugacaaggaaaccuggagaaagccucucccug

SEQ ID NO: 4190713 - RNA, 56 nt, Human
caggagcaguuagaagcccacugcacgguccacaaaggugcugcugacugcuucug

SEQ ID NO: 4190714 - RNA, 82 nt, Human
caggagcuggggcuggaacuucuucuggcauuugcuguucauucacaacugccauauuaggagcuucagccaucaguuguug

SEQ ID NO: 4190715 - RNA, 67 nt, Human
caggaggaaagagggagagagggggcccaucuguucaugguguccugccucuugccuucuucaccug

SEQ ID NO: 4190716 - RNA, 129 nt, Human
caggaggacuggaaguguuugucuaauuaucauuuacaauugagucuauuguaugccguguaaauuuaauuuucuuugcuuuuugugucagaugagaccaacugaaaagugauuacuucaguaaccuug

SEQ ID NO: 4190717 - RNA, 59 nt, Human
caggaggccaacugugggacuugagcauacaaagauuuuaguacccaccuggguuccug

SEQ ID NO: 4190718 - RNA, 121 nt, Human
caggaggccuuccugucccuccuccucugaaggcugagacgugcggccuugccucggcuuugccugcuuguaagacacaguccgcacucucuaccuccaaggaaccccgggguuccuccug

SEQ ID NO: 4190719 - RNA, 64 nt, Human
caggaggggcaguagugauggcuccgaggaacgucuugucugccagagcugccugcccuugcug

SEQ ID NO: 4190720 - RNA, 56 nt, Human
caggagguggagcucaagugguaaugcucacuugccugcccacuguucaccucuug

SEQ ID NO: 4190721 - RNA, 56 nt, Human
caggagguuguaagagcaggcccuacauuuguucgcugggcucuuggaggcucuug

SEQ ID NO: 4190722 - RNA, 77 nt, Human
caggaguagaaccauuaagcugguccagacaaguuggacuccaccauuucaacuuccagcuuucugucuaaugccug

SEQ ID NO: 4190723 - RNA, 55 nt, Human
caggaguccagagugucauuuucugaagccacaaauucccacuguggagcucuug

SEQ ID NO: 4190724 - RNA, 59 nt, Human
caggagucccugggaugcccuucuggggacacagcccugaaagguaaucugagggccug

SEQ ID NO: 4190725 - RNA, 68 nt, Human
caggagucugccauccucaccagagcagcuuccuuguagucuguuuuauguguuugguuuccucauug

SEQ ID NO: 4190726 - RNA, 68 nt, Human
caggaguguuccauccaagcccugcccaguucccaagggggcaggaagcucggagagggcaaauccug

SEQ ID NO: 4190727 - RNA, 99 nt, Human
caggaguuuagaccaguguuuuagaugguggugucugcccugguagcuguaaaguagcccucgugcauccaucauuuagaauauuuacuuuugcuccug

SEQ ID NO: 4190728 - RNA, 65 nt, Human
caggaguuuccucuggccuauaagccuuuuucuacuaccugguuauggcagugagaagacuccug

SEQ ID NO: 4190729 - RNA, 85 nt, Human
caggauagaaggaggcauuuccuaugggcagagaagacccccaggagggcuucacuggguaggacaugcugaucccuaguuccug

SEQ ID NO: 4190730 - RNA, 74 nt, Human
caggauauaaugaaugcagaaaaggaugagcauuuuacagugggagcuuccuuuuucugcaugacauaucacug

SEQ ID NO: 4190731 - RNA, 60 nt, Human
caggaugagcaugugacucaaaccaagcuaaucaggucuagcuagaguuaauguucccug

SEQ ID NO: 4190732 - RNA, 65 nt, Human
caggaugcuguggaaaugccuaacaugagguucuaaucucauccaagggcucugaggcaagacug

SEQ ID NO: 4190733 - RNA, 80 nt, Human
caggauggaagauguaccagguauuacaggagcagguaagagggcuauguaaccauauacugggugcaaugucuaaacug

SEQ ID NO: 4190734 - RNA, 118 nt, Human
caggauggcaaauugaaaaacacguaaccauguucuacagauggaaaggggugcuugguuauuaugaaggcccccucgcaagcgugugggacauggguguguucucuggguuguacug

SEQ ID NO: 4190735 - RNA, 98 nt, Human
caggauggccauguuggugcagaugggaugccccuugggccugcuuccaaggccuucuguggucuggcaucuguccaucucuccagcauuaucuccug

SEQ ID NO: 4190736 - RNA, 82 nt, Human
caggauucaggguauuuacacuaugagcacagaaaaggccuuuccuugguuccuggcucacaggugagaugcaugaaaccug

SEQ ID NO: 4190737 - RNA, 129 nt, Human
caggauuuccuaccauuuuucucuuucugaugaaauuaacuucccauaguuggucagcaggauaaucuaauuuuagccaaucagcuugggagcugcuguugaccucacaaagggagagaaagguaucug

SEQ ID NO: 4190738 - RNA, 86 nt, Human
caggcaaaggagaaguaggccgggccacugugggucucccucugggccaugccugacucuggccaggccagcucugacuuagccug

SEQ ID NO: 4190739 - RNA, 61 nt, Human
caggcaacauggugaaacccugucucuacaaaaaaugagccaggcuugaggaaugugccug

SEQ ID NO: 4190740 - RNA, 64 nt, Human
caggcacacagcuugcauaaauccugaacacauuccucaaggcuuuaugaugugugugugugug

SEQ ID NO: 4190741 - RNA, 59 nt, Human
caggcacagagagaauaccuuuugucuuuuccuccagaaguugaguuuuugugugucug

SEQ ID NO: 4190742 - RNA, 91 nt, Human
caggcaccaugccaccacgcugggcuaauuuguguauuuuuuauuagagacgggguuucacaauauuggccgggcuggucucgaacuccug

SEQ ID NO: 4190743 - RNA, 56 nt, Human
caggcacuuuggugagccacgugacccugcgccugcugaagccagaguguguccug

SEQ ID NO: 4190744 - RNA, 76 nt, Human
caggcagaagcaaucacagaguccagcagaugaaaaccgucaacugcuuuauucuagugauauagauguauaccug

SEQ ID NO: 4190745 - RNA, 61 nt, Human
caggcagacauuuuugacauaguugcauagcuagaaauacauaacagauaaugucugcuug

SEQ ID NO: 4190746 - RNA, 65 nt, Human
caggcagagacccucuccuaaaauagaagcaggaaauuaucuuagguguagguguuugcugucug

SEQ ID NO: 4190747 - RNA, 97 nt, Human
caggcagagaguuguagggaguguuacauaauggguucugcaaguggccacaaacuuauuuaaguaaacacuuacuggaauuaauauuuauugccug

SEQ ID NO: 4190748 - RNA, 84 nt, Human
cauggaaaagugccacgacacucauugggaaagugcucucuggggugccugagaaagcuccccaugagaugaugccacuccaug

SEQ ID NO: 4190749 - RNA, 93 nt, Human
cauggaaacagguuuagcucuuaguagucacugcagggauauuccucaaagaaggacuuauuuagguuugaccuguuaauauuuuaauacaug

SEQ ID NO: 4190750 - RNA, 56 nt, Human
cauggaacugugcugaaaaguguuuauuuaaacuucuccuucagcaucguugcaug

SEQ ID NO: 4190751 - RNA, 70 nt, Human
cauggaagcugaggaaugguucuuuugguuguacugucuguagcagacaauggaccaagcaccuuccaug

SEQ ID NO: 4190752 - RNA, 129 nt, Human
cauggaaugucaucuuggcauccacuacuguuaauauaggaggaugagugguuuuacggaaggaacugucuuuguuuaggaaauucucuugcuaaguuacuaguggggaagcgagggcucaggccaaug

SEQ ID NO: 4190753 - RNA, 55 nt, Human
cauggaggacccucagggagcucccuucuaauacagcucccuccguguccauaug

SEQ ID NO: 4190754 - RNA, 74 nt, Human
cauggagugugucauucugcccaguacacccagcacagaacacauggugucugaaacuuaugauauacuccaug

SEQ ID NO: 4190755 - RNA, 118 nt, Human
cauggauuuaugaaauaugagaauucuauugugugcuguguguguagauaaaaaaaguaagugccuacaaauuagaugugcagcaaaauagaaucuuuuaaguuuucuauaauugaug

SEQ ID NO: 4190756 - RNA, 59 nt, Human
cauggcagagaaggggaacuggcucagaaucucccugcuauucuccuuccugugucaug

SEQ ID NO: 4190757 - RNA, 69 nt, Human
cauggcauugugagucuguauauuauuaugccccaugccuuggcauaaagacaugcuuacuugcccaug

SEQ ID NO: 4190758 - RNA, 68 nt, Human
cauggccacauuuaguaacugguuugcaaacauucugaaaaaguagcaauuggcucuugugggccaug

SEQ ID NO: 4190759 - RNA, 80 nt, Human
cauggccccaggcgugucaggcuaauuugcaccugaggcucuucauacuuggcagacagccagacugcacuggggacaug

SEQ ID NO: 4190760 - RNA, 60 nt, Human
cauggccccuggucacuauggccuccuguccccauggccgcuggucaccauggcguccug

SEQ ID NO: 4190761 - RNA, 64 nt, Human
cauggcccucuucuggagcaauggguucaugagguuuacucuuaauuaucuagaaagggcuaug

SEQ ID NO: 4190762 - RNA, 58 nt, Human
cauggcggucaggauguaggugcuggugaacugacuauuggcauccauggccgugaug

SEQ ID NO: 4190763 - RNA, 61 nt, Human
cauggcucggggacaggagguaaaucauugcuuacccaaacaugcccuccuggggucuaug

SEQ ID NO: 4190764 - RNA, 57 nt, Human
cauggcuucgucacagagggcagcaggcgccagugcccggcccguguggagaccaug

SEQ ID NO: 4190765 - RNA, 109 nt, Human
cauggcuuggggauauggggcucaguucccuuggggcucuuugccaggcccagauaagggcuguucagggcacucaugggcugauggaguucuuucauccccaggucug

SEQ ID NO: 4190766 - RNA, 77 nt, Human
caugggacuagaagagcggguggaaucacuugcaaaacgcuaauaaaucugcaggcccagcuguuccucguccgaug

SEQ ID NO: 4190767 - RNA, 81 nt, Human
caugggaggacuggggagugagggugaggaagauagccuaacucucugcuucauuuugacuuagccagugcuuuucccaug

SEQ ID NO: 4190768 - RNA, 129 nt, Human
caugggcugugauauaaauuuugacagcaauacaguagguuuauuggugagacaaugagugaaauugcauugaauggcuucuguguugcucgugaaaugugaggugugagugacaguugagaggaaggg

SEQ ID NO: 4190769 - RNA, 57 nt, Human
caugggggcugaggcugcuguagcccucuuuuauugcuagucugccuccccaccgug

SEQ ID NO: 4190770 - RNA, 98 nt, Human
caugggguuuuuggggcaccauucuagucaaucuccaggauuucaacaaaaaucucugcagcuaagaaauuaauuggaaaugggagccuuaauccaug

SEQ ID NO: 4190771 - RNA, 63 nt, Human
cauggguaggauuuacucagauguuagacugauuuagagacaaauguaguguguccaccccug

SEQ ID NO: 4190772 - RNA, 56 nt, Human
cauggguaucauccccagagcuuuaugcuuuuuaaguucuuagguugauacuaaug

SEQ ID NO: 4190773 - RNA, 72 nt, Human
caugggucauauugccuguauaucacucucuucugcagucuaccaagcguuauaaacagcaugugauccaug

SEQ ID NO: 4190774 - RNA, 81 nt, Human
caugggugggcuuggugcacuugugauguggugccuccuguuaauucaccugucaucccggcugcaccgucaacgcucaug

SEQ ID NO: 4190775 - RNA, 106 nt, Human
caugguaacucuuccugguuggagaaugucauuuaaaauaauucugucuuuaaaacugugggaugaggggaaggaaaaugucaccuccaaccagguccucaccaug

SEQ ID NO: 4190776 - RNA, 61 nt, Human
cauggucaccaggccagccuggggcacgccagcagcuccgaugcuggcagauguggccgug

SEQ ID NO: 4190777 - RNA, 60 nt, Human
cauggucuacaauuucauuuuaugaugucuuuaaaugagagggagauugcaaagacuaug

SEQ ID NO: 4190778 - RNA, 74 nt, Human
caugguggauuaucuuucugauaugcuguugaaguugguuagcuaguauuucauugaggauuuuuccaucuaug

SEQ ID NO: 4190779 - RNA, 58 nt, Human
caugguucugacagacuuuuucagcuucuaaagugcucaggaggucaaauggaaucug

SEQ ID NO: 4190780 - RNA, 74 nt, Human
caugguugagaaggaaauagagaaguagccugguggcuguuucugguucuguuccuacaaguaacuggacuaug

SEQ ID NO: 4190781 - RNA, 76 nt, Human
caugguuuguaacccaauacuccccagcuuguccuucagaacaugggcaauuuggaguucuggguuaauaaaagug

SEQ ID NO: 4190782 - RNA, 111 nt, Human
cauguaaacuaagauacauacuuuaucagcgucaaagguacuucuccucuaaacagaguaggagauaacaauaccuuugacguugauaaagcacguaucuuaguugauaug

SEQ ID NO: 4190783 - RNA, 68 nt, Human
cauguacauagaucuugaaaauuagcuggacuuaaguaggcauuuaguuuucaagcuuuaguuuagug

SEQ ID NO: 4190784 - RNA, 75 nt, Human
cauguaccuaauuaugguaaaguuaauauguaaaauuacauauuugucuuuguacuguucggauuaaggugagug

SEQ ID NO: 4190785 - RNA, 92 nt, Human
cauguaggauuuuugagaagaauuuugcuuuuaugucaaguggaaugagggccacugaugaucugggaguagagugacuaugauccgacaug

SEQ ID NO: 4190786 - RNA, 62 nt, Human
cauguaugacaguaagagugucuggguuccaauuuuggcuacccacuuucuaacuguggcug

SEQ ID NO: 4190787 - RNA, 96 nt, Human
cauguaugguugagggcaacagucaguaguugacguguaagcaauccauaagauuguuagcaugauuccugcucauuguugucuugucaccaagug

SEQ ID NO: 4190788 - RNA, 74 nt, Human
cauguauucuuaaggauugagcaaacugcaggcugcuugcugccuuuuagguuugcuagucccugaucuacuug

SEQ ID NO: 4190789 - RNA, 75 nt, Human
caugucacaagcuuuccauuacacacauuccuucuccugaaaaccuggugaguguggggagggcuggugaauuug

SEQ ID NO: 4190790 - RNA, 56 nt, Human
caugucagucacaaaguucuaaagcuucugcuuuggaauguuucuuguacugaaug

SEQ ID NO: 4190791 - RNA, 77 nt, Human
cauguccuacucauuuuucucucacacuuaccagugcuggcacuggaaggaaagaaugaaaacugagugaccacaug

SEQ ID NO: 4190792 - RNA, 69 nt, Human
caugucuguacauuuuuagagggcuucagcagggcauugaggaggugcucuguguaugcauagaauuug

SEQ ID NO: 4190793 - RNA, 75 nt, Human
caugucugucuuugcucaucauugcagugggguggugagcccaucccuuguccugugggaagagcucagugcaug

SEQ ID NO: 4190794 - RNA, 78 nt, Human
caugugaugacuugggcucaguuggauggccuaucagugaugggccacuaccuucucuggauccccucuuaucauuug

SEQ ID NO: 4190795 - RNA, 58 nt, Human
caugugcaacuucagcagaaaggaaagaucagcuauucuaaugcuguauuuguaccug

SEQ ID NO: 4190796 - RNA, 61 nt, Human
caugugcauagacuuucaccaccucccuaugaaguggacaagauucugugcuuuaaacaug

SEQ ID NO: 4190797 - RNA, 85 nt, Human
caugugcucaaaauuuccaccauucugaggagaguggaugguugauacagcacauccuucuucaaagagggaaaaggagcaggug

SEQ ID NO: 4190798 - RNA, 66 nt, Human
caugugcuuggggaacgucaaggccagagucagcaugccuggagcagacgugucccggggucaaug

SEQ ID NO: 4190799 - RNA, 86 nt, Human
caugugggaaucaggaucaugcugggugggaaaaacaaccuucucauuuguguuaucccugugccuauaugugcugauucuccaug

SEQ ID NO: 4190800 - RNA, 74 nt, Human
caugugguuacuacauuaugaggaaagaguggaauuaaugcuaacuuguauauucucauauguacacauacaug

SEQ ID NO: 4190801 - RNA, 66 nt, Human
cauguguaccagcuguucuuugcccagcuuccuugggcuagaaacauauucagugaguaauacaug

SEQ ID NO: 4190802 - RNA, 59 nt, Human
caugugucugguuauugacaugcuguuggccagagagacaggaguucccaggccacaug

SEQ ID NO: 4190803 - RNA, 71 nt, Human
caugugugaagaggccgugugcaggugaggucuauuaaagaacaucgaugaaguccacguggcuucacaug

SEQ ID NO: 4190804 - RNA, 59 nt, Human
caugugugacaaacugccugcauaagucacagugccaguggcagagauuuguaaccaug

SEQ ID NO: 4190805 - RNA, 62 nt, Human
cauguguguacacacgugacucugcaggugcucugcgugucccaaaauuguguacacacgug

SEQ ID NO: 4190806 - RNA, 105 nt, Human
cauguuaaugaaaccagguaaaauuuggucauuugagcagcugaccaggcuugugaaugcugggacucuguacaaaagaaaguuccuauuugggucauugauuug

SEQ ID NO: 4190807 - RNA, 71 nt, Human
cauguuaugguugauaucaguaauauuauggaaauguccauugcuuuauuacucugucugccucugaccug

SEQ ID NO: 4190808 - RNA, 60 nt, Human
cauguuccaugaagcauuauguuauuuacuuagacauuuuaaaaugcauuuauggagaug

SEQ ID NO: 4190809 - RNA, 130 nt, Human
cauguuccauuaaaaacagcucguuagucccuuuacaacugguaaucuccacggucaaaucagcaugaaguauucguugugugacugagauuucagaaagggagcuuugagucugguacugauggaacug

SEQ ID NO: 4190810 - RNA, 93 nt, Human
cagccuuaaaugacauuuauuaucuuacaguucuagagaucagaagucugaaaugggucucacuggggugaaauuggagugucagcagggcug

SEQ ID NO: 4190811 - RNA, 60 nt, Human
cagccuucugaaugaacguacuggauuccgaaagcaguguggaguuacaugugaaggcug

SEQ ID NO: 4190812 - RNA, 77 nt, Human
cagccuucuugucuuuuuugguuuugcuuucuuuuaacacaugaggaaacuaaagcccagagagggaaagggaccug

SEQ ID NO: 4190813 - RNA, 68 nt, Human
cagccuuguugcuaccagaugcccauaugugauucaugcccauggcuucugaguggacaauaaaccug

SEQ ID NO: 4190814 - RNA, 56 nt, Human
cagccuuugggauugggauugagaugggcaaucccucuuccuuucccuugagggug

SEQ ID NO: 4190815 - RNA, 56 nt, Human
cagcgagaagaaaauggucuguggagucagacauuacagauuuuauaucucugcug

SEQ ID NO: 4190816 - RNA, 81 nt, Human
cagcgagcgguggaagggggauugggaagcagguggggugcccccacacuccugcuggcucuguugcucggccaccugcug

SEQ ID NO: 4190817 - RNA, 116 nt, Human
cagcggccgccacccuucguugccccuggagccgccggggaggccagugucggagccagccaugcggcggcuccucucuggccgcucccgcggggccggggcuucggcggcugcug

SEQ ID NO: 4190818 - RNA, 74 nt, Human
cagcggggcggcggggccugucugugcugagcauccccagcuccagggcaggugcugggcucugagccccacug

SEQ ID NO: 4190819 - RNA, 72 nt, Human
cagcgguuauuggagcagaacaggccgggugggaagacagcuuauucccaaagccacucugccucccugcug

SEQ ID NO: 4190820 - RNA, 61 nt, Human
cagcgucuucugccgacagcaucugccaaacgaggggaauugcaggcaggcagagaugcug

SEQ ID NO: 4190821 - RNA, 78 nt, Human
cagcgugaggggcggcgcauucaucuucucaagcaccacgugcgugugagcacugugaugcuguucccuccuacacug

SEQ ID NO: 4190822 - RNA, 88 nt, Human
cauuuuggauuuggguggacucuggcagagccugccccagggcuucugcacuaggcucugcagauucaucccuucacccagcaaaaug

SEQ ID NO: 4190823 - RNA, 55 nt, Human
cauuuugggugaguuugaggcacauaguagucugggaccuguuugcccacagaug

SEQ ID NO: 4190824 - RNA, 87 nt, Human
cauuuugucaggcaauuaaaguacugugaaugaguaauagcaauagauccucauauuaaggucauuuuguguguguguauaaaaaug

SEQ ID NO: 4190825 - RNA, 86 nt, Human
cauuuugucuuguucuagugcuuuugucauugaaucuugcuuucauauggguaaguuuagauauagguauucugauaugaaacaug

SEQ ID NO: 4190826 - RNA, 85 nt, Human
cauuuuuaaaauauuacaaauuagguauuuucuggacagggcccuagcuauggucucuuccuugaccuauuguaauagaagaaug

SEQ ID NO: 4190827 - RNA, 71 nt, Human
cauuuuuauauggggcuuggcauuuuaacaucuggaaaaguugugaaaucaauuagcugcagauaaagaug

SEQ ID NO: 4190828 - RNA, 60 nt, Human
cagugcagccaaggacaggcacccgcugcugggcuccgccugccgccuggcugagaacug

SEQ ID NO: 4190829 - RNA, 99 nt, Human
cagugcagggaggcuggggguccuggaggccagcuggagcagguaucgcccagucacccccuccuacuuccuuccacuccccacgccugagccucgcug

SEQ ID NO: 4190830 - RNA, 67 nt, Human
cagugccaagccacagaucacugcuaauuccaaggcagagcuuacuugauuugugcccauggcauug

SEQ ID NO: 4190831 - RNA, 93 nt, Human
cagugccccagagcccuucuguucaggccuggcaucccacagagguggcauucugcucaggagcuuagagcacagacgaagaggcaggcauug

SEQ ID NO: 4190832 - RNA, 66 nt, Human
cagugccuagcaugguauaggagcuuaauaaauacaggguagcuccucaguauauaaaggcagaug

SEQ ID NO: 4190833 - RNA, 78 nt, Human
cagugccuguuggccaaagcucaccagugcugugggaucagacucaggcagcgggcucaaguggccagcagggcacug

SEQ ID NO: 4190834 - RNA, 76 nt, Human
cagugcuccuggaguccuuuccuauucuuguauggggggaaggaagggauuugaggaaaggguaaaaaagguacug

SEQ ID NO: 4190835 - RNA, 59 nt, Human
cagugcuuugggaggcugaggagggagggagcccuugagcccagaaguucaaggcacug

SEQ ID NO: 4190836 - RNA, 59 nt, Human
cagugcuuuucaaaguucuaugugcacauaaaugcuugaggauuuuguugaaguuucug

SEQ ID NO: 4190837 - RNA, 64 nt, Human
caguggaaggucaggggacagugaaguggggucacucccaggugcugagcucuggcagccacug

SEQ ID NO: 4190838 - RNA, 73 nt, Human
caguggaaguuccugcuaucugacucuagcuuuguaagucuuaguucaaaaugucagagaaggagcuuuccug

SEQ ID NO: 4190839 - RNA, 86 nt, Human
caguggagacgcagugucaccaggcgagucucccaauuuaucagaggugauaauggagcagucuggugauacucagcucucgccug

SEQ ID NO: 4190840 - RNA, 57 nt, Human
caguggagggcaggggaguccguccgcuucuugaggacaguccgggguccuccacug

SEQ ID NO: 4190841 - RNA, 71 nt, Human
caguggcaagguuagcagcaaagggaggugagcucauuacuucucugacagucuguuucaccuagacacug

SEQ ID NO: 4190842 - RNA, 76 nt, Human
caguggccuuugucauuuucagcugggccccuuacucugagugggcugacucugcacugagccaugauauacacug

SEQ ID NO: 4190843 - RNA, 68 nt, Human
caguggcugcugggggaacaguuaaaauuacuacagugugauuacuguggaugccagcagcaugacug

SEQ ID NO: 4190844 - RNA, 84 nt, Human
caguggcugucuccuauuuccugcuaaggcuugcaacauauauggcacacauccaguauggagguaggaauaaagacaucacug

SEQ ID NO: 4190845 - RNA, 61 nt, Human
cagugggaaccugccugcacagugugguugaagcugcuuggcugggucagcagguccucug

SEQ ID NO: 4190846 - RNA, 56 nt, Human
cagugggaccggugcuauuccaggugcuaaucaaugcccuggaacugcucuuacug

SEQ ID NO: 4190847 - RNA, 65 nt, Human
cagugggaggaggcauuugauaggcuuauaauggcuuaagagccuggguuaggguucuuccccug

SEQ ID NO: 4190848 - RNA, 83 nt, Human
cagugggcacuaaaauacugucuuucacagauauuucgccuuggaaauuucauggaaaguuaguagagugaugcuaccaacug

SEQ ID NO: 4190849 - RNA, 86 nt, Human
cagugggcuggagccccacaguggccacccacugagacagggcauuaguuuccuguucaccauggucacgugcucccagcucagug

SEQ ID NO: 4190850 - RNA, 86 nt, Human
cagugggcuuccuggaccugcagcaucagcaucuccugggaacuaacuagacaugcagauucucaggccccaccacagaccuacug

SEQ ID NO: 4190851 - RNA, 67 nt, Human
caguggguggauuuauuuaaggaccucucuauuacugaaaauagaguccuucaagaguccccuacug

SEQ ID NO: 4190852 - RNA, 59 nt, Human
cagugguagaagccaaguagaucauuauuccacaaacauuuacaauuggcuuuccauug

SEQ ID NO: 4190853 - RNA, 89 nt, Human
cagugguagcagcgggaccucugcaccugccuccucuggccugcaaggaaaggggagacacgggugcugaggaccccucaaucucccug

SEQ ID NO: 4190854 - RNA, 64 nt, Human
caguggugaagagcaggggcucugggcccagaccaucuggguacaaauccuggcucugccacug

SEQ ID NO: 4190855 - RNA, 74 nt, Human
caguggugcgggggccaaggugaacugcugcaucuuaacuagcaucgguguccuuguccuuugguacccagcug

SEQ ID NO: 4190856 - RNA, 99 nt, Human
caguggugcugggcuguccauccacaggcaagucucuuggcagauucauacagucaccaucuccuucagaaccugugauggaaaaguccaguaccagug

SEQ ID NO: 4190857 - RNA, 90 nt, Human
cagugguggacuucauuauccagaaugcucgauucuccuguagcaaaaugaauccauugugauaguuauuuuggaaaaugagucauccug

SEQ ID NO: 4190858 - RNA, 85 nt, Human
caguggugggggcugugcggaaauagauagcuccucaccaucucaaaggaggagcugcuacugcucugccagaggaauacuguug

SEQ ID NO: 4190859 - RNA, 56 nt, Human
cagugguucucaaucaggaaugguuuugaauauugcagguuaggugggaaucacug

SEQ ID NO: 4190860 - RNA, 89 nt, Human
caguguaaaaauccucauucacauucuucuuacuguuauauucauuuucuggguucaggcaccgggguggagugugaggagaggcagug

SEQ ID NO: 4190861 - RNA, 111 nt, Human
caguguacaggauuucacacgacuuucaccagcagcucacuagucacauggaggcagcuagcaaacaugggcacugacagugagcguuagugaaugaacgcacugcaccug

SEQ ID NO: 4190862 - RNA, 58 nt, Human
caguguaucuuuuuuuaaccuuuaaaaaaaucuuuaaagguaguuuuaaaggugcuug

SEQ ID NO: 4190863 - RNA, 84 nt, Human
cagugucagugguccaggcagggcugacucagccacccucgguguccaagggcuugagacagaccgccacacucaccugcacug

SEQ ID NO: 4190864 - RNA, 66 nt, Human
cagugucaguuuggcucuaaaguuucaagggauacugaaagggaauauuggaaccaaaugaaucug

SEQ ID NO: 4190865 - RNA, 82 nt, Human
cagugucaucauagauuugugcaagaagggauuccagaugcuauuuuagaacaaucuucucauuguacagaugaugaaacug

SEQ ID NO: 4190866 - RNA, 83 nt, Human
caguguccugugagggcuauagggcagggcccugccccagcggaugggcucgggagggggcucccugaagccaguggacacug

SEQ ID NO: 4190867 - RNA, 100 nt, Human
cagugucuaccuugguucucuacuagggaaaguggacauggcuugucuuaggagucaaagggaagucuguuucauugucccuggauguuggauuauacug

SEQ ID NO: 4190868 - RNA, 67 nt, Human
cagugucugcucagacagcuacagcugcccaaauugccuuucuguaucuaccugucuagcaacacug

SEQ ID NO: 4190869 - RNA, 56 nt, Human
cagugucuuauuuguagcucagagagacaaccuucuggcuacagugguaagaacug

SEQ ID NO: 4190870 - RNA, 97 nt, Human
cagugugaagguuuuuauacuucugccagaggacaacguaauaugaaacaccgaguuuuauuugucucuacagagaguaguagugucuuucaggcug

SEQ ID NO: 4190871 - RNA, 62 nt, Human
cagugugcaggucuccccugcuggggccuagacagcagccaggaggugacagccugcaucug

SEQ ID NO: 4190872 - RNA, 64 nt, Human
caguguggagcaucgagggcagaggagagcugagccgaccccacccucugccccagccgcacug

SEQ ID NO: 4190873 - RNA, 77 nt, Human
cagugugggacggugauuggggccacagguuguggaaucugaccugguucccagccaggcucuaccacuugacgcug

SEQ ID NO: 4190874 - RNA, 78 nt, Human
cagugugucccugaugguggggcucugggguguuuccuuagcagcagccuagagucucucugcaggaguuucacucug

SEQ ID NO: 4190875 - RNA, 59 nt, Human
cagugugucucuuguccuggcuaggcauagggucccaagccagaguuggggacaagcug

SEQ ID NO: 4190876 - RNA, 58 nt, Human
cagugugucuugacugccuuuugaaagaccauuggaaaggcaggccuaggacauauug

SEQ ID NO: 4190877 - RNA, 68 nt, Human
cagugugucuuuauaagaagagggagagauaccagagaucuccuucucuaccaugugaggaaacagug

SEQ ID NO: 4190878 - RNA, 65 nt, Human
cagugugugacucuggggguacagcaaaacagcaugcucuuuacucucuuggaguucacauucug

SEQ ID NO: 4190879 - RNA, 85 nt, Human
cagugugugauugugggaggaauuagaaugggauaagauaucaacacaucauauucuuuuccuucuuucccccuagucauuuuug

SEQ ID NO: 4190880 - RNA, 77 nt, Human
caguguugaucuucaucgaaauauugugucaugucauugugggacgcgugauacauuuugauuuggaaaucaaucug

SEQ ID NO: 4190881 - RNA, 74 nt, Human
caguguuggcacagggaggcagccaugcucccgaguccugggagugggcagcacugcccugugggucugcacug

SEQ ID NO: 4190882 - RNA, 77 nt, Human
caguguuguauaauuccagggcguguugucuacaagggguacaaugugaagagugcucccuagaguugugcaaccug

SEQ ID NO: 4190883 - RNA, 74 nt, Human
caguguuuaaacagggcagugucuugaaaaaugacuuuguucucuagaucacucacggugcuggccugacacug

SEQ ID NO: 4190884 - RNA, 71 nt, Human
caguguuugcauugcaguguugccuggggccuuuaacaaaugcucaagguaacacugcaguugucaagcug

SEQ ID NO: 4190885 - RNA, 59 nt, Human
caguguuuuuacaagcacucugggugauucugauaaauccagaaauuugagaaccacug

SEQ ID NO: 4190886 - RNA, 55 nt, Human
caguuaaaugaugugcccuagaucacauaaugugugucucacauuagcuugacug

SEQ ID NO: 4190887 - RNA, 55 nt, Human
caguuaaucuugccauuauauccaauuuaaacauuggguguucaaagauuaacug

SEQ ID NO: 4190888 - RNA, 70 nt, Human
caguuaauucagucaggguucagggucuaaacaggaaguaaaaucugaccugagccuugaggagugacug

SEQ ID NO: 4190889 - RNA, 88 nt, Human
caguuacuucaggccaucugggcauauaugugcaagucacaggggaugcgauggcuuggcuugggcucagaggccugacacagugcug

SEQ ID NO: 4190890 - RNA, 56 nt, Human
caguuagagggcuccugggccacccccaaauaucuggcuugcccacaucugcacug

SEQ ID NO: 4190891 - RNA, 93 nt, Human
caguuaggagugcagcccagcagguacuuugcuuugggccuuacacgaggccuugugagaagcagagaacccaguugagccaaccuguaacug

SEQ ID NO: 4190892 - RNA, 67 nt, Human
caguuagugucauguuaacaaagcucugggacauaucuucaggccaagguagacaugacugaggcug

SEQ ID NO: 4190893 - RNA, 61 nt, Human
caguuaguguguuccugucuucuagacuuaucuacagggaucagaaacauagcccugacug

SEQ ID NO: 4190894 - RNA, 83 nt, Human
caguuaucauuugaagccacuguuuuggagugcuuuguuaugcagcaguaguuacccagaacacuggaaguaagggauggcug

SEQ ID NO: 4190895 - RNA, 56 nt, Human
caguuaugagguguuucuggcagcuuccuggacucagaauaauaaccuaguaacug

SEQ ID NO: 4190896 - RNA, 98 nt, Human
caguuauuuaagaaaaugugcagagccauuauggagacuugcagguugacuuacaaaguaggucuccauaaggcagaaacauuuuuaaaaucugacug

SEQ ID NO: 4190897 - RNA, 91 nt, Human
ccaaaaaauuuguguuagggaagguugcccuaggguuuguugccuuuaauagcaucuuuauauucugggcaagccuucuuauacauuuugg

SEQ ID NO: 4190898 - RNA, 60 nt, Human
ccaaaacaguaagagauguuuuaucuuguaggggauauuauugaauuuuuucuguuuugg

SEQ ID NO: 4190899 - RNA, 108 nt, Human
ccaaaaugcccuucggugacuuuccagcgaguaaaaucuuaagcacagugggauguccaaugucuuuugaagguuuuggcugagagagacaacauucuuggaauaugg

SEQ ID NO: 4190900 - RNA, 86 nt, Human
ccaaacccugcuauuuguucaaaaucaagauuaaaagcauuucuacaacacuacaacuuucuucuugauuuaaacagggaguuugg

SEQ ID NO: 4190901 - RNA, 55 nt, Human
ccaaacuacaauuccuaggcuucuauuucuagacaugccacaggaugaaguuugg

SEQ ID NO: 4190902 - RNA, 65 nt, Human
ccaaacuuugugcaacaucagggaauguauauugaagaagauuccugcaaauguaaugaguuugg

SEQ ID NO: 4190903 - RNA, 58 nt, Human
ccaaagcaugccucauggauggcuguuuggcccuuguaguccugggcguugacuuugg

SEQ ID NO: 4190904 - RNA, 67 nt, Human
ccaaaggcuugcugugcuggcuucuaaaauugacccgaauuaucagcagcccaauggcaagcucugg

SEQ ID NO: 4190905 - RNA, 55 nt, Human
ccaaagguaaaacgcaugcccagucaucauuauggguauucugugucaccuuugg

SEQ ID NO: 4190906 - RNA, 100 nt, Human
ccaaaguaacucuguaguaagugguggaguguggucuugaaccaugaaauauugaagacuuugcucuuaaccacagcacuauauuaagacuaagcuuugg

SEQ ID NO: 4190907 - RNA, 59 nt, Human
ccaaaguccacaguuuacauuacuguucacucuuagugguguacauucuauggguuugg

SEQ ID NO: 4190908 - RNA, 59 nt, Human
ccaaaguccauaguuuacauuaggguucauuuaugguguuguacacacuaugguuuugg

SEQ ID NO: 4190909 - RNA, 60 nt, Human
ccaaaguccauaguuuacuuuaagggucacucuuggugauguauauucuauggauuuugg

SEQ ID NO: 4190910 - RNA, 63 nt, Human
ccaaagucuauuaagaaacuuucaaagauagguggaccugggaaagacucuugaugucuuugg

SEQ ID NO: 4190911 - RNA, 58 nt, Human
ccaaagugcuaggauuacaggcaugaaccaccaugccuggccuccacuguauucuugg

SEQ ID NO: 4190912 - RNA, 102 nt, Human
ccaaagugucuaaauucuagcauugugaaaauauuccaaaaaacaggcagccauauuauuccuuugucuauauuuuggcaaaugucuagauggauacuuugg

SEQ ID NO: 4190913 - RNA, 77 nt, Human
ccaaauccuuagcccacuaauacuuauugagucucuauuuuuaucuauuaaugggaaauucuuuggguuaggguugg

SEQ ID NO: 4190914 - RNA, 129 nt, Human
ccaaaucugcaaacuucaccauugauaaucuauaaaagguauuauuugcaaucauuuguacuucugucugguuuauguacacaugggaaaugauaucucauuuauagauggagaaaauaaaauucgaag

SEQ ID NO: 4190915 - RNA, 79 nt, Human
ccaaauguauuacuccucugaugccuacaauuccacuauaauagucuggugggcuucuguuagggaggcuuauacaugg

SEQ ID NO: 4190916 - RNA, 75 nt, Human
ccaaauguccuuuauagccucuguggcuucuuucucaagcccaggauccaguccagggcuguguguuacauuugg

SEQ ID NO: 4190917 - RNA, 78 nt, Human
ccaaauguuuaggucuuagauacaguagaaagacucugugggccacagacagagugcuguaucugagaaagcaacugg

SEQ ID NO: 4190918 - RNA, 66 nt, Human
ccaaauucucacccuguuugauugguguauguuaucucuaccgaaguucacccagagagaauuagg

SEQ ID NO: 4190919 - RNA, 85 nt, Human
ccaaauugucagcaacccaucacucccaggcaaaauccaaacugcugggcuguccccuuggacugauuugugugcuggcuuuugg

SEQ ID NO: 4190920 - RNA, 94 nt, Human
ccaacaucuucuucaugauugacagcuucgaggaggugagcucugcacagggccucucuccuuagcuuccccuucucgugagauggguguuagg

SEQ ID NO: 4190921 - RNA, 116 nt, Human
ccaaccucaggugauccaccagccucagccucccaaagugcuaggauuacaggugugagccacugcaccuggcaguuuuuuguauuuuuaguagagaugggguuucaccauguugg

SEQ ID NO: 4190922 - RNA, 60 nt, Human
ccaacgcccagccuugaucaaaugauuuuuaaaucagaucaaacaaaauggguuaguggg

SEQ ID NO: 4190923 - RNA, 64 nt, Human
ccaacggaguccaagcuagagccacucauggugugguccauggguggcagcuucagcauguugg

SEQ ID NO: 4190924 - RNA, 76 nt, Human
ccaacuaaacuuuuucguuucuauucugaugauauaagaaaaauauauauuacaagaaagggcaugaauuaguugg

SEQ ID NO: 4190925 - RNA, 73 nt, Human
ccaacugcagugcguucuuguucucauuguucuggacagagagaagcaaucagcagccacccacugcagcugg

SEQ ID NO: 4190926 - RNA, 74 nt, Human
ccaacuggagcugagacuugagguuagguucaaguguaagcuuccuuucccucacagccucggagccuucuugg

SEQ ID NO: 4190927 - RNA, 62 nt, Human
ccaacuuagugagccacucuugcauccuaugucaguugggguguaaguuucaucugaauugg

SEQ ID NO: 4190928 - RNA, 58 nt, Human
ccaacuucacguucaguccaguugcuuuucaggcaaucucuugggaggaaugaauugg

SEQ ID NO: 4190929 - RNA, 116 nt, Human
ccaacuucugccauaucuaucucguguauuacuauaugcguggcaggugcuuccaccauaagacauccgaggcccucuugcagguggugcaccaugagaggucccugcaggguugg

SEQ ID NO: 4190930 - RNA, 62 nt, Human
ccaagaaagccuccuuggagcacccuggacuggccugggaucaguuaaggagaguuuuacgg

SEQ ID NO: 4190931 - RNA, 55 nt, Human
ccaagagcuucccauagcuucuuguggccauuuccagaacuaaggggagcucugg

SEQ ID NO: 4190932 - RNA, 68 nt, Human
ccaagaggggcagagggcugcaggcacucucuccccacccagcugccccauguuucagccccuccugg

SEQ ID NO: 4190933 - RNA, 55 nt, Human
ccaagagguaucuugccauaaagaucuuccucccgugguuucaaguugccucugg

SEQ ID NO: 4190934 - RNA, 75 nt, Human
ccaagagguugugaggcaggcaaaagagauauaggauuucuuccuccacuucaugcgcugcuuggaucuauuugg

SEQ ID NO: 4190935 - RNA, 91 nt, Human
ccaagaguguguuucucagaauuaauaaccacaaggcccuuuucuuacagaggucuuguagguacugguuugcugugaaaugcacuuuugg

SEQ ID NO: 4190936 - RNA, 59 nt, Human
ccaagauaaucugugaaaaaucaaguauuuuaaaauagauuuugucaaaauugucuugg

SEQ ID NO: 4190937 - RNA, 89 nt, Human
ccaagaugguaccuucacagggccacuggcaggaggccucaguuccuuaccaugugggcucuccauaggcccugguguccucauguugg

SEQ ID NO: 4190938 - RNA, 67 nt, Human
ccaagauuuuaucuccguuucuguaauucucccuaaagauuuagagauggcagauugaaucaaaugg

SEQ ID NO: 4190939 - RNA, 80 nt, Human
ccaagccaugaaggggaucggugaguggguguuggcagccuugccaccucugcucaagaccccuccgcucacagcccugg

SEQ ID NO: 4190940 - RNA, 56 nt, Human
ccaagccucacuucccuuuucauuggcaaauacauuugucaugagguagaggcugg

SEQ ID NO: 4190941 - RNA, 70 nt, Human
ccaagcuuguuucuccugggggugcucuuucgaggauauuugggcugccuccggagucacagugucuugg

SEQ ID NO: 4190942 - RNA, 64 nt, Human
ccaagcuuuuguguagauuuuucccugucuggaguaggcagguguuuuuauauuaaagaucugg

SEQ ID NO: 4190943 - RNA, 69 nt, Human
ccaaggaaaacuuguacuacgguugcuacaucaagggaugaggaccuuggaauaacaaauucucuuugg

SEQ ID NO: 4190944 - RNA, 67 nt, Human
ccaagggagacugugagaccucuaaggccaaguaaaaagacuuuucuggaauuacuuucuccuuugg

SEQ ID NO: 4190945 - RNA, 118 nt, Human
ccaagguguuaggccaacuccugaugcucugaaauaguaguaaaaaacuaugcaauuauaaugguguguuuguuagacuaauguuacaggaacaaucaugagguuggggacacagugg

SEQ ID NO: 4190946 - RNA, 105 nt, Human
ccaagguuccuguggcacagugauuaagagccagucuuagggagucugaaugaaggaccuggacuugaauccugacuuugccacccccuggcuuagggacguugg

SEQ ID NO: 4190947 - RNA, 82 nt, Human
ccaagguugucagcugccuuuccagacauugauaggcaccuugccucuuaggguuaaaugucuguagaugugcugaaccugg

SEQ ID NO: 4190948 - RNA, 93 nt, Human
ccaaguagaauagguauuuauguugccucuauguuugccuucauauauauuauaaacauauugagcucuaaaaguacauggcuuucugccugg

SEQ ID NO: 4190949 - RNA, 71 nt, Human
ccaagucuguggaauugaugcuuagugucaaaacaguccagaucacuuugguaccaauucagcgucgcugg

SEQ ID NO: 4190950 - RNA, 56 nt, Human
ccaagugccugagucagaaacgugacauuuuucaacauccuggccaguguacuugg

SEQ ID NO: 4190951 - RNA, 64 nt, Human
ccaaguggaucuuacugaucucugauacacgugcauggaacaaaggcucaguaaaucuuugugg

SEQ ID NO: 4190952 - RNA, 55 nt, Human
ccaagugucuucaaaggcuaaaacaccacuauuguuucaagcauaaggcacuugg

SEQ ID NO: 4190953 - RNA, 72 nt, Human
ccaaguguggcccuucugagcacagggcccuguguggcugcacaggucucgugcccacgaagccagcacugg

SEQ ID NO: 4190954 - RNA, 73 nt, Human
ccaaguucauuguagcauuauugacaauagccaaauauggaaucaaguuaagugucuauaaguggauuaaugg

SEQ ID NO: 4190955 - RNA, 97 nt, Human
ccaaguugccccgagacucauuggaauucagcuugcuuauaaacaccuggagguuuugagauuaggcugaggucuggggcucggggauuuugcuugg

SEQ ID NO: 4190956 - RNA, 77 nt, Human
ccaaguuggucaauccacagacuauuaagugaucuacacaugcaaguaggcuuuuaaaagcuucuguacuaauuugg

SEQ ID NO: 4190957 - RNA, 60 nt, Human
ccaauacuguaaauggagcagccaaucccagauucuugcugcuguccacacaguaagagg

SEQ ID NO: 4190958 - RNA, 76 nt, Human
ccaauagcuaggucauauuuugcaaggucagcuauaucccuguguagaucuguccucaguguagauucuagagugg

SEQ ID NO: 4190959 - RNA, 69 nt, Human
ccaauaugccucuccccacuuuuguuaagcugggcccugugugaccagugugggcagcaggcauacugg

SEQ ID NO: 4190960 - RNA, 61 nt, Human
ccaaucagagacauccauguuaguugggaugucaacugccccaaugcacauggucucuugg

SEQ ID NO: 4190961 - RNA, 69 nt, Human
ccaaugccugcuuuaagaaugaguguaagacuucaucccagcaaacagucuugaagcaaagucuguugg

SEQ ID NO: 4190962 - RNA, 87 nt, Human
ccaaugccugguuuguuaucauugucgcagucuaauuuauuuucauguaaaugaagcuuagaagaugacuggcaaacauguuccugg

SEQ ID NO: 4190963 - RNA, 88 nt, Human
caucuugcaaaggggaauaaagcaauuugguggguuugacugguguucugauuguccuuuacuuccucuucucugauaaugcauggug

SEQ ID NO: 4190964 - RNA, 68 nt, Human
caugaaaauauucaccauggcauuuaaagucuccccuuuaaaaggcaucauaggugaauaugauuaug

SEQ ID NO: 4190965 - RNA, 97 nt, Human
caugaaagaugcucaucuauccuaauuguuaggugucugaugugcuugaaugguccacaucagacaauuaauuauuaauuuuuggucauuuuauaug

SEQ ID NO: 4190966 - RNA, 129 nt, Human
caugaaagcauggcuuuauucaguaggugcagagucacugcccuugaagacagaccaaggagaaugaauaagucuuucccucuguuuucaguggaugcucaccuuaugaauggagccauauuuaaggag

SEQ ID NO: 4190967 - RNA, 60 nt, Human
caugaagcuugaagcaguccacgcagcuacugaggagcuacuuggacugguuucaaggug

SEQ ID NO: 4190968 - RNA, 104 nt, Human
caugaauaccuugccuuguuauaguauuucaguuccucuugugaccagugucauagcauggguuuauaaguuaacuggaguuagggaugcuaucuuuggucaug

SEQ ID NO: 4190969 - RNA, 72 nt, Human
caugaauaugguacaauuuucauuuguggaggucuucuuuaauggcuuucaauaauguuuugugauuuuaug

SEQ ID NO: 4190970 - RNA, 56 nt, Human
caugaaugcuggguucauguaaacugcacagcagaucugacuccccaggguucgug

SEQ ID NO: 4190971 - RNA, 56 nt, Human
caugucuuccauuagacucucagauucccauuacucugaaaaggucaggagacaug

SEQ ID NO: 4190972 - RNA, 71 nt, Human
caugugaaggacauuuguccaugauugggucaaagugucaugguucaugaguguccuuugaagucagcaug

SEQ ID NO: 4190973 - RNA, 72 nt, Human
caugugaaucugaacuguuucugauccucuuuccugauuguguuaggacagaacacauuuucagagucaaug

SEQ ID NO: 4190974 - RNA, 70 nt, Human
caugugauccguuccaccagucuuuauucgguauaguuucugaauagaugcuguucaauggaguuauaug

SEQ ID NO: 4190975 - RNA, 69 nt, Human
caugugauuucagguuuuucauacugaaaacauugagauuucaguuggaagacacccugaaaucuuaug

SEQ ID NO: 4190976 - RNA, 56 nt, Human
caugugcagacggugggcuggacuuuauccucaccauagcacucaguuuguacaug

SEQ ID NO: 4190977 - RNA, 109 nt, Human
caugugcuaaauaugugacuaggcaguguucuucuaagggcaacuugagugcuuaaacuguaaaauuccacugacuuuaaagcucacucuuuuucacaaguaguccaug

SEQ ID NO: 4190978 - RNA, 57 nt, Human
cauguggacaaauacucuguuguacccugcugcacagagcuguacaugugccaugug

SEQ ID NO: 4190979 - RNA, 81 nt, Human
cauguggcaaguggcagacacaaugugggcacuaggcaaguggcaagucccuuguauugagucuuauuugucuauucagug

SEQ ID NO: 4190980 - RNA, 117 nt, Human
cauguggcuccuguccugcaugcagggccuccagugucugccaacugcaugguccgucucuuccuggacuuuagaugacaagacacaagugaggacugaugaaaaaggagaaaaaug

SEQ ID NO: 4190981 - RNA, 89 nt, Human
cauguggggaaggagcagaccuaccaccgcgauguguugacggggagcccggagcauaggcggugguaggaccccucguucuucacgug

SEQ ID NO: 4190982 - RNA, 62 nt, Human
cauguguaacugugcuaaaaggcaagugccucuguggggaggcggcagacacaguugacaug

SEQ ID NO: 4190983 - RNA, 124 nt, Human
cauguguauacauuccauguguguguauuccauguguauacauuccauguguguguauuccguguguauacauuccauguguguguauuccguguguauacauuccauguguguguauuccgug

SEQ ID NO: 4190984 - RNA, 83 nt, Human
cauguguaugagucgacagccagugccuuuaaccacucccuacccuacaugugugccaggcaugugcuguuugucuccacaug

SEQ ID NO: 4190985 - RNA, 65 nt, Human
cauguguauuauucuuguggaauauuaguucaccagaugauagcccacaauucuaguuacauaug

SEQ ID NO: 4190986 - RNA, 60 nt, Human
caugugucgucaggucugagagccguggauucaaaucccacucuggagcugaugcaggug

SEQ ID NO: 4190987 - RNA, 57 nt, Human
caugugugaagacugcgggccaggugagaaggaacagggcccgcuguguguaucgug

SEQ ID NO: 4190988 - RNA, 55 nt, Human
cauguguugaguauaggcuucguauguuauuacgaauaaaucuauuucacacaug

SEQ ID NO: 4190989 - RNA, 115 nt, Human
cauguguuuccugucccuuauucuaaaucgauugggccauuugucuaauuuaaacacucuauaaauuauacacauccuccaaagauagggaugagguagaggcccuugauguaug

SEQ ID NO: 4190990 - RNA, 77 nt, Human
cauguguuugucucuuggccuaccucucguucugaaaugaagaugagcaagaugugaaagcuugagagaggcaacug

SEQ ID NO: 4190991 - RNA, 55 nt, Human
cauguguuuucuuuaagccaguugguuugggacuuuuggcuucuggcaacagaug

SEQ ID NO: 4190992 - RNA, 74 nt, Human
cauguuagaagggccaguuguuucucaaaaggugauagucuacagugaggaagcagcugugcuugggugaggug

SEQ ID NO: 4190993 - RNA, 76 nt, Human
cauguucagcucagaagccggaagugcuccucaacuagaggccagauacucucuucugcaacucacagccaacaug

SEQ ID NO: 4190994 - RNA, 80 nt, Human
cauguucucugggcaccaaaucugagcuacuuaugacuuccugaucuaggacaggagcaggcugagaguccaagaaggug

SEQ ID NO: 4190995 - RNA, 67 nt, Human
cauguucuuucaguccagaucccuguauuuuauuagaaucacaggcaaagaagauugguggaaugug

SEQ ID NO: 4190996 - RNA, 105 nt, Human
cauguuggccaggcuggucucgaacuccugaccuugugauccacccgccuuggccucccaaagugcuaggauuacaagcgugagccaccaugccuggccaagaug

SEQ ID NO: 4190997 - RNA, 104 nt, Human
cauguuuacuauuuccuguugucuuugccugaaaguguuuuaacaaaaauuaggguagagcauacaaacauuugaggcaggggaugaaaggaguuguuauuaug

SEQ ID NO: 4190998 - RNA, 96 nt, Human
cauguuuguuuuucuagugacugcuuauauguuaaagauaccuuuauguuuacacgugucucucaacguauaaucagugucuccuggaacaaauug

SEQ ID NO: 4190999 - RNA, 67 nt, Human
cauguuuucauuuaaauaauugccuucagggacauaaucugaagaaguuaauaauggugagaaaaug

SEQ ID NO: 4191000 - RNA, 81 nt, Human
cauuaaaagcaagaguuuuuucucucuugaaaaacacaaaccuaagagcuguucaaguugaaagacuuuuugaggguaaug

SEQ ID NO: 4191001 - RNA, 115 nt, Human
cauuaacauuauuagaacauaauccaaugcugguaauacauguauuccagagaguugagauuuuuaauuaaucugagugacauguauuuggaaugaucugcaugaugugacaaug

SEQ ID NO: 4191002 - RNA, 95 nt, Human
cauuaacuuuuucauaugugucgugcuacugcccauaaaguuaauuaaccacauggguaccucaaguaggaaauacaugcuaugaaaaaaaaaug

SEQ ID NO: 4191003 - RNA, 64 nt, Human
cauuaagcugucagugucaggcuaaaagaaacuuuuccuuuaucugagcugauagauaguagug

SEQ ID NO: 4191004 - RNA, 124 nt, Human
cauuacggaauuuccaguuauagaaacuguggggcuuugguugauaauaauuaguucuuggacucauuugcaugccacgggagagaauuauugccagacccuuguauuuauagcuucccaggug

SEQ ID NO: 4191005 - RNA, 71 nt, Human
cauuacuaugaauagccagauagugaacagaaccuggacaauucucugcucguuaggcucauucauuaaug

SEQ ID NO: 4191006 - RNA, 127 nt, Human
cauuagaauugccuaaaagacuuguuaaagcacaaauugcuaggucacagcaccagaguuugugauucaauaggucugguguugggccugaaaauuaaaguuuuuaacaaguuugcagguguuaaug

SEQ ID NO: 4191007 - RNA, 123 nt, Human
cauuagacagugcauucggguaaggugaugguucccuaggucucuuuggaguugauuacuauagaaaugggcaucugguggagccucagguugccaauugcauuacucuucauuuuacugaug

SEQ ID NO: 4191008 - RNA, 83 nt, Human
cauuagauuucaaaucauggaaacaaugcggaaaaauauuguguguguguuuuugccaucuccgugaguucugacaucuaaug

SEQ ID NO: 4191009 - RNA, 62 nt, Human
cauuagcagucauuacugugcucugauggacugacacagcagcaaagccgagacagccagug

SEQ ID NO: 4191010 - RNA, 81 nt, Human
cauuagcccaggcccaguugcaaggcaggcccucgucuagcaaggcaggcccuccucuagcaaggcaggccuucaguggug

SEQ ID NO: 4191011 - RNA, 100 nt, Human
cauuagccuccugaagccccuuuguguggguuguaguguccucugugagggugauaaauagaaggcaccguggccaauauuugggggaaggagccuugug

SEQ ID NO: 4191012 - RNA, 61 nt, Human
cauuagcuaacuacacucaauguucccgacauaugggguaaguguaggucauuagcuguug

SEQ ID NO: 4191013 - RNA, 58 nt, Human
cauuagggacugaggaauaagguauagaccuuacauucaaggaacucauucucuaaug

SEQ ID NO: 4191014 - RNA, 128 nt, Human
cauuaguaaggagcaaucagaaaucagauccaagaaagacuguaucucuauucaguucuaagucagagagcuagcaggaagcaguuuaguuuugcuuuguuugguuuguuuuaaugugguuucuagug

SEQ ID NO: 4191015 - RNA, 72 nt, Human
cauuaguccugaaugccuuuaggcagaaaguggugagaauucuuugaauaauauuaggcagaucagguggug

SEQ ID NO: 4191016 - RNA, 77 nt, Human
cauuaucuuugggaauuuuggucaguguauauuuauauuuauaauauacauugaguauuauuuagccauagcuaaug

SEQ ID NO: 4191017 - RNA, 81 nt, Human
cauuauguacauucaugucccacuucuagcaguguggugcugcugagaaaugcagacaugcuggaggaaaugagcaggaug

SEQ ID NO: 4191018 - RNA, 56 nt, Human
cauuaugucugaguuccaauaauggggggaaggaccagaaggaggaaggcauagug

SEQ ID NO: 4191019 - RNA, 59 nt, Human
ccaauggaaugucuugauauagagguuauuggugaccuuggccagggcaguuccagugg

SEQ ID NO: 4191020 - RNA, 61 nt, Human
ccaauggggaagcugcuccugguuuuacaguuuaguuugaaaucagaugcuuccuaguugg

SEQ ID NO: 4191021 - RNA, 56 nt, Human
ccaauguggaugucucuaguauauauuuuuauuuauuuacuaaacaugcauauugg

SEQ ID NO: 4191022 - RNA, 77 nt, Human
ccaauucaguuccuugugcgaauuccaagcugaaggcauuuagaaaaggagagagcgagaggagagaaauugaaugg

SEQ ID NO: 4191023 - RNA, 59 nt, Human
ccaauuggggaccagguggucugaucuaaacagaucagagccuuaugcuucucauaugg

SEQ ID NO: 4191024 - RNA, 84 nt, Human
ccacaacccagaggagggauggagggagaugggguuagagacaacuggaagcuuuaacuucaagcuucgucccuucgagugugg

SEQ ID NO: 4191025 - RNA, 57 nt, Human
ccacaagacucugucagcauaauccacagaacgacuuguguugaagauuauuugugg

SEQ ID NO: 4191026 - RNA, 85 nt, Human
ccacaaguguuugguuguuacucagcaguuguuuugugugcaguagcacugauggcuugcuuagugacagcaacaucccacaugg

SEQ ID NO: 4191027 - RNA, 67 nt, Human
ccacaauaaaugcugggcguggccauuguguucuaacauccaugccucugcagcuguuuauuagugg

SEQ ID NO: 4191028 - RNA, 77 nt, Human
ccacacagagacagaagcacuuaugaguaauaauucuacccugacucacacagagaugcuguguccuccugagcugg

SEQ ID NO: 4191029 - RNA, 84 nt, Human
ccacacagccaaagagggcagcuggauguuucaguggggguguuggcuggggucuaguuccagccuugccacuuuucugugugg

SEQ ID NO: 4191030 - RNA, 96 nt, Human
ccacacagccuucacuuaaugagaaaugggucugcugaagacguguccuuugugugccaccucccagagacaucauuucuccgggggagcuguggg

SEQ ID NO: 4191031 - RNA, 64 nt, Human
ccacaccagccugcaguuuccucuucuaggcuguggcuuggaggucugcaaggcgcuggagugg

SEQ ID NO: 4191032 - RNA, 80 nt, Human
ccacaccuuggggcuugcuguuguagccuguguggucacuaggcaugucugggcuaaggacgggcaagucccacaagugg

SEQ ID NO: 4191033 - RNA, 60 nt, Human
ccacacucaaguccugcauagcaucugugucacugacagauggugagauacugggugugg

SEQ ID NO: 4191034 - RNA, 84 nt, Human
ccacacugggcaauaugcacuguaauuuuuaacaaauaauaggaaacuguuaauguguucacaggaaauacaguuuugucuugg

SEQ ID NO: 4191035 - RNA, 64 nt, Human
ccacagaaagccugggaaguggaaacagacaggagccuguuggagcucuuggagcuuugugugg

SEQ ID NO: 4191036 - RNA, 115 nt, Human
ccacagacaaccguaaugcaagguguaccuugugcucaggaagcuguuccugcuaagggggcugggggucagggaagguuuccugggggagggccaccugugcuguguuucgugg

SEQ ID NO: 4191037 - RNA, 91 nt, Human
ccacagaugugugauuaaguacacauaaacuuugaguuugucuucugaggcucacagcauugaguguacuagauccuacacuucucaaugg

SEQ ID NO: 4191038 - RNA, 58 nt, Human
ccacagcuggaaugggguaccugcugggggauucucacagagcagcguucugcugugg

SEQ ID NO: 4191039 - RNA, 59 nt, Human
ccacagcuucugucugacccauguuucugccacugagcugguuccagaauugccugugg

SEQ ID NO: 4191040 - RNA, 66 nt, Human
ccacaggaagugaggccuaggcacugggugggauacugcuacucagucccagcucucacucauggg

SEQ ID NO: 4191041 - RNA, 100 nt, Human
ccacaggacccagauaucugacagaaucauuaagaccauuccuugaagugggaguguugguaaugguuuuaauauuuuaucaccuggcagcguccugugg

SEQ ID NO: 4191042 - RNA, 58 nt, Human
ccacagggacuguuaaaacccugggccuaucccggaguuucugauucagucugugugg

SEQ ID NO: 4191043 - RNA, 64 nt, Human
cauggcucacugcugagcucguucaaguguccagagaagagcaccuccgugcagcguggccaug

SEQ ID NO: 4191044 - RNA, 59 nt, Human
cauggcuccaaguuuccugugguuacugcccagccuucaggauuaauuuggggccuaug

SEQ ID NO: 4191045 - RNA, 60 nt, Human
cauggcugugcagagauugggaaaggcuauaucugccuucccacaucuuccacagcuaug

SEQ ID NO: 4191046 - RNA, 69 nt, Human
cauggcuuuugcuuuugcccauaagaagcauacuauuacuccuucaauaaggcaagcacaaaagcuuug

SEQ ID NO: 4191047 - RNA, 92 nt, Human
caugggagcucacugcugccuuuugcuccucccaccuuccccccagggagguggggagggagugaggcagcacguaagugccaccucccaug

SEQ ID NO: 4191048 - RNA, 70 nt, Human
cauggggcccacccucacccucucccugucaucuaauagucccagggggagcugggaggugaguuaccug

SEQ ID NO: 4191049 - RNA, 62 nt, Human
caugggguugaauaggggauugagguuaauuugagggccugaaucaauuaugggauucaaug

SEQ ID NO: 4191050 - RNA, 99 nt, Human
cauggguacacuuguugucagaaaacaucuugcucugauugguauuucucauggcuugaacugccgucuaggucucaggauguaucaauaagcuucaug

SEQ ID NO: 4191051 - RNA, 82 nt, Human
cauggguaucagccauauuagacacagggcucagggcugugugcaaccugcaucagugacugaauaugagugacaacccaug

SEQ ID NO: 4191052 - RNA, 77 nt, Human
caugguagcccaguugcuccacgcugcauuuuaguggagacagaaacugcugcgagagcacagggcccuaagccgag

SEQ ID NO: 4191053 - RNA, 63 nt, Human
cauggucagaggcagcaaggacugacauggauuucaguuugccacuguggacucuagaucaug

SEQ ID NO: 4191054 - RNA, 112 nt, Human
cauggucauccagaugcaggcucuucccuggggcacuauagcagagagggcucucuuccagucuauugcagauggaugcccucgugagcugaguuuugaugaacaucccaug

SEQ ID NO: 4191055 - RNA, 56 nt, Human
cauggucauuucccaucagugugaacucucugagggugucugaggggagugcugug

SEQ ID NO: 4191056 - RNA, 70 nt, Human
cauggugagcagggcaggacuggggaggggacagucucuauuccuuuaucucugcuuugccucugccaug

SEQ ID NO: 4191057 - RNA, 57 nt, Human
cauggugagcggccgcacacaauucugccccuagagggcaguggcugcacacacaug

SEQ ID NO: 4191058 - RNA, 77 nt, Human
caugguucugcaggcuguacaagaagcauggcaccagcaucugcuucuggugaggccucaggaagcuuacaaucaug

SEQ ID NO: 4191059 - RNA, 64 nt, Human
caugguuguacagcauuccauauagguguacuucauuuguuuucauugcuguacaauauucaug

SEQ ID NO: 4191060 - RNA, 76 nt, Human
caugguuguaguuuuguuauuuugucaggugagcugguugcagaaacucauccuggagaugacccuaauugccaug

SEQ ID NO: 4191061 - RNA, 69 nt, Human
cauguagaugggaauggaaggcauuuuuuguagcuguaacaauuauuugaauuccuucugauguauaug

SEQ ID NO: 4191062 - RNA, 119 nt, Human
cauguagguguucugagcagaguuucagcauaggcaaucuagacuucauggaaguggugacauuuaaugaaagugaagguuuacuaagcacuuacuuuguauaagcauugugcugcaug

SEQ ID NO: 4191063 - RNA, 130 nt, Human
cauguaguuauauuaaagaauguugaaucacugugauuacucauugaacuuguuuucaaagacuucagagaguccaguaugcaguuucauuccccauucucacacuuuuuuuuuguuaauggcacugcag

SEQ ID NO: 4191064 - RNA, 80 nt, Human
cauguauaguaugagcucauacacuuguguuaacucauauaauuaacucaacucaaacgcaugaguucauacugcauaug

SEQ ID NO: 4191065 - RNA, 76 nt, Human
cauguaucuuuaaguagguuuccucagugucuuuaauaugcuaauggacaaugugaaacuacaagaggagaauaug

SEQ ID NO: 4191066 - RNA, 130 nt, Human
cauguauuugugcuuuacagacucuucccuguguugguuguuuugucuguuuugucuuugucccucauaaagucauggcagcuagaauugaagaucgcauuucgggaguguucugaccagcacaaaucag

SEQ ID NO: 4191067 - RNA, 71 nt, Human
caugucacaauaugauuagauguuuucugaugauuuuaaguucuucugaggcauuuaauuaugaccccaug

SEQ ID NO: 4191068 - RNA, 87 nt, Human
caugucauucuuuucuucaugagcagaagggagggguuuugugaauuaaaaacucaaaugcuaaugccauggaaaaauuaugacuug

SEQ ID NO: 4191069 - RNA, 73 nt, Human
caugucucuagauauugccagauguccccggaagaacaaaaauuucugacacaaaauaaugacuaaagacaug

SEQ ID NO: 4191070 - RNA, 61 nt, Human
caugucugggcuuagggacauggcagagcgaaguguaugcaccugcccugugcccaugcug

SEQ ID NO: 4191071 - RNA, 64 nt, Human
caugugcaugcuguucugccagaaagauggagccacaccaaacuuucugcagaaggcauacaug

SEQ ID NO: 4191072 - RNA, 64 nt, Human
caugugccccagccgcugcuccuaagggaaccuuaguguucccagcuguggcgaggggaacaug

SEQ ID NO: 4191073 - RNA, 130 nt, Human
cauguggaggaaggaggcccagcccaggaggcaggacucugugcuggggaccucaucacccacgugaauggggagccugugcauggcauggugcauccugaggucguggagcugauccuuaaggugagug

SEQ ID NO: 4191074 - RNA, 63 nt, Human
caugugggcuaggagaaggcccccagguguccgagcccagggccucuguguucugcccacaug

SEQ ID NO: 4191075 - RNA, 130 nt, Human
caugugguccacaugguuuguugccuuuuucuuaguauuuauaguaauuacagauauuauacacugguaccugcuuauguuguuugugguuauaauaaguauuauuaguaacaaaaaauucgauuacgug

SEQ ID NO: 4191076 - RNA, 86 nt, Human
cauguguacaagggauaggggaccaguuaauccaggaguuagauggugacugagacuccaggaauuuccccuuuccuguaaacaug

SEQ ID NO: 4191077 - RNA, 61 nt, Human
cauguguacacagauaguaauggcaauguaauaguagccauuauucacugaguacuuaaug

SEQ ID NO: 4191078 - RNA, 58 nt, Human
cauguguaccugaaugccuccuccaggcagccuggagaacucagacgcaggucaugug

SEQ ID NO: 4191079 - RNA, 82 nt, Human
caugugucacuucugggcagaaguuuugagaaccagccuacaguuugcucugucucguuuccuucugccacagaucaccaug

SEQ ID NO: 4191080 - RNA, 65 nt, Human
cauguguccauucacugcaacacuugaacaagugaguaucaaguggagccaauguggaucucaug

SEQ ID NO: 4191081 - RNA, 95 nt, Human
caugugucuagcuuuguggagauauguuuuacuuaagaucccagggcagauuucuuagaaguaaagcauugucuucagagucagaccuauauaug

SEQ ID NO: 4191082 - RNA, 99 nt, Human
caugugugagaagcccuggccuagauggcaagggggcccauggugucugcuauguugacucaggucacccugcuguuuguccauuccuucucccacuug

SEQ ID NO: 4191083 - RNA, 61 nt, Human
caugugugagugagcagucuucccucagucugagaggagagaaaguuuugugcuauauaug

SEQ ID NO: 4191084 - RNA, 113 nt, Human
caugugugggagagagauugggcauauguauggcauaucugggagacucuauugguauggaguagagaaucuagaauguuuauaccaaagccagcaucuaaaaauccacuaug

SEQ ID NO: 4191085 - RNA, 59 nt, Human
cauguguggucuguggcuaucuugucucacaggcugcugaugccacacgaucucacaug

SEQ ID NO: 4191086 - RNA, 61 nt, Human
cauguguguccuaauuuggggaggaauauuuaaguaauguucucaacaaaaggaagcacug

SEQ ID NO: 4191087 - RNA, 69 nt, Human
cauguugaacuuacaaauuaaaagacuuauuuaaauuugaguggcuuuuucauuguagguaaaaauaug

SEQ ID NO: 4191088 - RNA, 100 nt, Human
cauguuggagaaccaccucugcaacccuggaaugggauauaugacauuugagcucccgauaucgugggucagaggagaaaaaaacuggguuuccuacaug

SEQ ID NO: 4191089 - RNA, 56 nt, Human
cauguuggcacugucucugccugagucuucccaagcagcacgcuuugccaacaaug

SEQ ID NO: 4191090 - RNA, 65 nt, Human
cauguuggccaggcuggucucaaacuccugaccucaggugauccaccagccucggccucccaaug

SEQ ID NO: 4191091 - RNA, 129 nt, Human
cauuaaaaucaccuaggagcuuauuaaaaauauaaauuccugggcccagcacuagaccuaaugaaucagcauuuccaagcguggguccaagaaucugugauuuaaauaaguaccccuagauaauugaug

SEQ ID NO: 4191092 - RNA, 99 nt, Human
cauuaacaaaagcaccaaaaggaauguuuuccagaccuagaugguuugagaagcaucuagguuuggaagauagaguccuuccuuuagcuguaguugaug

SEQ ID NO: 4191093 - RNA, 60 nt, Human
cauuacagugucagaggaacuguggcaaaaaauugagaggaaccuaucugaggcugaaug

SEQ ID NO: 4191094 - RNA, 86 nt, Human
cauuacuguauuauuggcuuccaggaucucagcagggcacgagggagguuuagccugucugaauuuuggaaucaaguuuggugaug

SEQ ID NO: 4191095 - RNA, 72 nt, Human
cauuacuuaacugcuaacugguuugauacuuuuuucaggucucguagguaucaguaguagaaaaguagcaug

SEQ ID NO: 4191096 - RNA, 82 nt, Human
cauuacuucauauaugaaaggcuuaauguuguuguaauguucugguuauuacaaaagauuuaagaucugaaaugaaguaaug

SEQ ID NO: 4191097 - RNA, 130 nt, Human
cauuagaaucaccuggggauauuaagagacacucauaccuaggcuucacuuccaguuauucugauuuaauuaauccggagcaagucccaggcacuaguauguuguuuacgcuuccuaggugauuccaaug

SEQ ID NO: 4191098 - RNA, 86 nt, Human
cauuagagacaguacaucacaguaguuaagccagacagccuauggccaaauucuaguucuaccacuuacugaucucgucuuuggug

SEQ ID NO: 4191099 - RNA, 62 nt, Human
cauuagcacugucugguuaucuugcuucaguugagggauucgggacaauagcagugcugaug

SEQ ID NO: 4191100 - RNA, 66 nt, Human
cauuagccaugugggaaaaacagccagagaaagcauucccaggcuaguccucccauguagccaaug

SEQ ID NO: 4191101 - RNA, 83 nt, Human
cauuagggaauuuuaucuucacuuauaucuuucuuugguugcaaaauugaagagacuaaucagggagaaacuauuauuugaug

SEQ ID NO: 4191102 - RNA, 85 nt, Human
cauuagguucucauaaggagcacaaaccuaggucccuuacaugcacaguucacaguaggguuugugcuccuaugagaaucuaaug

SEQ ID NO: 4191103 - RNA, 129 nt, Human
cauuaucagagucguggggaggguggaccuugauucuuccucucuguccccugaguccagacucucuagggaagaaucagacaggagacuggaucauggaccagcucccucaaaacuggccugaugaug

SEQ ID NO: 4191104 - RNA, 59 nt, Human
ccacaggucuguauuaacagaggguugggaaacuccugaucaucuugacagaugcuggg

SEQ ID NO: 4191105 - RNA, 68 nt, Human
ccacagguuucugauuucaguguuacuauaacagaaccuagaaguuagaguaucauucaaguaugugg

SEQ ID NO: 4191106 - RNA, 56 nt, Human
ccacaguaacuguuuuguaccgaggccagcuguacucgggagcaggaaagcugugg

SEQ ID NO: 4191107 - RNA, 68 nt, Human
ccacaguggcccaguugagaaugaaugaugcccuucaaugcacagucaggccgagaugggccuugugg

SEQ ID NO: 4191108 - RNA, 60 nt, Human
ccacagugguucucaaccaggggugauuuugcugguugcauuaacugagaggggcugugg

SEQ ID NO: 4191109 - RNA, 67 nt, Human
ccacaguguaucauuagugugaugaguuuaucucuuuaaagccucacaaccugcugauaugcugugg

SEQ ID NO: 4191110 - RNA, 55 nt, Human
ccacaguuuaggaagucacucuagguuaucacuguguggguuaucuauuuugugg

SEQ ID NO: 4191111 - RNA, 79 nt, Human
ccacauauauauuaguuuccuuucugccaacaaguugucaccaaaauuuauuggaaagaccgaauuccuguuugugugg

SEQ ID NO: 4191112 - RNA, 92 nt, Human
ccacaucaaugauaaagaacauuucuuccuugacuuaaauuguucccuaccauagcaguguggaacacucauggaagaguuuuuguuugugg

SEQ ID NO: 4191113 - RNA, 71 nt, Human
ccacaucagaaauguuuacucagugacuguuccuugaucugcugcugacucuaacaugacaucugaagugg

SEQ ID NO: 4191114 - RNA, 78 nt, Human
ccacaucuugccagaugggucucacagccccuggucaucuauuguccaggaagcugugagauuccaauaagauaaugg

SEQ ID NO: 4191115 - RNA, 109 nt, Human
ccaggcauaaaagaucacauauuguaugauucuauuuacaugaaauaucuauuagaggaugaaaaaauucauauagagggcauacaaauggugguuuccagggcccugg

SEQ ID NO: 4191116 - RNA, 68 nt, Human
ccaggccagaggaguugaggcuuuggguagcaccccgcaggcccagcaguagagcucauauggccugg

SEQ ID NO: 4191117 - RNA, 62 nt, Human
ccaggcccaggguacugaccaaacccuuaugauggccagucauuuucacccaugaggucugg

SEQ ID NO: 4191118 - RNA, 76 nt, Human
ccaggcccaggugucgauguuccucccaaggaaugauuggguggaugaaugaacacugagauguaccugggugugg

SEQ ID NO: 4191119 - RNA, 59 nt, Human
ccaggccucauaguagaccugcccuuaggaaagcagggguuaccaauacuugagccugg

SEQ ID NO: 4191120 - RNA, 89 nt, Human
ccaggccugcagcagggagcaggacacacgggcccagcaacuccagccagcagcuccagcccugcuuccugccucagcugcuggcuugg

SEQ ID NO: 4191121 - RNA, 72 nt, Human
ccaggccuggagcggccaucucauuugcaugccgcaagguuguggcucaggcggcuucuccugggggccugg

SEQ ID NO: 4191122 - RNA, 60 nt, Human
ccaggccuuccaguacgcagaagagcacgcggaaguuugucccgcuggcuggaagccugg

SEQ ID NO: 4191123 - RNA, 56 nt, Human
ccaggcucugcgcuggacauggggcaguugcucgugucuuuguguugagaggcugg

SEQ ID NO: 4191124 - RNA, 55 nt, Human
ccaggcucugucuggucagaagucacacauccucuccuugcucaacaaagccugg

SEQ ID NO: 4191125 - RNA, 56 nt, Human
ccaggcugcagucaaggggcauugggcuaacccaccacccuggcaggcaagccugg

SEQ ID NO: 4191126 - RNA, 91 nt, Human
ccaggcuggucccaaacuccugggcucaagcaguucucccgccgcugucuggcagguagcuggggcuacaggcguguaccaccaugccugg

SEQ ID NO: 4191127 - RNA, 76 nt, Human
ccaggcugugcuuuuaaaggcaauuaguagguuuacaaauucuauuuuuacauuuuguauuaaaaguauaguuugg

SEQ ID NO: 4191128 - RNA, 64 nt, Human
ccaggcugugcuuuucauaaauaagauucauguucuuuauucuggaaccuagcacugugccugg

SEQ ID NO: 4191129 - RNA, 61 nt, Human
ccaggcuugaagggaagaaugguuugagcaccgaggacaagaauuaauuccccaggccugg

SEQ ID NO: 4191130 - RNA, 64 nt, Human
ccaggcuuuguucugcacacacagacaggugcaaguaggcaugucauguauagacggggccugg

SEQ ID NO: 4191131 - RNA, 66 nt, Human
ccagggaauuugacuucagccuguacuuguaacuacuguucucuauggguagaagucaaaaaaugg

SEQ ID NO: 4191132 - RNA, 85 nt, Human
ccagggagcuaauaaagacucagaggcccaggcucauggaaguaggagagggccugggcuuuugcauuuuuacaaaguucccugg

SEQ ID NO: 4191133 - RNA, 64 nt, Human
ccagggcaauuauuuggaggguuaaacgaauuuaugcaaacaaaacccucugaauaguaucugg

SEQ ID NO: 4191134 - RNA, 66 nt, Human
ccagggcacguugggacaguacuuuuuucugcuuauaucuaaggauuuuuacuucagcuguucugg

SEQ ID NO: 4191135 - RNA, 70 nt, Human
ccagggcuccuuugccuucuggcuugcauuuggguucaaccaauagaaggcacagauagguaauagaugg

SEQ ID NO: 4191136 - RNA, 85 nt, Human
ccagggcugcccaaggccuggccugccugccgguugucgguggccccgaugggccagggcaggaggccugcuguggagggccugg

SEQ ID NO: 4191137 - RNA, 59 nt, Human
ccagggcugcugugggacuccaagggcuaacucaaggagagucccuaacacaggccugg

SEQ ID NO: 4191138 - RNA, 76 nt, Human
ccagggcuggcagcacagacuggucccaggucuccugaauucaggaacccgggcaaagcugugcccauucccaugg

SEQ ID NO: 4191139 - RNA, 56 nt, Human
ccagggcuucccacgugcccuggcugaccuugccuggggaugucggcagguccugg

SEQ ID NO: 4191140 - RNA, 60 nt, Human
ccaggggaacagauuagcagagacaucucauaggacugggaggugcuucuguauugcugg

SEQ ID NO: 4191141 - RNA, 70 nt, Human
ccaggggagcuguagaaagcccugggcugggaaggagaccucagguccagcuguugcagccuccccaugg

SEQ ID NO: 4191142 - RNA, 56 nt, Human
ccaggggcucugagugggccaggagggggcaguccuggacuggcucagcacccugg

SEQ ID NO: 4191143 - RNA, 82 nt, Human
ccagggggcgcugagaaccaccagggggugcucaggacaugaccggcccucaggaccaccaggggauuuucagaacaccagg

SEQ ID NO: 4191144 - RNA, 75 nt, Human
ccagggguauagugaugcauuaaucauaagacauuuuauuuguauugucuucuuuuggcacucacuuaucauugg

SEQ ID NO: 4191145 - RNA, 56 nt, Human
ccaggggucugcucggcuuaugggcacugugcuugcccaaggacacuggcuccugg

SEQ ID NO: 4191146 - RNA, 56 nt, Human
ccaggguccccgggucgcuggcaaguuuguggaagggccaggccugcgggcguugg

SEQ ID NO: 4191147 - RNA, 84 nt, Human
ccagggugagcagcagggugccagcuuugcaccugcaagacccugagagcaaguguccugagugccuugcuagucucacccugg

SEQ ID NO: 4191148 - RNA, 72 nt, Human
ccagggugccaaagaacaaauauggcaacuuuccccccaaguucuugcaauguuugcaguaacccauccugg

SEQ ID NO: 4191149 - RNA, 75 nt, Human
ccagggugggaauuucagaucagagaccauucuucucuaugagugauccauagauuaagauuccuuuuaucuugg

SEQ ID NO: 4191150 - RNA, 86 nt, Human
ccaggguguucuugggcaaacguaggggucagguagggacucugcuccagagacccagacugaucauugcucuaagguuacccugg

SEQ ID NO: 4191151 - RNA, 78 nt, Human
ccagguaccugggggagggucugcugacgaugcccaauguucaauggcccaagcaacccguccuugggggacuucugg

SEQ ID NO: 4191152 - RNA, 57 nt, Human
ccagguagccaaggggucugggagagggauaacuucauccagcaccauggcaucugg

SEQ ID NO: 4191153 - RNA, 117 nt, Human
ccagguagugugccuuccuuucauugugggagccuccacauuagugguggguccuggagaaggcagaccauagacuggaggaucuccuguuuugggugggggcagacacuacucugg

SEQ ID NO: 4191154 - RNA, 70 nt, Human
ccagguccagcugggccagggcacucaucccagucuauggggagaguccaccuuggcuccagcuggcagg

SEQ ID NO: 4191155 - RNA, 64 nt, Human
ccagguccuguuuucaccacagggucaccuccacccuucacugugcuggcaucucaggcuuugg

SEQ ID NO: 4191156 - RNA, 61 nt, Human
ccaggucugucagcagcaaagcgggauaaaaauaguuucuccugucugcucacagagcugg

SEQ ID NO: 4191157 - RNA, 74 nt, Human
ccaggugcucccgcucugucauagcacugaucagugacaacuuacaggaauguagcagcgauggaauuaccugg

SEQ ID NO: 4191158 - RNA, 55 nt, Human
ccaggugcuuguaccucugagcuucuauagccuucugagcauaugcagcaccugg

SEQ ID NO: 4191159 - RNA, 90 nt, Human
ccagguggaaggaacugcccugcagaaaggguccccaggagcccuguuaaugggaauuuauucagcaggucaggcagcaauuuucccugg

SEQ ID NO: 4191160 - RNA, 83 nt, Human
ccagguggcucugcugaucagggcaaagcaaagcuuaucagcugggcuguuaauaugucuggaucagcuaugaacugaccugg

SEQ ID NO: 4191161 - RNA, 56 nt, Human
ccagguguggccacauggcuggccugaaaucaugcagcuauuucgggcugaccugg

SEQ ID NO: 4191162 - RNA, 64 nt, Human
ccagguguucucugacauggcaaaucagaagaaaaaucauugcauugggagugaggagaccugg

SEQ ID NO: 4191163 - RNA, 103 nt, Human
ccagguucugcauccaggcccuagacuccuugccuaaucccagcuccccgcgaagaugcagccagcaggaacgucuagguuuugcagcuaccaaccaaccagg

SEQ ID NO: 4191164 - RNA, 62 nt, Human
ccaguaauguaaacacagagacagaacauugagaugugccuaguucuguauuuacaguuugg

SEQ ID NO: 4191165 - RNA, 91 nt, Human
ccaguacuauuauuaucucuccuuuaucaaggagccuuagagagguuaaguaauuuuucugaagucacaugauuggaaagaguagagcugg

SEQ ID NO: 4191166 - RNA, 111 nt, Human
ccaguagaaauggaaaggagaggacacacaugaaagacauuaaggugagaaaauuagcuauuuucacuaauauuucccuuuagugcauucuuuacuuuaauaaucagcugg

SEQ ID NO: 4191167 - RNA, 75 nt, Human
ccaguaguggacauucacucugcugcccgagggcugggguagccugccccggcccgcggacgcagcagggucugg

SEQ ID NO: 4191168 - RNA, 67 nt, Human
ccagucagugucaacaggaaguagcugguaggacaaaugcuauuuuuuaugucucuuuggugacugg

SEQ ID NO: 4191169 - RNA, 109 nt, Human
ccagucccugaccugaagcugccccuggggcugaggagccucacucugucccugggccagggucccgggcuccccagccuguggagugagagccgcagggcagggaugg

SEQ ID NO: 4191170 - RNA, 66 nt, Human
ccagucuggagacccuggugcugauuggcuauucuugggcacaaggcccugggucaccacaucugg

SEQ ID NO: 4191171 - RNA, 66 nt, Human
cauacauuuugagaggccaguuuucugaaaaauaagccaggaaagcuuagcauuuucaaaaugaug

SEQ ID NO: 4191172 - RNA, 107 nt, Human
cauaccagagacuccccuaauuugcauacugguguauauucaaguguugauuucaaagcagccuaacacuuaagcaugaaguauaaaauuaaugaguugaaccugug

SEQ ID NO: 4191173 - RNA, 59 nt, Human
cauaccaggaggcucugacuggacccuuggucacuggggaccaggcccuuccugguuug

SEQ ID NO: 4191174 - RNA, 57 nt, Human
cauaccucagauugcugccuugggcacaguuuuguuuccuagcauuuuugggguaug

SEQ ID NO: 4191175 - RNA, 130 nt, Human
cauacgccgaacuuuuagcuaucaauguugccuucuguuuuguauaauuagaagugcauccaaagccagucacuuuacuaucuauaaaauaaggauaacaaggaugcuaagucccucugagaagggugug

SEQ ID NO: 4191176 - RNA, 81 nt, Human
cauacuacaucagaaacucuggaaguggggccaaccgauuugugauugcauaggcucuccaggugacucugauguaucuug

SEQ ID NO: 4191177 - RNA, 57 nt, Human
cauacucacuguuguaucuucggugucaaacauagcaccugguacacaguaaguaug

SEQ ID NO: 4191178 - RNA, 80 nt, Human
cauacucuuacauaccauacauggugagaugaaauccuauuucaggaucauagccguauggccagauguaagaaaguaug

SEQ ID NO: 4191179 - RNA, 110 nt, Human
cauacugaagaucaaauaucauaauguagaaauuugggaaauaauuaaugugaagucaggucuugaucacucuguaaauucucuaucugugaguauuguuucguuguaug

SEQ ID NO: 4191180 - RNA, 57 nt, Human
cauacuuacuguguaccaggugcuauguuugacaccgaagauacaacagugaguaug

SEQ ID NO: 4191181 - RNA, 75 nt, Human
cauacuuagaggagacagacaaacuuuggaagccauguauugacuauuaaggaacuugucuuucucuuagagaug

SEQ ID NO: 4191182 - RNA, 103 nt, Human
cauacuucuacucucuccuacugaaauggagguuaacacuaaugcuacucagugacagcaugacauguucagcccucuauuaaucaguaaguuagauucuaug

SEQ ID NO: 4191183 - RNA, 68 nt, Human
cauacuugugcuccagggaguacauuuaucauaaaagaugguauagugguaaucucuggauuagugug

SEQ ID NO: 4191184 - RNA, 55 nt, Human
cauagaaaagaguagguaauguaaggcaaacccaacacauccuaucuuuacuaug

SEQ ID NO: 4191185 - RNA, 57 nt, Human
cauagaaacuugcagcaagcacgcuuucuuccuguguguuugucugcaccuuccaug

SEQ ID NO: 4191186 - RNA, 67 nt, Human
cauagaaugaagaauaagauagauggagcccccuugggcuuucauugcauuuauacuuauagcuaug

SEQ ID NO: 4191187 - RNA, 88 nt, Human
cauagacuuacuagaggaacaguuucagguuuugaugcuaaucaguguuguguccuaaaguuguccuuugugccuuuaaaaaguuuug

SEQ ID NO: 4191188 - RNA, 103 nt, Human
cauagacuugaaaacuguguagaaacagaaaacuguaauaguauggacaugguguaauauuguuaauuaagaguuuuuuguauuuauacuguuuauaacugug

SEQ ID NO: 4191189 - RNA, 86 nt, Human
cauagauaaaguguuucaauaauuuggaccuuauuuccuaaacuguaaaauguggcuaaaguucuguugguuacuuuaccucuaug

SEQ ID NO: 4191190 - RNA, 69 nt, Human
ccagagggcguccucaguuuguaggggcugcugaaaucuauuccuggguccugggaagcccugcccugg

SEQ ID NO: 4191191 - RNA, 59 nt, Human
ccagaggggaauuugucuuugaauaccauugccuguguucuuggcauuuucccauuugg

SEQ ID NO: 4191192 - RNA, 65 nt, Human
ccagaggggcugagcaggucacugccgggucccugugaggugaugacucuguguggccucucugg

SEQ ID NO: 4191193 - RNA, 56 nt, Human
ccagagguggcuuucaauauaguugcuuuauguagacaacaugacagccacucugg

SEQ ID NO: 4191194 - RNA, 129 nt, Human
ccagaguaaaccauuccccauugagguauucagggaacgccaggaugaagccuuguccaucagcaagugaugacagcaguccuggaguucccaggcagcuuuuauauucagaggaaaggcuugcuaagg

SEQ ID NO: 4191195 - RNA, 96 nt, Human
ccagaguagaauagagaggcacagcagaguuuggcuucuaaugguaucuagcccuccuucccauuaucuugccaacacuguccccuuuaucucugg

SEQ ID NO: 4191196 - RNA, 66 nt, Human
ccagagucaauuacuauuuuguauuuaccucucaguagauaauaagucugguaauaaugaguuugg

SEQ ID NO: 4191197 - RNA, 82 nt, Human
ccagagucacaagaagucacaucuaggaguggauagcaacccuuccaggcccgaggagaggauucuguuuuguguucuuugg

SEQ ID NO: 4191198 - RNA, 60 nt, Human
ccagagucugugugugucauccucauaaugauuugcuugaaaugaaacacaguggccugg

SEQ ID NO: 4191199 - RNA, 65 nt, Human
ccagaguguggcaucuuccaacuacauccaggguguuaaguuugguuuugaaugccacacugugg

SEQ ID NO: 4191200 - RNA, 86 nt, Human
ccagaguucccagaauggauccuggaggacuugucccagugaugcuccaugaagaggagccuccauggucacauucgcacucuugg

SEQ ID NO: 4191201 - RNA, 56 nt, Human
ccagaguucugucugccacacgaaagagaauauuugcuuacuugauagaacuuugg

SEQ ID NO: 4191202 - RNA, 58 nt, Human
ccagauaucuuuccauaagaaugucuaaauuuuggcuuguuauaagaagacugucugg

SEQ ID NO: 4191203 - RNA, 69 nt, Human
ccagauccuggagaggaacccgugacagcugggcagaaucuacugucugugccucuucucccagucugg

SEQ ID NO: 4191204 - RNA, 78 nt, Human
ccagaugaaggguggcucucaggcuucucggaugauauuucucuggguaaucagggcugggagcccaaacguaucugg

SEQ ID NO: 4191205 - RNA, 60 nt, Human
ccagauggaaaaacuaaagcacugccaucuuuaauuccguguuuaaguacuccuuucugg

SEQ ID NO: 4191206 - RNA, 65 nt, Human
ccagauggaguugccuggaaagcuuauacacaugaaaagacagucuccagguaacaucucucugg

SEQ ID NO: 4191207 - RNA, 57 nt, Human
ccagauggugccugucagaagguguugacuuuuuagacaacugggacuguuuccugg

SEQ ID NO: 4191208 - RNA, 55 nt, Human
ccagaugugugucacucucuggcuucauucuucagccauucugggugcagucugg

SEQ ID NO: 4191209 - RNA, 77 nt, Human
ccagauuagggagagacuaggggacuuggggucuuucuaugugacucugagaaucccuggacuuucuuagagaaugg

SEQ ID NO: 4191210 - RNA, 55 nt, Human
ccagauugaagccggccucgaagcuucccuuggagaaagccggcuaugauccugg

SEQ ID NO: 4191211 - RNA, 84 nt, Human
ccagauugacaucccuggggacugcuguuuccuguuggugccugugcaaaugaaggcagcaagcagaaguucuauguuuucugg

SEQ ID NO: 4191212 - RNA, 79 nt, Human
ccagauugucuuuccuuggaggaguccuguugcuaucucggcuggucuccuccauggagaugguauguaucagucaugg

SEQ ID NO: 4191213 - RNA, 78 nt, Human
ccagcaauggaaaaauaauaggaacgaguggcccuucagcaagaacccaugaagaccagccuauguuuuccauuuugg

SEQ ID NO: 4191214 - RNA, 109 nt, Human
ccagcacaacauuuagaacccaguguuuuugucuugaguuuuguuuugucaauuaacaccaaagcaggcuaaauaauaauacauguuugguugugagacaguguguugg

SEQ ID NO: 4191215 - RNA, 57 nt, Human
ccagcacagacguccagugggacucggacaucacucccacuggcaguuucugcaugg

SEQ ID NO: 4191216 - RNA, 95 nt, Human
ccagcaccauuaggaagggauggauauuugcuugcuuuggauucaguauuuggcuguucuucaaaauauuccauccauuuccaaaugaguacugg

SEQ ID NO: 4191217 - RNA, 68 nt, Human
ccagcacggucugauccggaaauacggccucaauaagugcagccaguguuuccgucaguaugugaagg

SEQ ID NO: 4191218 - RNA, 82 nt, Human
ccagcagacagccugagggaggcagugcauguucugagccagggccucaggaggccugcagcugccauucugcuucuguugg

SEQ ID NO: 4191219 - RNA, 94 nt, Human
ccagcagagguuuagcugugagucaugggugugagcuuauuccauaaaaucucaggagcccaagacuguacaguuaaagacucccaucugcugg

SEQ ID NO: 4191220 - RNA, 130 nt, Human
ccagcagcuucuaaguggauaagcacagauagcaaaggcccuaauagagcacauauuauauauuggagggacagagugguucucuauuaggucuuuugcuaucugugcuuauccaguuagaagcuuuugg

SEQ ID NO: 4191221 - RNA, 59 nt, Human
ccagcaggacuuuggaaauaugacaugccuuguuuauguuacuaaucuguucugguugg

SEQ ID NO: 4191222 - RNA, 56 nt, Human
ccagcaggagaugccugugucuccagagacgcgagagaguggugucugccaguugg

SEQ ID NO: 4191223 - RNA, 85 nt, Human
ccagcauagcuaacucagcaggucuuggguagggguucagauuuugcauuucuaacaauuugccgggugaugcucaugaugcugg

SEQ ID NO: 4191224 - RNA, 72 nt, Human
ccagcauggaccauguguugcugacaggaaguuccuauuagcaguuguaugugucugauuaauaaaagcugg

SEQ ID NO: 4191225 - RNA, 82 nt, Human
ccagcauguuauugcucccaggacucuugagccaggucauguccucgguuuuuauguguugggagugaagauaauccacugg

SEQ ID NO: 4191226 - RNA, 58 nt, Human
ccagccacagcugggugccugacggggcugcuuuucccuuguuggcugcuguggcugg

SEQ ID NO: 4191227 - RNA, 79 nt, Human
ccagccccuugcuagcugugcacccaggggccagccaaucccuggcucugagcugcaaagcugcaauacagggauaugg

SEQ ID NO: 4191228 - RNA, 75 nt, Human
ccagcccucagggaccacugacuucacugugaaaucacccauguggagucccagugagcgccccuuaggaacugg

SEQ ID NO: 4191229 - RNA, 69 nt, Human
ccagcccugcaugugcuucugcugauccgucacuguguggucacaccccaaguacauucgauggggugg

SEQ ID NO: 4191230 - RNA, 56 nt, Human
ccagcccuggggguccuucccacuguuucacaacagccaguccucccacagggugg

SEQ ID NO: 4191231 - RNA, 98 nt, Human
ccagccucacucccgcagccacugcugcccaucuggccacacacaggaugccccugguagugucugcucuggugccagggcuguugggggcaggcugg

SEQ ID NO: 4191232 - RNA, 68 nt, Human
ccagccuccugggaugacucuuucuuuuaguacuguaauucaaggcccuuaucccaggagacugcugg

SEQ ID NO: 4191233 - RNA, 72 nt, Human
ccagccugaccugcuccaggaaagccugaggcccggaggucccugggaagggaguuucuuggagugggcugg

SEQ ID NO: 4191234 - RNA, 84 nt, Human
ccagccugggugugcgcagcgccugcucuguuuccauguggccuguguggucguagcuccauugcagggcucgcagcaggcugg

SEQ ID NO: 4191235 - RNA, 116 nt, Human
cauuaucuacugauuagcaggauaucuuuagggcucagaaagcagguuuucugucucuaccgauggcuuguuuucuggcugaagaaugaagguguuuugauacaaaguuauuauug

SEQ ID NO: 4191236 - RNA, 130 nt, Human
cauuaucuaucuguugcugaaaccucuguguuucccacaccccaccaguaacugagggucuucccagucccucugugugcugcuggggagggcucggcagagagggaagcaagaguuaaaauggauauug

SEQ ID NO: 4191237 - RNA, 89 nt, Human
cauuaucuguuuccuugugccuguagcauuuacuguaauuccuuagauuaaaaccacggccccuaauguuacaggacaaagauggagug

SEQ ID NO: 4191238 - RNA, 119 nt, Human
cauuauuaagucuucguaaauggcauuauuaauagcugcaugaguauaggauagagaaacaccagugucuucuuaguagccauuauauaauuuccaguauuuuaugauuauuauuaaug

SEQ ID NO: 4191239 - RNA, 59 nt, Human
cauuauuacagucccagggaguaggggagucccauccuggcccuggcucugugaucaug

SEQ ID NO: 4191240 - RNA, 63 nt, Human
cauuauucaauguuauuucagugcuuaccaagcugggcaggcacuggagaaguauugcugaug

SEQ ID NO: 4191241 - RNA, 72 nt, Human
cauuauucuccuguggugcguaccccuccauauaaacaagauggggauucguugccaugguaacagagugug

SEQ ID NO: 4191242 - RNA, 68 nt, Human
cauuauugccauccuggaaccuagaauuuuuuuaacuuguuaaugcugccuaggauggcaaaauaaug

SEQ ID NO: 4191243 - RNA, 73 nt, Human
cauuauuuuguuuccuuuggaguagagaaacgugaauucaugaugaaaucuaaagccuagaggaaagguaaug

SEQ ID NO: 4191244 - RNA, 60 nt, Human
cauucaagaguggacauaaugcucugcucccagaccacgucaaaguguccacucugggug

SEQ ID NO: 4191245 - RNA, 55 nt, Human
cauucacaauaguugaaagguggaaacaacuccaauguccaucaacaggugaaug

SEQ ID NO: 4191246 - RNA, 106 nt, Human
cauucacagggcagcagggagaagugggccagggccaggccuccaggacaugggaaccauccuggggaggguucuggcuccuucccccaguguuguauuguaagug

SEQ ID NO: 4191247 - RNA, 110 nt, Human
cauucagagauaauggaaaaauaauggauaagccgcuccuguccuucauccucccuagcuuccuggagagguuggugaggggacacgguguccccauuaugcuuagaaug

SEQ ID NO: 4191248 - RNA, 123 nt, Human
cauucagagcagaagcugcugauuuuauucucaggaaauuuauauugugcccaguuagggagaaagaaaccucuucuagcuauaguguuuucuuaguucuuagaaaaagagaucugaagaaug

SEQ ID NO: 4191249 - RNA, 60 nt, Human
cauucaguggaguauuauucagccacaaaaaggagugaaguacugauacacacugcaaug

SEQ ID NO: 4191250 - RNA, 59 nt, Human
cauucaguuuaauuccauuuauuauucuuuaaggauacauacauggagauaaagugaug

SEQ ID NO: 4191251 - RNA, 58 nt, Human
cauucauccacuguuggaaauuugaguugcuuccuccuuuucccuauuguggauaaug

SEQ ID NO: 4191252 - RNA, 75 nt, Human
cauucauuuauucuauaggcauuaagcaccugccaugcucugagaacagugcugugugcugggaauaaaagagug

SEQ ID NO: 4191253 - RNA, 58 nt, Human
cauuccaggcagagcacaagacucuccaucagaagggagauuagcaugcuugaggaug

SEQ ID NO: 4191254 - RNA, 75 nt, Human
cauuccauucuugcuuucuagaaggcacagccaccccaguaucugguccaggcacccuucuagaguaauggaaug

SEQ ID NO: 4191255 - RNA, 58 nt, Human
cauucccaagcauaaaugguaccuccauaugaucaaagaggugugccaaaugggaaug

SEQ ID NO: 4191256 - RNA, 68 nt, Human
cauucccacacuccauauaauucaggggggauaucaaauaguauuccugagcaggagucaugggaaug

SEQ ID NO: 4191257 - RNA, 65 nt, Human
cauucccucuuugaaacccugagagacaacugcuaaugcuauuggcuccaguguucaggggagug

SEQ ID NO: 4191258 - RNA, 66 nt, Human
cauuccuaguuuuggacauuccugcagccucugggaaauugccaaaauggccaaaagcuagagaug

SEQ ID NO: 4191259 - RNA, 72 nt, Human
cauuccuaugccaagaauccuguucuugaagauaaacuguuaucuuuggugcaugauacuuugucuagaaug

SEQ ID NO: 4191260 - RNA, 90 nt, Human
cauucuaauaucuaucucauaacucauuugaagacaccaaagagcuacaggcccuaagucuucaguuugagaguggaauacauuagagug

SEQ ID NO: 4191261 - RNA, 85 nt, Human
cauucuaguacacauuucaagcauugacuucuauguccaguggacaaauguaguugaaaaguuaagguguggauguauuagaaug

SEQ ID NO: 4191262 - RNA, 59 nt, Human
cauucucaaugagacauuacugggaacaaacucuaauuccaauaauguucaugagauug

SEQ ID NO: 4191263 - RNA, 57 nt, Human
cauucucacaucugcccugugcugggacagcgaguccucaccacacacuguggaaug

SEQ ID NO: 4191264 - RNA, 55 nt, Human
caugugggacaaucucagguaucaagucacugaugcagcugaugauacccccaug

SEQ ID NO: 4191265 - RNA, 63 nt, Human
cauguguagaccgugaccucauccgcugcucacagcagccccaugaagcaagggucacacgug

SEQ ID NO: 4191266 - RNA, 59 nt, Human
cauguguagugaaauaagcagugucuuuaaaugauaccuguuuguuuucauagcaugug

SEQ ID NO: 4191267 - RNA, 96 nt, Human
caugugucuguguguacccuugauuuacauguuugcacacauauguaagguaucugugcucaugcaugugaauuaugguucauguauggcacuaug

SEQ ID NO: 4191268 - RNA, 69 nt, Human
caugugucuguuauacagaggagacuccaaaauggccugggauaugucacuuaacuguaauaacacaug

SEQ ID NO: 4191269 - RNA, 82 nt, Human
caugugugagucaaggagugaacacauaaaagcaaagggugauuuaucauaucauuguuguugcuguguugacaucugcaug

SEQ ID NO: 4191270 - RNA, 80 nt, Human
cauguguuauucauagaaagugcuuagauuggugccugacacuuagcuaauauuuacugagcacuuccugugauauuaug

SEQ ID NO: 4191271 - RNA, 75 nt, Human
cauguguuuucugucucacacugugccaaauccuuucuaccuguggauucaggaaagccagugugcugacacaug

SEQ ID NO: 4191272 - RNA, 77 nt, Human
cauguuagucuucacucuucacuacuauucuauacccgagaugguggaauggggguuccaagagaugggggaacaug

SEQ ID NO: 4191273 - RNA, 128 nt, Human
cauguuauuuucauuuucguuacuugagcagcauugacaagccucagucuuuugcgguccgcagaucaugauucuuggcuaugcaaaccugaggcugaugcauccuccagcagcugaccacggacaug

SEQ ID NO: 4191274 - RNA, 59 nt, Human
cauguucaucagaucaauuguaaugaaauacaaauuuaugaaauugucuguugaauaug

SEQ ID NO: 4191275 - RNA, 69 nt, Human
cauguucuguuguugaucuuuggaggguacaucauccaguuccuauccaaaggaacaaucacagccaug

SEQ ID NO: 4191276 - RNA, 101 nt, Human
cauguuggucaggcuggucucgaacuccugaccuugugauccaccuguuuuggccucccaaagugcugggauuacaggcgugagccagccugacccauaug

SEQ ID NO: 4191277 - RNA, 64 nt, Human
cauguuuacccagauaauguaacaguuuuugugaaagaaaucuacuuagugucuggaugacaug

SEQ ID NO: 4191278 - RNA, 76 nt, Human
cauguuucagauuuucggaagguaacuuggcgcauaugccccauccuguguuacucuuccccggggucuggggcug

SEQ ID NO: 4191279 - RNA, 78 nt, Human
cauguuuccguguaucugguggaagaugugugucugcaggaugagugucucuuuugucgguguaucauggauugugug

SEQ ID NO: 4191280 - RNA, 55 nt, Human
cauguuuguccacaugguagacugcacuagccuucuccaauguaggauaaaugug

SEQ ID NO: 4191281 - RNA, 66 nt, Human
cauuaaauaauuuauuugaaauuuuguaaauggcauaugccauuccagacagguaaauuagguuug

SEQ ID NO: 4191282 - RNA, 57 nt, Human
cauuaacacuuuggauuuagacauauguagauuagcuauaagucagaaguguuaaug

SEQ ID NO: 4191283 - RNA, 100 nt, Human
cauuaagaagguuugagaccagaaaguuugagaacuguagauuggagggaacauuaucauaacaaagaucaaauuuuccuugacucucaauccugagaug

SEQ ID NO: 4191284 - RNA, 72 nt, Human
cauuaagguaaaugggggaaucaaaguaagaaaucaaaucuuucaaacuguacuuuccccuaggcguuaaug

SEQ ID NO: 4191285 - RNA, 76 nt, Human
cauuaaucucuauuuuucuuggaccagacagggcaaaaaaucugaauuccccagaagagauagacuagaauugaug

SEQ ID NO: 4191286 - RNA, 95 nt, Human
cauuaaugcaggugauuacuugaauucucagguaaaaguuaaguggaaguacuugaauuaggccuugagagaugaaaaggaucuaucuauuaaug

SEQ ID NO: 4191287 - RNA, 60 nt, Human
cauuaaugggaugagguggaaaguuggacacacuaccucacagucugccuuucccuugug

SEQ ID NO: 4191288 - RNA, 60 nt, Human
cauuacauuucaaaauguuuccugugauugcuucuaaaggaagcucuguguaauguagug

SEQ ID NO: 4191289 - RNA, 118 nt, Human
cauuaccccauugguugcagccaauaaaagugggaauaggacauuggaagguaguuaugcauuagacuauuuccuauuucuuguccccuacaguugcuguuuuuacugcacgguuuug

SEQ ID NO: 4191290 - RNA, 75 nt, Human
cauuacuuaacauccugcauuuuucuucagacuugauuuucaaagaaggagaaacgcaagaugcuaaguuaaaug

SEQ ID NO: 4191291 - RNA, 130 nt, Human
cauuagaaucuccuggaggguuuacuaagccacacuucccuuggcgcugcucccagagcuucugauguaguaggucugggauagggccagaacaugugcguuuugaacagguucccaggugauacugacg

SEQ ID NO: 4191292 - RNA, 129 nt, Human
cauuagaauugccuggagaggaaugcaaagcccagaugucugagccacacuccccagucauuugcagaaacuggucuggagugagggccaggcauugguguuuacaguguuucucagcugauucuaaug

SEQ ID NO: 4191293 - RNA, 71 nt, Human
cauuagagaaggagacagagcuuuuaaauuuuuaauugaaagggacaaaggcaauuucuucuuccugaaug

SEQ ID NO: 4191294 - RNA, 81 nt, Human
cauuagagaccuggugauagcuguccuacacagcuaauaaaagccacguggggcuacuacuauaaucaggagcugcugaug

SEQ ID NO: 4191295 - RNA, 86 nt, Human
cauuagauucucauaaggagcgcgaaaccuagaucccucacgugcaccguucacaauaggccuugugcuccuaugagaaucuaaug

SEQ ID NO: 4191296 - RNA, 60 nt, Human
cauuagcaggcacuaagaaggucagacuuguguuuuagaagggcccucuggcugcugaug

SEQ ID NO: 4191297 - RNA, 60 nt, Human
cauuagcugagucagauugcagucuuguguccacaagagaguucuuugauuagugaagug

SEQ ID NO: 4191298 - RNA, 55 nt, Human
cauuagguauuuaagcacacagagcaaggccugugugcucuuuuugaagccaaug

SEQ ID NO: 4191299 - RNA, 66 nt, Human
cauuagucaaaacuuugggcaggggcuaucuacuagaauuaauccuccucauaucuuugacuagug

SEQ ID NO: 4191300 - RNA, 66 nt, Human
cauuaguguacauauugagucugcugacaaucuucggugucagggaugacaguauaugccuugaug

SEQ ID NO: 4191301 - RNA, 82 nt, Human
cauuaucuccugugggucaccaauaggcacaaagaagcagucuguuacuaauugguagccuagugguuccaggaaguuaaug

SEQ ID NO: 4191302 - RNA, 83 nt, Human
cauuaugauaaauucuuguuccuuuguauucuuagcaauggcaggcuuggaauacuaaaggaagcaauugacuuaaaauagug

SEQ ID NO: 4191303 - RNA, 57 nt, Human
cauuaugcauuaguucuuguugguuguauaaccaugcaucaaagcuaauauaugaug

SEQ ID NO: 4191304 - RNA, 68 nt, Human
cauuauguaccucuuucugcuucauugcuuuguuuguuggccuuggagugaaguaaagaggacaagug

SEQ ID NO: 4191305 - RNA, 57 nt, Human
cauuauuaauucagcacaugcuuauagggugccugcuaugugccagaaauaguagug

SEQ ID NO: 4191306 - RNA, 80 nt, Human
cauuauucaggaugaaagugugcaacacuagauccuaccaucuaguuuuuuguccuaacauaauucauccaugagugcug

SEQ ID NO: 4191307 - RNA, 60 nt, Human
cauuauugucaccuuuauuuggauugcccuaaauguggcuagaguacaggugcagaaaug

SEQ ID NO: 4191308 - RNA, 97 nt, Human
cauuauuuaagagaagaguccucacaugaauaaggcuuuauugugcuuauccgaagcagcagggcuuugucucugugaaauguuucuacuuugaaug

SEQ ID NO: 4191309 - RNA, 100 nt, Human
cauucaaaaaaugugccaguuacaagugauucuugguguuuuauuacaauauaucucacugaacaccuauguggaaaucagcuuguaauuucacugaaug

SEQ ID NO: 4191310 - RNA, 58 nt, Human
cauucaaagcaagacacaauuccuagguaguuaaauuuaggagacucuguauugaaug

SEQ ID NO: 4191311 - RNA, 57 nt, Human
cauucaaagcaggaaaggccuuugucauggucaaauggcuuuaauguguuuugaaug

SEQ ID NO: 4191312 - RNA, 59 nt, Human
cauucaaaugugccacuguccucauuauggagcucagauggcugaggauauaguggaug

SEQ ID NO: 4191313 - RNA, 80 nt, Human
cauucagaccacuggcacucagguuaauggagguuuuacugucuuccagugaaacaugagguguggguggggaaagagug

SEQ ID NO: 4191314 - RNA, 71 nt, Human
cauucagauaguaugauuuucuuccuuagugguuacauuugacugccaggauuaaaguauauuuuugagug

SEQ ID NO: 4191315 - RNA, 109 nt, Human
cauucauauaauaaucuuuuucuuuccucuugguuacuuccugaaucuuccauguauauuucuaugugugugcauuggcaggaauaaugaaggacagcauguguggaug

SEQ ID NO: 4191316 - RNA, 122 nt, Human
cauucauccaucgagggacccuuagguuguuucuauaucuuaccuauuguaaauaaagcugcaaugaacaugugggugcagauauuuuuugagauacugauuuucuuuccuuuggauauaug

SEQ ID NO: 4191317 - RNA, 62 nt, Human
cauucaucuaucaaaugguaccaauggguugagaugaccaaggugcucgcugaugaggagug

SEQ ID NO: 4191318 - RNA, 79 nt, Human
cauuccaaguauauacaugauaugaguguauuuccugacucccuuuuugaugguaucaugugacuagguuuggccaaug

SEQ ID NO: 4191319 - RNA, 120 nt, Human
cauuccacaccagcauuuuagucccucagucuguugcauguugcauauauuguuucucauuacucaaguuuguagaaauguaaccaggagauagaagagaaaaagagcuuguggggaaug

SEQ ID NO: 4191320 - RNA, 57 nt, Human
cauuccacaguguguggugaggacucgcugucccagcacagggcagaugugagaaug

SEQ ID NO: 4191321 - RNA, 83 nt, Human
cauuccacuugucuuggugccuggcacaggaauuaggagguccaagacucaccugaaagaugccggugcccauaacagggaug

SEQ ID NO: 4191322 - RNA, 74 nt, Human
cauuccagaaagauuucacaucccaagccuaagguccaggggcagcaggcauugaggcggauguggcuggagug

SEQ ID NO: 4191323 - RNA, 68 nt, Human
cauuccagacugggcugguggaaagcuggaaaauagaucacuuucccaggcccagauuuuagguaaug

SEQ ID NO: 4191324 - RNA, 65 nt, Human
cauuccaguaugugucuuuuggcaaacagauguuugcauuucuuuugaguauaugccuaggaaug

SEQ ID NO: 4191325 - RNA, 58 nt, Human
cauuccauggaauaaauuccuuauugaagguaacuuucagaauuauuuuuaugggaug

SEQ ID NO: 4191326 - RNA, 67 nt, Human
cauucccaacuugcaggauuuugcugcuguagaauuuacgaugccacaaaccugcauuuaaggaaug

SEQ ID NO: 4191327 - RNA, 76 nt, Human
cauucccacggccacugcagcaccccaguagcuccaacagaaggaccccuggagucugugugugucuguaggaaug

SEQ ID NO: 4191328 - RNA, 76 nt, Human
cccaagaaucaacauuauuuaguggaaaaaaguaucaacuaguagaaauuauuaaguaauguuuggggggcuuggg

SEQ ID NO: 4191329 - RNA, 69 nt, Human
cccaagaggaccuugccagggcagugcuaggcagagucucucugccugccuaggucuggccuccuuggg

SEQ ID NO: 4191330 - RNA, 127 nt, Human
cccaagcccauuuccucuaccucccuccguagugacaucuggccucacguccccgggguucguccuuacagaaugggauggagguucucagaugcucauuagccaggaggauaauugagggcuuggg

SEQ ID NO: 4191331 - RNA, 62 nt, Human
cccaagccuuucaaaacucagacugccuaauugucagggcucuguuuugaagaggcucuggg

SEQ ID NO: 4191332 - RNA, 81 nt, Human
cccaagcuaagugcugagcaggugaugugagucuggaacagccuuuguucugggauuuaggcacuuucucaugagcuuggg

SEQ ID NO: 4191333 - RNA, 79 nt, Human
cccaagcugaagcugccugggaggaagggcugagcaugccuagcccagccccuucuuuggggagcugacugccuauggg

SEQ ID NO: 4191334 - RNA, 63 nt, Human
cccaaggcuggagggcuuauguaugcuggggugcuggggaaugcagggucuccuguacuuggg

SEQ ID NO: 4191335 - RNA, 72 nt, Human
cccaaggugaaguggcuggagccccaggcugggguacugucccaacucugccacuagccgcugagaccuggg

SEQ ID NO: 4191336 - RNA, 77 nt, Human
cccaagugaccuccuaggcaggagcucuguccaugagauuguccuuagcagggcucugccaugggcccggcacuggg

SEQ ID NO: 4191337 - RNA, 65 nt, Human
cccaaguuccaagaaguaaagggcucucuccacuuuuauccuuccaucuaucccuggagcuuggg

SEQ ID NO: 4191338 - RNA, 69 nt, Human
cccaaguuuggagugggcaauguaggcaagucgaugaauuuugcugccgacacccuuugagaucuuggg

SEQ ID NO: 4191339 - RNA, 61 nt, Human
cccaauauccugcuauacuccugccagagcuguucaggucagagaaaaguaggguguuagg

SEQ ID NO: 4191340 - RNA, 62 nt, Human
cccaaucacugccauccaagcagccaucucauauggcagcagggaggccaguguucccuggg

SEQ ID NO: 4191341 - RNA, 129 nt, Human
cccaaucaggaggcuccucgaugugacguggauccguguuuccucuucuucuuccuggugguuuacguaagagggagagcaauggggacgggcagggacagagcugcgggcugagguuccuccguucgg

SEQ ID NO: 4191342 - RNA, 57 nt, Human
cccaaucuuugcggaugguugugauacugcaauaguguuucaauccuagggguuggg

SEQ ID NO: 4191343 - RNA, 88 nt, Human
cccacacaugugcucggccaugccugugggugcaggcgccaugcgucugcacacacagugcaugggcuugugccagcacacacacagg

SEQ ID NO: 4191344 - RNA, 79 nt, Human
cccacacucuucaccuccuccucugugggcagcaggucccugccugaagccgacagacaggaagucggaucuguguagg

SEQ ID NO: 4191345 - RNA, 70 nt, Human
cccacagcgccccccacgcacuugguaagggccccugguccaggcugcuguacuuggggggugcuguugg

SEQ ID NO: 4191346 - RNA, 62 nt, Human
cccacagcucaagugucuacaccgcacugccauccaggcugugagccgcugcugagcauggg

SEQ ID NO: 4191347 - RNA, 74 nt, Human
cccacaggcaggcucacuguaaggucagcuccaucacaguggcagcuaggagauuuugugaggcuuccuguggg

SEQ ID NO: 4191348 - RNA, 69 nt, Human
cccacaugugguuugcacagcguugggggagucaccagccccuucagccugucugcagaccccuguggg

SEQ ID NO: 4191349 - RNA, 80 nt, Human
cccacauucaguuucaaauccugugaaguuuuagcacuuuaacuccacaaaauacacagggagagauuggaaacuuaggg

SEQ ID NO: 4191350 - RNA, 72 nt, Human
cccaccagccaagggcuguuuuuggcaccugggacagagucugugccuuuaagaagcucauggucugguggg

SEQ ID NO: 4191351 - RNA, 75 nt, Human
cccacccccgcccugcucggccaguuucaggauuccuggggccagagauggggcgcagauuuguuuugggguggg

SEQ ID NO: 4191352 - RNA, 90 nt, Human
cccacccucuuuguccugcagggugcugccacagauuuauagaaagagauggagcugagaagaugguaccuguggacacaggggguuggg

SEQ ID NO: 4191353 - RNA, 66 nt, Human
cccacccuguugucugcagcuuucaguucuuccucuuaacuucugcuguugugacguuaguuuggg

SEQ ID NO: 4191354 - RNA, 106 nt, Human
cccaccucccccaagcccugcaggcuugggcucagcaccguguggaccugacgggaguuucccaugauucugggcucaaaaugcugggugccugggagaggguggg

SEQ ID NO: 4191355 - RNA, 82 nt, Human
cccaccugcagcccuuagcuguguagacacucagagccagacaagacccugguccucagccuuguccacagcuacagguggg

SEQ ID NO: 4191356 - RNA, 59 nt, Human
cccacggccugaccugguguugacaggagcaccugcagagagugccgggcagccccggg

SEQ ID NO: 4191357 - RNA, 64 nt, Human
cccacgggcugcacgggcuuccguggccuggcugcuggccaccagccuccuagcugcuccuggg

SEQ ID NO: 4191358 - RNA, 61 nt, Human
cccacggucaccugaaggucagaggcugagaagcaggaacgaguucauggggaccuguggg

SEQ ID NO: 4191359 - RNA, 130 nt, Human
cccacuauguaaggucagauugggcagugaguguugaaagaugaaagcaggcuggugagcaggccgacugaggaagcccacacggccugccuuaaauucuagucccaccacuuuccagcugcgccucggg

SEQ ID NO: 4191360 - RNA, 76 nt, Human
cccacuccccuccguagaucccagaaagcagcaguguggggcaugauacuugacauuugcgaucaaggggagaggg

SEQ ID NO: 4191361 - RNA, 68 nt, Human
cccacucgugggaaggagcuggucuucgcagcuuugcgugaagcucugauacuuccuaccugagucgg

SEQ ID NO: 4191362 - RNA, 65 nt, Human
cccacugaccgccagagugggugccaccuucuucaggguggcgccagcccaggccgucguguggg

SEQ ID NO: 4191363 - RNA, 107 nt, Human
cccacugccuggcugcuuucugcuguuggugucugcuccaaucucagaaaaguuggggcaaaaccugggcaucaugaauggcagcagaaggcagauagguuccuggg

SEQ ID NO: 4191364 - RNA, 74 nt, Human
cccacuguagcuaguccugggucuggagaauggaauguaugcguugcauuccuuucuaggauagcugaucaggg

SEQ ID NO: 4191365 - RNA, 60 nt, Human
cccacuguggaagaaaggggaggucccacgguacuugccuuggccuuucuucccagaggg

SEQ ID NO: 4191366 - RNA, 65 nt, Human
cccacuuggcauaauauucaccacccuaucuccccaaauaccuaguggugucuuauuacaguggg

SEQ ID NO: 4191367 - RNA, 63 nt, Human
cccacuuugguugcacucugcccuguggggaccccugacugaaggagggcagcugagaguugg

SEQ ID NO: 4191368 - RNA, 79 nt, Human
cccacuuuucagaacugcugcuuuugcgggagaacaccuuuuuccagguguuguccuuaggguagcagggaagacuggg

SEQ ID NO: 4191369 - RNA, 78 nt, Human
cccagaaaauuuaaugacuuaccugugauuucagaccgagacacacagaaaugcagguauauuuuauuaaaguuuggg

SEQ ID NO: 4191370 - RNA, 55 nt, Human
cccagaacacagccucuauuuuccagccucuuuuggagcugaguguggucauggg

SEQ ID NO: 4191371 - RNA, 66 nt, Human
cccagaacuuaauccaggcgaaugcagaaggccuuugcugguuuucugguuuggguagucuuuggg

SEQ ID NO: 4191372 - RNA, 75 nt, Human
cccagacagaaucaucuccugggacugaccucaugcacaugcucuugucuagcuacacaggaggacucuucuggg

SEQ ID NO: 4191373 - RNA, 71 nt, Human
cccagacccccgacauggcaaagugcaggggaaggagaagggucuuugagcaagccugcggcgggaaaggg

SEQ ID NO: 4191374 - RNA, 122 nt, Human
cccagaggaacgcuggacaaagggcaaggucgucugcagaggguuugagcauccuggcagaaaggggcacugucaggcugucuuccucccucuugggcaucguucuuaccaguuuccuuggg

SEQ ID NO: 4191375 - RNA, 59 nt, Human
cccagaggcuggcagccagcugauaccggacaggguucacaggggccagcgcucugugg

SEQ ID NO: 4191376 - RNA, 62 nt, Human
cccagaguccuugcccagccccaucugugaaaugggcagaguugcugcagaguauucuuggg

SEQ ID NO: 4191377 - RNA, 91 nt, Human
cccagaguguugguaaaugcagauuccugagccuaccccagaauugcugagguggagcccaggaaucagcauuaacaauaaacccucuggg

SEQ ID NO: 4191378 - RNA, 104 nt, Human
cccagaugguccgugggcauucuguaguuacugccugccugcugaaguaagggguuaauuaacuucagggcguuguggcugacugaagcuaggcugacucuggg

SEQ ID NO: 4191379 - RNA, 88 nt, Human
cccagauuacaugaguuaaugaauaugaagauagguuuccccuuacuaggaaaucaguaaauguucauuaacuguauuuaaugcuugg

SEQ ID NO: 4191380 - RNA, 67 nt, Human
cccagauucacuaauagcuggccucaagauacaccagaucgaggaaggcugagaaguagauccuggg

SEQ ID NO: 4191381 - RNA, 130 nt, Human
cccagcaaaaaucuuguggcauuuuauuggcuguguuugggucacaugcccaccuuugaaccagucacugaggucagggguaugugauguccugauuggguuaggcuugggccaccugauucauccuggg

SEQ ID NO: 4191382 - RNA, 59 nt, Human
cccagcacaggcaauuccauacagacaagacgguagaugaguggaugccagaggcuggg

SEQ ID NO: 4191383 - RNA, 56 nt, Human
cccagcaggaggagguugcagugggccgagaucgugccacugcacucuagccuggg

SEQ ID NO: 4191384 - RNA, 80 nt, Human
cccagcaugcucaccuguguuuuuguuugacuccuucacaugccugcgggaagauacauaaagguagagucuauguuggg

SEQ ID NO: 4191385 - RNA, 59 nt, Human
cccagcaugcucagucuaaauuguauauauguauauaauagauagggagaguugcuggg

SEQ ID NO: 4191386 - RNA, 67 nt, Human
cccagcaugggagcuaucuccaucacucuaucauggccacuagugaaauaaagcugccuaugguggg

SEQ ID NO: 4191387 - RNA, 80 nt, Human
cccagccacaggacccccaggggcaggaagaguccagggucuccaggguuuccuauguccauugagggaguguuucuggg

SEQ ID NO: 4191388 - RNA, 92 nt, Human
cccagcccaucuggcucagcugcugugugagggcccagcgcuggugggcagccagaucgccuuacacugccuggggccacgguagagcuggg

SEQ ID NO: 4191389 - RNA, 72 nt, Human
cccagccccucagguacccgugcagcaggucccgagucccaccugucuguccccugccuugaggggaacggg

SEQ ID NO: 4191390 - RNA, 55 nt, Human
cccagccugguagagcccuuuggggaaagccucagagaguuuucacuaggguggg

SEQ ID NO: 4191391 - RNA, 81 nt, Human
cccagcucugcaaggugccagccuugccaguuucuggacuguggucgucagcaaggcuguugcugcugcaaggaagcuggg

SEQ ID NO: 4191392 - RNA, 84 nt, Human
ccacaagcuucuuggcucugaggcauuguccuggggagggccgagcaccucccuggaggcccagaccugggagugcauaagugg

SEQ ID NO: 4191393 - RNA, 64 nt, Human
ccacaaggggacucguuaaauguacucucacuggucuaauugcauuuaauuaagucccuugagg

SEQ ID NO: 4191394 - RNA, 66 nt, Human
ccacaaugggcugggaccaucaggucgucugccacaagugcccacagaaccucucccagccccugg

SEQ ID NO: 4191395 - RNA, 102 nt, Human
ccacacccuugcugucaugggauucaggccaggccuggacagccugagacaccucuguccuuacugcuucuggcuuaguccucaucccagagaaggcugugg

SEQ ID NO: 4191396 - RNA, 67 nt, Human
ccacacgcgcacacucaggucaaguauucugaaccaaaggcacagguugacucuugagagccguggg

SEQ ID NO: 4191397 - RNA, 124 nt, Human
ccacacuggguaaggagagcagcaaaugggugagagaacaacuugggguugcugugggaaggaugcaagggaaauccuucagccaugggcucuccacuuccucucgcccccaaaccucaguggg

SEQ ID NO: 4191398 - RNA, 62 nt, Human
ccacacugucuccauagaguagcuugauggcucugaccagucgggcacaggagcggcugugg

SEQ ID NO: 4191399 - RNA, 58 nt, Human
ccacacuucuucccuggcaucgcugacugaaaggcagaaugugagggguugaaguggg

SEQ ID NO: 4191400 - RNA, 57 nt, Human
ccacagagauggucuggcagguggagugcagcuccacacgggccguggacucugugg

SEQ ID NO: 4191401 - RNA, 72 nt, Human
ccacagaugucacauggccuguacuuuggacugugaugcauaccuaugcucgcuaugucacauucccugugg

SEQ ID NO: 4191402 - RNA, 67 nt, Human
ccacagcuagggcaaucugauugcccccaaaucuauuccuauacacucagucugccccaagcucugg

SEQ ID NO: 4191403 - RNA, 63 nt, Human
ccacagcuccugcccucuugcaauucccacacugguggggaacaaaugugcagagccaugugg

SEQ ID NO: 4191404 - RNA, 56 nt, Human
ccacaggaauuagcagccuaaaacagccuauauguauuagcucaugauuucggugg

SEQ ID NO: 4191405 - RNA, 89 nt, Human
ccacaggcagaggcuggccgagcuggugcucaggggcauggacucagaaguccugagcugccgcaucagcagcacagcggucugcgugg

SEQ ID NO: 4191406 - RNA, 130 nt, Human
ccacaggccacuuguccauucuugccaccuuucacauguucccuaguuaggccccugugguaucccccagccagcgcaguguagguggggggcguguguucaugucaguagauaugucuguggccgccag

SEQ ID NO: 4191407 - RNA, 60 nt, Human
ccacagggcacaaccacauuccacuuuucuaccugaaaggggugagguuuauguucuggg

SEQ ID NO: 4191408 - RNA, 63 nt, Human
ccacagggccuuuccugcuggccacaaaacccacuuggcccagggcaguagaaggcugugugg

SEQ ID NO: 4191409 - RNA, 73 nt, Human
ccacaguaagagauaguuuauguaccaacauuuggccccaaguuuuaucagauaaucuuuuacaagcaugugg

SEQ ID NO: 4191410 - RNA, 55 nt, Human
ccacaguagaauucaucucccuuaugacaugaauaggauagaugucacacugugg

SEQ ID NO: 4191411 - RNA, 82 nt, Human
cccaggggcugcauuuccauguuaucuugcagacuuguacaguucccaagcaguggcauggaaugagaauguggucuuaggg

SEQ ID NO: 4191412 - RNA, 78 nt, Human
cccaggugcagcugcaggagucagguccaggacccaugaggcccucagacacugcccuccaccugugcugugucuggg

SEQ ID NO: 4191413 - RNA, 78 nt, Human
cccagguuuagguggacgugcaggcuagcuggcucccaggugccauggccaguccuguggucccugucugugccuggg

SEQ ID NO: 4191414 - RNA, 74 nt, Human
cccagguuuccaacuaguaugaucaggugcuuaaaaauaaauaugugccuagguuuauaucuauggacauuggg

SEQ ID NO: 4191415 - RNA, 93 nt, Human
cccagguuuccaugacuucaaguuuuguguucuuuuucugcuacuucagcaagaguauuuagagacacaagacggccaaucauagaaucuggg

SEQ ID NO: 4191416 - RNA, 77 nt, Human
cccaguacuuguuuagcacagacagaauggucauacuucuucugaccuugugauaaaucuucugugcugaauuuggg

SEQ ID NO: 4191417 - RNA, 57 nt, Human
cccaguagacaggugugccuacagaugggauugacaaguagaaccaugugugcuggg

SEQ ID NO: 4191418 - RNA, 87 nt, Human
cccaguauauaugacaacuugcugguagcaaaugaaucuuagaauuaagacacugcuaaacaguaaagaugauuguucaguauuggg

SEQ ID NO: 4191419 - RNA, 59 nt, Human
cccagucauaccuaaaauuuuuacuuagagcugaguauuuggugugguauugaccuggg

SEQ ID NO: 4191420 - RNA, 70 nt, Human
cccagucucagguauuucuuuuagcugugugagaaugaacuaauacaaaaaauugauacugacgaguggg

SEQ ID NO: 4191421 - RNA, 61 nt, Human
cccagucugauacagagaccucagcccaaccucuacaauguguccuucagucagaucuggg

SEQ ID NO: 4191422 - RNA, 72 nt, Human
cccagugacgaaauuccacuuacauaugcaacugaaaaaaaggugaaaguugagguaggaauuuguauuggg

SEQ ID NO: 4191423 - RNA, 61 nt, Human
cccagugcucauucucaugccuguuuuaacaguggaggcuggacaugagcuuggcaguggg

SEQ ID NO: 4191424 - RNA, 74 nt, Human
cccagugggagaaauuuguuuugaauauuucaguugcugugaauaugaaacauucauacaaauaaauggcuggg

SEQ ID NO: 4191425 - RNA, 78 nt, Human
cccagugucuccuuguggaucucaaggaugugcuuccacauagcagcaucuucuucagauggacaaggagacacuggg

SEQ ID NO: 4191426 - RNA, 67 nt, Human
cccagugugacuguauuugagauagggccuuuuaagagacaauuaagguuaaguaaggucauauggg

SEQ ID NO: 4191427 - RNA, 88 nt, Human
cccaguguguccugguuccuuguggcugucccuggcaguuggagacacccacaugccccagccuucagucagcagacacaaacuuggg

SEQ ID NO: 4191428 - RNA, 68 nt, Human
cccaguuaugcaguuaaagugcuuaucacagaaauguucuucuggguaauuauaauuguaauuauggg

SEQ ID NO: 4191429 - RNA, 85 nt, Human
cccaguucaaaggccuuauuccagcuaagaguccugguccaagguauauuaggaccacagcuaccugcguggaagaggaacuggg

SEQ ID NO: 4191430 - RNA, 92 nt, Human
cccaguugcugcuucccuggccucccuuccccagcacaugaccucacccuuauccagucugguagaggaagaggccuggauaggagccaggg

SEQ ID NO: 4191431 - RNA, 62 nt, Human
cccaguuuaauucaaguccuugacuucgagauuaaugaggagaaaggcuuggcugagcuggg

SEQ ID NO: 4191432 - RNA, 89 nt, Human
cccaguuuauuccagggcugaccuaagcuccacuucuacccaccacucccuaaagaggugauagaguaggcagcaaggagggggcuggg

SEQ ID NO: 4191433 - RNA, 87 nt, Human
cccaguuuauuucucagauauuuacugagcauuuacugugugucauguaaacuucuagaugcuguaguggauagugagaauauuggg

SEQ ID NO: 4191434 - RNA, 70 nt, Human
cccauaaaaauucacuccugggauaaauaccaaccugaaauaacacucacuuggcucagauuuuuauggg

SEQ ID NO: 4191435 - RNA, 81 nt, Human
cccauaauuagucauguuaugcauaugaaguuuccaaaauaaauagagaaaaaugcacaacaguggcugccuugagcuggg

SEQ ID NO: 4191436 - RNA, 56 nt, Human
cccauaauucaaucaccucccacuggguuccucccaugaaaggugggaauuguggg

SEQ ID NO: 4191437 - RNA, 69 nt, Human
cccauaccagaguaauguguggaaauuaucuuaagaguuagugcuuuuugcaaguuauuuugggguggg

SEQ ID NO: 4191438 - RNA, 63 nt, Human
cccauaggauuacagauacugacaaagugaaagacuuucaggccugagaaaaauccuuuuggg

SEQ ID NO: 4191439 - RNA, 69 nt, Human
cccauauuuuaagagcucaguagccacaaguggcugaguggcugcuacauaggauagcucaaauauggg

SEQ ID NO: 4191440 - RNA, 88 nt, Human
cccauccaaacagaaacugcucaaggaucugguagggcucguaccgauguucucuacuucaaccugugagcaucaauuuugugauggg

SEQ ID NO: 4191441 - RNA, 79 nt, Human
cccaucccagggcacuuaggcccagcccacaccccaacgugagacucuggggcggacugggcaugggugcucugcaggg

SEQ ID NO: 4191442 - RNA, 100 nt, Human
cccauccccagguaggccaguggcagguuguguguggucagcuucuucuuguuucccucuuccccuacucaauagcuacuguugcugaccuggggcuggg

SEQ ID NO: 4191443 - RNA, 56 nt, Human
cccaucuaagaaagcacuucaggagcaauuaauugcaguguaugaaucuggauggg

SEQ ID NO: 4191444 - RNA, 84 nt, Human
cccaucucagccucccaaagugcuaggauuacaggcgugagccaucgcgcccggccuaauuuuuguauuuuuuguagagauggg

SEQ ID NO: 4191445 - RNA, 57 nt, Human
cccaucuccaaauacagucaucuugggaguaaggccucaacauaugacuuugguggg

SEQ ID NO: 4191446 - RNA, 71 nt, Human
cauuugaauagaggccccucagaaaauucacauuuccauauuuacugggggauuuuuguuuauuacaaaug

SEQ ID NO: 4191447 - RNA, 96 nt, Human
cauuugauaguuuuccauccauaucuuguugaggaaacccugaguuuauuugcuucauagagaugcuuggauuuucuuaggagaguucuaaaaaug

SEQ ID NO: 4191448 - RNA, 58 nt, Human
cauuugauccccaaaauuucaaaggaagaauuuuuuucauugacaguugggggaaaug

SEQ ID NO: 4191449 - RNA, 71 nt, Human
cauuugaugagugccucccaugcauugccuccuuuaauacucaaaaagcaaugucauuuauuuaucaaaug

SEQ ID NO: 4191450 - RNA, 95 nt, Human
cauuugauuucaguuuuauaggacuuggaaggagcucccagccugggauuuuguaaucugggcucucuacuuuggagccuggacugagaaaaaug

SEQ ID NO: 4191451 - RNA, 86 nt, Human
cauuugcaagcuaggaaacagauucaaccuaagacaaucuaguccucuggagauccaggcugagucuuucgauuuuuagcagaaug

SEQ ID NO: 4191452 - RNA, 69 nt, Human
cauuugcauggggaaggaguauuuggagaaaggguauccccguauuucaucuccuuucugcuguugaug

SEQ ID NO: 4191453 - RNA, 55 nt, Human
cauuugcuuaucuccacaguuguuucacuacagcucuaaugaaggugggcauaug

SEQ ID NO: 4191454 - RNA, 84 nt, Human
cauuuggaauuggagaguuagagugguauguuggaaagaaugcaaauuuggaaauaucauuuauaacuuuuaaaagaaagaaug

SEQ ID NO: 4191455 - RNA, 60 nt, Human
cauuuguaauacugacuugcagaagauucaaauagcuagcugcaaggaagcaggcaagug

SEQ ID NO: 4191456 - RNA, 82 nt, Human
cauuuguaaugcucuuugaauuugucagaaagaaagacccauuacauacugaagucugcauccccaaagagcauuacaaaug

SEQ ID NO: 4191457 - RNA, 67 nt, Human
cauuuguaggguuucugucuaguauggacucuccuauguucaguaaggccugaggaccagauaaaug

SEQ ID NO: 4191458 - RNA, 128 nt, Human
cauuugugauugugugugcaugcaugaccguguuuguauacaugcacaugaacaugugugagugugccuauuuacauguguguuuauguguauguaccuguuugugucugcuuaugugggucaagaug

SEQ ID NO: 4191459 - RNA, 70 nt, Human
cauuuguugguugcugucuuauccauggguauguucccuuuguuccugacucagcgaugcucagcaaaug

SEQ ID NO: 4191460 - RNA, 65 nt, Human
cauuuuaaaugauuuaagccaaugaaaggacacuccauuuguuugcucaauagucaauugaaaug

SEQ ID NO: 4191461 - RNA, 60 nt, Human
cauuuuagugacuguuggaggcacaugauccagcaugugugaauagcaguggcugguaug

SEQ ID NO: 4191462 - RNA, 55 nt, Human
cauuuuauuuuguggucaaauucaaaugcugaucuaauggcuucagaguaaaaug

SEQ ID NO: 4191463 - RNA, 84 nt, Human
cauuuucacagaugcaaaagcagauuggggauuuccauggcaguguuauaaagauauucaaaaucugcauguauaguuaaaaug

SEQ ID NO: 4191464 - RNA, 69 nt, Human
cauuuucaggccgcgugugaaggccagcuuugaucuacaccaaggacuggagcagugguccuggagaug

SEQ ID NO: 4191465 - RNA, 61 nt, Human
cauuuucaugggcugacaacucagacaauaucacgauucuguuggucauucucagaaaaug

SEQ ID NO: 4191466 - RNA, 93 nt, Human
cauuuucucugugucucuguguugcaggaaaaucuggguucuugucacaugaccagguuaauuuaggcacgcagacacuuugaagggugagug

SEQ ID NO: 4191467 - RNA, 60 nt, Human
cauuuucuuaagccagcuauucucaaggccucaaaauagcugccauugcuccaggaagug

SEQ ID NO: 4191468 - RNA, 77 nt, Human
cauuuugaauuuccaggagaggaaaccugauuggucacacuaguauccaguuuuccgucuuggauaaaucagcaaug

SEQ ID NO: 4191469 - RNA, 57 nt, Human
cauuuugauuuuuggucuguuacauagcccaugggggcuacagacaaaauggaaaug

SEQ ID NO: 4191470 - RNA, 82 nt, Human
cauuuuggucauacaguaaaaucuauggauuaaguuagaaaucaucuaucccauauauuuugcggucacguggcuucaagug

SEQ ID NO: 4191471 - RNA, 116 nt, Human
cauuuugguggucacaacugguuggaaggugcuacugucauuuaguggguggagccaacagaugcugcuaaacaauguacaguguauaggacaggacaguuuuccacaauaaaaug

SEQ ID NO: 4191472 - RNA, 78 nt, Human
cauuuuuauauccuuuacugugucacagacuuuggaaacccauaaauaucuguuggauggauaaaggauggauggaug

SEQ ID NO: 4191473 - RNA, 99 nt, Human
cauuuuuauccuauugcaaccugaaacuacauucuugauucugaccaaauacaaaaauugaauuacgagaaugaaguaucaggcagauagcuaucgaug

SEQ ID NO: 4191474 - RNA, 83 nt, Human
cauuuuuggcaguguagcaggacccuucaugaagggacucucuucauucaagggguuccugauugcaaacuguaucaagucug

SEQ ID NO: 4191475 - RNA, 81 nt, Human
cauuuuugguuguuacaguuggggguaggggauggggagggauacaugcuccugauaucuaauguguagaagccaaagaug

SEQ ID NO: 4191476 - RNA, 86 nt, Human
cauuuuuguguucaauagauuauuugcucauuacuucucccuuuaacagggucugagaaaugaaugaauaaaugaaugaaugaaug

SEQ ID NO: 4191477 - RNA, 69 nt, Human
cauuuuuucagagagcuuuuaugucccuguuaguagaaucuagugggcauaguuuaucuuucugaagug

SEQ ID NO: 4191478 - RNA, 70 nt, Human
cauuuuuugucucuauuuacuuggaaguagaugcuaaaugcugcuuccugguagauaggaguagaugaug

SEQ ID NO: 4191479 - RNA, 62 nt, Human
ccaaaacuguaagagaauaaacuaccacuaagcuugugguaauuuguuacuggugcaguagg

SEQ ID NO: 4191480 - RNA, 59 nt, Human
ccaaaauaacagcccaauucaccaagccgaguaacuuggggguuuuguguuuguuuugg

SEQ ID NO: 4191481 - RNA, 72 nt, Human
ccaaaaucauugauuaaacaggcauauucaacauuaaaguguguguguguguuuaauuaaaauugauuuugg

SEQ ID NO: 4191482 - RNA, 92 nt, Human
ccaaaauguaaaguaguggggcagggagguuaucgccgaggggcaggauuucggugauucucauuccuuuucuucuuuuccuuuucuuuugg

SEQ ID NO: 4191483 - RNA, 80 nt, Human
ccaaaaugucugggugcagauagguccagaccuggaggacagaaucccugccagcauggcuuaucuccccaguaauuagg

SEQ ID NO: 4191484 - RNA, 63 nt, Human
ccaaaauugggaauuuuccuuaagcaaguagugaguuccucauuacugaaguuacccaaaugg

SEQ ID NO: 4191485 - RNA, 65 nt, Human
ccagaagaacuuaauucaaaacuaauuuauuccucaggucaaaaguuuuggggugguuggucugg

SEQ ID NO: 4191486 - RNA, 86 nt, Human
ccagaagacugacaaguaaaauuggcaaaguguaggucauugcaggucauuggccuuacugagggcaauuuugauggagucucugg

SEQ ID NO: 4191487 - RNA, 127 nt, Human
ccagaagaucugauguccuggcaugggucugaugccucauguugcucgcaucugcauucagaucuuaugcgugugacugauagguggaacgaucaugugccugacccuugauggugcagauuccugg

SEQ ID NO: 4191488 - RNA, 81 nt, Human
ccagaagcaaacagcuguuuuugugggcaugugauugagguaccugagcagucuaugcuagaaggucaguugaagcucugg

SEQ ID NO: 4191489 - RNA, 126 nt, Human
ccagaaggcggugaacacuuggucccaggaacucuggagcacgcccuggcccaggaaauacuucaccaucgucccggcuggagugggcuccagaguuccugggaccagguguucaccgccuucugg

SEQ ID NO: 4191490 - RNA, 90 nt, Human
ccagaaguggggaccugaaugaaaucaaggacugaguaugguaacuacagccauuuaauuuuauuugaagucucccguaaaauguucugg

SEQ ID NO: 4191491 - RNA, 72 nt, Human
ccagaaugggagaaaguaggcagccagaagaguuugaaauguugaucauauggcucagcuuuccccaucugg

SEQ ID NO: 4191492 - RNA, 63 nt, Human
ccagacaaagugacauaaaaucucccaggauuauauaucaauccaagggaugccauuguuugg

SEQ ID NO: 4191493 - RNA, 80 nt, Human
ccagacacacagcagaucuguggcagugaugagucuucucugcacugagaggccuccugucuggguugcuuuuuguuugg

SEQ ID NO: 4191494 - RNA, 79 nt, Human
ccagacaugugcccuugaggaaggcauuuaacaucucaaagacuaugcuucucugucaaaugggcacaguuuccauugg

SEQ ID NO: 4191495 - RNA, 95 nt, Human
ccagaccaauguguuguuuuucuuuauuauuauuucuuaaagcuucccuugagagaauaaaugguaauggagagaacuacuuaacaagguccugg

SEQ ID NO: 4191496 - RNA, 129 nt, Human
ccagacccaauugcaaaggccaacugaaaucaccaucugugcuuuacuggcagugauguaaugugauugcaugcuuucagaaauagggcuacagaggaaaugaaccccaguucuucacaugggaaaugg

SEQ ID NO: 4191497 - RNA, 67 nt, Human
ccagacugugugugauauuccuugaccacagagacaagauuuagaacaugcacacgauucagucugg

SEQ ID NO: 4191498 - RNA, 78 nt, Human
ccagagauugcuaauagugagagggucccaaaagaugagaagaagguguccaaucacacucauuagucauuucucugg

SEQ ID NO: 4191499 - RNA, 57 nt, Human
ccagagccggauugugaagugccuguaugcaagguaggcauuuggauucugcucugg

SEQ ID NO: 4191500 - RNA, 60 nt, Human
ccagagccugaguccaacaggcugaccagugaggggcuaaguggaucagucaggaccugg

SEQ ID NO: 4191501 - RNA, 79 nt, Human
ccagagcugacuuugugguggugucagauuugcugucuggagcagugcugaucccauggcagagagagaagagcucugg

SEQ ID NO: 4191502 - RNA, 62 nt, Human
ccagagcugagaauguggcuuccuuggaguuaugagagauagggagggauuuugagcugugg

SEQ ID NO: 4191503 - RNA, 130 nt, Human
ccagagcugccagccugcaaggggguguucccaggacaggccacauggaaggugcagaucagaacccaguccuuccaucugucucugguagccaucccucaacaucaggcuggcccuccccucgcucugg

SEQ ID NO: 4191504 - RNA, 68 nt, Human
ccagaggaugcuggucagccucgccuaaccuaaucacuuaugggagaggagagacuggcuccaacugg

SEQ ID NO: 4191505 - RNA, 58 nt, Human
ccagaggccuaauugcuacccuuuggagcuccagaguuaguuuuucaagguuguuugg

SEQ ID NO: 4191506 - RNA, 62 nt, Human
ccagagguggucauagaaagcaagcccuuaguaugagagucugaaaucugaucauucucugg

SEQ ID NO: 4191507 - RNA, 66 nt, Human
ccagaguacugcugcuggguacugaguguuugucccucacauaggauuccagaacagugcugcugg

SEQ ID NO: 4191508 - RNA, 74 nt, Human
ccagagucaugaggguugggguggagcuucggggaacuccagaauucgaauaccccagccuucuguaguucugg

SEQ ID NO: 4191509 - RNA, 70 nt, Human
ccagagucauuuugagucauaacuugcuauccuuuguccuucuugcaggccuuacucuauguggcucugg

SEQ ID NO: 4191510 - RNA, 76 nt, Human
ccagagucugguguucucacacuaguuggcacauagcugaagcuccuauuauguguguggauacacagagagcugg

SEQ ID NO: 4191511 - RNA, 113 nt, Human
ccagaguggagaaugcaaguuugguacguaucagagagaugcaguaacuucuauugaaaaacuuaagucacaugaguuucucuuuaugguaggagaccauauucuccauacgg

SEQ ID NO: 4191512 - RNA, 56 nt, Human
ccagaguggcugucauguugucuacauaaagcaacuauauugaaagccaccucugg

SEQ ID NO: 4191513 - RNA, 76 nt, Human
ccagaguuguugaugaugaguuugugccaaggucuuagcagggccaugcccaaaacuaucaggcucaaagcucugg

SEQ ID NO: 4191514 - RNA, 62 nt, Human
ccagauaauaauaugacuucacugcugagguugaggggguguuagaaauauuauaguccugg

SEQ ID NO: 4191515 - RNA, 70 nt, Human
ccagauagaaugugauuagaauucagaauuacuuuggaguaguggugaaauucaaaacacauuugucugg

SEQ ID NO: 4191516 - RNA, 70 nt, Human
ccagauaguaaauguuuuagauuuugugagccauacggucucugucacaauuacucaacuuugcugcugg

SEQ ID NO: 4191517 - RNA, 106 nt, Human
ccagauccucaaaauaucuagguuuugauguggugcagggcagugcuuuccaaggaguguuucuggggcauucauaguuguuaccuaggugaaaaaaagagucugg

SEQ ID NO: 4191518 - RNA, 67 nt, Human
ccagaucugggucaguauguucuugggaucacauuuaaacucagggaccaccacucacccagccugg

SEQ ID NO: 4191519 - RNA, 66 nt, Human
ccagaugcagggaacuugagagaggugagccacacaggccucuucagcuaggaucccugcagcugg

SEQ ID NO: 4191520 - RNA, 103 nt, Human
ccagaugguucuuucuuauauaauggaauucuccauuagaugucaacaaaacaagaguguagauaucuuuucagagucaagugugagaagauacacaaucugg

SEQ ID NO: 4191521 - RNA, 61 nt, Human
ccagauguuucaguaauuuaucuugcaaccaagaagcaggaggaauuaaucaugaagcagg

SEQ ID NO: 4191522 - RNA, 63 nt, Human
ccagauuaggaaagaaagucagggcaagccuuggguuucaguuguccuguuaauagcaucugg

SEQ ID NO: 4191523 - RNA, 64 nt, Human
ccagauuucguggcuccugcagaccaucuggacauaugugugcaggucacagggguuauaaugg

SEQ ID NO: 4191524 - RNA, 73 nt, Human
ccagauuucuacaugucaauccaaaccaugaaauauaugacaugacugggucuacugauauuuaggagccugg

SEQ ID NO: 4191525 - RNA, 74 nt, Human
ccagauuuggccagguguccagcccagggccaauuaguucuggccagggccugggucaucuggcucaaacaugg

SEQ ID NO: 4191526 - RNA, 59 nt, Human
ccagcaauaaguagagccuugcaaagacugcaaacuugcuucaacuuauuucacguugg

SEQ ID NO: 4191527 - RNA, 57 nt, Human
ccagcacacagugggugcccagagaaugggucuugugugggcagcacugcuggcugg

SEQ ID NO: 4191528 - RNA, 112 nt, Human
ccagcacuccaggccuugacaaucaguaaucuguuuucugccucuaugaauuugccuauucuggacguuucagguaaauggaaucauacgauaugcagccuuuugugacugg

SEQ ID NO: 4191529 - RNA, 58 nt, Human
ccagcacucugucccagcuuccacuucaaaaagcuuuucggggaggcacgcaggcugg

SEQ ID NO: 4191530 - RNA, 56 nt, Human
ccagcagagggcgcuucacaccccucauggaaggggccgggagggcgcucuccugg

SEQ ID NO: 4191531 - RNA, 71 nt, Human
ccagcagagguuggaacaguucuuaguuauuaacaucuaauggcuguuuugugacuucucaagugcguugg

SEQ ID NO: 4191532 - RNA, 59 nt, Human
ccagcagccagagaaggaccucucaaaaucaccccugaccuccugcuccuucugcaugg

SEQ ID NO: 4191533 - RNA, 58 nt, Human
ccagcagcccaagccugagcauccucuccccagagagggugaguuggggcugucaagg

SEQ ID NO: 4191534 - RNA, 128 nt, Human
ccagguccaaagcgugggaacuggagaaaggccacuagucacucagcacugacaaauauaguaaacuccugcugucuuuguuagagugugggaggcuggggaagggaggagguugauacaggaugagg

SEQ ID NO: 4191535 - RNA, 68 nt, Human
ccaggucccgccccgggcugaccacagcagaccccagcuuugcagguugcacaaggggcccgaccugg

SEQ ID NO: 4191536 - RNA, 69 nt, Human
ccaggucugcgggcggcaggcagauagccuggccaggcccucacaugcccaccgccagcaccagccugg

SEQ ID NO: 4191537 - RNA, 59 nt, Human
ccaggucuggcacuggccaguccagccuagcccaugcugacacucagugccagggcugg

SEQ ID NO: 4191538 - RNA, 69 nt, Human
ccaggucuggugagagcaggugcuacugaguucuggccacagaaaaccagcugccugcucuggaccugg

SEQ ID NO: 4191539 - RNA, 76 nt, Human
ccaggugaagagggcaagucuuggggucaacagcaggugucagcuguggccauagcucagcuccuucauugccugg

SEQ ID NO: 4191540 - RNA, 57 nt, Human
ccaggugaggagaguggcagcauggcacgcacuccaccugcuauuuagaacgccugg

SEQ ID NO: 4191541 - RNA, 82 nt, Human
ccaggugauucuuauguacacuuaaguuugagaaauaucgccaauaguucucaacucugguugcauguugaaaaucacuugg

SEQ ID NO: 4191542 - RNA, 58 nt, Human
ccaggugcugaccggucagauuacaaaaacaggagaguaauuuguacuugucaccugg

SEQ ID NO: 4191543 - RNA, 61 nt, Human
ccaggugcuucugcucagcuuccuacugggaccaaugaagcaauggagcgaagguacaggg

SEQ ID NO: 4191544 - RNA, 58 nt, Human
ccagguguagcacugcucacaggucagauugccugcucugacguagugacucaguugg

SEQ ID NO: 4191545 - RNA, 55 nt, Human
ccagguguuucaaaugugaaacuaggcuaaaaccaaugguuuuuuauacaccugg

SEQ ID NO: 4191546 - RNA, 90 nt, Human
ccagguucuacaaaccacaugcugagagccauugguguaguagaaucagacugccuggguugacucuuagcuguaacacuuagagccugg

SEQ ID NO: 4191547 - RNA, 87 nt, Human
ccaguaacuaaugcauuccacugagauuuguauccugcagagaauuagcuccuggagcaauuacaguggcauguauuuccccacagg

SEQ ID NO: 4191548 - RNA, 71 nt, Human
ccaguaagaagagggccuacuggacaugucagcugugaccuggcugaaaccagggugcccuccugggcugg

SEQ ID NO: 4191549 - RNA, 61 nt, Human
ccaguaagugcauaauagguacaacauauuuuggaugagugaagguuucugcauuuauugg

SEQ ID NO: 4191550 - RNA, 62 nt, Human
ccaguaaugcggccucacugauagcagaaguucggagagcucuugucagagaggccagcugg

SEQ ID NO: 4191551 - RNA, 78 nt, Human
ccaguacccaggacucucuuccaguagccuacaguagauagagggcucugacuuaucggagaaguccugcuuggcugg

SEQ ID NO: 4191552 - RNA, 63 nt, Human
ccagucaagcacaccuggaaagaauaaaaugccuuucugggcuuuacacugugcuuagaaugg

SEQ ID NO: 4191553 - RNA, 70 nt, Human
ccagucagagaaaauguccacuccaucaggaugucaauuccacaaaagggauauugucuuuggauuuugg

SEQ ID NO: 4191554 - RNA, 60 nt, Human
ccagucaggaaugccuccuuccuucuggggaacugggggucagugaguucguuucucugg

SEQ ID NO: 4191555 - RNA, 108 nt, Human
ccaguccgucggagaagcgcucuuugauuggccaguggacagcgccguggcaugacgcgcuggggcgcuggccaaucgguugagagcugagcuggacuuggcgguggg

SEQ ID NO: 4191556 - RNA, 96 nt, Human
ccagucuaagguagaaacgaagaagcucucagggcaaauguucuauccaggacauuggcuggagcauuccuugucuuguaucauauuguggauugg

SEQ ID NO: 4191557 - RNA, 83 nt, Human
ccagucuagguuuacaguacucacuugcauuguaucuuauuucagaaaaugccagugcagauauuguggccguuagauguugg

SEQ ID NO: 4191558 - RNA, 57 nt, Human
ccagucuccacagaaagaagacccugguccucagacucuggucugcuguggaccugg

SEQ ID NO: 4191559 - RNA, 59 nt, Human
ccaugugcuauaccacauuggaaaugucagcaaauuccauaaaggugauaguauacagg

SEQ ID NO: 4191560 - RNA, 70 nt, Human
ccaugugcucuguuugauugcuuguugauaaugaauggugacaagugccaucauagcauggcugcuuugg

SEQ ID NO: 4191561 - RNA, 123 nt, Human
ccauguggaaaaauuucaaauguuuuaugaagaccuuccacucuuaaggagguagagcaugacuucucacuccuuaaguaugggcugugcauaaugacuugaauaugauuccagucuacaugg

SEQ ID NO: 4191562 - RNA, 58 nt, Human
ccauguggaaugcuccuaagugaauauuauuguuuacuagacuuauuccaucuuaugg

SEQ ID NO: 4191563 - RNA, 62 nt, Human
ccauguggcuagcgugccugcaagugcuccuucgcacucaguccagaagcuuggugauaugg

SEQ ID NO: 4191564 - RNA, 73 nt, Human
ccaugugugucccuuggaaccucagcucugacucgccacaggucacaugcugaggggucuauggcauagcugg

SEQ ID NO: 4191565 - RNA, 80 nt, Human
ccauguguguuccuccaagcaagcaggauggucaaacuauugaacuuuagaacaugaguguccucuuguggcaaauaugg

SEQ ID NO: 4191566 - RNA, 109 nt, Human
ccauguuagccaggauggucucaaucuccugaccucgugauccgcccuccuuggccucccaaaguggugggauuacaggcaugagccaccacgccuggccuagcauagg

SEQ ID NO: 4191567 - RNA, 62 nt, Human
ccauguuagucugcucuagcugccauaaaauaauaucacagacugaguggauuaaacaaugg

SEQ ID NO: 4191568 - RNA, 64 nt, Human
ccauguucuggaguguuauggucaagucagagauaucaugacuacauggacaguccagaacugg

SEQ ID NO: 4191569 - RNA, 78 nt, Human
ccauguugcacaacuuuaggaaccacauucacuuacauagaagacagugugaauggagaccucagacuuggcaccugg

SEQ ID NO: 4191570 - RNA, 72 nt, Human
ccauguuggggcugcuggagggcgcagacaggcuguaaacacagcgcaugggcaccaggagcaccggacagg

SEQ ID NO: 4191571 - RNA, 117 nt, Human
ccauguugugguguuuccuauugauguauacaauuuuauuuuccuaaccucacuguccaacaaaaggagaauggcugaguaaguugugauaugucuguacaauggauuacaauaugg

SEQ ID NO: 4191572 - RNA, 57 nt, Human
ccauguuugaaggauauccaggcuggcaggaaagccugugucucguuaaagcauugg

SEQ ID NO: 4191573 - RNA, 60 nt, Human
ccauuaaaauugugacauaggagaauguuuuccaaaaugcaagucacaauccauuaaugg

SEQ ID NO: 4191574 - RNA, 62 nt, Human
ccauuaagauugugcuuaagaagacauuuugccucaugucuucuuaaguaugaucuuaacgg

SEQ ID NO: 4191575 - RNA, 59 nt, Human
ccauuacacuaauagccacacuaaugauuugcagucaucuaucaacuguuagugagugg

SEQ ID NO: 4191576 - RNA, 83 nt, Human
ccauuaccaccauuggcuucuggcagucuggacggaauuaaacaacugucuacacaaaucaaagcuucacgugguggucaugg

SEQ ID NO: 4191577 - RNA, 59 nt, Human
ccauuauagcuggaaggagcuaugucaagguguuaaaaguggcucucucuaguaagugg

SEQ ID NO: 4191578 - RNA, 71 nt, Human
ccauuauaugagacuugagggccucaagucccauaaggcgggacuugcgguccugaucuuugaugauaagg

SEQ ID NO: 4191579 - RNA, 103 nt, Human
ccauuaucaguuuuguuugccagauuuucauguuccuuguuaagugaccaaccaggauauaaacaauuacauggacauugaagaguaaacacacugauaaugg

SEQ ID NO: 4191580 - RNA, 69 nt, Human
ccauucaaauuccagaaacucaguauauuagcaacauuaagagcuuaauaguaugagguggaggggugg

SEQ ID NO: 4191581 - RNA, 92 nt, Human
ccauuccacugacucugaaggcaggggaaucccaggagugcccugaaugugggaaggaccugggagagcuucaugccuucagguggaggugg

SEQ ID NO: 4191582 - RNA, 61 nt, Human
ccauuccuuucccacuccacagggguggcauacaauacaccaagagcugggagaaggaagg

SEQ ID NO: 4191583 - RNA, 72 nt, Human
ccauucucacagugaugucuuaugacagguacgcagcaaucugucaaccacuucauuaugagacuauuaugg

SEQ ID NO: 4191584 - RNA, 94 nt, Human
ccauucucauuucccucuguauccccagcugcuccugcugagccuugcacacaguucaugcuuaaaagacacuugaggaagggagaagagaagg

SEQ ID NO: 4191585 - RNA, 70 nt, Human
ccauugaaacagauguacccaugucuccuccuuucucucuugggguguaggucuuagcacuguuagaugg

SEQ ID NO: 4191586 - RNA, 57 nt, Human
ccauugaauccucagcugcuaguacaaaaccuggaagcagaggaggauuuaguuagg

SEQ ID NO: 4191587 - RNA, 59 nt, Human
ccauugaauuagaaggggaaggagauucaugucagguguuuugcuuuuugauuuaaugg

SEQ ID NO: 4191588 - RNA, 55 nt, Human
ccauugacaucaggcuuggccaagugacucacuucagccaacaggauguuagagg

SEQ ID NO: 4191589 - RNA, 78 nt, Human
ccagcagccucugcucccagccagcuguggugugaguaucaaccccuggcugcccugggaggcaagggugagggcugg

SEQ ID NO: 4191590 - RNA, 71 nt, Human
ccagcaggaagccuccacuugugauaugaaaaugcccuuucaauagcucaguguggaagcucagauguugg

SEQ ID NO: 4191591 - RNA, 65 nt, Human
ccagcaggagcagucagacuccuuaagccauccugaaggagugaaaacaggcugcucuugugugg

SEQ ID NO: 4191592 - RNA, 90 nt, Human
ccagcaggaugucugcaagugguugaagaaacauuguccgaaucaguaucagaucuacagugagucauucaaacagcaugacauaacugg

SEQ ID NO: 4191593 - RNA, 111 nt, Human
ccagcaggccuggauaaaauguuucuguucauuugccucggcucugagccaccagccucagaguggaaggaaaaagagcagauucuggggguguuuugucuggcuugcugg

SEQ ID NO: 4191594 - RNA, 90 nt, Human
ccagcaguccccaaccuucuuggccccagggacugguuucauggaagauaauucuuccaugaacuugcggccaguagggggauaguuugg

SEQ ID NO: 4191595 - RNA, 130 nt, Human
ccagcauaauuuaggagagaaauaccauuaucuuguuuaguuagcuguuguuuuagagauuccuguuacucacagcugaaucucauucuaacuaguaggcuacgucaauguuaaauguuuucuaaacugg

SEQ ID NO: 4191596 - RNA, 62 nt, Human
ccagcaugagacgaugaugaagcuuguccuggaagacccacugcuugugucucucaggcugg

SEQ ID NO: 4191597 - RNA, 88 nt, Human
ccagcaugagcugaaacuuuaguucugcaacaagaucuuuccuuuuuguguagucagucaauaaagagcuucuacucaugaaaucugg

SEQ ID NO: 4191598 - RNA, 71 nt, Human
ccagcauuauucaccaagaaugauuucagucacuacaacuuagugcacuaaaguguuggagaaugaggcgg

SEQ ID NO: 4191599 - RNA, 66 nt, Human
ccagcauuugagcacuugagcaguugauguggcaggaggcacacagcugaccacccugcucccugg

SEQ ID NO: 4191600 - RNA, 66 nt, Human
ccagccaagcucagacggauccgaugaucuuucugaaucagagcccucugagcuucagcaggcugg

SEQ ID NO: 4191601 - RNA, 70 nt, Human
ccagccacucuccuuuacugcagagagcgggaccgugucccccuucaucccccuagaacgguagggcugg

SEQ ID NO: 4191602 - RNA, 56 nt, Human
ccagccagaaguccgggcuucugagauagaggaauauccuugaccuuuggaaaugg

SEQ ID NO: 4191603 - RNA, 58 nt, Human
ccagccagccuugaucugaguaucaaagccccugugaccuagacuggggcugggcugg

SEQ ID NO: 4191604 - RNA, 88 nt, Human
ccagcccagccucagcacagcgugucccugcggaugccaaaggucaccagacgcaugcaggauagguugagcucugagccagggcugg

SEQ ID NO: 4191605 - RNA, 67 nt, Human
ccagccccccuggagucgcugggauggccuccgagagggagagcaggccugacuguagggggcaugg

SEQ ID NO: 4191606 - RNA, 79 nt, Human
ccagcccccgcaggccggcgcuucccaggaggccccgcgcgcggguuuccauggggacgcgccggcgcugcggcguugg

SEQ ID NO: 4191607 - RNA, 65 nt, Human
ccagcccccuccaugacgucuucagccgcgcgcccgacgucggcugagacggccauagacacugg

SEQ ID NO: 4191608 - RNA, 76 nt, Human
ccagccccggaaaucugggagucuuggcucugcugaugacugcaaggcaagcucaggccucaggugucggggcugg

SEQ ID NO: 4191609 - RNA, 55 nt, Human
ccagccccgggccuuaccgugcgcggggcagccccggcaggcccagucgggcugg

SEQ ID NO: 4191610 - RNA, 72 nt, Human
ccagccccugccucugcugcuguggcaucacagaagccaucagugagucacuuauugcugagcagguauugg

SEQ ID NO: 4191611 - RNA, 64 nt, Human
ccagcccuccagacuuuggccauccucuuguuacacauggggaaacugaggcuggguggguagg

SEQ ID NO: 4191612 - RNA, 62 nt, Human
ccagcccucucucaggcugacagccuuugcccuuugcucagguuggcuucagagguggaggg

SEQ ID NO: 4191613 - RNA, 84 nt, Human
ccagcccugcucucguguaucucauguucuucucuggaggaauccggagcuggccgggugaaugcaucagaggaccagucuugg

SEQ ID NO: 4191614 - RNA, 68 nt, Human
ccagcccuucagggggcugcaggcgcuuuuugcucugggcauuacgucuucuucagccccugggcugg

SEQ ID NO: 4191615 - RNA, 68 nt, Human
ccagcccuucaucaccuaacuugugauuuacagacacugagcacauugcagguugagaaggugcuugg

SEQ ID NO: 4191616 - RNA, 58 nt, Human
ccagccucaucauauuccugcuuacugauccacaucugcuggaauguggacaggcugg

SEQ ID NO: 4191617 - RNA, 90 nt, Human
ccagccugcugugguggcugaggguauagcugucccagaggccccuccaaaacugggucccugcuguacccucccaccaggcagggcugg

SEQ ID NO: 4191618 - RNA, 106 nt, Human
ccagccuggagguggcagagccaggucuccagcucaggguccagagugcacucagucaugccaccccugagcuggggacuucccccuuuuaacaucuccuggaagg

SEQ ID NO: 4191619 - RNA, 55 nt, Human
ccagccuggcugacguaacucagggcaucucugaggcacugucagcugaggcagg

SEQ ID NO: 4191620 - RNA, 130 nt, Human
ccagcggaugcaccaacaauggcaauccggauuucacugugacuggaaugcuguuuagagacuuaauuguguaaugagcaguggcaccaggucaccagguguaucugauugaagucuuugcuuccgcuag

SEQ ID NO: 4191621 - RNA, 66 nt, Human
ccagcuacacuucugggugugucaaugucccuguguuuuuagaucugggccacuccuggugacugg

SEQ ID NO: 4191622 - RNA, 56 nt, Human
ccagcuagcuccucgaucaaugcacacuucuuuaaagugcugcaggaugcugcugg

SEQ ID NO: 4191623 - RNA, 55 nt, Human
ccagcuaguuggguauuauaagcaaucacugacuuagaagacauggcauggcugg

SEQ ID NO: 4191624 - RNA, 107 nt, Human
ccagcucauucugaagggccagggggacuggaccguccugggugaccuacaguggccaaugacagucucaguucugccgugaugcccuugugcaaccuugagccugg

SEQ ID NO: 4191625 - RNA, 59 nt, Human
ccagcuccuucugucuguggagucucauagggagacuaggucgagguugaaguagcugg

SEQ ID NO: 4191626 - RNA, 61 nt, Human
ccagcucuagccccauguggcugggggccagcuauuuucauugugggguuagacucccugg

SEQ ID NO: 4191627 - RNA, 104 nt, Human
ccagcugaaguggaugugcaaucuuaaucaagccguccuccuuccugccgagcagauggcuggaaagaccugcuugcuuuugauagucaugucuuuguaacugg

SEQ ID NO: 4191628 - RNA, 69 nt, Human
ccagcugagcugccagacuacugccuuagagugaaaaugagcccagugucuuucagacucagaaacugg

SEQ ID NO: 4191629 - RNA, 117 nt, Human
ccagcugaugcuguguaccucccugugccuguggaaugggagugagaagaccucacggcugggucuucuuugugucuauuccuaggucuauauuuuacaggagcauggcucaggugg

SEQ ID NO: 4191630 - RNA, 66 nt, Human
ccagcugcagggauccuagcugaagaggccuguguggcucaccucucucaaguucccugcaucugg

SEQ ID NO: 4191631 - RNA, 56 nt, Human
ccagcugccuaagcaauccauaagggccuguucugcguggaugaucaguguagugg

SEQ ID NO: 4191632 - RNA, 57 nt, Human
ccagcugcgggcaucgagaguucagagcggcaccagacagucggcgcgugcaggugg

SEQ ID NO: 4191633 - RNA, 77 nt, Human
ccagcuggcacaccugcccccagagaaagacugauccuacugugccgucaagcucucaggcacugggugccaacugg

SEQ ID NO: 4191634 - RNA, 72 nt, Human
ccaugcucuagaacauuauuucguguuaaccauccuccuuggccacaucugaaaugaguguuggagaguagg

SEQ ID NO: 4191635 - RNA, 98 nt, Human
ccaugcugaucaguuuggccauauauuauggacugcagaaucucccaagcauucucauuuuaugugcauucacauaauuaugauccuggucagaaugg

SEQ ID NO: 4191636 - RNA, 74 nt, Human
ccaugcugcccagggccugccacuuagcaaguacucuguagauauguauuugaugagcaagggccugagcaugg

SEQ ID NO: 4191637 - RNA, 87 nt, Human
ccaugcuggagagggugcauguaggcaguugagugcuuggcuaaugguuagcagcaaugacuggcuauaugauuugcuccaccuugg

SEQ ID NO: 4191638 - RNA, 108 nt, Human
ccauggaacuugguaauuuggagggcagcagagggcaagggaaacucagcaaugagaucauuccuacauuugccucacuccccgcuucccuucaagccuuaccuaugg

SEQ ID NO: 4191639 - RNA, 58 nt, Human
ccauggaccuaaaugggcuucuagaccuggucuuucuaggagccauguggucugaugg

SEQ ID NO: 4191640 - RNA, 55 nt, Human
ccauggagcgggugagugagugugcaaaucaguggaaauucaucugcaccacugg

SEQ ID NO: 4191641 - RNA, 63 nt, Human
ccauggagggagaaaguacugcuuccgaaguccaagcuuggagcaggcaucuuucucucuugg

SEQ ID NO: 4191642 - RNA, 59 nt, Human
ccauggagugacugccuuuucaucagguauccaucccuggcagaaagaguuacaccugg

SEQ ID NO: 4191643 - RNA, 100 nt, Human
ccauggcacaaguguggcagcugauguggggugaggugugguaaugccgacccuacuggcaccaacauguccucacacagcccccacgcucacagccugg

SEQ ID NO: 4191644 - RNA, 58 nt, Human
ccauggcuuggaaagggaggugguguuuuccacaagacucuugugucagagccagagg

SEQ ID NO: 4191645 - RNA, 118 nt, Human
ccaugggacucagugccacugcucaaggucuccauggcugagccugggggcucuuacaacaggcuccaugcccaagguggcaguuguggaaccaucagagagggcacagagcucaugg

SEQ ID NO: 4191646 - RNA, 55 nt, Human
ccaugggcacuggguggagguaggcgcaaagacgucccucagcccacagcccugg

SEQ ID NO: 4191647 - RNA, 57 nt, Human
ccauguacaugaacacggcggcaccauaaaagagccccacuaccgugaugugcgagg

SEQ ID NO: 4191648 - RNA, 55 nt, Human
ccauguauugaauuguuuaagggggaauacccuagaaugucauucaaugauaugg

SEQ ID NO: 4191649 - RNA, 90 nt, Human
ccauguccaaccuugaugcugcgggugaccugcaggagaaacuggcacuaucuccugcagugugucuccugcacacacacuuggcccagg

SEQ ID NO: 4191650 - RNA, 84 nt, Human
ccauguccauguccagcagugugggcugcacgcuggggggcccagggcucuccggagugucuggccugcugggaggcgagaugg

SEQ ID NO: 4191651 - RNA, 79 nt, Human
ccaugucuugcacuuaccuaagaacuauaggaauucuccauguaccuccuacaguuuuucuagcaguguuggacaaugg

SEQ ID NO: 4191652 - RNA, 65 nt, Human
ccaugugggguagcaguuuccgugugggguagcaguuuccaugcgggguagcagauuccaugcgg

SEQ ID NO: 4191653 - RNA, 107 nt, Human
ccaugugguuacagaguagaacuggauauuucaguaugagcacuuagcucaauauugaugcaaauaguuacauacagaaauauuuacagauaaaugaagauacaugg

SEQ ID NO: 4191654 - RNA, 83 nt, Human
ccauguuaacaggcacgagcaauggccgaggagggaccgcccucccuccacuccuagcucagugcacuuuccaguuaccaugg

SEQ ID NO: 4191655 - RNA, 85 nt, Human
ccauguucccuuauucuguaggcauggaacagggagacgguugccuucaucucauacauguuugcagaaagaaagugggccaagg

SEQ ID NO: 4191656 - RNA, 82 nt, Human
ccauguucucuuucuuuggcugccagucuggagacaucagccugaguccuagagugggaugccguggggcagagaacacugg

SEQ ID NO: 4191657 - RNA, 74 nt, Human
ccauguucuugaucugaauggcuuaugugugcaucccaagauacagugccaggagacaagaucaggaggcaugg

SEQ ID NO: 4191658 - RNA, 79 nt, Human
ccauuaaaagaauaacagaauaagucauuaccgcuuuaaugcaaggcgguacauggaagauucucguuuucucuuaggg

SEQ ID NO: 4191659 - RNA, 60 nt, Human
ccauuagcuaugcagauauuugcauuauugaauuaaauuggaucugcauaguuugaaugg

SEQ ID NO: 4191660 - RNA, 116 nt, Human
ccauuagcuccuggugccagcccuaucucugcuccaucucucgugguuccagccggugcauucacagaccuucugccccgggggacgaggaggauuuauggggggagaggagaggg

SEQ ID NO: 4191661 - RNA, 83 nt, Human
ccauuagcuuaugaaaagggcugucaacacaaucauaaucuauuuaccuguguuucgcugacagauuuuuucugagcuaaugg

SEQ ID NO: 4191662 - RNA, 60 nt, Human
ccauuagcuucuuucugacguggucuggguucccuggagccugggggagggaguuggugg

SEQ ID NO: 4191663 - RNA, 55 nt, Human
ccauuaggcaguauuucugaaagcaggccuaccugacagcaauaaugccagaugg

SEQ ID NO: 4191664 - RNA, 60 nt, Human
ccauuauccacgggcuuccugacacagagcuuccagucaucaggaacuagaaggugaugg

SEQ ID NO: 4191665 - RNA, 58 nt, Human
ccauuauuaacuuuauggggaagugagaauauaauccagaauaaagugcuaauaaugg

SEQ ID NO: 4191666 - RNA, 62 nt, Human
ccauuccaaguuuuaucugcggguggacaacagugccuguguucaagugaagccugggaugg

SEQ ID NO: 4191667 - RNA, 99 nt, Human
ccauuccacaaaaggggcaguuuuuucccauuagaaaggguuauugggacguucuucccguugcuuuuucaaaugaaagcuggucugugcugcgggagg

SEQ ID NO: 4191668 - RNA, 62 nt, Human
ccauucucauagugguggauugugauccugagauagagcauagucugcgcaacugagagagg

SEQ ID NO: 4191669 - RNA, 101 nt, Human
ccauucucccgugugucguaggcccuggccugggagcugcuagcguggagcccaugcccucuguuucccaaggccguggcccuauggcacuaggcaaaugg

SEQ ID NO: 4191670 - RNA, 62 nt, Human
ccauucugucacagcccgcgucuccucuauuuccaguggggcugggaucugugacccuuugg

SEQ ID NO: 4191671 - RNA, 80 nt, Human
ccauugauaacuauaaaaggauaaaccagaaagaagcuaguauauuucuuuuugguuucccuucuuaugguuaucaaugg

SEQ ID NO: 4191672 - RNA, 61 nt, Human
ccauugggaagcugaggcccaaguggcagucauuacugccaguagcacaguuacccagugg

SEQ ID NO: 4191673 - RNA, 67 nt, Human
ccauugguuuaggaacuggcuuggagccgauguuuaauuggcuugcggcuaccuccucaaccaaugg

SEQ ID NO: 4191674 - RNA, 55 nt, Human
ccauugucuauucuagcugagacacaguacuucguccucagcaagauagaaaugg

SEQ ID NO: 4191675 - RNA, 117 nt, Human
ccauuguuucaauuuaguguuguuagcagaaauuuuguuucuuuucucuguuguaucuuuauauaagcaugaaaacaugaaacagcauugacuugacaacauuuuuuuaaaaggugg

SEQ ID NO: 4191676 - RNA, 100 nt, Human
ccauuuagaucuccucuucuuuguggcagcucucuugauuucccuaggcuccucaguuggaaguagaagggguuggaauuccacauaagggaucuccugg

SEQ ID NO: 4191677 - RNA, 69 nt, Human
ccuccagaugugccuccguuucgugccaguagacagaucuaaaagggagccagcagggugacacugagg

SEQ ID NO: 4191678 - RNA, 55 nt, Human
ccuccagccuuccugaagagccaggcugguucuccuacucacucaaggcuugagg

SEQ ID NO: 4191679 - RNA, 61 nt, Human
ccuccaggcaucgcugacuuugcauuguguaauucacugcagcucauugguguccuggugg

SEQ ID NO: 4191680 - RNA, 67 nt, Human
ccuccagggcugugccuggucucugagcgcagugcucagagagcuggugggcagaggaccugggagg

SEQ ID NO: 4191681 - RNA, 108 nt, Human
ccuccaguggaagauucuacuuuauucaggaaggcugguggcuugcaggggcuaggcuuacacaagccagccaagauugagaagguaggggagugcuuucaauggagg

SEQ ID NO: 4191682 - RNA, 98 nt, Human
ccuccauuuccuugccucccguucugucagcuggucucuaggaaugguuaggaauguaguuugaguagaaaccugggaggaagcagcaaaaugagagg

SEQ ID NO: 4191683 - RNA, 73 nt, Human
ccucccaaagugcuggaauuauaggggugagccaccgugcccugccccucaguuugcuaguauuuuguggagg

SEQ ID NO: 4191684 - RNA, 69 nt, Human
ccucccagcuuucugggugguuucuguccccuugaggcgauuuacaacccaaguccagagagcgagagg

SEQ ID NO: 4191685 - RNA, 71 nt, Human
ccuccccacgggcagccggcgcagaccuccaggauucgccagcagauugugcccagggacaguggggaagg

SEQ ID NO: 4191686 - RNA, 88 nt, Human
ccuccccagcuuggcuauucgaucacugccgaggaccuagacuuagagaagaaggcuucauuacagugguucaaccaggccuuggagg

SEQ ID NO: 4191687 - RNA, 113 nt, Human
ccuccccaggagccugggcugaagacuucaucugcuguaauuaacaagccaacugcagcugucuugcuccauuaauagcagaucagccugucgggcgagggcugacagggagg

SEQ ID NO: 4191688 - RNA, 70 nt, Human
ccuccccaguauaugugaaugguguuuguaaguuaccaauggaauuccccauucacauauaccagggagg

SEQ ID NO: 4191689 - RNA, 58 nt, Human
ccuccccgagagagguuguccgcgcugccaggcgcugggcagcaggcucuccgggugg

SEQ ID NO: 4191690 - RNA, 83 nt, Human
ccucccuacucccagauagucacucuucacacagcuaauauggcuguagcuggcaggugaagaugauuucaguaggucaaagg

SEQ ID NO: 4191691 - RNA, 64 nt, Human
ccucccucccugcaguacucuuccacuuucaaagcacaauggcaacacugcaggagaggugagg

SEQ ID NO: 4191692 - RNA, 60 nt, Human
ccucccugccggcuggacuagugggcacgccuccagagucccccucugagcccagggagg

SEQ ID NO: 4191693 - RNA, 97 nt, Human
ccucccuguuucuggcugaggagcugcagggggagucuagccggcagggcuggcuccugcccucgugagcuuuucuagggucauggugugggggagg

SEQ ID NO: 4191694 - RNA, 67 nt, Human
ccucccuuggcuuaccuucuguguggcugccuaccaacacggucacugaauuucaagcuaguggagg

SEQ ID NO: 4191695 - RNA, 58 nt, Human
ccuccggcgucucuuccacuuccuacuccaagguggggagugcaggcggggucagagg

SEQ ID NO: 4191696 - RNA, 63 nt, Human
ccuccguagccuguggcagugacggcugcucaagggccuuaacugccaggauggcacuagagg

SEQ ID NO: 4191697 - RNA, 76 nt, Human
ccuccuacacaucucaccucacaggcaugaacucagaaggugguucuucuaggagcugagaguguguacguggggg

SEQ ID NO: 4191698 - RNA, 58 nt, Human
ccuccucauuucucuccagguaauucauuacuguacuuuggcagucagaaaugugagg

SEQ ID NO: 4191699 - RNA, 75 nt, Human
ccuccuccuuuuccacagccacucacuggggccaccaaaacccagagauggcaggugugugggacagacuggagg

SEQ ID NO: 4191700 - RNA, 88 nt, Human
ccuccugaguagcugggacuacagaccacaaugcccagcuaauuuuuugcuguuguugauauguggucucguuauguugcccaggcug

SEQ ID NO: 4191701 - RNA, 55 nt, Human
ccuccugcaccuccaggaacuccagcucuugcugcagcuucugcgagcagagagg

SEQ ID NO: 4191702 - RNA, 68 nt, Human
ccuccuguauugccuucacuugccagauagguccaugugucugaggaguugggccagugcugcugagg

SEQ ID NO: 4191703 - RNA, 73 nt, Human
ccuccuguauugcuucagcuuccugggcugccuugguuucauggcaccugcaugaugucugaagcaagggagg

SEQ ID NO: 4191704 - RNA, 55 nt, Human
ccuccuuuuucucucuuacuaagguugacugagcuuuaaagaauaggaagggagg

SEQ ID NO: 4191705 - RNA, 68 nt, Human
ccucgauggccugaccacccuuggacaaggucauuugcagugaccuggugggugggcagacauugggg

SEQ ID NO: 4191706 - RNA, 79 nt, Human
ccucgccccucucagcccugcaaguugcgugguuguguuuacaaauucugccacaauugcaaaggaaauaggggugggg

SEQ ID NO: 4191707 - RNA, 60 nt, Human
ccucgccugccugugucucuccccaaaccccuuuagauggggagggaagaagaggagagg

SEQ ID NO: 4191708 - RNA, 63 nt, Human
cccaccucucagagagccuugcuugcagaccccuucaucugauggauucucccgagagguagg

SEQ ID NO: 4191709 - RNA, 72 nt, Human
cccacgggaggaauaacauuggaacccugaagagagggaccucuugagggucugaauguugguuccaguggg

SEQ ID NO: 4191710 - RNA, 86 nt, Human
cccacggggaaggcguauaguugggacucagggcugacucagagggccagcccuggccagcucaugucugaggucacauccgaggg

SEQ ID NO: 4191711 - RNA, 61 nt, Human
cccacuaaguauaauaaaucauacauuucacugcagaaauguuaauguguuugcuuauggg

SEQ ID NO: 4191712 - RNA, 77 nt, Human
cccacuccagcauucuugagguguggacucagagcccccaggcacucggguuugcaaucaacugugagauguuuggg

SEQ ID NO: 4191713 - RNA, 81 nt, Human
cccacuccuccucuccuacuuucagauggauuuauuccuuuuuuaaacaaugaacaucggaaaugagacuguggggugugg

SEQ ID NO: 4191714 - RNA, 77 nt, Human
cccacugacaagucugucuuacuucacugaaguuaacccuccaaacacagaugaggacagaugacugggcacguggg

SEQ ID NO: 4191715 - RNA, 61 nt, Human
cccacugagugagcagagcagggcccauuucugauaagcggucucucugucuccucuuggg

SEQ ID NO: 4191716 - RNA, 72 nt, Human
cccacugauucaucuagugccucuauguuguugaccuucaauaucauuagggucucucagcugaauauuggg

SEQ ID NO: 4191717 - RNA, 90 nt, Human
cccacugcagcucccccugggcccucccacauccugugaaccauccuccaggagagguagaggguuccagagguaggggcauagaguggg

SEQ ID NO: 4191718 - RNA, 61 nt, Human
cccacugccuugucaggcacagggccagauccugcacccugugacgagcacggccaguggg

SEQ ID NO: 4191719 - RNA, 63 nt, Human
cccacuucagaggggacucaaagucagcaucuauagucugauccugauccucugaggcaaggg

SEQ ID NO: 4191720 - RNA, 76 nt, Human
cccacuuccuggcugggugaccugggauaaauuauugaacuccugugagccccagauuccccagcugugaaauggg

SEQ ID NO: 4191721 - RNA, 76 nt, Human
cccacuuucaucagaagaaagacaaaugaugcaaaagucaaggaggcagauaaucguuuucuuucuuccugguggg

SEQ ID NO: 4191722 - RNA, 62 nt, Human
cccagaaugcuuuuccagcucacugcuauuuaaucuaagucagcuggugucagagcucuggg

SEQ ID NO: 4191723 - RNA, 130 nt, Human
cccagagauuugauauuuagaaaguagugaauuuaguuuguaagaaggcuuacuuuuagaugcucaaauagauagcuccgacuaccuucacauagacuaaggauuuauuuaauuuguuuauuuaauaugg

SEQ ID NO: 4191724 - RNA, 57 nt, Human
cccagagccgcuccccuacuucuccucaggggacauagauggggcagguggccuggg

SEQ ID NO: 4191725 - RNA, 67 nt, Human
cccagagccuugaguucaagugcuggcuaugcuccucauuagccaguugugggaucuuaaguauggg

SEQ ID NO: 4191726 - RNA, 104 nt, Human
cccagaggcaggguguacauugugagugucagugccuggcuuguuugccugugcggauguggcagccauggacacuggcuagcauauggacaccuugccugggg

SEQ ID NO: 4191727 - RNA, 67 nt, Human
cccagaggugacaucccauucucuaccuuccaacaaggguauucagugccaggaguuaaacccuggg

SEQ ID NO: 4191728 - RNA, 63 nt, Human
cccagaucggcuuugcagaccucauggggguccucaccaaagggguccgggaaguggaauggg

SEQ ID NO: 4191729 - RNA, 55 nt, Human
cccagaugcagguucaagaguacuuuuccugggauagagccuuccagcauguggg

SEQ ID NO: 4191730 - RNA, 79 nt, Human
cccagauucccaggccagagcuaagcaccagagaauaaaccugacgcuguggacauacuaggccuaggcugggucuggg

SEQ ID NO: 4191731 - RNA, 60 nt, Human
ccucgcucagggccacccuugucuggggcuccccaugcccuggggcuaccucugagcagg

SEQ ID NO: 4191732 - RNA, 71 nt, Human
ccucggaagccacaaugccaaccucuacuuggcaacucagcccagcagaguugggauugugaagauugggg

SEQ ID NO: 4191733 - RNA, 56 nt, Human
ccucggacuugggugggcuccuuucucuuaagcgagggcccaccuuggugcugagg

SEQ ID NO: 4191734 - RNA, 61 nt, Human
ccucggagcacgccggccgcccgcccgcccgccuggcgcugcugccaccgcgugcuccagg

SEQ ID NO: 4191735 - RNA, 60 nt, Human
ccucggagccgcuuccgccgcucauuggcugaaacacaggagcugggcgaggcuccgggg

SEQ ID NO: 4191736 - RNA, 56 nt, Human
ccucggcccuuucucgggugggagagcccugccuacccaggcuuagagggcugggg

SEQ ID NO: 4191737 - RNA, 55 nt, Human
ccucgggcacaagagauccuuacagcucaagugcagacccucucagugccugagg

SEQ ID NO: 4191738 - RNA, 95 nt, Human
ccucggguguucacaguauuuuguugcccauuuucuguuuagugacuacuuuucaggaucaagacagauggguaacuugguaugguggcuugggg

SEQ ID NO: 4191739 - RNA, 100 nt, Human
ccucgucuacugcuucuuaaaaauguguuuaugcauuucguauuuguacguccuugaguuaaugagcguuauacauuuugugggaaguaguacuaugagg

SEQ ID NO: 4191740 - RNA, 71 nt, Human
ccucguggugucagaccugugcaucuucaaggacauaaacagaugggauaagcagaugagacucacagagg

SEQ ID NO: 4191741 - RNA, 77 nt, Human
ccucuacuggaacacugauaggccaauggaacaggucagccuaauaccugggcugucaguuuuguuuuauuuugagg

SEQ ID NO: 4191742 - RNA, 67 nt, Human
ccucuauccaaagaaggucacauucaugguaccaggaguccauggaucuggaucuaucuuuuggggg

SEQ ID NO: 4191743 - RNA, 65 nt, Human
ccucuauuuugcugcaacagccaaaggccauucaucugccccucacuguagagcacaaguggagg

SEQ ID NO: 4191744 - RNA, 67 nt, Human
ccucucagcgugugccauuuuccacuucaguuuguggcaaaggggaccauguugaaauaauuugagg

SEQ ID NO: 4191745 - RNA, 70 nt, Human
ccucucaguaagcaggcuguaagucagcauggaagcaccugcugcagcuucuuguccugugauuuagagg

SEQ ID NO: 4191746 - RNA, 82 nt, Human
ccucucauggccuagaaagucuuuaggauguuguuaaacagugguuugggagcauuuagaaaagacguauggcccggagugg

SEQ ID NO: 4191747 - RNA, 119 nt, Human
ccucuccaaggagcagcagaauaccauaugaauauucugaguuaaaauuccagagguaacaaagaaaguguuaccuuuggaggacuagggucauagaagaauucuguucucuugacagg

SEQ ID NO: 4191748 - RNA, 79 nt, Human
ccucucccauuucuccagggcuaccagguuuuagcagcaacuuacaaccaggcugcccagcucuggaaggugggggagg

SEQ ID NO: 4191749 - RNA, 57 nt, Human
ccucuccucugggccuccccucugccuggcagcggguuggcagcaccagaggagggg

SEQ ID NO: 4191750 - RNA, 55 nt, Human
ccucucucuccugcacacacacaugcaugugcacaaaugugguaacagagacagg

SEQ ID NO: 4191751 - RNA, 75 nt, Human
ccucucugcugaggugguuuuagagaagacuuaguggacagucaauauuuucaacaucaccuagcaguucugagg

SEQ ID NO: 4191752 - RNA, 65 nt, Human
ccucucuguucuccucuguugcccacagcaaccucagcaguugguaccagcacagaguggagagg

SEQ ID NO: 4191753 - RNA, 62 nt, Human
ccucucuuacauauacgucauuuaguauauaaauguaaugugauguaguguaagaguacagg

SEQ ID NO: 4191754 - RNA, 70 nt, Human
ccucugcacccacagugagugucauacuuggagcaggacaugcccuggacucaggcugugggcacggagg

SEQ ID NO: 4191755 - RNA, 65 nt, Human
ccucugcacugcugaucccaggucuaugcugaaaagcuaaggcuuauuaggucugcagagugagg

SEQ ID NO: 4191756 - RNA, 64 nt, Human
ccucugcauccccaauuagcgcccagcuugaaggcaagcagguuucucuuuggagggugggagg

SEQ ID NO: 4191757 - RNA, 61 nt, Human
ccucugcaucuggcugcugcagacccucguccaccuccugcagcucggccaggucuggagg

SEQ ID NO: 4191758 - RNA, 69 nt, Human
ccucugccgggcagccaaagggccgcaguuugucgugcgacugcaggugccucuugagcuuguaagagg

SEQ ID NO: 4191759 - RNA, 59 nt, Human
ccucugcugagaaaagacugagggaagcaaccuuccuucaggccucauucucauacagg

SEQ ID NO: 4191760 - RNA, 57 nt, Human
ccucugcuugcagaaucucucagcagccggacuuuugcagaagcugcaggucagugg

SEQ ID NO: 4191761 - RNA, 57 nt, Human
ccucuggacagauguauuuuauguaaguucaagcacuagaaauauugaguucagagg

SEQ ID NO: 4191762 - RNA, 105 nt, Human
ccucugggacuaauuacccugaucugacuagacugguuguuagaucugaauuauagucaugaauaaguuagaucuuaauuaaagucauguaugggguccaagagg

SEQ ID NO: 4191763 - RNA, 78 nt, Human
ccucugggagccugacagugcccagcaugaagguggggccagugcuggggguuucuguaggucccacucccacagagg

SEQ ID NO: 4191764 - RNA, 58 nt, Human
ccucugggcagguagcagcagcuuuaaucauuuaggccagaugcuuccaucccggagg

SEQ ID NO: 4191765 - RNA, 62 nt, Human
ccucugggccagccuggacccugaagcuguuggcuuccuaguugagaccacugggccagagg

SEQ ID NO: 4191766 - RNA, 71 nt, Human
ccucugguaguguauccuccaaugacauaaauuuuucccuuacacucacaggcagagaacucagccagagg

SEQ ID NO: 4191767 - RNA, 82 nt, Human
ccucugguguugccguuaucauuuugguugguuuucuuccuggacuuucaaaguugggaauuguaauugucuauuccagggg

SEQ ID NO: 4191768 - RNA, 58 nt, Human
ccucugugaaugggucauuacuuuuaggaggggaagugaauagccuauuuacuagagg

SEQ ID NO: 4191769 - RNA, 77 nt, Human
ccucugugagugcugagagcccaggcccugcugugcuaacuuugcacucagagugggcugucagccaccagcagagg

SEQ ID NO: 4191770 - RNA, 79 nt, Human
ccucuguguccuccccuuggcucuuggcccucucaccuguggaaguggccaugcaggucagaggugggggacccagggg

SEQ ID NO: 4191771 - RNA, 61 nt, Human
ccucuguguccuggucauugaaugggcacuugagucacccagggccauuggaacaaagagg

SEQ ID NO: 4191772 - RNA, 99 nt, Human
ccucuucaacugaaauauuuaaaaagaaugauugcacgggaaugaaaaccucagaaguuauuacucuuuaacauauuugcaggaaguuaaaggaagagg

SEQ ID NO: 4191773 - RNA, 81 nt, Human
ccucuucccauuucuuccuuucuccuucaauguaugccacuccuaggcaucaugaagaugagaaagcauauguuaaagagg

SEQ ID NO: 4191774 - RNA, 59 nt, Human
ccucuucccuucccucaggugaaugacaacguacguuuaacaggaucucgggcaagagg

SEQ ID NO: 4191775 - RNA, 62 nt, Human
ccucuuccucaccaucuacaacagcaccacucaugagugccucagaagaggagagggagagg

SEQ ID NO: 4191776 - RNA, 89 nt, Human
ccucuucugaacuccugcagcugauaaauacagucuaguccuccauggucucaacagcuaguguuugccagcguagccuucuagagagg

SEQ ID NO: 4191777 - RNA, 61 nt, Human
ccucuugccccgaagucugagaagguuaaccuucuguguauacagaguuugcaggcagagg

SEQ ID NO: 4191778 - RNA, 117 nt, Human
ccucuugcuccccuuccugugcugagggagaggcugaaaucacaggagcuugucuugcgaguuuuucugacauucuaguuucuuccuuggagccagaacagagagggguuuuggagg

SEQ ID NO: 4191779 - RNA, 81 nt, Human
ccucuuuaacauaugcuuucucaucuucaugaugccuaggaguggcauacauugaaggagaaaggaagaaaugggaagagg

SEQ ID NO: 4191780 - RNA, 96 nt, Human
ccucuuuaccuucuucuacccgcaacccuccacaccagucuuauuuuagcaaaaccuagagaaggaggagguggagggauuuggaggguggagagg

SEQ ID NO: 4191781 - RNA, 74 nt, Human
ccucuuuuucucuuuucuguggcuuucccaacuugccauggaugcagaggagaaggccaagaaggaagcagagg

SEQ ID NO: 4191782 - RNA, 61 nt, Human
ccugaaaaaccucaguucugcucuuaaggcccuuaaacugcuugaauuggguuuacccagg

SEQ ID NO: 4191783 - RNA, 73 nt, Human
ccugaaauaugcaccccuuuuccagcugaaacucuccaccuuuauaaucagcucagaggugaaauguuuuggg

SEQ ID NO: 4191784 - RNA, 56 nt, Human
cccgggaggaggaaguugcagugagccgagaucaugccacugcacuccagccuggg

SEQ ID NO: 4191785 - RNA, 56 nt, Human
cccgggaggaggaaguugcagugagugaagaucaugccacugcacuccagccuggg

SEQ ID NO: 4191786 - RNA, 59 nt, Human
cccgggaggcgcccgcugcaccggccucuccggguggcgcagggaccgcgacuucuggg

SEQ ID NO: 4191787 - RNA, 59 nt, Human
cccggggaucccgucugggcgagcaccccucgacccucgcuuagaagggacauccuggg

SEQ ID NO: 4191788 - RNA, 96 nt, Human
cccggggccggaggagcgagagcgaagcagggagcugcccuguaaucuggggcagccguuuccagcccgcgacuuguucagacggcgauuccuggg

SEQ ID NO: 4191789 - RNA, 99 nt, Human
cccggggccggggcccggcugcaggcgccgugcccgcuccgcgccgcugccgcccggccgcggagcuccgcccggugcccaggccugucccggcccggg

SEQ ID NO: 4191790 - RNA, 95 nt, Human
cccggggccugcugccucccacagcgauggcuccucacguccucagagcccuguugcucccaggaugaggagccagggacaggaggaugcccggg

SEQ ID NO: 4191791 - RNA, 60 nt, Human
cccggggcugcccucucucugugggcuugccucaucaugucagcucugggcagccugggg

SEQ ID NO: 4191792 - RNA, 81 nt, Human
cccagcaaucuacagcuuccccccgggcuugagagggaggcggcacugaguccauguggaggggagguggggagagcuggg

SEQ ID NO: 4191793 - RNA, 56 nt, Human
cccagcacuuugaauaugucacccuacuuccuuuggccugcagaguuucugcuggg

SEQ ID NO: 4191794 - RNA, 62 nt, Human
cccagcaggcacaaauuucuagauaagguuuuccucugcacaaauuuaguguccccccuggg

SEQ ID NO: 4191795 - RNA, 84 nt, Human
cccagcaggguggcaagucuuucugcaacauuuuuggaauacaagcagaaagugauuugcuauuccacacaaaacaugauuggg

SEQ ID NO: 4191796 - RNA, 93 nt, Human
cccagcauuaugcauucauaugcuucaacuaccccaggcugcuuucaggacagcaguuuguaauuacugcagcaugguguauagugucugugg

SEQ ID NO: 4191797 - RNA, 82 nt, Human
cccagccaccuucucugcaccaggcccugccuugagggaccuggacccccagguggcuucuggccagguguggguggguggg

SEQ ID NO: 4191798 - RNA, 64 nt, Human
cccagccccagacacgcuguccugccucaggccgggcaggcacaugggcgggucugguggcggg

SEQ ID NO: 4191799 - RNA, 76 nt, Human
cccagcccuggacagugacggugacccauggagaaugcaucaugccugucaggguccuguugguucagcggcuggg

SEQ ID NO: 4191800 - RNA, 70 nt, Human
cccagccucagcuuuacuuccacagugccuagcucccaggaauucuaaaagaaguaagauugaggauggg

SEQ ID NO: 4191801 - RNA, 113 nt, Human
cccagccugucuuggggugaggaucgcugcccggaagcggggcacuggggccccaacacaggggguuugcagugucagcuucuguguucaccucuccccuuaucuuaacuggg

SEQ ID NO: 4191802 - RNA, 73 nt, Human
cccagcgucaucacggcaagcaucuccucacucaccagccuuggagucggacuuguuuuguggugggcugagg

SEQ ID NO: 4191803 - RNA, 69 nt, Human
cccagcucagugguggucacuugguggaagaauaugaucuaucaccaaggaguuacuacuuaguuuggg

SEQ ID NO: 4191804 - RNA, 63 nt, Human
cccagcucccacauggaauagcagggaagaccacugucuucccuggaggugcugggagcuggg

SEQ ID NO: 4191805 - RNA, 63 nt, Human
cccagcucuuugucauuuuaggugucugacaucugucagggaugugacauuacagaagcaggg

SEQ ID NO: 4191806 - RNA, 86 nt, Human
cccagcugggaagugguaguuagaaugcacacacauggagucaugacugacucuggaauggguguuucuaacaccaccuggcuugg

SEQ ID NO: 4191807 - RNA, 67 nt, Human
cccagcugugcuuagccaucacauucaaccugacugguaguugaaucuucuagcagagcaugcuggg

SEQ ID NO: 4191808 - RNA, 80 nt, Human
cccagcuguggcagaggccgggcacucacagggccggugguguuugauucuggccucugagaagcuccuccgacaguggg

SEQ ID NO: 4191809 - RNA, 62 nt, Human
cccaggacuaaugagcucuacgcugagggcaucucugaaggaacuggaacucgauggcuggg

SEQ ID NO: 4191810 - RNA, 57 nt, Human
cccaggacucuucacugcagccucauuuuaccagccugaauguugaggggucuaggg

SEQ ID NO: 4191811 - RNA, 87 nt, Human
cccaggagcuggcugggcccaccuggcaucccugcccagccccuggccgggccucgggacaccggguacgcaccgccuacuccaggg

SEQ ID NO: 4191812 - RNA, 59 nt, Human
cccaggaggagggguuuacauuggaaccaguucagguucggugcaucuuuccucuucgg

SEQ ID NO: 4191813 - RNA, 56 nt, Human
cccaggaggcugagguugcagugagcugagaucgugccacuccccuccagccuggg

SEQ ID NO: 4191814 - RNA, 56 nt, Human
cccaggagguggagguugcggugagccgagaucacgcugcagcacuccugccuggg

SEQ ID NO: 4191815 - RNA, 69 nt, Human
cccaggcacugggcguguccugggugagggcugagugcugucuccccuagucuacgcucagcuccuggg

SEQ ID NO: 4191816 - RNA, 72 nt, Human
cccaggccagcaccauuuuccuggucagcucuggacaggcaggugcuggcacagguggaugcuggccauggg

SEQ ID NO: 4191817 - RNA, 72 nt, Human
cccaggcccaugggaucuguugccucagagacugacucgccuuuccugagcauuagacauccaucaccuggg

SEQ ID NO: 4191818 - RNA, 55 nt, Human
cccaggcucccaggugggacaacuuuguguugucguuugggcucaaagcuauggg

SEQ ID NO: 4191819 - RNA, 56 nt, Human
cccaggcuggagcgcaguggggcgaucuugguucacugcaaccuccgccucccggg

SEQ ID NO: 4191820 - RNA, 56 nt, Human
cccaggcuggagugcaguggcacgaucucggcucacugcaagcuccgccucccggg

SEQ ID NO: 4191821 - RNA, 56 nt, Human
cccaggcuggagugcaguggcgcgaucuccgcucacugcaagcucagccucccggg

SEQ ID NO: 4191822 - RNA, 55 nt, Human
cccaggcuggagugcaguggcgcgaucucggcucacugcaaccucccccucuggg

SEQ ID NO: 4191823 - RNA, 55 nt, Human
cccaggcuggagugcaguggcucgaucucagcucacugcuaccucugccucccgg

SEQ ID NO: 4191824 - RNA, 56 nt, Human
cccaggcuggagugcaguggugcgaucuccgcucacugcaagcucugccuuccggg

SEQ ID NO: 4191825 - RNA, 89 nt, Human
cccaggcugggcagaaggaagccagcacaguguggaaggaacagguuuuucaagguucaaggcuggcuucuuccaguuccagcccuggg

SEQ ID NO: 4191826 - RNA, 66 nt, Human
cccagggaaggcauguguccucagagagaaacacuaguuucuguuuucuggccacagccccuuggg

SEQ ID NO: 4191827 - RNA, 59 nt, Human
cccagggauguggcagauguuacagaauauuaguauaucauaaaugcacaguccuuggg

SEQ ID NO: 4191828 - RNA, 103 nt, Human
cccagggcccuggggcuggcccugcccaccugucucugcagggcccugccuugacaaaagccaggaccucagaugcagggccuggccucccagggucccaggg

SEQ ID NO: 4191829 - RNA, 55 nt, Human
cccagggcucaggcucccaguggggucugcuuccuacaacugcguggcccugugg

SEQ ID NO: 4191830 - RNA, 58 nt, Human
cccagggcugccugacuccagagcccaguguuucacccccaggccaggcagcccuggg

SEQ ID NO: 4191831 - RNA, 60 nt, Human
cccagggcuguagaauguccaaucucuguaguggguucuggaguuauggcaagcccuggg

SEQ ID NO: 4191832 - RNA, 81 nt, Human
cccaggggacucagagugugccccaggaguccugugggaauugccccacccuuccuggcacacuccugaauguucucgagg

SEQ ID NO: 4191833 - RNA, 56 nt, Human
cccaggguggaguacagugguacaguaauagcucacuguaaccucaaacuccuggg

SEQ ID NO: 4191834 - RNA, 122 nt, Human
cccaggguuacauggcuagcaaguggcauagcagggauugaauccggugccuccucacuccaagcaccaugcucuccucuaugcuauuccccuagcccuucacagcccagugugccccuggg

SEQ ID NO: 4191835 - RNA, 100 nt, Human
cccagguggaggggcgggacgcagagcagcggcuccaccucccgggcgggaagccccggcccucucggccugcuggcuccagcgcccgccccugaccggg

SEQ ID NO: 4191836 - RNA, 65 nt, Human
cccagguggucaggcaaggacacgcggucauucugccuccugcgucuuguccucgggcgccuggg

SEQ ID NO: 4191837 - RNA, 84 nt, Human
cccagguuggauuagggcacuuccucugggucccuggcaauuuccuccagguuagggaucccaaggggucucugccuuccuggg

SEQ ID NO: 4191838 - RNA, 93 nt, Human
cccagguuuccaugacuucaaguuuuguguucuuuuucugcuacuucaguaagaguauuuagagacacaagauggccaaucauagaaucuggg

SEQ ID NO: 4191839 - RNA, 59 nt, Human
cccaguagcagggcuuuggggaucugcugacaggaacccagagucaucuguagcugugg

SEQ ID NO: 4191840 - RNA, 59 nt, Human
cccaguccagaccaugaccucaggcccaggcuggggcuggggcuugggcuggggcuggg

SEQ ID NO: 4191841 - RNA, 76 nt, Human
cccagucuccagggagcagggaauuacagcgcaggaggaaccuguccaucuguccugccucacugcucccucuggg

SEQ ID NO: 4191842 - RNA, 63 nt, Human
cccagucugugguacuuuguagggucauuggggucacuuuugagucuacucaccacaacuggg

SEQ ID NO: 4191843 - RNA, 63 nt, Human
cccagucuuuuccuucauacaauucagugguuggacugagcugucaggaauggaaagccuggg

SEQ ID NO: 4191844 - RNA, 99 nt, Human
cccagugagugccggagcuggguggagggcccacggugaccucaggcguccagcuuuccaucugccugggccuuuucagggcccagaguggcaacuggg

SEQ ID NO: 4191845 - RNA, 60 nt, Human
cccagugccaggcacaggcagcccacuuccaccuagggcugcucuguuauuggcgguggg

SEQ ID NO: 4191846 - RNA, 61 nt, Human
cccagugggucacugcaucucacuaccaaccaucauagggagcgugcugcuucccacuggg

SEQ ID NO: 4191847 - RNA, 61 nt, Human
cccagugucucuugugccuuucucugagaauggacccggagugagguuguaagauacuggg

SEQ ID NO: 4191848 - RNA, 65 nt, Human
cccagugucugggccugcaggguggccucugaggcccagggcccuggaagagccugggcaugggg

SEQ ID NO: 4191849 - RNA, 74 nt, Human
cccaguguggccagucaagucccucugaccucugggcuccuuagaagucccuggugcuggcugcgcugcacggg

SEQ ID NO: 4191850 - RNA, 66 nt, Human
cccaguucaaaauuuugaagaaggcaguuaauuuucuuugugucuaucaccucauuuugaguuggg

SEQ ID NO: 4191851 - RNA, 56 nt, Human
cccaguucugagaugaauauccaggagugugcucuuguauccaugcagggucuggg

SEQ ID NO: 4191852 - RNA, 86 nt, Human
cccaguuucagagcagugcagaccuuccagaaagaacuuuggcaccagaaguucuucucccugggucucaagcuguguuuucuggg

SEQ ID NO: 4191853 - RNA, 63 nt, Human
cccaguuuccuuccacuggcucauuccugagauugcaguagagcugaguguagggagacuagg

SEQ ID NO: 4191854 - RNA, 65 nt, Human
cccaguuuuuccuacccuaggguggacuguauuuuuuacaauuaacucugugaagggugacuggg

SEQ ID NO: 4191855 - RNA, 61 nt, Human
cccauaacugagugagcagcgacuccuuuuauaggauacucuaagggagaugcucucaggg

SEQ ID NO: 4191856 - RNA, 80 nt, Human
cccauagcuguucucacaggaaccaucagagaaauguucauugauacuuagauaacaaaccugugguucaguuauauggg

SEQ ID NO: 4191857 - RNA, 73 nt, Human
cccauaucucauaaugugacuguauuugaagauaugaucuuuaaggagguaauuauaaugaguuacagugagg

SEQ ID NO: 4191858 - RNA, 95 nt, Human
cccaucauccaacccuguuuccaaaugauuuguucuuaguaugcauuguuuuucucaaaaacaauuuuauuuggagcagaaacagugauaauggg

SEQ ID NO: 4191859 - RNA, 105 nt, Human
cccaucccuagaagcccuugcuaacccagucuccucguguaaaccuuuccccagguuuacacuccaggcuggggugggcaaacaggggcucagcuauaggauggg

SEQ ID NO: 4191860 - RNA, 60 nt, Human
cccaucccugagucacaggagggcucugugucaguguccagcugugcuccaggagguggg

SEQ ID NO: 4191861 - RNA, 104 nt, Human
cgacugugccucuuuuggagggacuuagaaagaaggccagcuguuucaaagacucagcugccccucauuuucaccacacgagcccuccuaaacagagcacaucg

SEQ ID NO: 4191862 - RNA, 126 nt, Human
cgagagcugauuaggcaccgcggagcugcugagcugcggcaggcaccuggaacuuaaucagguccccaggggccggcgcaguuagggcagcuccacuuaggaauuggugcuaauuggcgccccuug

SEQ ID NO: 4191863 - RNA, 73 nt, Human
cgagaggcaaaaagacuacacgggaaagagcuggaacuccgguaguaccagcucuguggucauuuaccucccg

SEQ ID NO: 4191864 - RNA, 129 nt, Human
cgagcacagugaauuccaguacuuucggaggcugaggcgggugaucaccugaggucagguguucgagaucagccugaccaacauggugaaaccuugucucuacuaaaaauacaaaauucacaaggcaug

SEQ ID NO: 4191865 - RNA, 74 nt, Human
cgagcccaacgugcauuaggaccucuccagggaagugacagguccaccuggagggcucuuucaccugguacucg

SEQ ID NO: 4191866 - RNA, 94 nt, Human
cgaggcugcuggccagagacagucuacacaggcauugcagaaaaguagcucaauuuugcugccuaacagaacucuuuccagucaugcaguaacg

SEQ ID NO: 4191867 - RNA, 101 nt, Human
cgaucgcgcgaaggcguucgagaggggcggggccacagugaggcuaggccggaaggccuggccaggcucucacguggucugccucugcgccugcgcucucg

SEQ ID NO: 4191868 - RNA, 130 nt, Human
cgaucucuacucacuacaaccuccaccucccagguucaagcaauucuccugccucagccucccgaguagcugggacugcaggcacacgcugccaugccuggcuaauuuuuuguauuuuaguagagaugcg

SEQ ID NO: 4191869 - RNA, 64 nt, Human
cgaugaggcagcuggcuuucucccuggcaccagccccaagggagccagccuuugccuauaauug

SEQ ID NO: 4191870 - RNA, 107 nt, Human
cgaugaugauuuaugcaaaacccggucagcuccacagcuccaucaguuucaauuaaaacaagccgcagaggaggugugcugcggcccggugccugugaucaccauug

SEQ ID NO: 4191871 - RNA, 73 nt, Human
cgaugcugauuuuacuguuuucuccuuuagaccacaucagucucauuuaagaauacguuaaaagcagacguug

SEQ ID NO: 4191872 - RNA, 75 nt, Human
cgauggcaccuuuuuagguagugaguacuugaaucaaugugaucaaaugcuucuacuccuaagaagugacaauug

SEQ ID NO: 4191873 - RNA, 62 nt, Human
cgauggccuuuccuuggcacaggguccacugcagcaugccaaacgaggaggcaggggcgucg

SEQ ID NO: 4191874 - RNA, 57 nt, Human
ccucccuucccggcauggcucucuggacccaggcaggaagcugcugauugguggagg

SEQ ID NO: 4191875 - RNA, 72 nt, Human
ccuccuaacaugcagagauuggcuuuauagaugcacaugguuucaaauggccaauuuuugacugucaguagg

SEQ ID NO: 4191876 - RNA, 122 nt, Human
ccuccuacaguucagcuuuccacguuccaggaggaaaugugacccugcuguuucgggaaccccaccucauguagucuuaauuucucuccgaauguguuugaagucuugccagcguagagagg

SEQ ID NO: 4191877 - RNA, 127 nt, Human
ccuccucagaauucaggaccaacaaaauccucuuuagcaaggagaaauaauccugcugauccacgaaaugccacaauuagcaauuuauccuuuugcuaaagcacuugcgaguccccauaggaggagg

SEQ ID NO: 4191878 - RNA, 66 nt, Human
ccuccuccaacaucuugauucacuaccauucuuaccuucuuuuaggugacaaagaguaagaggagg

SEQ ID NO: 4191879 - RNA, 80 nt, Human
ccuccuccugcaggguagaugcaggcugugggaucacuuccuuuuccuuucagccccagucuggccucuguggggggagg

SEQ ID NO: 4191880 - RNA, 69 nt, Human
ccuccucuauaaagugcaugcggggccagaugcaguggcucacaucugaccucccaacacuuugggagg

SEQ ID NO: 4191881 - RNA, 115 nt, Human
ccuccucuugaagucuggagagucauaggcguccuccucgucugaggcggcguacugccccgcgcugcuucucucuaggaagacgcuccuuuucucuaacuuggaaagaaaaagg

SEQ ID NO: 4191882 - RNA, 55 nt, Human
ccuccugcggcguccgcgcucugucucucucuggcucguggagcuggcaggcagg

SEQ ID NO: 4191883 - RNA, 67 nt, Human
ccuccuggugggcgcuucuggccuucccucccuccccaaaggcaagaggcccccuuaccaccugagg

SEQ ID NO: 4191884 - RNA, 71 nt, Human
ccuccuguagagccccagcccugcuucuauagaggauucuuggaaaggcugcauuggggcggugugggagg

SEQ ID NO: 4191885 - RNA, 129 nt, Human
ccuccuugccccugucugucugacaccucugccuccagcuucucgccugacagcuccuuuccgccucaguggcugaagagcuauguccagggagcagggguugcagaggagauggaagggccagugggg

SEQ ID NO: 4191886 - RNA, 83 nt, Human
ccucgcuuccagaccucuggguggucucacugagugcccuugucuuagugaucaggaucccuauaucaggucuuugagccagg

SEQ ID NO: 4191887 - RNA, 129 nt, Human
ccucggauuuuccauauccccccucgccccgccccgcuuccagugguuugaaaggggugugguuuugcugggaaaauggccgaccgcuggggcugcgggagggagugagggccgggggcggggacgggg

SEQ ID NO: 4191888 - RNA, 93 nt, Human
ccucggcucaucuuacaucauauauuuacucuccuguugcagguuugaggcugcaaacaggagaguaaguauaugguguaagaugagcugagg

SEQ ID NO: 4191889 - RNA, 75 nt, Human
ccucggcucuugccugaguuucagagucccgccggaguuagagcuggcagaguccaauugcucagagcgccgagg

SEQ ID NO: 4191890 - RNA, 88 nt, Human
ccucuacugcuuuagaguuuacagugugcaaucccagaauauuauagcagauauucuuugaaagucuacuaugucuaaggcagugagg

SEQ ID NO: 4191891 - RNA, 82 nt, Human
ccucuagacaguggcauuaguuuuuagaaacaucagaaguuccaagggcacugacucugagaauagugccacuguggagugg

SEQ ID NO: 4191892 - RNA, 93 nt, Human
ccucuagaccaugcagccugcucaugggucccuggcagagaaugcccacuccccagcagacucagggcagguccccaacugcaggcuuccagg

SEQ ID NO: 4191893 - RNA, 71 nt, Human
ccucuauggccucccauuuucucaaauguaaaauacaucuggacuagagcagaaugggagguacaggaugg

SEQ ID NO: 4191894 - RNA, 100 nt, Human
ccucuauuguugggccucugagaccuggggacugcuguuucuguuuucucugacucauacagucugucccccaggugcuacagcugaacauaaaaccagg

SEQ ID NO: 4191895 - RNA, 55 nt, Human
ccucucagcgauuccucuuggagggcuuacaucuccaggcuucgccagugagagg

SEQ ID NO: 4191896 - RNA, 55 nt, Human
ccucucaugcuggcuggggagccaucauauugccaucacagcuggcuaugacagg

SEQ ID NO: 4191897 - RNA, 75 nt, Human
ccucucauggucagaaagaaaucaaaugaggauucaaguaggugccugauacuuuucuuuuagacuaaccagagg

SEQ ID NO: 4191898 - RNA, 77 nt, Human
ccucuccacaucacaguggcuguuuauuuaauaauucaucauucuuucaguuaacacagcaccugugaugugccagg

SEQ ID NO: 4191899 - RNA, 103 nt, Human
ccucucccacucugccccgaauuccaauccauagguuuuuccaagagcugcacagcucuggaauugaccugggagggggcacauuugggccgggagggguagg

SEQ ID NO: 4191900 - RNA, 76 nt, Human
ccucuccuuuuucauuggcuuuaggacagaggccauuguaagaugagcaacugagucuggguggaaauaggauagg

SEQ ID NO: 4191901 - RNA, 86 nt, Human
ccucucgcagccugagccaggccucagggcuguccguaggagaagagcuugaggacagugcuuggggccccucagcauguuggagg

SEQ ID NO: 4191902 - RNA, 82 nt, Human
ccucucguuuauuucaacguaugaaaagcuguuucuagcagggcgcagugguucaacguuguaaucucagcacuuugggagg

SEQ ID NO: 4191903 - RNA, 73 nt, Human
ccucucucaggcaccugagguggccagccuggcgccaggcacaggacuggagggucagcugcuugagacaagg

SEQ ID NO: 4191904 - RNA, 76 nt, Human
ccucucucccuucuuuucugucuugaccuccuugacaaaaucugucuggcagagugauaggauaaguauguggagg

SEQ ID NO: 4191905 - RNA, 122 nt, Human
ccucucucgaagccaucugugugugugguuuugugaagcaauuaagcuccaggugugcaauagaaaugaaguagccgcuuaauuauuuggugaaacagcaggcauuugggauucaagauugg

SEQ ID NO: 4191906 - RNA, 55 nt, Human
ccucucugagaggucacagcugugcccuuuuguacugagaccugcauuagagagg

SEQ ID NO: 4191907 - RNA, 83 nt, Human
ccucucugucccuuucuggcagugaagucaugagguacaauaagcaaaagcugccaucgugcacauuaccugccauagagagg

SEQ ID NO: 4191908 - RNA, 55 nt, Human
ccucucuuucucucuugucuuucucagaguuggaaaugucagagggaugagcagg

SEQ ID NO: 4191909 - RNA, 75 nt, Human
ccucugaaccaaucucuaugcaccagacuaguucugcaccuugcugaugcugaauugaugcgagggaggcugagg

SEQ ID NO: 4191910 - RNA, 66 nt, Human
ccucugaccggugguggcucaagucuccacuccaagucccuuggggacaggccgccucgguggggg

SEQ ID NO: 4191911 - RNA, 62 nt, Human
ccucugagccuuccuuguuauguuucauguggguggaauauaugaccaggaaguucugcagg

SEQ ID NO: 4191912 - RNA, 72 nt, Human
ccucugagguccuucccagcucugacaaucccugaguagucugugcaguggcuugggcuggggcccuagggg

SEQ ID NO: 4191913 - RNA, 58 nt, Human
ccucugcaccauagccuucagcaaaugcugcuggaggaggcuggaauggauguaaagg

SEQ ID NO: 4191914 - RNA, 62 nt, Human
ccucugcauaauggaugauuucacaagcggugugcuugagaucagcaucuguugucaccagg

SEQ ID NO: 4191915 - RNA, 81 nt, Human
ccucugcaugcauuagauuaaaagcggguuugaucaaauaauucccagguccugccuguuuaaguauucugacaucagagg

SEQ ID NO: 4191916 - RNA, 76 nt, Human
ccucugccauuucuugcagucaaguguuaagguggagaacuuucaacaucaagaaugcauggaauuagggaagggg

SEQ ID NO: 4191917 - RNA, 86 nt, Human
ccucugcuccauggcucucuccuuacugcugccaauucccacccauccaugggucaugcauaggcugagggagagcuaucaggagg
